United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 15

SEQ ID NO: 630775 - RNA, 20 nt, Human
ucucugagcuucucuugggg

SEQ ID NO: 630776 - RNA, 22 nt, Human
uagcaaagaaccugauacccca

SEQ ID NO: 630777 - RNA, 22 nt, Human
acugaaggguaaugugggagcc

SEQ ID NO: 630778 - RNA, 22 nt, Human
cagggagucaacaaacagauca

SEQ ID NO: 630779 - RNA, 22 nt, Human
ucagcaggcccauccuccaggc

SEQ ID NO: 630780 - RNA, 22 nt, Human
accuguguuuucccucaguuuc

SEQ ID NO: 630781 - RNA, 22 nt, Human
gggcacugaacacccucuucgc

SEQ ID NO: 630782 - RNA, 22 nt, Human
ggugaggcguccccaccauggg

SEQ ID NO: 630783 - RNA, 22 nt, Human
cagcuguucagcaacucgcaga

SEQ ID NO: 630784 - RNA, 22 nt, Human
aaguuuaacuugaauucuuucu

SEQ ID NO: 630785 - RNA, 22 nt, Human
agaaagugaccuugaaaacugg

SEQ ID NO: 630786 - RNA, 22 nt, Human
ugggugagcggcugcacacccg

SEQ ID NO: 630787 - RNA, 22 nt, Human
uguuaaacuguauugcauaagg

SEQ ID NO: 630788 - RNA, 22 nt, Human
uucaggagcuggcugcgaagga

SEQ ID NO: 630789 - RNA, 22 nt, Human
gguggggcugcaagcaguucgg

SEQ ID NO: 630790 - RNA, 17 nt, Human
ugggugguagggagagg

SEQ ID NO: 630791 - RNA, 22 nt, Human
acagaauagguacagucaguca

SEQ ID NO: 630792 - RNA, 21 nt, Human
uguauacacacauauauguac

SEQ ID NO: 630793 - RNA, 22 nt, Human
acaguagacccuggauaaacau

SEQ ID NO: 630794 - RNA, 19 nt, Human
ucuuggcuuugucuacugu

SEQ ID NO: 630795 - RNA, 22 nt, Human
aauuucagcuuaaguuguuugg

SEQ ID NO: 630796 - RNA, 22 nt, Human
gcagaugggagccccaggggag

SEQ ID NO: 630797 - RNA, 22 nt, Human
auacaauuauucugcagauauu

SEQ ID NO: 630798 - RNA, 22 nt, Human
aauguacaaaagucagccaacu

SEQ ID NO: 630799 - RNA, 22 nt, Human
cuuuuuaucucuuaaugauguu

SEQ ID NO: 630800 - RNA, 19 nt, Human
uccagcugguaugcccaga

SEQ ID NO: 630801 - RNA, 21 nt, Human
gcugccaggauuuugcaggaa

SEQ ID NO: 630802 - RNA, 22 nt, Human
aaugcuuauaccuaaugaucuu

SEQ ID NO: 630803 - RNA, 22 nt, Human
ugaacauuccugaaugaagcau

SEQ ID NO: 630804 - RNA, 20 nt, Human
acugggagcuaacggagauu

SEQ ID NO: 630805 - RNA, 19 nt, Human
aggcucugagcuccuggag

SEQ ID NO: 630806 - RNA, 22 nt, Human
uucuuggagauaaauucuuaca

SEQ ID NO: 630807 - RNA, 22 nt, Human
ggagaugguggaagcuggugca

SEQ ID NO: 630808 - RNA, 22 nt, Human
cuggccuguccugacccagccu

SEQ ID NO: 630809 - RNA, 22 nt, Human
uuagugcuucuguccaaauaua

SEQ ID NO: 630810 - RNA, 22 nt, Human
gcccuuggaagcggcagguagc

SEQ ID NO: 630811 - RNA, 22 nt, Human
cucuuaaauaacaucauugcuu

SEQ ID NO: 630812 - RNA, 22 nt, Human
gccccagaaaguucaaggcaca

SEQ ID NO: 630813 - RNA, 21 nt, Human
ucugucucuccacugcccugc

SEQ ID NO: 630814 - RNA, 22 nt, Human
agcuguuccaggccucauugcu

SEQ ID NO: 630815 - RNA, 22 nt, Human
guggagaggaacccagcucugu

SEQ ID NO: 630816 - RNA, 22 nt, Human
uuuguagauagaaaaaugauua

SEQ ID NO: 630817 - RNA, 22 nt, Human
gcagggcucaacaggacacccc

SEQ ID NO: 630818 - RNA, 23 nt, Human
uucaaagaucuucugaaaucugu

SEQ ID NO: 630819 - RNA, 22 nt, Human
cagaagagaugaaauaguauua

SEQ ID NO: 630820 - RNA, 22 nt, Human
cugcuucauauuucauagugau

SEQ ID NO: 630821 - RNA, 22 nt, Human
gcucagaguggccuggcuaggg

SEQ ID NO: 630822 - RNA, 22 nt, Human
auuuuaauaagauccauuuggu

SEQ ID NO: 630823 - RNA, 22 nt, Human
aaggacugucuaaggccuccaa

SEQ ID NO: 630824 - RNA, 20 nt, Human
ccugaggguuuguguucuuu

SEQ ID NO: 630825 - RNA, 21 nt, Human
ggaagcaguggcggcaacucc

SEQ ID NO: 630826 - RNA, 22 nt, Human
gaaagguuguaacaagacucuu

SEQ ID NO: 630827 - RNA, 22 nt, Human
uuuuagacuccaucugauucag

SEQ ID NO: 630828 - RNA, 22 nt, Human
cacugcugauuucauaggcagg

SEQ ID NO: 630829 - RNA, 22 nt, Human
ugaggcaggacugagcgggaug

SEQ ID NO: 630830 - RNA, 22 nt, Human
gcagaaagcuccuugcgaucug

SEQ ID NO: 630831 - RNA, 22 nt, Human
aacaguaaugugguguuggguu

SEQ ID NO: 630832 - RNA, 22 nt, Human
uaacagaaaggcucaggugcuc

SEQ ID NO: 630833 - RNA, 22 nt, Human
cugggcagaguccggaagaugg

SEQ ID NO: 630834 - RNA, 22 nt, Human
acugggccugauugggucggag

SEQ ID NO: 630835 - RNA, 22 nt, Human
ucaaaauuagugaccaaaggca

SEQ ID NO: 630836 - RNA, 22 nt, Human
gccuggcuaagcagaaggaccc

SEQ ID NO: 630837 - RNA, 21 nt, Human
uucuccuccaaguugcuccug

SEQ ID NO: 630838 - RNA, 22 nt, Human
gcacaguguaccacagucccua

SEQ ID NO: 630839 - RNA, 22 nt, Human
ucacuuuacagcuaagguuguu

SEQ ID NO: 630840 - RNA, 22 nt, Human
auacaaugaaguauagaugaaa

SEQ ID NO: 630841 - RNA, 22 nt, Human
acaauguaguugucaugagaca

SEQ ID NO: 630842 - RNA, 22 nt, Human
gcugugagcugccugugucaca

SEQ ID NO: 630843 - RNA, 22 nt, Human
uaaaguguuguacaaauguaug

SEQ ID NO: 630844 - RNA, 22 nt, Human
uaaaugaagcucaugggccaca

SEQ ID NO: 630845 - RNA, 22 nt, Human
gcugagggccgcauagggucau

SEQ ID NO: 630846 - RNA, 20 nt, Human
ugagaagcuccugucuccuc

SEQ ID NO: 630847 - RNA, 22 nt, Human
aaggcaguuugggccaccaucu

SEQ ID NO: 630848 - RNA, 22 nt, Human
uccguucucuaggagaaacuuc

SEQ ID NO: 630849 - RNA, 22 nt, Human
ggcaaagcggcccuguggccag

SEQ ID NO: 630850 - RNA, 22 nt, Human
aaagaaaccuaucagccacaug

SEQ ID NO: 630851 - RNA, 22 nt, Human
guagucugaacaguaauuuugu

SEQ ID NO: 630852 - RNA, 22 nt, Human
ggcccagccuggcaacaaugac

SEQ ID NO: 630853 - RNA, 22 nt, Human
uggguagagugcugacaaugcc

SEQ ID NO: 630854 - RNA, 22 nt, Human
ggcaccagccaccuauuucuag

SEQ ID NO: 630855 - RNA, 22 nt, Human
cagggaagagccgaugcugcag

SEQ ID NO: 630856 - RNA, 22 nt, Human
guauuucugguuaaaugugcua

SEQ ID NO: 630857 - RNA, 22 nt, Human
ggcagggcaggaaagucaggaa

SEQ ID NO: 630858 - RNA, 22 nt, Human
guauuuguaguagcauagaauu

SEQ ID NO: 630859 - RNA, 22 nt, Human
ggucuggaugcugagguuccca

SEQ ID NO: 630860 - RNA, 22 nt, Human
cauucauuagaauagauaugua

SEQ ID NO: 630861 - RNA, 22 nt, Human
augucacugugaggcagcuguc

SEQ ID NO: 630862 - RNA, 21 nt, Human
ccaggaaggacugagcucccu

SEQ ID NO: 630863 - RNA, 19 nt, Human
ucagggggcugauaggagg

SEQ ID NO: 630864 - RNA, 22 nt, Human
caagugucuucaaaggcuaaaa

SEQ ID NO: 630865 - RNA, 22 nt, Human
agcaugcuuggcauuugucaga

SEQ ID NO: 630866 - RNA, 20 nt, Human
guggccucucacauucugag

SEQ ID NO: 630867 - RNA, 22 nt, Human
guuuagauuucaugaagacacu

SEQ ID NO: 630868 - RNA, 22 nt, Human
cuacagaaaccuuuuucauaca

SEQ ID NO: 630869 - RNA, 20 nt, Human
auauagagucaaaauggcuu

SEQ ID NO: 630870 - RNA, 22 nt, Human
ucauugcagacuaacaaucuca

SEQ ID NO: 630871 - RNA, 21 nt, Human
accugugaauagccacugcac

SEQ ID NO: 630872 - RNA, 22 nt, Human
acauuuacagugcuagacaauc

SEQ ID NO: 630873 - RNA, 22 nt, Human
cuggcagucugguggaaggccu

SEQ ID NO: 630874 - RNA, 22 nt, Human
uuugggaagugggagcaaggug

SEQ ID NO: 630875 - RNA, 22 nt, Human
aguguuggaccgagguggagcc

SEQ ID NO: 630876 - RNA, 22 nt, Human
aggcccaguccucugccgucug

SEQ ID NO: 630877 - RNA, 22 nt, Human
caggagccagcugucccaacca

SEQ ID NO: 630878 - RNA, 22 nt, Human
gccagcagccacagaagucacu

SEQ ID NO: 630879 - RNA, 22 nt, Human
caggaguggugugagggacucc

SEQ ID NO: 630880 - RNA, 21 nt, Human
auuggcacaccuuuuauugga

SEQ ID NO: 630881 - RNA, 22 nt, Human
ugcaggagauaauggugcuuag

SEQ ID NO: 630882 - RNA, 22 nt, Human
agggaguuagaaauccaggaua

SEQ ID NO: 630883 - RNA, 22 nt, Human
uagacuuuacuaaggcucauuu

SEQ ID NO: 630884 - RNA, 22 nt, Human
augacuuuuaaaagcugguacu

SEQ ID NO: 630885 - RNA, 22 nt, Human
aaacagcugucauuguuuuaaa

SEQ ID NO: 630886 - RNA, 22 nt, Human
guagcuuccagaaagugucuuu

SEQ ID NO: 630887 - RNA, 22 nt, Human
ugacaaagaccuucaacaagau

SEQ ID NO: 630888 - RNA, 20 nt, Human
cccagagccauagccagaca

SEQ ID NO: 630889 - RNA, 22 nt, Human
aaauauguuuuccaguugucau

SEQ ID NO: 630890 - RNA, 22 nt, Human
aaagcaauuacaaaagggauaa

SEQ ID NO: 630891 - RNA, 22 nt, Human
aaaugcuguagaucagugaguu

SEQ ID NO: 630892 - RNA, 22 nt, Human
gagugcaguuggggugagggga

SEQ ID NO: 630893 - RNA, 23 nt, Human
ugugcgugaugcuuuguugaagg

SEQ ID NO: 630894 - RNA, 21 nt, Human
ugcauauauaagugcauacac

SEQ ID NO: 630895 - RNA, 22 nt, Human
ucacugaaaaccauacuucuuu

SEQ ID NO: 630896 - RNA, 22 nt, Human
uaaacauguugacaucuuaccu

SEQ ID NO: 630897 - RNA, 22 nt, Human
ggccaggcugcccugggagcag

SEQ ID NO: 630898 - RNA, 17 nt, Human
ucucaggcacguguggc

SEQ ID NO: 630899 - RNA, 19 nt, Human
uuucuaauguguuuuucuu

SEQ ID NO: 630900 - RNA, 22 nt, Human
ucuguacaguaccagauaguaa

SEQ ID NO: 630901 - RNA, 22 nt, Human
uucaguguuaaauucaaagagu

SEQ ID NO: 630902 - RNA, 18 nt, Human
ggcaugugagugcugagg

SEQ ID NO: 630903 - RNA, 22 nt, Human
gaacacauuucucugacuguag

SEQ ID NO: 630904 - RNA, 22 nt, Human
caggucuggcaucagcugugug

SEQ ID NO: 630905 - RNA, 21 nt, Human
ucuucccucaggauguccugc

SEQ ID NO: 630906 - RNA, 22 nt, Human
agcacugugagcaccagcacgc

SEQ ID NO: 630907 - RNA, 22 nt, Human
aggcuccaggcccuucaccagc

SEQ ID NO: 630908 - RNA, 22 nt, Human
guagcagagggcccagguaacu

SEQ ID NO: 630909 - RNA, 22 nt, Human
gccgaagcugccgucugguccu

SEQ ID NO: 630910 - RNA, 22 nt, Human
agucagagcuauguuguuauau

SEQ ID NO: 630911 - RNA, 22 nt, Human
gccgaacuugagggccaggcgg

SEQ ID NO: 630912 - RNA, 22 nt, Human
ccagagcccgggaccuggacuu

SEQ ID NO: 630913 - RNA, 22 nt, Human
uagcuggcuuauauaaaagggc

SEQ ID NO: 630914 - RNA, 22 nt, Human
uccaggagacacccuugugugu

SEQ ID NO: 630915 - RNA, 18 nt, Human
uaggcugggggcuguagu

SEQ ID NO: 630916 - RNA, 22 nt, Human
gccuggcaggggccugggagug

SEQ ID NO: 630917 - RNA, 22 nt, Human
gaaggaggucugauacaauaug

SEQ ID NO: 630918 - RNA, 22 nt, Human
cugaggugagcuucccugggcu

SEQ ID NO: 630919 - RNA, 23 nt, Human
ucguugaauagcaauagcacaac

SEQ ID NO: 630920 - RNA, 22 nt, Human
caaaccuguccuuuugucuccu

SEQ ID NO: 630921 - RNA, 22 nt, Human
cagaugaaguuugccuagagcu

SEQ ID NO: 630922 - RNA, 22 nt, Human
uccaggagguugagacugcagu

SEQ ID NO: 630923 - RNA, 22 nt, Human
uguuagcaaggauaauuaugau

SEQ ID NO: 630924 - RNA, 22 nt, Human
ccuuuugaagguguuguuaagu

SEQ ID NO: 630925 - RNA, 22 nt, Human
aagucagugaaaaggcaucauc

SEQ ID NO: 630926 - RNA, 22 nt, Human
acagccaguccucccacagggu

SEQ ID NO: 630927 - RNA, 22 nt, Human
accauugauauaacucagucuc

SEQ ID NO: 630928 - RNA, 22 nt, Human
uaccucaaguuccaggaaagcg

SEQ ID NO: 630929 - RNA, 23 nt, Human
agucagagcagaagggcugcuug

SEQ ID NO: 630930 - RNA, 22 nt, Human
gagagcagacucucaaagcugg

SEQ ID NO: 630931 - RNA, 22 nt, Human
gagcugaguaucccacugaagu

SEQ ID NO: 630932 - RNA, 22 nt, Human
uuacagguggagaaguaaggcu

SEQ ID NO: 630933 - RNA, 22 nt, Human
ugggggagccuucacaguagcu

SEQ ID NO: 630934 - RNA, 22 nt, Human
acauauaugugcacaugugcag

SEQ ID NO: 630935 - RNA, 22 nt, Human
gggcuguguaucaguuaucuau

SEQ ID NO: 630936 - RNA, 22 nt, Human
cuuggcucuguguugaugggac

SEQ ID NO: 630937 - RNA, 22 nt, Human
gccagcuccgcaggauggcgcg

SEQ ID NO: 630938 - RNA, 22 nt, Human
aguacuucagaggcugcccagg

SEQ ID NO: 630939 - RNA, 22 nt, Human
accaugucauuuauuggccaaa

SEQ ID NO: 630940 - RNA, 22 nt, Human
gguggguggaaacagcauguac

SEQ ID NO: 630941 - RNA, 22 nt, Human
uagaaaagccccagcuggaggg

SEQ ID NO: 630942 - RNA, 22 nt, Human
aguucuggcggcugucggcacu

SEQ ID NO: 630943 - RNA, 22 nt, Human
uguuuacauaguagcugcccug

SEQ ID NO: 630944 - RNA, 22 nt, Human
ugagcuguauauuguuuuaaua

SEQ ID NO: 630945 - RNA, 22 nt, Human
acauagcaagugcucaauaaau

SEQ ID NO: 630946 - RNA, 22 nt, Human
ccagaacagaccugccugaccu

SEQ ID NO: 630947 - RNA, 22 nt, Human
cuucuucaagagaaugggagac

SEQ ID NO: 630948 - RNA, 22 nt, Human
cacaggaacaaagaagacaauu

SEQ ID NO: 630949 - RNA, 22 nt, Human
cuggaauugcauaauauguccu

SEQ ID NO: 630950 - RNA, 22 nt, Human
cacagagcuggaaaggcugggc

SEQ ID NO: 630951 - RNA, 22 nt, Human
cagagcugugauaaauagauau

SEQ ID NO: 630952 - RNA, 22 nt, Human
gccaggccugcaagugcuggug

SEQ ID NO: 630953 - RNA, 22 nt, Human
agguuaaaaaggauucaguuaa

SEQ ID NO: 630954 - RNA, 22 nt, Human
caguuuuagggcaaugugaaga

SEQ ID NO: 630955 - RNA, 22 nt, Human
gcaacacagaucuucuuuguug

SEQ ID NO: 630956 - RNA, 22 nt, Human
guugaaaguagaugcuauuugg

SEQ ID NO: 630957 - RNA, 22 nt, Human
ugccugggagugaccaagacuc

SEQ ID NO: 630958 - RNA, 22 nt, Human
ugcuugugagaguuuuuucaga

SEQ ID NO: 630959 - RNA, 22 nt, Human
agaccugcagggccaggccugc

SEQ ID NO: 630960 - RNA, 22 nt, Human
gugggcaggguugcuuucuccg

SEQ ID NO: 630961 - RNA, 20 nt, Human
gcucugucuggccuacuuuu

SEQ ID NO: 630962 - RNA, 22 nt, Human
uagcaguacugggcauguguuu

SEQ ID NO: 630963 - RNA, 22 nt, Human
aagagagaacucccuucgccag

SEQ ID NO: 630964 - RNA, 22 nt, Human
cccaggaggugugcccaacucg

SEQ ID NO: 630965 - RNA, 22 nt, Human
ccagagacgucggucagggcgc

SEQ ID NO: 630966 - RNA, 20 nt, Human
ucagaugggagugagccauc

SEQ ID NO: 630967 - RNA, 22 nt, Human
guguuuccaguucagaaagcaa

SEQ ID NO: 630968 - RNA, 22 nt, Human
uauaaccuggauucuggcacua

SEQ ID NO: 630969 - RNA, 22 nt, Human
uucuuucugggaagaguucaga

SEQ ID NO: 630970 - RNA, 23 nt, Human
cuucagugugggacugcagcgug

SEQ ID NO: 630971 - RNA, 22 nt, Human
acagaaagauaggcacaagguc

SEQ ID NO: 630972 - RNA, 22 nt, Human
uucaugaaauucucguguaccu

SEQ ID NO: 630973 - RNA, 22 nt, Human
aaaguuuggauuagcaguuaga

SEQ ID NO: 630974 - RNA, 22 nt, Human
gccuugcuaauuucuccucaac

SEQ ID NO: 630975 - RNA, 22 nt, Human
ggccagagggagggcacaaauc

SEQ ID NO: 630976 - RNA, 22 nt, Human
acuugaaaagcucagcaguagu

SEQ ID NO: 630977 - RNA, 22 nt, Human
cagcugcugcccuuggcugcag

SEQ ID NO: 630978 - RNA, 22 nt, Human
uuuccucacuucaugagaguuu

SEQ ID NO: 630979 - RNA, 22 nt, Human
uccuguuuuuguaaucgacucu

SEQ ID NO: 630980 - RNA, 22 nt, Human
agucaaauaucuuaaaaggcua

SEQ ID NO: 630981 - RNA, 22 nt, Human
auacaguaauugcccugcaaug

SEQ ID NO: 630982 - RNA, 22 nt, Human
ugcaugaugacuaaggugguga

SEQ ID NO: 630983 - RNA, 22 nt, Human
cauaagaaauuuaacagaacuu

SEQ ID NO: 630984 - RNA, 22 nt, Human
aggcuguggugaugauuggguc

SEQ ID NO: 630985 - RNA, 22 nt, Human
uuagggaaguguuauucucagg

SEQ ID NO: 630986 - RNA, 22 nt, Human
gcuccaggccacggcuucuugg

SEQ ID NO: 630987 - RNA, 22 nt, Human
acuuucuucuuaugcauuaagg

SEQ ID NO: 630988 - RNA, 22 nt, Human
gaaaucauuagcaaagauaugu

SEQ ID NO: 630989 - RNA, 22 nt, Human
aguccuggcucuacgggcuuca

SEQ ID NO: 630990 - RNA, 22 nt, Human
ccugggcauucuuugaguucuc

SEQ ID NO: 630991 - RNA, 22 nt, Human
uguaugaauauguauuuucaua

SEQ ID NO: 630992 - RNA, 22 nt, Human
cugggcuuugaagccaggcugc

SEQ ID NO: 630993 - RNA, 22 nt, Human
cuuucucaguguuaauuacuuu

SEQ ID NO: 630994 - RNA, 22 nt, Human
gaguuauuaauggcugaguuug

SEQ ID NO: 630995 - RNA, 22 nt, Human
acagaaguuggaauuagauacu

SEQ ID NO: 630996 - RNA, 22 nt, Human
uguguaaauggcaucucucagc

SEQ ID NO: 630997 - RNA, 19 nt, Human
gagacauguagauagaaga

SEQ ID NO: 630998 - RNA, 22 nt, Human
cacugaacaacaaauagugaau

SEQ ID NO: 630999 - RNA, 22 nt, Human
cuuuaucagaaaacacauuagg

SEQ ID NO: 631000 - RNA, 22 nt, Human
ucuggcuccacaccucacugca

SEQ ID NO: 631001 - RNA, 22 nt, Human
gaaguuuauuucaaucuauuca

SEQ ID NO: 631002 - RNA, 22 nt, Human
ugucuacugcugacacuaacag

SEQ ID NO: 631003 - RNA, 23 nt, Human
aaggguccauagcuaucauuaca

SEQ ID NO: 631004 - RNA, 22 nt, Human
ugggccuccgcauggcccagcg

SEQ ID NO: 631005 - RNA, 22 nt, Human
agaggaggauuuguaaaggucu

SEQ ID NO: 631006 - RNA, 22 nt, Human
aucugcuuguugcaugucuguu

SEQ ID NO: 631007 - RNA, 22 nt, Human
caucacccggaacugugucugc

SEQ ID NO: 631008 - RNA, 22 nt, Human
gcaggagaaaugaagauugggu

SEQ ID NO: 631009 - RNA, 22 nt, Human
uuuaggcagcagugaggaugaa

SEQ ID NO: 631010 - RNA, 22 nt, Human
acauguguaaaaguggauaaaa

SEQ ID NO: 631011 - RNA, 20 nt, Human
ccugaagaguuucucuuucu

SEQ ID NO: 631012 - RNA, 22 nt, Human
uaccagccuuuuaacaugggcc

SEQ ID NO: 631013 - RNA, 22 nt, Human
ccauuuaacacagaguuuucca

SEQ ID NO: 631014 - RNA, 22 nt, Human
accaggaaauuuggcaacaaag

SEQ ID NO: 631015 - RNA, 22 nt, Human
ucagucaacauaaauccaaggu

SEQ ID NO: 631016 - RNA, 22 nt, Human
agcuuuauuugucauucacggc

SEQ ID NO: 631017 - RNA, 23 nt, Human
ucuuccugaacuaucaggcacau

SEQ ID NO: 631018 - RNA, 22 nt, Human
gucccagaggacagggucacau

SEQ ID NO: 631019 - RNA, 22 nt, Human
agccagcacggauuucccagga

SEQ ID NO: 631020 - RNA, 22 nt, Human
uaacaucaaacugcauuuucua

SEQ ID NO: 631021 - RNA, 22 nt, Human
uuauuuccaaacuggauauacc

SEQ ID NO: 631022 - RNA, 22 nt, Human
ggcagaagacaggcaaaucaug

SEQ ID NO: 631023 - RNA, 22 nt, Human
acaaagauguuuaaagcauuua

SEQ ID NO: 631024 - RNA, 22 nt, Human
guguccugcaggccaggaaugg

SEQ ID NO: 631025 - RNA, 19 nt, Human
agcuccugggcucugggcc

SEQ ID NO: 631026 - RNA, 22 nt, Human
caaaguccauaguuuacaauag

SEQ ID NO: 631027 - RNA, 22 nt, Human
ccugagagugguguacaggaga

SEQ ID NO: 631028 - RNA, 19 nt, Human
auuuuucuuccucugugca

SEQ ID NO: 631029 - RNA, 22 nt, Human
cucugaaaguuagagaaaauag

SEQ ID NO: 631030 - RNA, 22 nt, Human
aaucauucucaugccaguuucc

SEQ ID NO: 631031 - RNA, 17 nt, Human
ggcuggagcagcucccc

SEQ ID NO: 631032 - RNA, 22 nt, Human
ugggcagagaucuggaucaaac

SEQ ID NO: 631033 - RNA, 22 nt, Human
ucacaugaguauuauuuuccaa

SEQ ID NO: 631034 - RNA, 22 nt, Human
ccugugccugccugugaguucu

SEQ ID NO: 631035 - RNA, 22 nt, Human
ccucugugccucaguuucaugu

SEQ ID NO: 631036 - RNA, 22 nt, Human
aggaccuguaccucagcaucua

SEQ ID NO: 631037 - RNA, 22 nt, Human
ccaaaauaacagcccaauucac

SEQ ID NO: 631038 - RNA, 22 nt, Human
aaagugcaucaaaugacuuccc

SEQ ID NO: 631039 - RNA, 22 nt, Human
cacaggaaagucagccagaaga

SEQ ID NO: 631040 - RNA, 22 nt, Human
gacuacagauagccaauuaagu

SEQ ID NO: 631041 - RNA, 22 nt, Human
gcuucaugccaggagguuuaag

SEQ ID NO: 631042 - RNA, 22 nt, Human
cuccuggggccauggaaggaac

SEQ ID NO: 631043 - RNA, 23 nt, Human
uugacaguaggugguuuucauug

SEQ ID NO: 631044 - RNA, 21 nt, Human
agcagacacuugugaccuucc

SEQ ID NO: 631045 - RNA, 22 nt, Human
acagucugccucucagagcagc

SEQ ID NO: 631046 - RNA, 22 nt, Human
gcugcucugaaaaugacuguug

SEQ ID NO: 631047 - RNA, 22 nt, Human
uaucugucaccuguaggguagg

SEQ ID NO: 631048 - RNA, 22 nt, Human
uuucauauuguccagucagcgc

SEQ ID NO: 631049 - RNA, 22 nt, Human
ggaagccaggcugggggaucug

SEQ ID NO: 631050 - RNA, 22 nt, Human
acuucccaggugguguggaguu

SEQ ID NO: 631051 - RNA, 22 nt, Human
aagaaaacaugaucuaauuuaa

SEQ ID NO: 631052 - RNA, 22 nt, Human
ugccuggcaacuguggugggcu

SEQ ID NO: 631053 - RNA, 22 nt, Human
uaagagcagagguugaauaaau

SEQ ID NO: 631054 - RNA, 22 nt, Human
uccccucccuuccaacagagcu

SEQ ID NO: 631055 - RNA, 22 nt, Human
uggggugguaauacaccguucu

SEQ ID NO: 631056 - RNA, 22 nt, Human
ugccaggcaacugcccagccau

SEQ ID NO: 631057 - RNA, 22 nt, Human
gucaggaucaaauugaaguuau

SEQ ID NO: 631058 - RNA, 22 nt, Human
uucaagaugcacaguggcauuc

SEQ ID NO: 631059 - RNA, 20 nt, Human
gcugucccaggccaaagggc

SEQ ID NO: 631060 - RNA, 22 nt, Human
gcaggggcaggagaucucaggc

SEQ ID NO: 631061 - RNA, 21 nt, Human
caggccgggugagcaggcagc

SEQ ID NO: 631062 - RNA, 22 nt, Human
auuacauauguuggcaacauuu

SEQ ID NO: 631063 - RNA, 22 nt, Human
auugagaagaaaaucuaauaua

SEQ ID NO: 631064 - RNA, 22 nt, Human
ccucccaccguaucucaguggc

SEQ ID NO: 631065 - RNA, 22 nt, Human
cugugaggcggguggaguggag

SEQ ID NO: 631066 - RNA, 22 nt, Human
ucuucuguggcucucaccaccc

SEQ ID NO: 631067 - RNA, 22 nt, Human
cugacccuggucaaguugccuc

SEQ ID NO: 631068 - RNA, 22 nt, Human
uuucaggauuuuaugagauagu

SEQ ID NO: 631069 - RNA, 22 nt, Human
uuggaagggaaccgaguuugcu

SEQ ID NO: 631070 - RNA, 22 nt, Human
acuucaugaacauguggccugu

SEQ ID NO: 631071 - RNA, 22 nt, Human
uagcagagcgggugcgaggcgg

SEQ ID NO: 631072 - RNA, 22 nt, Human
cucuccaaguuaucaagaugaa

SEQ ID NO: 631073 - RNA, 22 nt, Human
uagaauaugugguaggaucugg

SEQ ID NO: 631074 - RNA, 21 nt, Human
ggcagaaguagcauggacggg

SEQ ID NO: 631075 - RNA, 22 nt, Human
gaggucaggcucaagcugggcc

SEQ ID NO: 631076 - RNA, 22 nt, Human
ugugacagccaguaaaguaagc

SEQ ID NO: 631077 - RNA, 20 nt, Human
ggcaugagaugugagggagg

SEQ ID NO: 631078 - RNA, 22 nt, Human
ccagcaagccaggucuguggcu

SEQ ID NO: 631079 - RNA, 22 nt, Human
uugggcuggcccuugucucugg

SEQ ID NO: 631080 - RNA, 22 nt, Human
ugagcagcaggaucuucuggua

SEQ ID NO: 631081 - RNA, 22 nt, Human
gccugagaaggauaggaagcga

SEQ ID NO: 631082 - RNA, 22 nt, Human
guggggcugcuuaggcugcgca

SEQ ID NO: 631083 - RNA, 22 nt, Human
cagggugccucccgcucgccgg

SEQ ID NO: 631084 - RNA, 22 nt, Human
agcaccuguugcacuucauaau

SEQ ID NO: 631085 - RNA, 22 nt, Human
gcuucuauuauuuggagcugag

SEQ ID NO: 631086 - RNA, 22 nt, Human
agcuggccuccgggugccuggg

SEQ ID NO: 631087 - RNA, 22 nt, Human
ucccacagucucacaaugcaua

SEQ ID NO: 631088 - RNA, 22 nt, Human
ccaguguuuacaguugaacaaa

SEQ ID NO: 631089 - RNA, 22 nt, Human
uugcuucagaaguucugcuugu

SEQ ID NO: 631090 - RNA, 22 nt, Human
aaacagaaauuuccucaugcuc

SEQ ID NO: 631091 - RNA, 22 nt, Human
auaguggugagcugcauuuaug

SEQ ID NO: 631092 - RNA, 22 nt, Human
cagaaacuucuggugucaaaua

SEQ ID NO: 631093 - RNA, 22 nt, Human
acaauuccugagaauacuuguu

SEQ ID NO: 631094 - RNA, 21 nt, Human
caugcagauucuggagccaga

SEQ ID NO: 631095 - RNA, 22 nt, Human
gcaucccucugaggggccaggc

SEQ ID NO: 631096 - RNA, 22 nt, Human
uaguucuguguagcucaagagu

SEQ ID NO: 631097 - RNA, 22 nt, Human
ucagacagagaaguacaaugag

SEQ ID NO: 631098 - RNA, 22 nt, Human
auagaacagaaacagaugcaca

SEQ ID NO: 631099 - RNA, 22 nt, Human
ugcauuggucauuugaaaauau

SEQ ID NO: 631100 - RNA, 22 nt, Human
gaauggcugaaugucuuaaauu

SEQ ID NO: 631101 - RNA, 22 nt, Human
gccuucaggaaaucaguccuug

SEQ ID NO: 631102 - RNA, 22 nt, Human
auccaaacauguaccacacuaa

SEQ ID NO: 631103 - RNA, 22 nt, Human
aacaggcaggagaauucugccu

SEQ ID NO: 631104 - RNA, 22 nt, Human
caggaaauucccagaaggacug

SEQ ID NO: 631105 - RNA, 22 nt, Human
auuauucauggucuuccacaau

SEQ ID NO: 631106 - RNA, 22 nt, Human
cagccagugugaccgaggagga

SEQ ID NO: 631107 - RNA, 22 nt, Human
acacaguuuaaacgauuaguac

SEQ ID NO: 631108 - RNA, 22 nt, Human
ucagacaaguaaaauaauguaa

SEQ ID NO: 631109 - RNA, 22 nt, Human
caggaacaaggccuaugggacu

SEQ ID NO: 631110 - RNA, 22 nt, Human
agucaaaggguauuuggauuga

SEQ ID NO: 631111 - RNA, 22 nt, Human
gggccggagcugggucccgcgc

SEQ ID NO: 631112 - RNA, 20 nt, Human
aucagaggauagggaagugg

SEQ ID NO: 631113 - RNA, 22 nt, Human
agccagagauugagaugcaggc

SEQ ID NO: 631114 - RNA, 22 nt, Human
auucuuugaacaguuuuccugu

SEQ ID NO: 631115 - RNA, 22 nt, Human
cagaauaugacaagauuuuccu

SEQ ID NO: 631116 - RNA, 22 nt, Human
cucccugggcagauguggcucu

SEQ ID NO: 631117 - RNA, 17 nt, Human
gggcugacaguggccuc

SEQ ID NO: 631118 - RNA, 22 nt, Human
gcugccugcaguguuuucccag

SEQ ID NO: 631119 - RNA, 22 nt, Human
gcuguggguaaacgcugagggu

SEQ ID NO: 631120 - RNA, 22 nt, Human
ucugcuugcguucugcucccuc

SEQ ID NO: 631121 - RNA, 22 nt, Human
cuggcagguggagguugcagug

SEQ ID NO: 631122 - RNA, 22 nt, Human
ccagaagcuucaaggagauucu

SEQ ID NO: 631123 - RNA, 22 nt, Human
uggcacuuccacuguggcugcu

SEQ ID NO: 631124 - RNA, 21 nt, Human
aauagcugaggucacccagcc

SEQ ID NO: 631125 - RNA, 22 nt, Human
gaaauguaauucucuugaagau

SEQ ID NO: 631126 - RNA, 22 nt, Human
aaaugcauuuuuaauuagaccc

SEQ ID NO: 631127 - RNA, 22 nt, Human
gaugagggccugguggcugugc

SEQ ID NO: 631128 - RNA, 22 nt, Human
ugucaccuugcagggcuggggc

SEQ ID NO: 631129 - RNA, 22 nt, Human
gucugcagagggaaggcuucag

SEQ ID NO: 631130 - RNA, 22 nt, Human
acaauucaagaagagagaugaa

SEQ ID NO: 631131 - RNA, 22 nt, Human
acugcugugaucugauguaauu

SEQ ID NO: 631132 - RNA, 22 nt, Human
ucuggcagugaagucaugaggu

SEQ ID NO: 631133 - RNA, 22 nt, Human
uuugucuucauccuucgagcug

SEQ ID NO: 631134 - RNA, 22 nt, Human
guccucugucccuggggcacgg

SEQ ID NO: 631135 - RNA, 22 nt, Human
gagcugaacaucauggaaaggc

SEQ ID NO: 631136 - RNA, 22 nt, Human
gcaucuaagguggauaacuucu

SEQ ID NO: 631137 - RNA, 22 nt, Human
gugauccuauaaagugagcaca

SEQ ID NO: 631138 - RNA, 22 nt, Human
uuagaguguagcaggaagaggc

SEQ ID NO: 631139 - RNA, 20 nt, Human
aggagggaccuggauuggcg

SEQ ID NO: 631140 - RNA, 22 nt, Human
ucauuuaauugguuuugcucgu

SEQ ID NO: 631141 - RNA, 18 nt, Human
agcaccagucacuaacag

SEQ ID NO: 631142 - RNA, 22 nt, Human
cucugcuagaaggucaaucucu

SEQ ID NO: 631143 - RNA, 17 nt, Human
gcuccaggcgugaguga

SEQ ID NO: 631144 - RNA, 22 nt, Human
cugcccagaagccagaugggca

SEQ ID NO: 631145 - RNA, 22 nt, Human
agcccuggcucccagcagcgcu

SEQ ID NO: 631146 - RNA, 22 nt, Human
uuuagacagcggcucugaacca

SEQ ID NO: 631147 - RNA, 22 nt, Human
augcaguacugauacaugccac

SEQ ID NO: 631148 - RNA, 22 nt, Human
aaaguccuuuuugccaugcaag

SEQ ID NO: 631149 - RNA, 22 nt, Human
uuucugcucgcucucaaucagg

SEQ ID NO: 631150 - RNA, 22 nt, Human
uauuaacacguauaaaguguuu

SEQ ID NO: 631151 - RNA, 22 nt, Human
ucuguggcuaucauacugaagg

SEQ ID NO: 631152 - RNA, 22 nt, Human
uagcacacgcauuagcaaauca

SEQ ID NO: 631153 - RNA, 22 nt, Human
uaccaggcagcugcacagaggc

SEQ ID NO: 631154 - RNA, 22 nt, Human
uugcagcuguugcaaagucucu

SEQ ID NO: 631155 - RNA, 22 nt, Human
ugagcucuguuagggcuggaac

SEQ ID NO: 631156 - RNA, 22 nt, Human
cagaugcuuggaggacacuugg

SEQ ID NO: 631157 - RNA, 22 nt, Human
ugucucuuggcucuaucacuua

SEQ ID NO: 631158 - RNA, 22 nt, Human
uuuagcauguuccuuucauaga

SEQ ID NO: 631159 - RNA, 22 nt, Human
caucauuuuuguaagcugguag

SEQ ID NO: 631160 - RNA, 22 nt, Human
ugucugaagcagccagugcugu

SEQ ID NO: 631161 - RNA, 22 nt, Human
uacagaauagaauagggacagg

SEQ ID NO: 631162 - RNA, 22 nt, Human
gcaccacaucaaugaggggagc

SEQ ID NO: 631163 - RNA, 22 nt, Human
uaaguucugaagaggcgaggua

SEQ ID NO: 631164 - RNA, 23 nt, Human
auugaccuguuuagucucucccu

SEQ ID NO: 631165 - RNA, 22 nt, Human
caccuuugaccuugcagcgcac

SEQ ID NO: 631166 - RNA, 20 nt, Human
caucagugccugacaggucc

SEQ ID NO: 631167 - RNA, 22 nt, Human
aaacacagcauguccuugggga

SEQ ID NO: 631168 - RNA, 22 nt, Human
agaguuaucacuccaugcagcu

SEQ ID NO: 631169 - RNA, 22 nt, Human
gggcuccaggagcccuaagaga

SEQ ID NO: 631170 - RNA, 23 nt, Human
ugguggcagaaguagcagaugac

SEQ ID NO: 631171 - RNA, 22 nt, Human
aggucugguauuuuucuauacu

SEQ ID NO: 631172 - RNA, 22 nt, Human
cugcugagguccuugcucagac

SEQ ID NO: 631173 - RNA, 22 nt, Human
caccaggggcagagaccaaagu

SEQ ID NO: 631174 - RNA, 22 nt, Human
aguaucauguuggaauuaauca

SEQ ID NO: 631175 - RNA, 22 nt, Human
aggucagguaucagcagguauu

SEQ ID NO: 631176 - RNA, 22 nt, Human
uggcuggcccugggagugcaga

SEQ ID NO: 631177 - RNA, 22 nt, Human
gggaaagaccuuccuggggugu

SEQ ID NO: 631178 - RNA, 22 nt, Human
aggcaccuggaucuuggaauuc

SEQ ID NO: 631179 - RNA, 22 nt, Human
uggcucagaugcucuuccagug

SEQ ID NO: 631180 - RNA, 22 nt, Human
ugauuauauuaacuauguuccu

SEQ ID NO: 631181 - RNA, 22 nt, Human
cuucuucugguuuauguggcaa

SEQ ID NO: 631182 - RNA, 22 nt, Human
gaguccagacaccauaccugau

SEQ ID NO: 631183 - RNA, 22 nt, Human
aggccucuguagggcccugaag

SEQ ID NO: 631184 - RNA, 22 nt, Human
uucucacuauguauguagauug

SEQ ID NO: 631185 - RNA, 22 nt, Human
ugugacagaucucuauacauga

SEQ ID NO: 631186 - RNA, 22 nt, Human
uuccaaguccagccaggccaaa

SEQ ID NO: 631187 - RNA, 22 nt, Human
ucuagggagaagcucugucugu

SEQ ID NO: 631188 - RNA, 22 nt, Human
gcacagagagggaagguaacuu

SEQ ID NO: 631189 - RNA, 22 nt, Human
uggaggggcaauggagcgcgga

SEQ ID NO: 631190 - RNA, 22 nt, Human
gcgcgccucugcccgguguucc

SEQ ID NO: 631191 - RNA, 22 nt, Human
cuucagcuguggucuccaaggc

SEQ ID NO: 631192 - RNA, 22 nt, Human
ucaggaaauggugauuugguug

SEQ ID NO: 631193 - RNA, 22 nt, Human
uguucacaucgauggauuuugc

SEQ ID NO: 631194 - RNA, 22 nt, Human
ucugcucugggccagcuauuaa

SEQ ID NO: 631195 - RNA, 22 nt, Human
ugagaaugccauaagagcuauu

SEQ ID NO: 631196 - RNA, 22 nt, Human
gaggaaggaaugcaguguaugc

SEQ ID NO: 631197 - RNA, 22 nt, Human
ucuggagaguccugcucacguc

SEQ ID NO: 631198 - RNA, 22 nt, Human
agcaccaguuucgucgugacaa

SEQ ID NO: 631199 - RNA, 22 nt, Human
ucuguagcaagugagaggcauu

SEQ ID NO: 631200 - RNA, 20 nt, Human
uagcaaugaguguuccauuu

SEQ ID NO: 631201 - RNA, 22 nt, Human
uucugcugaagccagggagcaa

SEQ ID NO: 631202 - RNA, 22 nt, Human
uaggcagcugcaaacuucgguc

SEQ ID NO: 631203 - RNA, 22 nt, Human
uugcugggugcuauuaugaaca

SEQ ID NO: 631204 - RNA, 22 nt, Human
cuggcucccucgcugaggugcu

SEQ ID NO: 631205 - RNA, 22 nt, Human
ugagcuggagucgugagcaaag

SEQ ID NO: 631206 - RNA, 22 nt, Human
uggaaacuaggauggaagaaau

SEQ ID NO: 631207 - RNA, 22 nt, Human
ucagcuaugagguggugguucu

SEQ ID NO: 631208 - RNA, 22 nt, Human
ucucugggaguugagcagcagc

SEQ ID NO: 631209 - RNA, 22 nt, Human
ccaguccuagaagaggagucga

SEQ ID NO: 631210 - RNA, 22 nt, Human
ggcugaaauucagaguaaauuc

SEQ ID NO: 631211 - RNA, 22 nt, Human
cugcuuugggcagcuuuguggc

SEQ ID NO: 631212 - RNA, 22 nt, Human
acaguggugagugacugauagg

SEQ ID NO: 631213 - RNA, 22 nt, Human
ugcaggaguccaaucaggagac

SEQ ID NO: 631214 - RNA, 22 nt, Human
gguccagaagcugguaggguag

SEQ ID NO: 631215 - RNA, 21 nt, Human
ggaagggcucugaggacggcu

SEQ ID NO: 631216 - RNA, 22 nt, Human
gggccaaggggagcuggaaggg

SEQ ID NO: 631217 - RNA, 22 nt, Human
uucaucuugauggcuuccuaau

SEQ ID NO: 631218 - RNA, 22 nt, Human
uggcccugccacucacugcuga

SEQ ID NO: 631219 - RNA, 22 nt, Human
caauauauaaugaguacuuucc

SEQ ID NO: 631220 - RNA, 22 nt, Human
ugauaugugaagcuauuaguuc

SEQ ID NO: 631221 - RNA, 22 nt, Human
gcccucccuacagccuauuucu

SEQ ID NO: 631222 - RNA, 23 nt, Human
ccucccaggcugcgagucccgag

SEQ ID NO: 631223 - RNA, 23 nt, Human
agacuucuccaacaagcuuggcu

SEQ ID NO: 631224 - RNA, 22 nt, Human
cagcaccuuccuuaacuccagg

SEQ ID NO: 631225 - RNA, 17 nt, Human
aauagcugcucagagag

SEQ ID NO: 631226 - RNA, 22 nt, Human
uuuucaggugcaguaaucauau

SEQ ID NO: 631227 - RNA, 22 nt, Human
agcuggugugccacuguugggg

SEQ ID NO: 631228 - RNA, 21 nt, Human
gaaggagaaagcaagugcugc

SEQ ID NO: 631229 - RNA, 22 nt, Human
uuccaggaagacaucucaggaa

SEQ ID NO: 631230 - RNA, 22 nt, Human
gccuccucuugagggucaggga

SEQ ID NO: 631231 - RNA, 22 nt, Human
gaaagcacaguucaugagacaa

SEQ ID NO: 631232 - RNA, 22 nt, Human
ccauaagguuuggggccaugca

SEQ ID NO: 631233 - RNA, 22 nt, Human
uccuguguuacugccuggagcg

SEQ ID NO: 631234 - RNA, 22 nt, Human
ccagcugaggcagccacacagg

SEQ ID NO: 631235 - RNA, 22 nt, Human
gauauuuuugcagacaccuggg

SEQ ID NO: 631236 - RNA, 22 nt, Human
cagcccucaucucagcuucuuu

SEQ ID NO: 631237 - RNA, 23 nt, Human
uuucuucagaagccuugcgaggc

SEQ ID NO: 631238 - RNA, 22 nt, Human
aaacugaggcucccgagggugu

SEQ ID NO: 631239 - RNA, 22 nt, Human
aaauucuuuggccuacuuugaa

SEQ ID NO: 631240 - RNA, 22 nt, Human
guggcuagaaaaauaugggugc

SEQ ID NO: 631241 - RNA, 22 nt, Human
auuucagauucgagaggaagug

SEQ ID NO: 631242 - RNA, 19 nt, Human
accuucugggaaacauucc

SEQ ID NO: 631243 - RNA, 22 nt, Human
ugcccugccaagacugaguggu

SEQ ID NO: 631244 - RNA, 22 nt, Human
agggcagagaaauguaguugag

SEQ ID NO: 631245 - RNA, 22 nt, Human
uggagaguguagacuucagagu

SEQ ID NO: 631246 - RNA, 22 nt, Human
cugggaagcauggugaugguau

SEQ ID NO: 631247 - RNA, 22 nt, Human
acagggcuggggaaagaggcua

SEQ ID NO: 631248 - RNA, 22 nt, Human
agaggaaguaaucaggaccugc

SEQ ID NO: 631249 - RNA, 22 nt, Human
agguccugugguuuggguaaaa

SEQ ID NO: 631250 - RNA, 22 nt, Human
gagccagcuauguagcaagagg

SEQ ID NO: 631251 - RNA, 22 nt, Human
cagccacugaacuccuggcuau

SEQ ID NO: 631252 - RNA, 22 nt, Human
acuguugaagugccagcuugau

SEQ ID NO: 631253 - RNA, 22 nt, Human
cucuggcuguuugcagcucaag

SEQ ID NO: 631254 - RNA, 22 nt, Human
uggcagguagucagaggcgaca

SEQ ID NO: 631255 - RNA, 21 nt, Human
uucugccuuccccuagcuggg

SEQ ID NO: 631256 - RNA, 22 nt, Human
auaucaaagcuaguggaaauuu

SEQ ID NO: 631257 - RNA, 22 nt, Human
caaauacaaauacgggcagcuu

SEQ ID NO: 631258 - RNA, 22 nt, Human
aguauuucuaguugguucuacu

SEQ ID NO: 631259 - RNA, 22 nt, Human
uccugggaggcugugccuggcu

SEQ ID NO: 631260 - RNA, 22 nt, Human
guacaaguguauuuggcuugau

SEQ ID NO: 631261 - RNA, 22 nt, Human
ccagggcuggguuugucggugu

SEQ ID NO: 631262 - RNA, 22 nt, Human
aaugaaacuguauauagacugu

SEQ ID NO: 631263 - RNA, 22 nt, Human
uagauucaaguauucaguuugg

SEQ ID NO: 631264 - RNA, 22 nt, Human
gggcaugccugagccugccacu

SEQ ID NO: 631265 - RNA, 22 nt, Human
gggagggaaagcuugaucuguc

SEQ ID NO: 631266 - RNA, 21 nt, Human
ggcagccucuguggaagggga

SEQ ID NO: 631267 - RNA, 21 nt, Human
cugaggcagcacagcuaguca

SEQ ID NO: 631268 - RNA, 22 nt, Human
ggccaugcaggucagagguggg

SEQ ID NO: 631269 - RNA, 22 nt, Human
gcggcaggaagagcgcagcccc

SEQ ID NO: 631270 - RNA, 22 nt, Human
aaaaguauggugguccuuuuua

SEQ ID NO: 631271 - RNA, 22 nt, Human
aagcaccugcaguugacaaaaa

SEQ ID NO: 631272 - RNA, 22 nt, Human
agcugccucucuugagguuacg

SEQ ID NO: 631273 - RNA, 18 nt, Human
auuaaucauaaaaugcug

SEQ ID NO: 631274 - RNA, 22 nt, Human
ugaguuauauauacuggcucug

SEQ ID NO: 631275 - RNA, 22 nt, Human
ccugaugguauauuguugggag

SEQ ID NO: 631276 - RNA, 22 nt, Human
aaaucccuugcucucucagacc

SEQ ID NO: 631277 - RNA, 22 nt, Human
uuuccuuucugguuuggucaua

SEQ ID NO: 631278 - RNA, 22 nt, Human
caucuugaagguuucuuuagcu

SEQ ID NO: 631279 - RNA, 22 nt, Human
uuugacuccugccuucuccugu

SEQ ID NO: 631280 - RNA, 22 nt, Human
uccccagguccugucggcuccu

SEQ ID NO: 631281 - RNA, 22 nt, Human
gucucagauucagacaucuaca

SEQ ID NO: 631282 - RNA, 22 nt, Human
gucccagagagcacuaguccau

SEQ ID NO: 631283 - RNA, 22 nt, Human
uuccccaguaacauacauguga

SEQ ID NO: 631284 - RNA, 22 nt, Human
guucccacuuggugcacuauga

SEQ ID NO: 631285 - RNA, 22 nt, Human
ugggcagauuaaugcaguggcu

SEQ ID NO: 631286 - RNA, 22 nt, Human
ucucugaagagcucagacuagu

SEQ ID NO: 631287 - RNA, 22 nt, Human
agauacaacuguuuaaacauua

SEQ ID NO: 631288 - RNA, 22 nt, Human
uaacacugguauuucauuuagu

SEQ ID NO: 631289 - RNA, 22 nt, Human
cuauuugaaaccaagaaugccg

SEQ ID NO: 631290 - RNA, 22 nt, Human
aucuggcugagcgaggcccaca

SEQ ID NO: 631291 - RNA, 22 nt, Human
uaguuuuacuugcgaugauaau

SEQ ID NO: 631292 - RNA, 22 nt, Human
uagaaaguaaacacgaagucuc

SEQ ID NO: 631293 - RNA, 22 nt, Human
uauauggauagugaucauaaga

SEQ ID NO: 631294 - RNA, 22 nt, Human
uauggagauucaaaagcaucuu

SEQ ID NO: 631295 - RNA, 22 nt, Human
caggccucgaggagacagcuac

SEQ ID NO: 631296 - RNA, 22 nt, Human
ccacagcuucgcagucugcugc

SEQ ID NO: 631297 - RNA, 22 nt, Human
ccaguaaaccaaguguuuacua

SEQ ID NO: 631298 - RNA, 22 nt, Human
cuguuuauaaaccaccaguuua

SEQ ID NO: 631299 - RNA, 22 nt, Human
aguacauacuucaaauguacuu

SEQ ID NO: 631300 - RNA, 22 nt, Human
agggccugcaucaggagcuugg

SEQ ID NO: 631301 - RNA, 22 nt, Human
agaucuggaaaaucacaggugc

SEQ ID NO: 631302 - RNA, 22 nt, Human
uuauuugccagaauuucucuug

SEQ ID NO: 631303 - RNA, 22 nt, Human
gcucagugaauuuuugcccaug

SEQ ID NO: 631304 - RNA, 22 nt, Human
ugucagcagaaaucuggucugc

SEQ ID NO: 631305 - RNA, 22 nt, Human
ggguggcacugauaaugagacg

SEQ ID NO: 631306 - RNA, 22 nt, Human
ucugauguugugacaucacuuc

SEQ ID NO: 631307 - RNA, 22 nt, Human
uucuucuugucugcccucacau

SEQ ID NO: 631308 - RNA, 22 nt, Human
aaaaugacauuccagugauauu

SEQ ID NO: 631309 - RNA, 22 nt, Human
ggaaggcagaggugucgugggg

SEQ ID NO: 631310 - RNA, 16 nt, Human
ccagguggggcuguga

SEQ ID NO: 631311 - RNA, 22 nt, Human
agcugucugucuccugaggaga

SEQ ID NO: 631312 - RNA, 19 nt, Human
gggagcugucugcccgugg

SEQ ID NO: 631313 - RNA, 22 nt, Human
uaauugucccugcaguuaggau

SEQ ID NO: 631314 - RNA, 22 nt, Human
ccagccagucccgcaugaccgc

SEQ ID NO: 631315 - RNA, 22 nt, Human
acauaacaaucauaggacauag

SEQ ID NO: 631316 - RNA, 22 nt, Human
aggcaauccucuuacagauggg

SEQ ID NO: 631317 - RNA, 23 nt, Human
agcugaaagcuugcaacgaggca

SEQ ID NO: 631318 - RNA, 22 nt, Human
cagggcagggauguugcggcag

SEQ ID NO: 631319 - RNA, 22 nt, Human
acagaugaaacccagcuaguug

SEQ ID NO: 631320 - RNA, 22 nt, Human
caucugaaaucugccuacaagc

SEQ ID NO: 631321 - RNA, 22 nt, Human
auguuacagaaagcaaagauga

SEQ ID NO: 631322 - RNA, 22 nt, Human
auugagaaugaagggacauuuu

SEQ ID NO: 631323 - RNA, 22 nt, Human
uuaaaacugcaaauccuacuga

SEQ ID NO: 631324 - RNA, 22 nt, Human
caggccugugacaccgugucug

SEQ ID NO: 631325 - RNA, 22 nt, Human
agguacaguagacagacaguua

SEQ ID NO: 631326 - RNA, 22 nt, Human
agaggcagcagucauacuacag

SEQ ID NO: 631327 - RNA, 22 nt, Human
agagacugcaaaucauaagaau

SEQ ID NO: 631328 - RNA, 22 nt, Human
ugucugaaggccugaccuacau

SEQ ID NO: 631329 - RNA, 22 nt, Human
acugucugcccugagaugccag

SEQ ID NO: 631330 - RNA, 22 nt, Human
ucuggcauuucaggcaucuaua

SEQ ID NO: 631331 - RNA, 22 nt, Human
acagcaucccugaagauaacca

SEQ ID NO: 631332 - RNA, 21 nt, Human
ugaagccugaggcauagcccc

SEQ ID NO: 631333 - RNA, 19 nt, Human
ugaguguguguuucucuaa

SEQ ID NO: 631334 - RNA, 22 nt, Human
cggagccugcuuguugcagcug

SEQ ID NO: 631335 - RNA, 22 nt, Human
acugcccagugauuggugguua

SEQ ID NO: 631336 - RNA, 22 nt, Human
aaggagucucagcugggccuga

SEQ ID NO: 631337 - RNA, 22 nt, Human
agcagacaacccagaugaccca

SEQ ID NO: 631338 - RNA, 22 nt, Human
auucaguuuuugaagggaaauu

SEQ ID NO: 631339 - RNA, 22 nt, Human
ucugaggcagcuugccacucua

SEQ ID NO: 631340 - RNA, 22 nt, Human
uaaaucaguaaggcauauucuc

SEQ ID NO: 631341 - RNA, 22 nt, Human
uuggaauuuuccagguacagug

SEQ ID NO: 631342 - RNA, 22 nt, Human
uuauuucauguaaaauuuaugu

SEQ ID NO: 631343 - RNA, 22 nt, Human
ucacuuugaugacauuguagcu

SEQ ID NO: 631344 - RNA, 22 nt, Human
cgagaggcuggacagggcuggg

SEQ ID NO: 631345 - RNA, 22 nt, Human
cugaggaguuggugaauaagcc

SEQ ID NO: 631346 - RNA, 22 nt, Human
gggcuggaguugggaagacaaa

SEQ ID NO: 631347 - RNA, 22 nt, Human
gcagcagagcuuuguccuggcu

SEQ ID NO: 631348 - RNA, 22 nt, Human
aacugcauuguacuaaacuugu

SEQ ID NO: 631349 - RNA, 20 nt, Human
cagcuuggaugagaggcuga

SEQ ID NO: 631350 - RNA, 22 nt, Human
ggcccagguccagcgaguaccu

SEQ ID NO: 631351 - RNA, 22 nt, Human
uauuuggacaccaaguagaagu

SEQ ID NO: 631352 - RNA, 22 nt, Human
uucuuucugggguccuucggcu

SEQ ID NO: 631353 - RNA, 22 nt, Human
ucuuccuaguuacauaugcaca

SEQ ID NO: 631354 - RNA, 22 nt, Human
ucaguuuaauacccagaugccu

SEQ ID NO: 631355 - RNA, 22 nt, Human
cacccacccacugcucauuggc

SEQ ID NO: 631356 - RNA, 22 nt, Human
caguguuuagaucaagaaggcc

SEQ ID NO: 631357 - RNA, 22 nt, Human
ugcuccagccuaugcucuccgg

SEQ ID NO: 631358 - RNA, 22 nt, Human
agcagcaaaguauugggcaaga

SEQ ID NO: 631359 - RNA, 20 nt, Human
uccagcugacauucucuuuc

SEQ ID NO: 631360 - RNA, 22 nt, Human
aguguggggucaccggcccagg

SEQ ID NO: 631361 - RNA, 22 nt, Human
uuaauccggggugaauuuaauu

SEQ ID NO: 631362 - RNA, 22 nt, Human
cuguuuaucuaggaguugcagg

SEQ ID NO: 631363 - RNA, 22 nt, Human
gcuggggcugggcugaggaaga

SEQ ID NO: 631364 - RNA, 18 nt, Human
cugugggcuggugcauga

SEQ ID NO: 631365 - RNA, 22 nt, Human
aacaaugcuugccaagugugau

SEQ ID NO: 631366 - RNA, 22 nt, Human
cuggugcuuugcucauuugaua

SEQ ID NO: 631367 - RNA, 22 nt, Human
aauguuuuguaugccucugagc

SEQ ID NO: 631368 - RNA, 22 nt, Human
ugggcugcggauaggccucgga

SEQ ID NO: 631369 - RNA, 23 nt, Human
aaugacagugugugauugaagaa

SEQ ID NO: 631370 - RNA, 22 nt, Human
ggugaguuucaugguuguuuac

SEQ ID NO: 631371 - RNA, 22 nt, Human
cagcucuggguaggaggaaucu

SEQ ID NO: 631372 - RNA, 22 nt, Human
ucugaggcccuacccugagccu

SEQ ID NO: 631373 - RNA, 22 nt, Human
aaauguggguaaugggacugga

SEQ ID NO: 631374 - RNA, 21 nt, Human
uagcaggaggccccugcuugc

SEQ ID NO: 631375 - RNA, 22 nt, Human
cauuuauucauuugcuagggcu

SEQ ID NO: 631376 - RNA, 22 nt, Human
augcagaagcagaacuuacaca

SEQ ID NO: 631377 - RNA, 22 nt, Human
uccuguggggaaaagccuaucu

SEQ ID NO: 631378 - RNA, 22 nt, Human
cuucucugcaccccacuuuugc

SEQ ID NO: 631379 - RNA, 22 nt, Human
uacuguguugugcugaaaggga

SEQ ID NO: 631380 - RNA, 22 nt, Human
uagcaacagcaauagugguauu

SEQ ID NO: 631381 - RNA, 22 nt, Human
ggcugcagagcugggugggccu

SEQ ID NO: 631382 - RNA, 22 nt, Human
uaaaggcaugcaggugaaugua

SEQ ID NO: 631383 - RNA, 22 nt, Human
ggcagcugcugcauuacguugu

SEQ ID NO: 631384 - RNA, 17 nt, Human
cuggagccuccaacucc

SEQ ID NO: 631385 - RNA, 22 nt, Human
ugggaugaggccucuguuguga

SEQ ID NO: 631386 - RNA, 22 nt, Human
cuccuccacagaguccuugcca

SEQ ID NO: 631387 - RNA, 18 nt, Human
ggcugccuguuccugaag

SEQ ID NO: 631388 - RNA, 22 nt, Human
ucaguucugcuagaaaaacagu

SEQ ID NO: 631389 - RNA, 22 nt, Human
aacagugucugugguuaaaggu

SEQ ID NO: 631390 - RNA, 22 nt, Human
uggccuggcagagcaaggccug

SEQ ID NO: 631391 - RNA, 22 nt, Human
ccuccuggaaaaauucccuggc

SEQ ID NO: 631392 - RNA, 22 nt, Human
uaugacauuauaaaggauuauu

SEQ ID NO: 631393 - RNA, 21 nt, Human
gggcucagcgcucggcuccuc

SEQ ID NO: 631394 - RNA, 22 nt, Human
gcagagcccuggggguauggug

SEQ ID NO: 631395 - RNA, 22 nt, Human
agaaagcacagcggguccauuu

SEQ ID NO: 631396 - RNA, 22 nt, Human
gcuuccauuugcuaggggauuu

SEQ ID NO: 631397 - RNA, 22 nt, Human
ucaguggagcuaagcaugagau

SEQ ID NO: 631398 - RNA, 20 nt, Human
cugcucugcuuugcaggugg

SEQ ID NO: 631399 - RNA, 22 nt, Human
agugucugccagcugccaggug

SEQ ID NO: 631400 - RNA, 22 nt, Human
ugggaaagacucaggacaggag

SEQ ID NO: 631401 - RNA, 22 nt, Human
caggaggcagagguugcaguga

SEQ ID NO: 631402 - RNA, 22 nt, Human
aggcagcagagguugaggaaag

SEQ ID NO: 631403 - RNA, 22 nt, Human
aaagaaggaccuggaggaggau

SEQ ID NO: 631404 - RNA, 22 nt, Human
gagauccuguaggcagcuaaga

SEQ ID NO: 631405 - RNA, 20 nt, Human
cccacacccuucccacuugg

SEQ ID NO: 631406 - RNA, 20 nt, Human
gaggccucagccucagcucc

SEQ ID NO: 631407 - RNA, 22 nt, Human
aauagucucucccacaccaucc

SEQ ID NO: 631408 - RNA, 22 nt, Human
uuauaagaguauauaguguacu

SEQ ID NO: 631409 - RNA, 22 nt, Human
uauacuuaugcuaaaaaauguu

SEQ ID NO: 631410 - RNA, 22 nt, Human
uuuaugcagccucaguaucaga

SEQ ID NO: 631411 - RNA, 22 nt, Human
aaaguaacaauaagguucuauu

SEQ ID NO: 631412 - RNA, 22 nt, Human
gagccagcagccggcaccacca

SEQ ID NO: 631413 - RNA, 22 nt, Human
cugagguaccuggagcaggucc

SEQ ID NO: 631414 - RNA, 22 nt, Human
uccaggcugugcaugaguuuag

SEQ ID NO: 631415 - RNA, 22 nt, Human
uggcccaguauguauaaucuua

SEQ ID NO: 631416 - RNA, 22 nt, Human
ggcggugguugagaggacggcg

SEQ ID NO: 631417 - RNA, 22 nt, Human
acauauuuccaugcagcauguc

SEQ ID NO: 631418 - RNA, 22 nt, Human
uucuaguguccuuggacuugcu

SEQ ID NO: 631419 - RNA, 22 nt, Human
agcagcuucuuucacuccugga

SEQ ID NO: 631420 - RNA, 22 nt, Human
ccucccuuuguugcaagggaaa

SEQ ID NO: 631421 - RNA, 22 nt, Human
acauuccucagugccaguugag

SEQ ID NO: 631422 - RNA, 22 nt, Human
cugggaaguggugagggccuga

SEQ ID NO: 631423 - RNA, 22 nt, Human
agcucagggcgaucugucucgg

SEQ ID NO: 631424 - RNA, 22 nt, Human
uucagggcccugagagggcagu

SEQ ID NO: 631425 - RNA, 22 nt, Human
uuugcauuauauuuauagaaga

SEQ ID NO: 631426 - RNA, 22 nt, Human
aggagcugauagucuauggaga

SEQ ID NO: 631427 - RNA, 22 nt, Human
aucugcuugaaugagcaacagg

SEQ ID NO: 631428 - RNA, 22 nt, Human
gagccuggauagccuuguucca

SEQ ID NO: 631429 - RNA, 22 nt, Human
uggaugaggcuggguuaggcag

SEQ ID NO: 631430 - RNA, 22 nt, Human
gcugaggccaggccccaccgga

SEQ ID NO: 631431 - RNA, 22 nt, Human
cagguggcaugacugccuacaa

SEQ ID NO: 631432 - RNA, 22 nt, Human
ucucagcugacugcuuuccucg

SEQ ID NO: 631433 - RNA, 22 nt, Human
gguggcucagggcuccaagcau

SEQ ID NO: 631434 - RNA, 22 nt, Human
aggcacuuuccuugaggaguuu

SEQ ID NO: 631435 - RNA, 22 nt, Human
gggcugcugcugccagcgacac

SEQ ID NO: 631436 - RNA, 22 nt, Human
gggagcuggaucgcgcgcccgg

SEQ ID NO: 631437 - RNA, 22 nt, Human
ugcaaggauauuuagucuagug

SEQ ID NO: 631438 - RNA, 21 nt, Human
gcaaguacuaucaucauuauc

SEQ ID NO: 631439 - RNA, 22 nt, Human
gugugcauauguguggcucucc

SEQ ID NO: 631440 - RNA, 22 nt, Human
uuguguccugauuugacacaau

SEQ ID NO: 631441 - RNA, 22 nt, Human
aaguuauaucaucucauugacg

SEQ ID NO: 631442 - RNA, 22 nt, Human
uccuggggcucuuugaugugau

SEQ ID NO: 631443 - RNA, 22 nt, Human
gcagucagacaggaggagcucc

SEQ ID NO: 631444 - RNA, 19 nt, Human
ucugaagaauuagagagca

SEQ ID NO: 631445 - RNA, 22 nt, Human
augcagcaguuuacaaagcaau

SEQ ID NO: 631446 - RNA, 22 nt, Human
aaacaguccucuuuauuuaguc

SEQ ID NO: 631447 - RNA, 22 nt, Human
acucaucugaaaaaugaggaga

SEQ ID NO: 631448 - RNA, 22 nt, Human
cuaaacaagauacuaaugaggu

SEQ ID NO: 631449 - RNA, 22 nt, Human
cgcgcggcucucgcgagaugug

SEQ ID NO: 631450 - RNA, 22 nt, Human
uccugcagaccucagucagguc

SEQ ID NO: 631451 - RNA, 22 nt, Human
aaguggcagccuuagaaggaga

SEQ ID NO: 631452 - RNA, 22 nt, Human
guggcaucaagauuuagauuca

SEQ ID NO: 631453 - RNA, 20 nt, Human
agcauuuuaugguaggaaac

SEQ ID NO: 631454 - RNA, 22 nt, Human
uuagaaaugucacagaucugau

SEQ ID NO: 631455 - RNA, 22 nt, Human
gaguuauuuguagggauuauau

SEQ ID NO: 631456 - RNA, 22 nt, Human
uacagaauaaagcgugaagcuu

SEQ ID NO: 631457 - RNA, 22 nt, Human
uucaaugucuauguacauuuua

SEQ ID NO: 631458 - RNA, 22 nt, Human
gucucucugcuaggccuccagu

SEQ ID NO: 631459 - RNA, 22 nt, Human
ggaaaucucuacuuugucauuu

SEQ ID NO: 631460 - RNA, 19 nt, Human
accaggaguaucagagcug

SEQ ID NO: 631461 - RNA, 20 nt, Human
cuuucucuaauuuauaagua

SEQ ID NO: 631462 - RNA, 22 nt, Human
uaauuucacaguucaacgcaca

SEQ ID NO: 631463 - RNA, 22 nt, Human
auguuacaugaaacggccuacu

SEQ ID NO: 631464 - RNA, 22 nt, Human
uccaagaagucaucuaaacugu

SEQ ID NO: 631465 - RNA, 22 nt, Human
gcuccaggcagcauaguggaug

SEQ ID NO: 631466 - RNA, 22 nt, Human
ucacacguccuugcuacuccuc

SEQ ID NO: 631467 - RNA, 23 nt, Human
ucacacuaugaaguguguuaucc

SEQ ID NO: 631468 - RNA, 22 nt, Human
auggcuuucuguguuuccguag

SEQ ID NO: 631469 - RNA, 22 nt, Human
guaggguuggagagcacaacca

SEQ ID NO: 631470 - RNA, 22 nt, Human
agugcuccucagaagaguugga

SEQ ID NO: 631471 - RNA, 21 nt, Human
aggcagccagucaugcucccu

SEQ ID NO: 631472 - RNA, 22 nt, Human
acacuuugggcuggauaauuau

SEQ ID NO: 631473 - RNA, 22 nt, Human
uuccucuauucuaacaaaagua

SEQ ID NO: 631474 - RNA, 22 nt, Human
ucagcaggucugaggcggggcc

SEQ ID NO: 631475 - RNA, 20 nt, Human
ugaacacugggguguuucag

SEQ ID NO: 631476 - RNA, 22 nt, Human
auacagauugcuauacuuacaa

SEQ ID NO: 631477 - RNA, 22 nt, Human
gggugugcaggucauggcgucu

SEQ ID NO: 631478 - RNA, 22 nt, Human
uucugagcuacauaguacuggg

SEQ ID NO: 631479 - RNA, 22 nt, Human
ugaagaaacgcagagagguagg

SEQ ID NO: 631480 - RNA, 22 nt, Human
acagucuaggccuaggucaaaa

SEQ ID NO: 631481 - RNA, 19 nt, Human
ccucugcuccaguuuccuu

SEQ ID NO: 631482 - RNA, 22 nt, Human
gagccuggguccuucccuggga

SEQ ID NO: 631483 - RNA, 22 nt, Human
aaagaucagaggauagcugagu

SEQ ID NO: 631484 - RNA, 22 nt, Human
accacccauucagaaacacuga

SEQ ID NO: 631485 - RNA, 22 nt, Human
cugaaugucgaucagcuugggu

SEQ ID NO: 631486 - RNA, 22 nt, Human
gugccaaaagcuauaauuuggu

SEQ ID NO: 631487 - RNA, 18 nt, Human
gcagcaaagggcccgggg

SEQ ID NO: 631488 - RNA, 22 nt, Human
ugccuggcaucuagcccuggga

SEQ ID NO: 631489 - RNA, 22 nt, Human
ggcuauggaagauaaggcugaa

SEQ ID NO: 631490 - RNA, 22 nt, Human
uuggaaggagccuaaaagagac

SEQ ID NO: 631491 - RNA, 22 nt, Human
cagggaugagcagauggagcaa

SEQ ID NO: 631492 - RNA, 22 nt, Human
cacugcaaccuccgccucuugg

SEQ ID NO: 631493 - RNA, 22 nt, Human
aaugauauuuauugaauagaug

SEQ ID NO: 631494 - RNA, 22 nt, Human
aaggcaauguuagcaacauaau

SEQ ID NO: 631495 - RNA, 22 nt, Human
gagcugggauuugaaccuggga

SEQ ID NO: 631496 - RNA, 18 nt, Human
agccugggcucugccugg

SEQ ID NO: 631497 - RNA, 23 nt, Human
aggcacugaaugugucagugagu

SEQ ID NO: 631498 - RNA, 22 nt, Human
aagcagguuaugaaauauagaa

SEQ ID NO: 631499 - RNA, 22 nt, Human
gugggguagaucuuucucagga

SEQ ID NO: 631500 - RNA, 19 nt, Human
uguaccugggucauggugc

SEQ ID NO: 631501 - RNA, 22 nt, Human
aaugaugggaaggagaaaagca

SEQ ID NO: 631502 - RNA, 22 nt, Human
aguugcucaauguggcugugga

SEQ ID NO: 631503 - RNA, 22 nt, Human
agacagaccauggcuauucaga

SEQ ID NO: 631504 - RNA, 22 nt, Human
augucugcggcccaggccaggg

SEQ ID NO: 631505 - RNA, 22 nt, Human
caguccuucauuccuccuuuga

SEQ ID NO: 631506 - RNA, 22 nt, Human
aaaggucagacuuaggcugggc

SEQ ID NO: 631507 - RNA, 22 nt, Human
cugcagauuggccugauguuca

SEQ ID NO: 631508 - RNA, 22 nt, Human
acccagucuggagugcagugac

SEQ ID NO: 631509 - RNA, 22 nt, Human
ucucuggcagggauaucuggcu

SEQ ID NO: 631510 - RNA, 22 nt, Human
uuggaagcccugugauaggcca

SEQ ID NO: 631511 - RNA, 22 nt, Human
aggaagggauacauaggauagu

SEQ ID NO: 631512 - RNA, 22 nt, Human
aaaugugauacuguucuuuuua

SEQ ID NO: 631513 - RNA, 22 nt, Human
uucugugaauggccaugacaag

SEQ ID NO: 631514 - RNA, 22 nt, Human
cuccaggccaagauuaaguaau

SEQ ID NO: 631515 - RNA, 22 nt, Human
cacugaacuccuuguuuguccu

SEQ ID NO: 631516 - RNA, 22 nt, Human
gcuggcuuuauggggcuugugg

SEQ ID NO: 631517 - RNA, 22 nt, Human
caccuuugcaaaccaaaucuga

SEQ ID NO: 631518 - RNA, 22 nt, Human
augcuuccuuuuucccuuaagg

SEQ ID NO: 631519 - RNA, 16 nt, Human
guucucucacuguacc

SEQ ID NO: 631520 - RNA, 22 nt, Human
gcucaccucgcugcaggugggu

SEQ ID NO: 631521 - RNA, 19 nt, Human
cuagggcuuggcagcaggc

SEQ ID NO: 631522 - RNA, 22 nt, Human
cuggggcccgagccuugggcca

SEQ ID NO: 631523 - RNA, 22 nt, Human
uacaugaagaaaauuaagcagu

SEQ ID NO: 631524 - RNA, 22 nt, Human
ugaucuuugguaguacgauaau

SEQ ID NO: 631525 - RNA, 22 nt, Human
ugauuuaaaagaaacauugucu

SEQ ID NO: 631526 - RNA, 22 nt, Human
agcacagggacaaugccaggug

SEQ ID NO: 631527 - RNA, 22 nt, Human
aaagcagguugcaauuacagug

SEQ ID NO: 631528 - RNA, 22 nt, Human
ucccacagugaaguucaugaua

SEQ ID NO: 631529 - RNA, 22 nt, Human
uggcaaggccacaggugcaguu

SEQ ID NO: 631530 - RNA, 16 nt, Human
ccucugggccugcaag

SEQ ID NO: 631531 - RNA, 22 nt, Human
auguuauggcucaaacauuugg

SEQ ID NO: 631532 - RNA, 22 nt, Human
uauucugugugauauguaaaug

SEQ ID NO: 631533 - RNA, 23 nt, Human
aaagcaaggaauuggcaacagag

SEQ ID NO: 631534 - RNA, 22 nt, Human
acccagcaugacaccugcacau

SEQ ID NO: 631535 - RNA, 22 nt, Human
uaugagauaauagauguguaaa

SEQ ID NO: 631536 - RNA, 22 nt, Human
acucugugcuggggaccucauc

SEQ ID NO: 631537 - RNA, 22 nt, Human
ucucagaacacccuucuauggu

SEQ ID NO: 631538 - RNA, 22 nt, Human
gugcucuguggauugaguugaa

SEQ ID NO: 631539 - RNA, 22 nt, Human
ucccugcacagccgagccaugc

SEQ ID NO: 631540 - RNA, 22 nt, Human
aauuaugagguagauaucacau

SEQ ID NO: 631541 - RNA, 22 nt, Human
gcagcugucgcuaggagcugug

SEQ ID NO: 631542 - RNA, 22 nt, Human
gguucauucugaagucuucagc

SEQ ID NO: 631543 - RNA, 20 nt, Human
uucaugcuggaggggcuggc

SEQ ID NO: 631544 - RNA, 22 nt, Human
ucucagugacacucuucauaca

SEQ ID NO: 631545 - RNA, 22 nt, Human
cagaaggcaaggccugccacgc

SEQ ID NO: 631546 - RNA, 22 nt, Human
ggaggaaauccuuaguaaggca

SEQ ID NO: 631547 - RNA, 22 nt, Human
uucauuaaguauaaaauguggu

SEQ ID NO: 631548 - RNA, 22 nt, Human
aaggucauggcaaauuacuuuu

SEQ ID NO: 631549 - RNA, 22 nt, Human
uggcagagugcagaagaggcau

SEQ ID NO: 631550 - RNA, 22 nt, Human
uauguacacauacacuuguaau

SEQ ID NO: 631551 - RNA, 22 nt, Human
gaacaguaucaguagugccagu

SEQ ID NO: 631552 - RNA, 22 nt, Human
agauuuccaucuuuuucaugug

SEQ ID NO: 631553 - RNA, 19 nt, Human
aaaguuuuauucucauuug

SEQ ID NO: 631554 - RNA, 22 nt, Human
caaucuuaguggcuuacaaaga

SEQ ID NO: 631555 - RNA, 21 nt, Human
gcaguuuauguaauaugcacu

SEQ ID NO: 631556 - RNA, 22 nt, Human
acaggcauauuucuagauuaca

SEQ ID NO: 631557 - RNA, 22 nt, Human
ggcaggcugggugucauggagu

SEQ ID NO: 631558 - RNA, 22 nt, Human
gaggccugguuuccagcauccu

SEQ ID NO: 631559 - RNA, 22 nt, Human
auauuacacacgguaucacggg

SEQ ID NO: 631560 - RNA, 22 nt, Human
uugaguguacuuuagucaucug

SEQ ID NO: 631561 - RNA, 22 nt, Human
gggcuccagcagaggcagccgg

SEQ ID NO: 631562 - RNA, 22 nt, Human
agggagagacauuuccuucuug

SEQ ID NO: 631563 - RNA, 22 nt, Human
aaaguggccauccucugcaucg

SEQ ID NO: 631564 - RNA, 23 nt, Human
ucucccugagguuguuagcauua

SEQ ID NO: 631565 - RNA, 22 nt, Human
ucaggacauuugucagcaggag

SEQ ID NO: 631566 - RNA, 22 nt, Human
auugcacaaagagggaaacuga

SEQ ID NO: 631567 - RNA, 22 nt, Human
gcccugugcuuggauggcagau

SEQ ID NO: 631568 - RNA, 22 nt, Human
uuacaugacaaagcuuuggcuc

SEQ ID NO: 631569 - RNA, 22 nt, Human
cgcaggggaggaagguacaccu

SEQ ID NO: 631570 - RNA, 22 nt, Human
ugcugaggucacggcggccaga

SEQ ID NO: 631571 - RNA, 22 nt, Human
ugcugaggacaccuagccuucu

SEQ ID NO: 631572 - RNA, 22 nt, Human
agguucagacgcauaauaggca

SEQ ID NO: 631573 - RNA, 22 nt, Human
ggcuugcuucuuguccaggaau

SEQ ID NO: 631574 - RNA, 23 nt, Human
ugucuggcucauggugggucuca

SEQ ID NO: 631575 - RNA, 22 nt, Human
uucacaaugccuuguugauggu

SEQ ID NO: 631576 - RNA, 22 nt, Human
ucugaaaacuccaugagcucgu

SEQ ID NO: 631577 - RNA, 22 nt, Human
cugaauaauuuuauaguugcug

SEQ ID NO: 631578 - RNA, 22 nt, Human
aaagagucuggcguuuuaaugg

SEQ ID NO: 631579 - RNA, 22 nt, Human
cagccugggcuccagagucccu

SEQ ID NO: 631580 - RNA, 22 nt, Human
gaucuguuauaaucucuuuuau

SEQ ID NO: 631581 - RNA, 19 nt, Human
uccagguggagagacaccc

SEQ ID NO: 631582 - RNA, 22 nt, Human
ugcaaggcuugcaauggugauc

SEQ ID NO: 631583 - RNA, 23 nt, Human
gagcagagcgggcggggguccug

SEQ ID NO: 631584 - RNA, 22 nt, Human
uagcagggucucaggagucagg

SEQ ID NO: 631585 - RNA, 22 nt, Human
uuauuaaugaguacaaguuauu

SEQ ID NO: 631586 - RNA, 22 nt, Human
gaucauuaacaaccuuacccuu

SEQ ID NO: 631587 - RNA, 22 nt, Human
gaaugcauucucuuagcaucua

SEQ ID NO: 631588 - RNA, 22 nt, Human
uccaccauguaacaagcucugu

SEQ ID NO: 631589 - RNA, 22 nt, Human
aaaggccuugagcugggugcca

SEQ ID NO: 631590 - RNA, 22 nt, Human
cugagcugugcuaagugaaaug

SEQ ID NO: 631591 - RNA, 22 nt, Human
uucacagauguauuggaacucc

SEQ ID NO: 631592 - RNA, 22 nt, Human
ugucucuucagcccauggcuuc

SEQ ID NO: 631593 - RNA, 22 nt, Human
ucaggcucagguuaggggccaa

SEQ ID NO: 631594 - RNA, 22 nt, Human
aaaugucauauuuaaguaggaa

SEQ ID NO: 631595 - RNA, 22 nt, Human
caugccaugugugaggagagga

SEQ ID NO: 631596 - RNA, 22 nt, Human
uugagaaauacuuuuguagccu

SEQ ID NO: 631597 - RNA, 22 nt, Human
agcugaggaauaauaacaaggu

SEQ ID NO: 631598 - RNA, 21 nt, Human
augguagguggagcaggugau

SEQ ID NO: 631599 - RNA, 22 nt, Human
ucuuugcagaauuuaacuuugc

SEQ ID NO: 631600 - RNA, 22 nt, Human
acaguguccuuguggucccugu

SEQ ID NO: 631601 - RNA, 20 nt, Human
auacacuugcccagcuugug

SEQ ID NO: 631602 - RNA, 22 nt, Human
aaacaaauagugcaugggaauu

SEQ ID NO: 631603 - RNA, 20 nt, Human
uuacacuuuguagcauuuuu

SEQ ID NO: 631604 - RNA, 22 nt, Human
agacagugauguaagcaggagu

SEQ ID NO: 631605 - RNA, 22 nt, Human
aaggucauuuaacaauuuauga

SEQ ID NO: 631606 - RNA, 22 nt, Human
auuuucuauguuguaauuguua

SEQ ID NO: 631607 - RNA, 22 nt, Human
ugacagagagaugggaaagggc

SEQ ID NO: 631608 - RNA, 22 nt, Human
gcagagccgugaauggauuuca

SEQ ID NO: 631609 - RNA, 22 nt, Human
gccaccucccaggacgaggcug

SEQ ID NO: 631610 - RNA, 22 nt, Human
uuucaucugugcugccaagacu

SEQ ID NO: 631611 - RNA, 22 nt, Human
uggcccugcuggccaaaggcua

SEQ ID NO: 631612 - RNA, 21 nt, Human
acccuggguucuccauacccu

SEQ ID NO: 631613 - RNA, 22 nt, Human
cuucccacuaaagcccuuguug

SEQ ID NO: 631614 - RNA, 22 nt, Human
aagucauuaucucuucuaaucu

SEQ ID NO: 631615 - RNA, 22 nt, Human
cagccacuguggaauagccccc

SEQ ID NO: 631616 - RNA, 22 nt, Human
ggcagagcugcaugagcacuca

SEQ ID NO: 631617 - RNA, 22 nt, Human
uaaagugugcauggucaaauau

SEQ ID NO: 631618 - RNA, 22 nt, Human
uuucucagucacaugaaccaau

SEQ ID NO: 631619 - RNA, 22 nt, Human
ucuguuuuagauaagaaaggcu

SEQ ID NO: 631620 - RNA, 22 nt, Human
uucugauuguuggaggaugcuu

SEQ ID NO: 631621 - RNA, 22 nt, Human
uuauuguuuacuaguuugcaga

SEQ ID NO: 631622 - RNA, 22 nt, Human
agcagcuggugcaacucuaaga

SEQ ID NO: 631623 - RNA, 22 nt, Human
caacuaauccuuugaaaagaag

SEQ ID NO: 631624 - RNA, 22 nt, Human
gaagcagagccuaaggcagaca

SEQ ID NO: 631625 - RNA, 21 nt, Human
gugcggaugccgucauuguca

SEQ ID NO: 631626 - RNA, 23 nt, Human
aagcuuccuugacuggccccuag

SEQ ID NO: 631627 - RNA, 22 nt, Human
aaucacauuugcccccauauuc

SEQ ID NO: 631628 - RNA, 22 nt, Human
uuuaacacuaguuucuuuaacu

SEQ ID NO: 631629 - RNA, 22 nt, Human
uucaggaaauuggaguccuucu

SEQ ID NO: 631630 - RNA, 22 nt, Human
acaguugguuaacacaaauauu

SEQ ID NO: 631631 - RNA, 22 nt, Human
cuccagauguauacuuuccaag

SEQ ID NO: 631632 - RNA, 22 nt, Human
ccugaggucagcgguucccaca

SEQ ID NO: 631633 - RNA, 22 nt, Human
augggcugacaagacaugcaua

SEQ ID NO: 631634 - RNA, 22 nt, Human
ucugaauaguauauugaaagca

SEQ ID NO: 631635 - RNA, 19 nt, Human
acuccagggaugacagaag

SEQ ID NO: 631636 - RNA, 22 nt, Human
gagauggagucuuuuucuguca

SEQ ID NO: 631637 - RNA, 21 nt, Human
aaaaucaccuuaggucacugg

SEQ ID NO: 631638 - RNA, 22 nt, Human
uuagagucaagcugcauguucu

SEQ ID NO: 631639 - RNA, 22 nt, Human
acaggaguagggcugguggaga

SEQ ID NO: 631640 - RNA, 22 nt, Human
aagguaaugaaacagcagcuaa

SEQ ID NO: 631641 - RNA, 21 nt, Human
agcuggcucucucuggagaga

SEQ ID NO: 631642 - RNA, 20 nt, Human
ugggcugaggaucaggugcc

SEQ ID NO: 631643 - RNA, 22 nt, Human
ggauucugccuuguugcuucaa

SEQ ID NO: 631644 - RNA, 22 nt, Human
ugaggacauugagacuggagac

SEQ ID NO: 631645 - RNA, 22 nt, Human
auuacuuucagaugugcuguaa

SEQ ID NO: 631646 - RNA, 22 nt, Human
auaaugcgccucagaaaacaga

SEQ ID NO: 631647 - RNA, 22 nt, Human
uggcugaauaaaauaugguguu

SEQ ID NO: 631648 - RNA, 22 nt, Human
uccaggaguccugggagugauu

SEQ ID NO: 631649 - RNA, 22 nt, Human
ccuucaaucagcagucuagcuu

SEQ ID NO: 631650 - RNA, 22 nt, Human
gccaguuccuguggagucagag

SEQ ID NO: 631651 - RNA, 22 nt, Human
cuucaaauacaaguagauuaug

SEQ ID NO: 631652 - RNA, 22 nt, Human
aagauacaucaaagcaaauugg

SEQ ID NO: 631653 - RNA, 22 nt, Human
agcagccacagucugggacagg

SEQ ID NO: 631654 - RNA, 22 nt, Human
cugggcugugguguggcccaaa

SEQ ID NO: 631655 - RNA, 21 nt, Human
ggccacaguuagggcucagga

SEQ ID NO: 631656 - RNA, 22 nt, Human
auacuagacuguucuguuauca

SEQ ID NO: 631657 - RNA, 22 nt, Human
cucucuggcuuggcacggagau

SEQ ID NO: 631658 - RNA, 21 nt, Human
uucugcuccagcuccucuggg

SEQ ID NO: 631659 - RNA, 21 nt, Human
uuucuucacuuugccccaugu

SEQ ID NO: 631660 - RNA, 22 nt, Human
uaaugcuuaauuuucacaagcc

SEQ ID NO: 631661 - RNA, 22 nt, Human
aaggcugaggcuggagaauuac

SEQ ID NO: 631662 - RNA, 17 nt, Human
caggugaccuggugaug

SEQ ID NO: 631663 - RNA, 22 nt, Human
ucagugugaauucauuuuagau

SEQ ID NO: 631664 - RNA, 18 nt, Human
agucucagcggaggagua

SEQ ID NO: 631665 - RNA, 22 nt, Human
aagaguucucagaaacgugggu

SEQ ID NO: 631666 - RNA, 22 nt, Human
cuguuuaugaagcugugguuua

SEQ ID NO: 631667 - RNA, 22 nt, Human
uacacaacugacaaccauucug

SEQ ID NO: 631668 - RNA, 22 nt, Human
ggcaggugaucuagagucaaua

SEQ ID NO: 631669 - RNA, 21 nt, Human
uuuguucaggcaaguuacagu

SEQ ID NO: 631670 - RNA, 20 nt, Human
aucuugggauugagauugcc

SEQ ID NO: 631671 - RNA, 22 nt, Human
caggcagccugcggucugcaca

SEQ ID NO: 631672 - RNA, 22 nt, Human
ucaaacaugaaagcuugauuuu

SEQ ID NO: 631673 - RNA, 22 nt, Human
agcauagaguccugagggcagg

SEQ ID NO: 631674 - RNA, 22 nt, Human
cugucagcacucuacuacagau

SEQ ID NO: 631675 - RNA, 22 nt, Human
uagugcuuaacacaaagugauu

SEQ ID NO: 631676 - RNA, 22 nt, Human
gggaaggcugccugagggaugg

SEQ ID NO: 631677 - RNA, 22 nt, Human
gugugugugcauauaacauaua

SEQ ID NO: 631678 - RNA, 19 nt, Human
cagagccucagagcuagaa

SEQ ID NO: 631679 - RNA, 22 nt, Human
aagacaucagugaugacauuug

SEQ ID NO: 631680 - RNA, 22 nt, Human
agacugaaacaaucugcaggca

SEQ ID NO: 631681 - RNA, 22 nt, Human
guccuggugcuggucauugucg

SEQ ID NO: 631682 - RNA, 22 nt, Human
gcuuccuugguccuggucuaag

SEQ ID NO: 631683 - RNA, 22 nt, Human
guaggcagguggaggagugaag

SEQ ID NO: 631684 - RNA, 22 nt, Human
uccagaaacugcugagauaaga

SEQ ID NO: 631685 - RNA, 22 nt, Human
cauuauguucaguagcuuaaaa

SEQ ID NO: 631686 - RNA, 22 nt, Human
gcaguguggccccaguaucacg

SEQ ID NO: 631687 - RNA, 21 nt, Human
cagugccagccacaggacgcc

SEQ ID NO: 631688 - RNA, 22 nt, Human
gaggugauuuucaaaagaacuu

SEQ ID NO: 631689 - RNA, 22 nt, Human
gauacacauuuuagcuuugucu

SEQ ID NO: 631690 - RNA, 19 nt, Human
guggcucauguagugggcc

SEQ ID NO: 631691 - RNA, 22 nt, Human
agcaggucuugcucucaacagg

SEQ ID NO: 631692 - RNA, 22 nt, Human
auauggaaguuaccugacuuca

SEQ ID NO: 631693 - RNA, 22 nt, Human
gugacucugcauuuuauggauc

SEQ ID NO: 631694 - RNA, 22 nt, Human
gcugccugggcuggcauuccca

SEQ ID NO: 631695 - RNA, 22 nt, Human
guuuaugaaauuucaggcauuu

SEQ ID NO: 631696 - RNA, 22 nt, Human
uguuacaaacuguuguuucuau

SEQ ID NO: 631697 - RNA, 18 nt, Human
cugaggcuuagagagguu

SEQ ID NO: 631698 - RNA, 22 nt, Human
cugggaggugaacagaaaaacu

SEQ ID NO: 631699 - RNA, 22 nt, Human
ccugccagugccucccacuggu

SEQ ID NO: 631700 - RNA, 22 nt, Human
aagaugugucucaucagggugu

SEQ ID NO: 631701 - RNA, 22 nt, Human
cuguagcagcugaccuggcuaa

SEQ ID NO: 631702 - RNA, 22 nt, Human
ucacaggaggacugaaagauau

SEQ ID NO: 631703 - RNA, 22 nt, Human
aagacaauuugauacuaguugc

SEQ ID NO: 631704 - RNA, 22 nt, Human
uccaggaguccuggguggcccc

SEQ ID NO: 631705 - RNA, 19 nt, Human
ugccccugcagucuaccca

SEQ ID NO: 631706 - RNA, 22 nt, Human
gaggauggauccgaccccuucc

SEQ ID NO: 631707 - RNA, 22 nt, Human
ucccagccggugccuggguccc

SEQ ID NO: 631708 - RNA, 22 nt, Human
auuggccauuugcauguauuau

SEQ ID NO: 631709 - RNA, 22 nt, Human
ggcuccugagaaugggccauca

SEQ ID NO: 631710 - RNA, 22 nt, Human
uuacuuugaugaucaaugagcg

SEQ ID NO: 631711 - RNA, 21 nt, Human
aacauuucugggagaacucac

SEQ ID NO: 631712 - RNA, 22 nt, Human
uauaggaaguaauuguugccug

SEQ ID NO: 631713 - RNA, 22 nt, Human
ucuguguccugcuagcugucuu

SEQ ID NO: 631714 - RNA, 21 nt, Human
agauuacaggugugauccacc

SEQ ID NO: 631715 - RNA, 22 nt, Human
aaggaagaagacucuuuacucc

SEQ ID NO: 631716 - RNA, 22 nt, Human
ccucuuugagauucaguuuucc

SEQ ID NO: 631717 - RNA, 22 nt, Human
gggauuugugggauggccagug

SEQ ID NO: 631718 - RNA, 22 nt, Human
cagcuuugccaaguaaggucuu

SEQ ID NO: 631719 - RNA, 22 nt, Human
aaggcaauaguauuaaacugga

SEQ ID NO: 631720 - RNA, 22 nt, Human
acugcugauuuuaggacuguua

SEQ ID NO: 631721 - RNA, 22 nt, Human
gggcacugcuuugcucugucac

SEQ ID NO: 631722 - RNA, 22 nt, Human
ucuuccagcuguaggaccuagg

SEQ ID NO: 631723 - RNA, 22 nt, Human
uucuucuccgaggagggcuggu

SEQ ID NO: 631724 - RNA, 22 nt, Human
agaagcugagaaugaauuaaga

SEQ ID NO: 631725 - RNA, 22 nt, Human
uuaugcuucccugaggaucuua

SEQ ID NO: 631726 - RNA, 22 nt, Human
acagcauccuucuaaaguagcu

SEQ ID NO: 631727 - RNA, 22 nt, Human
ugcauuugcaauggguacacaa

SEQ ID NO: 631728 - RNA, 21 nt, Human
uucacaguggauaacuuucug

SEQ ID NO: 631729 - RNA, 22 nt, Human
ugcccacugugucaaagaaaua

SEQ ID NO: 631730 - RNA, 22 nt, Human
ccaggccagcgcuggcuggagg

SEQ ID NO: 631731 - RNA, 22 nt, Human
ucacaucucucauugccucugc

SEQ ID NO: 631732 - RNA, 22 nt, Human
ugcuucagcacuuugagagccu

SEQ ID NO: 631733 - RNA, 22 nt, Human
gggagcuccacugccucucauu

SEQ ID NO: 631734 - RNA, 22 nt, Human
aagggcugcuguagaagcagag

SEQ ID NO: 631735 - RNA, 22 nt, Human
aauuuguggccacauuguggaa

SEQ ID NO: 631736 - RNA, 22 nt, Human
cccuggagucagguuggccugg

SEQ ID NO: 631737 - RNA, 22 nt, Human
ccaggcuggagugcaguagugu

SEQ ID NO: 631738 - RNA, 21 nt, Human
gcugccugccccucgggggcu

SEQ ID NO: 631739 - RNA, 22 nt, Human
ccagaggucucucuauacuggg

SEQ ID NO: 631740 - RNA, 22 nt, Human
augcagcugugggcaagaaaug

SEQ ID NO: 631741 - RNA, 22 nt, Human
uaaugucagcauaguuuauuuu

SEQ ID NO: 631742 - RNA, 22 nt, Human
auggcucagcgccuuucugugg

SEQ ID NO: 631743 - RNA, 22 nt, Human
gaguauauuucucucucuuaag

SEQ ID NO: 631744 - RNA, 22 nt, Human
gcagggaccugccacugcuguc

SEQ ID NO: 631745 - RNA, 22 nt, Human
augcuuccagauugguaggggu

SEQ ID NO: 631746 - RNA, 22 nt, Human
cagagcccugugugccauguga

SEQ ID NO: 631747 - RNA, 19 nt, Human
uugcagcaaaguuaggacc

SEQ ID NO: 631748 - RNA, 22 nt, Human
caacugaaaagauucuacgcag

SEQ ID NO: 631749 - RNA, 22 nt, Human
agcuguggaguaggggguugga

SEQ ID NO: 631750 - RNA, 22 nt, Human
uugcauaugaagcugacuuaaa

SEQ ID NO: 631751 - RNA, 22 nt, Human
uuucugacacaucaguuguaaa

SEQ ID NO: 631752 - RNA, 22 nt, Human
gagggugcaggcaagagcaaaa

SEQ ID NO: 631753 - RNA, 22 nt, Human
gggucuccuaauggaggaugac

SEQ ID NO: 631754 - RNA, 22 nt, Human
cucucccuaugccucccaggag

SEQ ID NO: 631755 - RNA, 22 nt, Human
accagagaugucuaauaggggc

SEQ ID NO: 631756 - RNA, 22 nt, Human
gacaguguuacaauuuaaugga

SEQ ID NO: 631757 - RNA, 22 nt, Human
uucucuggccugaggcgaggcc

SEQ ID NO: 631758 - RNA, 22 nt, Human
uuuauucucuaguuggucagau

SEQ ID NO: 631759 - RNA, 22 nt, Human
cuggagaaguacugagacauuu

SEQ ID NO: 631760 - RNA, 22 nt, Human
ucugggaaacacugcaucccca

SEQ ID NO: 631761 - RNA, 22 nt, Human
gcucccagggacacuggccacu

SEQ ID NO: 631762 - RNA, 22 nt, Human
agguagggaagaaggcaugaaa

SEQ ID NO: 631763 - RNA, 22 nt, Human
ucauauuuauauguuggcacag

SEQ ID NO: 631764 - RNA, 22 nt, Human
cucagggagguccugugcugaa

SEQ ID NO: 631765 - RNA, 22 nt, Human
cagucuccugggggcuguuguu

SEQ ID NO: 631766 - RNA, 22 nt, Human
cacuagaaagguacagauuaug

SEQ ID NO: 631767 - RNA, 22 nt, Human
gggcuccaaaauccuguagccu

SEQ ID NO: 631768 - RNA, 22 nt, Human
ugccaucucuuccucgugcugc

SEQ ID NO: 631769 - RNA, 22 nt, Human
gaugggguccuugaccuggcca

SEQ ID NO: 631770 - RNA, 22 nt, Human
augggcugggaauacacagggg

SEQ ID NO: 631771 - RNA, 22 nt, Human
uucauucuugucuuuguauagu

SEQ ID NO: 631772 - RNA, 22 nt, Human
ucacauuuuccuugguaucugu

SEQ ID NO: 631773 - RNA, 22 nt, Human
ucugcaggaaaaaagugccugg

SEQ ID NO: 631774 - RNA, 22 nt, Human
ugaggauuuaaugggacucauu

SEQ ID NO: 631775 - RNA, 22 nt, Human
agcagcaucuucuaaguaaggc

SEQ ID NO: 631776 - RNA, 22 nt, Human
ggagcuggcagcgcaacccaga

SEQ ID NO: 631777 - RNA, 22 nt, Human
aguggcucuccaagaagucaca

SEQ ID NO: 631778 - RNA, 22 nt, Human
aagucacacuagacaacugagg

SEQ ID NO: 631779 - RNA, 22 nt, Human
ccuggcugcugucacugaccau

SEQ ID NO: 631780 - RNA, 23 nt, Human
gcccugcugggaccuccugcuac

SEQ ID NO: 631781 - RNA, 22 nt, Human
ccucagaccccugcugagcuuc

SEQ ID NO: 631782 - RNA, 22 nt, Human
ucucagcaacgauccggaguaa

SEQ ID NO: 631783 - RNA, 20 nt, Human
ugugugaauuagggcauguu

SEQ ID NO: 631784 - RNA, 22 nt, Human
ggagauaguccaggugaaggga

SEQ ID NO: 631785 - RNA, 22 nt, Human
cuugagaacaggguuagguaac

SEQ ID NO: 631786 - RNA, 22 nt, Human
aagcucugcucagcagacuagg

SEQ ID NO: 631787 - RNA, 22 nt, Human
uugcuuuaccauuugaucucua

SEQ ID NO: 631788 - RNA, 22 nt, Human
guggagcccugccuugcucaug

SEQ ID NO: 631789 - RNA, 22 nt, Human
cucuccagguuagagcacuuau

SEQ ID NO: 631790 - RNA, 22 nt, Human
gugagcagcucaggguggucuc

SEQ ID NO: 631791 - RNA, 22 nt, Human
cugagggucaacuugauuguau

SEQ ID NO: 631792 - RNA, 22 nt, Human
agaaggggagaagcuaccagga

SEQ ID NO: 631793 - RNA, 22 nt, Human
uucaaaugguuagacuguuagc

SEQ ID NO: 631794 - RNA, 20 nt, Human
uacaggaccuucuuuguauc

SEQ ID NO: 631795 - RNA, 22 nt, Human
auguuucaggcgaacuaacaug

SEQ ID NO: 631796 - RNA, 22 nt, Human
gccuguuggguaacagaguuca

SEQ ID NO: 631797 - RNA, 23 nt, Human
uccaagaaguagggccuggacuu

SEQ ID NO: 631798 - RNA, 22 nt, Human
aaaucaguucucccuuucuuca

SEQ ID NO: 631799 - RNA, 22 nt, Human
cuguguucagugcuacugaguu

SEQ ID NO: 631800 - RNA, 22 nt, Human
caagaagcuuucccugcuugca

SEQ ID NO: 631801 - RNA, 22 nt, Human
auaaaggauaauccauuagacu

SEQ ID NO: 631802 - RNA, 22 nt, Human
ugggcucucuggcaggaaggcu

SEQ ID NO: 631803 - RNA, 22 nt, Human
ggagagguuauccguguuaugu

SEQ ID NO: 631804 - RNA, 22 nt, Human
caaguuacauuagaaaucaugc

SEQ ID NO: 631805 - RNA, 22 nt, Human
cugcuuuaacagaugauggugu

SEQ ID NO: 631806 - RNA, 22 nt, Human
uuuccuaguucuaagaaaugua

SEQ ID NO: 631807 - RNA, 22 nt, Human
cuggcagcauuaacagagagca

SEQ ID NO: 631808 - RNA, 22 nt, Human
ucugcugaauggagccaaccuc

SEQ ID NO: 631809 - RNA, 22 nt, Human
acugcagccuagggaccacagu

SEQ ID NO: 631810 - RNA, 22 nt, Human
cugaggcaggauggccuggcug

SEQ ID NO: 631811 - RNA, 21 nt, Human
ccagaugcaaaugcagacauu

SEQ ID NO: 631812 - RNA, 22 nt, Human
uaccauuucauucuuuccucau

SEQ ID NO: 631813 - RNA, 22 nt, Human
uaauuucuaauucauuuucagu

SEQ ID NO: 631814 - RNA, 22 nt, Human
ggacagcauaucagcagggcag

SEQ ID NO: 631815 - RNA, 20 nt, Human
cugggcagguguuugaucuc

SEQ ID NO: 631816 - RNA, 22 nt, Human
cuguggcuguauuuggccagag

SEQ ID NO: 631817 - RNA, 22 nt, Human
gggagaaggagcuaguucuuga

SEQ ID NO: 631818 - RNA, 20 nt, Human
cccugcagccaugggagugg

SEQ ID NO: 631819 - RNA, 22 nt, Human
cagucacuuacaaaaauauaau

SEQ ID NO: 631820 - RNA, 22 nt, Human
ucugggcucugcgaagcccuuc

SEQ ID NO: 631821 - RNA, 22 nt, Human
uagugcuuauuacugugcuguc

SEQ ID NO: 631822 - RNA, 22 nt, Human
aauuucaaugcacucaugguug

SEQ ID NO: 631823 - RNA, 22 nt, Human
augcacuucaagcaucucucug

SEQ ID NO: 631824 - RNA, 19 nt, Human
uugagcagugcuuagcacc

SEQ ID NO: 631825 - RNA, 22 nt, Human
aagauucugucaguuaggagga

SEQ ID NO: 631826 - RNA, 22 nt, Human
aggcaugaugugcaguggcaaa

SEQ ID NO: 631827 - RNA, 22 nt, Human
gcugugugcuaggauauguuuu

SEQ ID NO: 631828 - RNA, 22 nt, Human
uccuguuuccaauuuguugggu

SEQ ID NO: 631829 - RNA, 22 nt, Human
uucuucugagagaaaaagcuca

SEQ ID NO: 631830 - RNA, 22 nt, Human
uuucagacuguacuuugggguu

SEQ ID NO: 631831 - RNA, 22 nt, Human
ugggaggcccaggccuggcagg

SEQ ID NO: 631832 - RNA, 22 nt, Human
uuugacaugaaguagcuuauaa

SEQ ID NO: 631833 - RNA, 22 nt, Human
cagcacaggccugucuuugucu

SEQ ID NO: 631834 - RNA, 22 nt, Human
cagcauggacccaucgcugagu

SEQ ID NO: 631835 - RNA, 22 nt, Human
aauauggcuccauuccuuuagg

SEQ ID NO: 631836 - RNA, 22 nt, Human
uguguucaaucaccaaagguau

SEQ ID NO: 631837 - RNA, 22 nt, Human
uauggguauaaacagguccuaa

SEQ ID NO: 631838 - RNA, 22 nt, Human
ugucuccauagaguagcuugau

SEQ ID NO: 631839 - RNA, 22 nt, Human
guguuuaacaucugguuuauac

SEQ ID NO: 631840 - RNA, 22 nt, Human
ugucccuggagcuucugucccc

SEQ ID NO: 631841 - RNA, 22 nt, Human
uacaugcacaugaacaugugug

SEQ ID NO: 631842 - RNA, 22 nt, Human
cucuuugugcuauuaugauccu

SEQ ID NO: 631843 - RNA, 22 nt, Human
uaagauaaggaacauucuguga

SEQ ID NO: 631844 - RNA, 22 nt, Human
uggcuggauaucaggcaagggg

SEQ ID NO: 631845 - RNA, 23 nt, Human
uuccaagugcuuuacuuaauccu

SEQ ID NO: 631846 - RNA, 22 nt, Human
cacccacauggaaauucacagu

SEQ ID NO: 631847 - RNA, 22 nt, Human
cuucacugaguagucuagacuc

SEQ ID NO: 631848 - RNA, 22 nt, Human
cuucugggauuaauuuuuccug

SEQ ID NO: 631849 - RNA, 22 nt, Human
aaacauugaccucauccuggca

SEQ ID NO: 631850 - RNA, 22 nt, Human
ucaauagauuagguauuagauu

SEQ ID NO: 631851 - RNA, 22 nt, Human
ucagugaaguaauggugagaga

SEQ ID NO: 631852 - RNA, 22 nt, Human
ucugaggaaagagagugggaug

SEQ ID NO: 631853 - RNA, 22 nt, Human
agucagaguucuuggggagaca

SEQ ID NO: 631854 - RNA, 22 nt, Human
cacccauguuucccucugucuu

SEQ ID NO: 631855 - RNA, 22 nt, Human
uauacacaaggugugcauuugu

SEQ ID NO: 631856 - RNA, 22 nt, Human
uuagcuuuugagaaugauuucu

SEQ ID NO: 631857 - RNA, 18 nt, Human
cccagcuuagcgccccuc

SEQ ID NO: 631858 - RNA, 22 nt, Human
uugucugaaagaucauuacauu

SEQ ID NO: 631859 - RNA, 22 nt, Human
guucuucagauuccauuucagu

SEQ ID NO: 631860 - RNA, 22 nt, Human
uccuggcccacuccuagcuucu

SEQ ID NO: 631861 - RNA, 22 nt, Human
auccuugagaaaauaaaugacc

SEQ ID NO: 631862 - RNA, 22 nt, Human
cacuuuaugggaagcaaaaauu

SEQ ID NO: 631863 - RNA, 20 nt, Human
accuggcucucaggagcaac

SEQ ID NO: 631864 - RNA, 22 nt, Human
ccugccuucccagcuuggcuuu

SEQ ID NO: 631865 - RNA, 22 nt, Human
gcccagagagaugcuguagacc

SEQ ID NO: 631866 - RNA, 22 nt, Human
ucaagcaggguagcaagcuggu

SEQ ID NO: 631867 - RNA, 22 nt, Human
gucugaaacgcauuguuaucga

SEQ ID NO: 631868 - RNA, 22 nt, Human
aacuguucuucauuuucaguau

SEQ ID NO: 631869 - RNA, 22 nt, Human
acagagcauauaaagugcuuug

SEQ ID NO: 631870 - RNA, 22 nt, Human
auauagaaggugcuauuuacau

SEQ ID NO: 631871 - RNA, 22 nt, Human
ugugggcaggcccgggucugag

SEQ ID NO: 631872 - RNA, 22 nt, Human
accugguaaccugccugacuaa

SEQ ID NO: 631873 - RNA, 22 nt, Human
gagggcaguagccucguacccu

SEQ ID NO: 631874 - RNA, 22 nt, Human
uuucaguuacugcuauaucauu

SEQ ID NO: 631875 - RNA, 22 nt, Human
uuugcaauuugugcugcaaaug

SEQ ID NO: 631876 - RNA, 22 nt, Human
ccugcagcuuugccuccugaac

SEQ ID NO: 631877 - RNA, 22 nt, Human
gcaggccacugucuccucuggg

SEQ ID NO: 631878 - RNA, 22 nt, Human
agcaggagcauuuccaugauuc

SEQ ID NO: 631879 - RNA, 22 nt, Human
augaccaguguugcuggccccg

SEQ ID NO: 631880 - RNA, 22 nt, Human
gcagauggcucagacacugggg

SEQ ID NO: 631881 - RNA, 22 nt, Human
uaccuuggaggccaagcaguuu

SEQ ID NO: 631882 - RNA, 18 nt, Human
ugagcagaguaaggcuuu

SEQ ID NO: 631883 - RNA, 22 nt, Human
acuuauuuauucauucagcuca

SEQ ID NO: 631884 - RNA, 22 nt, Human
gggcaguggguggcugcagccu

SEQ ID NO: 631885 - RNA, 23 nt, Human
aggcauggcauggaugguggcuc

SEQ ID NO: 631886 - RNA, 22 nt, Human
aacaaaacauuugucuuguuuc

SEQ ID NO: 631887 - RNA, 22 nt, Human
uaggacaugcuacauaaauagg

SEQ ID NO: 631888 - RNA, 22 nt, Human
augaacaagagagggaagauuc

SEQ ID NO: 631889 - RNA, 22 nt, Human
aggaaucccgcaccagcugcug

SEQ ID NO: 631890 - RNA, 22 nt, Human
cagcaucuuucucuucuggagu

SEQ ID NO: 631891 - RNA, 22 nt, Human
caggcuccuuaucuuacaacuu

SEQ ID NO: 631892 - RNA, 23 nt, Human
gggagaauaugaggaugauggug

SEQ ID NO: 631893 - RNA, 22 nt, Human
gcagcagggugccagcuuugca

SEQ ID NO: 631894 - RNA, 22 nt, Human
acaaagugcacaagaugagaac

SEQ ID NO: 631895 - RNA, 22 nt, Human
acagagggucugggcacaggac

SEQ ID NO: 631896 - RNA, 22 nt, Human
ugucugggauguuggcagccac

SEQ ID NO: 631897 - RNA, 22 nt, Human
cugggccagauccagccucaca

SEQ ID NO: 631898 - RNA, 22 nt, Human
cagcaauaacucaaagccauuu

SEQ ID NO: 631899 - RNA, 22 nt, Human
ugucauuuauucucuuauucua

SEQ ID NO: 631900 - RNA, 22 nt, Human
gaguccaggcucagaaacccgu

SEQ ID NO: 631901 - RNA, 22 nt, Human
gcaccagccugagccucuugca

SEQ ID NO: 631902 - RNA, 22 nt, Human
uugcuuccuugagcuggucuga

SEQ ID NO: 631903 - RNA, 22 nt, Human
aagacagagacucugcaacagg

SEQ ID NO: 631904 - RNA, 22 nt, Human
aagcuggcaaacaagcaucauu

SEQ ID NO: 631905 - RNA, 23 nt, Human
gaguggggagaaauugguuaaac

SEQ ID NO: 631906 - RNA, 22 nt, Human
guguccugcauuggcucugccc

SEQ ID NO: 631907 - RNA, 18 nt, Human
guucccagauggugcuga

SEQ ID NO: 631908 - RNA, 22 nt, Human
agccagugacauacgauuggga

SEQ ID NO: 631909 - RNA, 22 nt, Human
uggggguccuccucugcuuaag

SEQ ID NO: 631910 - RNA, 22 nt, Human
ucaaaggaaacacaagcuucug

SEQ ID NO: 631911 - RNA, 22 nt, Human
uagggcuuugcucauccuaggu

SEQ ID NO: 631912 - RNA, 22 nt, Human
gcaggggcggcuggguuuccag

SEQ ID NO: 631913 - RNA, 22 nt, Human
uuuuacaagcugagucguuaaa

SEQ ID NO: 631914 - RNA, 22 nt, Human
uuaacaaaguaacgggaaaaga

SEQ ID NO: 631915 - RNA, 22 nt, Human
cucagagagugaauuccugccu

SEQ ID NO: 631916 - RNA, 19 nt, Human
aaauacagcagcuguuucc

SEQ ID NO: 631917 - RNA, 22 nt, Human
ucuuuacaguccucugucaauc

SEQ ID NO: 631918 - RNA, 22 nt, Human
uccaagggcagccauagaacuu

SEQ ID NO: 631919 - RNA, 22 nt, Human
ucagucucuggggcuucuguuu

SEQ ID NO: 631920 - RNA, 22 nt, Human
cacagaacaccaaagaaccuuc

SEQ ID NO: 631921 - RNA, 22 nt, Human
cauugcugcuuccaggcacagg

SEQ ID NO: 631922 - RNA, 22 nt, Human
ccugggagugucagacuugcuu

SEQ ID NO: 631923 - RNA, 22 nt, Human
ccucuggacuugggacagugag

SEQ ID NO: 631924 - RNA, 22 nt, Human
aagagcauuuuguaaaauccuu

SEQ ID NO: 631925 - RNA, 22 nt, Human
uuugagaagauaggggaauacu

SEQ ID NO: 631926 - RNA, 22 nt, Human
ucagguccuuuugguguauauu

SEQ ID NO: 631927 - RNA, 22 nt, Human
uagagcuggaaaacugcaggua

SEQ ID NO: 631928 - RNA, 22 nt, Human
gcagucaguaaggcagccagaa

SEQ ID NO: 631929 - RNA, 21 nt, Human
guccagagagccggcuccuga

SEQ ID NO: 631930 - RNA, 22 nt, Human
ugugugucagcccaagggccuu

SEQ ID NO: 631931 - RNA, 22 nt, Human
uuguacaaguuuugagcuuaag

SEQ ID NO: 631932 - RNA, 20 nt, Human
gaggaugcagacagagggca

SEQ ID NO: 631933 - RNA, 22 nt, Human
uucaucugcuucuuccuauucc

SEQ ID NO: 631934 - RNA, 18 nt, Human
cacauuuaccuggcuccc

SEQ ID NO: 631935 - RNA, 22 nt, Human
gugccucccgggaccaugcacu

SEQ ID NO: 631936 - RNA, 22 nt, Human
caggaaaaucugcccacacaag

SEQ ID NO: 631937 - RNA, 22 nt, Human
caucuuuugguaggagccgggc

SEQ ID NO: 631938 - RNA, 22 nt, Human
cuugugcaauugacauugaauc

SEQ ID NO: 631939 - RNA, 22 nt, Human
guacaauaacuagucuuauagu

SEQ ID NO: 631940 - RNA, 22 nt, Human
gugggccagcuuuucuccuggg

SEQ ID NO: 631941 - RNA, 22 nt, Human
auaucauuauguuaugagcaca

SEQ ID NO: 631942 - RNA, 22 nt, Human
aggucuggaaacagcagggaga

SEQ ID NO: 631943 - RNA, 22 nt, Human
agggauguaaauucuucuucuu

SEQ ID NO: 631944 - RNA, 22 nt, Human
uuucuucagccuucacaaccug

SEQ ID NO: 631945 - RNA, 22 nt, Human
guggcagggugcucaucaugca

SEQ ID NO: 631946 - RNA, 22 nt, Human
gucuuuggaggcacuguugagu

SEQ ID NO: 631947 - RNA, 22 nt, Human
ugcagcauugcaaagcagucuu

SEQ ID NO: 631948 - RNA, 22 nt, Human
aggcccugggcaguucuguagc

SEQ ID NO: 631949 - RNA, 22 nt, Human
aacacagucaguuccuggauca

SEQ ID NO: 631950 - RNA, 20 nt, Human
ggagggcagcugagaguugg

SEQ ID NO: 631951 - RNA, 22 nt, Human
augcaaucauauggcauacagc

SEQ ID NO: 631952 - RNA, 22 nt, Human
auucugggucugggugugauca

SEQ ID NO: 631953 - RNA, 20 nt, Human
gccuggaggcagagauaaag

SEQ ID NO: 631954 - RNA, 22 nt, Human
uggagcugagcaccuccagggc

SEQ ID NO: 631955 - RNA, 22 nt, Human
agccaucacuugagaaucuauu

SEQ ID NO: 631956 - RNA, 22 nt, Human
uaaugucaaggugauagauuug

SEQ ID NO: 631957 - RNA, 22 nt, Human
aagguaauauuuuucucucuaa

SEQ ID NO: 631958 - RNA, 20 nt, Human
ugcugcaguuucaugggacu

SEQ ID NO: 631959 - RNA, 22 nt, Human
ucuuagaaaaaugguauguuuu

SEQ ID NO: 631960 - RNA, 22 nt, Human
gccuggggcaugcagcugauac

SEQ ID NO: 631961 - RNA, 22 nt, Human
ucauucagguugggcaaguguc

SEQ ID NO: 631962 - RNA, 20 nt, Human
ccuccuggucaggugugcag

SEQ ID NO: 631963 - RNA, 22 nt, Human
uucuguuuugcacagacuugaa

SEQ ID NO: 631964 - RNA, 22 nt, Human
aagccaauguugccuggguuuc

SEQ ID NO: 631965 - RNA, 22 nt, Human
ccuuuuucaauauagaauugca

SEQ ID NO: 631966 - RNA, 22 nt, Human
agaagauuuagguugacgcuau

SEQ ID NO: 631967 - RNA, 20 nt, Human
caccagcagcagcugccacc

SEQ ID NO: 631968 - RNA, 21 nt, Human
ugauuuccagaaaauuggccc

SEQ ID NO: 631969 - RNA, 22 nt, Human
ugucaugguagcugaaggaugu

SEQ ID NO: 631970 - RNA, 18 nt, Human
ugcaucauuuauggguca

SEQ ID NO: 631971 - RNA, 22 nt, Human
uacauacaguggaugcuuuagg

SEQ ID NO: 631972 - RNA, 22 nt, Human
cuccugggggacagcggcaggg

SEQ ID NO: 631973 - RNA, 22 nt, Human
gcuguggcugaccaccaggggg

SEQ ID NO: 631974 - RNA, 22 nt, Human
aggguggcaccuggaagggaug

SEQ ID NO: 631975 - RNA, 22 nt, Human
uagcaaauacaugauguaauuu

SEQ ID NO: 631976 - RNA, 22 nt, Human
gagcacugaggaaagcugguua

SEQ ID NO: 631977 - RNA, 22 nt, Human
ccaggccauucccagaguugcu

SEQ ID NO: 631978 - RNA, 22 nt, Human
gguccccagcaguggcugcuuc

SEQ ID NO: 631979 - RNA, 22 nt, Human
cagagccucagaauccugugga

SEQ ID NO: 631980 - RNA, 22 nt, Human
ucaaaaauggucuuugagcugc

SEQ ID NO: 631981 - RNA, 22 nt, Human
ugccacagaggugaagcccacu

SEQ ID NO: 631982 - RNA, 22 nt, Human
ugaguauccuauaugguguaag

SEQ ID NO: 631983 - RNA, 22 nt, Human
uguuccugacggccaaagaggu

SEQ ID NO: 631984 - RNA, 22 nt, Human
aaggccacugaagaaaucacaa

SEQ ID NO: 631985 - RNA, 22 nt, Human
augugcuucauaaucuucucau

SEQ ID NO: 631986 - RNA, 22 nt, Human
ccacagggacuguuaaaacccu

SEQ ID NO: 631987 - RNA, 22 nt, Human
agaugaagauaucugcaggggc

SEQ ID NO: 631988 - RNA, 22 nt, Human
guguccuuuugaggguccacag

SEQ ID NO: 631989 - RNA, 22 nt, Human
agcauacuugacacuucucuau

SEQ ID NO: 631990 - RNA, 22 nt, Human
accugagggcccaaacuuggua

SEQ ID NO: 631991 - RNA, 19 nt, Human
aguguguacugaaagcacu

SEQ ID NO: 631992 - RNA, 22 nt, Human
gggcagugacaaaggggaugaa

SEQ ID NO: 631993 - RNA, 22 nt, Human
ucugcucugagagggccaucag

SEQ ID NO: 631994 - RNA, 22 nt, Human
ugcauugaucauauccuuccug

SEQ ID NO: 631995 - RNA, 22 nt, Human
acuggcuguggccacggcugcu

SEQ ID NO: 631996 - RNA, 22 nt, Human
cugucaccugccagcauaccca

SEQ ID NO: 631997 - RNA, 22 nt, Human
acucuggcagcagaaccagugu

SEQ ID NO: 631998 - RNA, 22 nt, Human
gcucccaggaagagaagggcca

SEQ ID NO: 631999 - RNA, 22 nt, Human
uugggaaggcguggaagcagaa

SEQ ID NO: 632000 - RNA, 22 nt, Human
agagcuccucacuucggguuca

SEQ ID NO: 632001 - RNA, 22 nt, Human
uuccuuaggcuguuugcagugc

SEQ ID NO: 632002 - RNA, 19 nt, Human
ccugugcuaggagcugacc

SEQ ID NO: 632003 - RNA, 22 nt, Human
agacuccaggagggaggcugcu

SEQ ID NO: 632004 - RNA, 22 nt, Human
gagcuggaagucuguggucaga

SEQ ID NO: 632005 - RNA, 22 nt, Human
gaaccucuuuagugcauccuuc

SEQ ID NO: 632006 - RNA, 22 nt, Human
ggcccagaauacuuuguaaaau

SEQ ID NO: 632007 - RNA, 22 nt, Human
ggaggggagauguuugggcuca

SEQ ID NO: 632008 - RNA, 22 nt, Human
uucucugaaggccaugcucacu

SEQ ID NO: 632009 - RNA, 22 nt, Human
ucccuggcuguguucaggugcg

SEQ ID NO: 632010 - RNA, 22 nt, Human
cagucacauggaugauggauag

SEQ ID NO: 632011 - RNA, 22 nt, Human
acaggcaagaggaaagcaagua

SEQ ID NO: 632012 - RNA, 22 nt, Human
acugagguaauugugaggauua

SEQ ID NO: 632013 - RNA, 22 nt, Human
guggccagaggucccauguguc

SEQ ID NO: 632014 - RNA, 22 nt, Human
cauccauaugaggcacauuggu

SEQ ID NO: 632015 - RNA, 22 nt, Human
gaguggcuguguacaugcccag

SEQ ID NO: 632016 - RNA, 22 nt, Human
ucugccugugguggaggaaguu

SEQ ID NO: 632017 - RNA, 19 nt, Human
ggacuugguuuccaggcuc

SEQ ID NO: 632018 - RNA, 22 nt, Human
uugucugcuccucccagccuca

SEQ ID NO: 632019 - RNA, 22 nt, Human
gaaggcugucagagaggagggc

SEQ ID NO: 632020 - RNA, 22 nt, Human
caugucuuccuugcacacacac

SEQ ID NO: 632021 - RNA, 22 nt, Human
gcagcagaaggccaaggggagc

SEQ ID NO: 632022 - RNA, 23 nt, Human
cugcagagaacugagggacagcc

SEQ ID NO: 632023 - RNA, 18 nt, Human
acaggcuauugcaggaga

SEQ ID NO: 632024 - RNA, 22 nt, Human
uccagccaggauggcccaggga

SEQ ID NO: 632025 - RNA, 17 nt, Human
ggcuggaggggacccgg

SEQ ID NO: 632026 - RNA, 22 nt, Human
uguggcaggcuaggcuuuuugg

SEQ ID NO: 632027 - RNA, 22 nt, Human
ggcauguuucaucacaucaaga

SEQ ID NO: 632028 - RNA, 22 nt, Human
cuacauuuuucaccgagccucu

SEQ ID NO: 632029 - RNA, 22 nt, Human
cugugcuugcggguguggagcc

SEQ ID NO: 632030 - RNA, 22 nt, Human
uuacaacagacacauauucuaa

SEQ ID NO: 632031 - RNA, 22 nt, Human
accagacacugugaagacaggc

SEQ ID NO: 632032 - RNA, 22 nt, Human
augaaacacacacgcgcauacu

SEQ ID NO: 632033 - RNA, 22 nt, Human
ggcaccugguaagugcucagua

SEQ ID NO: 632034 - RNA, 21 nt, Human
ugcauuccuccauccaacagg

SEQ ID NO: 632035 - RNA, 22 nt, Human
agaacaggaggaagccagcucc

SEQ ID NO: 632036 - RNA, 22 nt, Human
cuguccugaguucuuggagguc

SEQ ID NO: 632037 - RNA, 22 nt, Human
cugcagcuauauuuucccacag

SEQ ID NO: 632038 - RNA, 22 nt, Human
acagcugugacuuagagaaguu

SEQ ID NO: 632039 - RNA, 22 nt, Human
ugcugucccuaagucucuucaa

SEQ ID NO: 632040 - RNA, 22 nt, Human
cuguuacacggaccuucaaauc

SEQ ID NO: 632041 - RNA, 22 nt, Human
uuugcagaugagaaaacugugg

SEQ ID NO: 632042 - RNA, 22 nt, Human
agccaccuucuccaaggccuag

SEQ ID NO: 632043 - RNA, 22 nt, Human
ugagggugcauuuagcauguag

SEQ ID NO: 632044 - RNA, 22 nt, Human
uugcuguuuaaugaugucuuau

SEQ ID NO: 632045 - RNA, 21 nt, Human
uuuguucaggggcaaaguuaa

SEQ ID NO: 632046 - RNA, 22 nt, Human
gcagaugccacuaggugaagug

SEQ ID NO: 632047 - RNA, 22 nt, Human
ucuggagcuggagggcaaggca

SEQ ID NO: 632048 - RNA, 22 nt, Human
ucuuugcaugugcuucuuggcc

SEQ ID NO: 632049 - RNA, 22 nt, Human
gaaauguacuuuaaagccaucc

SEQ ID NO: 632050 - RNA, 22 nt, Human
uuuagaaauucaucuauggccu

SEQ ID NO: 632051 - RNA, 22 nt, Human
uuuguauuccauaucaugccau

SEQ ID NO: 632052 - RNA, 22 nt, Human
gcuccuggugcuguagagauuu

SEQ ID NO: 632053 - RNA, 22 nt, Human
uugcuuuacuuugccauucguu

SEQ ID NO: 632054 - RNA, 22 nt, Human
cugagcuguuacucuguccucg

SEQ ID NO: 632055 - RNA, 22 nt, Human
ugguaaaguugauuggugcucu

SEQ ID NO: 632056 - RNA, 18 nt, Human
ucauuauuguuucuggag

SEQ ID NO: 632057 - RNA, 22 nt, Human
auucacaaugauacauaagcga

SEQ ID NO: 632058 - RNA, 22 nt, Human
cacaugagguggagaugaauga

SEQ ID NO: 632059 - RNA, 22 nt, Human
cugggacuuguagucucggcgc

SEQ ID NO: 632060 - RNA, 22 nt, Human
caguacaauuuuacaaaggacg

SEQ ID NO: 632061 - RNA, 22 nt, Human
ugugaggcgaggccagugagcu

SEQ ID NO: 632062 - RNA, 22 nt, Human
gagcagacgcugcagucuuggg

SEQ ID NO: 632063 - RNA, 22 nt, Human
acauccauuugucagcucuuga

SEQ ID NO: 632064 - RNA, 22 nt, Human
aagcugcagacccccugucuca

SEQ ID NO: 632065 - RNA, 22 nt, Human
gggcacagagaagguuuuagug

SEQ ID NO: 632066 - RNA, 22 nt, Human
guggcagaacuaugugauugcu

SEQ ID NO: 632067 - RNA, 22 nt, Human
cucagcaacccacacacggucu

SEQ ID NO: 632068 - RNA, 22 nt, Human
gcauguuuugcaacaagugacc

SEQ ID NO: 632069 - RNA, 22 nt, Human
cgaggcggcggaagugcccgua

SEQ ID NO: 632070 - RNA, 20 nt, Human
acuguuggaaguggagaaug

SEQ ID NO: 632071 - RNA, 22 nt, Human
gauggcuucacuuacauggcug

SEQ ID NO: 632072 - RNA, 22 nt, Human
auccugggcugcacccucagcc

SEQ ID NO: 632073 - RNA, 22 nt, Human
aaauacuagaauucagaguuga

SEQ ID NO: 632074 - RNA, 21 nt, Human
accaaaaccuauacuuucugu

SEQ ID NO: 632075 - RNA, 22 nt, Human
ucagugcuuauauucugagccu

SEQ ID NO: 632076 - RNA, 22 nt, Human
accuggccauccagcuggcauc

SEQ ID NO: 632077 - RNA, 22 nt, Human
cagcuuugugcaaugcagucuc

SEQ ID NO: 632078 - RNA, 22 nt, Human
ugauucaucagaauaggaguuu

SEQ ID NO: 632079 - RNA, 22 nt, Human
uugauguaaagugauucauggg

SEQ ID NO: 632080 - RNA, 22 nt, Human
uuugugugcuugguauugaaga

SEQ ID NO: 632081 - RNA, 22 nt, Human
ugcuuaaacauccagacaguau

SEQ ID NO: 632082 - RNA, 22 nt, Human
ccuggcugcauuuugcuggaug

SEQ ID NO: 632083 - RNA, 22 nt, Human
gguggagcuggaccaggagagg

SEQ ID NO: 632084 - RNA, 22 nt, Human
aagcaaggccggaaggaaacuc

SEQ ID NO: 632085 - RNA, 22 nt, Human
agagcacagccaccauuuacaa

SEQ ID NO: 632086 - RNA, 22 nt, Human
ccagagcagggcagcagggcuc

SEQ ID NO: 632087 - RNA, 22 nt, Human
aauaucucaccaugacaaagca

SEQ ID NO: 632088 - RNA, 22 nt, Human
auuugucauguauguaaaguug

SEQ ID NO: 632089 - RNA, 22 nt, Human
agaggugacauaggagaggcuc

SEQ ID NO: 632090 - RNA, 22 nt, Human
gaggcuccccaugaggccccag

SEQ ID NO: 632091 - RNA, 20 nt, Human
cacguuuuuccacuagcaaa

SEQ ID NO: 632092 - RNA, 22 nt, Human
augaauuguaaauuccuugaaa

SEQ ID NO: 632093 - RNA, 20 nt, Human
ucacaauaugagcucauaca

SEQ ID NO: 632094 - RNA, 22 nt, Human
ugggagcagcuuugcgagggag

SEQ ID NO: 632095 - RNA, 22 nt, Human
gcucugagagugggugauucug

SEQ ID NO: 632096 - RNA, 22 nt, Human
auggaauuaauaggggaauacu

SEQ ID NO: 632097 - RNA, 22 nt, Human
aagcacaugaaaaugugaagcu

SEQ ID NO: 632098 - RNA, 22 nt, Human
gacaggaagucugaaggaggga

SEQ ID NO: 632099 - RNA, 22 nt, Human
cccagcacaggcaauuccauac

SEQ ID NO: 632100 - RNA, 22 nt, Human
aucuguguaugaaaguauaacu

SEQ ID NO: 632101 - RNA, 22 nt, Human
agcucugacaaggauuuucugc

SEQ ID NO: 632102 - RNA, 22 nt, Human
cugccacuuuggagugcucaga

SEQ ID NO: 632103 - RNA, 22 nt, Human
aagaacuuccuaauauauuuuc

SEQ ID NO: 632104 - RNA, 22 nt, Human
ggccaccucugcccuaccgagu

SEQ ID NO: 632105 - RNA, 22 nt, Human
aaucucuuuggcucaaggaucc

SEQ ID NO: 632106 - RNA, 22 nt, Human
guccuucuuuucaucccugguu

SEQ ID NO: 632107 - RNA, 22 nt, Human
uggccacaguguccagcagcag

SEQ ID NO: 632108 - RNA, 22 nt, Human
ggagugggaacaaugacauggu

SEQ ID NO: 632109 - RNA, 22 nt, Human
cugccugugauuuuucucuagu

SEQ ID NO: 632110 - RNA, 22 nt, Human
uugaauaggacucagcagugau

SEQ ID NO: 632111 - RNA, 22 nt, Human
gaccuggccugcacagcccuua

SEQ ID NO: 632112 - RNA, 22 nt, Human
acacuacaaucucagaacuaua

SEQ ID NO: 632113 - RNA, 22 nt, Human
cagcucuguaaauuccuucauc

SEQ ID NO: 632114 - RNA, 22 nt, Human
uguuaugugccacacuugaggg

SEQ ID NO: 632115 - RNA, 22 nt, Human
ucagggagaggugagagccugu

SEQ ID NO: 632116 - RNA, 19 nt, Human
uggagacugagagugagca

SEQ ID NO: 632117 - RNA, 22 nt, Human
uguauacaagucguguaaacuu

SEQ ID NO: 632118 - RNA, 22 nt, Human
ccaggguugguauucaccugga

SEQ ID NO: 632119 - RNA, 22 nt, Human
aaaacccuucugcagacucuga

SEQ ID NO: 632120 - RNA, 22 nt, Human
uugcaaauauuguuuaccuuuc

SEQ ID NO: 632121 - RNA, 22 nt, Human
acugagaggugauagugacauu

SEQ ID NO: 632122 - RNA, 22 nt, Human
ccugagcagggcucugcagggc

SEQ ID NO: 632123 - RNA, 22 nt, Human
uucuucaggauacgucauccag

SEQ ID NO: 632124 - RNA, 22 nt, Human
aaauuccauuuugugacuauuc

SEQ ID NO: 632125 - RNA, 22 nt, Human
acaaagucuuuuacaacaguca

SEQ ID NO: 632126 - RNA, 22 nt, Human
uugaggccccauggaugagaac

SEQ ID NO: 632127 - RNA, 22 nt, Human
gaggcucacuuucauccucuuc

SEQ ID NO: 632128 - RNA, 22 nt, Human
cagauaaauagauagauaaacu

SEQ ID NO: 632129 - RNA, 22 nt, Human
ccugccacuguaggugacaguu

SEQ ID NO: 632130 - RNA, 18 nt, Human
ucccuucucccuugccuc

SEQ ID NO: 632131 - RNA, 22 nt, Human
gccugugguuugauuaagcauu

SEQ ID NO: 632132 - RNA, 22 nt, Human
gcucugcugagauaucugggag

SEQ ID NO: 632133 - RNA, 21 nt, Human
uggacuggugaguuuaggcug

SEQ ID NO: 632134 - RNA, 22 nt, Human
agaguccacccuggggucaggc

SEQ ID NO: 632135 - RNA, 22 nt, Human
ugggacuucaaugcaaugaggu

SEQ ID NO: 632136 - RNA, 22 nt, Human
auguuuuuggaaaugggaacau

SEQ ID NO: 632137 - RNA, 22 nt, Human
cagucuguuucugagaaacaga

SEQ ID NO: 632138 - RNA, 20 nt, Human
cagagaccaggccagguguc

SEQ ID NO: 632139 - RNA, 22 nt, Human
uagucaccuuuggcaccugcaa

SEQ ID NO: 632140 - RNA, 22 nt, Human
agcagcauccccggccuccacc

SEQ ID NO: 632141 - RNA, 22 nt, Human
accagagauggggcuucucugu

SEQ ID NO: 632142 - RNA, 16 nt, Human
guaaaggcagggaauu

SEQ ID NO: 632143 - RNA, 19 nt, Human
uuuuggaaaugugaacagc

SEQ ID NO: 632144 - RNA, 22 nt, Human
ggcuugaagggaggaaagcagg

SEQ ID NO: 632145 - RNA, 21 nt, Human
auuagaagguauuuagggccu

SEQ ID NO: 632146 - RNA, 22 nt, Human
agccacagagcaggagaccuuu

SEQ ID NO: 632147 - RNA, 22 nt, Human
ggggagcaauugcccccuuaga

SEQ ID NO: 632148 - RNA, 22 nt, Human
aacacaugccuuaagaauaagu

SEQ ID NO: 632149 - RNA, 22 nt, Human
auagacaaucccccauccuacc

SEQ ID NO: 632150 - RNA, 22 nt, Human
ucacuggauccuagcugagccu

SEQ ID NO: 632151 - RNA, 22 nt, Human
guggagagcaaauaauuggaau

SEQ ID NO: 632152 - RNA, 22 nt, Human
uuucuuaguccuagagugauuu

SEQ ID NO: 632153 - RNA, 22 nt, Human
cccagcccagcguucgaggggu

SEQ ID NO: 632154 - RNA, 22 nt, Human
ugagcagggacuuuggagucug

SEQ ID NO: 632155 - RNA, 23 nt, Human
gggugcugccuguagucaugcug

SEQ ID NO: 632156 - RNA, 22 nt, Human
cuccuccagacuuacugaaucc

SEQ ID NO: 632157 - RNA, 22 nt, Human
cagaauucgaaugagcagaauc

SEQ ID NO: 632158 - RNA, 22 nt, Human
cugaggcuaguauaaagagcau

SEQ ID NO: 632159 - RNA, 22 nt, Human
ccugccugcaccuucucugggg

SEQ ID NO: 632160 - RNA, 22 nt, Human
acagcagugucugguacugagu

SEQ ID NO: 632161 - RNA, 22 nt, Human
cagcgucucguugugggccucg

SEQ ID NO: 632162 - RNA, 22 nt, Human
aauguacaauaagacaaagagg

SEQ ID NO: 632163 - RNA, 22 nt, Human
gagcugugagggacacauugcu

SEQ ID NO: 632164 - RNA, 22 nt, Human
uauuccuggguuccagcccaga

SEQ ID NO: 632165 - RNA, 22 nt, Human
caaggcugugcaggguccauau

SEQ ID NO: 632166 - RNA, 22 nt, Human
cauucaaauuaagauuuuguua

SEQ ID NO: 632167 - RNA, 22 nt, Human
ccagcugagaaguguaaaguga

SEQ ID NO: 632168 - RNA, 22 nt, Human
gaguuaaauagcuuaggauuca

SEQ ID NO: 632169 - RNA, 19 nt, Human
ugagugggagcccagguau

SEQ ID NO: 632170 - RNA, 21 nt, Human
uuuggcuucucugcugcagcc

SEQ ID NO: 632171 - RNA, 19 nt, Human
cucuuuccauuguauuugc

SEQ ID NO: 632172 - RNA, 22 nt, Human
aggaagcuuggggcagggcuac

SEQ ID NO: 632173 - RNA, 22 nt, Human
uuccaugcaagaaguauggcuc

SEQ ID NO: 632174 - RNA, 22 nt, Human
ccaggcaccauguucuuaggac

SEQ ID NO: 632175 - RNA, 22 nt, Human
cugagaaaagcuuucuuauaca

SEQ ID NO: 632176 - RNA, 22 nt, Human
uggcagccacaucucguggauu

SEQ ID NO: 632177 - RNA, 22 nt, Human
gucugggcaccuggccugggaa

SEQ ID NO: 632178 - RNA, 22 nt, Human
ucacugaugcuuaugaaagugu

SEQ ID NO: 632179 - RNA, 22 nt, Human
uccaggcagagcaacaaaauau

SEQ ID NO: 632180 - RNA, 22 nt, Human
gagagcugaggggccuggcacu

SEQ ID NO: 632181 - RNA, 22 nt, Human
ccugggauuuccugagcacucu

SEQ ID NO: 632182 - RNA, 22 nt, Human
uuacaacagcgauuuaccuguc

SEQ ID NO: 632183 - RNA, 22 nt, Human
gauuucuugauaaguaguguga

SEQ ID NO: 632184 - RNA, 22 nt, Human
uuggaauucaaguuguagcuua

SEQ ID NO: 632185 - RNA, 22 nt, Human
cuaaaugauggauuuaaacuuu

SEQ ID NO: 632186 - RNA, 22 nt, Human
gcugggaggaucucucccuguc

SEQ ID NO: 632187 - RNA, 17 nt, Human
uucaaugauuaaugcau

SEQ ID NO: 632188 - RNA, 22 nt, Human
gacagggacucccugguuagaa

SEQ ID NO: 632189 - RNA, 22 nt, Human
aggcagaugggagcuggaaguu

SEQ ID NO: 632190 - RNA, 17 nt, Human
agaaagaggauccacag

SEQ ID NO: 632191 - RNA, 22 nt, Human
augaggcaguacacacaaagcc

SEQ ID NO: 632192 - RNA, 22 nt, Human
ggcagggaaacagcugauccca

SEQ ID NO: 632193 - RNA, 22 nt, Human
uugcauaaaagaguauaucuua

SEQ ID NO: 632194 - RNA, 22 nt, Human
uggaauguuguguauaggucag

SEQ ID NO: 632195 - RNA, 22 nt, Human
cagcagcucccauccgcugagc

SEQ ID NO: 632196 - RNA, 22 nt, Human
ucccacagugguacagcccuga

SEQ ID NO: 632197 - RNA, 20 nt, Human
acagucagggaauagaaaaa

SEQ ID NO: 632198 - RNA, 22 nt, Human
ggcuggucaggaaacuaggcuc

SEQ ID NO: 632199 - RNA, 22 nt, Human
uuguuacuguucuacauacagu

SEQ ID NO: 632200 - RNA, 22 nt, Human
auauuugucaauucacuguuca

SEQ ID NO: 632201 - RNA, 22 nt, Human
cucagggcggcgggcagcccag

SEQ ID NO: 632202 - RNA, 19 nt, Human
uuugaugagaauuuaagca

SEQ ID NO: 632203 - RNA, 22 nt, Human
auuaaggaacaaagccuuuuga

SEQ ID NO: 632204 - RNA, 22 nt, Human
gccugcaggcuguaguuuguga

SEQ ID NO: 632205 - RNA, 22 nt, Human
ucaggagcucaggcugauggaa

SEQ ID NO: 632206 - RNA, 22 nt, Human
ucacacacauuugcugucugau

SEQ ID NO: 632207 - RNA, 22 nt, Human
cuuuccuaguuggucccagcac

SEQ ID NO: 632208 - RNA, 22 nt, Human
uccugugugggcaggaugagaa

SEQ ID NO: 632209 - RNA, 22 nt, Human
guccugugcccuggguggcgcu

SEQ ID NO: 632210 - RNA, 22 nt, Human
aaggcagucugguuucaaagca

SEQ ID NO: 632211 - RNA, 22 nt, Human
ucagacauggggagagagaccu

SEQ ID NO: 632212 - RNA, 22 nt, Human
gugaacauugaggcagaaagga

SEQ ID NO: 632213 - RNA, 19 nt, Human
ucugggaagccgggcucca

SEQ ID NO: 632214 - RNA, 19 nt, Human
cugugucacauuuaugaaa

SEQ ID NO: 632215 - RNA, 22 nt, Human
gagagaacacaaagggccagcu

SEQ ID NO: 632216 - RNA, 22 nt, Human
uuugcaaaguuauuuagacuca

SEQ ID NO: 632217 - RNA, 22 nt, Human
uucuucugccucccaccugaua

SEQ ID NO: 632218 - RNA, 22 nt, Human
gguccagggaacuuugaaggau

SEQ ID NO: 632219 - RNA, 22 nt, Human
cgaggccaugcaugcugaggac

SEQ ID NO: 632220 - RNA, 22 nt, Human
agucuggaccugcugggucucc

SEQ ID NO: 632221 - RNA, 21 nt, Human
accuucaagccagaggugguc

SEQ ID NO: 632222 - RNA, 22 nt, Human
uuguguacuguugguugauauu

SEQ ID NO: 632223 - RNA, 22 nt, Human
guugccguuuguucuaccagac

SEQ ID NO: 632224 - RNA, 22 nt, Human
aaucagaaccuugggucauaac

SEQ ID NO: 632225 - RNA, 22 nt, Human
cuggaagaggaagccagcugga

SEQ ID NO: 632226 - RNA, 22 nt, Human
aaggcuggcaauauauuuguua

SEQ ID NO: 632227 - RNA, 22 nt, Human
auagcacuuauagauuuggucu

SEQ ID NO: 632228 - RNA, 22 nt, Human
aaguaucucaaaaacaguaauc

SEQ ID NO: 632229 - RNA, 22 nt, Human
uuggccuuugucaucaagauca

SEQ ID NO: 632230 - RNA, 18 nt, Human
cuggauuaagacagugcu

SEQ ID NO: 632231 - RNA, 22 nt, Human
caugcagaggugccacgaggcu

SEQ ID NO: 632232 - RNA, 18 nt, Human
gaacuuuuggcuuugugu

SEQ ID NO: 632233 - RNA, 22 nt, Human
uuucucauggaacauagcuccu

SEQ ID NO: 632234 - RNA, 22 nt, Human
gcacugggugggagaucugaau

SEQ ID NO: 632235 - RNA, 22 nt, Human
acagcaggauuuggcgauguug

SEQ ID NO: 632236 - RNA, 22 nt, Human
gaacucuugcagugaaagcuua

SEQ ID NO: 632237 - RNA, 22 nt, Human
uccacugcuacaaccucccaga

SEQ ID NO: 632238 - RNA, 22 nt, Human
aacaugugucuggcuagauugu

SEQ ID NO: 632239 - RNA, 22 nt, Human
ccagaucuaaguccaaaguacu

SEQ ID NO: 632240 - RNA, 22 nt, Human
uggcugugggauaugugacuga

SEQ ID NO: 632241 - RNA, 22 nt, Human
aaucauaauucaaauaagcuua

SEQ ID NO: 632242 - RNA, 20 nt, Human
ucagacagucgcaguucugg

SEQ ID NO: 632243 - RNA, 20 nt, Human
gcuucucagggcuucucuga

SEQ ID NO: 632244 - RNA, 21 nt, Human
cccuugccugcacuccucggc

SEQ ID NO: 632245 - RNA, 17 nt, Human
aagacaagacaaaugca

SEQ ID NO: 632246 - RNA, 22 nt, Human
cacaucagguagaccuacagag

SEQ ID NO: 632247 - RNA, 22 nt, Human
gccugagauucugcauuucuaa

SEQ ID NO: 632248 - RNA, 22 nt, Human
cacugaaccugaaccaauacuc

SEQ ID NO: 632249 - RNA, 22 nt, Human
gacccagaaggagugcccuaga

SEQ ID NO: 632250 - RNA, 22 nt, Human
aaacuagaaaucagcaagauag

SEQ ID NO: 632251 - RNA, 22 nt, Human
ggaaaaggccauuguuucucug

SEQ ID NO: 632252 - RNA, 22 nt, Human
ucagaggauugccucagcgagc

SEQ ID NO: 632253 - RNA, 22 nt, Human
guuacagucaggagauauuuug

SEQ ID NO: 632254 - RNA, 22 nt, Human
uucugucucccugauguagagc

SEQ ID NO: 632255 - RNA, 22 nt, Human
guguuaaacauguucacagcau

SEQ ID NO: 632256 - RNA, 22 nt, Human
caggagugaaaugaggcccagg

SEQ ID NO: 632257 - RNA, 22 nt, Human
aaacagcaggaacaucuugcca

SEQ ID NO: 632258 - RNA, 22 nt, Human
uccuggccaaguagauguggcg

SEQ ID NO: 632259 - RNA, 22 nt, Human
uuccugguuggauucugauuaa

SEQ ID NO: 632260 - RNA, 22 nt, Human
gcacucaggacucucaucagua

SEQ ID NO: 632261 - RNA, 22 nt, Human
gaaacagcacguuuggagagau

SEQ ID NO: 632262 - RNA, 22 nt, Human
ugcugugcuggcggcagaggcc

SEQ ID NO: 632263 - RNA, 22 nt, Human
gccuagugcacuggcagggcuc

SEQ ID NO: 632264 - RNA, 22 nt, Human
ugagccaggguuuccggcugcu

SEQ ID NO: 632265 - RNA, 22 nt, Human
auuacaauaauacaugcucauu

SEQ ID NO: 632266 - RNA, 22 nt, Human
cacagaugagcugaauagcuuu

SEQ ID NO: 632267 - RNA, 22 nt, Human
ccucagggucucucacagcacc

SEQ ID NO: 632268 - RNA, 22 nt, Human
gccugcagccucagagaauuuu

SEQ ID NO: 632269 - RNA, 22 nt, Human
cagcacagggcuugagaggugu

SEQ ID NO: 632270 - RNA, 22 nt, Human
cuggccucacagaggcuaagcc

SEQ ID NO: 632271 - RNA, 21 nt, Human
uucugggaaaugagcuggggc

SEQ ID NO: 632272 - RNA, 22 nt, Human
cagcuucucagaaagcugaggu

SEQ ID NO: 632273 - RNA, 22 nt, Human
augaaugauuuuauguaaauga

SEQ ID NO: 632274 - RNA, 22 nt, Human
guccugguagcuggcuugguca

SEQ ID NO: 632275 - RNA, 22 nt, Human
guggaggucccgggcaggagca

SEQ ID NO: 632276 - RNA, 22 nt, Human
uaggucuggcagaagaaaaaug

SEQ ID NO: 632277 - RNA, 23 nt, Human
augaagacccgugguguccccac

SEQ ID NO: 632278 - RNA, 22 nt, Human
ccugcccagcuucaccucaggc

SEQ ID NO: 632279 - RNA, 22 nt, Human
uuaguuagagcccuauguuagg

SEQ ID NO: 632280 - RNA, 22 nt, Human
aacacuuuuuauauauuguauc

SEQ ID NO: 632281 - RNA, 22 nt, Human
ggggacagucgaucuagugauu

SEQ ID NO: 632282 - RNA, 22 nt, Human
gcuccagaguguggcaucuggg

SEQ ID NO: 632283 - RNA, 22 nt, Human
guuauaaaaugcacaguuguuu

SEQ ID NO: 632284 - RNA, 23 nt, Human
cugaggucugcaauucuaguagu

SEQ ID NO: 632285 - RNA, 22 nt, Human
cuuauaaaguccaucugaacaa

SEQ ID NO: 632286 - RNA, 22 nt, Human
aauaacuuguaugguuauucca

SEQ ID NO: 632287 - RNA, 22 nt, Human
aagcacuggguauagcaaugau

SEQ ID NO: 632288 - RNA, 22 nt, Human
acauuguugugcaauuauaguu

SEQ ID NO: 632289 - RNA, 22 nt, Human
aguccuggcauauagguccuca

SEQ ID NO: 632290 - RNA, 23 nt, Human
augacaaacaggacaucuugugc

SEQ ID NO: 632291 - RNA, 22 nt, Human
uuacuuaaacagaaaugcagaa

SEQ ID NO: 632292 - RNA, 22 nt, Human
uggcuucagagacagaaucuau

SEQ ID NO: 632293 - RNA, 22 nt, Human
uccagcagaccaucaaggcuca

SEQ ID NO: 632294 - RNA, 22 nt, Human
gguccaccuccaagcuggggac

SEQ ID NO: 632295 - RNA, 22 nt, Human
gaaccucuauauuugugacauc

SEQ ID NO: 632296 - RNA, 22 nt, Human
gcagggcucauugccaggcauu

SEQ ID NO: 632297 - RNA, 22 nt, Human
gaaccuuuuuccaaguaaacaa

SEQ ID NO: 632298 - RNA, 22 nt, Human
cuggcagggugggcuuugcuuu

SEQ ID NO: 632299 - RNA, 22 nt, Human
ccauggcuuuugagucucaaga

SEQ ID NO: 632300 - RNA, 22 nt, Human
guuccugacuguggaguuuggu

SEQ ID NO: 632301 - RNA, 22 nt, Human
cuggcuuugaaggucuuuccua

SEQ ID NO: 632302 - RNA, 22 nt, Human
aucuacagcugucugcacagua

SEQ ID NO: 632303 - RNA, 19 nt, Human
acaaagcugugagcagcuu

SEQ ID NO: 632304 - RNA, 22 nt, Human
cccuggaggcggauguugcagu

SEQ ID NO: 632305 - RNA, 22 nt, Human
ucagcugugauccaucuaucua

SEQ ID NO: 632306 - RNA, 22 nt, Human
gcugucacucuccggccuuccc

SEQ ID NO: 632307 - RNA, 22 nt, Human
uugugaaacauucauggauuug

SEQ ID NO: 632308 - RNA, 19 nt, Human
uccagaagucccugagcgg

SEQ ID NO: 632309 - RNA, 22 nt, Human
agacagacuugaaaauguucuu

SEQ ID NO: 632310 - RNA, 22 nt, Human
uuguuuucuccacugcaucuua

SEQ ID NO: 632311 - RNA, 22 nt, Human
agucucugcugguugugccuau

SEQ ID NO: 632312 - RNA, 22 nt, Human
ugcagcucaggauucucagggc

SEQ ID NO: 632313 - RNA, 15 nt, Human
aaucuggcggcaagu

SEQ ID NO: 632314 - RNA, 22 nt, Human
cagcaguggcugcaggcagcug

SEQ ID NO: 632315 - RNA, 22 nt, Human
ugcagaagauggucugagcacc

SEQ ID NO: 632316 - RNA, 22 nt, Human
aagagcccugguugaaaauaac

SEQ ID NO: 632317 - RNA, 22 nt, Human
uucugacaguaaucaguuugcu

SEQ ID NO: 632318 - RNA, 22 nt, Human
uccagaccaugugagaggcgca

SEQ ID NO: 632319 - RNA, 22 nt, Human
agcacgagaucgaugugccuuu

SEQ ID NO: 632320 - RNA, 22 nt, Human
ccugagaucagugcauuuggug

SEQ ID NO: 632321 - RNA, 22 nt, Human
uggcucaggcuugaaaauagau

SEQ ID NO: 632322 - RNA, 19 nt, Human
ucucugccgaucagggccc

SEQ ID NO: 632323 - RNA, 22 nt, Human
auauaacauacauacagaaaag

SEQ ID NO: 632324 - RNA, 22 nt, Human
ucuuggcuacuuuccugucugc

SEQ ID NO: 632325 - RNA, 22 nt, Human
aaauguguuucuuugugaaugg

SEQ ID NO: 632326 - RNA, 22 nt, Human
accagcugaguaggggagggcc

SEQ ID NO: 632327 - RNA, 22 nt, Human
uuucgagggauuagcuaggacu

SEQ ID NO: 632328 - RNA, 22 nt, Human
acuguaaaacagguuucaucau

SEQ ID NO: 632329 - RNA, 22 nt, Human
aacaucuagguucucaucgaua

SEQ ID NO: 632330 - RNA, 22 nt, Human
uugcuuauagagaguuucauac

SEQ ID NO: 632331 - RNA, 22 nt, Human
ugugagcacuggcugggaaagu

SEQ ID NO: 632332 - RNA, 22 nt, Human
agcuguccugugggagggagug

SEQ ID NO: 632333 - RNA, 22 nt, Human
aggagccaaaagcugaacaaga

SEQ ID NO: 632334 - RNA, 22 nt, Human
aggaauuuucacaguuggguau

SEQ ID NO: 632335 - RNA, 21 nt, Human
ggguagcagaggaggccgugg

SEQ ID NO: 632336 - RNA, 22 nt, Human
gccuggagggauagaaugcaag

SEQ ID NO: 632337 - RNA, 22 nt, Human
gcugaacuacaugaaguugccg

SEQ ID NO: 632338 - RNA, 22 nt, Human
acccaggcuggaaugcaguggu

SEQ ID NO: 632339 - RNA, 22 nt, Human
acagccaggaggaacucaguga

SEQ ID NO: 632340 - RNA, 18 nt, Human
ucugaaagcccuuuucca

SEQ ID NO: 632341 - RNA, 19 nt, Human
aggcacaauucugagaagc

SEQ ID NO: 632342 - RNA, 22 nt, Human
guggaagaggcaagauagcucu

SEQ ID NO: 632343 - RNA, 22 nt, Human
cccccaccugaggacagucuua

SEQ ID NO: 632344 - RNA, 22 nt, Human
gucugaauacguacuugugaag

SEQ ID NO: 632345 - RNA, 22 nt, Human
cuaagcaagaaugagugcaaca

SEQ ID NO: 632346 - RNA, 22 nt, Human
gccacacugcuucuuugagccu

SEQ ID NO: 632347 - RNA, 22 nt, Human
uggcuggcaguuaucuuuggau

SEQ ID NO: 632348 - RNA, 22 nt, Human
augcaucauggaaaacucaguu

SEQ ID NO: 632349 - RNA, 22 nt, Human
ugggaaggacgugucaguggca

SEQ ID NO: 632350 - RNA, 22 nt, Human
gaggcucccuuuagguccagau

SEQ ID NO: 632351 - RNA, 22 nt, Human
agcauauuguaugucuauaugu

SEQ ID NO: 632352 - RNA, 22 nt, Human
agcaguguucuaaucuggcuag

SEQ ID NO: 632353 - RNA, 21 nt, Human
uggagcugccacuugagcugc

SEQ ID NO: 632354 - RNA, 22 nt, Human
uaggaaaugaaugcaggcuccc

SEQ ID NO: 632355 - RNA, 22 nt, Human
gaguggggucugggcaucaguc

SEQ ID NO: 632356 - RNA, 22 nt, Human
uuuccacacucacugcacucau

SEQ ID NO: 632357 - RNA, 21 nt, Human
uuucuuaggcucuaaaaugac

SEQ ID NO: 632358 - RNA, 22 nt, Human
uuucuagacauuucuauguaca

SEQ ID NO: 632359 - RNA, 22 nt, Human
cagaagaugcagugucugagaa

SEQ ID NO: 632360 - RNA, 22 nt, Human
aaagugccacaacuggacaacc

SEQ ID NO: 632361 - RNA, 22 nt, Human
cuauucaguaagccaaaaccau

SEQ ID NO: 632362 - RNA, 22 nt, Human
gacacagauaucucugagauua

SEQ ID NO: 632363 - RNA, 22 nt, Human
caguggcuucucaugucauuca

SEQ ID NO: 632364 - RNA, 22 nt, Human
ucucaguguggugcuuaggaua

SEQ ID NO: 632365 - RNA, 22 nt, Human
ucauuuaaaauguaccaggauu

SEQ ID NO: 632366 - RNA, 22 nt, Human
caaaguaacugccuuuccaauu

SEQ ID NO: 632367 - RNA, 22 nt, Human
uuugacaaaggaaaaaugcaca

SEQ ID NO: 632368 - RNA, 22 nt, Human
ccugggugaugugcugcccucg

SEQ ID NO: 632369 - RNA, 22 nt, Human
cagcccauuucugggaccugag

SEQ ID NO: 632370 - RNA, 21 nt, Human
cucagggcuugguguccucau

SEQ ID NO: 632371 - RNA, 22 nt, Human
ucagaaacacucuucuucuguc

SEQ ID NO: 632372 - RNA, 22 nt, Human
cagcccugcucuuagugucucc

SEQ ID NO: 632373 - RNA, 22 nt, Human
gagcuguuuuuccaaacuauug

SEQ ID NO: 632374 - RNA, 21 nt, Human
agaggucauugggcugguucu

SEQ ID NO: 632375 - RNA, 22 nt, Human
cugagcuggucuauggacuugg

SEQ ID NO: 632376 - RNA, 22 nt, Human
ugugcagcucuagagccaagcc

SEQ ID NO: 632377 - RNA, 22 nt, Human
ccaggcauugugagugggcagg

SEQ ID NO: 632378 - RNA, 22 nt, Human
uagaaaguagggaagguaggau

SEQ ID NO: 632379 - RNA, 22 nt, Human
ugcaggcucaccugccagggcc

SEQ ID NO: 632380 - RNA, 22 nt, Human
aguguaugcagguuuucaaugu

SEQ ID NO: 632381 - RNA, 22 nt, Human
uuccucucucuugccagaaugu

SEQ ID NO: 632382 - RNA, 22 nt, Human
gugacugugaacuguuucugau

SEQ ID NO: 632383 - RNA, 22 nt, Human
gcaguguugcuaggugcgguga

SEQ ID NO: 632384 - RNA, 22 nt, Human
gagccuggggacccuccugagu

SEQ ID NO: 632385 - RNA, 22 nt, Human
agcagggcaaagucaggcuaac

SEQ ID NO: 632386 - RNA, 19 nt, Human
aggcugugagggaggacuc

SEQ ID NO: 632387 - RNA, 22 nt, Human
gaggcugaggguuagagaguca

SEQ ID NO: 632388 - RNA, 22 nt, Human
gcaguguuggcaggauggggcu

SEQ ID NO: 632389 - RNA, 22 nt, Human
cuggugaccggaccucaguuuu

SEQ ID NO: 632390 - RNA, 22 nt, Human
cuuuccccaagcaccacagugc

SEQ ID NO: 632391 - RNA, 22 nt, Human
gguaugaauucacuacuuccaa

SEQ ID NO: 632392 - RNA, 22 nt, Human
uggcaaagcuagacauucccuc

SEQ ID NO: 632393 - RNA, 22 nt, Human
uuaacuucaacacucucuugua

SEQ ID NO: 632394 - RNA, 21 nt, Human
ucccacagaaacugcgaaauu

SEQ ID NO: 632395 - RNA, 22 nt, Human
gagcuucagaauuuaacagacu

SEQ ID NO: 632396 - RNA, 22 nt, Human
uuucuaagucugagggaguaua

SEQ ID NO: 632397 - RNA, 22 nt, Human
agauggcuagauugcaagaacu

SEQ ID NO: 632398 - RNA, 21 nt, Human
gagccuucccucugcccuuuc

SEQ ID NO: 632399 - RNA, 22 nt, Human
cucuggaguaagagcuaugaaa

SEQ ID NO: 632400 - RNA, 22 nt, Human
guauucuguuuacagugagcaa

SEQ ID NO: 632401 - RNA, 22 nt, Human
cuaaauuauuugcacauuagag

SEQ ID NO: 632402 - RNA, 22 nt, Human
uguggcugcucaggugcagacc

SEQ ID NO: 632403 - RNA, 22 nt, Human
uacaugugguagggagggcagu

SEQ ID NO: 632404 - RNA, 22 nt, Human
gccagcugaagggaagcuccug

SEQ ID NO: 632405 - RNA, 22 nt, Human
uggagaggagcaccauggccau

SEQ ID NO: 632406 - RNA, 23 nt, Human
aagcauucgccuucacccuccuc

SEQ ID NO: 632407 - RNA, 21 nt, Human
agauccuggggucuggggagg

SEQ ID NO: 632408 - RNA, 19 nt, Human
cuggcuucaagcaguccuc

SEQ ID NO: 632409 - RNA, 22 nt, Human
ucauuuauaaggaugcaauuaa

SEQ ID NO: 632410 - RNA, 22 nt, Human
uccugguggugccagcugcagg

SEQ ID NO: 632411 - RNA, 19 nt, Human
acccucuccccacuggguc

SEQ ID NO: 632412 - RNA, 20 nt, Human
ugagcuucagauaucgugca

SEQ ID NO: 632413 - RNA, 17 nt, Human
ggcucugggugucacau

SEQ ID NO: 632414 - RNA, 22 nt, Human
aaggcccuaauagagcacauau

SEQ ID NO: 632415 - RNA, 22 nt, Human
gaggcaccucgcgggaggaggc

SEQ ID NO: 632416 - RNA, 22 nt, Human
agcaggcuugguccccagccuc

SEQ ID NO: 632417 - RNA, 22 nt, Human
ucaaaccaccuuguuacugggg

SEQ ID NO: 632418 - RNA, 22 nt, Human
guggucauguuaauuaugaucc

SEQ ID NO: 632419 - RNA, 16 nt, Human
agacucagugcacuuu

SEQ ID NO: 632420 - RNA, 22 nt, Human
ccugaggcucgcgcgccccugg

SEQ ID NO: 632421 - RNA, 22 nt, Human
aauguacaccguggguuuuuua

SEQ ID NO: 632422 - RNA, 22 nt, Human
gugugcaugcauagacaccaca

SEQ ID NO: 632423 - RNA, 22 nt, Human
cagggagccccaauuccaugcc

SEQ ID NO: 632424 - RNA, 22 nt, Human
uugaaucucuugaaucucuguu

SEQ ID NO: 632425 - RNA, 22 nt, Human
uccaggaggguuuucugccuuc

SEQ ID NO: 632426 - RNA, 22 nt, Human
aucuggcucuuccuggaguucc

SEQ ID NO: 632427 - RNA, 22 nt, Human
acacaucagccucagcuuuggg

SEQ ID NO: 632428 - RNA, 22 nt, Human
uccuccagcuacuaggcaaaua

SEQ ID NO: 632429 - RNA, 22 nt, Human
cugucuguaucccuguugguaa

SEQ ID NO: 632430 - RNA, 22 nt, Human
uuaggaguccagaugucuuggg

SEQ ID NO: 632431 - RNA, 22 nt, Human
gagagaagaauguuccgaggcc

SEQ ID NO: 632432 - RNA, 22 nt, Human
agaggccucccucccagcuggu

SEQ ID NO: 632433 - RNA, 22 nt, Human
aaggcugguuuccuugauguuu

SEQ ID NO: 632434 - RNA, 22 nt, Human
ugcauaaacagauacuucaugu

SEQ ID NO: 632435 - RNA, 22 nt, Human
acugucauuaaugaauguaaua

SEQ ID NO: 632436 - RNA, 22 nt, Human
augcacacugggauucaacugg

SEQ ID NO: 632437 - RNA, 22 nt, Human
agccagaaccacuggaacggug

SEQ ID NO: 632438 - RNA, 22 nt, Human
aaaguuuggauccagcaaaaga

SEQ ID NO: 632439 - RNA, 19 nt, Human
ggcagaagguguaggggga

SEQ ID NO: 632440 - RNA, 22 nt, Human
ggcacaggagcuagucaaagcc

SEQ ID NO: 632441 - RNA, 22 nt, Human
cugucccucucacaccucacca

SEQ ID NO: 632442 - RNA, 22 nt, Human
cucugggucuauaaugcagcug

SEQ ID NO: 632443 - RNA, 22 nt, Human
agcagggggccacagucacagc

SEQ ID NO: 632444 - RNA, 22 nt, Human
ucaggccugcaggcuuccugga

SEQ ID NO: 632445 - RNA, 17 nt, Human
gcaguggagggguaguu

SEQ ID NO: 632446 - RNA, 22 nt, Human
gccuccuguuaugccaugugcc

SEQ ID NO: 632447 - RNA, 22 nt, Human
ucagagguaaaaacucacugua

SEQ ID NO: 632448 - RNA, 22 nt, Human
agacacugauguucagcucaau

SEQ ID NO: 632449 - RNA, 22 nt, Human
acagaguacauucagagacuau

SEQ ID NO: 632450 - RNA, 22 nt, Human
auguauaaugcuaauuagcuag

SEQ ID NO: 632451 - RNA, 22 nt, Human
uguuacaguggcuuuuuaaaca

SEQ ID NO: 632452 - RNA, 22 nt, Human
acaggcacaacugaguagacuc

SEQ ID NO: 632453 - RNA, 22 nt, Human
uuucagaugugugucucugaag

SEQ ID NO: 632454 - RNA, 22 nt, Human
uccagccaugcaugacaaucac

SEQ ID NO: 632455 - RNA, 22 nt, Human
cagcagcugaggcgcuggcgug

SEQ ID NO: 632456 - RNA, 22 nt, Human
cuggcucucugagauauugagu

SEQ ID NO: 632457 - RNA, 22 nt, Human
uuacacagacauggcaucauga

SEQ ID NO: 632458 - RNA, 22 nt, Human
accagcucuuucuuuucacuau

SEQ ID NO: 632459 - RNA, 22 nt, Human
gcuggccaguguggugaccacc

SEQ ID NO: 632460 - RNA, 22 nt, Human
ucuugaaguccuuacauuugau

SEQ ID NO: 632461 - RNA, 22 nt, Human
cccugagcacaccuggcagaca

SEQ ID NO: 632462 - RNA, 22 nt, Human
ugcuccugacaguuuuaggcuc

SEQ ID NO: 632463 - RNA, 22 nt, Human
cucuccacuguccuuugcuggu

SEQ ID NO: 632464 - RNA, 22 nt, Human
ugucugaacgaaguagguccac

SEQ ID NO: 632465 - RNA, 19 nt, Human
gaguccugugcuccuuguu

SEQ ID NO: 632466 - RNA, 22 nt, Human
acugccugccuuccagguacug

SEQ ID NO: 632467 - RNA, 22 nt, Human
aaguuuaagguggaaguggugg

SEQ ID NO: 632468 - RNA, 22 nt, Human
uuguggcugugcaccgcugccu

SEQ ID NO: 632469 - RNA, 19 nt, Human
agcuccugauugugccucg

SEQ ID NO: 632470 - RNA, 22 nt, Human
auuacaguucugcagguaguuu

SEQ ID NO: 632471 - RNA, 22 nt, Human
uuacaauaccacaucaccucau

SEQ ID NO: 632472 - RNA, 22 nt, Human
uggguccuuuuuggacuucuuc

SEQ ID NO: 632473 - RNA, 20 nt, Human
aggcuuggcuuggcaggaac

SEQ ID NO: 632474 - RNA, 22 nt, Human
ccugucaguugcugucagggau

SEQ ID NO: 632475 - RNA, 22 nt, Human
ugauucagaccugucagacuuc

SEQ ID NO: 632476 - RNA, 22 nt, Human
uuacagaaaggaaggacugacu

SEQ ID NO: 632477 - RNA, 22 nt, Human
ccugccaggacauugcuugaag

SEQ ID NO: 632478 - RNA, 22 nt, Human
cugaguccagggacagaggcgu

SEQ ID NO: 632479 - RNA, 22 nt, Human
ucagaggaagccuuggugggag

SEQ ID NO: 632480 - RNA, 22 nt, Human
ggugugggaacuacagguuuuu

SEQ ID NO: 632481 - RNA, 22 nt, Human
uccagggaugccagccauguug

SEQ ID NO: 632482 - RNA, 22 nt, Human
uuugaaagucaaccuuccaguu

SEQ ID NO: 632483 - RNA, 22 nt, Human
gcagauggaaagugcuugaggg

SEQ ID NO: 632484 - RNA, 22 nt, Human
uggcaaaggaaccuauuuuaaa

SEQ ID NO: 632485 - RNA, 22 nt, Human
agccucucauguucucccccag

SEQ ID NO: 632486 - RNA, 22 nt, Human
agcugccaucagccuuuggaug

SEQ ID NO: 632487 - RNA, 22 nt, Human
uugggccaaagauguccuuguu

SEQ ID NO: 632488 - RNA, 22 nt, Human
cccagcuugcgggcggcaggag

SEQ ID NO: 632489 - RNA, 22 nt, Human
ugauacauaaaccaucauuuug

SEQ ID NO: 632490 - RNA, 22 nt, Human
aaguugaaugcguacgugacau

SEQ ID NO: 632491 - RNA, 22 nt, Human
uaagcuauuccugaagaagguu

SEQ ID NO: 632492 - RNA, 17 nt, Human
ucugucugugguccacu

SEQ ID NO: 632493 - RNA, 22 nt, Human
ccauuugaaaugaauguuuuua

SEQ ID NO: 632494 - RNA, 22 nt, Human
aauuuacaggugcacucgccau

SEQ ID NO: 632495 - RNA, 21 nt, Human
ucugucuuccucagccuaagg

SEQ ID NO: 632496 - RNA, 22 nt, Human
ggaugaggaaaccacagugucc

SEQ ID NO: 632497 - RNA, 22 nt, Human
acauucaacauggcuggucuag

SEQ ID NO: 632498 - RNA, 22 nt, Human
caucugccuaaguggcccuguu

SEQ ID NO: 632499 - RNA, 22 nt, Human
guuagacaugagugugcuuaca

SEQ ID NO: 632500 - RNA, 22 nt, Human
gauuaagagaaguuucuuaucg

SEQ ID NO: 632501 - RNA, 22 nt, Human
gcaagggugugaaccaaugaga

SEQ ID NO: 632502 - RNA, 22 nt, Human
gggaugauggaaaagucuguua

SEQ ID NO: 632503 - RNA, 22 nt, Human
cugcaguuggauaaagauacuu

SEQ ID NO: 632504 - RNA, 22 nt, Human
ugugugucagagucuccauggu

SEQ ID NO: 632505 - RNA, 22 nt, Human
aagggggcccagcacuaaguug

SEQ ID NO: 632506 - RNA, 22 nt, Human
ccuggcucugguucccucagcu

SEQ ID NO: 632507 - RNA, 22 nt, Human
uaaugagaucauaucuucugag

SEQ ID NO: 632508 - RNA, 22 nt, Human
ucagggcaggacaguguaggcc

SEQ ID NO: 632509 - RNA, 22 nt, Human
aaauucaguuccucagccacau

SEQ ID NO: 632510 - RNA, 22 nt, Human
agcugcccugggucuugcugcu

SEQ ID NO: 632511 - RNA, 22 nt, Human
cagcuucuuagucuuuccuugu

SEQ ID NO: 632512 - RNA, 22 nt, Human
ugaagcccugugucagcuucca

SEQ ID NO: 632513 - RNA, 22 nt, Human
ucaggaaggcacuugguguguu

SEQ ID NO: 632514 - RNA, 22 nt, Human
ucaguguaaguuauguagaugu

SEQ ID NO: 632515 - RNA, 22 nt, Human
aaaauagccucacauaauugcu

SEQ ID NO: 632516 - RNA, 22 nt, Human
aguuuugaaaugaaauguaguu

SEQ ID NO: 632517 - RNA, 22 nt, Human
agcaucccaugacucuggagga

SEQ ID NO: 632518 - RNA, 22 nt, Human
cugggaagggacgccagugccu

SEQ ID NO: 632519 - RNA, 22 nt, Human
gggcucagaggaguggccuggg

SEQ ID NO: 632520 - RNA, 22 nt, Human
guguaaacacccuuacuguggc

SEQ ID NO: 632521 - RNA, 22 nt, Human
auaaagcaugcuuguuuggaga

SEQ ID NO: 632522 - RNA, 22 nt, Human
aucuacccacugaacacaauau

SEQ ID NO: 632523 - RNA, 22 nt, Human
aaagccuugcccgucacuggga

SEQ ID NO: 632524 - RNA, 22 nt, Human
gggagcuggcggauuccccagg

SEQ ID NO: 632525 - RNA, 22 nt, Human
ccagcucucuguccuccccaca

SEQ ID NO: 632526 - RNA, 22 nt, Human
uuuguaacauuauggacugcuu

SEQ ID NO: 632527 - RNA, 22 nt, Human
gaaaaucugcuuauauuauuuu

SEQ ID NO: 632528 - RNA, 22 nt, Human
gcugugugcucuggucuuucuu

SEQ ID NO: 632529 - RNA, 22 nt, Human
gccugagugcaucugcagacau

SEQ ID NO: 632530 - RNA, 22 nt, Human
gggcaugcaggacuguggcaga

SEQ ID NO: 632531 - RNA, 22 nt, Human
aagauggcuuagaguccuggug

SEQ ID NO: 632532 - RNA, 22 nt, Human
cagaggccuugucuucuuugcu

SEQ ID NO: 632533 - RNA, 22 nt, Human
uccaggcaaagugcugggcugc

SEQ ID NO: 632534 - RNA, 22 nt, Human
ggaaagggcagaggccuuggag

SEQ ID NO: 632535 - RNA, 22 nt, Human
accaggagaggcacuugcaaug

SEQ ID NO: 632536 - RNA, 22 nt, Human
cuuguggcagguggauggugcc

SEQ ID NO: 632537 - RNA, 19 nt, Human
aucacaugucaagagcagg

SEQ ID NO: 632538 - RNA, 22 nt, Human
agacugaaguaagaaugcagcu

SEQ ID NO: 632539 - RNA, 22 nt, Human
gagggagaaggacuaucaggcu

SEQ ID NO: 632540 - RNA, 22 nt, Human
gcucagggaaagagcuccuguc

SEQ ID NO: 632541 - RNA, 18 nt, Human
uaaaugcauguuaauaac

SEQ ID NO: 632542 - RNA, 20 nt, Human
uccuccaaccagcugcuaau

SEQ ID NO: 632543 - RNA, 22 nt, Human
ugggcaggaugcguugauucuu

SEQ ID NO: 632544 - RNA, 22 nt, Human
gcugggcucugucaugccuucc

SEQ ID NO: 632545 - RNA, 19 nt, Human
cucucuggcggugucugcg

SEQ ID NO: 632546 - RNA, 22 nt, Human
gggauggggagcuggaaagggg

SEQ ID NO: 632547 - RNA, 22 nt, Human
cagcaggacauggaggaguaaa

SEQ ID NO: 632548 - RNA, 22 nt, Human
ccagcugcccacuauguguucu

SEQ ID NO: 632549 - RNA, 22 nt, Human
uacagcgaaaauuuagcuugau

SEQ ID NO: 632550 - RNA, 19 nt, Human
ggccaggcugacugugguc

SEQ ID NO: 632551 - RNA, 21 nt, Human
ccaggucuugguccuuggacu

SEQ ID NO: 632552 - RNA, 22 nt, Human
aaagcaauugugguuuuugcca

SEQ ID NO: 632553 - RNA, 22 nt, Human
ugaggggagcccgcccuggacg

SEQ ID NO: 632554 - RNA, 22 nt, Human
agcagguaugacauagauaugu

SEQ ID NO: 632555 - RNA, 22 nt, Human
ugauucuuuggagagcuauaua

SEQ ID NO: 632556 - RNA, 22 nt, Human
ccauuuaguaaggaagaacagc

SEQ ID NO: 632557 - RNA, 22 nt, Human
cucugaggcuuguucuauguau

SEQ ID NO: 632558 - RNA, 22 nt, Human
aucauugagauuuuuuacaacu

SEQ ID NO: 632559 - RNA, 22 nt, Human
accugucaacccaucaccuagg

SEQ ID NO: 632560 - RNA, 22 nt, Human
ggcagcuggggcagugcccugu

SEQ ID NO: 632561 - RNA, 22 nt, Human
acgaagacgccguucuugccga

SEQ ID NO: 632562 - RNA, 22 nt, Human
aucaccaggcaaaaugucagag

SEQ ID NO: 632563 - RNA, 22 nt, Human
ugccacaguuucauggauucug

SEQ ID NO: 632564 - RNA, 22 nt, Human
uacacacagaggccaugggauu

SEQ ID NO: 632565 - RNA, 22 nt, Human
ugugugucuuugccuccucuca

SEQ ID NO: 632566 - RNA, 22 nt, Human
gaaguguuguaucuuuuuaaua

SEQ ID NO: 632567 - RNA, 22 nt, Human
ggcuugcacacagccucaguuu

SEQ ID NO: 632568 - RNA, 21 nt, Human
cagaggguuucucagguguuu

SEQ ID NO: 632569 - RNA, 22 nt, Human
aggccagaugucgggcuagaag

SEQ ID NO: 632570 - RNA, 22 nt, Human
uuuggagagaguuaaauauguu

SEQ ID NO: 632571 - RNA, 22 nt, Human
uaagaaacaugauacuuuuccu

SEQ ID NO: 632572 - RNA, 22 nt, Human
uauuucuaagagauaucuguac

SEQ ID NO: 632573 - RNA, 22 nt, Human
aggcccuguuguagcauuuugg

SEQ ID NO: 632574 - RNA, 19 nt, Human
agaaucaggucaggugaca

SEQ ID NO: 632575 - RNA, 22 nt, Human
gagagggccgggggccagcucc

SEQ ID NO: 632576 - RNA, 21 nt, Human
agaaaauggcguuuuagauuu

SEQ ID NO: 632577 - RNA, 22 nt, Human
uuggcugcugaaauauguucug

SEQ ID NO: 632578 - RNA, 22 nt, Human
cuccagacagaucuucuagcag

SEQ ID NO: 632579 - RNA, 22 nt, Human
gcccaagccggagcugggagag

SEQ ID NO: 632580 - RNA, 22 nt, Human
gccugggaacucugaucuccug

SEQ ID NO: 632581 - RNA, 22 nt, Human
augcuucuugagauagaaacac

SEQ ID NO: 632582 - RNA, 22 nt, Human
ggcucugcccagguggacagca

SEQ ID NO: 632583 - RNA, 22 nt, Human
cuccucagaagaggguaacaca

SEQ ID NO: 632584 - RNA, 22 nt, Human
ucuacaaagguugaggugcccu

SEQ ID NO: 632585 - RNA, 18 nt, Human
acagacacuuaguaugag

SEQ ID NO: 632586 - RNA, 22 nt, Human
acaaauucuacaaucauaugau

SEQ ID NO: 632587 - RNA, 22 nt, Human
uauccuguguacugucuaguac

SEQ ID NO: 632588 - RNA, 22 nt, Human
cugcauaugagaauaggagaaa

SEQ ID NO: 632589 - RNA, 22 nt, Human
cuuaggaaaguuucugcuuaug

SEQ ID NO: 632590 - RNA, 22 nt, Human
ggacuuggcuucuuucagagac

SEQ ID NO: 632591 - RNA, 23 nt, Human
agugagcagcuguagggcaagga

SEQ ID NO: 632592 - RNA, 22 nt, Human
aagcaucucuauguggagagug

SEQ ID NO: 632593 - RNA, 22 nt, Human
gauuuaguggcccuugguacac

SEQ ID NO: 632594 - RNA, 22 nt, Human
acaggcuucagauguauuaacu

SEQ ID NO: 632595 - RNA, 22 nt, Human
aacagucuuccuacggccauua

SEQ ID NO: 632596 - RNA, 22 nt, Human
cagcugccuucugcgggaaguc

SEQ ID NO: 632597 - RNA, 22 nt, Human
aguggcugcugacuuuaauaca

SEQ ID NO: 632598 - RNA, 22 nt, Human
gcaugcauuuguacuugauuuu

SEQ ID NO: 632599 - RNA, 22 nt, Human
agggggaguuucaguuagaaag

SEQ ID NO: 632600 - RNA, 22 nt, Human
ggaagagaaaugagucaagacu

SEQ ID NO: 632601 - RNA, 22 nt, Human
acccagccauguucaguucucu

SEQ ID NO: 632602 - RNA, 18 nt, Human
aggcaggcuggagugacu

SEQ ID NO: 632603 - RNA, 22 nt, Human
ccugcucaccugauguggcaac

SEQ ID NO: 632604 - RNA, 19 nt, Human
ucaguauauaauuacacca

SEQ ID NO: 632605 - RNA, 22 nt, Human
ucuggcucuuugggugauugua

SEQ ID NO: 632606 - RNA, 22 nt, Human
acuuguuugaaucucucuagag

SEQ ID NO: 632607 - RNA, 20 nt, Human
uccagguaacaucucucugg

SEQ ID NO: 632608 - RNA, 22 nt, Human
guauuuucaugauuucagacca

SEQ ID NO: 632609 - RNA, 22 nt, Human
ggaggccaaggugggcggauca

SEQ ID NO: 632610 - RNA, 22 nt, Human
cucugugugcuggugggguccu

SEQ ID NO: 632611 - RNA, 22 nt, Human
cuuuucucuguaccguauaucu

SEQ ID NO: 632612 - RNA, 22 nt, Human
uaggaugaucuuguagagagau

SEQ ID NO: 632613 - RNA, 22 nt, Human
auggaugggauauugcuugcca

SEQ ID NO: 632614 - RNA, 22 nt, Human
uguacaaggccaucuacaugcu

SEQ ID NO: 632615 - RNA, 21 nt, Human
gcugagagguugggaaguuca

SEQ ID NO: 632616 - RNA, 22 nt, Human
aaaucacagggucucuaaguau

SEQ ID NO: 632617 - RNA, 22 nt, Human
cccuggagcuagucugagcaga

SEQ ID NO: 632618 - RNA, 18 nt, Human
gaugaagcugcuggggau

SEQ ID NO: 632619 - RNA, 22 nt, Human
ggcuuucaacacaggcuuuccu

SEQ ID NO: 632620 - RNA, 21 nt, Human
agaucccugaggagagcaucc

SEQ ID NO: 632621 - RNA, 22 nt, Human
gcagggccagggcucaggcugu

SEQ ID NO: 632622 - RNA, 22 nt, Human
ccagaagaccggggagucaggg

SEQ ID NO: 632623 - RNA, 23 nt, Human
cagcaggagggugccugggcugc

SEQ ID NO: 632624 - RNA, 23 nt, Human
uccaauucaauugggucaggaag

SEQ ID NO: 632625 - RNA, 21 nt, Human
augcauguuacaguauaugcc

SEQ ID NO: 632626 - RNA, 22 nt, Human
ucggccacgggguuuccuccaa

SEQ ID NO: 632627 - RNA, 22 nt, Human
acugggcuccaaggaccuggag

SEQ ID NO: 632628 - RNA, 22 nt, Human
ccucucaaaagcacaacauuga

SEQ ID NO: 632629 - RNA, 22 nt, Human
aguguuucacagcacuuuuucu

SEQ ID NO: 632630 - RNA, 22 nt, Human
gucaagaugagaauucuuuuua

SEQ ID NO: 632631 - RNA, 22 nt, Human
agggaagccccgaggaggcacc

SEQ ID NO: 632632 - RNA, 19 nt, Human
caggugguaaucugagccu

SEQ ID NO: 632633 - RNA, 22 nt, Human
gagcugcccugagcuuugcaug

SEQ ID NO: 632634 - RNA, 22 nt, Human
uggccagcccuucagccaugcc

SEQ ID NO: 632635 - RNA, 22 nt, Human
agcuguggaaaucaggcaauga

SEQ ID NO: 632636 - RNA, 22 nt, Human
uggcuaggacucauccuguuuc

SEQ ID NO: 632637 - RNA, 22 nt, Human
ccucaagucaauucugucucgc

SEQ ID NO: 632638 - RNA, 22 nt, Human
cuggcuggccauguagagauga

SEQ ID NO: 632639 - RNA, 22 nt, Human
acaguguagaauccuguacuua

SEQ ID NO: 632640 - RNA, 22 nt, Human
uuuuguuuucuuagaaaccugg

SEQ ID NO: 632641 - RNA, 22 nt, Human
aguguuuaaugccuuuuccagc

SEQ ID NO: 632642 - RNA, 22 nt, Human
aaagcugaugucuacuagagaa

SEQ ID NO: 632643 - RNA, 19 nt, Human
aaaaggaauauucuuuggg

SEQ ID NO: 632644 - RNA, 22 nt, Human
cacccagagccugagagggaua

SEQ ID NO: 632645 - RNA, 22 nt, Human
acuuuccuggcccuguccucug

SEQ ID NO: 632646 - RNA, 22 nt, Human
cgccugggaguccacaccugcu

SEQ ID NO: 632647 - RNA, 22 nt, Human
aggagccccucuucaguccugg

SEQ ID NO: 632648 - RNA, 22 nt, Human
uauaggcuuuugccugaagcua

SEQ ID NO: 632649 - RNA, 22 nt, Human
cacagguucaccucagguaggu

SEQ ID NO: 632650 - RNA, 22 nt, Human
uaggaaaauaucucuuauuggg

SEQ ID NO: 632651 - RNA, 22 nt, Human
uucuuucacucaagaaggaucu

SEQ ID NO: 632652 - RNA, 22 nt, Human
ggccacugcugcucugguggag

SEQ ID NO: 632653 - RNA, 22 nt, Human
ucuggguggcugccaaucugcc

SEQ ID NO: 632654 - RNA, 22 nt, Human
uguuauugagguuacuuauaag

SEQ ID NO: 632655 - RNA, 22 nt, Human
caaaccacacucagcguaucgg

SEQ ID NO: 632656 - RNA, 22 nt, Human
uucauauuuucugcuugcucac

SEQ ID NO: 632657 - RNA, 22 nt, Human
uucuagcaugccuuuuagcaca

SEQ ID NO: 632658 - RNA, 22 nt, Human
cagggcuucuuggcauuugcug

SEQ ID NO: 632659 - RNA, 20 nt, Human
ccuucucuggaauugccucc

SEQ ID NO: 632660 - RNA, 22 nt, Human
cagguccacagcccaucacugc

SEQ ID NO: 632661 - RNA, 22 nt, Human
auuguacauaaaauguaugucu

SEQ ID NO: 632662 - RNA, 22 nt, Human
ccuuccaggugcaggcaagccu

SEQ ID NO: 632663 - RNA, 21 nt, Human
ccagggaagaaaugagggcag

SEQ ID NO: 632664 - RNA, 22 nt, Human
agcccagggacagggcggaugu

SEQ ID NO: 632665 - RNA, 22 nt, Human
ugagguggaaggauccuuugaa

SEQ ID NO: 632666 - RNA, 22 nt, Human
caaugauggcuaggcagcugcu

SEQ ID NO: 632667 - RNA, 22 nt, Human
ugcuuuuugcacccuuugccgu

SEQ ID NO: 632668 - RNA, 22 nt, Human
uuauaggcuuaguucugugugu

SEQ ID NO: 632669 - RNA, 22 nt, Human
acccuggacuggggcugaggcu

SEQ ID NO: 632670 - RNA, 22 nt, Human
acucaguacaucuggaguuggc

SEQ ID NO: 632671 - RNA, 22 nt, Human
uggaugcuguaggacacgcucu

SEQ ID NO: 632672 - RNA, 19 nt, Human
uccagggcuuuauggcuuu

SEQ ID NO: 632673 - RNA, 20 nt, Human
uggcuccuggcuccucccuc

SEQ ID NO: 632674 - RNA, 22 nt, Human
ugucuggggaacugugcaucca

SEQ ID NO: 632675 - RNA, 22 nt, Human
cagggcuuugugugccugggga

SEQ ID NO: 632676 - RNA, 22 nt, Human
uacacauguccaaggugucacc

SEQ ID NO: 632677 - RNA, 22 nt, Human
auggagaguucacuucuaaguu

SEQ ID NO: 632678 - RNA, 22 nt, Human
cagcaggauuugaaaggaagag

SEQ ID NO: 632679 - RNA, 22 nt, Human
ccaggugcucuugccagggcug

SEQ ID NO: 632680 - RNA, 22 nt, Human
acauuucuccuacuuguuauuu

SEQ ID NO: 632681 - RNA, 17 nt, Human
gcuccugcaggucagga

SEQ ID NO: 632682 - RNA, 23 nt, Human
uuaaaggcagauguugaguauua

SEQ ID NO: 632683 - RNA, 22 nt, Human
gaacaaggauucccaaagaaga

SEQ ID NO: 632684 - RNA, 22 nt, Human
aggacagcccccaacagcaaca

SEQ ID NO: 632685 - RNA, 22 nt, Human
uaacuuuaggaauagguaaucu

SEQ ID NO: 632686 - RNA, 22 nt, Human
uagauguuuuaacucuugguua

SEQ ID NO: 632687 - RNA, 21 nt, Human
ccagcccagcugugucccagc

SEQ ID NO: 632688 - RNA, 22 nt, Human
augaguguuuagaaaacacugg

SEQ ID NO: 632689 - RNA, 22 nt, Human
cggcagagcccugagucagccu

SEQ ID NO: 632690 - RNA, 22 nt, Human
auuuucugagcacgugacagca

SEQ ID NO: 632691 - RNA, 22 nt, Human
aaguacagaaauagcaggugca

SEQ ID NO: 632692 - RNA, 22 nt, Human
aggaauaaccucauugcuuuuu

SEQ ID NO: 632693 - RNA, 22 nt, Human
aguguuccugcucucaggaagc

SEQ ID NO: 632694 - RNA, 22 nt, Human
aaugaagcaguccaucugcucu

SEQ ID NO: 632695 - RNA, 22 nt, Human
ucagaggcucacugucuacuuu

SEQ ID NO: 632696 - RNA, 22 nt, Human
ucacguuuuacugagugagaua

SEQ ID NO: 632697 - RNA, 22 nt, Human
acacacaugguauuguucagaa

SEQ ID NO: 632698 - RNA, 22 nt, Human
ccaggagugcagggaugguauc

SEQ ID NO: 632699 - RNA, 22 nt, Human
uccaggccaggguaagaggaga

SEQ ID NO: 632700 - RNA, 22 nt, Human
gcaguguguuuggauaacacac

SEQ ID NO: 632701 - RNA, 22 nt, Human
auggccaagaaguauuccugac

SEQ ID NO: 632702 - RNA, 22 nt, Human
agccacagcaacaagugcaauu

SEQ ID NO: 632703 - RNA, 21 nt, Human
augugugcuagaggacuacug

SEQ ID NO: 632704 - RNA, 22 nt, Human
auaaacagcuccauuuagugcc

SEQ ID NO: 632705 - RNA, 22 nt, Human
uagauucuguuuccucugguuu

SEQ ID NO: 632706 - RNA, 22 nt, Human
guuucauacagauuauucaugg

SEQ ID NO: 632707 - RNA, 22 nt, Human
caaggcaggaagccugucuuau

SEQ ID NO: 632708 - RNA, 22 nt, Human
ugaggaaacuuacaaggcagaa

SEQ ID NO: 632709 - RNA, 22 nt, Human
uuuaauuaggaaaugggcaggg

SEQ ID NO: 632710 - RNA, 22 nt, Human
gcagggacaacugugcaccuga

SEQ ID NO: 632711 - RNA, 20 nt, Human
cauuggcauucacagaagcu

SEQ ID NO: 632712 - RNA, 22 nt, Human
gggcaaagugguggaggcaguu

SEQ ID NO: 632713 - RNA, 22 nt, Human
augaaacaugagaaauggagag

SEQ ID NO: 632714 - RNA, 23 nt, Human
ugcuggaacccagggccuaacac

SEQ ID NO: 632715 - RNA, 22 nt, Human
uggaggaaaaaaccaggcagag

SEQ ID NO: 632716 - RNA, 22 nt, Human
gccagguggucuggcuccagag

SEQ ID NO: 632717 - RNA, 22 nt, Human
aaggagcgcuuagggggcagaa

SEQ ID NO: 632718 - RNA, 22 nt, Human
ccagugcaggugagcaccaggu

SEQ ID NO: 632719 - RNA, 22 nt, Human
ugcuuccuugagcucuccaauc

SEQ ID NO: 632720 - RNA, 22 nt, Human
cagagcaguggagaguaggucu

SEQ ID NO: 632721 - RNA, 22 nt, Human
aggucccaggcauagcuggucu

SEQ ID NO: 632722 - RNA, 22 nt, Human
ucuguucuuccuacauucacau

SEQ ID NO: 632723 - RNA, 22 nt, Human
ccaggaguuggaagcugccaug

SEQ ID NO: 632724 - RNA, 22 nt, Human
ccuuagugugaggggauacccc

SEQ ID NO: 632725 - RNA, 22 nt, Human
gugacaauauuagcucaggggc

SEQ ID NO: 632726 - RNA, 22 nt, Human
accucaggauguggacacagaa

SEQ ID NO: 632727 - RNA, 23 nt, Human
cugaagcaguucccucucugccc

SEQ ID NO: 632728 - RNA, 22 nt, Human
aacacugucuuauacuucaaug

SEQ ID NO: 632729 - RNA, 22 nt, Human
gcucagaaaagugaggcucagu

SEQ ID NO: 632730 - RNA, 22 nt, Human
agagacaggaguucuguuucca

SEQ ID NO: 632731 - RNA, 22 nt, Human
cacuguacugugaauaaggagg

SEQ ID NO: 632732 - RNA, 22 nt, Human
ugcaauuuuuaucaauucagca

SEQ ID NO: 632733 - RNA, 22 nt, Human
ggcaggcaucauguggucauua

SEQ ID NO: 632734 - RNA, 22 nt, Human
aauuccauccauuuguuucaac

SEQ ID NO: 632735 - RNA, 22 nt, Human
agugugagcccuggaguggugc

SEQ ID NO: 632736 - RNA, 22 nt, Human
cccaggacucggcacucuccuu

SEQ ID NO: 632737 - RNA, 22 nt, Human
uuuuuguugcagagaggccacu

SEQ ID NO: 632738 - RNA, 22 nt, Human
ucacauuugcaauugcauuguu

SEQ ID NO: 632739 - RNA, 22 nt, Human
uggccuggggaccugugagacc

SEQ ID NO: 632740 - RNA, 22 nt, Human
gacucuuucaaacagaaagcca

SEQ ID NO: 632741 - RNA, 23 nt, Human
acuagacuucaucgaagguuacc

SEQ ID NO: 632742 - RNA, 22 nt, Human
auuuuuucccaguuagccagga

SEQ ID NO: 632743 - RNA, 22 nt, Human
caggaacagcaccaggagcuag

SEQ ID NO: 632744 - RNA, 22 nt, Human
aucuuuaguagaggaauauauu

SEQ ID NO: 632745 - RNA, 15 nt, Human
ugaagacauaaggug

SEQ ID NO: 632746 - RNA, 22 nt, Human
gucaggucuuggaagauaggcu

SEQ ID NO: 632747 - RNA, 19 nt, Human
ucccaggcaaaggcuucuc

SEQ ID NO: 632748 - RNA, 22 nt, Human
gaaacucucgcauccugggaac

SEQ ID NO: 632749 - RNA, 22 nt, Human
agcagagaccauauagcccaga

SEQ ID NO: 632750 - RNA, 22 nt, Human
guccucugggagccuugagccu

SEQ ID NO: 632751 - RNA, 22 nt, Human
gauuuauuuuuaaucagcaggg

SEQ ID NO: 632752 - RNA, 22 nt, Human
caugauguuaucuaaaucuggu

SEQ ID NO: 632753 - RNA, 22 nt, Human
cuggcugucuucugggagcugu

SEQ ID NO: 632754 - RNA, 22 nt, Human
auaaucauucacauaaggugcu

SEQ ID NO: 632755 - RNA, 22 nt, Human
uagugugguaaauaaauguuuu

SEQ ID NO: 632756 - RNA, 22 nt, Human
ggcuuggaaauugcaggacaca

SEQ ID NO: 632757 - RNA, 22 nt, Human
auacaaugagugagugaauggg

SEQ ID NO: 632758 - RNA, 22 nt, Human
aaugucuuucuguucuaugaga

SEQ ID NO: 632759 - RNA, 22 nt, Human
caggcccacgaggcacacagag

SEQ ID NO: 632760 - RNA, 22 nt, Human
uuggcuuucagaaucccuaucu

SEQ ID NO: 632761 - RNA, 22 nt, Human
aacauagaauuguuauauuuuc

SEQ ID NO: 632762 - RNA, 22 nt, Human
auagcacaauauuaccuuuaug

SEQ ID NO: 632763 - RNA, 22 nt, Human
uuuaucucuuuugaccaagauu

SEQ ID NO: 632764 - RNA, 22 nt, Human
gcagugaaacaauaggaucaaa

SEQ ID NO: 632765 - RNA, 22 nt, Human
uccuggcucuaaguccugagug

SEQ ID NO: 632766 - RNA, 22 nt, Human
cagcugcccaagccccagaugu

SEQ ID NO: 632767 - RNA, 22 nt, Human
agccacugugagaggaccaggg

SEQ ID NO: 632768 - RNA, 22 nt, Human
cagggugagccucuggagcccu

SEQ ID NO: 632769 - RNA, 21 nt, Human
ucucuguguacagucucaccc

SEQ ID NO: 632770 - RNA, 22 nt, Human
uaggccaggacagagcuuccag

SEQ ID NO: 632771 - RNA, 22 nt, Human
aagacauuggcauugacuguaa

SEQ ID NO: 632772 - RNA, 22 nt, Human
gcaguguguguccccacacugg

SEQ ID NO: 632773 - RNA, 22 nt, Human
aguaggcauugugaaacugcau

SEQ ID NO: 632774 - RNA, 20 nt, Human
gcucagggccugggucugga

SEQ ID NO: 632775 - RNA, 22 nt, Human
uagcccagagucccaauuccag

SEQ ID NO: 632776 - RNA, 22 nt, Human
ggcucugggccagaguuggcuu

SEQ ID NO: 632777 - RNA, 20 nt, Human
cucuuaaauguaaaguaggc

SEQ ID NO: 632778 - RNA, 22 nt, Human
ugucuccauuuucaaguagcag

SEQ ID NO: 632779 - RNA, 22 nt, Human
aaugcacagcuaaagugguucc

SEQ ID NO: 632780 - RNA, 22 nt, Human
acuuguguaacacagaaagaac

SEQ ID NO: 632781 - RNA, 22 nt, Human
aaggcagucaaagcagacuucu

SEQ ID NO: 632782 - RNA, 22 nt, Human
cugggcucuaggaaccauuccu

SEQ ID NO: 632783 - RNA, 22 nt, Human
ucacaguaucuagaaaugaggg

SEQ ID NO: 632784 - RNA, 22 nt, Human
gcucugccaaggacccauucuc

SEQ ID NO: 632785 - RNA, 22 nt, Human
agccucugcacuucuuacaggu

SEQ ID NO: 632786 - RNA, 22 nt, Human
auccugucuaugaguagauaau

SEQ ID NO: 632787 - RNA, 22 nt, Human
ggcagccuucucucauagguga

SEQ ID NO: 632788 - RNA, 22 nt, Human
uucauugagugguuuauucuaa

SEQ ID NO: 632789 - RNA, 21 nt, Human
aggguccuacagggcucagga

SEQ ID NO: 632790 - RNA, 22 nt, Human
aaaugucuuucuucugcuacgu

SEQ ID NO: 632791 - RNA, 22 nt, Human
cagagcucuauguucauggagg

SEQ ID NO: 632792 - RNA, 22 nt, Human
ugggagugcaccugggacacga

SEQ ID NO: 632793 - RNA, 22 nt, Human
cagguacauucguagacccauu

SEQ ID NO: 632794 - RNA, 22 nt, Human
acagaacaagaccugcuuauug

SEQ ID NO: 632795 - RNA, 22 nt, Human
aaauaaagguccacuuuagggc

SEQ ID NO: 632796 - RNA, 22 nt, Human
gagagaaaugugcaguuugggc

SEQ ID NO: 632797 - RNA, 22 nt, Human
caaauacugaguuuauuuucaa

SEQ ID NO: 632798 - RNA, 22 nt, Human
uugcacuccagcccgagcaaca

SEQ ID NO: 632799 - RNA, 22 nt, Human
guccuucaucuggagccugguc

SEQ ID NO: 632800 - RNA, 19 nt, Human
cuccucagucccagagguc

SEQ ID NO: 632801 - RNA, 22 nt, Human
gaacuuuugggaagccguguga

SEQ ID NO: 632802 - RNA, 22 nt, Human
acuacuacaagugaguacaaag

SEQ ID NO: 632803 - RNA, 22 nt, Human
aaagcagcuguuugacuuucca

SEQ ID NO: 632804 - RNA, 22 nt, Human
gcaaagcaaaugccugaaggcg

SEQ ID NO: 632805 - RNA, 22 nt, Human
ugguggaccuggcauugaaccu

SEQ ID NO: 632806 - RNA, 21 nt, Human
cuugggcuuguagauggugga

SEQ ID NO: 632807 - RNA, 22 nt, Human
gaaaacuaacggaaaaguuagg

SEQ ID NO: 632808 - RNA, 22 nt, Human
ggggguaggcagacaaggacau

SEQ ID NO: 632809 - RNA, 22 nt, Human
ucagauggguuuugaaggaugu

SEQ ID NO: 632810 - RNA, 22 nt, Human
auucuguauggaaaagcacuau

SEQ ID NO: 632811 - RNA, 22 nt, Human
cccaguggcccagcauguggug

SEQ ID NO: 632812 - RNA, 22 nt, Human
guggagcaggacuagcugagaa

SEQ ID NO: 632813 - RNA, 22 nt, Human
aaagccagugguaugagagaaa

SEQ ID NO: 632814 - RNA, 22 nt, Human
agggcugcuauguugauucaga

SEQ ID NO: 632815 - RNA, 22 nt, Human
cugggaagaaauugugggaggc

SEQ ID NO: 632816 - RNA, 22 nt, Human
cagaggcuguguaggcagacug

SEQ ID NO: 632817 - RNA, 22 nt, Human
cccaggacccuucaauggcucc

SEQ ID NO: 632818 - RNA, 22 nt, Human
uuccauaauuaaguggagagaa

SEQ ID NO: 632819 - RNA, 22 nt, Human
uaguuuuuucaacaaauggugc

SEQ ID NO: 632820 - RNA, 19 nt, Human
gagggcucauuugaacaau

SEQ ID NO: 632821 - RNA, 21 nt, Human
auugcucuguugugucuagaa

SEQ ID NO: 632822 - RNA, 22 nt, Human
ccccucuuguacuagacaguuu

SEQ ID NO: 632823 - RNA, 22 nt, Human
ggccagagucuauaugcagaca

SEQ ID NO: 632824 - RNA, 22 nt, Human
uacuguuuucuauaauggcugu

SEQ ID NO: 632825 - RNA, 22 nt, Human
auuuucugguugagguuuaaca

SEQ ID NO: 632826 - RNA, 22 nt, Human
agcaauuuuugauuuucagugu

SEQ ID NO: 632827 - RNA, 22 nt, Human
ucaggccucaagcugcuuuaag

SEQ ID NO: 632828 - RNA, 22 nt, Human
aggccagcucacccuggcuccu

SEQ ID NO: 632829 - RNA, 22 nt, Human
ugaaauaucauuuucaucuccc

SEQ ID NO: 632830 - RNA, 22 nt, Human
ggagagaauucagcuuaagauu

SEQ ID NO: 632831 - RNA, 22 nt, Human
ugggggcauggaccagccuggc

SEQ ID NO: 632832 - RNA, 22 nt, Human
augucacagcucccauuccucc

SEQ ID NO: 632833 - RNA, 22 nt, Human
uuuccucuccaccaggaggucu

SEQ ID NO: 632834 - RNA, 23 nt, Human
gugugcaggauuauuugcagaca

SEQ ID NO: 632835 - RNA, 22 nt, Human
gccagccagaguccaucugaga

SEQ ID NO: 632836 - RNA, 22 nt, Human
ugcagagaccacugugccuucc

SEQ ID NO: 632837 - RNA, 22 nt, Human
uccagcucugauucucacuagc

SEQ ID NO: 632838 - RNA, 22 nt, Human
uucaacaagucuuuuuucacug

SEQ ID NO: 632839 - RNA, 22 nt, Human
ggccuugguuccaaagcaggca

SEQ ID NO: 632840 - RNA, 22 nt, Human
ucuggccccuggucucuggugu

SEQ ID NO: 632841 - RNA, 22 nt, Human
aagagugacuuuucagcuguga

SEQ ID NO: 632842 - RNA, 22 nt, Human
aagcaucuauagguucuaggag

SEQ ID NO: 632843 - RNA, 22 nt, Human
uggugggacaucugaggagagg

SEQ ID NO: 632844 - RNA, 22 nt, Human
ugcuggcugggcugcuggagac

SEQ ID NO: 632845 - RNA, 22 nt, Human
gaguccuggcguccaauuuccu

SEQ ID NO: 632846 - RNA, 22 nt, Human
ucucaggaagugauauugagac

SEQ ID NO: 632847 - RNA, 22 nt, Human
auucagauugguuuaagcuagu

SEQ ID NO: 632848 - RNA, 22 nt, Human
aggaaagguucagugauugaaa

SEQ ID NO: 632849 - RNA, 22 nt, Human
cauaacauuauuuucugaagau

SEQ ID NO: 632850 - RNA, 22 nt, Human
ggcagcuuuuaucccugacaga

SEQ ID NO: 632851 - RNA, 22 nt, Human
aggguuaauugguguccugagg

SEQ ID NO: 632852 - RNA, 19 nt, Human
ucucacaguuuccuugccu

SEQ ID NO: 632853 - RNA, 22 nt, Human
uuccuuucucuggacugcagcc

SEQ ID NO: 632854 - RNA, 22 nt, Human
ccagcaggagaugccugugucu

SEQ ID NO: 632855 - RNA, 22 nt, Human
aaacuguuccuuuuucagcaac

SEQ ID NO: 632856 - RNA, 22 nt, Human
acagggaagcucaggggcucug

SEQ ID NO: 632857 - RNA, 19 nt, Human
acaaugaauguguucucuu

SEQ ID NO: 632858 - RNA, 22 nt, Human
uggagccaaggccaguucucag

SEQ ID NO: 632859 - RNA, 17 nt, Human
ggcagcugugugcaugc

SEQ ID NO: 632860 - RNA, 19 nt, Human
ugcagggcugcgccugggg

SEQ ID NO: 632861 - RNA, 22 nt, Human
cauguauugaagugugcaucug

SEQ ID NO: 632862 - RNA, 22 nt, Human
guggagagagugacagcaucuu

SEQ ID NO: 632863 - RNA, 22 nt, Human
ucaggaugguguggaggaaaua

SEQ ID NO: 632864 - RNA, 22 nt, Human
ccaagagguaauacgagauauc

SEQ ID NO: 632865 - RNA, 22 nt, Human
gaagacauuuuaugcauacucu

SEQ ID NO: 632866 - RNA, 22 nt, Human
aacaguuugccugaaauguauu

SEQ ID NO: 632867 - RNA, 22 nt, Human
gucuguaucagaggagugaaug

SEQ ID NO: 632868 - RNA, 22 nt, Human
ugugggaaucagccaggggggc

SEQ ID NO: 632869 - RNA, 22 nt, Human
ggcaggcuugauauggggggac

SEQ ID NO: 632870 - RNA, 21 nt, Human
uccugcaggaggccugagagg

SEQ ID NO: 632871 - RNA, 22 nt, Human
ugggaagaugaggugccauggg

SEQ ID NO: 632872 - RNA, 22 nt, Human
aaguacauaaaggaauuagcca

SEQ ID NO: 632873 - RNA, 21 nt, Human
agcuuccagagcacauuccau

SEQ ID NO: 632874 - RNA, 22 nt, Human
auuucccaauacgcuaagugga

SEQ ID NO: 632875 - RNA, 22 nt, Human
gaggagcacaugaggcugaggg

SEQ ID NO: 632876 - RNA, 21 nt, Human
uaagcuaaacauucaguuaac

SEQ ID NO: 632877 - RNA, 22 nt, Human
guggccuagaggugcaaggaac

SEQ ID NO: 632878 - RNA, 22 nt, Human
gcugcuguguuggccacugcuu

SEQ ID NO: 632879 - RNA, 19 nt, Human
acugggaaaaaggcacugg

SEQ ID NO: 632880 - RNA, 22 nt, Human
gggcuucucucaggggcaugag

SEQ ID NO: 632881 - RNA, 22 nt, Human
caggcccugccuuggcaugugu

SEQ ID NO: 632882 - RNA, 23 nt, Human
acacaaggguaacugccagccau

SEQ ID NO: 632883 - RNA, 22 nt, Human
gagaggcugugugccauuguug

SEQ ID NO: 632884 - RNA, 22 nt, Human
aacagcaucaccccauaacauu

SEQ ID NO: 632885 - RNA, 21 nt, Human
aguuugaugcaauuucugaga

SEQ ID NO: 632886 - RNA, 22 nt, Human
aucaaaaugcuccagugauggu

SEQ ID NO: 632887 - RNA, 22 nt, Human
ugcucugggauucagcagccug

SEQ ID NO: 632888 - RNA, 22 nt, Human
gcccuggccuucaucucagaca

SEQ ID NO: 632889 - RNA, 22 nt, Human
uagacaggguggcuuagaaaca

SEQ ID NO: 632890 - RNA, 22 nt, Human
cugcugggucccccugcugauu

SEQ ID NO: 632891 - RNA, 22 nt, Human
aaauuggauuuuaaacuguugg

SEQ ID NO: 632892 - RNA, 22 nt, Human
aauggccauaucauugcagagc

SEQ ID NO: 632893 - RNA, 22 nt, Human
cauguguguggacgagcguggc

SEQ ID NO: 632894 - RNA, 22 nt, Human
aaaaguauuuuggaucucagau

SEQ ID NO: 632895 - RNA, 22 nt, Human
ccuuuacacauggaaugggucu

SEQ ID NO: 632896 - RNA, 22 nt, Human
uaagcaaauaaugcaucaaggg

SEQ ID NO: 632897 - RNA, 21 nt, Human
aaagaacaggcagauguucuu

SEQ ID NO: 632898 - RNA, 22 nt, Human
cacagucaauguagaaauauga

SEQ ID NO: 632899 - RNA, 22 nt, Human
uuucucaacuguauuaugcaga

SEQ ID NO: 632900 - RNA, 22 nt, Human
uaaagucaagguacuguuucac

SEQ ID NO: 632901 - RNA, 22 nt, Human
aagcacauuaaggaacauugaa

SEQ ID NO: 632902 - RNA, 21 nt, Human
ucaguccuguuagccuuuggg

SEQ ID NO: 632903 - RNA, 17 nt, Human
aggccagaugaggcaag

SEQ ID NO: 632904 - RNA, 22 nt, Human
ucaaauaccagcuuuuccagaa

SEQ ID NO: 632905 - RNA, 23 nt, Human
acagacuguauucaaaguaggac

SEQ ID NO: 632906 - RNA, 22 nt, Human
uccaggcugcagucuugcccuc

SEQ ID NO: 632907 - RNA, 17 nt, Human
uggcacagaggugcuau

SEQ ID NO: 632908 - RNA, 22 nt, Human
agggugcagggacaggugugca

SEQ ID NO: 632909 - RNA, 22 nt, Human
ucugggaauuuauuggcacuuu

SEQ ID NO: 632910 - RNA, 22 nt, Human
uaaugugaagacauaaaucaga

SEQ ID NO: 632911 - RNA, 20 nt, Human
uggaccacccuccucuuugc

SEQ ID NO: 632912 - RNA, 22 nt, Human
agagacagacacaucgggcugc

SEQ ID NO: 632913 - RNA, 22 nt, Human
ccagcaccuugaucuuggaguu

SEQ ID NO: 632914 - RNA, 22 nt, Human
aucagagauuguaguaugugca

SEQ ID NO: 632915 - RNA, 20 nt, Human
caccuggauaugacccagcu

SEQ ID NO: 632916 - RNA, 19 nt, Human
ggcugagcgccuuggcugc

SEQ ID NO: 632917 - RNA, 22 nt, Human
ggcuucaccugugcacucuacc

SEQ ID NO: 632918 - RNA, 22 nt, Human
gcaggcugaugacuggaguugg

SEQ ID NO: 632919 - RNA, 22 nt, Human
cuuuaacaguuccauucaauuu

SEQ ID NO: 632920 - RNA, 22 nt, Human
uuacgcagcugcuccaggaagc

SEQ ID NO: 632921 - RNA, 22 nt, Human
uuugaacaggaguaucuauagu

SEQ ID NO: 632922 - RNA, 22 nt, Human
cucacaggcgguaauucaggga

SEQ ID NO: 632923 - RNA, 22 nt, Human
ucaucacauguguagucauccc

SEQ ID NO: 632924 - RNA, 22 nt, Human
uuugacucauugauuuucucug

SEQ ID NO: 632925 - RNA, 22 nt, Human
aucaccaaggcuuuaggaauuu

SEQ ID NO: 632926 - RNA, 22 nt, Human
gaggcucacugggcaaagacuc

SEQ ID NO: 632927 - RNA, 22 nt, Human
cauaaacucuugagauucuugu

SEQ ID NO: 632928 - RNA, 22 nt, Human
guaauugaguuaccuggaccag

SEQ ID NO: 632929 - RNA, 22 nt, Human
uuugugugcaacgcauggaguc

SEQ ID NO: 632930 - RNA, 19 nt, Human
agcaacaccguuuauuucc

SEQ ID NO: 632931 - RNA, 22 nt, Human
ccaggaagggcucuuuaaagac

SEQ ID NO: 632932 - RNA, 22 nt, Human
uucagggcuuagggaaauagug

SEQ ID NO: 632933 - RNA, 22 nt, Human
agacagacauucuagagccacc

SEQ ID NO: 632934 - RNA, 22 nt, Human
acugucuuguguuaaagaacca

SEQ ID NO: 632935 - RNA, 22 nt, Human
auaaacuuuagcggaaggagga

SEQ ID NO: 632936 - RNA, 22 nt, Human
uuguuucaugaguguaaaggga

SEQ ID NO: 632937 - RNA, 22 nt, Human
acaugcacaccuauauacaugu

SEQ ID NO: 632938 - RNA, 22 nt, Human
auggagugggccaauuuuagug

SEQ ID NO: 632939 - RNA, 22 nt, Human
aucauguuaaauauuucaaucu

SEQ ID NO: 632940 - RNA, 22 nt, Human
augguagguacaacagcaggca

SEQ ID NO: 632941 - RNA, 23 nt, Human
ucucuuucaagagcuuaaugugc

SEQ ID NO: 632942 - RNA, 22 nt, Human
caauucaaaugcauaguucaca

SEQ ID NO: 632943 - RNA, 22 nt, Human
accagcugauuuaagaauaaag

SEQ ID NO: 632944 - RNA, 22 nt, Human
aaccucucugugcccugacuuu

SEQ ID NO: 632945 - RNA, 22 nt, Human
caugaaggcugccagcaggcau

SEQ ID NO: 632946 - RNA, 22 nt, Human
gagagggccagggugagaacua

SEQ ID NO: 632947 - RNA, 22 nt, Human
gucacaguggggucacagugug

SEQ ID NO: 632948 - RNA, 22 nt, Human
uagggaccuuagaauuguaugu

SEQ ID NO: 632949 - RNA, 19 nt, Human
ccaugccaucauuuuaaag

SEQ ID NO: 632950 - RNA, 22 nt, Human
cccagggcuguagaauguccaa

SEQ ID NO: 632951 - RNA, 22 nt, Human
gcccaggaguuugcauuuuaac

SEQ ID NO: 632952 - RNA, 22 nt, Human
cccagggauuauaaaggugaaa

SEQ ID NO: 632953 - RNA, 22 nt, Human
guucagcagcagugauuuugug

SEQ ID NO: 632954 - RNA, 22 nt, Human
agcuucuuggcucagcacuugg

SEQ ID NO: 632955 - RNA, 22 nt, Human
ucugauaagugguguauacugu

SEQ ID NO: 632956 - RNA, 22 nt, Human
ugcagcaggcacaggacggaag

SEQ ID NO: 632957 - RNA, 22 nt, Human
ccaagaugaucuuuacaguguu

SEQ ID NO: 632958 - RNA, 22 nt, Human
agugcauuccuggggaagaagc

SEQ ID NO: 632959 - RNA, 22 nt, Human
aggagcagaauuuaaugugcag

SEQ ID NO: 632960 - RNA, 22 nt, Human
auuucuaaagagggugguuugg

SEQ ID NO: 632961 - RNA, 22 nt, Human
uaaccugaggagaacagugcuu

SEQ ID NO: 632962 - RNA, 22 nt, Human
cugcaguaguuuuugacucuag

SEQ ID NO: 632963 - RNA, 22 nt, Human
aaggcccuggaugguuuugaga

SEQ ID NO: 632964 - RNA, 21 nt, Human
ucagugcaauucuauggggaa

SEQ ID NO: 632965 - RNA, 22 nt, Human
ucuuggaaguagaacacagucu

SEQ ID NO: 632966 - RNA, 22 nt, Human
gcagagcugguacuugagccug

SEQ ID NO: 632967 - RNA, 21 nt, Human
gaggcccaugggacaggggcu

SEQ ID NO: 632968 - RNA, 21 nt, Human
uuggccuuugucucagacacu

SEQ ID NO: 632969 - RNA, 22 nt, Human
ucaggacacuuggcacaagguc

SEQ ID NO: 632970 - RNA, 22 nt, Human
aggaggaaaaaggccacagcaa

SEQ ID NO: 632971 - RNA, 22 nt, Human
augcugggaaguccuaaccaca

SEQ ID NO: 632972 - RNA, 22 nt, Human
aaacccugcucuuauggaacuu

SEQ ID NO: 632973 - RNA, 22 nt, Human
uuacagagcucauuucuaaggg

SEQ ID NO: 632974 - RNA, 22 nt, Human
gggagcugcggucuugcgaaga

SEQ ID NO: 632975 - RNA, 22 nt, Human
agugggugagcuuggucuagau

SEQ ID NO: 632976 - RNA, 22 nt, Human
ucccugcauuugggagaguguc

SEQ ID NO: 632977 - RNA, 22 nt, Human
gaaauguuguccugucucuuga

SEQ ID NO: 632978 - RNA, 22 nt, Human
gaaaugaaacaggcuuuuaagg

SEQ ID NO: 632979 - RNA, 22 nt, Human
acaugcacccaguuacacucuc

SEQ ID NO: 632980 - RNA, 22 nt, Human
cuauuuuucuguacccuaauuu

SEQ ID NO: 632981 - RNA, 22 nt, Human
uggcccugacagguccugggca

SEQ ID NO: 632982 - RNA, 22 nt, Human
uuguuauuuaggucuggguuag

SEQ ID NO: 632983 - RNA, 22 nt, Human
agcccugcccugccauguggca

SEQ ID NO: 632984 - RNA, 22 nt, Human
uucuucauggguucuuuuagga

SEQ ID NO: 632985 - RNA, 22 nt, Human
ucucaucuccauuauagcauca

SEQ ID NO: 632986 - RNA, 22 nt, Human
gauauguaccaccucuuaaaag

SEQ ID NO: 632987 - RNA, 23 nt, Human
uggaagacuccucucuuggcugc

SEQ ID NO: 632988 - RNA, 22 nt, Human
aggacacacuucugaggucuuu

SEQ ID NO: 632989 - RNA, 22 nt, Human
gcugcagguugggcaacagagu

SEQ ID NO: 632990 - RNA, 22 nt, Human
cugaaggauuagagagcacuua

SEQ ID NO: 632991 - RNA, 22 nt, Human
aaauacacguacauguguaaaa

SEQ ID NO: 632992 - RNA, 22 nt, Human
gcagcuuucugggacagaaagg

SEQ ID NO: 632993 - RNA, 22 nt, Human
aguccauaguuuacauuacagc

SEQ ID NO: 632994 - RNA, 23 nt, Human
agaaaagcuuggacacauggccu

SEQ ID NO: 632995 - RNA, 22 nt, Human
cuggguguagcccaguaugagg

SEQ ID NO: 632996 - RNA, 22 nt, Human
uuggcauugaaguuucauuggu

SEQ ID NO: 632997 - RNA, 22 nt, Human
uccaggcaaggauaauaaacau

SEQ ID NO: 632998 - RNA, 22 nt, Human
caugcagggagugcuccuauua

SEQ ID NO: 632999 - RNA, 22 nt, Human
cagcacaguuucuggcccgccg

SEQ ID NO: 633000 - RNA, 20 nt, Human
aggcagacaaggagucuguu

SEQ ID NO: 633001 - RNA, 22 nt, Human
cucugcaguguaacagcgcuug

SEQ ID NO: 633002 - RNA, 22 nt, Human
uugcuuuagggcaaauauuuca

SEQ ID NO: 633003 - RNA, 22 nt, Human
ucugagaaugaguguuuucuua

SEQ ID NO: 633004 - RNA, 22 nt, Human
cuccaggcgggaggcgguucca

SEQ ID NO: 633005 - RNA, 22 nt, Human
ugagggcagagcacuggggagc

SEQ ID NO: 633006 - RNA, 22 nt, Human
gcaggugggagccgcugccuga

SEQ ID NO: 633007 - RNA, 22 nt, Human
cugaggaagagguaccauuugu

SEQ ID NO: 633008 - RNA, 22 nt, Human
ucauucucugggaugcaguuug

SEQ ID NO: 633009 - RNA, 22 nt, Human
aguguccucaggcuuuguuccu

SEQ ID NO: 633010 - RNA, 22 nt, Human
ucauaaauuagcugucuuugaa

SEQ ID NO: 633011 - RNA, 22 nt, Human
ggaauugguuucaagggaaagu

SEQ ID NO: 633012 - RNA, 22 nt, Human
gacaagacagcuugcagacaac

SEQ ID NO: 633013 - RNA, 22 nt, Human
ggcuuuaucaaaugagacccug

SEQ ID NO: 633014 - RNA, 22 nt, Human
aggacacagcugcucugcagag

SEQ ID NO: 633015 - RNA, 22 nt, Human
uaguggcugcagggcuguuuga

SEQ ID NO: 633016 - RNA, 22 nt, Human
ccagcucccgcaggcugcacag

SEQ ID NO: 633017 - RNA, 22 nt, Human
ugguccuggaagguccugaggg

SEQ ID NO: 633018 - RNA, 19 nt, Human
ugaggcacaugauaagaac

SEQ ID NO: 633019 - RNA, 22 nt, Human
aaaacaguuauaaacagaguca

SEQ ID NO: 633020 - RNA, 22 nt, Human
uguuuuuuccuuaugcaaucug

SEQ ID NO: 633021 - RNA, 22 nt, Human
acccugggucauauacagugug

SEQ ID NO: 633022 - RNA, 22 nt, Human
uauaguacauggaaucuucaua

SEQ ID NO: 633023 - RNA, 21 nt, Human
agaaaaguagaguuuucagag

SEQ ID NO: 633024 - RNA, 16 nt, Human
ggcaccagugaacaca

SEQ ID NO: 633025 - RNA, 22 nt, Human
agcugggaugaggagcauccuu

SEQ ID NO: 633026 - RNA, 22 nt, Human
uucuuuuuaucuucccauaaga

SEQ ID NO: 633027 - RNA, 21 nt, Human
acugugggucugaccaccugg

SEQ ID NO: 633028 - RNA, 22 nt, Human
guuuugaaucacugcgcuucac

SEQ ID NO: 633029 - RNA, 22 nt, Human
acuuuuuacaggguguauacca

SEQ ID NO: 633030 - RNA, 22 nt, Human
aguguguagcacaugguaagca

SEQ ID NO: 633031 - RNA, 22 nt, Human
uugcugaugguauuaugcuagu

SEQ ID NO: 633032 - RNA, 22 nt, Human
acucacagcaugagcuuggcag

SEQ ID NO: 633033 - RNA, 22 nt, Human
cagaggcuuggcauuaucaugc

SEQ ID NO: 633034 - RNA, 22 nt, Human
acaucugauuacaugagaauau

SEQ ID NO: 633035 - RNA, 22 nt, Human
uggcccagcccugcucuagggc

SEQ ID NO: 633036 - RNA, 22 nt, Human
uggagcugggguuugaaucugg

SEQ ID NO: 633037 - RNA, 22 nt, Human
gaauuucaaagagguuaagagg

SEQ ID NO: 633038 - RNA, 22 nt, Human
agggagaagagaacaaagcccu

SEQ ID NO: 633039 - RNA, 22 nt, Human
gaggccuccucugagacaucug

SEQ ID NO: 633040 - RNA, 22 nt, Human
cugagcccauugggugcuguua

SEQ ID NO: 633041 - RNA, 20 nt, Human
gacacaggcaguccucagag

SEQ ID NO: 633042 - RNA, 22 nt, Human
agucgcagacaugguccccuuu

SEQ ID NO: 633043 - RNA, 20 nt, Human
uccugagauuuaagggguuc

SEQ ID NO: 633044 - RNA, 22 nt, Human
auuuacacuugguuuacuagag

SEQ ID NO: 633045 - RNA, 22 nt, Human
cauugcuuaucuaguucacaua

SEQ ID NO: 633046 - RNA, 22 nt, Human
aaccuggaggacugcaauccau

SEQ ID NO: 633047 - RNA, 22 nt, Human
uguugaguauauaccuacaagu

SEQ ID NO: 633048 - RNA, 20 nt, Human
uggaccauaaacaccaggua

SEQ ID NO: 633049 - RNA, 22 nt, Human
uugcccugucuuaagcuggcaa

SEQ ID NO: 633050 - RNA, 22 nt, Human
auggccagaugaaauaauagag

SEQ ID NO: 633051 - RNA, 22 nt, Human
auuauucuuaugucaucauggc

SEQ ID NO: 633052 - RNA, 22 nt, Human
ccucaguguuaggauaagagaa

SEQ ID NO: 633053 - RNA, 22 nt, Human
augucccagcugagagacaacu

SEQ ID NO: 633054 - RNA, 19 nt, Human
agggccugagcagauguug

SEQ ID NO: 633055 - RNA, 22 nt, Human
gggcucucgauuagacccuggg

SEQ ID NO: 633056 - RNA, 22 nt, Human
cagagagaaucuuggcagcuga

SEQ ID NO: 633057 - RNA, 22 nt, Human
cccuucagcugagugggacagc

SEQ ID NO: 633058 - RNA, 22 nt, Human
acaguucuguccuagacuucgu

SEQ ID NO: 633059 - RNA, 22 nt, Human
uuaauguggaaagcucuugagu

SEQ ID NO: 633060 - RNA, 22 nt, Human
uggaauguaaacucugugaggg

SEQ ID NO: 633061 - RNA, 22 nt, Human
cagcagcagauucagcgucugg

SEQ ID NO: 633062 - RNA, 22 nt, Human
gugcagccugucgccaguggau

SEQ ID NO: 633063 - RNA, 22 nt, Human
aaauugucaguuaucugggaua

SEQ ID NO: 633064 - RNA, 22 nt, Human
aucacagagauugcuuuuaaaa

SEQ ID NO: 633065 - RNA, 22 nt, Human
agcugaggcauggacaggcugc

SEQ ID NO: 633066 - RNA, 22 nt, Human
cccagcaguuugcuuagaguga

SEQ ID NO: 633067 - RNA, 22 nt, Human
cuuccagcugauuggcauccag

SEQ ID NO: 633068 - RNA, 22 nt, Human
gaacacaucacauuuuacagug

SEQ ID NO: 633069 - RNA, 22 nt, Human
agcccugagcuggccugggcuu

SEQ ID NO: 633070 - RNA, 22 nt, Human
aaaugcaaggccaugugaagga

SEQ ID NO: 633071 - RNA, 22 nt, Human
cuggcaggaagaggaaagguca

SEQ ID NO: 633072 - RNA, 22 nt, Human
gcacacacaugugaguacaugc

SEQ ID NO: 633073 - RNA, 22 nt, Human
cuugggugugaccuuggcauug

SEQ ID NO: 633074 - RNA, 22 nt, Human
ggcaggguuuacaauagcaaua

SEQ ID NO: 633075 - RNA, 22 nt, Human
caggucugaagagucacaugcc

SEQ ID NO: 633076 - RNA, 22 nt, Human
aaauuaagaguaacucuguaga

SEQ ID NO: 633077 - RNA, 22 nt, Human
cuggagccuagguugaccuggg

SEQ ID NO: 633078 - RNA, 22 nt, Human
uugaacagcuguuacauuguua

SEQ ID NO: 633079 - RNA, 22 nt, Human
ugagcuuccucccugcauccau

SEQ ID NO: 633080 - RNA, 22 nt, Human
agaaaauaauuucuuggcuggu

SEQ ID NO: 633081 - RNA, 22 nt, Human
uggccucaagucugagggccuu

SEQ ID NO: 633082 - RNA, 22 nt, Human
uuuggcucggcugcugauggug

SEQ ID NO: 633083 - RNA, 22 nt, Human
uguggcugcuccugggugguca

SEQ ID NO: 633084 - RNA, 20 nt, Human
aggcucagcugagcucuugg

SEQ ID NO: 633085 - RNA, 22 nt, Human
cugagaacaucauucagauauu

SEQ ID NO: 633086 - RNA, 22 nt, Human
ucaguaauauucuuuaaaauac

SEQ ID NO: 633087 - RNA, 22 nt, Human
uauguuucuuccuuuucauaca

SEQ ID NO: 633088 - RNA, 22 nt, Human
agugggugggugucugacaguu

SEQ ID NO: 633089 - RNA, 22 nt, Human
uggaaugugcuagggcuguggc

SEQ ID NO: 633090 - RNA, 22 nt, Human
gugcccugaguggguaggagag

SEQ ID NO: 633091 - RNA, 22 nt, Human
uaauuuauuucaacugccaagg

SEQ ID NO: 633092 - RNA, 22 nt, Human
cagaacauuccaugugcccugc

SEQ ID NO: 633093 - RNA, 22 nt, Human
uauaaagagucucaaagaaguu

SEQ ID NO: 633094 - RNA, 22 nt, Human
aacucuauuuacccuacuaaac

SEQ ID NO: 633095 - RNA, 22 nt, Human
aaugggaggauuuucucucuug

SEQ ID NO: 633096 - RNA, 22 nt, Human
gggauggggucgggacccugcu

SEQ ID NO: 633097 - RNA, 20 nt, Human
aguagcagugugacauugac

SEQ ID NO: 633098 - RNA, 22 nt, Human
aacauugaguucuacuuccauu

SEQ ID NO: 633099 - RNA, 22 nt, Human
uaacuucacuggacucagcagc

SEQ ID NO: 633100 - RNA, 17 nt, Human
acaagcaguggccaugg

SEQ ID NO: 633101 - RNA, 22 nt, Human
cugcuuuaaguauucaacaaag

SEQ ID NO: 633102 - RNA, 22 nt, Human
ggccccaggaccuccacggucc

SEQ ID NO: 633103 - RNA, 22 nt, Human
uugcucagcacuggagccagcu

SEQ ID NO: 633104 - RNA, 22 nt, Human
gugcgcuucuuccugagccagg

SEQ ID NO: 633105 - RNA, 22 nt, Human
ugugauuuccagccauuaaaaa

SEQ ID NO: 633106 - RNA, 22 nt, Human
cagccccuuccuggcaucugga

SEQ ID NO: 633107 - RNA, 18 nt, Human
agggcucucugcuggguu

SEQ ID NO: 633108 - RNA, 22 nt, Human
gauauucaacuaaagugaauua

SEQ ID NO: 633109 - RNA, 22 nt, Human
gcaguggcuaagcucgcaugca

SEQ ID NO: 633110 - RNA, 22 nt, Human
uacugccaaauugcagcaaugu

SEQ ID NO: 633111 - RNA, 22 nt, Human
uaaaggguagguuuuacuguaa

SEQ ID NO: 633112 - RNA, 22 nt, Human
guuucucaacaugcuuucuaac

SEQ ID NO: 633113 - RNA, 22 nt, Human
agcuuucguuccuuagacacau

SEQ ID NO: 633114 - RNA, 22 nt, Human
uguaauuuuacgugacacaguu

SEQ ID NO: 633115 - RNA, 22 nt, Human
auggcaggaugagacaacaauu

SEQ ID NO: 633116 - RNA, 22 nt, Human
gcccaggcuagcguagagugca

SEQ ID NO: 633117 - RNA, 22 nt, Human
uuuaucuucugcaguucuggcu

SEQ ID NO: 633118 - RNA, 22 nt, Human
ccucaccuuuucucugauugcu

SEQ ID NO: 633119 - RNA, 22 nt, Human
cucagucaguuuuugugagaga

SEQ ID NO: 633120 - RNA, 22 nt, Human
aacacaggccagccugugcagu

SEQ ID NO: 633121 - RNA, 22 nt, Human
aagaugguaaggcagcuggcag

SEQ ID NO: 633122 - RNA, 22 nt, Human
cggcagcuccgcgccguaggac

SEQ ID NO: 633123 - RNA, 22 nt, Human
cacugccuccccaggcuccaca

SEQ ID NO: 633124 - RNA, 23 nt, Human
ccugccuguucuaacuccauuuc

SEQ ID NO: 633125 - RNA, 22 nt, Human
acuccccagacugccaugcugg

SEQ ID NO: 633126 - RNA, 22 nt, Human
uccaggcaugucugaguccuuc

SEQ ID NO: 633127 - RNA, 22 nt, Human
aaaggacaugucaauaucaggc

SEQ ID NO: 633128 - RNA, 22 nt, Human
agcagggaggcccagggcacug

SEQ ID NO: 633129 - RNA, 22 nt, Human
cugaggcaggggcagcuggaga

SEQ ID NO: 633130 - RNA, 22 nt, Human
aagcauuuuucacagcaacagc

SEQ ID NO: 633131 - RNA, 22 nt, Human
accagcuccaggccccugcugg

SEQ ID NO: 633132 - RNA, 21 nt, Human
gggcacugaaagggaauagca

SEQ ID NO: 633133 - RNA, 22 nt, Human
cauagcgguauuccacgugguu

SEQ ID NO: 633134 - RNA, 22 nt, Human
ucuaacuuguauguauaguuuu

SEQ ID NO: 633135 - RNA, 22 nt, Human
auaugaagucagacaaacuggg

SEQ ID NO: 633136 - RNA, 22 nt, Human
cagcuauuuucucauuaaggau

SEQ ID NO: 633137 - RNA, 22 nt, Human
agucuggaguagagccuagaaa

SEQ ID NO: 633138 - RNA, 22 nt, Human
ugucuggaugucuggagcaucg

SEQ ID NO: 633139 - RNA, 22 nt, Human
ugguaaagaaaugucagggcag

SEQ ID NO: 633140 - RNA, 22 nt, Human
gagcagcucagaggacuagugu

SEQ ID NO: 633141 - RNA, 22 nt, Human
gagcagaucucaggccuucugu

SEQ ID NO: 633142 - RNA, 22 nt, Human
agugcugaagacuggcuaggga

SEQ ID NO: 633143 - RNA, 22 nt, Human
ugccuuuaacaagaucuccaga

SEQ ID NO: 633144 - RNA, 22 nt, Human
gaauuuccucuaaaccccugag

SEQ ID NO: 633145 - RNA, 22 nt, Human
uuguuugaggucacugauauuu

SEQ ID NO: 633146 - RNA, 22 nt, Human
uuggugagugcuauguaccaca

SEQ ID NO: 633147 - RNA, 22 nt, Human
ucucuaaaucugguucacuugc

SEQ ID NO: 633148 - RNA, 22 nt, Human
acagacauuuuaagacacuuua

SEQ ID NO: 633149 - RNA, 22 nt, Human
agaaggcucacuaagagugacu

SEQ ID NO: 633150 - RNA, 22 nt, Human
uguauauguuuguauguacaca

SEQ ID NO: 633151 - RNA, 22 nt, Human
aaagcuaguaauauuuuaaucc

SEQ ID NO: 633152 - RNA, 22 nt, Human
cuggcccuaggcaaacacagau

SEQ ID NO: 633153 - RNA, 22 nt, Human
cacagcugucagcugaccuagg

SEQ ID NO: 633154 - RNA, 22 nt, Human
cugugaguaaugaccugucuug

SEQ ID NO: 633155 - RNA, 23 nt, Human
ucagugcaaaaauaggauuuugg

SEQ ID NO: 633156 - RNA, 22 nt, Human
cccagcagaccgcugugauggc

SEQ ID NO: 633157 - RNA, 18 nt, Human
guccacagcccucacagc

SEQ ID NO: 633158 - RNA, 22 nt, Human
cagcagggaagcugugcuguuu

SEQ ID NO: 633159 - RNA, 22 nt, Human
aacauguaaauaucauuguacu

SEQ ID NO: 633160 - RNA, 22 nt, Human
uaauuagagucacaaguaacca

SEQ ID NO: 633161 - RNA, 22 nt, Human
ggcucaggagaggggcuaaaag

SEQ ID NO: 633162 - RNA, 22 nt, Human
ucacacaugaguaaauacaggg

SEQ ID NO: 633163 - RNA, 22 nt, Human
cagcugccccgcuggcugacca

SEQ ID NO: 633164 - RNA, 21 nt, Human
gcagcagaggcuugacagaca

SEQ ID NO: 633165 - RNA, 22 nt, Human
uggguuaagccucauucauagc

SEQ ID NO: 633166 - RNA, 22 nt, Human
uggagagcacugucucauuuug

SEQ ID NO: 633167 - RNA, 22 nt, Human
agagcuguagcuuccuagagcc

SEQ ID NO: 633168 - RNA, 22 nt, Human
uggcuuccagaacugagcaaca

SEQ ID NO: 633169 - RNA, 22 nt, Human
cugugacuggaaucuggcucuu

SEQ ID NO: 633170 - RNA, 23 nt, Human
gcucagagguuuuucucuggaug

SEQ ID NO: 633171 - RNA, 16 nt, Human
ucccugggaguggugg

SEQ ID NO: 633172 - RNA, 19 nt, Human
agugugagacuccaucuca

SEQ ID NO: 633173 - RNA, 19 nt, Human
gguguccuagagauaagag

SEQ ID NO: 633174 - RNA, 22 nt, Human
ugcuggaggccagaagucugag

SEQ ID NO: 633175 - RNA, 22 nt, Human
ugcagagguuuccaggcaaguu

SEQ ID NO: 633176 - RNA, 22 nt, Human
aggcauuuccuaugggcagaga

SEQ ID NO: 633177 - RNA, 22 nt, Human
aaaagagcuugguugauuuugc

SEQ ID NO: 633178 - RNA, 22 nt, Human
aucuggcucccuuggaauccgu

SEQ ID NO: 633179 - RNA, 22 nt, Human
ugccaggcucaggaugucccug

SEQ ID NO: 633180 - RNA, 20 nt, Human
ucagagagagggugccacuu

SEQ ID NO: 633181 - RNA, 22 nt, Human
ucagauuuauguggcuaggcuc

SEQ ID NO: 633182 - RNA, 22 nt, Human
caggaagcugccggugagcgag

SEQ ID NO: 633183 - RNA, 19 nt, Human
augcaacaaaaguguaaga

SEQ ID NO: 633184 - RNA, 22 nt, Human
gguuugaacagcuuuggagaag

SEQ ID NO: 633185 - RNA, 22 nt, Human
uaacuacuaauugaugauaaug

SEQ ID NO: 633186 - RNA, 22 nt, Human
ggaaaagaaagggacugauugg

SEQ ID NO: 633187 - RNA, 23 nt, Human
aucuguucaucugacacagauuc

SEQ ID NO: 633188 - RNA, 22 nt, Human
gcaggaguggagaccaugggga

SEQ ID NO: 633189 - RNA, 22 nt, Human
uaggccuaagagauacuacugu

SEQ ID NO: 633190 - RNA, 22 nt, Human
ucugaauucugacaauuugaau

SEQ ID NO: 633191 - RNA, 22 nt, Human
gggcagccccagcgcguuggcu

SEQ ID NO: 633192 - RNA, 22 nt, Human
gugggcagccccuucaaggcca

SEQ ID NO: 633193 - RNA, 23 nt, Human
acauuacacgcaguaauugcccc

SEQ ID NO: 633194 - RNA, 22 nt, Human
aaggccugggaguacugggaca

SEQ ID NO: 633195 - RNA, 22 nt, Human
aggagcacuaauuccugcagag

SEQ ID NO: 633196 - RNA, 22 nt, Human
accaggaacaagccauggagga

SEQ ID NO: 633197 - RNA, 22 nt, Human
gggaauuauagcugucacaggc

SEQ ID NO: 633198 - RNA, 22 nt, Human
cuguccugcccacccugcaggg

SEQ ID NO: 633199 - RNA, 22 nt, Human
acucugagaaucccuggacuuu

SEQ ID NO: 633200 - RNA, 22 nt, Human
uucugauaacaaacaccaauuu

SEQ ID NO: 633201 - RNA, 22 nt, Human
ucagucuuucgaauucagccag

SEQ ID NO: 633202 - RNA, 22 nt, Human
agcuccuguaguacauauuauu

SEQ ID NO: 633203 - RNA, 22 nt, Human
uugagagugccaagcauccucc

SEQ ID NO: 633204 - RNA, 22 nt, Human
agagaucaguuaaaaucuuuuu

SEQ ID NO: 633205 - RNA, 22 nt, Human
uggaaaaugugacuauucuaaa

SEQ ID NO: 633206 - RNA, 22 nt, Human
agggugcaggggaagcugcccu

SEQ ID NO: 633207 - RNA, 22 nt, Human
uaugugauauaggcuauuugau

SEQ ID NO: 633208 - RNA, 22 nt, Human
ucccacagaccaugaguggaag

SEQ ID NO: 633209 - RNA, 22 nt, Human
ccugaagaugagggacagcuaa

SEQ ID NO: 633210 - RNA, 22 nt, Human
uacaguauuaugagugauugaa

SEQ ID NO: 633211 - RNA, 22 nt, Human
gacauuuaaauugcaggcagcc

SEQ ID NO: 633212 - RNA, 22 nt, Human
uggcuggcugucaaggaaagcc

SEQ ID NO: 633213 - RNA, 22 nt, Human
cccacuucaugggcaggaagga

SEQ ID NO: 633214 - RNA, 22 nt, Human
agugucuggucucugaacuaaa

SEQ ID NO: 633215 - RNA, 22 nt, Human
accuccaggaagcucuugguac

SEQ ID NO: 633216 - RNA, 22 nt, Human
accuucuggucugccugacagc

SEQ ID NO: 633217 - RNA, 22 nt, Human
ucuucuuaaaguauguucucuu

SEQ ID NO: 633218 - RNA, 22 nt, Human
gauuucuucauuuguggugaau

SEQ ID NO: 633219 - RNA, 22 nt, Human
cucccacuccuggcucaccaca

SEQ ID NO: 633220 - RNA, 22 nt, Human
gcagcugcuggaaguuccugcc

SEQ ID NO: 633221 - RNA, 22 nt, Human
cagaggcagccgggggagaacg

SEQ ID NO: 633222 - RNA, 22 nt, Human
aagaaauacaugguuuuugagu

SEQ ID NO: 633223 - RNA, 22 nt, Human
gggcaggugauuuuggcuccau

SEQ ID NO: 633224 - RNA, 22 nt, Human
ccuggagcacagcccaguccca

SEQ ID NO: 633225 - RNA, 22 nt, Human
ugaaaaaccucaguccgcuuua

SEQ ID NO: 633226 - RNA, 22 nt, Human
ccagcuuuagguugccugccag

SEQ ID NO: 633227 - RNA, 22 nt, Human
gcauggcauuugaagguagaag

SEQ ID NO: 633228 - RNA, 22 nt, Human
uuuacaagaaaucaugaugcua

SEQ ID NO: 633229 - RNA, 22 nt, Human
cacuugaauggcauuguuccuu

SEQ ID NO: 633230 - RNA, 22 nt, Human
cauacauauguggaugucauau

SEQ ID NO: 633231 - RNA, 22 nt, Human
gcuuggccagcagccgggaugc

SEQ ID NO: 633232 - RNA, 22 nt, Human
gcuuccagaccccagucccuca

SEQ ID NO: 633233 - RNA, 22 nt, Human
cacagggcagugcugcccacuc

SEQ ID NO: 633234 - RNA, 22 nt, Human
ggcuccugggcagcugcucccu

SEQ ID NO: 633235 - RNA, 22 nt, Human
gagggggcgugcaaggcuccgc

SEQ ID NO: 633236 - RNA, 22 nt, Human
ggccccagggauuaggccaacc

SEQ ID NO: 633237 - RNA, 22 nt, Human
ggaggccaaggcaggcggauca

SEQ ID NO: 633238 - RNA, 22 nt, Human
ccuucuccccucugcagggugu

SEQ ID NO: 633239 - RNA, 22 nt, Human
gagcuccuggauugcuccuagg

SEQ ID NO: 633240 - RNA, 22 nt, Human
gacugggguaaggugaggaggu

SEQ ID NO: 633241 - RNA, 22 nt, Human
aaaaccacaaaaguggcuuggu

SEQ ID NO: 633242 - RNA, 22 nt, Human
uaaaguauauuuuuucucaaua

SEQ ID NO: 633243 - RNA, 18 nt, Human
aggcacagagcauacaua

SEQ ID NO: 633244 - RNA, 22 nt, Human
guucaaauggcugcaguuacca

SEQ ID NO: 633245 - RNA, 22 nt, Human
ucugcacaaaacugucgcagaa

SEQ ID NO: 633246 - RNA, 22 nt, Human
acagggccagccugggaccugg

SEQ ID NO: 633247 - RNA, 22 nt, Human
ucagugcuuuugucacaugguc

SEQ ID NO: 633248 - RNA, 22 nt, Human
cugaaagaauaagauguuuaca

SEQ ID NO: 633249 - RNA, 22 nt, Human
uuauucuguuguucaggguugg

SEQ ID NO: 633250 - RNA, 22 nt, Human
cauuaugcaaagaacacuugag

SEQ ID NO: 633251 - RNA, 22 nt, Human
cugcagggguguccuguauugg

SEQ ID NO: 633252 - RNA, 22 nt, Human
accugggaacgcuuuguggagg

SEQ ID NO: 633253 - RNA, 22 nt, Human
gaacacugggguaucauugagc

SEQ ID NO: 633254 - RNA, 22 nt, Human
guccauuuuauucagagacuuu

SEQ ID NO: 633255 - RNA, 22 nt, Human
gugcugaguagaaugaaugccu

SEQ ID NO: 633256 - RNA, 20 nt, Human
cuaggaacuauggucuggcu

SEQ ID NO: 633257 - RNA, 22 nt, Human
ugagcccaggaguaugaggcug

SEQ ID NO: 633258 - RNA, 22 nt, Human
auuuugaaauacuugaaggaaa

SEQ ID NO: 633259 - RNA, 22 nt, Human
gagguggcacugugaggagcac

SEQ ID NO: 633260 - RNA, 22 nt, Human
ucuguacuuuuauuuuggcacu

SEQ ID NO: 633261 - RNA, 22 nt, Human
uagucuuuuuaauaaauaaugc

SEQ ID NO: 633262 - RNA, 22 nt, Human
caggauggagggagggcuguua

SEQ ID NO: 633263 - RNA, 22 nt, Human
uugcuacaugguuucaaagcug

SEQ ID NO: 633264 - RNA, 22 nt, Human
gauauuuuuaggugaugcaggc

SEQ ID NO: 633265 - RNA, 22 nt, Human
augaugaaauuuucuaucaugu

SEQ ID NO: 633266 - RNA, 22 nt, Human
ggcggcgcguagccggagacuu

SEQ ID NO: 633267 - RNA, 22 nt, Human
gucucccaaccccugugcccag

SEQ ID NO: 633268 - RNA, 22 nt, Human
uggagcccagggugagaaggag

SEQ ID NO: 633269 - RNA, 22 nt, Human
ucacagaagcccucgcaaacua

SEQ ID NO: 633270 - RNA, 22 nt, Human
cagcucuuccauuuccuucagc

SEQ ID NO: 633271 - RNA, 22 nt, Human
ggagcucuuccagcuuguugcu

SEQ ID NO: 633272 - RNA, 22 nt, Human
agugcuccuauggaucaguugu

SEQ ID NO: 633273 - RNA, 22 nt, Human
uggguagacauuccugaaacuc

SEQ ID NO: 633274 - RNA, 22 nt, Human
uaaaggcaguaauuccugaguu

SEQ ID NO: 633275 - RNA, 22 nt, Human
uuaguugaucauucaacauggg

SEQ ID NO: 633276 - RNA, 22 nt, Human
acuuucucccacccacccgucu

SEQ ID NO: 633277 - RNA, 22 nt, Human
auuuagacauguaucugauagc

SEQ ID NO: 633278 - RNA, 22 nt, Human
uuucugaagauacagcuuugcu

SEQ ID NO: 633279 - RNA, 22 nt, Human
gguggagcgcagggugcuggcg

SEQ ID NO: 633280 - RNA, 22 nt, Human
aaccugaaacuacauucuugau

SEQ ID NO: 633281 - RNA, 22 nt, Human
caggccaccagauacaugcccc

SEQ ID NO: 633282 - RNA, 19 nt, Human
acacauuugcacaauccac

SEQ ID NO: 633283 - RNA, 22 nt, Human
ggaagaaagguggacaacaggu

SEQ ID NO: 633284 - RNA, 22 nt, Human
uuucacucagcucucauugucu

SEQ ID NO: 633285 - RNA, 21 nt, Human
gauuuauaagccuuaagccua

SEQ ID NO: 633286 - RNA, 22 nt, Human
auuuucaguugaaaaaguuggu

SEQ ID NO: 633287 - RNA, 22 nt, Human
acuacagucccucauauguugg

SEQ ID NO: 633288 - RNA, 22 nt, Human
acuucagcccagaggaagggau

SEQ ID NO: 633289 - RNA, 17 nt, Human
uccaggcauaucuccua

SEQ ID NO: 633290 - RNA, 22 nt, Human
ucaguggauuguagaaggcuua

SEQ ID NO: 633291 - RNA, 22 nt, Human
uaguuuaugauuuuuuggaagg

SEQ ID NO: 633292 - RNA, 22 nt, Human
cugggucuggcuacugcuuccu

SEQ ID NO: 633293 - RNA, 22 nt, Human
uucagagaugacaccugguguu

SEQ ID NO: 633294 - RNA, 22 nt, Human
cugcagcugucucuacugggca

SEQ ID NO: 633295 - RNA, 22 nt, Human
aggcugggcaccguuuugaucc

SEQ ID NO: 633296 - RNA, 22 nt, Human
ugaggcucugcuucuguggcuc

SEQ ID NO: 633297 - RNA, 22 nt, Human
ggguuggcagcaccagaggagg

SEQ ID NO: 633298 - RNA, 19 nt, Human
gccucugcuggggacaggc

SEQ ID NO: 633299 - RNA, 17 nt, Human
caagagagaugacugga

SEQ ID NO: 633300 - RNA, 18 nt, Human
uacuucaacucccagggc

SEQ ID NO: 633301 - RNA, 22 nt, Human
ggcacacucaccacguggaggg

SEQ ID NO: 633302 - RNA, 22 nt, Human
acccagagcacugggugugggc

SEQ ID NO: 633303 - RNA, 22 nt, Human
aaaggaggccacauggcuagga

SEQ ID NO: 633304 - RNA, 22 nt, Human
uugacagcuauuuugcuuugau

SEQ ID NO: 633305 - RNA, 22 nt, Human
ggcccaggcuggagugcggugg

SEQ ID NO: 633306 - RNA, 22 nt, Human
cugauuccaaagccaaagcuau

SEQ ID NO: 633307 - RNA, 22 nt, Human
guacacauuaugcuucucuaaa

SEQ ID NO: 633308 - RNA, 22 nt, Human
ggcuucacucauaauuagguuc

SEQ ID NO: 633309 - RNA, 20 nt, Human
ccagucucuaucagaaauaa

SEQ ID NO: 633310 - RNA, 22 nt, Human
cacucuaaccuccaucuuccau

SEQ ID NO: 633311 - RNA, 21 nt, Human
ugcuguccuagaaccagggcc

SEQ ID NO: 633312 - RNA, 22 nt, Human
ucaugcuuauugcauauuugga

SEQ ID NO: 633313 - RNA, 22 nt, Human
caguccugcuagugugaaaagc

SEQ ID NO: 633314 - RNA, 22 nt, Human
agaggcugugcagagggagugc

SEQ ID NO: 633315 - RNA, 22 nt, Human
gccuggcaaggcccuguugacu

SEQ ID NO: 633316 - RNA, 22 nt, Human
ccuguucacccuccaugcacag

SEQ ID NO: 633317 - RNA, 22 nt, Human
uucugugucuucuuguucugug

SEQ ID NO: 633318 - RNA, 22 nt, Human
gaaguuauaaacuuuuccuccc

SEQ ID NO: 633319 - RNA, 22 nt, Human
cagguaaagcuucaaaucacuu

SEQ ID NO: 633320 - RNA, 22 nt, Human
uaaaguucuuagaacaaggccu

SEQ ID NO: 633321 - RNA, 22 nt, Human
aguccugucucucccagggcca

SEQ ID NO: 633322 - RNA, 22 nt, Human
aaggaccuauauugucagagga

SEQ ID NO: 633323 - RNA, 22 nt, Human
aaagaucaaguaggcauggccu

SEQ ID NO: 633324 - RNA, 18 nt, Human
uguuuccuccuggaggcu

SEQ ID NO: 633325 - RNA, 22 nt, Human
uagaaagcaaaauccuaccaag

SEQ ID NO: 633326 - RNA, 22 nt, Human
ccaggaagccucagaugcugag

SEQ ID NO: 633327 - RNA, 22 nt, Human
cuggaaggggcagucuuugggc

SEQ ID NO: 633328 - RNA, 22 nt, Human
cauuucuguucucuuccuguac

SEQ ID NO: 633329 - RNA, 22 nt, Human
cccaggcugccacgauuacugc

SEQ ID NO: 633330 - RNA, 22 nt, Human
uuuguuuaucaaggucuagcau

SEQ ID NO: 633331 - RNA, 22 nt, Human
gaaagugccagaauaggaggcc

SEQ ID NO: 633332 - RNA, 22 nt, Human
cuucugcaggcccugucugacc

SEQ ID NO: 633333 - RNA, 22 nt, Human
auggcagcauaguggcaaguua

SEQ ID NO: 633334 - RNA, 22 nt, Human
aaugcuuuugcugucauugcuu

SEQ ID NO: 633335 - RNA, 22 nt, Human
uaagacauaaauaggcuuuuua

SEQ ID NO: 633336 - RNA, 22 nt, Human
acucugcuguuuacucucuaua

SEQ ID NO: 633337 - RNA, 22 nt, Human
acauuugacucuguucauauua

SEQ ID NO: 633338 - RNA, 22 nt, Human
uauugaaaugaaugacagugau

SEQ ID NO: 633339 - RNA, 21 nt, Human
guggccagugacuacuuauug

SEQ ID NO: 633340 - RNA, 22 nt, Human
uugucuggucaaaucacuugua

SEQ ID NO: 633341 - RNA, 22 nt, Human
ucuccaggggcagggucuggag

SEQ ID NO: 633342 - RNA, 22 nt, Human
auuauuagauucuuaauuguaa

SEQ ID NO: 633343 - RNA, 22 nt, Human
aguuucuaccgguacauucagg

SEQ ID NO: 633344 - RNA, 22 nt, Human
acaugacagugcuuagcaaacu

SEQ ID NO: 633345 - RNA, 22 nt, Human
ucaguucuaagugcuuuacaug

SEQ ID NO: 633346 - RNA, 22 nt, Human
gaggccucuucuuuguuaaccu

SEQ ID NO: 633347 - RNA, 22 nt, Human
aauggcagaggcaaagauggua

SEQ ID NO: 633348 - RNA, 22 nt, Human
acugggaggcaucuggagcuga

SEQ ID NO: 633349 - RNA, 23 nt, Human
ggguccagagaagccauuagggc

SEQ ID NO: 633350 - RNA, 22 nt, Human
ucuugacaacuauacuacuuac

SEQ ID NO: 633351 - RNA, 21 nt, Human
ugucuuuggccucauucccag

SEQ ID NO: 633352 - RNA, 22 nt, Human
aucuagaaguggcaugaauuac

SEQ ID NO: 633353 - RNA, 22 nt, Human
ccuucaugucauuggacaccuu

SEQ ID NO: 633354 - RNA, 22 nt, Human
ggcagcugagaucaugcuguug

SEQ ID NO: 633355 - RNA, 22 nt, Human
ccuggagugggguccgugcaug

SEQ ID NO: 633356 - RNA, 22 nt, Human
augcaugcuucuuauaguacuu

SEQ ID NO: 633357 - RNA, 22 nt, Human
uuggcagaggccgaggugaaga

SEQ ID NO: 633358 - RNA, 22 nt, Human
uaccuggauccugguagacauc

SEQ ID NO: 633359 - RNA, 22 nt, Human
uccucuccagcaaacuggcuau

SEQ ID NO: 633360 - RNA, 19 nt, Human
ggcagccugcacgggcugc

SEQ ID NO: 633361 - RNA, 22 nt, Human
aauccagguggcggagguugug

SEQ ID NO: 633362 - RNA, 22 nt, Human
ugucagcaggacauuaaaagcu

SEQ ID NO: 633363 - RNA, 18 nt, Human
uaucuuuuccagugguau

SEQ ID NO: 633364 - RNA, 22 nt, Human
cuucagagaguccagggacugc

SEQ ID NO: 633365 - RNA, 22 nt, Human
uugacuucagaauguugauggu

SEQ ID NO: 633366 - RNA, 22 nt, Human
auugugaauagugccgcaguaa

SEQ ID NO: 633367 - RNA, 22 nt, Human
aucauaaaauugcaccauuucu

SEQ ID NO: 633368 - RNA, 22 nt, Human
augcagaaagcggcaaacaggu

SEQ ID NO: 633369 - RNA, 22 nt, Human
gcucuagaaagaaggauguggg

SEQ ID NO: 633370 - RNA, 21 nt, Human
ugaaugaugccccagaguugu

SEQ ID NO: 633371 - RNA, 22 nt, Human
gcuccagggucagcucagaacu

SEQ ID NO: 633372 - RNA, 22 nt, Human
uucagccaauuagaagccccac

SEQ ID NO: 633373 - RNA, 22 nt, Human
auguauguaugcugugcuugca

SEQ ID NO: 633374 - RNA, 22 nt, Human
agagaucucugaagcugcugcu

SEQ ID NO: 633375 - RNA, 22 nt, Human
ugugagagagugcauuugcaua

SEQ ID NO: 633376 - RNA, 23 nt, Human
aggcugcuuacugguaucagagc

SEQ ID NO: 633377 - RNA, 22 nt, Human
ugcuugugacagaacugugucc

SEQ ID NO: 633378 - RNA, 22 nt, Human
gccagcaguggccaccaccagg

SEQ ID NO: 633379 - RNA, 22 nt, Human
agaaguauuuggcuaaaagaca

SEQ ID NO: 633380 - RNA, 23 nt, Human
gcauccagagcucaguccccuuu

SEQ ID NO: 633381 - RNA, 22 nt, Human
uuuagacagaugugaggugggu

SEQ ID NO: 633382 - RNA, 22 nt, Human
uuuaaaccuaucuaagaaauag

SEQ ID NO: 633383 - RNA, 22 nt, Human
gcugcccacagcggguguuucg

SEQ ID NO: 633384 - RNA, 22 nt, Human
gauuuauuggucuuucauuggu

SEQ ID NO: 633385 - RNA, 19 nt, Human
ugcagagagaggcaaagaa

SEQ ID NO: 633386 - RNA, 22 nt, Human
aagggcccggcugugggcagag

SEQ ID NO: 633387 - RNA, 22 nt, Human
ucuggagcgaggucccugucug

SEQ ID NO: 633388 - RNA, 23 nt, Human
uggagccugggauacaauagaug

SEQ ID NO: 633389 - RNA, 22 nt, Human
gauuucuucaggagcagaggag

SEQ ID NO: 633390 - RNA, 19 nt, Human
auccuggguccuccagcug

SEQ ID NO: 633391 - RNA, 22 nt, Human
uacaaucacccaaaaguggcuc

SEQ ID NO: 633392 - RNA, 22 nt, Human
ucacagacacuggguuauugca

SEQ ID NO: 633393 - RNA, 22 nt, Human
agcagggcagugaucagaaagg

SEQ ID NO: 633394 - RNA, 18 nt, Human
ggagcugggccugguucc

SEQ ID NO: 633395 - RNA, 22 nt, Human
caaacauugcuaccagagguuu

SEQ ID NO: 633396 - RNA, 22 nt, Human
gaugaucugagguacaugaaac

SEQ ID NO: 633397 - RNA, 21 nt, Human
accuuuggaaagacccuggga

SEQ ID NO: 633398 - RNA, 18 nt, Human
cugagggcaacagaggcu

SEQ ID NO: 633399 - RNA, 22 nt, Human
agacagcagcagaggggcuccc

SEQ ID NO: 633400 - RNA, 22 nt, Human
aaguucuugcugugugucagau

SEQ ID NO: 633401 - RNA, 22 nt, Human
ccaguguauuuuugggaccugc

SEQ ID NO: 633402 - RNA, 22 nt, Human
ugcauacugaacagcaugcuaa

SEQ ID NO: 633403 - RNA, 22 nt, Human
acaggacagguaggauucgcag

SEQ ID NO: 633404 - RNA, 17 nt, Human
ucugggcuucagugguc

SEQ ID NO: 633405 - RNA, 22 nt, Human
cugggucuuuuucuuccauuga

SEQ ID NO: 633406 - RNA, 22 nt, Human
uauuagauuaacuuuaaugucu

SEQ ID NO: 633407 - RNA, 22 nt, Human
ucuggagccacaaaccucagcu

SEQ ID NO: 633408 - RNA, 22 nt, Human
uaguaaaaguuuaguugaaagu

SEQ ID NO: 633409 - RNA, 20 nt, Human
uucuagcauacuuacaagga

SEQ ID NO: 633410 - RNA, 22 nt, Human
cagaaacauguauaaaguugua

SEQ ID NO: 633411 - RNA, 21 nt, Human
cuacacagcuuucuauaggaa

SEQ ID NO: 633412 - RNA, 22 nt, Human
gggcugacaaccaucugacaag

SEQ ID NO: 633413 - RNA, 22 nt, Human
ugaagacagaccaaggagaaug

SEQ ID NO: 633414 - RNA, 22 nt, Human
caggucagagguagaugagaug

SEQ ID NO: 633415 - RNA, 22 nt, Human
uuuauuugucuugccauuuagu

SEQ ID NO: 633416 - RNA, 22 nt, Human
cugggccagggaggugucugua

SEQ ID NO: 633417 - RNA, 22 nt, Human
aaagaaugucugaacagcuggc

SEQ ID NO: 633418 - RNA, 22 nt, Human
agggacuuguguccuauguaug

SEQ ID NO: 633419 - RNA, 22 nt, Human
ggucuggggcaggcaucugaca

SEQ ID NO: 633420 - RNA, 22 nt, Human
caaauagacaagauggcaggaa

SEQ ID NO: 633421 - RNA, 22 nt, Human
ugaagguguaugcuguggguca

SEQ ID NO: 633422 - RNA, 22 nt, Human
ggcuuaaaacuuugaaaguguu

SEQ ID NO: 633423 - RNA, 22 nt, Human
uggguaaaaugaguuaggagaa

SEQ ID NO: 633424 - RNA, 23 nt, Human
gccucugcucugcguuggggacu

SEQ ID NO: 633425 - RNA, 22 nt, Human
cucugugggaagcuggguguga

SEQ ID NO: 633426 - RNA, 22 nt, Human
ugaaaaugcccucuaugucuca

SEQ ID NO: 633427 - RNA, 22 nt, Human
uguccugggaggcgggguccag

SEQ ID NO: 633428 - RNA, 22 nt, Human
ggccacagcagaugcuucagau

SEQ ID NO: 633429 - RNA, 22 nt, Human
auggcagauggcuggagcaggu

SEQ ID NO: 633430 - RNA, 22 nt, Human
acuuuggggaacuuuucuccuc

SEQ ID NO: 633431 - RNA, 22 nt, Human
agggcagagaucugagugggca

SEQ ID NO: 633432 - RNA, 22 nt, Human
caggaaccuaaagagacauuac

SEQ ID NO: 633433 - RNA, 22 nt, Human
gcuacuuugcagcuagcuagga

SEQ ID NO: 633434 - RNA, 22 nt, Human
guauaugagaaccauggaggug

SEQ ID NO: 633435 - RNA, 20 nt, Human
agugcaagaaagcacagcug

SEQ ID NO: 633436 - RNA, 22 nt, Human
uacauggauguuauccuuacug

SEQ ID NO: 633437 - RNA, 22 nt, Human
uuuuguaugagaagugcuuuac

SEQ ID NO: 633438 - RNA, 22 nt, Human
auacuuacuuuucuucagacua

SEQ ID NO: 633439 - RNA, 21 nt, Human
auguggcucccuuccucagga

SEQ ID NO: 633440 - RNA, 22 nt, Human
acacauuucucccagucuccau

SEQ ID NO: 633441 - RNA, 18 nt, Human
ucucuccaucuauuuguu

SEQ ID NO: 633442 - RNA, 22 nt, Human
agagccuguaacaucuuucuua

SEQ ID NO: 633443 - RNA, 22 nt, Human
ucagcugaguucuagagcacuc

SEQ ID NO: 633444 - RNA, 22 nt, Human
uuuaauguagcgugaaaugauu

SEQ ID NO: 633445 - RNA, 22 nt, Human
ccucccugggugcugggauugc

SEQ ID NO: 633446 - RNA, 22 nt, Human
ggaggcccagagaggugaagug

SEQ ID NO: 633447 - RNA, 18 nt, Human
gacuuuaaaacacugcuc

SEQ ID NO: 633448 - RNA, 22 nt, Human
ggagccugguuacuagagccug

SEQ ID NO: 633449 - RNA, 22 nt, Human
guucauauuacuuugagugcag

SEQ ID NO: 633450 - RNA, 18 nt, Human
ugaacacaguacaauucc

SEQ ID NO: 633451 - RNA, 22 nt, Human
aacacuguaucagucuucaaua

SEQ ID NO: 633452 - RNA, 22 nt, Human
cuuuacauaaggauaaaccugg

SEQ ID NO: 633453 - RNA, 22 nt, Human
uuaucugaaaaccucaaaauau

SEQ ID NO: 633454 - RNA, 22 nt, Human
acaagguauccacauuaaaugu

SEQ ID NO: 633455 - RNA, 22 nt, Human
ucuuucugaauauuugaccuca

SEQ ID NO: 633456 - RNA, 22 nt, Human
gagcuuuaagggcacuggucuu

SEQ ID NO: 633457 - RNA, 22 nt, Human
guaguaauuguuuuaagccacc

SEQ ID NO: 633458 - RNA, 18 nt, Human
ggucaagaaaguaaggca

SEQ ID NO: 633459 - RNA, 22 nt, Human
cagauauguggauucuauuagc

SEQ ID NO: 633460 - RNA, 22 nt, Human
acaguaaauaaugcauguugau

SEQ ID NO: 633461 - RNA, 22 nt, Human
uugaacaguuuugucagguuca

SEQ ID NO: 633462 - RNA, 22 nt, Human
acaguacugaguacugaguugg

SEQ ID NO: 633463 - RNA, 22 nt, Human
cuccaggacaugacuuucuugc

SEQ ID NO: 633464 - RNA, 22 nt, Human
gggguggagcuaaaugucuacu

SEQ ID NO: 633465 - RNA, 22 nt, Human
uuacaacuggugaauuuuaugg

SEQ ID NO: 633466 - RNA, 20 nt, Human
uuuagcaaaagggacugcuc

SEQ ID NO: 633467 - RNA, 22 nt, Human
ugcugcccacuguauuucucca

SEQ ID NO: 633468 - RNA, 22 nt, Human
uuucuggaacaguaauugaaga

SEQ ID NO: 633469 - RNA, 22 nt, Human
cauaaucccccauuugugacau

SEQ ID NO: 633470 - RNA, 22 nt, Human
ccagucuguacuuugcucuguu

SEQ ID NO: 633471 - RNA, 22 nt, Human
aauaauaguugcaaaguguuua

SEQ ID NO: 633472 - RNA, 22 nt, Human
acauauuggcaaacuggaggca

SEQ ID NO: 633473 - RNA, 22 nt, Human
gggcagguacaagaugcuucuu

SEQ ID NO: 633474 - RNA, 22 nt, Human
ccuguguuucaccaaaagaguc

SEQ ID NO: 633475 - RNA, 22 nt, Human
ggaagaaaguagaaaaccgugg

SEQ ID NO: 633476 - RNA, 22 nt, Human
cccuggagaucgggagaggaag

SEQ ID NO: 633477 - RNA, 22 nt, Human
ugcauuguaggauguuuagcag

SEQ ID NO: 633478 - RNA, 21 nt, Human
acuuuaauauacaugaggagg

SEQ ID NO: 633479 - RNA, 22 nt, Human
auauuauucuagcucuugugug

SEQ ID NO: 633480 - RNA, 22 nt, Human
ucaaucaaugugucaguuccca

SEQ ID NO: 633481 - RNA, 22 nt, Human
guucacagcuucuuaggucaua

SEQ ID NO: 633482 - RNA, 22 nt, Human
cccaggcagcggggucuccuug

SEQ ID NO: 633483 - RNA, 22 nt, Human
cagcuuguuaccgagggagggu

SEQ ID NO: 633484 - RNA, 22 nt, Human
uucucccaucucagucuuacau

SEQ ID NO: 633485 - RNA, 21 nt, Human
cugaggcaugcaggccugggc

SEQ ID NO: 633486 - RNA, 22 nt, Human
ugccugaauucaauuccuggcu

SEQ ID NO: 633487 - RNA, 22 nt, Human
agcaaagcaucacuccaaucug

SEQ ID NO: 633488 - RNA, 22 nt, Human
caucacugacgcugagauucca

SEQ ID NO: 633489 - RNA, 22 nt, Human
ugaagcacagaccugggcauca

SEQ ID NO: 633490 - RNA, 22 nt, Human
uccuugagccguggccagggcc

SEQ ID NO: 633491 - RNA, 20 nt, Human
agauggugggcuggaacacc

SEQ ID NO: 633492 - RNA, 22 nt, Human
augcuuccucccuuccacucaa

SEQ ID NO: 633493 - RNA, 22 nt, Human
cacugaagguaggaccaaggcu

SEQ ID NO: 633494 - RNA, 22 nt, Human
uacauucagcaaaagaaugguu

SEQ ID NO: 633495 - RNA, 20 nt, Human
uuucacaucugucccuuuaa

SEQ ID NO: 633496 - RNA, 22 nt, Human
cagcuaguacaaugggagagca

SEQ ID NO: 633497 - RNA, 22 nt, Human
aggccugggacgggagccguga

SEQ ID NO: 633498 - RNA, 22 nt, Human
uuuccaagagcuuauuucugaa

SEQ ID NO: 633499 - RNA, 22 nt, Human
ucucuuuuauguacacccugac

SEQ ID NO: 633500 - RNA, 22 nt, Human
uccuguguuacccuugcaguga

SEQ ID NO: 633501 - RNA, 22 nt, Human
uccugucuaaagaccugcaggc

SEQ ID NO: 633502 - RNA, 22 nt, Human
aagaucaccuugacaugaaaag

SEQ ID NO: 633503 - RNA, 23 nt, Human
ugcuccagguacagaacuccagg

SEQ ID NO: 633504 - RNA, 22 nt, Human
gcguguuugcccagugaguggc

SEQ ID NO: 633505 - RNA, 22 nt, Human
guccugaggcaggauggguuuc

SEQ ID NO: 633506 - RNA, 22 nt, Human
gccuguuggugacuuucuguug

SEQ ID NO: 633507 - RNA, 22 nt, Human
aagaacaguguccugggacucg

SEQ ID NO: 633508 - RNA, 22 nt, Human
agacacuucauguaaguggaau

SEQ ID NO: 633509 - RNA, 22 nt, Human
uggaaagaugaagauguuuaag

SEQ ID NO: 633510 - RNA, 17 nt, Human
uaggagacuggcugucc

SEQ ID NO: 633511 - RNA, 22 nt, Human
auggcccucaguccuuccuugg

SEQ ID NO: 633512 - RNA, 17 nt, Human
cagguacauugcuacug

SEQ ID NO: 633513 - RNA, 22 nt, Human
ucucugcucugugccucaguuu

SEQ ID NO: 633514 - RNA, 22 nt, Human
aagacaauccuggacagucagc

SEQ ID NO: 633515 - RNA, 22 nt, Human
gacagacacagggccaugauug

SEQ ID NO: 633516 - RNA, 20 nt, Human
uuggaagguggagaagagga

SEQ ID NO: 633517 - RNA, 22 nt, Human
ugaggcaggaauggggaaaagu

SEQ ID NO: 633518 - RNA, 22 nt, Human
augucuuuauuaauaucaugcc

SEQ ID NO: 633519 - RNA, 22 nt, Human
ucuuuaauauaaaggaaugaau

SEQ ID NO: 633520 - RNA, 22 nt, Human
gcaguggcccagcuugcaggcu

SEQ ID NO: 633521 - RNA, 22 nt, Human
uauacacauccuccaaagauag

SEQ ID NO: 633522 - RNA, 22 nt, Human
auuauggguauaacacaguuau

SEQ ID NO: 633523 - RNA, 22 nt, Human
cagcagccuagaagcucuacca

SEQ ID NO: 633524 - RNA, 22 nt, Human
ugaggccucugaggccuaggcu

SEQ ID NO: 633525 - RNA, 22 nt, Human
acucaggcuguuuuuuccuugu

SEQ ID NO: 633526 - RNA, 21 nt, Human
cagcaaaucauugggcagacu

SEQ ID NO: 633527 - RNA, 22 nt, Human
auuucauugaaguuaauucuuc

SEQ ID NO: 633528 - RNA, 22 nt, Human
cugagaguuaagagauggggcu

SEQ ID NO: 633529 - RNA, 22 nt, Human
ccugcuggccacugcuccaccu

SEQ ID NO: 633530 - RNA, 22 nt, Human
cucuuaaaauuaccuuugcaaa

SEQ ID NO: 633531 - RNA, 22 nt, Human
ugggaugccggcaggaggcaau

SEQ ID NO: 633532 - RNA, 22 nt, Human
ucaggauguuaauauagcauua

SEQ ID NO: 633533 - RNA, 22 nt, Human
uuuaucugugggaguuguuugg

SEQ ID NO: 633534 - RNA, 22 nt, Human
ugcuaggugcuccucccuaauu

SEQ ID NO: 633535 - RNA, 22 nt, Human
ggccuggcauggggacuaaggg

SEQ ID NO: 633536 - RNA, 22 nt, Human
gggcagugguccaggcuacagc

SEQ ID NO: 633537 - RNA, 22 nt, Human
cagugcugcaucuccaugccag

SEQ ID NO: 633538 - RNA, 22 nt, Human
ccacagggccuuuccugcuggc

SEQ ID NO: 633539 - RNA, 22 nt, Human
cuguuucccuccagggggugga

SEQ ID NO: 633540 - RNA, 22 nt, Human
cugggccauggaagucucugcc

SEQ ID NO: 633541 - RNA, 22 nt, Human
ucagggaaauagcagggcugaa

SEQ ID NO: 633542 - RNA, 22 nt, Human
ucaguaaaagggugcuuuacuc

SEQ ID NO: 633543 - RNA, 22 nt, Human
caaaauucugcauuucuaauaa

SEQ ID NO: 633544 - RNA, 22 nt, Human
aaugcacaaaaauuguauguaa

SEQ ID NO: 633545 - RNA, 22 nt, Human
gucaggggaugugcugguggcc

SEQ ID NO: 633546 - RNA, 23 nt, Human
caucuagcauccagugaguagug

SEQ ID NO: 633547 - RNA, 22 nt, Human
cuggcuccaaggaagagguuuu

SEQ ID NO: 633548 - RNA, 18 nt, Human
agcugcagaccaggaggu

SEQ ID NO: 633549 - RNA, 22 nt, Human
ucugggagagggaaagaagacu

SEQ ID NO: 633550 - RNA, 19 nt, Human
ucugagcugauaugacauu

SEQ ID NO: 633551 - RNA, 22 nt, Human
gaaggaaaucugugauuuaugc

SEQ ID NO: 633552 - RNA, 22 nt, Human
cagugguugucagcaacaauau

SEQ ID NO: 633553 - RNA, 22 nt, Human
ucuucaaacugaaaauuuagaa

SEQ ID NO: 633554 - RNA, 22 nt, Human
agggauguggugggagagaaag

SEQ ID NO: 633555 - RNA, 22 nt, Human
acaauauuguacccagaaguuu

SEQ ID NO: 633556 - RNA, 22 nt, Human
agaaaugcagucucgucaaaag

SEQ ID NO: 633557 - RNA, 20 nt, Human
acacuucauuugcagcagcu

SEQ ID NO: 633558 - RNA, 22 nt, Human
ggugcagaucuuucucuucagg

SEQ ID NO: 633559 - RNA, 22 nt, Human
ugggcaaggcuggagccugcag

SEQ ID NO: 633560 - RNA, 21 nt, Human
gccaaggggguagcuauuccu

SEQ ID NO: 633561 - RNA, 21 nt, Human
gcucuggccuacuguucccuc

SEQ ID NO: 633562 - RNA, 22 nt, Human
gcauucaugccugugugagcuc

SEQ ID NO: 633563 - RNA, 22 nt, Human
cuuuacagaaagagaacucugg

SEQ ID NO: 633564 - RNA, 22 nt, Human
gggugcagcuuugaaagcaugu

SEQ ID NO: 633565 - RNA, 22 nt, Human
cagggacucccaggguagcucc

SEQ ID NO: 633566 - RNA, 22 nt, Human
uagacacauccguggaagcuuc

SEQ ID NO: 633567 - RNA, 22 nt, Human
gcaguguuguuaaaagauuaga

SEQ ID NO: 633568 - RNA, 22 nt, Human
ugaucacaagucugaagaauga

SEQ ID NO: 633569 - RNA, 18 nt, Human
acauuucuccuucugacc

SEQ ID NO: 633570 - RNA, 22 nt, Human
ugacacaggcagcucccagcac

SEQ ID NO: 633571 - RNA, 22 nt, Human
ugcccccugguggccagagccg

SEQ ID NO: 633572 - RNA, 22 nt, Human
ggagccuggucagguuggcucc

SEQ ID NO: 633573 - RNA, 22 nt, Human
gcccugugcgacucuagagguu

SEQ ID NO: 633574 - RNA, 22 nt, Human
ucaguucuugggcugcuaggac

SEQ ID NO: 633575 - RNA, 22 nt, Human
caggcucaagcccugcuuauau

SEQ ID NO: 633576 - RNA, 22 nt, Human
aaaugaguagcgaugcacauua

SEQ ID NO: 633577 - RNA, 22 nt, Human
uuggcagaaugggcagcuugag

SEQ ID NO: 633578 - RNA, 22 nt, Human
uuguaauggagcaaacagguug

SEQ ID NO: 633579 - RNA, 22 nt, Human
gcugcuggcacuggagugagcc

SEQ ID NO: 633580 - RNA, 22 nt, Human
ugcugccaugcagagcaacaga

SEQ ID NO: 633581 - RNA, 21 nt, Human
gggccuggcugcgcaggacgg

SEQ ID NO: 633582 - RNA, 22 nt, Human
gugaaggaccaauaugacucau

SEQ ID NO: 633583 - RNA, 22 nt, Human
gcuggagccuucugcucuguug

SEQ ID NO: 633584 - RNA, 22 nt, Human
gaggaggucccccgacaugccu

SEQ ID NO: 633585 - RNA, 22 nt, Human
uggggcagccacauagacaaca

SEQ ID NO: 633586 - RNA, 22 nt, Human
ucuucagaggaagucagucuuu

SEQ ID NO: 633587 - RNA, 20 nt, Human
ucucaggcccccuccuugcu

SEQ ID NO: 633588 - RNA, 22 nt, Human
agggccagggaagcuguauuuu

SEQ ID NO: 633589 - RNA, 22 nt, Human
ucucucagaggaagaggcagug

SEQ ID NO: 633590 - RNA, 22 nt, Human
aaaccggggccuuuccacaaug

SEQ ID NO: 633591 - RNA, 22 nt, Human
ggguacagaaacugaggcuuag

SEQ ID NO: 633592 - RNA, 22 nt, Human
cugccaggacugacgucuucag

SEQ ID NO: 633593 - RNA, 22 nt, Human
ccaaggcuguggggcugugcag

SEQ ID NO: 633594 - RNA, 19 nt, Human
agggauauuuaaaaagcuc

SEQ ID NO: 633595 - RNA, 22 nt, Human
acuggcacuauguuggagaaau

SEQ ID NO: 633596 - RNA, 22 nt, Human
cuccugcccacgugcuacuucu

SEQ ID NO: 633597 - RNA, 22 nt, Human
auuguaacaggaucccuguggc

SEQ ID NO: 633598 - RNA, 22 nt, Human
gccagccccuuagggcucuccc

SEQ ID NO: 633599 - RNA, 22 nt, Human
gcugcuggccccacaugcucca

SEQ ID NO: 633600 - RNA, 22 nt, Human
ugucauaaaacacaagcuguug

SEQ ID NO: 633601 - RNA, 22 nt, Human
guaagagcacugucuccugcug

SEQ ID NO: 633602 - RNA, 22 nt, Human
agucugggugugaaugaacuug

SEQ ID NO: 633603 - RNA, 22 nt, Human
uaacugugaaguaauuguggau

SEQ ID NO: 633604 - RNA, 22 nt, Human
aacauaauguggccaaagucac

SEQ ID NO: 633605 - RNA, 20 nt, Human
uccaguuuuggagacauucu

SEQ ID NO: 633606 - RNA, 22 nt, Human
ccaugccuuccuuucccuggaa

SEQ ID NO: 633607 - RNA, 22 nt, Human
uccugagauguggagcuccaug

SEQ ID NO: 633608 - RNA, 22 nt, Human
uuuguuuagagaauugaagcag

SEQ ID NO: 633609 - RNA, 22 nt, Human
uggagcagaggaagaaggcuuu

SEQ ID NO: 633610 - RNA, 22 nt, Human
cacauauuugaugaagcuuugu

SEQ ID NO: 633611 - RNA, 22 nt, Human
auuuccauagagcgucucacag

SEQ ID NO: 633612 - RNA, 22 nt, Human
gugggcuuguuuugaugagauc

SEQ ID NO: 633613 - RNA, 22 nt, Human
aauuuguuacacagcaauauaa

SEQ ID NO: 633614 - RNA, 22 nt, Human
aguggucaaagacuagauuuca

SEQ ID NO: 633615 - RNA, 22 nt, Human
uaggcucccagaucguuugcug

SEQ ID NO: 633616 - RNA, 22 nt, Human
aagcagcaugauuguaauacua

SEQ ID NO: 633617 - RNA, 22 nt, Human
cuggcccaggagagcaggcauu

SEQ ID NO: 633618 - RNA, 20 nt, Human
cuggggagccucgcgguggc

SEQ ID NO: 633619 - RNA, 22 nt, Human
caagggcuucaaguggccaaga

SEQ ID NO: 633620 - RNA, 22 nt, Human
uagggucccagauaggagccag

SEQ ID NO: 633621 - RNA, 22 nt, Human
acaggcaacuucaaaucucacu

SEQ ID NO: 633622 - RNA, 22 nt, Human
auguacaggauggugcucaucu

SEQ ID NO: 633623 - RNA, 22 nt, Human
ucacauguguggcagugcaagu

SEQ ID NO: 633624 - RNA, 20 nt, Human
agcuggccuguccuaggccu

SEQ ID NO: 633625 - RNA, 20 nt, Human
gacaggagaguuagguaggu

SEQ ID NO: 633626 - RNA, 22 nt, Human
uauagaagagacaugugcauag

SEQ ID NO: 633627 - RNA, 22 nt, Human
agugcauucaguauucauaggc

SEQ ID NO: 633628 - RNA, 22 nt, Human
aagccaguaaguuuuugucauu

SEQ ID NO: 633629 - RNA, 22 nt, Human
gcugugugaccugggcaagucu

SEQ ID NO: 633630 - RNA, 22 nt, Human
ucucagagggaaaggccaauuu

SEQ ID NO: 633631 - RNA, 23 nt, Human
agcuggguggccugcgugaagcu

SEQ ID NO: 633632 - RNA, 22 nt, Human
uaacuuguguuacauuacucuu

SEQ ID NO: 633633 - RNA, 22 nt, Human
uggaauuuuguauuagcuuuga

SEQ ID NO: 633634 - RNA, 22 nt, Human
cagggauggcugucaggaugua

SEQ ID NO: 633635 - RNA, 22 nt, Human
acacaucuaucucuacacaagg

SEQ ID NO: 633636 - RNA, 20 nt, Human
auccaugagagucuggauuc

SEQ ID NO: 633637 - RNA, 22 nt, Human
cagaugugcaugaugggaaggg

SEQ ID NO: 633638 - RNA, 22 nt, Human
ucccugugggcagaggcugccu

SEQ ID NO: 633639 - RNA, 22 nt, Human
augucuguauguggagaggggu

SEQ ID NO: 633640 - RNA, 22 nt, Human
guggccagaagacugcaaugcu

SEQ ID NO: 633641 - RNA, 22 nt, Human
acagccugauuuauggagcagu

SEQ ID NO: 633642 - RNA, 20 nt, Human
ugagugauggaggcggguca

SEQ ID NO: 633643 - RNA, 17 nt, Human
gcuguuucuccagaagu

SEQ ID NO: 633644 - RNA, 21 nt, Human
ucucugguuggaguugugcca

SEQ ID NO: 633645 - RNA, 22 nt, Human
gagaaggauguggcucauagcu

SEQ ID NO: 633646 - RNA, 22 nt, Human
uccucagauauaaaugagggug

SEQ ID NO: 633647 - RNA, 21 nt, Human
uauucaguccauugauguuua

SEQ ID NO: 633648 - RNA, 18 nt, Human
agcagagcccaugcauuc

SEQ ID NO: 633649 - RNA, 19 nt, Human
uucuugaacauguuucuca

SEQ ID NO: 633650 - RNA, 22 nt, Human
aggcccagagcaggaaaggguu

SEQ ID NO: 633651 - RNA, 22 nt, Human
gggcugugccucaggugggguc

SEQ ID NO: 633652 - RNA, 22 nt, Human
aauuucagcucaaacuuguguu

SEQ ID NO: 633653 - RNA, 22 nt, Human
gcugcagcuuuaggauccagug

SEQ ID NO: 633654 - RNA, 22 nt, Human
cauuuacacuucuaaccacaag

SEQ ID NO: 633655 - RNA, 21 nt, Human
ucugucugguuuuagaguggc

SEQ ID NO: 633656 - RNA, 22 nt, Human
ucuucauggucugguucuccag

SEQ ID NO: 633657 - RNA, 21 nt, Human
uuguuucccagagcucgcucc

SEQ ID NO: 633658 - RNA, 22 nt, Human
uccucagcuuuuauuucacuug

SEQ ID NO: 633659 - RNA, 22 nt, Human
auguggcuccuuacucaucagc

SEQ ID NO: 633660 - RNA, 22 nt, Human
cuguuggaugguuuccaaaaga

SEQ ID NO: 633661 - RNA, 22 nt, Human
agggcaugaaaugggcagaagc

SEQ ID NO: 633662 - RNA, 22 nt, Human
ucuggaaauaaaauuauaguug

SEQ ID NO: 633663 - RNA, 22 nt, Human
uaacaauggaguuuugagaaag

SEQ ID NO: 633664 - RNA, 22 nt, Human
auuuggaagaaaucugucacag

SEQ ID NO: 633665 - RNA, 22 nt, Human
aauguguagggugccuguuuuu

SEQ ID NO: 633666 - RNA, 22 nt, Human
agcugguggaagggagcccaaa

SEQ ID NO: 633667 - RNA, 22 nt, Human
uccauacacauugaauuuuagu

SEQ ID NO: 633668 - RNA, 22 nt, Human
aaauucaauuaacuuucaugcu

SEQ ID NO: 633669 - RNA, 22 nt, Human
ucuguccauucagccauccauc

SEQ ID NO: 633670 - RNA, 22 nt, Human
uuaggaagaaggaggcaguauu

SEQ ID NO: 633671 - RNA, 22 nt, Human
ucacagugaggaguuacaguuu

SEQ ID NO: 633672 - RNA, 23 nt, Human
agggcugaugccauugcagcucu

SEQ ID NO: 633673 - RNA, 22 nt, Human
ugcagcagacauaauguggauu

SEQ ID NO: 633674 - RNA, 22 nt, Human
gccaggcauguccucugcagaa

SEQ ID NO: 633675 - RNA, 22 nt, Human
ucagaucauggaucuauuacuu

SEQ ID NO: 633676 - RNA, 22 nt, Human
cucuguccacagguuugucccu

SEQ ID NO: 633677 - RNA, 22 nt, Human
uguguucaugucacuggaaucc

SEQ ID NO: 633678 - RNA, 22 nt, Human
caaaccugcugcuauuuuaucc

SEQ ID NO: 633679 - RNA, 22 nt, Human
gcuuccauguugcugcugguca

SEQ ID NO: 633680 - RNA, 22 nt, Human
cuacauuuugugauuaugaaau

SEQ ID NO: 633681 - RNA, 22 nt, Human
uaaagugcuggauuugaguaaa

SEQ ID NO: 633682 - RNA, 22 nt, Human
gcaguggggaaugcuggggaga

SEQ ID NO: 633683 - RNA, 22 nt, Human
uaacaguauauuuaccaaaccu

SEQ ID NO: 633684 - RNA, 22 nt, Human
gcacuuggaggugcccacacag

SEQ ID NO: 633685 - RNA, 22 nt, Human
uuuguuuacaaaaauaagcagu

SEQ ID NO: 633686 - RNA, 22 nt, Human
agagcccugacggggacagaug

SEQ ID NO: 633687 - RNA, 21 nt, Human
aaggccugcuuacugcuaguu

SEQ ID NO: 633688 - RNA, 22 nt, Human
gaggaggcagccuaucccuuag

SEQ ID NO: 633689 - RNA, 22 nt, Human
gaucaugugauuugaaguaaug

SEQ ID NO: 633690 - RNA, 22 nt, Human
gaggcucacgacgggacgaacu

SEQ ID NO: 633691 - RNA, 22 nt, Human
gaugcuccaaacagcaauucuu

SEQ ID NO: 633692 - RNA, 23 nt, Human
gcugcagcuguggauguucucag

SEQ ID NO: 633693 - RNA, 20 nt, Human
aaucagaaagugugagcucu

SEQ ID NO: 633694 - RNA, 22 nt, Human
agugucaaugcucuguuaaaaa

SEQ ID NO: 633695 - RNA, 22 nt, Human
cuccugagcucugaggaagcuu

SEQ ID NO: 633696 - RNA, 22 nt, Human
augucucucagguuuaacuuua

SEQ ID NO: 633697 - RNA, 22 nt, Human
cagaagcauugacuccuugcuc

SEQ ID NO: 633698 - RNA, 22 nt, Human
ggaugcugcugcacauccugca

SEQ ID NO: 633699 - RNA, 22 nt, Human
gaucauuugacuuuauaaggcu

SEQ ID NO: 633700 - RNA, 22 nt, Human
ucauccauuguccucacauuag

SEQ ID NO: 633701 - RNA, 22 nt, Human
auuuccaccggcucaggaaguu

SEQ ID NO: 633702 - RNA, 22 nt, Human
cucacugugccuuuucccaaac

SEQ ID NO: 633703 - RNA, 22 nt, Human
cugagcagaagggugcacgugc

SEQ ID NO: 633704 - RNA, 22 nt, Human
aagcaucuccucaucauuuggg

SEQ ID NO: 633705 - RNA, 22 nt, Human
ggcaggugcucugugggccugg

SEQ ID NO: 633706 - RNA, 22 nt, Human
cugcaggggaccaaagucugac

SEQ ID NO: 633707 - RNA, 22 nt, Human
aguagauuuuugaauguaaguu

SEQ ID NO: 633708 - RNA, 22 nt, Human
agggggcaucagguccuggcuc

SEQ ID NO: 633709 - RNA, 22 nt, Human
ucagcucacucugcuuccuggg

SEQ ID NO: 633710 - RNA, 22 nt, Human
aagggaaaauaguugaugacca

SEQ ID NO: 633711 - RNA, 22 nt, Human
gugaggaagucugagagccaca

SEQ ID NO: 633712 - RNA, 22 nt, Human
aguucuguggcugugcccugua

SEQ ID NO: 633713 - RNA, 22 nt, Human
gugagcaggauuucauggugua

SEQ ID NO: 633714 - RNA, 19 nt, Human
gcuccugggccucacucau

SEQ ID NO: 633715 - RNA, 22 nt, Human
aaaucacuguuauugaucuuaa

SEQ ID NO: 633716 - RNA, 22 nt, Human
ugugaggaccucagcagagucu

SEQ ID NO: 633717 - RNA, 22 nt, Human
guccuauuagcauauugaauac

SEQ ID NO: 633718 - RNA, 22 nt, Human
aaaugcacacaccaggaaacua

SEQ ID NO: 633719 - RNA, 22 nt, Human
uaucuagauauuuggauaaaug

SEQ ID NO: 633720 - RNA, 22 nt, Human
gccugggugaauuugauccuaa

SEQ ID NO: 633721 - RNA, 22 nt, Human
ggcuggccagggcccucgcugg

SEQ ID NO: 633722 - RNA, 22 nt, Human
aacaguuuguggauagcuugua

SEQ ID NO: 633723 - RNA, 22 nt, Human
cagaaugcauugcuucugaugg

SEQ ID NO: 633724 - RNA, 18 nt, Human
agccuggaggguugaagu

SEQ ID NO: 633725 - RNA, 22 nt, Human
cacugggagucguaagacacgg

SEQ ID NO: 633726 - RNA, 22 nt, Human
agucacaugagcacuaauuagg

SEQ ID NO: 633727 - RNA, 22 nt, Human
uaagcaaaguuuauaaggcucu

SEQ ID NO: 633728 - RNA, 22 nt, Human
gauauuuauuaagugguuggua

SEQ ID NO: 633729 - RNA, 23 nt, Human
uccuucaaguuaggaagugaaca

SEQ ID NO: 633730 - RNA, 22 nt, Human
ugaagggggagauauaugugug

SEQ ID NO: 633731 - RNA, 21 nt, Human
auguggccauuguaguccacg

SEQ ID NO: 633732 - RNA, 22 nt, Human
aggcuucauuacagugguucaa

SEQ ID NO: 633733 - RNA, 23 nt, Human
ugcagcaggguggucuacuucuc

SEQ ID NO: 633734 - RNA, 22 nt, Human
uucugagggcuaauguacugua

SEQ ID NO: 633735 - RNA, 22 nt, Human
ucagacuuccacuuugugcacu

SEQ ID NO: 633736 - RNA, 18 nt, Human
cugaggccaacuacacug

SEQ ID NO: 633737 - RNA, 22 nt, Human
cagcaaaguaagcugacaugua

SEQ ID NO: 633738 - RNA, 20 nt, Human
ggccucaguguccuuguuug

SEQ ID NO: 633739 - RNA, 22 nt, Human
cacacagcaacaagaauagcca

SEQ ID NO: 633740 - RNA, 22 nt, Human
uccauuugaaaugaaagugaua

SEQ ID NO: 633741 - RNA, 22 nt, Human
guccuggugccaccugcgggau

SEQ ID NO: 633742 - RNA, 22 nt, Human
uuacagcacagugcuuuuacug

SEQ ID NO: 633743 - RNA, 22 nt, Human
cagaggcuaagaguguccaaag

SEQ ID NO: 633744 - RNA, 22 nt, Human
uggaaccuggccugagcuacca

SEQ ID NO: 633745 - RNA, 22 nt, Human
cacaaugauuugguucaaaaau

SEQ ID NO: 633746 - RNA, 22 nt, Human
aaguccauaguuugcauuaggg

SEQ ID NO: 633747 - RNA, 22 nt, Human
agggauggaucuuggcccugga

SEQ ID NO: 633748 - RNA, 21 nt, Human
agaaacaugaucaaaggaacc

SEQ ID NO: 633749 - RNA, 22 nt, Human
ccaaggcagaagauggcucuug

SEQ ID NO: 633750 - RNA, 22 nt, Human
uggcuguggacucagauggcuc

SEQ ID NO: 633751 - RNA, 19 nt, Human
agcagagcccugaagaucc

SEQ ID NO: 633752 - RNA, 22 nt, Human
ugcaggcuggcagauaucucau

SEQ ID NO: 633753 - RNA, 22 nt, Human
acccuggagcaauaaucccugg

SEQ ID NO: 633754 - RNA, 22 nt, Human
agcagaaccugcagaccugucu

SEQ ID NO: 633755 - RNA, 22 nt, Human
uuucacagaaagacaacagaua

SEQ ID NO: 633756 - RNA, 22 nt, Human
gaggcccaaugcuucccuccuu

SEQ ID NO: 633757 - RNA, 22 nt, Human
auaacagacuuagaguuacaag

SEQ ID NO: 633758 - RNA, 22 nt, Human
gggaagugugguuucuuuacag

SEQ ID NO: 633759 - RNA, 22 nt, Human
ucuggagggguuuagagggaca

SEQ ID NO: 633760 - RNA, 22 nt, Human
uagaggcucuucauugcaguag

SEQ ID NO: 633761 - RNA, 22 nt, Human
ucauuguuucugcuuuucauga

SEQ ID NO: 633762 - RNA, 22 nt, Human
ucuuucaaaguaacaaccacga

SEQ ID NO: 633763 - RNA, 22 nt, Human
acaucuguaaucuagucaaccc

SEQ ID NO: 633764 - RNA, 18 nt, Human
ugaggccucugcugggcc

SEQ ID NO: 633765 - RNA, 22 nt, Human
augaagggugucccugugagca

SEQ ID NO: 633766 - RNA, 22 nt, Human
ugcccagccaguuuaugguaau

SEQ ID NO: 633767 - RNA, 22 nt, Human
gggcagguuauuggaguaggga

SEQ ID NO: 633768 - RNA, 22 nt, Human
aggacuggcccugaggggaggc

SEQ ID NO: 633769 - RNA, 22 nt, Human
gucuguguuuucaggccuuugu

SEQ ID NO: 633770 - RNA, 22 nt, Human
caguucuuauuuggccaguguc

SEQ ID NO: 633771 - RNA, 22 nt, Human
auuuugcugugguacauuagga

SEQ ID NO: 633772 - RNA, 22 nt, Human
uaucugauacaacagaauaaca

SEQ ID NO: 633773 - RNA, 22 nt, Human
acuggauugggaaaguacuuca

SEQ ID NO: 633774 - RNA, 22 nt, Human
aucugccugcaguggagguggg

SEQ ID NO: 633775 - RNA, 22 nt, Human
cuggagccagccagggcccucu

SEQ ID NO: 633776 - RNA, 22 nt, Human
gaaauucugugucccagagugc

SEQ ID NO: 633777 - RNA, 22 nt, Human
cuguggagguaggagcaggaca

SEQ ID NO: 633778 - RNA, 22 nt, Human
cucaggaaaauauugaagaagu

SEQ ID NO: 633779 - RNA, 22 nt, Human
aucagaagcaggaggaaugaag

SEQ ID NO: 633780 - RNA, 22 nt, Human
uucacaaaaugguuuguugaug

SEQ ID NO: 633781 - RNA, 22 nt, Human
gucugcugcagucguggcucua

SEQ ID NO: 633782 - RNA, 22 nt, Human
uuauuagagugcuuugagaaag

SEQ ID NO: 633783 - RNA, 22 nt, Human
auuagcaugccaagcuuuuaga

SEQ ID NO: 633784 - RNA, 19 nt, Human
gcugugccucucuccugcu

SEQ ID NO: 633785 - RNA, 22 nt, Human
gucuucuguaagaugagguccc

SEQ ID NO: 633786 - RNA, 22 nt, Human
gaauguuuuuaggaauguuaug

SEQ ID NO: 633787 - RNA, 22 nt, Human
ccacauuuggagaagauacuuu

SEQ ID NO: 633788 - RNA, 22 nt, Human
aguauugugacucaaguauucu

SEQ ID NO: 633789 - RNA, 22 nt, Human
cagaaacacuguauuuagggaa

SEQ ID NO: 633790 - RNA, 22 nt, Human
uuugcucuuaugaacaaggugg

SEQ ID NO: 633791 - RNA, 19 nt, Human
agcuguggaugugggauuu

SEQ ID NO: 633792 - RNA, 22 nt, Human
uacaaagagguaauugcauaua

SEQ ID NO: 633793 - RNA, 22 nt, Human
uuccuucugaagccuuuguguu

SEQ ID NO: 633794 - RNA, 22 nt, Human
uggucucugcaggccaggcuca

SEQ ID NO: 633795 - RNA, 22 nt, Human
ugcuggaaauuccuaggaggua

SEQ ID NO: 633796 - RNA, 22 nt, Human
ugguauuacagcauuccauauu

SEQ ID NO: 633797 - RNA, 22 nt, Human
aggcaguguucuucuaagggca

SEQ ID NO: 633798 - RNA, 22 nt, Human
ucucuuugacccuuuagcucca

SEQ ID NO: 633799 - RNA, 22 nt, Human
gcaugcauuuccauucucacau

SEQ ID NO: 633800 - RNA, 22 nt, Human
cucuuauagacacucuucuaua

SEQ ID NO: 633801 - RNA, 22 nt, Human
cagggaugggauggagucaguu

SEQ ID NO: 633802 - RNA, 18 nt, Human
agaauuauucuuguccuc

SEQ ID NO: 633803 - RNA, 22 nt, Human
gagaagggauaugccacucucg

SEQ ID NO: 633804 - RNA, 22 nt, Human
agggcuggcaucucuaaugcug

SEQ ID NO: 633805 - RNA, 22 nt, Human
agggcugaaguuauggcugagc

SEQ ID NO: 633806 - RNA, 21 nt, Human
aaagaaaucucccauugguag

SEQ ID NO: 633807 - RNA, 22 nt, Human
agagcccugagucaguucugga

SEQ ID NO: 633808 - RNA, 22 nt, Human
cuccugugcaugcaucucccua

SEQ ID NO: 633809 - RNA, 22 nt, Human
augaggcucucaggggagcugu

SEQ ID NO: 633810 - RNA, 22 nt, Human
agcugcucgaagccgguggccc

SEQ ID NO: 633811 - RNA, 22 nt, Human
auauucugcuuuugaugcauuc

SEQ ID NO: 633812 - RNA, 22 nt, Human
caagaaaugggauuugacugcc

SEQ ID NO: 633813 - RNA, 23 nt, Human
ggcuccaggccugacgggcgcgg

SEQ ID NO: 633814 - RNA, 22 nt, Human
aaaaucugcuuccuuuuacaga

SEQ ID NO: 633815 - RNA, 22 nt, Human
ugcuucuuuaugauguaugauu

SEQ ID NO: 633816 - RNA, 22 nt, Human
ccagaggaggggggucuuucug

SEQ ID NO: 633817 - RNA, 22 nt, Human
agcugguucauucauucauggu

SEQ ID NO: 633818 - RNA, 22 nt, Human
acuuugcaaauaaacucucuaa

SEQ ID NO: 633819 - RNA, 22 nt, Human
aaagccaucuguauuaagugaa

SEQ ID NO: 633820 - RNA, 22 nt, Human
cuucuucacacuggucugaagc

SEQ ID NO: 633821 - RNA, 16 nt, Human
augggcagugaggaag

SEQ ID NO: 633822 - RNA, 22 nt, Human
ggcagggguucauuuugucuua

SEQ ID NO: 633823 - RNA, 22 nt, Human
aaauuccauuaugauaauuucg

SEQ ID NO: 633824 - RNA, 22 nt, Human
uccaaagccgacugacaucuga

SEQ ID NO: 633825 - RNA, 22 nt, Human
gcagaggcucuuuaaugcuuag

SEQ ID NO: 633826 - RNA, 22 nt, Human
cccugcccaccacaugcuggga

SEQ ID NO: 633827 - RNA, 22 nt, Human
acacagaugcuauuuagucucu

SEQ ID NO: 633828 - RNA, 22 nt, Human
cugcaaaucaaguucuuauaau

SEQ ID NO: 633829 - RNA, 22 nt, Human
gugucacaggcccagcucuuca

SEQ ID NO: 633830 - RNA, 22 nt, Human
gcagaggccuagguggaaggcc

SEQ ID NO: 633831 - RNA, 22 nt, Human
agauaaaaugauuuucuggauc

SEQ ID NO: 633832 - RNA, 22 nt, Human
uggugucugcacucccuggcgu

SEQ ID NO: 633833 - RNA, 22 nt, Human
ugguggcagcugagugucaggu

SEQ ID NO: 633834 - RNA, 22 nt, Human
aggcccucacagucuauuguga

SEQ ID NO: 633835 - RNA, 22 nt, Human
acuuguuucaacuguacucuca

SEQ ID NO: 633836 - RNA, 22 nt, Human
cuagucacgucuuucaguuacc

SEQ ID NO: 633837 - RNA, 22 nt, Human
gaggcugggggcugccuuccuc

SEQ ID NO: 633838 - RNA, 18 nt, Human
auauguuaauuagguagg

SEQ ID NO: 633839 - RNA, 22 nt, Human
caugggaggucugcaaggugcu

SEQ ID NO: 633840 - RNA, 22 nt, Human
guggcgcagaggguggcagaga

SEQ ID NO: 633841 - RNA, 22 nt, Human
ucacaggguuuggaagccuccu

SEQ ID NO: 633842 - RNA, 22 nt, Human
ccagauagaaaagaaggcagga

SEQ ID NO: 633843 - RNA, 22 nt, Human
ucuggcugaagcuuuugcagcu

SEQ ID NO: 633844 - RNA, 22 nt, Human
aguuuucaguaaauauuaguga

SEQ ID NO: 633845 - RNA, 22 nt, Human
acaauagaaggaaacugacaua

SEQ ID NO: 633846 - RNA, 22 nt, Human
gugccugccccacuccucagca

SEQ ID NO: 633847 - RNA, 22 nt, Human
uaggaaaagucuagauugauga

SEQ ID NO: 633848 - RNA, 22 nt, Human
gagaggaaagaaccaaugaccc

SEQ ID NO: 633849 - RNA, 22 nt, Human
aucugucuuuuauucaugagcu

SEQ ID NO: 633850 - RNA, 22 nt, Human
ucauggauuaaauuauuaaguu

SEQ ID NO: 633851 - RNA, 22 nt, Human
aaguuugcauagauuaagcauu

SEQ ID NO: 633852 - RNA, 23 nt, Human
augugugggaggucagagagcca

SEQ ID NO: 633853 - RNA, 22 nt, Human
aggcuggcagccaccucagcag

SEQ ID NO: 633854 - RNA, 22 nt, Human
cccagagaugggaggugaucgg

SEQ ID NO: 633855 - RNA, 22 nt, Human
agcagggcucacauuaguggau

SEQ ID NO: 633856 - RNA, 22 nt, Human
uuuucuguguauccaggcuucc

SEQ ID NO: 633857 - RNA, 22 nt, Human
gagguacaugaggauacacagg

SEQ ID NO: 633858 - RNA, 22 nt, Human
aggcccugcugaggccucccuc

SEQ ID NO: 633859 - RNA, 22 nt, Human
uucacauuagugguucuauaua

SEQ ID NO: 633860 - RNA, 22 nt, Human
uauagcacacaguuuauaaaag

SEQ ID NO: 633861 - RNA, 22 nt, Human
accagcucucuagcccuggucc

SEQ ID NO: 633862 - RNA, 19 nt, Human
cucagcuguagcucaugug

SEQ ID NO: 633863 - RNA, 22 nt, Human
cauacauugcucauucaguauc

SEQ ID NO: 633864 - RNA, 19 nt, Human
gggcuuuacuccaaguggg

SEQ ID NO: 633865 - RNA, 22 nt, Human
cacuuuauaugcauuaccucau

SEQ ID NO: 633866 - RNA, 22 nt, Human
acagauguugcuugucauucuc

SEQ ID NO: 633867 - RNA, 22 nt, Human
uaaaguauccaguuauucuucu

SEQ ID NO: 633868 - RNA, 22 nt, Human
uuucaggagagaccagaaauga

SEQ ID NO: 633869 - RNA, 22 nt, Human
gugcccugagcuuaugcauucu

SEQ ID NO: 633870 - RNA, 22 nt, Human
ugggagagcuucaugccuucag

SEQ ID NO: 633871 - RNA, 18 nt, Human
guguggcugagaugaggc

SEQ ID NO: 633872 - RNA, 22 nt, Human
guuuccucugcugguuuucauu

SEQ ID NO: 633873 - RNA, 22 nt, Human
aaaagaggagugguuuaugaca

SEQ ID NO: 633874 - RNA, 22 nt, Human
uggaucaugugaugucaggagu

SEQ ID NO: 633875 - RNA, 21 nt, Human
ugacauuuggauucauaguaa

SEQ ID NO: 633876 - RNA, 22 nt, Human
agaggcacccgcgcgcggccau

SEQ ID NO: 633877 - RNA, 22 nt, Human
uauagugucucuagaucaaaga

SEQ ID NO: 633878 - RNA, 22 nt, Human
cugcacagccugucugggggcc

SEQ ID NO: 633879 - RNA, 22 nt, Human
acugucaucugguagaugaugg

SEQ ID NO: 633880 - RNA, 22 nt, Human
cagggucuuauaaggccaauuu

SEQ ID NO: 633881 - RNA, 22 nt, Human
ggagagcuuggagugcgauuuu

SEQ ID NO: 633882 - RNA, 22 nt, Human
ccugagagugagugccuccuua

SEQ ID NO: 633883 - RNA, 22 nt, Human
uagaaagacaaugggaagugcu

SEQ ID NO: 633884 - RNA, 22 nt, Human
uggcaaaggggaccauguugaa

SEQ ID NO: 633885 - RNA, 22 nt, Human
ugugccuuucaucaugcuuuug

SEQ ID NO: 633886 - RNA, 22 nt, Human
uucauucuucagagcugcgcuu

SEQ ID NO: 633887 - RNA, 23 nt, Human
aguguugguugggaagccaagca

SEQ ID NO: 633888 - RNA, 22 nt, Human
aaagcagccacagagagagcgu

SEQ ID NO: 633889 - RNA, 22 nt, Human
aagagcuggcccaaucugagca

SEQ ID NO: 633890 - RNA, 22 nt, Human
aucuuuggugcaugauacuuug

SEQ ID NO: 633891 - RNA, 22 nt, Human
cagcagcagccccaggaagguu

SEQ ID NO: 633892 - RNA, 22 nt, Human
aagauggcugcagcaauuccaa

SEQ ID NO: 633893 - RNA, 22 nt, Human
uucaggaaaugucugccuacca

SEQ ID NO: 633894 - RNA, 23 nt, Human
cauuucuagguguguuuggccau

SEQ ID NO: 633895 - RNA, 22 nt, Human
auuuuucagcuucauugaggca

SEQ ID NO: 633896 - RNA, 22 nt, Human
uucuguuacaagugaaaaaaug

SEQ ID NO: 633897 - RNA, 17 nt, Human
cagacagauauccuggg

SEQ ID NO: 633898 - RNA, 22 nt, Human
gacaguaguaaagcuaggacca

SEQ ID NO: 633899 - RNA, 22 nt, Human
uaaagugcugggauuauaggcc

SEQ ID NO: 633900 - RNA, 22 nt, Human
ugcaggugccucuugagcuugu

SEQ ID NO: 633901 - RNA, 22 nt, Human
cuggcuguaagcguguuuccua

SEQ ID NO: 633902 - RNA, 22 nt, Human
gaccuggaagaacugaggccuu

SEQ ID NO: 633903 - RNA, 22 nt, Human
ucuggaagaacggggcaugcug

SEQ ID NO: 633904 - RNA, 22 nt, Human
cagaggaaaguauuucuggaag

SEQ ID NO: 633905 - RNA, 22 nt, Human
ugccaauuugccccuuugcuga

SEQ ID NO: 633906 - RNA, 22 nt, Human
agcacagguacggagaugcuac

SEQ ID NO: 633907 - RNA, 18 nt, Human
cuuuaugugcagagcuuu

SEQ ID NO: 633908 - RNA, 22 nt, Human
aggcucugcagaccccagcugu

SEQ ID NO: 633909 - RNA, 21 nt, Human
aguuuuuacucuuaacugugg

SEQ ID NO: 633910 - RNA, 22 nt, Human
cugucccaggagcuguaagaca

SEQ ID NO: 633911 - RNA, 22 nt, Human
aaagaugucauacacauuaaga

SEQ ID NO: 633912 - RNA, 23 nt, Human
cauccaggagcugagucugacug

SEQ ID NO: 633913 - RNA, 22 nt, Human
uccaugggaagauuuugagugg

SEQ ID NO: 633914 - RNA, 22 nt, Human
uugauucuggugacugauggaa

SEQ ID NO: 633915 - RNA, 22 nt, Human
ucaaugucuucucaagucuuuu

SEQ ID NO: 633916 - RNA, 22 nt, Human
gaagggugugugugagggacac

SEQ ID NO: 633917 - RNA, 22 nt, Human
cauuacauuucaaaauguuucc

SEQ ID NO: 633918 - RNA, 22 nt, Human
aucacgucaugguuugaucugg

SEQ ID NO: 633919 - RNA, 23 nt, Human
auauuagggagauuagcccucua

SEQ ID NO: 633920 - RNA, 22 nt, Human
uuucauguuuauggaaaaugag

SEQ ID NO: 633921 - RNA, 22 nt, Human
ggcccugggcagaggagugggc

SEQ ID NO: 633922 - RNA, 22 nt, Human
ugaguggagaacagaggcucuc

SEQ ID NO: 633923 - RNA, 22 nt, Human
aguguuucaccguauguucuca

SEQ ID NO: 633924 - RNA, 21 nt, Human
auuuauguuugggguggaaug

SEQ ID NO: 633925 - RNA, 22 nt, Human
uaacacagacagccacuaguaa

SEQ ID NO: 633926 - RNA, 22 nt, Human
agacaauauauaauuuuaguug

SEQ ID NO: 633927 - RNA, 22 nt, Human
gcccuuggcaaauucuccuuua

SEQ ID NO: 633928 - RNA, 22 nt, Human
acauuuacccuggaacauugga

SEQ ID NO: 633929 - RNA, 22 nt, Human
uuuuauucaaauaguucacacu

SEQ ID NO: 633930 - RNA, 22 nt, Human
cugaggacauugaugaggcaau

SEQ ID NO: 633931 - RNA, 21 nt, Human
aguggucuuuuucacccagug

SEQ ID NO: 633932 - RNA, 22 nt, Human
uagcaaggcguggcacucaaau

SEQ ID NO: 633933 - RNA, 22 nt, Human
aggccagagaggggaccagccu

SEQ ID NO: 633934 - RNA, 22 nt, Human
uucaagaucuuccaaaggauac

SEQ ID NO: 633935 - RNA, 22 nt, Human
uucauuuggccucugcuuaaaa

SEQ ID NO: 633936 - RNA, 23 nt, Human
guguguggaaagugcaugggccu

SEQ ID NO: 633937 - RNA, 19 nt, Human
cugaaaaacauucucagga

SEQ ID NO: 633938 - RNA, 18 nt, Human
cauaauuuucuuucuuua

SEQ ID NO: 633939 - RNA, 22 nt, Human
ggacccugggcucugggccuau

SEQ ID NO: 633940 - RNA, 22 nt, Human
ugugugaacucucugauguaca

SEQ ID NO: 633941 - RNA, 23 nt, Human
agcuggaaauggccgagcucugc

SEQ ID NO: 633942 - RNA, 22 nt, Human
gagacacuugcugugaggucgc

SEQ ID NO: 633943 - RNA, 22 nt, Human
ggggcaggagguguucucuuuu

SEQ ID NO: 633944 - RNA, 19 nt, Human
uuccugugcugcugugucc

SEQ ID NO: 633945 - RNA, 21 nt, Human
ccugcagcaccagaaggagau

SEQ ID NO: 633946 - RNA, 22 nt, Human
uucuggaaacccucagccagug

SEQ ID NO: 633947 - RNA, 21 nt, Human
ucagagaacccggcaggcaag

SEQ ID NO: 633948 - RNA, 22 nt, Human
uuuaugcagcacuuuacauuug

SEQ ID NO: 633949 - RNA, 22 nt, Human
cuguccagcuuggcuccugggg

SEQ ID NO: 633950 - RNA, 22 nt, Human
cugugccaggcccagcugacuu

SEQ ID NO: 633951 - RNA, 18 nt, Human
gaaaccugaggaagaaag

SEQ ID NO: 633952 - RNA, 16 nt, Human
aucuaagaauguagag

SEQ ID NO: 633953 - RNA, 22 nt, Human
aaugaugagaacuggaguaauu

SEQ ID NO: 633954 - RNA, 22 nt, Human
aggccacauugugauucccgca

SEQ ID NO: 633955 - RNA, 22 nt, Human
aaguucaagucugcaucuuuuu

SEQ ID NO: 633956 - RNA, 22 nt, Human
uggucugaaugacuuguuaguu

SEQ ID NO: 633957 - RNA, 22 nt, Human
ccugucagaugaaguaauugug

SEQ ID NO: 633958 - RNA, 22 nt, Human
cuugggaaguguuuaaagcuga

SEQ ID NO: 633959 - RNA, 22 nt, Human
uacaggugguaaaaauauuguu

SEQ ID NO: 633960 - RNA, 22 nt, Human
gccuagagaaaaagccucugca

SEQ ID NO: 633961 - RNA, 22 nt, Human
agggcuggagccacagcuggga

SEQ ID NO: 633962 - RNA, 22 nt, Human
gacuucagauauuuuuuaaguu

SEQ ID NO: 633963 - RNA, 18 nt, Human
cccacuguccccacaggc

SEQ ID NO: 633964 - RNA, 22 nt, Human
gcugggcaccggagagacccca

SEQ ID NO: 633965 - RNA, 22 nt, Human
gcugccguuggcucuucaggcc

SEQ ID NO: 633966 - RNA, 22 nt, Human
ugcucuggguccugggccuccu

SEQ ID NO: 633967 - RNA, 15 nt, Human
gcucuggguauuuga

SEQ ID NO: 633968 - RNA, 22 nt, Human
ucacaacucuuuccauuuaaua

SEQ ID NO: 633969 - RNA, 22 nt, Human
aaagcuauagggucaagcauuu

SEQ ID NO: 633970 - RNA, 22 nt, Human
cugaggcuggggaagggaagug

SEQ ID NO: 633971 - RNA, 22 nt, Human
acacuuuaucaauauucaaaaa

SEQ ID NO: 633972 - RNA, 22 nt, Human
aaagagcuggcauuuauagucu

SEQ ID NO: 633973 - RNA, 22 nt, Human
uguuuuuccaugugcagaacaa

SEQ ID NO: 633974 - RNA, 23 nt, Human
acaaccagcacuggagggcacca

SEQ ID NO: 633975 - RNA, 22 nt, Human
ccagcaucuaacgcuccuggga

SEQ ID NO: 633976 - RNA, 22 nt, Human
gucagcaaaaaauuuaugugag

SEQ ID NO: 633977 - RNA, 22 nt, Human
uuguuuaaugccucauacaucu

SEQ ID NO: 633978 - RNA, 22 nt, Human
uuggcaguagugguaguacauu

SEQ ID NO: 633979 - RNA, 22 nt, Human
cugugucuuuccuacuuugugg

SEQ ID NO: 633980 - RNA, 22 nt, Human
agaaguuaauuccugaaauucu

SEQ ID NO: 633981 - RNA, 22 nt, Human
aggaggccuguuuucuccugga

SEQ ID NO: 633982 - RNA, 22 nt, Human
ugacacaguaucaaacaugauu

SEQ ID NO: 633983 - RNA, 22 nt, Human
uuuccucugcugccauugcccc

SEQ ID NO: 633984 - RNA, 22 nt, Human
ucuacacauuuguaaaggcauu

SEQ ID NO: 633985 - RNA, 22 nt, Human
aauagcaugcauccugcauaga

SEQ ID NO: 633986 - RNA, 19 nt, Human
ucauggaagaaaugugaua

SEQ ID NO: 633987 - RNA, 22 nt, Human
cuuacacacuagaugguaggug

SEQ ID NO: 633988 - RNA, 22 nt, Human
uccuguggcguuaucaugugau

SEQ ID NO: 633989 - RNA, 22 nt, Human
gagguugggaaguccaagcugg

SEQ ID NO: 633990 - RNA, 22 nt, Human
agcacaggaccaaggaagcugu

SEQ ID NO: 633991 - RNA, 22 nt, Human
uuucauguauuucccaaagcuu

SEQ ID NO: 633992 - RNA, 22 nt, Human
uuuggucucugugcauccuccu

SEQ ID NO: 633993 - RNA, 22 nt, Human
aggggagcaaggccguggugua

SEQ ID NO: 633994 - RNA, 22 nt, Human
ucucuuucuauugcaccaugcu

SEQ ID NO: 633995 - RNA, 22 nt, Human
auuuauugaagcuuauuacguu

SEQ ID NO: 633996 - RNA, 22 nt, Human
ugugacuugauguuugcaccag

SEQ ID NO: 633997 - RNA, 22 nt, Human
auaauaaaccaggaugggucug

SEQ ID NO: 633998 - RNA, 22 nt, Human
aggcagaaaauagucauccaaa

SEQ ID NO: 633999 - RNA, 21 nt, Human
acuguuauucccauuuucacc

SEQ ID NO: 634000 - RNA, 22 nt, Human
gggaucagcaagccacugcacc

SEQ ID NO: 634001 - RNA, 20 nt, Human
acaguggguggggagcacug

SEQ ID NO: 634002 - RNA, 22 nt, Human
gcaugggaggacagucugggcu

SEQ ID NO: 634003 - RNA, 22 nt, Human
uaccauuucaguaaaaacuuag

SEQ ID NO: 634004 - RNA, 22 nt, Human
cugcaggggcaguccacuuccu

SEQ ID NO: 634005 - RNA, 22 nt, Human
ggggugagaucaaggaagcccu

SEQ ID NO: 634006 - RNA, 22 nt, Human
ucucuccuuaucauuguguuua

SEQ ID NO: 634007 - RNA, 22 nt, Human
gguaugaaaugauuccauguua

SEQ ID NO: 634008 - RNA, 22 nt, Human
aucuccagauugugaucaucag

SEQ ID NO: 634009 - RNA, 22 nt, Human
ucauugcaggcauuccccugcc

SEQ ID NO: 634010 - RNA, 22 nt, Human
cagaggucugacacugaauggu

SEQ ID NO: 634011 - RNA, 21 nt, Human
augggcagaggcagagaggcu

SEQ ID NO: 634012 - RNA, 20 nt, Human
ugcuuuaugcuauacuuugu

SEQ ID NO: 634013 - RNA, 18 nt, Human
cucuguguuggugugaag

SEQ ID NO: 634014 - RNA, 22 nt, Human
ugauauaagaaguaguauggau

SEQ ID NO: 634015 - RNA, 21 nt, Human
uuacagcaauguuagcaggaa

SEQ ID NO: 634016 - RNA, 22 nt, Human
ugcugcucaaugagaugccauc

SEQ ID NO: 634017 - RNA, 23 nt, Human
augcaggguuacagggcugacuu

SEQ ID NO: 634018 - RNA, 22 nt, Human
augugcuucauucuacaugaca

SEQ ID NO: 634019 - RNA, 22 nt, Human
gugggcaggagugagcaacagg

SEQ ID NO: 634020 - RNA, 23 nt, Human
ucugucuguguaugugcagaaag

SEQ ID NO: 634021 - RNA, 22 nt, Human
cugccuggaugaauggcgccuu

SEQ ID NO: 634022 - RNA, 22 nt, Human
cucagagcacaguuuaugacag

SEQ ID NO: 634023 - RNA, 22 nt, Human
cuccagguugacuucagucaau

SEQ ID NO: 634024 - RNA, 22 nt, Human
auggguagacugacaaagucaa

SEQ ID NO: 634025 - RNA, 22 nt, Human
uuaucugaaacuuuugggacca

SEQ ID NO: 634026 - RNA, 22 nt, Human
agcccagguggagugugugggg

SEQ ID NO: 634027 - RNA, 22 nt, Human
ucacauuuuaucuauuuuaagu

SEQ ID NO: 634028 - RNA, 22 nt, Human
acccagggagugcuccuguucu

SEQ ID NO: 634029 - RNA, 22 nt, Human
caacuguuauaaaucaacagag

SEQ ID NO: 634030 - RNA, 22 nt, Human
ucacuguauuugcugaugcaua

SEQ ID NO: 634031 - RNA, 22 nt, Human
agggccagcccauaaugccaaa

SEQ ID NO: 634032 - RNA, 22 nt, Human
gcccugagggguggugucugua

SEQ ID NO: 634033 - RNA, 22 nt, Human
aaaucaguucacguucugaggu

SEQ ID NO: 634034 - RNA, 17 nt, Human
caguggcagaucuucuc

SEQ ID NO: 634035 - RNA, 22 nt, Human
cucuucuuuaguccagaccauc

SEQ ID NO: 634036 - RNA, 22 nt, Human
cucugcuuuuuagggagccuag

SEQ ID NO: 634037 - RNA, 22 nt, Human
gaguuggcuguucgaagguagc

SEQ ID NO: 634038 - RNA, 22 nt, Human
ccauuggagccaagaguuuuac

SEQ ID NO: 634039 - RNA, 22 nt, Human
cucuuuaacucccauucugucc

SEQ ID NO: 634040 - RNA, 22 nt, Human
aggaacaagggagccuuuucuc

SEQ ID NO: 634041 - RNA, 22 nt, Human
ugcugcagcggcauggucuuug

SEQ ID NO: 634042 - RNA, 22 nt, Human
ucugaacagaaaagaugcacaa

SEQ ID NO: 634043 - RNA, 22 nt, Human
ucuuuauuuaagucuguuguaa

SEQ ID NO: 634044 - RNA, 22 nt, Human
ugcuuaaaaacaguaugguagu

SEQ ID NO: 634045 - RNA, 22 nt, Human
augcaguuagguaauagucuca

SEQ ID NO: 634046 - RNA, 22 nt, Human
caguaaaagauggaaauagaau

SEQ ID NO: 634047 - RNA, 22 nt, Human
cuaaaugacuuccagugguuau

SEQ ID NO: 634048 - RNA, 22 nt, Human
gcauggccucugugcuuguugc

SEQ ID NO: 634049 - RNA, 22 nt, Human
gccagagcugagugagguucuu

SEQ ID NO: 634050 - RNA, 22 nt, Human
uugaggagcaggaugggaggcu

SEQ ID NO: 634051 - RNA, 22 nt, Human
ucugagcacaauuacuuacauc

SEQ ID NO: 634052 - RNA, 22 nt, Human
ucucagagaccugaacucccug

SEQ ID NO: 634053 - RNA, 22 nt, Human
uauuuguccuuauuaagaucug

SEQ ID NO: 634054 - RNA, 22 nt, Human
gaagcugacccaggagcgugug

SEQ ID NO: 634055 - RNA, 22 nt, Human
cuugggccaccuggagggacug

SEQ ID NO: 634056 - RNA, 22 nt, Human
ucucugugagaugccuuccuga

SEQ ID NO: 634057 - RNA, 22 nt, Human
uguuuaagccuguggugucauc

SEQ ID NO: 634058 - RNA, 22 nt, Human
agaucugaguggcugcauguaa

SEQ ID NO: 634059 - RNA, 22 nt, Human
cucuccagccacagaagcugcu

SEQ ID NO: 634060 - RNA, 22 nt, Human
agcugaggacgugaagggcggc

SEQ ID NO: 634061 - RNA, 22 nt, Human
cccuuuaaguagaauauauuau

SEQ ID NO: 634062 - RNA, 22 nt, Human
uaaaugagauguacauaacuca

SEQ ID NO: 634063 - RNA, 22 nt, Human
gcugggaggaauuuggggaaua

SEQ ID NO: 634064 - RNA, 22 nt, Human
cugugcuggcagaccuggaguu

SEQ ID NO: 634065 - RNA, 22 nt, Human
uuuccagugauugcugcucuca

SEQ ID NO: 634066 - RNA, 22 nt, Human
cugccaaaaggugcaccugcug

SEQ ID NO: 634067 - RNA, 22 nt, Human
agucugcaggcugugauuuuuu

SEQ ID NO: 634068 - RNA, 22 nt, Human
uggguggcacuucuggggucca

SEQ ID NO: 634069 - RNA, 23 nt, Human
gaggccuggcccugccacaucuc

SEQ ID NO: 634070 - RNA, 22 nt, Human
uccauacucagaaaguauugca

SEQ ID NO: 634071 - RNA, 22 nt, Human
aagcccuggauuaaagaugcca

SEQ ID NO: 634072 - RNA, 22 nt, Human
caggcacaaugagcgccaucuu

SEQ ID NO: 634073 - RNA, 23 nt, Human
cuccuggaggguccggcccugcc

SEQ ID NO: 634074 - RNA, 22 nt, Human
ggcacagccacuuuggagaacu

SEQ ID NO: 634075 - RNA, 22 nt, Human
gucuguccagcaacacaggagu

SEQ ID NO: 634076 - RNA, 22 nt, Human
uguaggcugaagaugaagugga

SEQ ID NO: 634077 - RNA, 22 nt, Human
aagggacauagacuguacaucu

SEQ ID NO: 634078 - RNA, 22 nt, Human
gcccaucaucacuguggaggcu

SEQ ID NO: 634079 - RNA, 22 nt, Human
uucuguuaucauuaagcauuau

SEQ ID NO: 634080 - RNA, 22 nt, Human
aagacagagggaagcaaugaug

SEQ ID NO: 634081 - RNA, 22 nt, Human
uugaaggacaucuuguuucuag

SEQ ID NO: 634082 - RNA, 22 nt, Human
cuugccaaugguacaaacgauu

SEQ ID NO: 634083 - RNA, 22 nt, Human
agguggccccaggccucugcca

SEQ ID NO: 634084 - RNA, 22 nt, Human
gagccugcagcuuucacagcau

SEQ ID NO: 634085 - RNA, 22 nt, Human
caggcacugugcaagggucucg

SEQ ID NO: 634086 - RNA, 20 nt, Human
accuaguacaaucuguuucu

SEQ ID NO: 634087 - RNA, 22 nt, Human
ccagccuuugcaucccccaucu

SEQ ID NO: 634088 - RNA, 22 nt, Human
ccagagcuucggggcggcugua

SEQ ID NO: 634089 - RNA, 22 nt, Human
uuuccuuaaaucuguuucuagu

SEQ ID NO: 634090 - RNA, 22 nt, Human
ugauuuaugcauuauacuguug

SEQ ID NO: 634091 - RNA, 22 nt, Human
aggcacuguggaagacaugguu

SEQ ID NO: 634092 - RNA, 22 nt, Human
ucacagcagaauuuaggaggca

SEQ ID NO: 634093 - RNA, 22 nt, Human
cagaaggcaaacaaaaggauuu

SEQ ID NO: 634094 - RNA, 22 nt, Human
agugaaaacacuaguucuugcc

SEQ ID NO: 634095 - RNA, 22 nt, Human
ggcugguguugagugccuguag

SEQ ID NO: 634096 - RNA, 22 nt, Human
gagaaagauuguccuucagggg

SEQ ID NO: 634097 - RNA, 22 nt, Human
aacacuuaaggagagaucaaau

SEQ ID NO: 634098 - RNA, 22 nt, Human
cugcagugaaaucaggaagcaa

SEQ ID NO: 634099 - RNA, 22 nt, Human
uggcuucacacaggcacuuccg

SEQ ID NO: 634100 - RNA, 22 nt, Human
accaaggcuaaaauaacauguu

SEQ ID NO: 634101 - RNA, 18 nt, Human
aggucuguggucaccagg

SEQ ID NO: 634102 - RNA, 22 nt, Human
aggcuaauauggcacaugaaca

SEQ ID NO: 634103 - RNA, 22 nt, Human
cacaggaggaggccagagcgua

SEQ ID NO: 634104 - RNA, 22 nt, Human
agcuuugggauucaggcaggaa

SEQ ID NO: 634105 - RNA, 22 nt, Human
agucucugcaugccugcugugc

SEQ ID NO: 634106 - RNA, 17 nt, Human
cugaagauaauggcaac

SEQ ID NO: 634107 - RNA, 22 nt, Human
gaccacuggcgcugcgagaccc

SEQ ID NO: 634108 - RNA, 22 nt, Human
uaccugaguuauauuaauaauu

SEQ ID NO: 634109 - RNA, 18 nt, Human
cagcugcaggcucaggac

SEQ ID NO: 634110 - RNA, 22 nt, Human
cccugagaacaacuuagggguc

SEQ ID NO: 634111 - RNA, 22 nt, Human
aacuagagcuuccagcuucuug

SEQ ID NO: 634112 - RNA, 18 nt, Human
uguggcaggggugggaga

SEQ ID NO: 634113 - RNA, 22 nt, Human
uauauaauuuucugccauaucc

SEQ ID NO: 634114 - RNA, 22 nt, Human
aaggugucggcagagccgcuuc

SEQ ID NO: 634115 - RNA, 22 nt, Human
accagcugccuggucuaucugc

SEQ ID NO: 634116 - RNA, 23 nt, Human
gcugccucuguuggucuucaguu

SEQ ID NO: 634117 - RNA, 22 nt, Human
agggugguggcgaugaggacau

SEQ ID NO: 634118 - RNA, 22 nt, Human
gaugggaggaaccugggucccu

SEQ ID NO: 634119 - RNA, 22 nt, Human
gugugugugcaucucuuuuauu

SEQ ID NO: 634120 - RNA, 22 nt, Human
gagcugagaucauguacacuag

SEQ ID NO: 634121 - RNA, 21 nt, Human
aggcccagagucuugggggga

SEQ ID NO: 634122 - RNA, 22 nt, Human
agagcuggcagcagcuucuccu

SEQ ID NO: 634123 - RNA, 22 nt, Human
uaaggccagccagcaaaucugu

SEQ ID NO: 634124 - RNA, 22 nt, Human
aucagcaagcauuuauugagug

SEQ ID NO: 634125 - RNA, 22 nt, Human
agccccuugugggcgcacagca

SEQ ID NO: 634126 - RNA, 22 nt, Human
gcugccucacuccagcccaaua

SEQ ID NO: 634127 - RNA, 22 nt, Human
cacacaguaggcacucauuaau

SEQ ID NO: 634128 - RNA, 22 nt, Human
uuugaauauacuucaaacaaag

SEQ ID NO: 634129 - RNA, 22 nt, Human
cacagguauauguguauauacu

SEQ ID NO: 634130 - RNA, 22 nt, Human
ucuccaggcacuuggcugcuac

SEQ ID NO: 634131 - RNA, 22 nt, Human
gagauacaguuggcugcaggcu

SEQ ID NO: 634132 - RNA, 18 nt, Human
gguggcuggggacggaca

SEQ ID NO: 634133 - RNA, 22 nt, Human
acaggcauugggauggagguug

SEQ ID NO: 634134 - RNA, 22 nt, Human
cucauugauucagugcugcucu

SEQ ID NO: 634135 - RNA, 22 nt, Human
aacugcaauuacuuuugcacua

SEQ ID NO: 634136 - RNA, 20 nt, Human
ggcaguuaaggcacagucau

SEQ ID NO: 634137 - RNA, 22 nt, Human
caucuaaauuugacuccaagga

SEQ ID NO: 634138 - RNA, 22 nt, Human
ucuacagugucaaugugucuug

SEQ ID NO: 634139 - RNA, 22 nt, Human
gccucccuguagaggccagccu

SEQ ID NO: 634140 - RNA, 22 nt, Human
aggugcaccugagggugucauc

SEQ ID NO: 634141 - RNA, 19 nt, Human
aacagcaacuuccuaguca

SEQ ID NO: 634142 - RNA, 22 nt, Human
uggaacacaggacuaucagcug

SEQ ID NO: 634143 - RNA, 22 nt, Human
aaccuggaccuuuuggguauug

SEQ ID NO: 634144 - RNA, 22 nt, Human
cugugcuuucgagaugugaucu

SEQ ID NO: 634145 - RNA, 22 nt, Human
agcagcuccucuaggaacggau

SEQ ID NO: 634146 - RNA, 22 nt, Human
cccagaggaggaucucggcccg

SEQ ID NO: 634147 - RNA, 22 nt, Human
cuguggcugcagccuugguccu

SEQ ID NO: 634148 - RNA, 22 nt, Human
aaagacagauggcaaggaugau

SEQ ID NO: 634149 - RNA, 22 nt, Human
cagccugcccuggaagcccagc

SEQ ID NO: 634150 - RNA, 22 nt, Human
gaguucaguguuucuaguagug

SEQ ID NO: 634151 - RNA, 22 nt, Human
uaguggaggggaugcaaagcuu

SEQ ID NO: 634152 - RNA, 21 nt, Human
ucugagaacuucugcugcagc

SEQ ID NO: 634153 - RNA, 22 nt, Human
ggcugccugcuccuccugcacg

SEQ ID NO: 634154 - RNA, 22 nt, Human
uuguccagcagcucagucuacg

SEQ ID NO: 634155 - RNA, 22 nt, Human
uucagcaggcgguagcugccac

SEQ ID NO: 634156 - RNA, 22 nt, Human
gcagaggguccugugccagcag

SEQ ID NO: 634157 - RNA, 22 nt, Human
uauuuccaagcugaauccaaug

SEQ ID NO: 634158 - RNA, 23 nt, Human
augaaugaauaaggcaggaaagc

SEQ ID NO: 634159 - RNA, 22 nt, Human
accugccucagugcagcuggau

SEQ ID NO: 634160 - RNA, 22 nt, Human
agcuccaguuacuuaccuagag

SEQ ID NO: 634161 - RNA, 22 nt, Human
ugagccacagugagagcuccug

SEQ ID NO: 634162 - RNA, 22 nt, Human
caggauauuaguuuucuuguua

SEQ ID NO: 634163 - RNA, 22 nt, Human
gaagcagcaaguauaggacagg

SEQ ID NO: 634164 - RNA, 18 nt, Human
cugagggcagccccuggg

SEQ ID NO: 634165 - RNA, 22 nt, Human
ugcccugggaguuggagcugcu

SEQ ID NO: 634166 - RNA, 22 nt, Human
gcaugcagacagucugagacca

SEQ ID NO: 634167 - RNA, 22 nt, Human
caguguuucugugcccaguggg

SEQ ID NO: 634168 - RNA, 22 nt, Human
uucugcauuucuaauaaguucc

SEQ ID NO: 634169 - RNA, 22 nt, Human
ugcaccauuuugucaggcuacu

SEQ ID NO: 634170 - RNA, 22 nt, Human
uggaaugacagagagucugaau

SEQ ID NO: 634171 - RNA, 18 nt, Human
ucagauuuaacuguaucc

SEQ ID NO: 634172 - RNA, 22 nt, Human
ucacugacguggggcuacuuga

SEQ ID NO: 634173 - RNA, 22 nt, Human
uuucacauacaguguauaguag

SEQ ID NO: 634174 - RNA, 17 nt, Human
uauguaguacuuauaaa

SEQ ID NO: 634175 - RNA, 22 nt, Human
cuauacagcagcuuacuaguua

SEQ ID NO: 634176 - RNA, 22 nt, Human
caucaguguggcaguucacugu

SEQ ID NO: 634177 - RNA, 22 nt, Human
cuccagauccagcugagcugca

SEQ ID NO: 634178 - RNA, 22 nt, Human
uuuucuaucuccuagaacugcc

SEQ ID NO: 634179 - RNA, 22 nt, Human
gcucugggugaauggcagauug

SEQ ID NO: 634180 - RNA, 22 nt, Human
accaagcuucguggaggaaguu

SEQ ID NO: 634181 - RNA, 22 nt, Human
accuguuuucagaaaaugcaga

SEQ ID NO: 634182 - RNA, 22 nt, Human
ugccaaaauggccaaaagcuag

SEQ ID NO: 634183 - RNA, 22 nt, Human
ugcucaguagcagugugcugcu

SEQ ID NO: 634184 - RNA, 22 nt, Human
cacuaguggccccaugugguug

SEQ ID NO: 634185 - RNA, 22 nt, Human
cuuauuuuaagucaguuugggu

SEQ ID NO: 634186 - RNA, 22 nt, Human
gcugucugucucugucccacca

SEQ ID NO: 634187 - RNA, 22 nt, Human
ugggacacccucacgccugcac

SEQ ID NO: 634188 - RNA, 22 nt, Human
ucucuccugcacugaauuaugu

SEQ ID NO: 634189 - RNA, 22 nt, Human
agggugcguucuaugagaaucu

SEQ ID NO: 634190 - RNA, 22 nt, Human
uucugggccaaucucuuaaucu

SEQ ID NO: 634191 - RNA, 22 nt, Human
gucaggaagcaagguugggcau

SEQ ID NO: 634192 - RNA, 22 nt, Human
gaaugugugacucuauugagca

SEQ ID NO: 634193 - RNA, 22 nt, Human
cauggccagcccccaguuccuc

SEQ ID NO: 634194 - RNA, 22 nt, Human
cuuugaaaacacacgaauagac

SEQ ID NO: 634195 - RNA, 22 nt, Human
caggccugggcuggguaucagg

SEQ ID NO: 634196 - RNA, 22 nt, Human
acacagcuuucagucauuaucu

SEQ ID NO: 634197 - RNA, 20 nt, Human
guggcagugguggcagcagu

SEQ ID NO: 634198 - RNA, 22 nt, Human
ugcucuggcuggagcaaugacu

SEQ ID NO: 634199 - RNA, 19 nt, Human
cugggcugaggucugccuu

SEQ ID NO: 634200 - RNA, 22 nt, Human
gcuuccauguaugcucuugaca

SEQ ID NO: 634201 - RNA, 22 nt, Human
ucaauguccgggccccauucca

SEQ ID NO: 634202 - RNA, 22 nt, Human
ucagcuucucaaaauggcuuag

SEQ ID NO: 634203 - RNA, 22 nt, Human
uuuaaauguuuauagagaguac

SEQ ID NO: 634204 - RNA, 22 nt, Human
cagcaucuguuuuucugaccca

SEQ ID NO: 634205 - RNA, 22 nt, Human
agaauucagaaugcauuucuaa

SEQ ID NO: 634206 - RNA, 22 nt, Human
ugagaaugaaucuuuugcuuuc

SEQ ID NO: 634207 - RNA, 22 nt, Human
cuucucuacuuccuggaagggg

SEQ ID NO: 634208 - RNA, 22 nt, Human
gcccucaguggauucuuauugu

SEQ ID NO: 634209 - RNA, 22 nt, Human
ccuuuucuauguaccagcagug

SEQ ID NO: 634210 - RNA, 22 nt, Human
ccagggugagaaaaggcuggau

SEQ ID NO: 634211 - RNA, 22 nt, Human
gaggcacaccagggagucuugu

SEQ ID NO: 634212 - RNA, 17 nt, Human
ccaggucuccuugcuuu

SEQ ID NO: 634213 - RNA, 18 nt, Human
ucugggcuucccgaggcu

SEQ ID NO: 634214 - RNA, 22 nt, Human
uuuguucaaaaauuauaagaua

SEQ ID NO: 634215 - RNA, 22 nt, Human
ucuccagaggucccuugucucu

SEQ ID NO: 634216 - RNA, 22 nt, Human
ugcuccugcugcaugcaucucc

SEQ ID NO: 634217 - RNA, 22 nt, Human
agucuuuaacauuuggagauug

SEQ ID NO: 634218 - RNA, 22 nt, Human
uacccagcuccucagaagacca

SEQ ID NO: 634219 - RNA, 22 nt, Human
aaucuacaugcaauauuuuuag

SEQ ID NO: 634220 - RNA, 22 nt, Human
ugucucaggggcauugaaauaa

SEQ ID NO: 634221 - RNA, 22 nt, Human
uccaugagcuagcuuuccaaag

SEQ ID NO: 634222 - RNA, 22 nt, Human
aggguccugggugcaguugcuu

SEQ ID NO: 634223 - RNA, 22 nt, Human
ucagcaggcacaccaaaaacug

SEQ ID NO: 634224 - RNA, 19 nt, Human
uaaugcacuuaacacaugg

SEQ ID NO: 634225 - RNA, 20 nt, Human
accaggagauggaggcaggg

SEQ ID NO: 634226 - RNA, 22 nt, Human
aggagcagaccguaguccugca

SEQ ID NO: 634227 - RNA, 23 nt, Human
agucacaucuuagcagccagguc

SEQ ID NO: 634228 - RNA, 23 nt, Human
ggccacugaauuuucugcaucuu

SEQ ID NO: 634229 - RNA, 22 nt, Human
aggcccuggcccccagagauuc

SEQ ID NO: 634230 - RNA, 22 nt, Human
agcaggacaauaugggaucagg

SEQ ID NO: 634231 - RNA, 22 nt, Human
gcuucuccucccgcucccaggc

SEQ ID NO: 634232 - RNA, 22 nt, Human
uaguuaggggaaaaacgacagg

SEQ ID NO: 634233 - RNA, 22 nt, Human
ucauggaagaaagguuuguuuc

SEQ ID NO: 634234 - RNA, 22 nt, Human
uauguacaauuuguuguauguc

SEQ ID NO: 634235 - RNA, 23 nt, Human
uucaugaguuggacaagacuggg

SEQ ID NO: 634236 - RNA, 17 nt, Human
cagcucugcaucuuccu

SEQ ID NO: 634237 - RNA, 19 nt, Human
ugacagagagcaggguggu

SEQ ID NO: 634238 - RNA, 22 nt, Human
cuccuggcccugagcucccagg

SEQ ID NO: 634239 - RNA, 22 nt, Human
acuccgacucugagucuacauu

SEQ ID NO: 634240 - RNA, 22 nt, Human
agggaagugaaugacagauauc

SEQ ID NO: 634241 - RNA, 22 nt, Human
aagugugagacacacaaaauua

SEQ ID NO: 634242 - RNA, 22 nt, Human
acagagucugacagguaggcgc

SEQ ID NO: 634243 - RNA, 22 nt, Human
cagcaauaagguaagcuucucc

SEQ ID NO: 634244 - RNA, 22 nt, Human
ucuuugaugugguuaauuauga

SEQ ID NO: 634245 - RNA, 17 nt, Human
agcuucugcccuuucuu

SEQ ID NO: 634246 - RNA, 22 nt, Human
ucucagggagggcgagucagcg

SEQ ID NO: 634247 - RNA, 22 nt, Human
ccacugggcguuucuguccaau

SEQ ID NO: 634248 - RNA, 22 nt, Human
ucacaggaggaaccuggccugg

SEQ ID NO: 634249 - RNA, 22 nt, Human
ucucuuccaguggcuuugauuu

SEQ ID NO: 634250 - RNA, 20 nt, Human
cauuugaaucuccauucugc

SEQ ID NO: 634251 - RNA, 23 nt, Human
uggcuaaaggcucuaguccugcu

SEQ ID NO: 634252 - RNA, 22 nt, Human
uuccucagccagcacuuagggg

SEQ ID NO: 634253 - RNA, 22 nt, Human
cagcuucuguccuagaaacugg

SEQ ID NO: 634254 - RNA, 22 nt, Human
ggaggcuccuaagcugacuuga

SEQ ID NO: 634255 - RNA, 21 nt, Human
acugugggguucaacuggcag

SEQ ID NO: 634256 - RNA, 22 nt, Human
gcaaacaaggacauacauccug

SEQ ID NO: 634257 - RNA, 20 nt, Human
uucucuggauagccagaugu

SEQ ID NO: 634258 - RNA, 22 nt, Human
ugugaauaccuugaauucauca

SEQ ID NO: 634259 - RNA, 22 nt, Human
uggggagcacgguagggaaaug

SEQ ID NO: 634260 - RNA, 22 nt, Human
ggaagaggcugguagugcccgu

SEQ ID NO: 634261 - RNA, 22 nt, Human
agaaaauuagauuuuacugugu

SEQ ID NO: 634262 - RNA, 22 nt, Human
aauuagggagccaucauaaggu

SEQ ID NO: 634263 - RNA, 22 nt, Human
ggagguggagcuggaaguucca

SEQ ID NO: 634264 - RNA, 22 nt, Human
uagacaacuggagauagucuga

SEQ ID NO: 634265 - RNA, 22 nt, Human
acauagaguucaauuuucaguc

SEQ ID NO: 634266 - RNA, 22 nt, Human
gcucccuuaggccuugccggga

SEQ ID NO: 634267 - RNA, 22 nt, Human
aagccaggauaaaguuguuuua

SEQ ID NO: 634268 - RNA, 22 nt, Human
augugucuuggaguuuuaaugu

SEQ ID NO: 634269 - RNA, 20 nt, Human
aggggugaucgggugacacu

SEQ ID NO: 634270 - RNA, 22 nt, Human
uggcagccuucucugagaaggu

SEQ ID NO: 634271 - RNA, 22 nt, Human
uugcagggccuuggcuucuucc

SEQ ID NO: 634272 - RNA, 22 nt, Human
gguggcugcuuccucaagagga

SEQ ID NO: 634273 - RNA, 21 nt, Human
cuauuggaaaagaaaauauuu

SEQ ID NO: 634274 - RNA, 22 nt, Human
uacagagaugccgaagagugaa

SEQ ID NO: 634275 - RNA, 22 nt, Human
uccucaugccgggucucacgcu

SEQ ID NO: 634276 - RNA, 22 nt, Human
gccaagaguuuccagcugcaag

SEQ ID NO: 634277 - RNA, 22 nt, Human
gggcuacugagcuggaacuggg

SEQ ID NO: 634278 - RNA, 22 nt, Human
uuaugccuccgaaaccuggagu

SEQ ID NO: 634279 - RNA, 22 nt, Human
cuuuccuaguaguuacagaaug

SEQ ID NO: 634280 - RNA, 22 nt, Human
uggacaggcuccuagggguucc

SEQ ID NO: 634281 - RNA, 22 nt, Human
caggcugugaaacugagaugcg

SEQ ID NO: 634282 - RNA, 22 nt, Human
gagcaucuggcuagaggaguga

SEQ ID NO: 634283 - RNA, 22 nt, Human
agcccaggaaguugaggcuugc

SEQ ID NO: 634284 - RNA, 22 nt, Human
uugauucuaugagguaagcuau

SEQ ID NO: 634285 - RNA, 22 nt, Human
guccugugucccagagaaagag

SEQ ID NO: 634286 - RNA, 22 nt, Human
aucagaaauagucauguuacuu

SEQ ID NO: 634287 - RNA, 22 nt, Human
cccaguaccucuguucccugcu

SEQ ID NO: 634288 - RNA, 22 nt, Human
ugcagcugcucauucucucagu

SEQ ID NO: 634289 - RNA, 22 nt, Human
uguguuaaguauuugauacacu

SEQ ID NO: 634290 - RNA, 22 nt, Human
gcccacuuucugccagcucacc

SEQ ID NO: 634291 - RNA, 20 nt, Human
auuuguuucuacucucugac

SEQ ID NO: 634292 - RNA, 22 nt, Human
auucaucuaugacucuaaugug

SEQ ID NO: 634293 - RNA, 22 nt, Human
uaaaguguaugccaucucucau

SEQ ID NO: 634294 - RNA, 22 nt, Human
uucucugcucucacauacagaa

SEQ ID NO: 634295 - RNA, 22 nt, Human
gguuuucaguuugugagcucug

SEQ ID NO: 634296 - RNA, 22 nt, Human
gcagcuuugaagacuuauuugc

SEQ ID NO: 634297 - RNA, 22 nt, Human
ugacccugagagcugaauggcu

SEQ ID NO: 634298 - RNA, 22 nt, Human
uagguacuuaagaucucagcua

SEQ ID NO: 634299 - RNA, 21 nt, Human
cggagcugggcagggcauccc

SEQ ID NO: 634300 - RNA, 22 nt, Human
gccaccugcgggccguggugga

SEQ ID NO: 634301 - RNA, 22 nt, Human
caaggaggaagaugcaggggac

SEQ ID NO: 634302 - RNA, 22 nt, Human
ucacugcuauauuggauacuga

SEQ ID NO: 634303 - RNA, 22 nt, Human
aggacagcauaugggaaccagu

SEQ ID NO: 634304 - RNA, 22 nt, Human
acagccagaggugguccugggu

SEQ ID NO: 634305 - RNA, 22 nt, Human
auagaaacagaugcacuucucu

SEQ ID NO: 634306 - RNA, 22 nt, Human
agggagguccaucccugcagag

SEQ ID NO: 634307 - RNA, 22 nt, Human
ggcaggugaggcaugugccugg

SEQ ID NO: 634308 - RNA, 22 nt, Human
uggaguucucaggugagggcuu

SEQ ID NO: 634309 - RNA, 22 nt, Human
gugugccuuucacacacuggga

SEQ ID NO: 634310 - RNA, 22 nt, Human
uacacauuuugcggguacaugu

SEQ ID NO: 634311 - RNA, 22 nt, Human
uccagaggcuccaaagggagau

SEQ ID NO: 634312 - RNA, 22 nt, Human
cugcagagcuaggcugagugaa

SEQ ID NO: 634313 - RNA, 22 nt, Human
uagagcauuaugacaaccccau

SEQ ID NO: 634314 - RNA, 22 nt, Human
gaagcccuauccucuccuggga

SEQ ID NO: 634315 - RNA, 22 nt, Human
guguccugggcugguagagcug

SEQ ID NO: 634316 - RNA, 22 nt, Human
augaacaaaaacaaggccuguu

SEQ ID NO: 634317 - RNA, 22 nt, Human
cagcccugggaguuggggccga

SEQ ID NO: 634318 - RNA, 22 nt, Human
ugaucuuugggccauuaauaaa

SEQ ID NO: 634319 - RNA, 22 nt, Human
aucuuuacaguguaagugcaga

SEQ ID NO: 634320 - RNA, 22 nt, Human
cagaugcugcucaccugauuau

SEQ ID NO: 634321 - RNA, 22 nt, Human
uguaacaguaagccugugagcu

SEQ ID NO: 634322 - RNA, 17 nt, Human
agccagguacaagucca

SEQ ID NO: 634323 - RNA, 22 nt, Human
aguuuaauauccuucaacuuuc

SEQ ID NO: 634324 - RNA, 22 nt, Human
ucagaguuccucauagauccag

SEQ ID NO: 634325 - RNA, 21 nt, Human
aaugugugcuauuuaucuuuu

SEQ ID NO: 634326 - RNA, 22 nt, Human
uuuccucuuugugacacagcug

SEQ ID NO: 634327 - RNA, 22 nt, Human
gugcugacaggagccuggcggu

SEQ ID NO: 634328 - RNA, 22 nt, Human
gcuguacaaauuccacaagaga

SEQ ID NO: 634329 - RNA, 22 nt, Human
caugauacuugacauuugcgau

SEQ ID NO: 634330 - RNA, 22 nt, Human
uuuucaggccagaagauagacc

SEQ ID NO: 634331 - RNA, 22 nt, Human
ucccuugagaguuggccaauug

SEQ ID NO: 634332 - RNA, 22 nt, Human
cucugcccgugccuuucccagu

SEQ ID NO: 634333 - RNA, 22 nt, Human
agccacagagguugaugugguu

SEQ ID NO: 634334 - RNA, 22 nt, Human
gagucuucuacgcucacacaaa

SEQ ID NO: 634335 - RNA, 22 nt, Human
aaacugaggaacaaggaaggau

SEQ ID NO: 634336 - RNA, 22 nt, Human
acauugaacauggcaggacauu

SEQ ID NO: 634337 - RNA, 21 nt, Human
aaagauguuucaucugagaaa

SEQ ID NO: 634338 - RNA, 22 nt, Human
agcccucaggcuuugcugggcc

SEQ ID NO: 634339 - RNA, 22 nt, Human
agaaggaguguacaggucaugc

SEQ ID NO: 634340 - RNA, 22 nt, Human
aacagugucaggauuacagaua

SEQ ID NO: 634341 - RNA, 22 nt, Human
accuuuuuucagaacucuaaag

SEQ ID NO: 634342 - RNA, 22 nt, Human
aggcuggcauacauuuguucuu

SEQ ID NO: 634343 - RNA, 22 nt, Human
agagguauuagauuugcauagg

SEQ ID NO: 634344 - RNA, 22 nt, Human
uaagaaacuuaacugggaacua

SEQ ID NO: 634345 - RNA, 22 nt, Human
uacaaagauaaaaucucaccau

SEQ ID NO: 634346 - RNA, 22 nt, Human
cagaggccuucaauacucauuu

SEQ ID NO: 634347 - RNA, 22 nt, Human
ucaaaacaaucauuggaugugc

SEQ ID NO: 634348 - RNA, 22 nt, Human
cuauucugauuaccagauauug

SEQ ID NO: 634349 - RNA, 22 nt, Human
gcagaaccauaaauucagguaa

SEQ ID NO: 634350 - RNA, 22 nt, Human
aagaacaugggugugggcauuc

SEQ ID NO: 634351 - RNA, 22 nt, Human
gagguuucuuaucaagaaagcu

SEQ ID NO: 634352 - RNA, 22 nt, Human
aucucuggguccauagaagaga

SEQ ID NO: 634353 - RNA, 22 nt, Human
gugucaaugagguuuauuuuug

SEQ ID NO: 634354 - RNA, 22 nt, Human
aucuggagaauaaauguccaag

SEQ ID NO: 634355 - RNA, 22 nt, Human
ggccaauuccaggagccggcgg

SEQ ID NO: 634356 - RNA, 22 nt, Human
ucuuuggaguguuaucaguaau

SEQ ID NO: 634357 - RNA, 22 nt, Human
uacuuugguugaauauguaaug

SEQ ID NO: 634358 - RNA, 22 nt, Human
cuuccugguuugaagcucgccg

SEQ ID NO: 634359 - RNA, 22 nt, Human
uauagacaagcguaacaagaag

SEQ ID NO: 634360 - RNA, 22 nt, Human
auggccagccacuccugauggc

SEQ ID NO: 634361 - RNA, 22 nt, Human
ucagaagguggagguugcagug

SEQ ID NO: 634362 - RNA, 22 nt, Human
aaaaguuauugaugcaggacaa

SEQ ID NO: 634363 - RNA, 22 nt, Human
gucuguggucccugcuggggac

SEQ ID NO: 634364 - RNA, 22 nt, Human
uggugggcugagucucaucgga

SEQ ID NO: 634365 - RNA, 22 nt, Human
aauagacaauucuagccaacau

SEQ ID NO: 634366 - RNA, 22 nt, Human
gauuauauaauggaagcucuug

SEQ ID NO: 634367 - RNA, 22 nt, Human
ugagagaugaaguuaguuguuc

SEQ ID NO: 634368 - RNA, 22 nt, Human
ggucccagaauugguuagcaca

SEQ ID NO: 634369 - RNA, 19 nt, Human
gcauuucaggcauguuugc

SEQ ID NO: 634370 - RNA, 22 nt, Human
agccucugggggagcugggagc

SEQ ID NO: 634371 - RNA, 22 nt, Human
ccugcagaagaguccagcucau

SEQ ID NO: 634372 - RNA, 22 nt, Human
uggcccugggcaucuuucguga

SEQ ID NO: 634373 - RNA, 22 nt, Human
ggcugcugguagggguaggaag

SEQ ID NO: 634374 - RNA, 19 nt, Human
agccacagaacuugcagga

SEQ ID NO: 634375 - RNA, 19 nt, Human
accuuuccuuucucagaug

SEQ ID NO: 634376 - RNA, 22 nt, Human
agaauugcuaacucuccuccug

SEQ ID NO: 634377 - RNA, 23 nt, Human
acagccaguucaccucuccuugg

SEQ ID NO: 634378 - RNA, 21 nt, Human
acuuugggaggugugaggggc

SEQ ID NO: 634379 - RNA, 22 nt, Human
ucccagaagagaugccacuuga

SEQ ID NO: 634380 - RNA, 22 nt, Human
ccaugggaauugggagguccca

SEQ ID NO: 634381 - RNA, 22 nt, Human
ugggccagggcacccaguccag

SEQ ID NO: 634382 - RNA, 20 nt, Human
ggccacagggugcuggugga

SEQ ID NO: 634383 - RNA, 23 nt, Human
acagagaucuugacuuguaugga

SEQ ID NO: 634384 - RNA, 22 nt, Human
guuauaaaugacugcaaaaguu

SEQ ID NO: 634385 - RNA, 22 nt, Human
aggcccuggcuggguuucuuua

SEQ ID NO: 634386 - RNA, 22 nt, Human
gugcaauagacugugguauuaa

SEQ ID NO: 634387 - RNA, 22 nt, Human
uuauaaagauccuuccagaguu

SEQ ID NO: 634388 - RNA, 22 nt, Human
ggaagagccuggggugucaggc

SEQ ID NO: 634389 - RNA, 22 nt, Human
uaaggguucagaaugcaguggu

SEQ ID NO: 634390 - RNA, 22 nt, Human
gcccuggaugcucauggcauca

SEQ ID NO: 634391 - RNA, 22 nt, Human
ucugcucuaguugcuuccugcc

SEQ ID NO: 634392 - RNA, 22 nt, Human
aggccuugccaaugagagaacu

SEQ ID NO: 634393 - RNA, 22 nt, Human
cugaaauuauuguuuaaucaaa

SEQ ID NO: 634394 - RNA, 22 nt, Human
augugggccgugcggguguccu

SEQ ID NO: 634395 - RNA, 22 nt, Human
cccuccuggaggcggaugccca

SEQ ID NO: 634396 - RNA, 22 nt, Human
ugaaagcacaaguucuaacagg

SEQ ID NO: 634397 - RNA, 22 nt, Human
aagaaaacaaugacuugccagc

SEQ ID NO: 634398 - RNA, 22 nt, Human
ugaaauggcaaggcagagcuuu

SEQ ID NO: 634399 - RNA, 20 nt, Human
aggaggcaauguagauaagc

SEQ ID NO: 634400 - RNA, 22 nt, Human
gcugcaggcuguggcaggggag

SEQ ID NO: 634401 - RNA, 22 nt, Human
auuugguuacucaguugucuga

SEQ ID NO: 634402 - RNA, 19 nt, Human
cacagaugauugacacaua

SEQ ID NO: 634403 - RNA, 22 nt, Human
agcuagcuuagccugugaggua

SEQ ID NO: 634404 - RNA, 22 nt, Human
uuaaguacaggguuagugacgg

SEQ ID NO: 634405 - RNA, 22 nt, Human
auuuggaacaaauauuaguaaa

SEQ ID NO: 634406 - RNA, 22 nt, Human
gcugugggugcuggcuccaccc

SEQ ID NO: 634407 - RNA, 22 nt, Human
ggcaaagcccugccugguucaa

SEQ ID NO: 634408 - RNA, 22 nt, Human
gacuccccugggccccauccag

SEQ ID NO: 634409 - RNA, 22 nt, Human
aauaagccagcccaugugaccc

SEQ ID NO: 634410 - RNA, 22 nt, Human
acuuucucaaaucagacuuuaa

SEQ ID NO: 634411 - RNA, 19 nt, Human
agaggcaaggguggaagua

SEQ ID NO: 634412 - RNA, 22 nt, Human
cccauucauccucgcuuccuuc

SEQ ID NO: 634413 - RNA, 22 nt, Human
gcagcauugcacuuuuguucuu

SEQ ID NO: 634414 - RNA, 22 nt, Human
cccacugaggguuaaugccugc

SEQ ID NO: 634415 - RNA, 22 nt, Human
caucacaccacaggcauuuucu

SEQ ID NO: 634416 - RNA, 22 nt, Human
ccggcgggcagcggcagugagc

SEQ ID NO: 634417 - RNA, 22 nt, Human
cugcuucauagcccuggucucu

SEQ ID NO: 634418 - RNA, 22 nt, Human
acacuuguguugaaagcuguua

SEQ ID NO: 634419 - RNA, 22 nt, Human
auacaugcacauuuuuauacau

SEQ ID NO: 634420 - RNA, 21 nt, Human
uuucuaagugcuugguuuggg

SEQ ID NO: 634421 - RNA, 22 nt, Human
acccugggaacuggaaacugga

SEQ ID NO: 634422 - RNA, 22 nt, Human
uggcuucaaaaucuaguggucu

SEQ ID NO: 634423 - RNA, 22 nt, Human
gugcagagaaggagcaguaguu

SEQ ID NO: 634424 - RNA, 22 nt, Human
guguguggggccuucggguccu

SEQ ID NO: 634425 - RNA, 22 nt, Human
cacagauaccuagugaaacaua

SEQ ID NO: 634426 - RNA, 22 nt, Human
cucugagaagaguucaaguaaa

SEQ ID NO: 634427 - RNA, 22 nt, Human
ccuuuggucuugaugaacuguu

SEQ ID NO: 634428 - RNA, 22 nt, Human
ucugaggcauacccaggccccc

SEQ ID NO: 634429 - RNA, 22 nt, Human
ucccugaggaagggguguggug

SEQ ID NO: 634430 - RNA, 22 nt, Human
auguuucagauacagaucaaau

SEQ ID NO: 634431 - RNA, 22 nt, Human
ucagccaguuuguuuauuccgg

SEQ ID NO: 634432 - RNA, 23 nt, Human
uugcacauuggagcuggucuucu

SEQ ID NO: 634433 - RNA, 22 nt, Human
cuuggggcagcccaggcugagc

SEQ ID NO: 634434 - RNA, 22 nt, Human
gcugaagcugacacauagugcu

SEQ ID NO: 634435 - RNA, 22 nt, Human
uaccauuugagagagaacauaa

SEQ ID NO: 634436 - RNA, 22 nt, Human
uauuacacagugaaagcaugga

SEQ ID NO: 634437 - RNA, 22 nt, Human
ucaucagcucaucugcuccuag

SEQ ID NO: 634438 - RNA, 22 nt, Human
ugccuggccagacccuauagag

SEQ ID NO: 634439 - RNA, 22 nt, Human
ugguuuacucuguaaaccagga

SEQ ID NO: 634440 - RNA, 22 nt, Human
augcugagauaaggcuuuaguc

SEQ ID NO: 634441 - RNA, 22 nt, Human
aguuuucuucauuuuguggcca

SEQ ID NO: 634442 - RNA, 22 nt, Human
uguuuuuguucaaugcuagguc

SEQ ID NO: 634443 - RNA, 22 nt, Human
cucucuuuuucgugugccgaag

SEQ ID NO: 634444 - RNA, 22 nt, Human
caguggcauacuuggcugauau

SEQ ID NO: 634445 - RNA, 22 nt, Human
aauugauggacagagaugaaga

SEQ ID NO: 634446 - RNA, 22 nt, Human
uccgggcaacugaagggagguu

SEQ ID NO: 634447 - RNA, 22 nt, Human
ucucaggaaauaggauuugagu

SEQ ID NO: 634448 - RNA, 22 nt, Human
uucugcuuuuauugccagaguu

SEQ ID NO: 634449 - RNA, 22 nt, Human
auguuuaaaggguugagaaaua

SEQ ID NO: 634450 - RNA, 22 nt, Human
gucucagaguccuacuuauucc

SEQ ID NO: 634451 - RNA, 22 nt, Human
ucugccucgcuaacagcagcca

SEQ ID NO: 634452 - RNA, 22 nt, Human
cuguguccugucuccuaaggug

SEQ ID NO: 634453 - RNA, 22 nt, Human
gcugcagggagcuggaaggcuc

SEQ ID NO: 634454 - RNA, 22 nt, Human
uaauagaaagguauuuuuugca

SEQ ID NO: 634455 - RNA, 22 nt, Human
cugcuggggucagagcacuggg

SEQ ID NO: 634456 - RNA, 22 nt, Human
cauggaaggcaaaagacacaga

SEQ ID NO: 634457 - RNA, 18 nt, Human
aggcuugggcccagcagc

SEQ ID NO: 634458 - RNA, 22 nt, Human
gcacugaaaauguuggauucca

SEQ ID NO: 634459 - RNA, 22 nt, Human
ugaucagucccaugaucuucca

SEQ ID NO: 634460 - RNA, 22 nt, Human
caccagcuacucggguuuccug

SEQ ID NO: 634461 - RNA, 22 nt, Human
caauguuuuuccuuccuuaaua

SEQ ID NO: 634462 - RNA, 22 nt, Human
gcagaggcuguagggaagguug

SEQ ID NO: 634463 - RNA, 22 nt, Human
gaagaucugcagccucaggcga

SEQ ID NO: 634464 - RNA, 22 nt, Human
auguguaggugaaucgaggcug

SEQ ID NO: 634465 - RNA, 22 nt, Human
uucuuuucuuuaggcauugugu

SEQ ID NO: 634466 - RNA, 22 nt, Human
aguuuaauccuccagcccaacu

SEQ ID NO: 634467 - RNA, 22 nt, Human
aucaggauguuuggcugucaua

SEQ ID NO: 634468 - RNA, 22 nt, Human
aaggaacacuacaaggcuggga

SEQ ID NO: 634469 - RNA, 22 nt, Human
uguggagguuuaaguaauggga

SEQ ID NO: 634470 - RNA, 22 nt, Human
ccauccuaucugaccuacuugu

SEQ ID NO: 634471 - RNA, 22 nt, Human
cuagggcacuaggacucaugug

SEQ ID NO: 634472 - RNA, 20 nt, Human
aagagucuuuacugagcuaa

SEQ ID NO: 634473 - RNA, 22 nt, Human
auugaaagauuuugggcucaug

SEQ ID NO: 634474 - RNA, 22 nt, Human
uccucaguggggcauucauuau

SEQ ID NO: 634475 - RNA, 22 nt, Human
acagcaggcccauacuggaagg

SEQ ID NO: 634476 - RNA, 22 nt, Human
gcacagugauaggcaguugugc

SEQ ID NO: 634477 - RNA, 22 nt, Human
gggcucagacaucccuccugga

SEQ ID NO: 634478 - RNA, 22 nt, Human
auauauacaacuagauuaaaag

SEQ ID NO: 634479 - RNA, 22 nt, Human
ugccaaggguaugggcaagaua

SEQ ID NO: 634480 - RNA, 22 nt, Human
agcaaggaguagaacaagagug

SEQ ID NO: 634481 - RNA, 22 nt, Human
uauguuucaucaggcauggagu

SEQ ID NO: 634482 - RNA, 22 nt, Human
aucucugguuguuuugcuccca

SEQ ID NO: 634483 - RNA, 22 nt, Human
gcaggcuccaacuggaggaguu

SEQ ID NO: 634484 - RNA, 22 nt, Human
aaaugcaaggauuuuguuaggc

SEQ ID NO: 634485 - RNA, 22 nt, Human
gugugcaguagagaaagagcag

SEQ ID NO: 634486 - RNA, 22 nt, Human
acaguguuccuuuguugugacu

SEQ ID NO: 634487 - RNA, 23 nt, Human
acagcaagaggaccagaugugag

SEQ ID NO: 634488 - RNA, 22 nt, Human
uccuucagcuuguuagagugac

SEQ ID NO: 634489 - RNA, 22 nt, Human
agcagacauaucucaugucaca

SEQ ID NO: 634490 - RNA, 22 nt, Human
gggaacagggccugagcugggg

SEQ ID NO: 634491 - RNA, 22 nt, Human
acaaauguggacauggauaaug

SEQ ID NO: 634492 - RNA, 22 nt, Human
caggcagaggaggccuucuccu

SEQ ID NO: 634493 - RNA, 22 nt, Human
gcaaagacccaggugucuaucc

SEQ ID NO: 634494 - RNA, 22 nt, Human
aucuucaguuuucagugagcca

SEQ ID NO: 634495 - RNA, 21 nt, Human
cacaggugggucagugaggcc

SEQ ID NO: 634496 - RNA, 16 nt, Human
gccuggaguggcaggg

SEQ ID NO: 634497 - RNA, 22 nt, Human
ucucucuccuaguuuuuagugg

SEQ ID NO: 634498 - RNA, 22 nt, Human
ccagagccucgcccggagccuc

SEQ ID NO: 634499 - RNA, 22 nt, Human
acucugcucuuauaguguuaua

SEQ ID NO: 634500 - RNA, 22 nt, Human
ugcaggaaaaccaacacgccuu

SEQ ID NO: 634501 - RNA, 22 nt, Human
uaaggccagcaugaaugcagca

SEQ ID NO: 634502 - RNA, 22 nt, Human
uaugucuucgucaccuaucuca

SEQ ID NO: 634503 - RNA, 22 nt, Human
accacuguaucuccagcacauu

SEQ ID NO: 634504 - RNA, 22 nt, Human
caauagugucugcuuguuucua

SEQ ID NO: 634505 - RNA, 22 nt, Human
cauauuuauucuucugccagug

SEQ ID NO: 634506 - RNA, 22 nt, Human
uccucccuucucacugggaagg

SEQ ID NO: 634507 - RNA, 19 nt, Human
uccaccccagccagcucug

SEQ ID NO: 634508 - RNA, 22 nt, Human
ugagcagagcaauaggacucuc

SEQ ID NO: 634509 - RNA, 22 nt, Human
ugcagcccuuccuuccucuggg

SEQ ID NO: 634510 - RNA, 23 nt, Human
uuuaugcagcauguagaacaugg

SEQ ID NO: 634511 - RNA, 22 nt, Human
aacauucuacuguacugcauug

SEQ ID NO: 634512 - RNA, 19 nt, Human
uuugagaaguuauuaucua

SEQ ID NO: 634513 - RNA, 22 nt, Human
auuugugggacuauaaugcagg

SEQ ID NO: 634514 - RNA, 22 nt, Human
ggagaauucuuuauuagcuuuu

SEQ ID NO: 634515 - RNA, 22 nt, Human
cauggauauauuguacaguagc

SEQ ID NO: 634516 - RNA, 22 nt, Human
uuguagcauuuuaaaugagcau

SEQ ID NO: 634517 - RNA, 19 nt, Human
cccucaggucugagcaguc

SEQ ID NO: 634518 - RNA, 22 nt, Human
acauuguaguuguucugcagca

SEQ ID NO: 634519 - RNA, 22 nt, Human
ucagcuggugaguggauagaca

SEQ ID NO: 634520 - RNA, 22 nt, Human
acauuugggacccucucuucac

SEQ ID NO: 634521 - RNA, 22 nt, Human
acccaggaggcagagguugcag

SEQ ID NO: 634522 - RNA, 22 nt, Human
uucugggaggccuuugugucug

SEQ ID NO: 634523 - RNA, 22 nt, Human
agaaagggcuauuuugagguag

SEQ ID NO: 634524 - RNA, 22 nt, Human
ccaugcucuggggaggucaagc

SEQ ID NO: 634525 - RNA, 22 nt, Human
agcucccaauugacuugaacua

SEQ ID NO: 634526 - RNA, 22 nt, Human
gagcuggugaucagcuggagga

SEQ ID NO: 634527 - RNA, 22 nt, Human
gaggggcagagguagagaacaa

SEQ ID NO: 634528 - RNA, 22 nt, Human
ugcacacauuaaggauacacag

SEQ ID NO: 634529 - RNA, 22 nt, Human
uggaacuucaugagauuaugga

SEQ ID NO: 634530 - RNA, 22 nt, Human
gagguucgauacagcguauuua

SEQ ID NO: 634531 - RNA, 22 nt, Human
gcacagaacccuaucuuucgga

SEQ ID NO: 634532 - RNA, 22 nt, Human
ccauccaugcgccagacagauu

SEQ ID NO: 634533 - RNA, 22 nt, Human
cuagugaaauuugcaaguaauu

SEQ ID NO: 634534 - RNA, 22 nt, Human
ugcacagaauaauauauguucu

SEQ ID NO: 634535 - RNA, 22 nt, Human
agcuuacugggcaguaaagauu

SEQ ID NO: 634536 - RNA, 22 nt, Human
auccaggcugcuaugaggauga

SEQ ID NO: 634537 - RNA, 22 nt, Human
aguggucuccccaguagaauaa

SEQ ID NO: 634538 - RNA, 22 nt, Human
cacagcauuaacugggacagcu

SEQ ID NO: 634539 - RNA, 22 nt, Human
aaaaguaauugcaguuuuguca

SEQ ID NO: 634540 - RNA, 22 nt, Human
cuccagucauagccucuugagu

SEQ ID NO: 634541 - RNA, 22 nt, Human
guguguguucaauaaauuuaag

SEQ ID NO: 634542 - RNA, 22 nt, Human
ggccgggcaggucucagccagc

SEQ ID NO: 634543 - RNA, 22 nt, Human
gcuugcaagauagguuacuuaa

SEQ ID NO: 634544 - RNA, 22 nt, Human
auguuuaauuaucuggguuuug

SEQ ID NO: 634545 - RNA, 22 nt, Human
gggagggacacaaagaguuccc

SEQ ID NO: 634546 - RNA, 22 nt, Human
cuggaaggucuguccccacugc

SEQ ID NO: 634547 - RNA, 22 nt, Human
ggccaggugcgguggcucacac

SEQ ID NO: 634548 - RNA, 22 nt, Human
acaugacuauaauuacuuaaau

SEQ ID NO: 634549 - RNA, 21 nt, Human
aagaggaagcauuauggcaua

SEQ ID NO: 634550 - RNA, 22 nt, Human
ugucagcagaucuccugcagcc

SEQ ID NO: 634551 - RNA, 22 nt, Human
cccagagccgguggugcucaca

SEQ ID NO: 634552 - RNA, 21 nt, Human
guccuucauuaucaagucaaa

SEQ ID NO: 634553 - RNA, 22 nt, Human
ggcuucaggggcccagucagca

SEQ ID NO: 634554 - RNA, 22 nt, Human
cagaggccuggcuuggacaccu

SEQ ID NO: 634555 - RNA, 22 nt, Human
cccucucugacuucugaacuug

SEQ ID NO: 634556 - RNA, 22 nt, Human
cucagaggguugaaggugcucu

SEQ ID NO: 634557 - RNA, 22 nt, Human
uucuaacuaauuggaaauggaa

SEQ ID NO: 634558 - RNA, 22 nt, Human
uuguaugcuguaggcaugcauu

SEQ ID NO: 634559 - RNA, 22 nt, Human
gcugugcaaaucgauuuguugg

SEQ ID NO: 634560 - RNA, 22 nt, Human
ggugaagggccuuaggagacag

SEQ ID NO: 634561 - RNA, 22 nt, Human
ggcucuggaaaguguccuugau

SEQ ID NO: 634562 - RNA, 22 nt, Human
cccacagaaugccaaugagacc

SEQ ID NO: 634563 - RNA, 22 nt, Human
uaugaaggauacaccucugauu

SEQ ID NO: 634564 - RNA, 20 nt, Human
agagccuggaaaaagacauc

SEQ ID NO: 634565 - RNA, 22 nt, Human
gacagaaucaucuccugggacu

SEQ ID NO: 634566 - RNA, 22 nt, Human
uuuacaguuccaugugauaggc

SEQ ID NO: 634567 - RNA, 23 nt, Human
gccuggagaaaagcugcaguuca

SEQ ID NO: 634568 - RNA, 22 nt, Human
ugacagugagcuugggguacuu

SEQ ID NO: 634569 - RNA, 22 nt, Human
ggaaggagccauaucauaucca

SEQ ID NO: 634570 - RNA, 21 nt, Human
ucuuggccuaaguucacugaa

SEQ ID NO: 634571 - RNA, 22 nt, Human
cacuaggcaucugugaggguag

SEQ ID NO: 634572 - RNA, 22 nt, Human
ugcagcugaccagcaaguccug

SEQ ID NO: 634573 - RNA, 22 nt, Human
uguggccuccuguuccugggua

SEQ ID NO: 634574 - RNA, 22 nt, Human
cagcccugcugguuuugggcaa

SEQ ID NO: 634575 - RNA, 22 nt, Human
augcacccagugucuggacuau

SEQ ID NO: 634576 - RNA, 22 nt, Human
uuuucaugucauguccuugagg

SEQ ID NO: 634577 - RNA, 22 nt, Human
ggccagcuguggggccgagccu

SEQ ID NO: 634578 - RNA, 22 nt, Human
uccucugcucagcauuccucac

SEQ ID NO: 634579 - RNA, 22 nt, Human
cugucugucaaguucaucucca

SEQ ID NO: 634580 - RNA, 22 nt, Human
acagagcaauaacagggagagg

SEQ ID NO: 634581 - RNA, 22 nt, Human
uggcagcuguguccagguagaa

SEQ ID NO: 634582 - RNA, 22 nt, Human
ucccugaugccuugauccgugg

SEQ ID NO: 634583 - RNA, 22 nt, Human
agugggcugguggcagggagaa

SEQ ID NO: 634584 - RNA, 22 nt, Human
acucaggaauggggcugggacu

SEQ ID NO: 634585 - RNA, 22 nt, Human
ucaguuuuuaaaugauauaauu

SEQ ID NO: 634586 - RNA, 23 nt, Human
ggacuaggcaacagaugggacag

SEQ ID NO: 634587 - RNA, 22 nt, Human
aauggcagaaugggccagaagc

SEQ ID NO: 634588 - RNA, 22 nt, Human
uguggcugggcuaauaggcaaa

SEQ ID NO: 634589 - RNA, 22 nt, Human
ggcuccacccugcuuccagaag

SEQ ID NO: 634590 - RNA, 22 nt, Human
ugcuaucaccaacucugcuaag

SEQ ID NO: 634591 - RNA, 22 nt, Human
aggcagaggaaggguggauuug

SEQ ID NO: 634592 - RNA, 22 nt, Human
acauugaacaguacaaaugauc

SEQ ID NO: 634593 - RNA, 22 nt, Human
uggacaggauagugcaguacgc

SEQ ID NO: 634594 - RNA, 19 nt, Human
cuugcugggugguuucugc

SEQ ID NO: 634595 - RNA, 22 nt, Human
cagaagccuaaauagugcacca

SEQ ID NO: 634596 - RNA, 22 nt, Human
uacaacaguucaugaaaugaaa

SEQ ID NO: 634597 - RNA, 16 nt, Human
agcagggcgggaagga

SEQ ID NO: 634598 - RNA, 21 nt, Human
agcugcuguggccagaaucca

SEQ ID NO: 634599 - RNA, 22 nt, Human
aguucucauugcaugagacaga

SEQ ID NO: 634600 - RNA, 22 nt, Human
ugucuggcauaguugcucccug

SEQ ID NO: 634601 - RNA, 22 nt, Human
uacagguagagucucuaguuua

SEQ ID NO: 634602 - RNA, 22 nt, Human
ccugucuguucugacuggucag

SEQ ID NO: 634603 - RNA, 22 nt, Human
aaaugucuguaugagaaagaga

SEQ ID NO: 634604 - RNA, 18 nt, Human
aaugcacacauuuacucc

SEQ ID NO: 634605 - RNA, 22 nt, Human
ugggauauaccuauccuagaag

SEQ ID NO: 634606 - RNA, 22 nt, Human
aggcucagugauguaaaauaua

SEQ ID NO: 634607 - RNA, 22 nt, Human
gcacugugcuaaacauguauca

SEQ ID NO: 634608 - RNA, 19 nt, Human
cagaccuguccagccugug

SEQ ID NO: 634609 - RNA, 22 nt, Human
gccuucaggugucccugugggc

SEQ ID NO: 634610 - RNA, 22 nt, Human
agagcaccccgggaagagcaag

SEQ ID NO: 634611 - RNA, 21 nt, Human
ucagcaggcaccagaaggcug

SEQ ID NO: 634612 - RNA, 22 nt, Human
agcugccccucauuuucaccac

SEQ ID NO: 634613 - RNA, 22 nt, Human
caaaugauccuugcaagcugug

SEQ ID NO: 634614 - RNA, 22 nt, Human
agcgggcagaaguggggucugc

SEQ ID NO: 634615 - RNA, 22 nt, Human
uugaaaugagcaaacugucagc

SEQ ID NO: 634616 - RNA, 22 nt, Human
guuuaaagucuuggaaggagga

SEQ ID NO: 634617 - RNA, 22 nt, Human
aaauacuguugaaugaaguaag

SEQ ID NO: 634618 - RNA, 22 nt, Human
uuggagagaggcugcucaggcu

SEQ ID NO: 634619 - RNA, 22 nt, Human
guggcagauugcucaccauggu

SEQ ID NO: 634620 - RNA, 22 nt, Human
cagcaggucccacugagggccc

SEQ ID NO: 634621 - RNA, 22 nt, Human
cugggcucugcaguugauguuu

SEQ ID NO: 634622 - RNA, 22 nt, Human
ucccugccaaugauuggagcaa

SEQ ID NO: 634623 - RNA, 22 nt, Human
uccagagagccacggacagggg

SEQ ID NO: 634624 - RNA, 17 nt, Human
aguguguaacuugugua

SEQ ID NO: 634625 - RNA, 22 nt, Human
cacuggcugggccagcacuccu

SEQ ID NO: 634626 - RNA, 22 nt, Human
agucaggagcugcugcauugua

SEQ ID NO: 634627 - RNA, 22 nt, Human
uucagcaaaauaucucagauag

SEQ ID NO: 634628 - RNA, 22 nt, Human
uggcugccuagugucugagcag

SEQ ID NO: 634629 - RNA, 22 nt, Human
aagugagugaaaaugcagaaua

SEQ ID NO: 634630 - RNA, 22 nt, Human
cuggaggagagucugaaugaca

SEQ ID NO: 634631 - RNA, 22 nt, Human
ucuuuucuucuuaaugguuaau

SEQ ID NO: 634632 - RNA, 22 nt, Human
ucuguuauacagucuguggcac

SEQ ID NO: 634633 - RNA, 22 nt, Human
gggcugagcuguucugaguuua

SEQ ID NO: 634634 - RNA, 22 nt, Human
gucaggaugacaagugcuuuca

SEQ ID NO: 634635 - RNA, 22 nt, Human
uggaaaaacugagacuuagaca

SEQ ID NO: 634636 - RNA, 22 nt, Human
ggcgccgcacucggugcagccg

SEQ ID NO: 634637 - RNA, 22 nt, Human
auguaugagagauucuuuuauu

SEQ ID NO: 634638 - RNA, 22 nt, Human
ugaggcagccugcauuaaagag

SEQ ID NO: 634639 - RNA, 22 nt, Human
gggaguguugagcgcccugcca

SEQ ID NO: 634640 - RNA, 22 nt, Human
uuacuugauagggggauggggu

SEQ ID NO: 634641 - RNA, 22 nt, Human
aaauaucauuuauaacuuuuaa

SEQ ID NO: 634642 - RNA, 22 nt, Human
ucaggaggccugaguagcucua

SEQ ID NO: 634643 - RNA, 22 nt, Human
ugugcuucagguugucgccacg

SEQ ID NO: 634644 - RNA, 22 nt, Human
ugugcucugaagagugcauguc

SEQ ID NO: 634645 - RNA, 22 nt, Human
uuugcugacuggaugcaguugg

SEQ ID NO: 634646 - RNA, 22 nt, Human
cuggcucaauaaauauuagcug

SEQ ID NO: 634647 - RNA, 17 nt, Human
uuccuccucaccauguu

SEQ ID NO: 634648 - RNA, 22 nt, Human
acuguuaugauuuacacagucc

SEQ ID NO: 634649 - RNA, 22 nt, Human
aaauuuuaaggcuggaacuuaa

SEQ ID NO: 634650 - RNA, 22 nt, Human
aagcacagcagagccuugcuug

SEQ ID NO: 634651 - RNA, 22 nt, Human
aaugcauaaugguuugugacaa

SEQ ID NO: 634652 - RNA, 22 nt, Human
agccuggguggggguucggaga

SEQ ID NO: 634653 - RNA, 22 nt, Human
aagaauggugguggggccagca

SEQ ID NO: 634654 - RNA, 20 nt, Human
gucaucgccggcagcaaaga

SEQ ID NO: 634655 - RNA, 22 nt, Human
cacagcuagauggauagauaga

SEQ ID NO: 634656 - RNA, 22 nt, Human
acuuccuggcugggugaccugg

SEQ ID NO: 634657 - RNA, 22 nt, Human
auuguuucugcuuuauuuaggg

SEQ ID NO: 634658 - RNA, 22 nt, Human
acagaaggacuugagaaagaca

SEQ ID NO: 634659 - RNA, 22 nt, Human
uagaggcauuaaugaauaaaca

SEQ ID NO: 634660 - RNA, 23 nt, Human
gggaccugguaggaggugauugg

SEQ ID NO: 634661 - RNA, 22 nt, Human
guacaugugcacaacaugcaug

SEQ ID NO: 634662 - RNA, 23 nt, Human
gccugugccuaugcccagcucug

SEQ ID NO: 634663 - RNA, 22 nt, Human
agucagaggaaugggccaggcu

SEQ ID NO: 634664 - RNA, 22 nt, Human
uaaaugccauucguuucauaca

SEQ ID NO: 634665 - RNA, 22 nt, Human
ucuuuugagggccagaggaaga

SEQ ID NO: 634666 - RNA, 22 nt, Human
ucuaccacuuugaccucucugu

SEQ ID NO: 634667 - RNA, 22 nt, Human
gcuuacaagaucgugcuccagu

SEQ ID NO: 634668 - RNA, 22 nt, Human
cauuccagagcugccucugcua

SEQ ID NO: 634669 - RNA, 22 nt, Human
cacaacuuuaggaaccacauuc

SEQ ID NO: 634670 - RNA, 21 nt, Human
guauucuuuaugaagugaaaa

SEQ ID NO: 634671 - RNA, 21 nt, Human
gcaggcuggucaaaccucagu

SEQ ID NO: 634672 - RNA, 22 nt, Human
agaaccuuucuuuagaaauuca

SEQ ID NO: 634673 - RNA, 21 nt, Human
uuugaauagaaauagugcuua

SEQ ID NO: 634674 - RNA, 22 nt, Human
agagucagcuuaugacacaguc

SEQ ID NO: 634675 - RNA, 22 nt, Human
uuagcauuucauuucaagagga

SEQ ID NO: 634676 - RNA, 22 nt, Human
aggcuccacggcaggaugcugu

SEQ ID NO: 634677 - RNA, 22 nt, Human
ggucagggcuggguaugaagag

SEQ ID NO: 634678 - RNA, 22 nt, Human
auugauuucugcuuacucacug

SEQ ID NO: 634679 - RNA, 22 nt, Human
ucauccaugugcaaacuuuggu

SEQ ID NO: 634680 - RNA, 22 nt, Human
ugacuucucuggccuggugcag

SEQ ID NO: 634681 - RNA, 22 nt, Human
gaggcucccaaggggcuaggcc

SEQ ID NO: 634682 - RNA, 20 nt, Human
ucuguacacucaucuucugc

SEQ ID NO: 634683 - RNA, 22 nt, Human
uucuucaugcuguugcugcuug

SEQ ID NO: 634684 - RNA, 22 nt, Human
agaaucauuauauuuauuaagc

SEQ ID NO: 634685 - RNA, 22 nt, Human
guuaacacaugcaauugcacuu

SEQ ID NO: 634686 - RNA, 22 nt, Human
uggaggccgaauuagagcguug

SEQ ID NO: 634687 - RNA, 22 nt, Human
cucugcccagugcccacaggag

SEQ ID NO: 634688 - RNA, 22 nt, Human
acuuccagaggguguggaaaua

SEQ ID NO: 634689 - RNA, 22 nt, Human
cccuuccuccucgccugucaga

SEQ ID NO: 634690 - RNA, 22 nt, Human
ggcagauggagaagcagcaggu

SEQ ID NO: 634691 - RNA, 22 nt, Human
ugugucuggauagguaauggau

SEQ ID NO: 634692 - RNA, 22 nt, Human
uggaaugccgggccaggcuccg

SEQ ID NO: 634693 - RNA, 22 nt, Human
ggggcugggauuugaacccagg

SEQ ID NO: 634694 - RNA, 17 nt, Human
uccuuggcaaccaguuc

SEQ ID NO: 634695 - RNA, 22 nt, Human
gucuaaacuuuacagagucaag

SEQ ID NO: 634696 - RNA, 22 nt, Human
uuuuuaagcuccuuugauguca

SEQ ID NO: 634697 - RNA, 22 nt, Human
uuauauauauguagaggucacg

SEQ ID NO: 634698 - RNA, 22 nt, Human
aaggccuucucuugugucugug

SEQ ID NO: 634699 - RNA, 22 nt, Human
uaacagcaguccucuucucaug

SEQ ID NO: 634700 - RNA, 22 nt, Human
caugaggugauaaagcugggau

SEQ ID NO: 634701 - RNA, 22 nt, Human
uuucuaguauauaacuagaucu

SEQ ID NO: 634702 - RNA, 22 nt, Human
ggcagcauauauucagugggca

SEQ ID NO: 634703 - RNA, 22 nt, Human
uucucugcagcuccuggcuggg

SEQ ID NO: 634704 - RNA, 22 nt, Human
gcaggcaggaaggacuaaguaa

SEQ ID NO: 634705 - RNA, 22 nt, Human
agcaggugguaggcagucagca

SEQ ID NO: 634706 - RNA, 22 nt, Human
uacuuucuuguuccuuucauaa

SEQ ID NO: 634707 - RNA, 22 nt, Human
cuggguggagccuggucaucug

SEQ ID NO: 634708 - RNA, 22 nt, Human
cagacggguggucugcgaggcc

SEQ ID NO: 634709 - RNA, 22 nt, Human
guggcugcagagccagcaagcu

SEQ ID NO: 634710 - RNA, 22 nt, Human
ucagagcugcccaugcaagggg

SEQ ID NO: 634711 - RNA, 20 nt, Human
uuuauagugaucaauuuaua

SEQ ID NO: 634712 - RNA, 22 nt, Human
ccuuuacacguaaggcuguuga

SEQ ID NO: 634713 - RNA, 22 nt, Human
agcuacaguggacaagugaacu

SEQ ID NO: 634714 - RNA, 23 nt, Human
acuuugcagagccccuugaaaca

SEQ ID NO: 634715 - RNA, 22 nt, Human
agguccagagguugaacggugg

SEQ ID NO: 634716 - RNA, 22 nt, Human
auuaugcuuaggaaaauaugaa

SEQ ID NO: 634717 - RNA, 22 nt, Human
uguccuuuucuuuagugcagcu

SEQ ID NO: 634718 - RNA, 22 nt, Human
gggcucaggucagggcaucagc

SEQ ID NO: 634719 - RNA, 22 nt, Human
gaugguggcaagagccaagucu

SEQ ID NO: 634720 - RNA, 22 nt, Human
aggagcugacuuguaaagcauu

SEQ ID NO: 634721 - RNA, 22 nt, Human
ugucagcaguaucucuaucuca

SEQ ID NO: 634722 - RNA, 22 nt, Human
uuggcuguauguacaucuguua

SEQ ID NO: 634723 - RNA, 22 nt, Human
ucaggagcaacaucuuugaauc

SEQ ID NO: 634724 - RNA, 22 nt, Human
ggccuguggcuuuggcgucuaa

SEQ ID NO: 634725 - RNA, 22 nt, Human
aauacuauguugugacacauga

SEQ ID NO: 634726 - RNA, 22 nt, Human
ucaccaggcaacuauguacucc

SEQ ID NO: 634727 - RNA, 22 nt, Human
augugcuugcagaugagccuca

SEQ ID NO: 634728 - RNA, 22 nt, Human
uagccaggcugcagcugauccg

SEQ ID NO: 634729 - RNA, 22 nt, Human
uccugggaguaauugagucaug

SEQ ID NO: 634730 - RNA, 22 nt, Human
cagccugacaccagcuuugggc

SEQ ID NO: 634731 - RNA, 22 nt, Human
ccagcugcaggggagcagugga

SEQ ID NO: 634732 - RNA, 22 nt, Human
aggauacauguuuuuuaucaau

SEQ ID NO: 634733 - RNA, 22 nt, Human
ugggccaggggccucuucugau

SEQ ID NO: 634734 - RNA, 22 nt, Human
aagugaaauugccauucuuaua

SEQ ID NO: 634735 - RNA, 22 nt, Human
cccagcccaucucaaaggucua

SEQ ID NO: 634736 - RNA, 22 nt, Human
cuccagggcagcauggcagugg

SEQ ID NO: 634737 - RNA, 22 nt, Human
aucuggguagugcaagacauga

SEQ ID NO: 634738 - RNA, 22 nt, Human
agccucagugucaccaucuacc

SEQ ID NO: 634739 - RNA, 20 nt, Human
aaagucuguuuaucucugga

SEQ ID NO: 634740 - RNA, 22 nt, Human
gaaagcaguaaaugggucccau

SEQ ID NO: 634741 - RNA, 22 nt, Human
auacagaaaaguggauagccag

SEQ ID NO: 634742 - RNA, 22 nt, Human
aaggcuggaccuggaugaaucu

SEQ ID NO: 634743 - RNA, 19 nt, Human
gcauuucucuuuacagcca

SEQ ID NO: 634744 - RNA, 22 nt, Human
ugucagcaccauggguagugau

SEQ ID NO: 634745 - RNA, 22 nt, Human
uguuuaagcugaugagguaucg

SEQ ID NO: 634746 - RNA, 22 nt, Human
cuggcagcuucaggacacucgg

SEQ ID NO: 634747 - RNA, 17 nt, Human
aagaacacucaauagca

SEQ ID NO: 634748 - RNA, 22 nt, Human
gcugcugcgcuugucuacuguu

SEQ ID NO: 634749 - RNA, 22 nt, Human
uggaaggaagccaaggaagguu

SEQ ID NO: 634750 - RNA, 22 nt, Human
ccagagcugaggagaugggcuu

SEQ ID NO: 634751 - RNA, 20 nt, Human
aacuuguuuuguuuucuaau

SEQ ID NO: 634752 - RNA, 22 nt, Human
aucugaaauagucuuaucugag

SEQ ID NO: 634753 - RNA, 22 nt, Human
auggcugagaugggcuccaggc

SEQ ID NO: 634754 - RNA, 20 nt, Human
ccuaggcaugcugagucucc

SEQ ID NO: 634755 - RNA, 22 nt, Human
uuaagugcaaaaaugaaaguau

SEQ ID NO: 634756 - RNA, 22 nt, Human
agggccaggcucccaugucagg

SEQ ID NO: 634757 - RNA, 22 nt, Human
ucuuuccuacuuuauugugaac

SEQ ID NO: 634758 - RNA, 22 nt, Human
uccaggcacagaguuggucagu

SEQ ID NO: 634759 - RNA, 22 nt, Human
aggcaggagcaagcccuacaag

SEQ ID NO: 634760 - RNA, 22 nt, Human
cccugcugaaucccauggaguc

SEQ ID NO: 634761 - RNA, 22 nt, Human
aaagggcagaguucacuagaaa

SEQ ID NO: 634762 - RNA, 22 nt, Human
caugcauuuucuauucacucag

SEQ ID NO: 634763 - RNA, 22 nt, Human
cuugcuuggagaagagaucagu

SEQ ID NO: 634764 - RNA, 22 nt, Human
agggccucuaccauccaagguu

SEQ ID NO: 634765 - RNA, 20 nt, Human
ccuggccaaugagauaggaa

SEQ ID NO: 634766 - RNA, 22 nt, Human
caaagcaggaagaauauugaaa

SEQ ID NO: 634767 - RNA, 22 nt, Human
uagcaucuaacaucuuaggacu

SEQ ID NO: 634768 - RNA, 22 nt, Human
uuaggaaaggguuuucuaacag

SEQ ID NO: 634769 - RNA, 22 nt, Human
cuaguucuagaucccugaggaa

SEQ ID NO: 634770 - RNA, 23 nt, Human
cagggcccugcucaauuucucca

SEQ ID NO: 634771 - RNA, 22 nt, Human
uguguagcuuucuucugugggg

SEQ ID NO: 634772 - RNA, 22 nt, Human
gaugaucaucuguaaaguuaga

SEQ ID NO: 634773 - RNA, 22 nt, Human
acagcucuucuucaagccuggc

SEQ ID NO: 634774 - RNA, 22 nt, Human
cugcagcuaaggaaugugguug

SEQ ID NO: 634775 - RNA, 22 nt, Human
uaagauaauaaguaugucuaug

SEQ ID NO: 634776 - RNA, 22 nt, Human
cagggacaaagugagaaaggaa

SEQ ID NO: 634777 - RNA, 21 nt, Human
auguuauucuguuccuccagc

SEQ ID NO: 634778 - RNA, 22 nt, Human
cacuacuugaaagaauuacaga

SEQ ID NO: 634779 - RNA, 22 nt, Human
acacaugcagguauacauguuc

SEQ ID NO: 634780 - RNA, 20 nt, Human
uggccuuggggagcucacac

SEQ ID NO: 634781 - RNA, 22 nt, Human
aucaggaagaucuagcgaaugu

SEQ ID NO: 634782 - RNA, 23 nt, Human
cuggaacauaguagauggucaga

SEQ ID NO: 634783 - RNA, 22 nt, Human
aagcuggcaauuaucaaaacug

SEQ ID NO: 634784 - RNA, 20 nt, Human
ggccuuggccucuuugcagc

SEQ ID NO: 634785 - RNA, 22 nt, Human
aacugcaaaauaaucaaguugu

SEQ ID NO: 634786 - RNA, 22 nt, Human
ggaaaggggccuggaucuuuug

SEQ ID NO: 634787 - RNA, 22 nt, Human
uguagaaaauuggagcauucau

SEQ ID NO: 634788 - RNA, 22 nt, Human
uccaucucaccugcacucugcg

SEQ ID NO: 634789 - RNA, 22 nt, Human
acauacacacauacuuucuccu

SEQ ID NO: 634790 - RNA, 20 nt, Human
uuaagaaaagcacauccugc

SEQ ID NO: 634791 - RNA, 22 nt, Human
ugggccucaccuucuuggcagc

SEQ ID NO: 634792 - RNA, 22 nt, Human
guaaguuuuguauaggcauggg

SEQ ID NO: 634793 - RNA, 22 nt, Human
uuaaagcauccugucagucugu

SEQ ID NO: 634794 - RNA, 22 nt, Human
aaaguucuccuggauugugcug

SEQ ID NO: 634795 - RNA, 22 nt, Human
gcugcgucgagacagccuggca

SEQ ID NO: 634796 - RNA, 22 nt, Human
ucugcugucuaugcaaguccuu

SEQ ID NO: 634797 - RNA, 22 nt, Human
aggcaccugagguggccagccu

SEQ ID NO: 634798 - RNA, 22 nt, Human
acagaauauugguuacuguugc

SEQ ID NO: 634799 - RNA, 22 nt, Human
uaguaaaucucagaaaaagauc

SEQ ID NO: 634800 - RNA, 22 nt, Human
uuuucaccauagacacuggucc

SEQ ID NO: 634801 - RNA, 22 nt, Human
gcugcccucugugacccggccc

SEQ ID NO: 634802 - RNA, 22 nt, Human
ugcucaggucguucugccccuu

SEQ ID NO: 634803 - RNA, 22 nt, Human
cagcugcuuucagcaggaggga

SEQ ID NO: 634804 - RNA, 22 nt, Human
uaauugcuccaaggagaacuaa

SEQ ID NO: 634805 - RNA, 22 nt, Human
aaauaauugaguuggucaauau

SEQ ID NO: 634806 - RNA, 22 nt, Human
cagggcccaagacacaaugagg

SEQ ID NO: 634807 - RNA, 22 nt, Human
uccuccaggcaccucacuggcu

SEQ ID NO: 634808 - RNA, 22 nt, Human
ggaggugcuggcggccagcucu

SEQ ID NO: 634809 - RNA, 23 nt, Human
uugcauagacauccucauagauu

SEQ ID NO: 634810 - RNA, 22 nt, Human
ugaugaggcauaugcuacacau

SEQ ID NO: 634811 - RNA, 22 nt, Human
aucugaggguuugggcaucagc

SEQ ID NO: 634812 - RNA, 22 nt, Human
uucuuucucagugggcagauac

SEQ ID NO: 634813 - RNA, 20 nt, Human
uccaguauguuauuuggugu

SEQ ID NO: 634814 - RNA, 22 nt, Human
auaaggcacacauagauagggu

SEQ ID NO: 634815 - RNA, 22 nt, Human
uaccagcuuccuucaagaugug

SEQ ID NO: 634816 - RNA, 22 nt, Human
ccuguuguuuagcacuuagaac

SEQ ID NO: 634817 - RNA, 22 nt, Human
aaagcaaugcccguucauuauc

SEQ ID NO: 634818 - RNA, 22 nt, Human
agagcugggaccgucuggaagu

SEQ ID NO: 634819 - RNA, 22 nt, Human
accuuuggucauuuacuuuuca

SEQ ID NO: 634820 - RNA, 22 nt, Human
cugugucuugaguaauucggug

SEQ ID NO: 634821 - RNA, 22 nt, Human
gcagaaaccacagugucuuuua

SEQ ID NO: 634822 - RNA, 22 nt, Human
gcugggccuuccgauucucaag

SEQ ID NO: 634823 - RNA, 22 nt, Human
ucacagcugaguuuccauuucu

SEQ ID NO: 634824 - RNA, 22 nt, Human
ucagcagggccuccuugugcag

SEQ ID NO: 634825 - RNA, 22 nt, Human
augccagcuauagacuuguuau

SEQ ID NO: 634826 - RNA, 22 nt, Human
augcaucuaugacuuagacauu

SEQ ID NO: 634827 - RNA, 22 nt, Human
aggcuucaguagggagcauguc

SEQ ID NO: 634828 - RNA, 22 nt, Human
gcaggaagcauagaagaaugcc

SEQ ID NO: 634829 - RNA, 22 nt, Human
cagugccuggccggcuuccauu

SEQ ID NO: 634830 - RNA, 22 nt, Human
gccaguggucacugaggaagaa

SEQ ID NO: 634831 - RNA, 22 nt, Human
cuggagcugggcuaggguagga

SEQ ID NO: 634832 - RNA, 22 nt, Human
uaaaccagguaaagaagcucuc

SEQ ID NO: 634833 - RNA, 22 nt, Human
uaggugucugcucuuauuuaac

SEQ ID NO: 634834 - RNA, 22 nt, Human
uugugcuagaaccaguacagaa

SEQ ID NO: 634835 - RNA, 22 nt, Human
auacaguauuaccuguucagga

SEQ ID NO: 634836 - RNA, 22 nt, Human
gcugaaugaauguauuuuaaaa

SEQ ID NO: 634837 - RNA, 22 nt, Human
uuauggaaaugaaauuuuauug

SEQ ID NO: 634838 - RNA, 22 nt, Human
uguaugaaccuuuaauauagug

SEQ ID NO: 634839 - RNA, 22 nt, Human
uauccugcuuuguuccucuuga

SEQ ID NO: 634840 - RNA, 22 nt, Human
cccaugagaccugguuuaaggc

SEQ ID NO: 634841 - RNA, 22 nt, Human
aaugcugcaagaggugaaaaga

SEQ ID NO: 634842 - RNA, 22 nt, Human
cagacagacagccguggccacc

SEQ ID NO: 634843 - RNA, 20 nt, Human
aaaauauguauaacucuucu

SEQ ID NO: 634844 - RNA, 22 nt, Human
aagcaucuucuaucaguuagac

SEQ ID NO: 634845 - RNA, 19 nt, Human
uguuuacauguuucuucag

SEQ ID NO: 634846 - RNA, 22 nt, Human
cucacuguuuaauagcuggauc

SEQ ID NO: 634847 - RNA, 22 nt, Human
ucagaaagcugauucuugauac

SEQ ID NO: 634848 - RNA, 22 nt, Human
uacaggaaagaaauuugaacuc

SEQ ID NO: 634849 - RNA, 17 nt, Human
cccaggccgccgggagc

SEQ ID NO: 634850 - RNA, 22 nt, Human
cagaugcuuuugauucuggggu

SEQ ID NO: 634851 - RNA, 20 nt, Human
aaaauugcucugcagucccc

SEQ ID NO: 634852 - RNA, 22 nt, Human
auccccuugugggcuggcagca

SEQ ID NO: 634853 - RNA, 22 nt, Human
agcagccaagguaaccugugcu

SEQ ID NO: 634854 - RNA, 22 nt, Human
ggccucucgaagcuucagucca

SEQ ID NO: 634855 - RNA, 22 nt, Human
uguuucuuauccaaguggucug

SEQ ID NO: 634856 - RNA, 22 nt, Human
ccaggucuuguuugacaucaau

SEQ ID NO: 634857 - RNA, 22 nt, Human
aguguagacauaggucuggucu

SEQ ID NO: 634858 - RNA, 22 nt, Human
cgcaggaagacaaggguggaaa

SEQ ID NO: 634859 - RNA, 22 nt, Human
cugugucuguggaauagcgaau

SEQ ID NO: 634860 - RNA, 22 nt, Human
uagcaaggugaaguauggguga

SEQ ID NO: 634861 - RNA, 22 nt, Human
gguggguuuggaagagcaggcu

SEQ ID NO: 634862 - RNA, 22 nt, Human
uagcagcauuuuuguagaguau

SEQ ID NO: 634863 - RNA, 22 nt, Human
uaauaccuugaucucucuuguc

SEQ ID NO: 634864 - RNA, 22 nt, Human
auaccugaucaaggcaaaaaug

SEQ ID NO: 634865 - RNA, 22 nt, Human
uaguuugagaauugaaauagaa

SEQ ID NO: 634866 - RNA, 22 nt, Human
auguuucaccaguuuuauaaga

SEQ ID NO: 634867 - RNA, 22 nt, Human
aaugcuuucuuauaaccacugc

SEQ ID NO: 634868 - RNA, 22 nt, Human
cacuuaagcaguuaauuuaucu

SEQ ID NO: 634869 - RNA, 22 nt, Human
gaggaaaucuuaggccccaacc

SEQ ID NO: 634870 - RNA, 22 nt, Human
uuccuugagaugacugucuugu

SEQ ID NO: 634871 - RNA, 22 nt, Human
gaggccacagucaguguucauc

SEQ ID NO: 634872 - RNA, 22 nt, Human
ugggcugaaaugcuguggacua

SEQ ID NO: 634873 - RNA, 22 nt, Human
cucugccaucuuggagcucaag

SEQ ID NO: 634874 - RNA, 18 nt, Human
cuccagggaacucaguca

SEQ ID NO: 634875 - RNA, 22 nt, Human
ccugaccacccuuggacaaggu

SEQ ID NO: 634876 - RNA, 22 nt, Human
auauuuuggggugaugugcauc

SEQ ID NO: 634877 - RNA, 22 nt, Human
ugccucugccuccauuguuagu

SEQ ID NO: 634878 - RNA, 20 nt, Human
ucuuuguuaauuuuaucucc

SEQ ID NO: 634879 - RNA, 22 nt, Human
ucaggcugagaaaaucuggacc

SEQ ID NO: 634880 - RNA, 22 nt, Human
cuccagauuccugcuggcagaa

SEQ ID NO: 634881 - RNA, 22 nt, Human
gggagaacuggguggagcaucu

SEQ ID NO: 634882 - RNA, 22 nt, Human
gcugaggcggaaggauugcuag

SEQ ID NO: 634883 - RNA, 22 nt, Human
uauguuuaguauccauuuucag

SEQ ID NO: 634884 - RNA, 22 nt, Human
uaacucugcuuguucucugagu

SEQ ID NO: 634885 - RNA, 22 nt, Human
gucaacuuuaagaugaucuuuu

SEQ ID NO: 634886 - RNA, 22 nt, Human
uccaugagggacacuggaugcu

SEQ ID NO: 634887 - RNA, 22 nt, Human
aagccaggcaugcuuggacagu

SEQ ID NO: 634888 - RNA, 22 nt, Human
cucagagguggaugccuugugg

SEQ ID NO: 634889 - RNA, 22 nt, Human
aaaaguacuauuuuaacaaagu

SEQ ID NO: 634890 - RNA, 22 nt, Human
ucauuuggagccuuccuguuuu

SEQ ID NO: 634891 - RNA, 22 nt, Human
aacacugucagccuuugaugga

SEQ ID NO: 634892 - RNA, 22 nt, Human
aacaacagugagugcugggagg

SEQ ID NO: 634893 - RNA, 22 nt, Human
acagaggaagcauauagcacaa

SEQ ID NO: 634894 - RNA, 22 nt, Human
aucucugggcuuugaguuuguu

SEQ ID NO: 634895 - RNA, 22 nt, Human
aacacauaggcagagcaugaca

SEQ ID NO: 634896 - RNA, 22 nt, Human
aacaucagaauauccauguugg

SEQ ID NO: 634897 - RNA, 22 nt, Human
ggacaaaucucauuauuucuga

SEQ ID NO: 634898 - RNA, 22 nt, Human
auuuaagggauuuggagaccaa

SEQ ID NO: 634899 - RNA, 17 nt, Human
ggcaccagacggagagu

SEQ ID NO: 634900 - RNA, 22 nt, Human
ugccaagaccacaauugcuuuu

SEQ ID NO: 634901 - RNA, 22 nt, Human
ccagagaaagcucacaggcagu

SEQ ID NO: 634902 - RNA, 22 nt, Human
uaaaccauucagacugaaccac

SEQ ID NO: 634903 - RNA, 22 nt, Human
agcugccucagucacucauggc

SEQ ID NO: 634904 - RNA, 22 nt, Human
gaagccaguacugugcucugca

SEQ ID NO: 634905 - RNA, 22 nt, Human
ccccagagaaagucagcagcau

SEQ ID NO: 634906 - RNA, 22 nt, Human
uuacagaaugugccauuugguc

SEQ ID NO: 634907 - RNA, 22 nt, Human
gagagugaugaaugguuaaaca

SEQ ID NO: 634908 - RNA, 22 nt, Human
uucccacacuccauauaauuca

SEQ ID NO: 634909 - RNA, 20 nt, Human
aucaaaauccuauugagguu

SEQ ID NO: 634910 - RNA, 22 nt, Human
ugcucuguaaggucagaaaagg

SEQ ID NO: 634911 - RNA, 22 nt, Human
ucaggccaagguagacaugacu

SEQ ID NO: 634912 - RNA, 22 nt, Human
cuccuguauguugggcuucaca

SEQ ID NO: 634913 - RNA, 22 nt, Human
aagagaggacauggugaaccug

SEQ ID NO: 634914 - RNA, 22 nt, Human
uuauauaucuugauuuguucca

SEQ ID NO: 634915 - RNA, 22 nt, Human
augcuuccccucucauuucagc

SEQ ID NO: 634916 - RNA, 22 nt, Human
uuuuggucagguuggucucgaa

SEQ ID NO: 634917 - RNA, 22 nt, Human
auucuggacaaggcaagcuccu

SEQ ID NO: 634918 - RNA, 22 nt, Human
gagccagguuggaggcugcagu

SEQ ID NO: 634919 - RNA, 22 nt, Human
gagacacaagaagacaugcaca

SEQ ID NO: 634920 - RNA, 22 nt, Human
agccagaaaaacaccaagagga

SEQ ID NO: 634921 - RNA, 22 nt, Human
cccagcagugacccagugauac

SEQ ID NO: 634922 - RNA, 22 nt, Human
uuggcagauggauucaacauua

SEQ ID NO: 634923 - RNA, 22 nt, Human
aggccauguggccccagagucu

SEQ ID NO: 634924 - RNA, 23 nt, Human
ucugucuuguuuaggccacuguu

SEQ ID NO: 634925 - RNA, 22 nt, Human
aauuacaaauguagacucucau

SEQ ID NO: 634926 - RNA, 22 nt, Human
uggcccgaccucugcucaugca

SEQ ID NO: 634927 - RNA, 22 nt, Human
cuguguuccccugcugcugagg

SEQ ID NO: 634928 - RNA, 22 nt, Human
aggaucagugaauacucagggu

SEQ ID NO: 634929 - RNA, 20 nt, Human
agccugccagcuggcccaga

SEQ ID NO: 634930 - RNA, 23 nt, Human
aggcuccacaugggcacuuugca

SEQ ID NO: 634931 - RNA, 22 nt, Human
agcagggcccacuaggggagau

SEQ ID NO: 634932 - RNA, 22 nt, Human
cuucuuccugcugcagccucca

SEQ ID NO: 634933 - RNA, 22 nt, Human
ucucuggggauggaccugggag

SEQ ID NO: 634934 - RNA, 22 nt, Human
aauaaaaugaacugguagaguu

SEQ ID NO: 634935 - RNA, 22 nt, Human
ucagaggagcaaaagaggggau

SEQ ID NO: 634936 - RNA, 22 nt, Human
ucucagagggaaacaugaguga

SEQ ID NO: 634937 - RNA, 22 nt, Human
gagaggcugguaaagucugaac

SEQ ID NO: 634938 - RNA, 22 nt, Human
uggaggaugagugugggcucug

SEQ ID NO: 634939 - RNA, 22 nt, Human
aagggagaaaacuuguggcuua

SEQ ID NO: 634940 - RNA, 22 nt, Human
aaagcagggaugaggcuagagg

SEQ ID NO: 634941 - RNA, 22 nt, Human
guuauuguccagcacaguuggg

SEQ ID NO: 634942 - RNA, 22 nt, Human
caggggcuguuugccucaggcc

SEQ ID NO: 634943 - RNA, 22 nt, Human
auuuccaaaaccacuuauugcc

SEQ ID NO: 634944 - RNA, 22 nt, Human
uccucaggugacuagguaucuu

SEQ ID NO: 634945 - RNA, 22 nt, Human
ggagccagagcacuggggagcc

SEQ ID NO: 634946 - RNA, 22 nt, Human
aacagcuugagacuggauaugc

SEQ ID NO: 634947 - RNA, 18 nt, Human
cuaucccuggagcuuggg

SEQ ID NO: 634948 - RNA, 22 nt, Human
ucaaggugcugugcugugcuag

SEQ ID NO: 634949 - RNA, 18 nt, Human
gggagcugggaagcuggu

SEQ ID NO: 634950 - RNA, 22 nt, Human
ccugggucaccaggcccaggca

SEQ ID NO: 634951 - RNA, 22 nt, Human
ugauugacuuuagaauagcacu

SEQ ID NO: 634952 - RNA, 22 nt, Human
ucaauacuuaagcuuaauucua

SEQ ID NO: 634953 - RNA, 22 nt, Human
gacacuucaccuuucccagccu

SEQ ID NO: 634954 - RNA, 22 nt, Human
agcccuggauucugagguccaa

SEQ ID NO: 634955 - RNA, 22 nt, Human
ccuuagcauuagaagcuguggg

SEQ ID NO: 634956 - RNA, 22 nt, Human
ggaacauuuuuuaaggcagaaa

SEQ ID NO: 634957 - RNA, 22 nt, Human
cccagcacuuugaauaugucac

SEQ ID NO: 634958 - RNA, 22 nt, Human
ggucagcucuuugggcuggugg

SEQ ID NO: 634959 - RNA, 21 nt, Human
agugucauuugaucauuguua

SEQ ID NO: 634960 - RNA, 22 nt, Human
agugaccaacaaugcugagaag

SEQ ID NO: 634961 - RNA, 22 nt, Human
uugacaauugggagauauaaag

SEQ ID NO: 634962 - RNA, 22 nt, Human
ccaaauuaaaucauacagacag

SEQ ID NO: 634963 - RNA, 22 nt, Human
gagggcucugucuggaagggaa

SEQ ID NO: 634964 - RNA, 22 nt, Human
auuguaaauagugccacaauaa

SEQ ID NO: 634965 - RNA, 20 nt, Human
uucagagucagcaaaugcag

SEQ ID NO: 634966 - RNA, 22 nt, Human
gcagaaguuaaucgaaggccau

SEQ ID NO: 634967 - RNA, 22 nt, Human
aucuugcugcuacaaagugccc

SEQ ID NO: 634968 - RNA, 23 nt, Human
ccagcucccaggucugaggacug

SEQ ID NO: 634969 - RNA, 22 nt, Human
ccaggcucuaucccuccuucuu

SEQ ID NO: 634970 - RNA, 22 nt, Human
aagacacuggguuaggcacgug

SEQ ID NO: 634971 - RNA, 22 nt, Human
uucucuauguguguuguaguuu

SEQ ID NO: 634972 - RNA, 22 nt, Human
agugcuccuuucauugcugccc

SEQ ID NO: 634973 - RNA, 22 nt, Human
gcugaagcugcagcaggaggaa

SEQ ID NO: 634974 - RNA, 22 nt, Human
ucacaaaucauuuuaucugugu

SEQ ID NO: 634975 - RNA, 22 nt, Human
cucuuauuccuacaguaacagg

SEQ ID NO: 634976 - RNA, 22 nt, Human
cacaauacuauuuuuaggucuu

SEQ ID NO: 634977 - RNA, 22 nt, Human
agacaacaccaaaugcuagugu

SEQ ID NO: 634978 - RNA, 22 nt, Human
ucagagaacuccacaccuuagg

SEQ ID NO: 634979 - RNA, 22 nt, Human
aaggaccugauuuugagcaucu

SEQ ID NO: 634980 - RNA, 22 nt, Human
uggggaccagauuagaccaugg

SEQ ID NO: 634981 - RNA, 22 nt, Human
gaucacaugaguuaucuaacuu

SEQ ID NO: 634982 - RNA, 22 nt, Human
acucuggcuugaggaccagguc

SEQ ID NO: 634983 - RNA, 22 nt, Human
uccuggagcugacuccguuuga

SEQ ID NO: 634984 - RNA, 22 nt, Human
cugaggugcuagggucccugcu

SEQ ID NO: 634985 - RNA, 22 nt, Human
cugaggcugggcauggggucca

SEQ ID NO: 634986 - RNA, 22 nt, Human
acaggaagaaagugcaguagau

SEQ ID NO: 634987 - RNA, 22 nt, Human
gcugcugucagugguggcaguu

SEQ ID NO: 634988 - RNA, 22 nt, Human
cuggccagcugacagcagggcu

SEQ ID NO: 634989 - RNA, 19 nt, Human
acugagaccacagacaagu

SEQ ID NO: 634990 - RNA, 20 nt, Human
uucgcugggaguggccaggc

SEQ ID NO: 634991 - RNA, 22 nt, Human
uuauuuauggcacuguuggugg

SEQ ID NO: 634992 - RNA, 19 nt, Human
uuccaggugcuguggggag

SEQ ID NO: 634993 - RNA, 22 nt, Human
guuggccauuaauuggaggaca

SEQ ID NO: 634994 - RNA, 22 nt, Human
uaaaugcaagugcuccugggag

SEQ ID NO: 634995 - RNA, 22 nt, Human
cucugggucuaccuguggccag

SEQ ID NO: 634996 - RNA, 22 nt, Human
cugcucugugguccaugagaca

SEQ ID NO: 634997 - RNA, 22 nt, Human
aaagguuuauugcuaugguugu

SEQ ID NO: 634998 - RNA, 22 nt, Human
gaaccuguccugagugaggagu

SEQ ID NO: 634999 - RNA, 22 nt, Human
gcgcaagccacacagccugggg

SEQ ID NO: 635000 - RNA, 22 nt, Human
uacaguaagaugaaauagcaau

SEQ ID NO: 635001 - RNA, 20 nt, Human
gcuucauuugcaagucuagu

SEQ ID NO: 635002 - RNA, 22 nt, Human
caguccugggagacuuacccag

SEQ ID NO: 635003 - RNA, 19 nt, Human
aaagaucugggauugagac

SEQ ID NO: 635004 - RNA, 22 nt, Human
augcuaaacuaugaucauuuuc

SEQ ID NO: 635005 - RNA, 22 nt, Human
uuugacagcuuguuacaaaguu

SEQ ID NO: 635006 - RNA, 22 nt, Human
ugguuuauuucucugaaagguu

SEQ ID NO: 635007 - RNA, 22 nt, Human
gccugcucuggaauccauguaa

SEQ ID NO: 635008 - RNA, 22 nt, Human
gaagaacaagcagugcuuuccu

SEQ ID NO: 635009 - RNA, 22 nt, Human
gaauagauauccuugagggucu

SEQ ID NO: 635010 - RNA, 22 nt, Human
uauuucaacguaugaaaagcug

SEQ ID NO: 635011 - RNA, 22 nt, Human
aggagcuggaaugguccuuuug

SEQ ID NO: 635012 - RNA, 22 nt, Human
cuuccagguccuucuugagaag

SEQ ID NO: 635013 - RNA, 22 nt, Human
uucagauaagucaaguuaguau

SEQ ID NO: 635014 - RNA, 22 nt, Human
agagaucccuucugccugggga

SEQ ID NO: 635015 - RNA, 22 nt, Human
cccucccagaugggcuugaggu

SEQ ID NO: 635016 - RNA, 22 nt, Human
agaggcuguuacacucccagau

SEQ ID NO: 635017 - RNA, 22 nt, Human
uuucacagguacaaacacuccu

SEQ ID NO: 635018 - RNA, 22 nt, Human
cagacauggcgccaagugcuag

SEQ ID NO: 635019 - RNA, 22 nt, Human
uuguacaacacauauucuacag

SEQ ID NO: 635020 - RNA, 22 nt, Human
uaacugauauugaaaaacauca

SEQ ID NO: 635021 - RNA, 22 nt, Human
uagcuuuagugaaaaauaucag

SEQ ID NO: 635022 - RNA, 22 nt, Human
ccacccuggacaggccucugag

SEQ ID NO: 635023 - RNA, 23 nt, Human
ucccugggcccgugccagcggug

SEQ ID NO: 635024 - RNA, 22 nt, Human
caauuaaagaagaccugccuca

SEQ ID NO: 635025 - RNA, 22 nt, Human
uuagcuuuagagccauuacugg

SEQ ID NO: 635026 - RNA, 22 nt, Human
aagccaaaggcuccagugaccu

SEQ ID NO: 635027 - RNA, 22 nt, Human
aaacauguagugcaugaggauc

SEQ ID NO: 635028 - RNA, 22 nt, Human
cugcacauguucaucaugacaa

SEQ ID NO: 635029 - RNA, 19 nt, Human
agaaggcuccuguuggaga

SEQ ID NO: 635030 - RNA, 20 nt, Human
agcuaggagaaagcauggag

SEQ ID NO: 635031 - RNA, 22 nt, Human
uguguacaaacuaacaacauau

SEQ ID NO: 635032 - RNA, 22 nt, Human
gcccacaguguagcagguacuc

SEQ ID NO: 635033 - RNA, 22 nt, Human
agcuccaggauaagacaggugc

SEQ ID NO: 635034 - RNA, 22 nt, Human
caggcccaucugcucccaggcu

SEQ ID NO: 635035 - RNA, 15 nt, Human
ggugucugcagugug

SEQ ID NO: 635036 - RNA, 22 nt, Human
agugugucugaucacuugugag

SEQ ID NO: 635037 - RNA, 18 nt, Human
cucucuggucuggauccc

SEQ ID NO: 635038 - RNA, 22 nt, Human
uguggaagaaacaagacacuuu

SEQ ID NO: 635039 - RNA, 22 nt, Human
ccugggaagagcugacaggagg

SEQ ID NO: 635040 - RNA, 23 nt, Human
acucucagguucuuuccagcagg

SEQ ID NO: 635041 - RNA, 23 nt, Human
cuuuccuuucuuugacacccagc

SEQ ID NO: 635042 - RNA, 22 nt, Human
acuagcagggauauuauauaag

SEQ ID NO: 635043 - RNA, 22 nt, Human
guuccacaaaauguacccaguu

SEQ ID NO: 635044 - RNA, 22 nt, Human
auccuaaagcagacagcagguu

SEQ ID NO: 635045 - RNA, 22 nt, Human
augaccagccgagauaaacaga

SEQ ID NO: 635046 - RNA, 22 nt, Human
auguuaccaucuuuuaucuaca

SEQ ID NO: 635047 - RNA, 22 nt, Human
ugaaugaugcauuuguuuccca

SEQ ID NO: 635048 - RNA, 22 nt, Human
auguaggauugagugauagagg

SEQ ID NO: 635049 - RNA, 22 nt, Human
auaguuccagcaucuuugguaa

SEQ ID NO: 635050 - RNA, 22 nt, Human
guucugggucuggacacacaga

SEQ ID NO: 635051 - RNA, 19 nt, Human
uuugaaagaguuuuauugg

SEQ ID NO: 635052 - RNA, 21 nt, Human
caccuuauagauaaaauuaga

SEQ ID NO: 635053 - RNA, 22 nt, Human
gcaccaggaggcccuucucauc

SEQ ID NO: 635054 - RNA, 19 nt, Human
cccuggcaggcaagccugg

SEQ ID NO: 635055 - RNA, 22 nt, Human
gagcaggucuuucauggugcau

SEQ ID NO: 635056 - RNA, 19 nt, Human
acaauaacucauugauugc

SEQ ID NO: 635057 - RNA, 22 nt, Human
agcucagagauaaucaagagac

SEQ ID NO: 635058 - RNA, 22 nt, Human
agccuucacugggaccuuggau

SEQ ID NO: 635059 - RNA, 22 nt, Human
caggucugcagacagggccaug

SEQ ID NO: 635060 - RNA, 22 nt, Human
caauagaaaacucaauacuuaa

SEQ ID NO: 635061 - RNA, 23 nt, Human
uggaaacuuaagggggagauguc

SEQ ID NO: 635062 - RNA, 22 nt, Human
ugaguuaucuaaaauagucaaa

SEQ ID NO: 635063 - RNA, 22 nt, Human
gcuagcagaaagcaggcugcuc

SEQ ID NO: 635064 - RNA, 22 nt, Human
uagauuucuaacagugugcuug

SEQ ID NO: 635065 - RNA, 23 nt, Human
uugauucuuucagggaccuagau

SEQ ID NO: 635066 - RNA, 22 nt, Human
ugaagcaacuggacaaguuggc

SEQ ID NO: 635067 - RNA, 22 nt, Human
cccuuccuggaguacccucugu

SEQ ID NO: 635068 - RNA, 22 nt, Human
uuccuuaguguuagauucugug

SEQ ID NO: 635069 - RNA, 22 nt, Human
agccccugggaguagcugcugc

SEQ ID NO: 635070 - RNA, 22 nt, Human
uuucuccuccagagagacacag

SEQ ID NO: 635071 - RNA, 22 nt, Human
gagcagagacaguacaacuggc

SEQ ID NO: 635072 - RNA, 23 nt, Human
uuuggcuccauggguggcucauu

SEQ ID NO: 635073 - RNA, 22 nt, Human
aaagugcuaaauaagcccugaa

SEQ ID NO: 635074 - RNA, 22 nt, Human
agccuccaucucccaucuguga

SEQ ID NO: 635075 - RNA, 22 nt, Human
cuuuccaagaaugcagauaccu

SEQ ID NO: 635076 - RNA, 22 nt, Human
cucugcugucucagaugggcca

SEQ ID NO: 635077 - RNA, 22 nt, Human
ggugacagugguuaaaauuugu

SEQ ID NO: 635078 - RNA, 22 nt, Human
aguguuaagagaaaauucugcu

SEQ ID NO: 635079 - RNA, 22 nt, Human
cgaggccacaccugcuucuggg

SEQ ID NO: 635080 - RNA, 22 nt, Human
gagccagacugccugaagcuca

SEQ ID NO: 635081 - RNA, 22 nt, Human
ugaggcuggaugggaugccucc

SEQ ID NO: 635082 - RNA, 22 nt, Human
ggcucugcuucucaccuguucc

SEQ ID NO: 635083 - RNA, 22 nt, Human
uagaaagcguuaaaucuacaga

SEQ ID NO: 635084 - RNA, 22 nt, Human
aggcuuuaauuaucuacaggag

SEQ ID NO: 635085 - RNA, 22 nt, Human
ucugccaucaagaugcucuggc

SEQ ID NO: 635086 - RNA, 22 nt, Human
acagcaggaagcuggagggaaa

SEQ ID NO: 635087 - RNA, 20 nt, Human
aauuagcuuaagucaaucag

SEQ ID NO: 635088 - RNA, 22 nt, Human
uggagagcgugcuuagcacucu

SEQ ID NO: 635089 - RNA, 22 nt, Human
ggcacagcaccuuuucacauug

SEQ ID NO: 635090 - RNA, 22 nt, Human
accugagggagauuaggccuga

SEQ ID NO: 635091 - RNA, 22 nt, Human
ccacugccucuccagggccauc

SEQ ID NO: 635092 - RNA, 22 nt, Human
gaccaggaaagagugugacuaa

SEQ ID NO: 635093 - RNA, 22 nt, Human
cuggagaagcauucaaauaauu

SEQ ID NO: 635094 - RNA, 22 nt, Human
aaccagcacugcuggggccugc

SEQ ID NO: 635095 - RNA, 18 nt, Human
uuggaggauguccaugaa

SEQ ID NO: 635096 - RNA, 22 nt, Human
ugcuggagaugaaagggcccug

SEQ ID NO: 635097 - RNA, 22 nt, Human
cagagggcucggcggccgcucc

SEQ ID NO: 635098 - RNA, 22 nt, Human
aacaguacaacuccacaagacu

SEQ ID NO: 635099 - RNA, 22 nt, Human
guggugagauugcuggaucaaa

SEQ ID NO: 635100 - RNA, 22 nt, Human
gaacauuugaugaugacauugg

SEQ ID NO: 635101 - RNA, 22 nt, Human
guuaauacaaccaugaucuucu

SEQ ID NO: 635102 - RNA, 22 nt, Human
uuguuuaauaucgugaaguacu

SEQ ID NO: 635103 - RNA, 22 nt, Human
guacaaauguacacuuguauaa

SEQ ID NO: 635104 - RNA, 22 nt, Human
aacacagaguauuugaagcauu

SEQ ID NO: 635105 - RNA, 22 nt, Human
aauuucacagugaacuuugagg

SEQ ID NO: 635106 - RNA, 22 nt, Human
uauauuaacacccacuugccuc

SEQ ID NO: 635107 - RNA, 22 nt, Human
cugggacacccaaggaaagagc

SEQ ID NO: 635108 - RNA, 22 nt, Human
uugagcaggauggcuaugcaca

SEQ ID NO: 635109 - RNA, 22 nt, Human
ugauuucuuccuugucauuaga

SEQ ID NO: 635110 - RNA, 19 nt, Human
acagugcaugggaccuggu

SEQ ID NO: 635111 - RNA, 22 nt, Human
agaaguuauccaccuuagaugc

SEQ ID NO: 635112 - RNA, 22 nt, Human
ccaccuccuaggccuggagaag

SEQ ID NO: 635113 - RNA, 22 nt, Human
auccucugaccgcugcagggag

SEQ ID NO: 635114 - RNA, 22 nt, Human
ucuggagaggaggauguggaca

SEQ ID NO: 635115 - RNA, 22 nt, Human
gauagcaacauagaacagaauu

SEQ ID NO: 635116 - RNA, 22 nt, Human
aaauaguccugggaauaguacu

SEQ ID NO: 635117 - RNA, 22 nt, Human
agugcaggccccaggccaggcc

SEQ ID NO: 635118 - RNA, 22 nt, Human
ugcugcauuugcaguccuuuaa

SEQ ID NO: 635119 - RNA, 22 nt, Human
cagucugaacacugggcuacuc

SEQ ID NO: 635120 - RNA, 23 nt, Human
aacacuugcaugaacagcuacac

SEQ ID NO: 635121 - RNA, 22 nt, Human
cucuggaggccguuggcccuua

SEQ ID NO: 635122 - RNA, 22 nt, Human
caggaaugaucugcugagugau

SEQ ID NO: 635123 - RNA, 22 nt, Human
ggcuguguccccaccugagcag

SEQ ID NO: 635124 - RNA, 22 nt, Human
agcaacuguuacaagaacaaca

SEQ ID NO: 635125 - RNA, 22 nt, Human
gcaggcagguggcaucuuguga

SEQ ID NO: 635126 - RNA, 23 nt, Human
gaggccacauuccccugcuugag

SEQ ID NO: 635127 - RNA, 22 nt, Human
uccagcucuuguugcccacugc

SEQ ID NO: 635128 - RNA, 22 nt, Human
auaugugugugugagaaaagcu

SEQ ID NO: 635129 - RNA, 22 nt, Human
aggaagagcaucuuugggucug

SEQ ID NO: 635130 - RNA, 22 nt, Human
cauucccacguguucuuugcuu

SEQ ID NO: 635131 - RNA, 22 nt, Human
acuaagaccuagauacuagggg

SEQ ID NO: 635132 - RNA, 22 nt, Human
auucacaaguucuagggauuag

SEQ ID NO: 635133 - RNA, 22 nt, Human
cuguagccagaagcagaaggcc

SEQ ID NO: 635134 - RNA, 22 nt, Human
uuuagacauggcuugcucacuu

SEQ ID NO: 635135 - RNA, 22 nt, Human
augugaaauagcuggauaugaa

SEQ ID NO: 635136 - RNA, 22 nt, Human
ucucugggagcaauuguuugcu

SEQ ID NO: 635137 - RNA, 22 nt, Human
cuuucccuuagccccauucuau

SEQ ID NO: 635138 - RNA, 22 nt, Human
auucagcugacuuugauucauu

SEQ ID NO: 635139 - RNA, 22 nt, Human
auauucuuauccuuuucucugu

SEQ ID NO: 635140 - RNA, 22 nt, Human
aaaccucugugcuaugacaccc

SEQ ID NO: 635141 - RNA, 22 nt, Human
guuaacuugguagucuaagugu

SEQ ID NO: 635142 - RNA, 22 nt, Human
gcaggcaccacggcucaggucu

SEQ ID NO: 635143 - RNA, 22 nt, Human
cagcccagugcacgcccguuuc

SEQ ID NO: 635144 - RNA, 22 nt, Human
ccuugagccagggagcuggcag

SEQ ID NO: 635145 - RNA, 22 nt, Human
ugcagcaccuauggacacuugu

SEQ ID NO: 635146 - RNA, 22 nt, Human
aucaguuuauacuuauaaaucu

SEQ ID NO: 635147 - RNA, 22 nt, Human
ucuccagguucagucgauggaa

SEQ ID NO: 635148 - RNA, 22 nt, Human
aguuuccucaucuguaaaauga

SEQ ID NO: 635149 - RNA, 22 nt, Human
uuucaguucaucugugaagauu

SEQ ID NO: 635150 - RNA, 20 nt, Human
aggcuguugacggcugccuc

SEQ ID NO: 635151 - RNA, 22 nt, Human
guggaaaugcccccaaauagug

SEQ ID NO: 635152 - RNA, 22 nt, Human
caguuauaagacuaagcuauuc

SEQ ID NO: 635153 - RNA, 22 nt, Human
aggggagccccugguccuggug

SEQ ID NO: 635154 - RNA, 22 nt, Human
agugugaguaauucagggaggg

SEQ ID NO: 635155 - RNA, 22 nt, Human
cgggguggcacucuaaauagaa

SEQ ID NO: 635156 - RNA, 22 nt, Human
auuacaacaagaaaaggguaag

SEQ ID NO: 635157 - RNA, 22 nt, Human
cucagugcugaggaaaguugaa

SEQ ID NO: 635158 - RNA, 22 nt, Human
guuugauuugauccggagagau

SEQ ID NO: 635159 - RNA, 22 nt, Human
acauccacuauccuugcuuguu

SEQ ID NO: 635160 - RNA, 19 nt, Human
acagugcuucugagugagg

SEQ ID NO: 635161 - RNA, 19 nt, Human
agguuucuaacuauucaag

SEQ ID NO: 635162 - RNA, 22 nt, Human
acaguuaucuuugaaauagaga

SEQ ID NO: 635163 - RNA, 22 nt, Human
ugggcccaagagagucuccaac

SEQ ID NO: 635164 - RNA, 22 nt, Human
auugauucucauaggaccaucu

SEQ ID NO: 635165 - RNA, 20 nt, Human
uuauaucauaaugugccaau

SEQ ID NO: 635166 - RNA, 22 nt, Human
gaagcacauggcuauagcuauu

SEQ ID NO: 635167 - RNA, 22 nt, Human
uaauguuuagaagcagacagcu

SEQ ID NO: 635168 - RNA, 22 nt, Human
aaaggccagguuggcugguauu

SEQ ID NO: 635169 - RNA, 22 nt, Human
cuccuggaugcaggcugucugc

SEQ ID NO: 635170 - RNA, 23 nt, Human
acuuccaguuauaggaacucuuc

SEQ ID NO: 635171 - RNA, 22 nt, Human
cuuccucuauguucagguagaa

SEQ ID NO: 635172 - RNA, 20 nt, Human
aaguauauguccguguacuu

SEQ ID NO: 635173 - RNA, 22 nt, Human
cagcacaggaauaugguggaca

SEQ ID NO: 635174 - RNA, 22 nt, Human
cugagcucaagugaucugccca

SEQ ID NO: 635175 - RNA, 22 nt, Human
acacacugcucgcucagauuaa

SEQ ID NO: 635176 - RNA, 22 nt, Human
auaaaguagcuuucagugccaa

SEQ ID NO: 635177 - RNA, 22 nt, Human
gcccuguggacccaggaacucu

SEQ ID NO: 635178 - RNA, 22 nt, Human
cugaggccucucuccugggcuu

SEQ ID NO: 635179 - RNA, 22 nt, Human
auguuaugucugggaaggggua

SEQ ID NO: 635180 - RNA, 21 nt, Human
cagaggcagguccugggacgg

SEQ ID NO: 635181 - RNA, 22 nt, Human
uuggaagggaacaccauuugac

SEQ ID NO: 635182 - RNA, 22 nt, Human
guuagggaagcgcuguguucuu

SEQ ID NO: 635183 - RNA, 22 nt, Human
uuaaggaaagccaaaaugaauu

SEQ ID NO: 635184 - RNA, 22 nt, Human
cuguccuguggaccugaggacg

SEQ ID NO: 635185 - RNA, 22 nt, Human
agucuccacaacagcccugaua

SEQ ID NO: 635186 - RNA, 22 nt, Human
uugauacaugcucuagaguuga

SEQ ID NO: 635187 - RNA, 22 nt, Human
ucaagucauuugacuguguguu

SEQ ID NO: 635188 - RNA, 22 nt, Human
uguugggaucgaaugguggaac

SEQ ID NO: 635189 - RNA, 22 nt, Human
aguguguguuugggcgguuuau

SEQ ID NO: 635190 - RNA, 22 nt, Human
gcccucuguuauugcauccuua

SEQ ID NO: 635191 - RNA, 22 nt, Human
auguagaaauuaggaugauagu

SEQ ID NO: 635192 - RNA, 22 nt, Human
ggucaggguuccagguaucuuc

SEQ ID NO: 635193 - RNA, 22 nt, Human
cauccugaaagaaacauuuccu

SEQ ID NO: 635194 - RNA, 22 nt, Human
agaggccucuagggccccucag

SEQ ID NO: 635195 - RNA, 22 nt, Human
gucauauuggcuccacuuccuc

SEQ ID NO: 635196 - RNA, 22 nt, Human
acagcagaccacuacuaguagg

SEQ ID NO: 635197 - RNA, 22 nt, Human
acuguaacacucauacugaagu

SEQ ID NO: 635198 - RNA, 22 nt, Human
uaguuuaugcugcugcagugag

SEQ ID NO: 635199 - RNA, 22 nt, Human
guuagggagucagguggcucuu

SEQ ID NO: 635200 - RNA, 22 nt, Human
cugggccuuaugaguaccugga

SEQ ID NO: 635201 - RNA, 22 nt, Human
gguucacagguccugggagcag

SEQ ID NO: 635202 - RNA, 22 nt, Human
gccagcagcugugggguggcca

SEQ ID NO: 635203 - RNA, 22 nt, Human
aagugcauaauaacucccaagu

SEQ ID NO: 635204 - RNA, 22 nt, Human
agugugggggcuuuggugucac

SEQ ID NO: 635205 - RNA, 23 nt, Human
agggagcuaaaaggcuggagcag

SEQ ID NO: 635206 - RNA, 22 nt, Human
uuauguacucugcaauguuuga

SEQ ID NO: 635207 - RNA, 22 nt, Human
aaagccagaguguguuagagac

SEQ ID NO: 635208 - RNA, 22 nt, Human
uguuuaauuucacaaaguugac

SEQ ID NO: 635209 - RNA, 19 nt, Human
ggccuuucaccuggaugcu

SEQ ID NO: 635210 - RNA, 22 nt, Human
ucacugcuucuuggagaauguc

SEQ ID NO: 635211 - RNA, 22 nt, Human
aacuacaggggguggcaggcgg

SEQ ID NO: 635212 - RNA, 22 nt, Human
ggugagugucaaugguuagagu

SEQ ID NO: 635213 - RNA, 22 nt, Human
gcagacacuuuuauucugcaua

SEQ ID NO: 635214 - RNA, 22 nt, Human
ugagccagucucucagaacccu

SEQ ID NO: 635215 - RNA, 19 nt, Human
uguggucucuguucucagg

SEQ ID NO: 635216 - RNA, 22 nt, Human
aaguaaaacacacaguccaccg

SEQ ID NO: 635217 - RNA, 22 nt, Human
cugcccccaggcugcauggcug

SEQ ID NO: 635218 - RNA, 22 nt, Human
aucucguuuugagaacuguguu

SEQ ID NO: 635219 - RNA, 22 nt, Human
ggcuauggcaaagaacucagau

SEQ ID NO: 635220 - RNA, 22 nt, Human
ucagaggacgcacuaggguugu

SEQ ID NO: 635221 - RNA, 22 nt, Human
aucagcaagauguaauuucuau

SEQ ID NO: 635222 - RNA, 22 nt, Human
aaauguccugagauucaacuua

SEQ ID NO: 635223 - RNA, 22 nt, Human
aauuuggcagugucuugaagua

SEQ ID NO: 635224 - RNA, 22 nt, Human
aauuccuuuggaucuucuggag

SEQ ID NO: 635225 - RNA, 22 nt, Human
cugugcugagugaugugacuua

SEQ ID NO: 635226 - RNA, 19 nt, Human
ugguccagcuucuucuccu

SEQ ID NO: 635227 - RNA, 22 nt, Human
augcaacaauguauuuauguau

SEQ ID NO: 635228 - RNA, 18 nt, Human
ggacacagauagguacag

SEQ ID NO: 635229 - RNA, 22 nt, Human
uuuaccacagaaaaaaguaacu

SEQ ID NO: 635230 - RNA, 22 nt, Human
cacaaugugguuugucaucuuu

SEQ ID NO: 635231 - RNA, 22 nt, Human
caguuucuguuuuaaauagcag

SEQ ID NO: 635232 - RNA, 22 nt, Human
uaaaugcuuagauucauagaaa

SEQ ID NO: 635233 - RNA, 22 nt, Human
ggagagcaggguccugagauac

SEQ ID NO: 635234 - RNA, 16 nt, Human
ucaguguuccagaaua

SEQ ID NO: 635235 - RNA, 22 nt, Human
uuuacagcauugcugaaaguuc

SEQ ID NO: 635236 - RNA, 22 nt, Human
uugcaagauguuaccauuguua

SEQ ID NO: 635237 - RNA, 22 nt, Human
uagaggugagaggaacuuugga

SEQ ID NO: 635238 - RNA, 22 nt, Human
ccaggcaggcgauggugcagug

SEQ ID NO: 635239 - RNA, 22 nt, Human
aagcgcagacacagagagugga

SEQ ID NO: 635240 - RNA, 19 nt, Human
uagacuuuuccagcaggca

SEQ ID NO: 635241 - RNA, 22 nt, Human
auguaguuuggggcuagauuua

SEQ ID NO: 635242 - RNA, 22 nt, Human
accacuuaucaucacuaucuca

SEQ ID NO: 635243 - RNA, 22 nt, Human
cuugaaagucacaugcagcccu

SEQ ID NO: 635244 - RNA, 22 nt, Human
cugggcaauaugcugggccugg

SEQ ID NO: 635245 - RNA, 22 nt, Human
uauacagauaucuaagauguaa

SEQ ID NO: 635246 - RNA, 22 nt, Human
ccagcugguaagugauggagcc

SEQ ID NO: 635247 - RNA, 22 nt, Human
gaccuggauucaaauucagacu

SEQ ID NO: 635248 - RNA, 22 nt, Human
guacacacuauuuaaaguguuu

SEQ ID NO: 635249 - RNA, 22 nt, Human
cagugaggcucugcugagcggu

SEQ ID NO: 635250 - RNA, 22 nt, Human
guuacaaaggucauaaaagugu

SEQ ID NO: 635251 - RNA, 22 nt, Human
uucggcuucuuagaggcgcucc

SEQ ID NO: 635252 - RNA, 22 nt, Human
gcaggcagagguggaggagaca

SEQ ID NO: 635253 - RNA, 22 nt, Human
acagguggucuuugcuccuuuu

SEQ ID NO: 635254 - RNA, 22 nt, Human
auguuacaauccaacaaaauua

SEQ ID NO: 635255 - RNA, 22 nt, Human
uggcacagugcuggauggugcu

SEQ ID NO: 635256 - RNA, 22 nt, Human
cugauucccuggugccuccguu

SEQ ID NO: 635257 - RNA, 22 nt, Human
uuucaccucagucuuuuuauau

SEQ ID NO: 635258 - RNA, 22 nt, Human
uaugagaaaggagaaugacuuu

SEQ ID NO: 635259 - RNA, 22 nt, Human
ugauuuugagguuucaggucuu

SEQ ID NO: 635260 - RNA, 22 nt, Human
uaauuuuaacugugcuguuugg

SEQ ID NO: 635261 - RNA, 22 nt, Human
gccuggggggcaugucauaaua

SEQ ID NO: 635262 - RNA, 22 nt, Human
ccagguguaggacaccaaggga

SEQ ID NO: 635263 - RNA, 22 nt, Human
uagcuagcugcacaggcccugg

SEQ ID NO: 635264 - RNA, 22 nt, Human
gcucugggguuggaaagugauc

SEQ ID NO: 635265 - RNA, 22 nt, Human
ugguuucacggagugccuugcu

SEQ ID NO: 635266 - RNA, 22 nt, Human
gcccaugcacuuucugugaugg

SEQ ID NO: 635267 - RNA, 22 nt, Human
ucacauucuagaauguuaucgu

SEQ ID NO: 635268 - RNA, 22 nt, Human
auacaugugucccugauuuauu

SEQ ID NO: 635269 - RNA, 21 nt, Human
uucaggacaggaaaaacaggg

SEQ ID NO: 635270 - RNA, 22 nt, Human
acacagagugguuuguagaaua

SEQ ID NO: 635271 - RNA, 22 nt, Human
uggaaagugagacauauuuaua

SEQ ID NO: 635272 - RNA, 22 nt, Human
uucagggcagagaguucaggga

SEQ ID NO: 635273 - RNA, 22 nt, Human
aucauucuauuguugagcugcc

SEQ ID NO: 635274 - RNA, 22 nt, Human
gcccauggacacccaagugcca

SEQ ID NO: 635275 - RNA, 22 nt, Human
aaguuacagucagagguuaaca

SEQ ID NO: 635276 - RNA, 22 nt, Human
aguguauuaugcagcggagguc

SEQ ID NO: 635277 - RNA, 22 nt, Human
caggcucaaggcugacuuccau

SEQ ID NO: 635278 - RNA, 22 nt, Human
aguguuuagugaugaaagagaa

SEQ ID NO: 635279 - RNA, 22 nt, Human
uacaaugugugcuucuugucac

SEQ ID NO: 635280 - RNA, 22 nt, Human
ucagccuuguggcccugcucca

SEQ ID NO: 635281 - RNA, 22 nt, Human
uuauguuaugaauggaugaucu

SEQ ID NO: 635282 - RNA, 22 nt, Human
agauuuaaagcaguauucgcaa

SEQ ID NO: 635283 - RNA, 22 nt, Human
uacaagagacaccagggaggcu

SEQ ID NO: 635284 - RNA, 22 nt, Human
uggugcaguagagcugucuggg

SEQ ID NO: 635285 - RNA, 16 nt, Human
ccaccugcagcucuca

SEQ ID NO: 635286 - RNA, 22 nt, Human
aaugucauugguaaagauuagg

SEQ ID NO: 635287 - RNA, 23 nt, Human
ucugcuucuguauuuuuucccau

SEQ ID NO: 635288 - RNA, 22 nt, Human
ugggaggucucuugcggccuag

SEQ ID NO: 635289 - RNA, 22 nt, Human
agcucugagaaaguuagaaagu

SEQ ID NO: 635290 - RNA, 22 nt, Human
uuuaguuugauguucuacuccu

SEQ ID NO: 635291 - RNA, 22 nt, Human
auggauaagucaaagaguaucc

SEQ ID NO: 635292 - RNA, 20 nt, Human
agcugaggcaccugagguua

SEQ ID NO: 635293 - RNA, 22 nt, Human
ugggaagacuccucaggaggcg

SEQ ID NO: 635294 - RNA, 22 nt, Human
gacaaaacugagaucacacugu

SEQ ID NO: 635295 - RNA, 22 nt, Human
ucucacagugagccugaggucg

SEQ ID NO: 635296 - RNA, 22 nt, Human
agucccagcuacucaagaggcu

SEQ ID NO: 635297 - RNA, 22 nt, Human
aaaacauucugugaacucucaa

SEQ ID NO: 635298 - RNA, 22 nt, Human
ugcugcagaucagcugaguccu

SEQ ID NO: 635299 - RNA, 22 nt, Human
guuucacaugaaacuuggggaa

SEQ ID NO: 635300 - RNA, 22 nt, Human
auaaagaccaguaucuuauguu

SEQ ID NO: 635301 - RNA, 22 nt, Human
acuggaaaugagaugauaucag

SEQ ID NO: 635302 - RNA, 22 nt, Human
ggcugugcuugguguccuugga

SEQ ID NO: 635303 - RNA, 22 nt, Human
ggaggagggguuuacauuggaa

SEQ ID NO: 635304 - RNA, 22 nt, Human
augggcugggaucugaguguca

SEQ ID NO: 635305 - RNA, 21 nt, Human
gcacucagucacuacucaaga

SEQ ID NO: 635306 - RNA, 22 nt, Human
aaaucucaguguucuaagcauu

SEQ ID NO: 635307 - RNA, 22 nt, Human
ccuaggagagggaaaaucuagg

SEQ ID NO: 635308 - RNA, 22 nt, Human
gggcacugggucuucuccacgc

SEQ ID NO: 635309 - RNA, 22 nt, Human
ucuggaggcucugagggugagu

SEQ ID NO: 635310 - RNA, 22 nt, Human
ggucacugucuucugggcucug

SEQ ID NO: 635311 - RNA, 22 nt, Human
caggaagggggauccuuggaag

SEQ ID NO: 635312 - RNA, 22 nt, Human
ggacuggguaggagcccagggc

SEQ ID NO: 635313 - RNA, 22 nt, Human
uguggcagagagagcuuccuug

SEQ ID NO: 635314 - RNA, 22 nt, Human
uaacacugugguguucuuuguc

SEQ ID NO: 635315 - RNA, 22 nt, Human
uuggaggaggcauuggaggauu

SEQ ID NO: 635316 - RNA, 22 nt, Human
gugaaaaaucaucaugacuuga

SEQ ID NO: 635317 - RNA, 20 nt, Human
acaugcacguguguauauau

SEQ ID NO: 635318 - RNA, 18 nt, Human
agcugcuugcaggccuuc

SEQ ID NO: 635319 - RNA, 22 nt, Human
caggcucuuuugguggcaagga

SEQ ID NO: 635320 - RNA, 22 nt, Human
uggugccuccagcugcuucucc

SEQ ID NO: 635321 - RNA, 22 nt, Human
uucuagggaaugggaugaggau

SEQ ID NO: 635322 - RNA, 22 nt, Human
uacagggacucccgcagagaua

SEQ ID NO: 635323 - RNA, 22 nt, Human
cacaggagagguuaaugggggc

SEQ ID NO: 635324 - RNA, 22 nt, Human
uuccagcuaacucacaucccuu

SEQ ID NO: 635325 - RNA, 22 nt, Human
ucccuccacaccugcugguacc

SEQ ID NO: 635326 - RNA, 22 nt, Human
cugaggcacugguaaugggcau

SEQ ID NO: 635327 - RNA, 22 nt, Human
ggagggacccacucuagaggug

SEQ ID NO: 635328 - RNA, 22 nt, Human
augaaucaaacuguacacugag

SEQ ID NO: 635329 - RNA, 23 nt, Human
aaagaugugaguauucauauggc

SEQ ID NO: 635330 - RNA, 22 nt, Human
cacaggaaaugauucugcagca

SEQ ID NO: 635331 - RNA, 22 nt, Human
caguaguguugcugagugucag

SEQ ID NO: 635332 - RNA, 22 nt, Human
agggagaacaguugcagcagac

SEQ ID NO: 635333 - RNA, 22 nt, Human
ucugggggaggaggcauggccc

SEQ ID NO: 635334 - RNA, 22 nt, Human
cuggggcaucugacagauaaau

SEQ ID NO: 635335 - RNA, 22 nt, Human
gcugcugucuggucugagggcu

SEQ ID NO: 635336 - RNA, 22 nt, Human
aggggcugccuggcuuggcacu

SEQ ID NO: 635337 - RNA, 22 nt, Human
cuggugucugcucccucacagc

SEQ ID NO: 635338 - RNA, 22 nt, Human
ggaagaagcagggcauuugaau

SEQ ID NO: 635339 - RNA, 22 nt, Human
cucugugucagcugggugugca

SEQ ID NO: 635340 - RNA, 22 nt, Human
ugucaccaugccagcuucugcc

SEQ ID NO: 635341 - RNA, 22 nt, Human
ugggcacagaauagauggccca

SEQ ID NO: 635342 - RNA, 22 nt, Human
agagcuggggcucuggguuuaa

SEQ ID NO: 635343 - RNA, 22 nt, Human
agcagguguuagggauccaaug

SEQ ID NO: 635344 - RNA, 22 nt, Human
ucauaauacaaagaguucugca

SEQ ID NO: 635345 - RNA, 23 nt, Human
ugucauugugacuacagaaccag

SEQ ID NO: 635346 - RNA, 22 nt, Human
uggagucaguggcuauugggca

SEQ ID NO: 635347 - RNA, 22 nt, Human
caaugcaugauggaauugccuu

SEQ ID NO: 635348 - RNA, 22 nt, Human
augaggcaucuaacauugcaaa

SEQ ID NO: 635349 - RNA, 22 nt, Human
ugaagaacgugagauccagaaa

SEQ ID NO: 635350 - RNA, 22 nt, Human
gggcaggaacaaaucaaaugau

SEQ ID NO: 635351 - RNA, 20 nt, Human
uggagguggucugcuguccu

SEQ ID NO: 635352 - RNA, 22 nt, Human
guauacaacuauuguuggguaa

SEQ ID NO: 635353 - RNA, 22 nt, Human
ucuuuccauggccacacagucu

SEQ ID NO: 635354 - RNA, 22 nt, Human
ucuggaucucccucauccuggg

SEQ ID NO: 635355 - RNA, 22 nt, Human
ugggccugggucuuugcugcca

SEQ ID NO: 635356 - RNA, 22 nt, Human
gagaggcuuaagggcugugaag

SEQ ID NO: 635357 - RNA, 22 nt, Human
cucuucuugucucugguuagaa

SEQ ID NO: 635358 - RNA, 22 nt, Human
uucuguauuucaaugucuuuau

SEQ ID NO: 635359 - RNA, 22 nt, Human
uggaaccaucaaagagauccug

SEQ ID NO: 635360 - RNA, 22 nt, Human
accagggcaaauguuuguacuc

SEQ ID NO: 635361 - RNA, 20 nt, Human
ucaagacagacauggaguuu

SEQ ID NO: 635362 - RNA, 22 nt, Human
uugcuuuaggauuuaaguggca

SEQ ID NO: 635363 - RNA, 22 nt, Human
agagccugugggagaugcagcu

SEQ ID NO: 635364 - RNA, 22 nt, Human
guugaaagaugucuugguuccc

SEQ ID NO: 635365 - RNA, 22 nt, Human
ggccucgcggcuucugguggcu

SEQ ID NO: 635366 - RNA, 22 nt, Human
agcugcccccagggcugugcuu

SEQ ID NO: 635367 - RNA, 22 nt, Human
aacccuggcccuggaauaggca

SEQ ID NO: 635368 - RNA, 22 nt, Human
cugaacuucucugagccucagu

SEQ ID NO: 635369 - RNA, 22 nt, Human
agagacuggcuucuaaaauggc

SEQ ID NO: 635370 - RNA, 22 nt, Human
accugaggaagggcgagaagcu

SEQ ID NO: 635371 - RNA, 20 nt, Human
aucugggcaucaauuuugug

SEQ ID NO: 635372 - RNA, 22 nt, Human
ccccucuugugggcucagguca

SEQ ID NO: 635373 - RNA, 22 nt, Human
cgcuuuggagucccugcuuuac

SEQ ID NO: 635374 - RNA, 22 nt, Human
cucugcuuuuuaaaaggagucc

SEQ ID NO: 635375 - RNA, 22 nt, Human
acaggaaccaggcaggucgauu

SEQ ID NO: 635376 - RNA, 21 nt, Human
caaucacuuuugcaccaagcu

SEQ ID NO: 635377 - RNA, 22 nt, Human
agguuacagucaucucagaauc

SEQ ID NO: 635378 - RNA, 22 nt, Human
guacauuuaggauucauugaaa

SEQ ID NO: 635379 - RNA, 22 nt, Human
gugggcaguuggugauucucgu

SEQ ID NO: 635380 - RNA, 22 nt, Human
ggucccaggaagugcggcggcg

SEQ ID NO: 635381 - RNA, 22 nt, Human
uaacuuuucuaggugugauaau

SEQ ID NO: 635382 - RNA, 22 nt, Human
cuucagcccagccuccgccucc

SEQ ID NO: 635383 - RNA, 22 nt, Human
ugagccaggaguuugaggcugu

SEQ ID NO: 635384 - RNA, 22 nt, Human
gugagguccaguaacuugucca

SEQ ID NO: 635385 - RNA, 22 nt, Human
uauguauucugaguacaaguuc

SEQ ID NO: 635386 - RNA, 19 nt, Human
uacaggaggccugcaaucu

SEQ ID NO: 635387 - RNA, 20 nt, Human
ucaggcuggugggcuuuccc

SEQ ID NO: 635388 - RNA, 22 nt, Human
agcccugccauucucuggagcu

SEQ ID NO: 635389 - RNA, 21 nt, Human
aaauacagaugcaaaucuguu

SEQ ID NO: 635390 - RNA, 22 nt, Human
uucuucaaacaaaaguggcaug

SEQ ID NO: 635391 - RNA, 22 nt, Human
caggccucuauggucagcugag

SEQ ID NO: 635392 - RNA, 22 nt, Human
gaacuagaauguucugauggag

SEQ ID NO: 635393 - RNA, 22 nt, Human
cugggcucuguguuucaguuuc

SEQ ID NO: 635394 - RNA, 22 nt, Human
ugugcgugguucccggggccau

SEQ ID NO: 635395 - RNA, 22 nt, Human
agagccuuuggagcugcuauua

SEQ ID NO: 635396 - RNA, 21 nt, Human
ugcuggugagcucauguggcu

SEQ ID NO: 635397 - RNA, 22 nt, Human
ucaguggagagcuuccaggauu

SEQ ID NO: 635398 - RNA, 22 nt, Human
auugucuuguacguuugccugu

SEQ ID NO: 635399 - RNA, 22 nt, Human
uccuguggucauucuucugccc

SEQ ID NO: 635400 - RNA, 17 nt, Human
uguuuucauucauugcu

SEQ ID NO: 635401 - RNA, 22 nt, Human
uuugucaaucccuugaaaaccu

SEQ ID NO: 635402 - RNA, 23 nt, Human
guuguaauggauaaugcaaauug

SEQ ID NO: 635403 - RNA, 22 nt, Human
ucauucuggaugacuuucuaga

SEQ ID NO: 635404 - RNA, 22 nt, Human
gggaaguuugugggaggaauau

SEQ ID NO: 635405 - RNA, 20 nt, Human
agggucagagagcgugagug

SEQ ID NO: 635406 - RNA, 22 nt, Human
accuggagauccauggugucga

SEQ ID NO: 635407 - RNA, 22 nt, Human
uuuauccagaaucaggauuuuu

SEQ ID NO: 635408 - RNA, 22 nt, Human
gcccucagaguuccccacagug

SEQ ID NO: 635409 - RNA, 22 nt, Human
gauucacaacugcccugaaggg

SEQ ID NO: 635410 - RNA, 22 nt, Human
guuucagaacaccccauuuggg

SEQ ID NO: 635411 - RNA, 22 nt, Human
gugagaaauggaacuucauacg

SEQ ID NO: 635412 - RNA, 22 nt, Human
gggccuggugcuucugacuccu

SEQ ID NO: 635413 - RNA, 22 nt, Human
ucucccaggucauacacagaga

SEQ ID NO: 635414 - RNA, 22 nt, Human
cauuuggaaagagacuagagaa

SEQ ID NO: 635415 - RNA, 22 nt, Human
acagaguacagacaaaggucag

SEQ ID NO: 635416 - RNA, 22 nt, Human
caugcacaagggaugaugaaau

SEQ ID NO: 635417 - RNA, 22 nt, Human
uuucucuuugacaggaaucaga

SEQ ID NO: 635418 - RNA, 22 nt, Human
uugaaggaggcgaaaauugguc

SEQ ID NO: 635419 - RNA, 22 nt, Human
caggcagagccaaucguggggu

SEQ ID NO: 635420 - RNA, 22 nt, Human
aaagucugaaagauaagaguga

SEQ ID NO: 635421 - RNA, 22 nt, Human
aaugucuuaaagucguguuaca

SEQ ID NO: 635422 - RNA, 22 nt, Human
cgcuuaauuuucuauagaaaag

SEQ ID NO: 635423 - RNA, 22 nt, Human
cuacauggagaagaaaauucuu

SEQ ID NO: 635424 - RNA, 22 nt, Human
cugcacaguggacagugaagau

SEQ ID NO: 635425 - RNA, 22 nt, Human
auguacauguuuaagugaagga

SEQ ID NO: 635426 - RNA, 22 nt, Human
accaggcaguauggugcugcaa

SEQ ID NO: 635427 - RNA, 22 nt, Human
acuucucuucauagguggcaau

SEQ ID NO: 635428 - RNA, 22 nt, Human
cugucccaggauccugacucca

SEQ ID NO: 635429 - RNA, 20 nt, Human
ugggccugagccugugggcu

SEQ ID NO: 635430 - RNA, 22 nt, Human
ccacaggaggauguucagacaa

SEQ ID NO: 635431 - RNA, 22 nt, Human
ucugcuguaaagaauuucugcc

SEQ ID NO: 635432 - RNA, 22 nt, Human
gggggcaggucuggaacuuuga

SEQ ID NO: 635433 - RNA, 22 nt, Human
auuaacaugaguuggagauagg

SEQ ID NO: 635434 - RNA, 22 nt, Human
caggcauggugagaacucagcc

SEQ ID NO: 635435 - RNA, 22 nt, Human
aaaucuagaaguuuaaaaggau

SEQ ID NO: 635436 - RNA, 22 nt, Human
aagccaaugauacgggugaucu

SEQ ID NO: 635437 - RNA, 22 nt, Human
uauagcaucuaggaugauugca

SEQ ID NO: 635438 - RNA, 22 nt, Human
uuacaguaugaucaacuuuuca

SEQ ID NO: 635439 - RNA, 23 nt, Human
uugcacaguuucggaaacugagg

SEQ ID NO: 635440 - RNA, 22 nt, Human
ugagaccuuggggagcccuguu

SEQ ID NO: 635441 - RNA, 22 nt, Human
cuccugucaauaggcuccuggc

SEQ ID NO: 635442 - RNA, 22 nt, Human
uuuguauaagaacauucuagca

SEQ ID NO: 635443 - RNA, 22 nt, Human
cucuuaaagcuuccaguuucaa

SEQ ID NO: 635444 - RNA, 19 nt, Human
auguuuacacucaggggcu

SEQ ID NO: 635445 - RNA, 22 nt, Human
uacuuccuguuuccaugucugu

SEQ ID NO: 635446 - RNA, 22 nt, Human
cuaaucaucuuucucuuaaagc

SEQ ID NO: 635447 - RNA, 22 nt, Human
auggcagccuguggacagucaa

SEQ ID NO: 635448 - RNA, 22 nt, Human
guuuuucuaggaccaugugauu

SEQ ID NO: 635449 - RNA, 22 nt, Human
uggcaaggaagagccuggugca

SEQ ID NO: 635450 - RNA, 22 nt, Human
auuuaugacguguucggucaau

SEQ ID NO: 635451 - RNA, 22 nt, Human
gggggcaguaaggauauggaaa

SEQ ID NO: 635452 - RNA, 22 nt, Human
aacagucuaaauuauacccuuu

SEQ ID NO: 635453 - RNA, 22 nt, Human
cuucugauuagcaaguuuguau

SEQ ID NO: 635454 - RNA, 22 nt, Human
gaucauuugcaggaaacauuaa

SEQ ID NO: 635455 - RNA, 22 nt, Human
uuccaugugaguacacugugau

SEQ ID NO: 635456 - RNA, 22 nt, Human
aggcuagggccauggcugguga

SEQ ID NO: 635457 - RNA, 22 nt, Human
cagcuguugaucucuuaagccu

SEQ ID NO: 635458 - RNA, 22 nt, Human
augcuauaaacucuaggucauu

SEQ ID NO: 635459 - RNA, 22 nt, Human
uagacagaauccagcccacgcc

SEQ ID NO: 635460 - RNA, 22 nt, Human
uuggaaauacagcaguuacuuu

SEQ ID NO: 635461 - RNA, 22 nt, Human
cccaggaguuugaguucagcau

SEQ ID NO: 635462 - RNA, 22 nt, Human
acagaggguuucuaaggauuug

SEQ ID NO: 635463 - RNA, 22 nt, Human
uagaaguucaugcgaauuauuu

SEQ ID NO: 635464 - RNA, 22 nt, Human
aaaaccuucuagacuuuauauu

SEQ ID NO: 635465 - RNA, 22 nt, Human
ugcaugcaugcuacugggaggu

SEQ ID NO: 635466 - RNA, 22 nt, Human
cuggaucuguuugugcuugugg

SEQ ID NO: 635467 - RNA, 22 nt, Human
aaugaacuccgaacauuuacau

SEQ ID NO: 635468 - RNA, 22 nt, Human
ggccagcucaggguccuugggc

SEQ ID NO: 635469 - RNA, 22 nt, Human
ugucuccaaaacaaucucagau

SEQ ID NO: 635470 - RNA, 22 nt, Human
agcaggcugcuggcguugaagu

SEQ ID NO: 635471 - RNA, 22 nt, Human
ucucugggaaugggccugggua

SEQ ID NO: 635472 - RNA, 22 nt, Human
uaugguuauguaaucaguuguu

SEQ ID NO: 635473 - RNA, 22 nt, Human
gggcagugucuggcccccaggc

SEQ ID NO: 635474 - RNA, 22 nt, Human
guuaaugucacuuuauguggcu

SEQ ID NO: 635475 - RNA, 22 nt, Human
caggcucccuucucggaauucu

SEQ ID NO: 635476 - RNA, 22 nt, Human
uccucacagggcaggaaggagg

SEQ ID NO: 635477 - RNA, 22 nt, Human
caagagcuuuagaaaugcucau

SEQ ID NO: 635478 - RNA, 23 nt, Human
ugaagcauggauaacucacaccu

SEQ ID NO: 635479 - RNA, 18 nt, Human
cauuaugugguuauagaa

SEQ ID NO: 635480 - RNA, 22 nt, Human
uccugccuucauacugcuguau

SEQ ID NO: 635481 - RNA, 22 nt, Human
uaaggacauuagaaaugaugcu

SEQ ID NO: 635482 - RNA, 22 nt, Human
agccuuagauuugggcaagaac

SEQ ID NO: 635483 - RNA, 22 nt, Human
gaagauuucaguuaaguaucua

SEQ ID NO: 635484 - RNA, 20 nt, Human
acaguccugcacugguguuu

SEQ ID NO: 635485 - RNA, 20 nt, Human
uuucacuguggugcuggaga

SEQ ID NO: 635486 - RNA, 23 nt, Human
aaucagcaugcucuguggcuggc

SEQ ID NO: 635487 - RNA, 22 nt, Human
gagaauguggagccugugguug

SEQ ID NO: 635488 - RNA, 22 nt, Human
auuauuuauccucuuggucuau

SEQ ID NO: 635489 - RNA, 20 nt, Human
agguccuguuccuugucucc

SEQ ID NO: 635490 - RNA, 22 nt, Human
cuacagaaucuaccucaagcca

SEQ ID NO: 635491 - RNA, 22 nt, Human
cauggcaauuucauaaacaggu

SEQ ID NO: 635492 - RNA, 22 nt, Human
uacuuuauuguaaaugcugaug

SEQ ID NO: 635493 - RNA, 22 nt, Human
uaaguucaagucuuggauauaa

SEQ ID NO: 635494 - RNA, 22 nt, Human
acauucucauuuggugaucauu

SEQ ID NO: 635495 - RNA, 22 nt, Human
uggcugccugaaugcaagacag

SEQ ID NO: 635496 - RNA, 22 nt, Human
ucagagaauguccuucuucauu

SEQ ID NO: 635497 - RNA, 22 nt, Human
cugucuuuaguacaaaaaaugu

SEQ ID NO: 635498 - RNA, 22 nt, Human
uucaacauuugaaaugaaugaa

SEQ ID NO: 635499 - RNA, 22 nt, Human
ucacagccuggacaguugccug

SEQ ID NO: 635500 - RNA, 22 nt, Human
gaggggcugcccuggugucagg

SEQ ID NO: 635501 - RNA, 19 nt, Human
ugugguuucccggcggccu

SEQ ID NO: 635502 - RNA, 22 nt, Human
aggugaguugguaggaaguuug

SEQ ID NO: 635503 - RNA, 20 nt, Human
aagagcccgcagggcagugc

SEQ ID NO: 635504 - RNA, 22 nt, Human
gaaugauaaauggaagcagcau

SEQ ID NO: 635505 - RNA, 22 nt, Human
acugagguagggcacaccuagg

SEQ ID NO: 635506 - RNA, 22 nt, Human
uuucaagagcaggaaaaagguc

SEQ ID NO: 635507 - RNA, 22 nt, Human
cagggccuucguaaguguccgg

SEQ ID NO: 635508 - RNA, 22 nt, Human
aaugccaucagagaaaacucuu

SEQ ID NO: 635509 - RNA, 22 nt, Human
gcucugcuaauauuguaguacc

SEQ ID NO: 635510 - RNA, 23 nt, Human
agagggagauguuuuucucaaga

SEQ ID NO: 635511 - RNA, 22 nt, Human
cuuuauucugcaaauugccuug

SEQ ID NO: 635512 - RNA, 18 nt, Human
cagagcagagguggagcg

SEQ ID NO: 635513 - RNA, 22 nt, Human
agugucugcuagguucaucaac

SEQ ID NO: 635514 - RNA, 22 nt, Human
ucuagacaucuuggcugcaauu

SEQ ID NO: 635515 - RNA, 22 nt, Human
ugaguggguuaucaggaaaggu

SEQ ID NO: 635516 - RNA, 22 nt, Human
aggcagccuauggggagcucag

SEQ ID NO: 635517 - RNA, 20 nt, Human
agucucuguagugccugaga

SEQ ID NO: 635518 - RNA, 21 nt, Human
auuucagaaauauugguggga

SEQ ID NO: 635519 - RNA, 22 nt, Human
agggaggaccaaugugugguua

SEQ ID NO: 635520 - RNA, 22 nt, Human
accugaauuugaaauguuuauu

SEQ ID NO: 635521 - RNA, 22 nt, Human
uauucccagccucuuucuaucu

SEQ ID NO: 635522 - RNA, 22 nt, Human
uuauugcaaccuuuucuggugu

SEQ ID NO: 635523 - RNA, 21 nt, Human
uccugcagggcagcagagugg

SEQ ID NO: 635524 - RNA, 22 nt, Human
aaguaaaccacagagaagccac

SEQ ID NO: 635525 - RNA, 22 nt, Human
gaaagaccagcaugaggcuuua

SEQ ID NO: 635526 - RNA, 22 nt, Human
aagcacagggacucaggaccgg

SEQ ID NO: 635527 - RNA, 22 nt, Human
uggacucagaaguguucuuuua

SEQ ID NO: 635528 - RNA, 22 nt, Human
acaaacagcuaacauauguuaa

SEQ ID NO: 635529 - RNA, 22 nt, Human
aaucauaauuuugugaauguag

SEQ ID NO: 635530 - RNA, 22 nt, Human
auaauggcaugacaguuauaua

SEQ ID NO: 635531 - RNA, 18 nt, Human
ugaauguuuucuggaccc

SEQ ID NO: 635532 - RNA, 22 nt, Human
aggaacaauugauaaacucaca

SEQ ID NO: 635533 - RNA, 22 nt, Human
aggaggccgcugaugggcuccc

SEQ ID NO: 635534 - RNA, 22 nt, Human
gggggagcuaguccagcugagg

SEQ ID NO: 635535 - RNA, 20 nt, Human
acagauauuugauuuucagu

SEQ ID NO: 635536 - RNA, 22 nt, Human
cuccuggaguccuuuccuauuc

SEQ ID NO: 635537 - RNA, 22 nt, Human
cagauuuaccuaacuccaaguu

SEQ ID NO: 635538 - RNA, 20 nt, Human
acagaauaugcugguugugg

SEQ ID NO: 635539 - RNA, 22 nt, Human
augcaauauagggaagauagau

SEQ ID NO: 635540 - RNA, 22 nt, Human
gaggcaagaaaggacuuucuag

SEQ ID NO: 635541 - RNA, 22 nt, Human
aucacaauguacguuaaaaugu

SEQ ID NO: 635542 - RNA, 22 nt, Human
uagauuuccucuuccucauucc

SEQ ID NO: 635543 - RNA, 22 nt, Human
ccagcccuacaguaucaccugu

SEQ ID NO: 635544 - RNA, 22 nt, Human
aggcugugaugagccucaugga

SEQ ID NO: 635545 - RNA, 22 nt, Human
aguagaaauguaagaaggauua

SEQ ID NO: 635546 - RNA, 22 nt, Human
uggcuccaaaucaacugcuguu

SEQ ID NO: 635547 - RNA, 22 nt, Human
acauuguuccagcgauagagaa

SEQ ID NO: 635548 - RNA, 22 nt, Human
ucuuguccuaagagcuggauuc

SEQ ID NO: 635549 - RNA, 21 nt, Human
cccgcacagcgguaggccgcc

SEQ ID NO: 635550 - RNA, 22 nt, Human
ugcagaaacagaguuuugccau

SEQ ID NO: 635551 - RNA, 22 nt, Human
gaccuggguaaggggcugacaa

SEQ ID NO: 635552 - RNA, 22 nt, Human
uccugaaaauaauuucacaaga

SEQ ID NO: 635553 - RNA, 22 nt, Human
gaggauguaaaauagacaaaau

SEQ ID NO: 635554 - RNA, 22 nt, Human
aaauggaucuguggaauacauu

SEQ ID NO: 635555 - RNA, 22 nt, Human
uuucucuuucaaucugcaguac

SEQ ID NO: 635556 - RNA, 22 nt, Human
gacacauagaucuaucucacuc

SEQ ID NO: 635557 - RNA, 22 nt, Human
ggcaccaggaucagucugucau

SEQ ID NO: 635558 - RNA, 22 nt, Human
uguuuucacaaugaugucagau

SEQ ID NO: 635559 - RNA, 22 nt, Human
cagguggcugagcugaccuuug

SEQ ID NO: 635560 - RNA, 22 nt, Human
cacagggcuaaaugaaggguug

SEQ ID NO: 635561 - RNA, 22 nt, Human
caguggagaggcaugcuuggca

SEQ ID NO: 635562 - RNA, 22 nt, Human
ucagcuuucucaaagaagcugg

SEQ ID NO: 635563 - RNA, 22 nt, Human
augggaguuuucucugaugcuc

SEQ ID NO: 635564 - RNA, 22 nt, Human
gcugaagagagaugcguccagc

SEQ ID NO: 635565 - RNA, 22 nt, Human
aaggccugcucagcugucugug

SEQ ID NO: 635566 - RNA, 22 nt, Human
cuguggcauugugaggacugca

SEQ ID NO: 635567 - RNA, 22 nt, Human
uaucuuggcuugaaagaugcuu

SEQ ID NO: 635568 - RNA, 22 nt, Human
uucuggggccaauugccacugc

SEQ ID NO: 635569 - RNA, 22 nt, Human
agauccaugugauuuggaguuc

SEQ ID NO: 635570 - RNA, 22 nt, Human
agaaacagaagggaaagcuuuu

SEQ ID NO: 635571 - RNA, 22 nt, Human
uugacuguacaaccuuuuguag

SEQ ID NO: 635572 - RNA, 18 nt, Human
uucagagucuggugagga

SEQ ID NO: 635573 - RNA, 22 nt, Human
gaguggggcuuuaaaggcucag

SEQ ID NO: 635574 - RNA, 22 nt, Human
aggaggaggugggacacaguga

SEQ ID NO: 635575 - RNA, 22 nt, Human
ugcccucugcaggccgccaugg

SEQ ID NO: 635576 - RNA, 17 nt, Human
ugagaaguaggcaucau

SEQ ID NO: 635577 - RNA, 22 nt, Human
guuuccaucuccaggacauaau

SEQ ID NO: 635578 - RNA, 21 nt, Human
uggcucgauuuauagcauuuc

SEQ ID NO: 635579 - RNA, 22 nt, Human
uugcuuuacaaaaauugauggu

SEQ ID NO: 635580 - RNA, 22 nt, Human
agguuucugcuguccuccuucu

SEQ ID NO: 635581 - RNA, 22 nt, Human
cugagccaaggggacagugaca

SEQ ID NO: 635582 - RNA, 17 nt, Human
ucuguucaagugagagg

SEQ ID NO: 635583 - RNA, 21 nt, Human
agacagcagucuccaaacccc

SEQ ID NO: 635584 - RNA, 22 nt, Human
caaagcaccacaaaccagguga

SEQ ID NO: 635585 - RNA, 22 nt, Human
ugcuacacucaaucagugcuau

SEQ ID NO: 635586 - RNA, 22 nt, Human
agagcagucaggcuaggacacu

SEQ ID NO: 635587 - RNA, 22 nt, Human
uagcauuucacugaucuucacu

SEQ ID NO: 635588 - RNA, 22 nt, Human
auugacaagacaauggcucuua

SEQ ID NO: 635589 - RNA, 22 nt, Human
gcucugccucuuugcugcguca

SEQ ID NO: 635590 - RNA, 22 nt, Human
gcauuagaaacuauugcugcaa

SEQ ID NO: 635591 - RNA, 22 nt, Human
uauuccuggucccuaccacaga

SEQ ID NO: 635592 - RNA, 22 nt, Human
aagauugacggcuuugagugcu

SEQ ID NO: 635593 - RNA, 23 nt, Human
ggcuggcccggggcugcuccuga

SEQ ID NO: 635594 - RNA, 22 nt, Human
auuuagucaucacucauguguu

SEQ ID NO: 635595 - RNA, 22 nt, Human
uggcaggcugaguuggccuggu

SEQ ID NO: 635596 - RNA, 22 nt, Human
aagcacaucuccugugcagaac

SEQ ID NO: 635597 - RNA, 22 nt, Human
uauguagaagcugcucaaagaa

SEQ ID NO: 635598 - RNA, 22 nt, Human
ugccccucuugcuggcccuguc

SEQ ID NO: 635599 - RNA, 22 nt, Human
aacuacaguauguccaaagaau

SEQ ID NO: 635600 - RNA, 22 nt, Human
aagaggcuggaggauacugcgc

SEQ ID NO: 635601 - RNA, 22 nt, Human
ucucagaguuuuuuuccaggac

SEQ ID NO: 635602 - RNA, 22 nt, Human
ggguggaggagaacaggcccca

SEQ ID NO: 635603 - RNA, 22 nt, Human
cuccagagguucucaucuggga

SEQ ID NO: 635604 - RNA, 22 nt, Human
auggaagggacagaagggcaag

SEQ ID NO: 635605 - RNA, 22 nt, Human
cauagaauguaauaaagaguag

SEQ ID NO: 635606 - RNA, 22 nt, Human
cagcagacuggaguaggcagug

SEQ ID NO: 635607 - RNA, 22 nt, Human
ccaggaacucagcucugcacuu

SEQ ID NO: 635608 - RNA, 22 nt, Human
aggauggcgauucgagcaccuc

SEQ ID NO: 635609 - RNA, 22 nt, Human
uauguacuacacuagaacauuu

SEQ ID NO: 635610 - RNA, 22 nt, Human
auguggauggaagucagauagc

SEQ ID NO: 635611 - RNA, 22 nt, Human
acauacaugggauuaaaaaauu

SEQ ID NO: 635612 - RNA, 22 nt, Human
ucucuguacaguacaugccgug

SEQ ID NO: 635613 - RNA, 22 nt, Human
uugcuucaguagcucuuuaaag

SEQ ID NO: 635614 - RNA, 22 nt, Human
ugucucugaacagcuuacuaaa

SEQ ID NO: 635615 - RNA, 22 nt, Human
acaucaugagagacuuaaauug

SEQ ID NO: 635616 - RNA, 19 nt, Human
ugcauugagggcugucuca

SEQ ID NO: 635617 - RNA, 22 nt, Human
cacuuuauuauaaauuugagag

SEQ ID NO: 635618 - RNA, 22 nt, Human
caguuuauauauaagcacauug

SEQ ID NO: 635619 - RNA, 22 nt, Human
cucagugguugagagccugggc

SEQ ID NO: 635620 - RNA, 22 nt, Human
aggaagaaacugagcucugaca

SEQ ID NO: 635621 - RNA, 22 nt, Human
cagcagcucagucucucaguag

SEQ ID NO: 635622 - RNA, 22 nt, Human
gucccugggucuaaggcaguaa

SEQ ID NO: 635623 - RNA, 22 nt, Human
ugggaaggcagucacuguccua

SEQ ID NO: 635624 - RNA, 22 nt, Human
uaaaucaagaauaucagcuugu

SEQ ID NO: 635625 - RNA, 22 nt, Human
ucugccuguucaagucuucuag

SEQ ID NO: 635626 - RNA, 22 nt, Human
uuucuucuuucccagugauggg

SEQ ID NO: 635627 - RNA, 22 nt, Human
ugucugaauucaagaaauucaa

SEQ ID NO: 635628 - RNA, 20 nt, Human
uuccacaucuuugcacaugc

SEQ ID NO: 635629 - RNA, 22 nt, Human
ccucugugccucguguccucug

SEQ ID NO: 635630 - RNA, 17 nt, Human
ugcuuaauuuugacugg

SEQ ID NO: 635631 - RNA, 22 nt, Human
auaauaacaccugaauaggaaa

SEQ ID NO: 635632 - RNA, 20 nt, Human
agaagcugauacugauggaa

SEQ ID NO: 635633 - RNA, 22 nt, Human
uauuccaacuucacuauugucu

SEQ ID NO: 635634 - RNA, 20 nt, Human
uacuugaauguugcagcagu

SEQ ID NO: 635635 - RNA, 22 nt, Human
agaacugucacgagugacaaag

SEQ ID NO: 635636 - RNA, 21 nt, Human
ugaacucuggucaucuucauu

SEQ ID NO: 635637 - RNA, 17 nt, Human
ugccaagaagagcagag

SEQ ID NO: 635638 - RNA, 22 nt, Human
ugugaaagcaagucuaguucuc

SEQ ID NO: 635639 - RNA, 22 nt, Human
gugcacagauuuaauuuuauuc

SEQ ID NO: 635640 - RNA, 22 nt, Human
uauggcaagaugacauguucuc

SEQ ID NO: 635641 - RNA, 22 nt, Human
uggggccugugacggguccaga

SEQ ID NO: 635642 - RNA, 22 nt, Human
uuaaauuucuacgugauccagg

SEQ ID NO: 635643 - RNA, 22 nt, Human
accguggauuuguagucauuuc

SEQ ID NO: 635644 - RNA, 22 nt, Human
cugggucccggcuucuauccac

SEQ ID NO: 635645 - RNA, 22 nt, Human
aguagauucucauugaucuggu

SEQ ID NO: 635646 - RNA, 22 nt, Human
guguacaguuagccaccaaauu

SEQ ID NO: 635647 - RNA, 22 nt, Human
uccugcaggccagaggggugag

SEQ ID NO: 635648 - RNA, 22 nt, Human
cuacuuuaacauggaggcacuu

SEQ ID NO: 635649 - RNA, 22 nt, Human
cagaggauucccuagugaccug

SEQ ID NO: 635650 - RNA, 22 nt, Human
gucccucaagguccagucaugg

SEQ ID NO: 635651 - RNA, 22 nt, Human
aacugcauuugcauaaguccau

SEQ ID NO: 635652 - RNA, 22 nt, Human
ggcugaagaacugggagucuca

SEQ ID NO: 635653 - RNA, 22 nt, Human
uaggaaaugcuccauugcauaa

SEQ ID NO: 635654 - RNA, 22 nt, Human
agccaggccuuuucucaagguu

SEQ ID NO: 635655 - RNA, 22 nt, Human
aaggcacugagccagccgucuc

SEQ ID NO: 635656 - RNA, 22 nt, Human
acaaagcuagagaagagaauug

SEQ ID NO: 635657 - RNA, 22 nt, Human
caggggcugaaauguugggguu

SEQ ID NO: 635658 - RNA, 22 nt, Human
agggcugccauuucuggcccaa

SEQ ID NO: 635659 - RNA, 22 nt, Human
aggcugugagcaagaacaccua

SEQ ID NO: 635660 - RNA, 22 nt, Human
auguguauauuuggugucaaua

SEQ ID NO: 635661 - RNA, 22 nt, Human
uuuugccugugaauacuaucuu

SEQ ID NO: 635662 - RNA, 22 nt, Human
aggcucagccugggccuagagc

SEQ ID NO: 635663 - RNA, 22 nt, Human
agggggcucagugacugaagug

SEQ ID NO: 635664 - RNA, 23 nt, Human
gggcuccagucucugcucaguug

SEQ ID NO: 635665 - RNA, 21 nt, Human
cuggaagaagcagcaggauuc

SEQ ID NO: 635666 - RNA, 22 nt, Human
ucagggagggaccugaggcugg

SEQ ID NO: 635667 - RNA, 22 nt, Human
cacauaaucaccaaguccuuuc

SEQ ID NO: 635668 - RNA, 22 nt, Human
auuuccuaauuuaugcaggagu

SEQ ID NO: 635669 - RNA, 22 nt, Human
uuucuguagggauuucacaguu

SEQ ID NO: 635670 - RNA, 22 nt, Human
uaaggcaguagugucuguaggg

SEQ ID NO: 635671 - RNA, 22 nt, Human
uugucugugaaauggaaauagu

SEQ ID NO: 635672 - RNA, 22 nt, Human
ucagaaauagucuuuaaaauga

SEQ ID NO: 635673 - RNA, 22 nt, Human
cagaaacuguuuguuaauauuu

SEQ ID NO: 635674 - RNA, 22 nt, Human
gagggagcuggagcagacgccg

SEQ ID NO: 635675 - RNA, 22 nt, Human
uucugcaucucacagccagugc

SEQ ID NO: 635676 - RNA, 18 nt, Human
gcuuucugugcagcggag

SEQ ID NO: 635677 - RNA, 22 nt, Human
ugaaacaaugugaaguugcuga

SEQ ID NO: 635678 - RNA, 22 nt, Human
cagcugagcaucacuagucugg

SEQ ID NO: 635679 - RNA, 22 nt, Human
uuaaagcaaaaacuaggaugga

SEQ ID NO: 635680 - RNA, 22 nt, Human
ggggagcaggcugggcugucug

SEQ ID NO: 635681 - RNA, 22 nt, Human
uuucacauagaaagugauuuac

SEQ ID NO: 635682 - RNA, 22 nt, Human
aaugcauuagcuacauaugucu

SEQ ID NO: 635683 - RNA, 22 nt, Human
agaugguguuuccccaggugga

SEQ ID NO: 635684 - RNA, 19 nt, Human
ccaccccuuugcugggccc

SEQ ID NO: 635685 - RNA, 22 nt, Human
gagcugccggcccacaguacua

SEQ ID NO: 635686 - RNA, 19 nt, Human
gggcagaauggcaucucag

SEQ ID NO: 635687 - RNA, 22 nt, Human
uccaggccuggcuccauucagu

SEQ ID NO: 635688 - RNA, 22 nt, Human
uaggaagaugaguaucaacuug

SEQ ID NO: 635689 - RNA, 22 nt, Human
ccugcaguuuguugugaccccg

SEQ ID NO: 635690 - RNA, 22 nt, Human
gggucccuggaauuacuugaca

SEQ ID NO: 635691 - RNA, 22 nt, Human
uagccaggccuuugaucccggc

SEQ ID NO: 635692 - RNA, 22 nt, Human
gaauguaaaauugccuacaaga

SEQ ID NO: 635693 - RNA, 22 nt, Human
uuuguaaaaggaggaagcaugg

SEQ ID NO: 635694 - RNA, 22 nt, Human
ucucuggcagcuugugcuguug

SEQ ID NO: 635695 - RNA, 19 nt, Human
aggcugugaggggaaggaa

SEQ ID NO: 635696 - RNA, 22 nt, Human
agggcuccgggccaccggccug

SEQ ID NO: 635697 - RNA, 22 nt, Human
uccagggcaccagcgucccccu

SEQ ID NO: 635698 - RNA, 22 nt, Human
acccagagucauggcacuuagc

SEQ ID NO: 635699 - RNA, 22 nt, Human
aaauuccauuaggaaacuucca

SEQ ID NO: 635700 - RNA, 22 nt, Human
ugguugugcugaguuuagugca

SEQ ID NO: 635701 - RNA, 22 nt, Human
cuacuguccauaaaguauaacu

SEQ ID NO: 635702 - RNA, 22 nt, Human
guuuggcacuaugaugaggcua

SEQ ID NO: 635703 - RNA, 22 nt, Human
aaauauagugacacuuauaguc

SEQ ID NO: 635704 - RNA, 22 nt, Human
ucucuggggaugcuuauucuug

SEQ ID NO: 635705 - RNA, 22 nt, Human
ucacagaaguguagugaggaaa

SEQ ID NO: 635706 - RNA, 22 nt, Human
ucugccagaagccagggucugg

SEQ ID NO: 635707 - RNA, 22 nt, Human
acagucugcagggugaacaugu

SEQ ID NO: 635708 - RNA, 22 nt, Human
ccuggcagcuguuuggcuuggc

SEQ ID NO: 635709 - RNA, 22 nt, Human
auguuguguuugacuguuaccc

SEQ ID NO: 635710 - RNA, 22 nt, Human
ccagcuuuccaggguugacugg

SEQ ID NO: 635711 - RNA, 22 nt, Human
uggacaucuuagucaugucaau

SEQ ID NO: 635712 - RNA, 22 nt, Human
cagguauaacgugcauguugua

SEQ ID NO: 635713 - RNA, 22 nt, Human
caugaagcucuugcaccucuag

SEQ ID NO: 635714 - RNA, 21 nt, Human
uccaacaugccugauggugcc

SEQ ID NO: 635715 - RNA, 22 nt, Human
cucaguccuuauuugccucuac

SEQ ID NO: 635716 - RNA, 22 nt, Human
gccgagcacagugcagcugccu

SEQ ID NO: 635717 - RNA, 22 nt, Human
aagcugcagaugugccugugga

SEQ ID NO: 635718 - RNA, 22 nt, Human
acagaauuuuuacacaggguaa

SEQ ID NO: 635719 - RNA, 22 nt, Human
aguauacaaauaaauguguaau

SEQ ID NO: 635720 - RNA, 22 nt, Human
cugcuuuagagcugagccucag

SEQ ID NO: 635721 - RNA, 22 nt, Human
gcccaggagguggaggugcagu

SEQ ID NO: 635722 - RNA, 22 nt, Human
uuucaguguaucuuccaaaagc

SEQ ID NO: 635723 - RNA, 23 nt, Human
uuucacauuaauguuuagcagga

SEQ ID NO: 635724 - RNA, 22 nt, Human
gcaggacaaaauuuccagggug

SEQ ID NO: 635725 - RNA, 22 nt, Human
ugagggggguaaucacuggguu

SEQ ID NO: 635726 - RNA, 22 nt, Human
uuuuuccuaagcaguggagcug

SEQ ID NO: 635727 - RNA, 22 nt, Human
acaggcucgugcgcgcacgugu

SEQ ID NO: 635728 - RNA, 22 nt, Human
agauacauauagaaaacaucaa

SEQ ID NO: 635729 - RNA, 20 nt, Human
uccuaacuauaaaguggcuc

SEQ ID NO: 635730 - RNA, 22 nt, Human
aggccugaggaccuucuggagg

SEQ ID NO: 635731 - RNA, 22 nt, Human
uuucagcugguaaaggaguagc

SEQ ID NO: 635732 - RNA, 22 nt, Human
auaguaaauuaucguggagaga

SEQ ID NO: 635733 - RNA, 22 nt, Human
uuagggacagcucuguagguga

SEQ ID NO: 635734 - RNA, 22 nt, Human
aaagccaggcuggccugggguu

SEQ ID NO: 635735 - RNA, 19 nt, Human
aauauuuuagccucuuccu

SEQ ID NO: 635736 - RNA, 22 nt, Human
acaagaauuuacauguagugga

SEQ ID NO: 635737 - RNA, 22 nt, Human
gaaccugauccaauauuuacuc

SEQ ID NO: 635738 - RNA, 22 nt, Human
uuauuguaggccuauuguagaa

SEQ ID NO: 635739 - RNA, 19 nt, Human
ccugugacuaucuuuguaa

SEQ ID NO: 635740 - RNA, 22 nt, Human
gcccagggcuucaaagagagaa

SEQ ID NO: 635741 - RNA, 17 nt, Human
ugaggccugcaucagug

SEQ ID NO: 635742 - RNA, 22 nt, Human
uuuaugacaagcauuacugauu

SEQ ID NO: 635743 - RNA, 22 nt, Human
uccucagcauggaaucuggacu

SEQ ID NO: 635744 - RNA, 22 nt, Human
aaauuuuguauucuaguucuag

SEQ ID NO: 635745 - RNA, 22 nt, Human
cuggcacauaguaggugcacag

SEQ ID NO: 635746 - RNA, 22 nt, Human
ucacaagauacaguuagaagca

SEQ ID NO: 635747 - RNA, 22 nt, Human
aggcagcagaaaacaaaugguu

SEQ ID NO: 635748 - RNA, 22 nt, Human
aucuuagagagucguguuuugu

SEQ ID NO: 635749 - RNA, 18 nt, Human
cuccuuucccuacaccuc

SEQ ID NO: 635750 - RNA, 22 nt, Human
auggcucagcccauggaagaaa

SEQ ID NO: 635751 - RNA, 22 nt, Human
uuuaugcagcguuucaccaccc

SEQ ID NO: 635752 - RNA, 22 nt, Human
uugaagaccuuuagugcuaugu

SEQ ID NO: 635753 - RNA, 22 nt, Human
cucucaguaaauuucugcccca

SEQ ID NO: 635754 - RNA, 22 nt, Human
ccacauggagcaggaggugggg

SEQ ID NO: 635755 - RNA, 22 nt, Human
uccaagcacuguuaauuaaacu

SEQ ID NO: 635756 - RNA, 22 nt, Human
gcuccuggcuucacugacauca

SEQ ID NO: 635757 - RNA, 22 nt, Human
agacaugccaagaaacccagug

SEQ ID NO: 635758 - RNA, 22 nt, Human
uaaaggcuuuuagugaugguaa

SEQ ID NO: 635759 - RNA, 22 nt, Human
ccugggcucuauccugacccag

SEQ ID NO: 635760 - RNA, 22 nt, Human
uccugggacucugccucaggcu

SEQ ID NO: 635761 - RNA, 22 nt, Human
auuuccuucaucagccuauccu

SEQ ID NO: 635762 - RNA, 22 nt, Human
ugcaggaaauuccaggguggcc

SEQ ID NO: 635763 - RNA, 22 nt, Human
gcccucagaggacagcugacuu

SEQ ID NO: 635764 - RNA, 22 nt, Human
acuagccaaguuuuacgacuaa

SEQ ID NO: 635765 - RNA, 22 nt, Human
gaaagcagcuaagucuuaugau

SEQ ID NO: 635766 - RNA, 22 nt, Human
uaucuguuguaguacagaugau

SEQ ID NO: 635767 - RNA, 22 nt, Human
agaggcaccaucuggaacagcc

SEQ ID NO: 635768 - RNA, 22 nt, Human
gguggcucacgccuguaagccc

SEQ ID NO: 635769 - RNA, 22 nt, Human
cagccuggagccacagcccagg

SEQ ID NO: 635770 - RNA, 17 nt, Human
cagcccugccguuccca

SEQ ID NO: 635771 - RNA, 22 nt, Human
cuacagaaaaucagccacaggc

SEQ ID NO: 635772 - RNA, 22 nt, Human
aggccagccuuguaaaugccuc

SEQ ID NO: 635773 - RNA, 22 nt, Human
auucuggggcugguuauuuuga

SEQ ID NO: 635774 - RNA, 22 nt, Human
aacauucaaguucugguuuaug

SEQ ID NO: 635775 - RNA, 22 nt, Human
agcuugaguuuuggaugaagug

SEQ ID NO: 635776 - RNA, 23 nt, Human
agggccacugggaaggauuacug

SEQ ID NO: 635777 - RNA, 22 nt, Human
cagcagucaggcaaaugggagg

SEQ ID NO: 635778 - RNA, 22 nt, Human
agguuggccaagcugcuggccc

SEQ ID NO: 635779 - RNA, 22 nt, Human
gcugagagaucaaggcaggauu

SEQ ID NO: 635780 - RNA, 22 nt, Human
cagaugugauucuucccucagc

SEQ ID NO: 635781 - RNA, 22 nt, Human
cagauacauuaaaaugaugauu

SEQ ID NO: 635782 - RNA, 22 nt, Human
ggaaggggccuugagcaaacug

SEQ ID NO: 635783 - RNA, 22 nt, Human
aggcuaagggaugacuggagug

SEQ ID NO: 635784 - RNA, 22 nt, Human
aaagaacaauguggaaucuccu

SEQ ID NO: 635785 - RNA, 22 nt, Human
uuucacaguuagcaugaggacu

SEQ ID NO: 635786 - RNA, 22 nt, Human
aaggguggauuucugagcucua

SEQ ID NO: 635787 - RNA, 22 nt, Human
ggugaggcagguggcugcugag

SEQ ID NO: 635788 - RNA, 22 nt, Human
ucaguauagcuucuaaacuaac

SEQ ID NO: 635789 - RNA, 22 nt, Human
gcauuuuagaauauuggagcaa

SEQ ID NO: 635790 - RNA, 22 nt, Human
auuugcuggugaaauagugaca

SEQ ID NO: 635791 - RNA, 22 nt, Human
uucaauaucauuguuuagucuc

SEQ ID NO: 635792 - RNA, 22 nt, Human
uucucaggugaggcugaggcug

SEQ ID NO: 635793 - RNA, 22 nt, Human
auguaugaagcuuuguuuggga

SEQ ID NO: 635794 - RNA, 22 nt, Human
uuccugguaaauuauguccagg

SEQ ID NO: 635795 - RNA, 22 nt, Human
gcuggagggguaauaggauggg

SEQ ID NO: 635796 - RNA, 22 nt, Human
ucuggacuuucggugcaagagu

SEQ ID NO: 635797 - RNA, 22 nt, Human
acaccuuugccccaagucauag

SEQ ID NO: 635798 - RNA, 22 nt, Human
auauuaaugagcaaguaaguga

SEQ ID NO: 635799 - RNA, 22 nt, Human
aggauuuacaaugauucuaggu

SEQ ID NO: 635800 - RNA, 22 nt, Human
cagcaucucauucauucauguu

SEQ ID NO: 635801 - RNA, 22 nt, Human
aggguauguuuuuaucuacugu

SEQ ID NO: 635802 - RNA, 22 nt, Human
uuccuucuggagcccggggagc

SEQ ID NO: 635803 - RNA, 22 nt, Human
gcacuugacccccagagcuggu

SEQ ID NO: 635804 - RNA, 22 nt, Human
cauugcacgggcgucugucugu

SEQ ID NO: 635805 - RNA, 22 nt, Human
uaccugcagcgggaauccauua

SEQ ID NO: 635806 - RNA, 22 nt, Human
ggcagggaguggagacucccua

SEQ ID NO: 635807 - RNA, 22 nt, Human
agcccaaggcuucccugcuggc

SEQ ID NO: 635808 - RNA, 22 nt, Human
uagguaguuacacagcaaugua

SEQ ID NO: 635809 - RNA, 22 nt, Human
cccugaggggcuuacuuugccc

SEQ ID NO: 635810 - RNA, 22 nt, Human
ugcagguggcuccagggacugc

SEQ ID NO: 635811 - RNA, 22 nt, Human
uuuggagagaugaaguucugug

SEQ ID NO: 635812 - RNA, 22 nt, Human
aacugagauuacaagagacauu

SEQ ID NO: 635813 - RNA, 22 nt, Human
gacuguggacucucaugauaga

SEQ ID NO: 635814 - RNA, 23 nt, Human
aggaaguuaugaagggagaauag

SEQ ID NO: 635815 - RNA, 22 nt, Human
cuggagggcugcagcgaggcug

SEQ ID NO: 635816 - RNA, 22 nt, Human
auguguucgcuagauugcuguu

SEQ ID NO: 635817 - RNA, 22 nt, Human
acaaauaugguacucggagaaa

SEQ ID NO: 635818 - RNA, 22 nt, Human
cuucuucucuacauccuuugau

SEQ ID NO: 635819 - RNA, 22 nt, Human
uggucauugcuauuguuucuca

SEQ ID NO: 635820 - RNA, 22 nt, Human
aaagcaagacaggaguuucaga

SEQ ID NO: 635821 - RNA, 22 nt, Human
aaaucugagaaauauuguccag

SEQ ID NO: 635822 - RNA, 22 nt, Human
agacuggguuugagacuuagca

SEQ ID NO: 635823 - RNA, 22 nt, Human
gcaaggauguacugcaauagga

SEQ ID NO: 635824 - RNA, 23 nt, Human
ggugggagauuauccagaauuau

SEQ ID NO: 635825 - RNA, 22 nt, Human
gggagcaggagccugccugcca

SEQ ID NO: 635826 - RNA, 21 nt, Human
uuagaaagcucacuacaguua

SEQ ID NO: 635827 - RNA, 22 nt, Human
guccucugaaagaugaaccaug

SEQ ID NO: 635828 - RNA, 22 nt, Human
gcuccuggguguggcugccccu

SEQ ID NO: 635829 - RNA, 22 nt, Human
ucuuucuuuaucaccugauaug

SEQ ID NO: 635830 - RNA, 21 nt, Human
ggguggguggaauuaggagug

SEQ ID NO: 635831 - RNA, 22 nt, Human
auccuuuaguccuacaacucga

SEQ ID NO: 635832 - RNA, 23 nt, Human
uggcauagugaggggcacagaga

SEQ ID NO: 635833 - RNA, 22 nt, Human
guuuucuuccugcaauuggcau

SEQ ID NO: 635834 - RNA, 22 nt, Human
uauauuguaggugcuauuugaa

SEQ ID NO: 635835 - RNA, 23 nt, Human
ugcaggggaggcuuaaagcaggu

SEQ ID NO: 635836 - RNA, 22 nt, Human
ggcaagugguagaacaucugag

SEQ ID NO: 635837 - RNA, 22 nt, Human
gggcuggaagacaggaaaugcu

SEQ ID NO: 635838 - RNA, 22 nt, Human
agaggcacggaggcugcaugga

SEQ ID NO: 635839 - RNA, 22 nt, Human
gaggcuggcagaaaagcacagg

SEQ ID NO: 635840 - RNA, 22 nt, Human
ggccuuggcuccugcagggagu

SEQ ID NO: 635841 - RNA, 19 nt, Human
ucccaggaagcaaauguca

SEQ ID NO: 635842 - RNA, 22 nt, Human
uaugaacugcucuuguguuuug

SEQ ID NO: 635843 - RNA, 22 nt, Human
ugccagaagugcuuuauaagug

SEQ ID NO: 635844 - RNA, 22 nt, Human
aaaggcaggcuuucacaucuca

SEQ ID NO: 635845 - RNA, 22 nt, Human
augagcaguagguucauggcug

SEQ ID NO: 635846 - RNA, 22 nt, Human
ucacccuuaguguacuaucaug

SEQ ID NO: 635847 - RNA, 22 nt, Human
gcuuggggucaugaggcugcug

SEQ ID NO: 635848 - RNA, 22 nt, Human
uuugcaaauuucgucuccucag

SEQ ID NO: 635849 - RNA, 22 nt, Human
aacauuuuuaagaccaagugcu

SEQ ID NO: 635850 - RNA, 22 nt, Human
cuugaaugggccauaagacggu

SEQ ID NO: 635851 - RNA, 22 nt, Human
caugcuggucagccaguggaug

SEQ ID NO: 635852 - RNA, 22 nt, Human
ugcuggaggccugacuguguuu

SEQ ID NO: 635853 - RNA, 22 nt, Human
ucugucuucuguagcuaauaau

SEQ ID NO: 635854 - RNA, 22 nt, Human
gaaguggguggugauaucacug

SEQ ID NO: 635855 - RNA, 19 nt, Human
aggggcacugucucuagag

SEQ ID NO: 635856 - RNA, 22 nt, Human
cugcugucaucuggcgcugugc

SEQ ID NO: 635857 - RNA, 21 nt, Human
uuaaagcuaugguagugggcu

SEQ ID NO: 635858 - RNA, 16 nt, Human
ucucuggguugcacag

SEQ ID NO: 635859 - RNA, 22 nt, Human
uuucuguggauuuuccauucaa

SEQ ID NO: 635860 - RNA, 20 nt, Human
gggcuccagcugugauucuu

SEQ ID NO: 635861 - RNA, 22 nt, Human
uuuguaacuuuagaauugaucc

SEQ ID NO: 635862 - RNA, 22 nt, Human
ucaaaaauaagauauucuggac

SEQ ID NO: 635863 - RNA, 22 nt, Human
acaggcagggaccuuggcuaag

SEQ ID NO: 635864 - RNA, 22 nt, Human
auuagcaauugugcaucuagua

SEQ ID NO: 635865 - RNA, 22 nt, Human
aaccagcuuugauacgcauuau

SEQ ID NO: 635866 - RNA, 22 nt, Human
acugggcuucacuuggcacauc

SEQ ID NO: 635867 - RNA, 22 nt, Human
agugaaauacugucguuuuuag

SEQ ID NO: 635868 - RNA, 22 nt, Human
cuggagauaaguaaagaggcaa

SEQ ID NO: 635869 - RNA, 22 nt, Human
acagccaaggaauuaggaaggg

SEQ ID NO: 635870 - RNA, 19 nt, Human
aucacagacgugccucauc

SEQ ID NO: 635871 - RNA, 22 nt, Human
agcuccaggcagcauuaauaaa

SEQ ID NO: 635872 - RNA, 22 nt, Human
aggagagggguaggauuaauuu

SEQ ID NO: 635873 - RNA, 22 nt, Human
uugauugaauuuugaaaaucua

SEQ ID NO: 635874 - RNA, 21 nt, Human
ccugagaucuggaguggcuuu

SEQ ID NO: 635875 - RNA, 22 nt, Human
ucucauuauccaucacugcacu

SEQ ID NO: 635876 - RNA, 22 nt, Human
uguuugugcugccuggugggca

SEQ ID NO: 635877 - RNA, 22 nt, Human
cucccccuuagcucuugucuuu

SEQ ID NO: 635878 - RNA, 22 nt, Human
ugcugcuuggcacccucagagu

SEQ ID NO: 635879 - RNA, 22 nt, Human
cugcugccggcgagccucccuu

SEQ ID NO: 635880 - RNA, 22 nt, Human
cugcuuuguguggucccuccag

SEQ ID NO: 635881 - RNA, 22 nt, Human
gggugguggccagcagugggca

SEQ ID NO: 635882 - RNA, 23 nt, Human
cccugcccauugagcaggacguc

SEQ ID NO: 635883 - RNA, 22 nt, Human
gaccagcuggugaaaaccaauu

SEQ ID NO: 635884 - RNA, 22 nt, Human
caagcagagacuagauagcugu

SEQ ID NO: 635885 - RNA, 23 nt, Human
gccuggguuguaacuagugcauc

SEQ ID NO: 635886 - RNA, 22 nt, Human
aaagagaugugccaaauagccu

SEQ ID NO: 635887 - RNA, 23 nt, Human
ugagcaagugaccaacugucugu

SEQ ID NO: 635888 - RNA, 22 nt, Human
ccuuuagaugaucucuuggaca

SEQ ID NO: 635889 - RNA, 22 nt, Human
auuugucucugcacuuuacuca

SEQ ID NO: 635890 - RNA, 22 nt, Human
ccaggucuuuggccuuggcacu

SEQ ID NO: 635891 - RNA, 22 nt, Human
ucugggccgcugcguuccauga

SEQ ID NO: 635892 - RNA, 22 nt, Human
uuuaagacucuuguaguacaca

SEQ ID NO: 635893 - RNA, 22 nt, Human
cagcucugaggaacacuccuuu

SEQ ID NO: 635894 - RNA, 22 nt, Human
ucugcugccucgguguggguac

SEQ ID NO: 635895 - RNA, 22 nt, Human
uauguucuuagaagaggcagca

SEQ ID NO: 635896 - RNA, 22 nt, Human
ucaggucccacugcuaguaagu

SEQ ID NO: 635897 - RNA, 22 nt, Human
uuuagacaggggcaaaauaagg

SEQ ID NO: 635898 - RNA, 20 nt, Human
auaauuuacccugcaccacu

SEQ ID NO: 635899 - RNA, 22 nt, Human
cuggaagaggacacacgaauca

SEQ ID NO: 635900 - RNA, 22 nt, Human
cugggcugcuugcugaaggggu

SEQ ID NO: 635901 - RNA, 22 nt, Human
agccccacacucucucugagaa

SEQ ID NO: 635902 - RNA, 22 nt, Human
gaaagggagugaagaugguaua

SEQ ID NO: 635903 - RNA, 22 nt, Human
ggcagcccuguggagaggccca

SEQ ID NO: 635904 - RNA, 22 nt, Human
cagguccucacgccucacccuu

SEQ ID NO: 635905 - RNA, 22 nt, Human
augagguaguauuagaaggaga

SEQ ID NO: 635906 - RNA, 22 nt, Human
ugcucugcaagcaggagcaaga

SEQ ID NO: 635907 - RNA, 22 nt, Human
acaggugauucaggcucuggga

SEQ ID NO: 635908 - RNA, 22 nt, Human
gucuccugcuagcaagcaccac

SEQ ID NO: 635909 - RNA, 22 nt, Human
ggggccugcgagguucaacuuc

SEQ ID NO: 635910 - RNA, 22 nt, Human
ucccuggagauaacuucuggga

SEQ ID NO: 635911 - RNA, 23 nt, Human
gcucagccucagcaggcccagga

SEQ ID NO: 635912 - RNA, 22 nt, Human
ugcagaaacagucauuaaugua

SEQ ID NO: 635913 - RNA, 23 nt, Human
uaggaagacagcaaaagaaugga

SEQ ID NO: 635914 - RNA, 20 nt, Human
ggaacaugaaugugaguggc

SEQ ID NO: 635915 - RNA, 22 nt, Human
ucaggcucaaagggccggauga

SEQ ID NO: 635916 - RNA, 22 nt, Human
cuuuaucauggagguaaauaug

SEQ ID NO: 635917 - RNA, 22 nt, Human
uucucagggucuggauggccug

SEQ ID NO: 635918 - RNA, 22 nt, Human
ucuggggagugccuaaguggaa

SEQ ID NO: 635919 - RNA, 22 nt, Human
ucugggagguggcagggugcau

SEQ ID NO: 635920 - RNA, 22 nt, Human
ccuggagauuucuucaagcuuu

SEQ ID NO: 635921 - RNA, 21 nt, Human
cuucagcaaauacuuggcagg

SEQ ID NO: 635922 - RNA, 22 nt, Human
auagauguacguauguaaauca

SEQ ID NO: 635923 - RNA, 22 nt, Human
cacauuuuuacugccaacuuaa

SEQ ID NO: 635924 - RNA, 22 nt, Human
aucagaccauccagcguggaug

SEQ ID NO: 635925 - RNA, 22 nt, Human
gugccuggcaugcgccggugcu

SEQ ID NO: 635926 - RNA, 20 nt, Human
cagauucuccacuaacauau

SEQ ID NO: 635927 - RNA, 22 nt, Human
cagagcaggcccacugcccucc

SEQ ID NO: 635928 - RNA, 19 nt, Human
uggcagacacaccuucuuc

SEQ ID NO: 635929 - RNA, 22 nt, Human
guuuucauuacugcugugauuu

SEQ ID NO: 635930 - RNA, 22 nt, Human
ucaaaugaggcugaugaaugug

SEQ ID NO: 635931 - RNA, 22 nt, Human
augcugugucaccuuaggauuu

SEQ ID NO: 635932 - RNA, 22 nt, Human
gcugcggucacugcgggggcug

SEQ ID NO: 635933 - RNA, 22 nt, Human
ugguccugcuacaggggauuag

SEQ ID NO: 635934 - RNA, 22 nt, Human
uuguacaaagauuucacagcuc

SEQ ID NO: 635935 - RNA, 22 nt, Human
gcagccaguauccucugagauu

SEQ ID NO: 635936 - RNA, 23 nt, Human
ugagaagccaggggagcgugagg

SEQ ID NO: 635937 - RNA, 22 nt, Human
uaacacuucagaugauuuuguu

SEQ ID NO: 635938 - RNA, 22 nt, Human
cuguagcaguguuccagcauug

SEQ ID NO: 635939 - RNA, 22 nt, Human
ugugugucugcacauguauaau

SEQ ID NO: 635940 - RNA, 22 nt, Human
ucccauucugccaaggacauug

SEQ ID NO: 635941 - RNA, 20 nt, Human
ccacccacgcgggcucugcc

SEQ ID NO: 635942 - RNA, 22 nt, Human
cagagggaaaaggggaguaaua

SEQ ID NO: 635943 - RNA, 22 nt, Human
uuuuauacuuaagacagaguuu

SEQ ID NO: 635944 - RNA, 17 nt, Human
uuuguacaacauuuuaa

SEQ ID NO: 635945 - RNA, 22 nt, Human
uggcacagccacugaaucggga

SEQ ID NO: 635946 - RNA, 22 nt, Human
cacagagaggcuugucuccaag

SEQ ID NO: 635947 - RNA, 22 nt, Human
aaaugaguuugccucuagauag

SEQ ID NO: 635948 - RNA, 22 nt, Human
ugcugcuuuuaguuggauagaa

SEQ ID NO: 635949 - RNA, 22 nt, Human
gaggaccacagaugagccugca

SEQ ID NO: 635950 - RNA, 22 nt, Human
aggagacauacuauaggaauau

SEQ ID NO: 635951 - RNA, 22 nt, Human
ucuucaaaaauacagguuuuca

SEQ ID NO: 635952 - RNA, 22 nt, Human
ggccagaggaccucucauagcc

SEQ ID NO: 635953 - RNA, 22 nt, Human
aaucaguuguccaaaguucaca

SEQ ID NO: 635954 - RNA, 22 nt, Human
gagcaucuaugugcuggguacu

SEQ ID NO: 635955 - RNA, 22 nt, Human
gcccugagcacacaguagcaaa

SEQ ID NO: 635956 - RNA, 22 nt, Human
uuguaacuuaaguuuugcauau

SEQ ID NO: 635957 - RNA, 22 nt, Human
aagcugccaccagcccagggca

SEQ ID NO: 635958 - RNA, 20 nt, Human
agaaaauguuuucagcugga

SEQ ID NO: 635959 - RNA, 22 nt, Human
acaugauuuuuaaagagauaau

SEQ ID NO: 635960 - RNA, 22 nt, Human
gagaaacacuguuaguuuauua

SEQ ID NO: 635961 - RNA, 21 nt, Human
uucucuggucaagcacacaua

SEQ ID NO: 635962 - RNA, 21 nt, Human
aggccucccuguugacagggc

SEQ ID NO: 635963 - RNA, 22 nt, Human
ucccagcagggccgaccagccu

SEQ ID NO: 635964 - RNA, 22 nt, Human
cuuaaggaaaagucucuuuuaa

SEQ ID NO: 635965 - RNA, 22 nt, Human
guacagagaagguuacauauga

SEQ ID NO: 635966 - RNA, 21 nt, Human
caguuauucuugaugugugug

SEQ ID NO: 635967 - RNA, 22 nt, Human
aggcagggugaugauaaugauu

SEQ ID NO: 635968 - RNA, 17 nt, Human
uccuucagggccucaca

SEQ ID NO: 635969 - RNA, 22 nt, Human
uggcucaggauaauuuucccaa

SEQ ID NO: 635970 - RNA, 22 nt, Human
auguucagcauucuauaaauau

SEQ ID NO: 635971 - RNA, 20 nt, Human
aacugagaguucaggaggag

SEQ ID NO: 635972 - RNA, 22 nt, Human
caggaaauucuuuuuaacagaa

SEQ ID NO: 635973 - RNA, 22 nt, Human
uccuagaacuccaggacagucc

SEQ ID NO: 635974 - RNA, 22 nt, Human
uucagagugguaugaagugaug

SEQ ID NO: 635975 - RNA, 22 nt, Human
cuggcagcguguuuaugaacau

SEQ ID NO: 635976 - RNA, 22 nt, Human
ucauccagccucaucaggagcu

SEQ ID NO: 635977 - RNA, 22 nt, Human
aaaaaugcugugguagcugugu

SEQ ID NO: 635978 - RNA, 22 nt, Human
uggcaacauggacaggucugcc

SEQ ID NO: 635979 - RNA, 22 nt, Human
caucaagagucuuacuaucagu

SEQ ID NO: 635980 - RNA, 22 nt, Human
cuggagaggcugggaacagguu

SEQ ID NO: 635981 - RNA, 22 nt, Human
agaaaguuguuggaggaaauga

SEQ ID NO: 635982 - RNA, 18 nt, Human
aagccaggucaagauaag

SEQ ID NO: 635983 - RNA, 22 nt, Human
acauucauggguuuuacauuau

SEQ ID NO: 635984 - RNA, 21 nt, Human
uuguagcuuguuagaccaugu

SEQ ID NO: 635985 - RNA, 22 nt, Human
aaaugcagcugggcaugagagg

SEQ ID NO: 635986 - RNA, 22 nt, Human
gugagggagguagauuucauca

SEQ ID NO: 635987 - RNA, 22 nt, Human
guagcauucugaguucgcagag

SEQ ID NO: 635988 - RNA, 23 nt, Human
cuggcucauccugguugcagugg

SEQ ID NO: 635989 - RNA, 23 nt, Human
gcccagagaggcucaccaggaau

SEQ ID NO: 635990 - RNA, 22 nt, Human
uaaggccaaacuauuauaguuc

SEQ ID NO: 635991 - RNA, 22 nt, Human
auguacaugugaauuuaggcaa

SEQ ID NO: 635992 - RNA, 20 nt, Human
ucuggccccuuccuguccug

SEQ ID NO: 635993 - RNA, 22 nt, Human
gaggcacugaauacuugagggu

SEQ ID NO: 635994 - RNA, 22 nt, Human
ggccucucuagcauccagccug

SEQ ID NO: 635995 - RNA, 23 nt, Human
gcagaggagcaagcuggacacca

SEQ ID NO: 635996 - RNA, 20 nt, Human
ugugucuuccuuucuuuaug

SEQ ID NO: 635997 - RNA, 22 nt, Human
uucuaacucaaagcuucuuuca

SEQ ID NO: 635998 - RNA, 22 nt, Human
auucauuggcuugaacuccacc

SEQ ID NO: 635999 - RNA, 17 nt, Human
agugugugaaauggugg

SEQ ID NO: 636000 - RNA, 22 nt, Human
caggacauugauccauuggcac

SEQ ID NO: 636001 - RNA, 22 nt, Human
uauaacaguuuaggugguguca

SEQ ID NO: 636002 - RNA, 22 nt, Human
aagaugcagcuuccacuuuugc

SEQ ID NO: 636003 - RNA, 22 nt, Human
uucugcuguaguugcaucuguu

SEQ ID NO: 636004 - RNA, 22 nt, Human
agcagggcucugccaugggccc

SEQ ID NO: 636005 - RNA, 22 nt, Human
augggcugcuuggcuuccaccc

SEQ ID NO: 636006 - RNA, 23 nt, Human
cuggucagaggcugcuggaaggg

SEQ ID NO: 636007 - RNA, 22 nt, Human
uccugcucugauggguucuccu

SEQ ID NO: 636008 - RNA, 22 nt, Human
uggggcuaaacacgccuggccu

SEQ ID NO: 636009 - RNA, 22 nt, Human
aaggcagcacagcaacugcuca

SEQ ID NO: 636010 - RNA, 22 nt, Human
gauaaagcaaggaugacugaag

SEQ ID NO: 636011 - RNA, 22 nt, Human
uaaggaaggggaaagacauguc

SEQ ID NO: 636012 - RNA, 22 nt, Human
uucacaauuucccuucaucagg

SEQ ID NO: 636013 - RNA, 22 nt, Human
guucuacuuucugugucuuuga

SEQ ID NO: 636014 - RNA, 22 nt, Human
acccuggggguggccagugcca

SEQ ID NO: 636015 - RNA, 22 nt, Human
cugucuccuccacugcauggga

SEQ ID NO: 636016 - RNA, 19 nt, Human
cugaggcccauguaccaug

SEQ ID NO: 636017 - RNA, 19 nt, Human
uuucccagcccuugcugug

SEQ ID NO: 636018 - RNA, 22 nt, Human
uugagaauguguuuugcuaagu

SEQ ID NO: 636019 - RNA, 21 nt, Human
ggaaaauucagagugcaauuu

SEQ ID NO: 636020 - RNA, 22 nt, Human
guccugaggaugcagagauaaa

SEQ ID NO: 636021 - RNA, 19 nt, Human
aucugaaguaggugcagcu

SEQ ID NO: 636022 - RNA, 22 nt, Human
guagcagcagagcagguccucc

SEQ ID NO: 636023 - RNA, 22 nt, Human
ccaggguggggcaggcccacug

SEQ ID NO: 636024 - RNA, 22 nt, Human
accaggaaacugugcccacgac

SEQ ID NO: 636025 - RNA, 22 nt, Human
ccugcuguccccugagccugga

SEQ ID NO: 636026 - RNA, 22 nt, Human
aaaggccaugguuggaguguuu

SEQ ID NO: 636027 - RNA, 23 nt, Human
agaagcugggagccuggggaugg

SEQ ID NO: 636028 - RNA, 22 nt, Human
uugcuuuagguauagaauccau

SEQ ID NO: 636029 - RNA, 22 nt, Human
uuucuaacguagacagggaggu

SEQ ID NO: 636030 - RNA, 22 nt, Human
acacaguaccccaaggcugggc

SEQ ID NO: 636031 - RNA, 22 nt, Human
ugccuggcuaauuuuuguaucc

SEQ ID NO: 636032 - RNA, 22 nt, Human
gcagauguaauggcuggagguc

SEQ ID NO: 636033 - RNA, 22 nt, Human
gacauugaaguauuuuugucga

SEQ ID NO: 636034 - RNA, 20 nt, Human
gccugagcuauugccaggau

SEQ ID NO: 636035 - RNA, 22 nt, Human
cuguggcuccagugaaccaaug

SEQ ID NO: 636036 - RNA, 22 nt, Human
gaaggccugugguagugagacg

SEQ ID NO: 636037 - RNA, 22 nt, Human
aacauucaaaacccaguucagu

SEQ ID NO: 636038 - RNA, 19 nt, Human
aaggcugguaccauagguu

SEQ ID NO: 636039 - RNA, 22 nt, Human
ucagccagugugcaccuggagu

SEQ ID NO: 636040 - RNA, 22 nt, Human
cuccgaacaguggcuccaaggc

SEQ ID NO: 636041 - RNA, 22 nt, Human
aggaauuacucaucugugguau

SEQ ID NO: 636042 - RNA, 22 nt, Human
uugcuaauagaagauuugggaa

SEQ ID NO: 636043 - RNA, 22 nt, Human
uauucacaugaaaacaaauuuu

SEQ ID NO: 636044 - RNA, 22 nt, Human
auauuaauuauuuacacaugag

SEQ ID NO: 636045 - RNA, 22 nt, Human
cguggccaguuucaagcuacca

SEQ ID NO: 636046 - RNA, 22 nt, Human
acacggcacuuuaggaaggggc

SEQ ID NO: 636047 - RNA, 22 nt, Human
uucaguaaaacacugcaauguc

SEQ ID NO: 636048 - RNA, 22 nt, Human
ccaggucugcgggcggcaggca

SEQ ID NO: 636049 - RNA, 22 nt, Human
uuccauccauaucuuguugagg

SEQ ID NO: 636050 - RNA, 22 nt, Human
acuuuguucuaauaguaucucu

SEQ ID NO: 636051 - RNA, 22 nt, Human
ucuguuccuguccuaagggcca

SEQ ID NO: 636052 - RNA, 22 nt, Human
ccaggaaggcguuguuccucuc

SEQ ID NO: 636053 - RNA, 22 nt, Human
gaaucucauucuaacuaguagg

SEQ ID NO: 636054 - RNA, 22 nt, Human
uggcagcaaaaccagaaucaga

SEQ ID NO: 636055 - RNA, 22 nt, Human
uuuauccauaucauuaaaaucu

SEQ ID NO: 636056 - RNA, 19 nt, Human
uucucugugcuagacucug

SEQ ID NO: 636057 - RNA, 17 nt, Human
cccuggcaaagaauggc

SEQ ID NO: 636058 - RNA, 21 nt, Human
agagcugggacuugccugaga

SEQ ID NO: 636059 - RNA, 22 nt, Human
uaucuacaguuaauaugucauc

SEQ ID NO: 636060 - RNA, 22 nt, Human
acagauggcacuuuuuaggacu

SEQ ID NO: 636061 - RNA, 22 nt, Human
gcagcaguggucuguagaagga

SEQ ID NO: 636062 - RNA, 22 nt, Human
ggagguggccugaaaauguggc

SEQ ID NO: 636063 - RNA, 22 nt, Human
agugucugcuuaucaguucuug

SEQ ID NO: 636064 - RNA, 21 nt, Human
ugcgugugcauggccuucggg

SEQ ID NO: 636065 - RNA, 22 nt, Human
cacagggaggcggucacuggcu

SEQ ID NO: 636066 - RNA, 22 nt, Human
uccugagcccuggggucagugu

SEQ ID NO: 636067 - RNA, 22 nt, Human
cucuggcuuguuaaugcauauu

SEQ ID NO: 636068 - RNA, 21 nt, Human
gcuggcuuuauucugcguuug

SEQ ID NO: 636069 - RNA, 22 nt, Human
aaucaucccaacugagaauccc

SEQ ID NO: 636070 - RNA, 22 nt, Human
uuucuauaacuggacuggauug

SEQ ID NO: 636071 - RNA, 22 nt, Human
aauaauugucaacuaugcuaca

SEQ ID NO: 636072 - RNA, 22 nt, Human
agcccuggaagccacaguccua

SEQ ID NO: 636073 - RNA, 22 nt, Human
agggggcuccuuggugugcaga

SEQ ID NO: 636074 - RNA, 22 nt, Human
gcuggccauauauuuugcuguu

SEQ ID NO: 636075 - RNA, 22 nt, Human
aguggucugggcuaaaugaggu

SEQ ID NO: 636076 - RNA, 22 nt, Human
cagaaauaucaccuggacucua

SEQ ID NO: 636077 - RNA, 19 nt, Human
uaugucccuuucccccauu

SEQ ID NO: 636078 - RNA, 22 nt, Human
uggagcagaggcugagguuggg

SEQ ID NO: 636079 - RNA, 22 nt, Human
uuuguaugugauaagacuauuc

SEQ ID NO: 636080 - RNA, 22 nt, Human
auggcaaaaacugcaguuaccu

SEQ ID NO: 636081 - RNA, 22 nt, Human
gucuucuggaagagagccagcu

SEQ ID NO: 636082 - RNA, 23 nt, Human
ucagagaacucgggcagaugacc

SEQ ID NO: 636083 - RNA, 20 nt, Human
ccucaggaugagggugagca

SEQ ID NO: 636084 - RNA, 22 nt, Human
uccucuuucucaacauuaguua

SEQ ID NO: 636085 - RNA, 22 nt, Human
cuuuaguuguuauuucuucaca

SEQ ID NO: 636086 - RNA, 22 nt, Human
ccagggaaggcugcuggcugug

SEQ ID NO: 636087 - RNA, 22 nt, Human
auuuuuuauauaccaagguggg

SEQ ID NO: 636088 - RNA, 22 nt, Human
uaugagaacgggggcguguggg

SEQ ID NO: 636089 - RNA, 22 nt, Human
aggaacuggggcuauucacccu

SEQ ID NO: 636090 - RNA, 22 nt, Human
auguuauuuauuauccucgguu

SEQ ID NO: 636091 - RNA, 22 nt, Human
ugaucagacaguuaugugcaug

SEQ ID NO: 636092 - RNA, 22 nt, Human
ugcaggcugcucaagacuuagu

SEQ ID NO: 636093 - RNA, 20 nt, Human
uucucuuuggguccagagaa

SEQ ID NO: 636094 - RNA, 21 nt, Human
gcagcaguguucuagaauacu

SEQ ID NO: 636095 - RNA, 22 nt, Human
gcacugggaaugagggcagcuu

SEQ ID NO: 636096 - RNA, 21 nt, Human
uguaacaaaauacugcagauu

SEQ ID NO: 636097 - RNA, 22 nt, Human
cugggcuuagcagcuccugguc

SEQ ID NO: 636098 - RNA, 22 nt, Human
ccucugggcuggaaaauuaaug

SEQ ID NO: 636099 - RNA, 22 nt, Human
uccgccaggacugagggcccau

SEQ ID NO: 636100 - RNA, 22 nt, Human
uaugugcacauuagagagaugg

SEQ ID NO: 636101 - RNA, 21 nt, Human
ugucugccugcuucuucacuc

SEQ ID NO: 636102 - RNA, 22 nt, Human
agcugcccuggcggagcugcuc

SEQ ID NO: 636103 - RNA, 22 nt, Human
uggaagugccuugcuggcugug

SEQ ID NO: 636104 - RNA, 22 nt, Human
aaaaggaggcaaacagccuaga

SEQ ID NO: 636105 - RNA, 22 nt, Human
agggucugugcaagaacacgcc

SEQ ID NO: 636106 - RNA, 22 nt, Human
gcugagccuagcugucuccugu

SEQ ID NO: 636107 - RNA, 19 nt, Human
gagguggguccccgcagcc

SEQ ID NO: 636108 - RNA, 22 nt, Human
agacuacaggagaaacucacuc

SEQ ID NO: 636109 - RNA, 22 nt, Human
gccuuuggugacaggcaugugu

SEQ ID NO: 636110 - RNA, 22 nt, Human
cauuucuccgccgagaucacug

SEQ ID NO: 636111 - RNA, 22 nt, Human
uaagacauccuggauguucaaa

SEQ ID NO: 636112 - RNA, 22 nt, Human
uuacacagaaacacuguucaga

SEQ ID NO: 636113 - RNA, 22 nt, Human
uugaaauuuuaggccuugcaau

SEQ ID NO: 636114 - RNA, 22 nt, Human
uuuuuuaguuaggucagaaugu

SEQ ID NO: 636115 - RNA, 22 nt, Human
uaggaaauaaauacuuaugguu

SEQ ID NO: 636116 - RNA, 20 nt, Human
ggcaggugcucgcuuggucu

SEQ ID NO: 636117 - RNA, 22 nt, Human
aguuuucuuucgcaaagguaca

SEQ ID NO: 636118 - RNA, 22 nt, Human
auccaugaucaauuuauuacua

SEQ ID NO: 636119 - RNA, 22 nt, Human
aggcggguacccuggcucgaaa

SEQ ID NO: 636120 - RNA, 22 nt, Human
gaaugcauuccacgguagugau

SEQ ID NO: 636121 - RNA, 22 nt, Human
cagacuggcugaaggccgagug

SEQ ID NO: 636122 - RNA, 22 nt, Human
agacccacacuuugaguagcaa

SEQ ID NO: 636123 - RNA, 22 nt, Human
agggaaggcuuuugacauuucc

SEQ ID NO: 636124 - RNA, 22 nt, Human
ccuggagggacccuggcccugu

SEQ ID NO: 636125 - RNA, 22 nt, Human
guccucaggaaagcagauaaca

SEQ ID NO: 636126 - RNA, 22 nt, Human
aaucuuggaaguguccacuggu

SEQ ID NO: 636127 - RNA, 22 nt, Human
uggagaaggggcagggucucca

SEQ ID NO: 636128 - RNA, 19 nt, Human
ucagcuggcaggccuccuc

SEQ ID NO: 636129 - RNA, 22 nt, Human
accugguuccuccucacugcug

SEQ ID NO: 636130 - RNA, 22 nt, Human
agccaggccuuagggagaggca

SEQ ID NO: 636131 - RNA, 22 nt, Human
gggcacugagaauuuuccacuu

SEQ ID NO: 636132 - RNA, 22 nt, Human
gcuggcuggcugugcaaaggca

SEQ ID NO: 636133 - RNA, 22 nt, Human
aggucaaguuuagauagaguua

SEQ ID NO: 636134 - RNA, 22 nt, Human
gagggccagaucccaggaggaa

SEQ ID NO: 636135 - RNA, 22 nt, Human
uccuuggcuuucuggagcuucu

SEQ ID NO: 636136 - RNA, 22 nt, Human
ucuacauuuucuuuauguacau

SEQ ID NO: 636137 - RNA, 22 nt, Human
aagauauagauggugguauaaa

SEQ ID NO: 636138 - RNA, 22 nt, Human
gagccagcuacauggucugcaa

SEQ ID NO: 636139 - RNA, 22 nt, Human
gaggaagaugguugaguggucc

SEQ ID NO: 636140 - RNA, 22 nt, Human
ggcaguggguggaucucaggga

SEQ ID NO: 636141 - RNA, 22 nt, Human
ccacugaaggucaacauagagc

SEQ ID NO: 636142 - RNA, 22 nt, Human
ugugucauagagagcacaaauc

SEQ ID NO: 636143 - RNA, 22 nt, Human
agcuucucucuuugcacucaca

SEQ ID NO: 636144 - RNA, 22 nt, Human
uuuuccagauuggacuuagucc

SEQ ID NO: 636145 - RNA, 22 nt, Human
uugggugcugucauggggcacg

SEQ ID NO: 636146 - RNA, 22 nt, Human
ggucagguagcucugacaggcc

SEQ ID NO: 636147 - RNA, 22 nt, Human
ucuucuuccucauuuauacaua

SEQ ID NO: 636148 - RNA, 22 nt, Human
agccaagggucagcugcacaga

SEQ ID NO: 636149 - RNA, 23 nt, Human
ggauaaaucucagcuucuuccau

SEQ ID NO: 636150 - RNA, 22 nt, Human
ccugucaccuagguacugagca

SEQ ID NO: 636151 - RNA, 22 nt, Human
aauuuguuauaacuugggcuga

SEQ ID NO: 636152 - RNA, 22 nt, Human
acauguaaaagauaaauuaaca

SEQ ID NO: 636153 - RNA, 22 nt, Human
ucaauucugguccucaggaacu

SEQ ID NO: 636154 - RNA, 22 nt, Human
gcauugauucugaagugaaaug

SEQ ID NO: 636155 - RNA, 22 nt, Human
cuggcugguccucggggacagc

SEQ ID NO: 636156 - RNA, 22 nt, Human
uccagcucccacucucacugcu

SEQ ID NO: 636157 - RNA, 23 nt, Human
ucccagccucuucucuugcauac

SEQ ID NO: 636158 - RNA, 22 nt, Human
ggagagucugcuggccacagug

SEQ ID NO: 636159 - RNA, 22 nt, Human
ggccucagaggaggugugaguc

SEQ ID NO: 636160 - RNA, 22 nt, Human
uaucaguagauaaacggauugc

SEQ ID NO: 636161 - RNA, 22 nt, Human
ccuggccucuccgaguaaccug

SEQ ID NO: 636162 - RNA, 22 nt, Human
agauuucaauggauauugcaag

SEQ ID NO: 636163 - RNA, 22 nt, Human
aggcccuguaagguguggagau

SEQ ID NO: 636164 - RNA, 22 nt, Human
ugcaaggcuauucacauguauu

SEQ ID NO: 636165 - RNA, 22 nt, Human
ggugcugacauucagagucugg

SEQ ID NO: 636166 - RNA, 22 nt, Human
augggcaggcaagguggcgagu

SEQ ID NO: 636167 - RNA, 20 nt, Human
ugccccaggccugcaccugc

SEQ ID NO: 636168 - RNA, 22 nt, Human
gaaaaugagccucagcuacauu

SEQ ID NO: 636169 - RNA, 23 nt, Human
aggagaagagauuuccacaugca

SEQ ID NO: 636170 - RNA, 22 nt, Human
auagcaaaaggcaccagaguga

SEQ ID NO: 636171 - RNA, 22 nt, Human
auuguacaaaaaaguagaccuu

SEQ ID NO: 636172 - RNA, 22 nt, Human
ugccuccauguuucagcaucua

SEQ ID NO: 636173 - RNA, 22 nt, Human
uacuguaaugagauuagcuucc

SEQ ID NO: 636174 - RNA, 22 nt, Human
ugguugccucucagagauuccg

SEQ ID NO: 636175 - RNA, 22 nt, Human
gaugggcaucaaacaugacgug

SEQ ID NO: 636176 - RNA, 22 nt, Human
ucgcuuuaauggucuucacagc

SEQ ID NO: 636177 - RNA, 22 nt, Human
gcccucagcuccuggacacaug

SEQ ID NO: 636178 - RNA, 22 nt, Human
caucaaauaggaauauuuggca

SEQ ID NO: 636179 - RNA, 22 nt, Human
agcucccagggcugggcaaguu

SEQ ID NO: 636180 - RNA, 22 nt, Human
cacuguggaauuagaauaaccu

SEQ ID NO: 636181 - RNA, 22 nt, Human
gcucugcucuugacuuaccagg

SEQ ID NO: 636182 - RNA, 22 nt, Human
ucuuuacuggaauggaacuuuc

SEQ ID NO: 636183 - RNA, 17 nt, Human
ugagacagggcaggccc

SEQ ID NO: 636184 - RNA, 22 nt, Human
aaacucugccauuuuuggccug

SEQ ID NO: 636185 - RNA, 22 nt, Human
ucaagcaaaguuuagcugguua

SEQ ID NO: 636186 - RNA, 22 nt, Human
agagaacagccuccuagagaaa

SEQ ID NO: 636187 - RNA, 22 nt, Human
cagcugugcugauugcucagua

SEQ ID NO: 636188 - RNA, 22 nt, Human
cuauuauuagcaaaagguggau

SEQ ID NO: 636189 - RNA, 22 nt, Human
augaauggauggggucaagaua

SEQ ID NO: 636190 - RNA, 22 nt, Human
gaacaaacagucaggacagucu

SEQ ID NO: 636191 - RNA, 22 nt, Human
agggcugccugcucugcauuga

SEQ ID NO: 636192 - RNA, 22 nt, Human
ggcagauggggugacaagagag

SEQ ID NO: 636193 - RNA, 22 nt, Human
ucaggagguguaacgaauacag

SEQ ID NO: 636194 - RNA, 22 nt, Human
ggugucugauuccaaggccaca

SEQ ID NO: 636195 - RNA, 22 nt, Human
acaaggaucuguguaggcaggc

SEQ ID NO: 636196 - RNA, 22 nt, Human
agcuaaugggagacccuuucac

SEQ ID NO: 636197 - RNA, 21 nt, Human
caauaaacugcacauugagac

SEQ ID NO: 636198 - RNA, 22 nt, Human
uauuugcuuugcuuuauagaga

SEQ ID NO: 636199 - RNA, 22 nt, Human
ccucaggcagugguauggaugg

SEQ ID NO: 636200 - RNA, 22 nt, Human
aucuaacagcaacaccagaaua

SEQ ID NO: 636201 - RNA, 22 nt, Human
ugauuccacucugaggaucgua

SEQ ID NO: 636202 - RNA, 22 nt, Human
uuucuuaugggguaguccuuua

SEQ ID NO: 636203 - RNA, 22 nt, Human
ucagagagcuggugggcagagg

SEQ ID NO: 636204 - RNA, 22 nt, Human
ccaggcugcuguugguguccgc

SEQ ID NO: 636205 - RNA, 22 nt, Human
cagggcauuacuucagguccuu

SEQ ID NO: 636206 - RNA, 22 nt, Human
guccugggaggggcugguccug

SEQ ID NO: 636207 - RNA, 22 nt, Human
aguguuuacucaaaggguucca

SEQ ID NO: 636208 - RNA, 22 nt, Human
cuggcugugugcccccggcacc

SEQ ID NO: 636209 - RNA, 21 nt, Human
ggcuggucgcgugcaugucuc

SEQ ID NO: 636210 - RNA, 22 nt, Human
uggaaguggcagaggaaguggu

SEQ ID NO: 636211 - RNA, 22 nt, Human
agccagcuggagaccacuguuu

SEQ ID NO: 636212 - RNA, 19 nt, Human
aggacccuuauccuggcuu

SEQ ID NO: 636213 - RNA, 22 nt, Human
gcuggagagauaggcauggggu

SEQ ID NO: 636214 - RNA, 22 nt, Human
caaggccuucgucuccuagcuu

SEQ ID NO: 636215 - RNA, 23 nt, Human
acugggcugaaauuuuucauggc

SEQ ID NO: 636216 - RNA, 22 nt, Human
uuuuggaaucauuuacagagca

SEQ ID NO: 636217 - RNA, 22 nt, Human
guuucuaauuggaacuuugagg

SEQ ID NO: 636218 - RNA, 22 nt, Human
uucagugugaagcuucugaaag

SEQ ID NO: 636219 - RNA, 22 nt, Human
cagagcuuucugucacauuagu

SEQ ID NO: 636220 - RNA, 22 nt, Human
cuccagguuacuuagccuagcu

SEQ ID NO: 636221 - RNA, 23 nt, Human
aauuacaaccaagaacuggaagg

SEQ ID NO: 636222 - RNA, 22 nt, Human
ucaugcaguuucuuaucugcca

SEQ ID NO: 636223 - RNA, 22 nt, Human
cccagguccccaccugucugcu

SEQ ID NO: 636224 - RNA, 22 nt, Human
agcaccuugaucuuggacuucc

SEQ ID NO: 636225 - RNA, 22 nt, Human
uucuaacucuacacuagcuuug

SEQ ID NO: 636226 - RNA, 22 nt, Human
gaggugugguccucagccccca

SEQ ID NO: 636227 - RNA, 22 nt, Human
gccccagcucugccacaacuag

SEQ ID NO: 636228 - RNA, 17 nt, Human
cacuugcuggucuaccu

SEQ ID NO: 636229 - RNA, 22 nt, Human
caggccaagccuccccagcucc

SEQ ID NO: 636230 - RNA, 22 nt, Human
cuggugaucuugggcaagucac

SEQ ID NO: 636231 - RNA, 22 nt, Human
auaugucgcuacaucauuagau

SEQ ID NO: 636232 - RNA, 22 nt, Human
uucaguaugauuccuccaguag

SEQ ID NO: 636233 - RNA, 22 nt, Human
cuacuuguucacuguaggucgc

SEQ ID NO: 636234 - RNA, 22 nt, Human
aagauacaucauucaggaguga

SEQ ID NO: 636235 - RNA, 22 nt, Human
uguccccuuucuuuccuucgua

SEQ ID NO: 636236 - RNA, 22 nt, Human
gagcucugggaaacaaagugua

SEQ ID NO: 636237 - RNA, 22 nt, Human
auugaaacaaguugcuuucuau

SEQ ID NO: 636238 - RNA, 22 nt, Human
aucuuuccuguuuucagacagc

SEQ ID NO: 636239 - RNA, 22 nt, Human
aggcugguguguccugaagccu

SEQ ID NO: 636240 - RNA, 22 nt, Human
aucuuccaagcucccuggugua

SEQ ID NO: 636241 - RNA, 22 nt, Human
ucugaaaugaccuuuccccacu

SEQ ID NO: 636242 - RNA, 22 nt, Human
uaacauugaguccacuaaacag

SEQ ID NO: 636243 - RNA, 22 nt, Human
gucagagagggcacgugcacac

SEQ ID NO: 636244 - RNA, 22 nt, Human
accaggccuagcaaguacauua

SEQ ID NO: 636245 - RNA, 22 nt, Human
ucccucaggugguucuuguuuc

SEQ ID NO: 636246 - RNA, 22 nt, Human
agacagguagcaggacagauau

SEQ ID NO: 636247 - RNA, 22 nt, Human
agcaccaggcaguauaucaaag

SEQ ID NO: 636248 - RNA, 22 nt, Human
uggcuggcuuucuuguauuuac

SEQ ID NO: 636249 - RNA, 22 nt, Human
gucuauuugggaucaugauaug

SEQ ID NO: 636250 - RNA, 22 nt, Human
ccagugcuucuuugcuagcugg

SEQ ID NO: 636251 - RNA, 22 nt, Human
cucuuuucaaaccuguuuaugg

SEQ ID NO: 636252 - RNA, 22 nt, Human
agccauuuuccugaaauauaac

SEQ ID NO: 636253 - RNA, 22 nt, Human
ugcauaaacuucucugguguga

SEQ ID NO: 636254 - RNA, 22 nt, Human
cuucaguuaugugccaaggaca

SEQ ID NO: 636255 - RNA, 22 nt, Human
caguguguccucagaauauaua

SEQ ID NO: 636256 - RNA, 22 nt, Human
cagcugagagacaaugagucau

SEQ ID NO: 636257 - RNA, 22 nt, Human
acugaggucucagguggggaag

SEQ ID NO: 636258 - RNA, 22 nt, Human
ugucaugcuuauguuacauacu

SEQ ID NO: 636259 - RNA, 22 nt, Human
cacuugaaaaucagaggaaauu

SEQ ID NO: 636260 - RNA, 22 nt, Human
agagggagaaaagaaucaguug

SEQ ID NO: 636261 - RNA, 22 nt, Human
cuguuuaucauguacauuucca

SEQ ID NO: 636262 - RNA, 22 nt, Human
uaggcuccaagagcgaacucag

SEQ ID NO: 636263 - RNA, 22 nt, Human
ugggcaagucacuucugucuuu

SEQ ID NO: 636264 - RNA, 22 nt, Human
caguacacaagcuuucauguau

SEQ ID NO: 636265 - RNA, 22 nt, Human
gaaggcaguaaauggcuguuuu

SEQ ID NO: 636266 - RNA, 22 nt, Human
aagauacagugaaagggcauug

SEQ ID NO: 636267 - RNA, 22 nt, Human
uuuucugaaguuuaagacauuu

SEQ ID NO: 636268 - RNA, 22 nt, Human
agagaaauuucccugccuucug

SEQ ID NO: 636269 - RNA, 19 nt, Human
ccaguagagacagcugcag

SEQ ID NO: 636270 - RNA, 22 nt, Human
gcacaaacugcaauuacuuuug

SEQ ID NO: 636271 - RNA, 22 nt, Human
acaucaguaauuaagucucaag

SEQ ID NO: 636272 - RNA, 22 nt, Human
uuaauuuauguccaaaccagau

SEQ ID NO: 636273 - RNA, 22 nt, Human
gccuccccaggggugucaugag

SEQ ID NO: 636274 - RNA, 22 nt, Human
agguccuggucuugagucuuaa

SEQ ID NO: 636275 - RNA, 22 nt, Human
uuguacaaaugcauauuccugg

SEQ ID NO: 636276 - RNA, 22 nt, Human
uacccagcaaucccuagagguu

SEQ ID NO: 636277 - RNA, 22 nt, Human
ucucugggaaauggagaauuuu

SEQ ID NO: 636278 - RNA, 22 nt, Human
auauaugcgcaggcacccagcu

SEQ ID NO: 636279 - RNA, 22 nt, Human
uuacaagugucagguacuggca

SEQ ID NO: 636280 - RNA, 22 nt, Human
aggcugaggugugcugugaucg

SEQ ID NO: 636281 - RNA, 22 nt, Human
gcuuccucgcugggcagaggca

SEQ ID NO: 636282 - RNA, 22 nt, Human
auuucuguuauaccuuucucag

SEQ ID NO: 636283 - RNA, 22 nt, Human
uucugacaauucaguaacagca

SEQ ID NO: 636284 - RNA, 22 nt, Human
ggcugugcuuugcccaaagggc

SEQ ID NO: 636285 - RNA, 22 nt, Human
aucauuuaaaacaagucucuau

SEQ ID NO: 636286 - RNA, 22 nt, Human
ucugcaaauauuagcuuagaca

SEQ ID NO: 636287 - RNA, 22 nt, Human
agaggucagaggucgccagguc

SEQ ID NO: 636288 - RNA, 21 nt, Human
ugagagaguagcaggacauau

SEQ ID NO: 636289 - RNA, 22 nt, Human
ucugaugucugaaaugcucuug

SEQ ID NO: 636290 - RNA, 22 nt, Human
gggugcugaggaagacagcagg

SEQ ID NO: 636291 - RNA, 22 nt, Human
gccuucagcccugacuggccag

SEQ ID NO: 636292 - RNA, 22 nt, Human
ugaccucuugucggagcuccag

SEQ ID NO: 636293 - RNA, 22 nt, Human
augaaugcauacauuugucaag

SEQ ID NO: 636294 - RNA, 19 nt, Human
uguguaaagucugugguca

SEQ ID NO: 636295 - RNA, 22 nt, Human
cauuuccacucugggagucaga

SEQ ID NO: 636296 - RNA, 22 nt, Human
caaagugagagaauggcagaaa

SEQ ID NO: 636297 - RNA, 22 nt, Human
ggcaggcaggagcgugcuuggg

SEQ ID NO: 636298 - RNA, 22 nt, Human
ugaacacagggccaaacuugag

SEQ ID NO: 636299 - RNA, 22 nt, Human
uauaccaaaauaucagaaaggg

SEQ ID NO: 636300 - RNA, 22 nt, Human
aguucugguugcccaugacauc

SEQ ID NO: 636301 - RNA, 22 nt, Human
uuuucuccuaagacccuucacc

SEQ ID NO: 636302 - RNA, 22 nt, Human
ugcacugauguuuugccaagga

SEQ ID NO: 636303 - RNA, 22 nt, Human
gagcucauccccaugguccguc

SEQ ID NO: 636304 - RNA, 22 nt, Human
uuuauuuggcaucucugccaag

SEQ ID NO: 636305 - RNA, 22 nt, Human
uuauucacucugaagccauccu

SEQ ID NO: 636306 - RNA, 22 nt, Human
ccuggcucuagaggccacuccu

SEQ ID NO: 636307 - RNA, 23 nt, Human
agggaagggggcuuauuccacag

SEQ ID NO: 636308 - RNA, 21 nt, Human
gaauaguucuguggcagcagu

SEQ ID NO: 636309 - RNA, 22 nt, Human
uauggcuuuaaacaacuuaggu

SEQ ID NO: 636310 - RNA, 22 nt, Human
cuccuuccugccccagugauaa

SEQ ID NO: 636311 - RNA, 22 nt, Human
uucagacuuaaaagaucccagc

SEQ ID NO: 636312 - RNA, 22 nt, Human
aaugccuucaaguaucugagga

SEQ ID NO: 636313 - RNA, 22 nt, Human
uuguggcuucuacgcccacagg

SEQ ID NO: 636314 - RNA, 22 nt, Human
ugggaggcagaaguugacugga

SEQ ID NO: 636315 - RNA, 22 nt, Human
cuugaaagaagggucuuuuaau

SEQ ID NO: 636316 - RNA, 22 nt, Human
gcccccagcucucaagcucaaa

SEQ ID NO: 636317 - RNA, 22 nt, Human
caggagaucuuaggaauucuua

SEQ ID NO: 636318 - RNA, 18 nt, Human
acagugcugucacugcuu

SEQ ID NO: 636319 - RNA, 22 nt, Human
agaguccaaaugugcaguuaug

SEQ ID NO: 636320 - RNA, 22 nt, Human
gcucugugcaguucagggacac

SEQ ID NO: 636321 - RNA, 22 nt, Human
aauacaguagguaauaguucau

SEQ ID NO: 636322 - RNA, 22 nt, Human
cuccgugcuauuuuaguaucgc

SEQ ID NO: 636323 - RNA, 22 nt, Human
auaucauucugauguauaucuu

SEQ ID NO: 636324 - RNA, 22 nt, Human
caccaggugcuggaggacauca

SEQ ID NO: 636325 - RNA, 18 nt, Human
agguggccugggagcuuu

SEQ ID NO: 636326 - RNA, 22 nt, Human
uuuauaugaaagugaccagugg

SEQ ID NO: 636327 - RNA, 22 nt, Human
auuugcagaagggagggggacc

SEQ ID NO: 636328 - RNA, 22 nt, Human
uuugaacuaccucuccuuagca

SEQ ID NO: 636329 - RNA, 22 nt, Human
cugugacuagaccugcaggaga

SEQ ID NO: 636330 - RNA, 22 nt, Human
agaccuggaaguucaagagaaa

SEQ ID NO: 636331 - RNA, 22 nt, Human
ggcuccaugcuccgcuucuugu

SEQ ID NO: 636332 - RNA, 22 nt, Human
aguuuauucucuggucuuagua

SEQ ID NO: 636333 - RNA, 22 nt, Human
gagucccaugaugauagccaca

SEQ ID NO: 636334 - RNA, 22 nt, Human
uucuuugggcaauugcuggccc

SEQ ID NO: 636335 - RNA, 22 nt, Human
guccagagguccaggaucaagg

SEQ ID NO: 636336 - RNA, 22 nt, Human
cagauuuaagagauaaacagug

SEQ ID NO: 636337 - RNA, 22 nt, Human
gcacccagccagcaucucagag

SEQ ID NO: 636338 - RNA, 22 nt, Human
gggaucuguguugcgauggauu

SEQ ID NO: 636339 - RNA, 19 nt, Human
uuuagaaguugaaacucug

SEQ ID NO: 636340 - RNA, 22 nt, Human
accugguuugucucaucaccac

SEQ ID NO: 636341 - RNA, 22 nt, Human
uuuaacuggucuccugcugcuu

SEQ ID NO: 636342 - RNA, 22 nt, Human
gccaggcuccccggaucccugg

SEQ ID NO: 636343 - RNA, 22 nt, Human
guuagaaacacauucuuauuga

SEQ ID NO: 636344 - RNA, 22 nt, Human
ccagcugcugacaugggcaggu

SEQ ID NO: 636345 - RNA, 22 nt, Human
ucaaguguaguggugucagguc

SEQ ID NO: 636346 - RNA, 22 nt, Human
uaaaagacccucuagaguccca

SEQ ID NO: 636347 - RNA, 22 nt, Human
cagccccucccucaggcaggug

SEQ ID NO: 636348 - RNA, 22 nt, Human
gagaggaagccaggggguguug

SEQ ID NO: 636349 - RNA, 22 nt, Human
uggaugugucgcccuggcucuc

SEQ ID NO: 636350 - RNA, 22 nt, Human
ugacuauuacggccacgaauuu

SEQ ID NO: 636351 - RNA, 20 nt, Human
agcugguuaucuuaauucuu

SEQ ID NO: 636352 - RNA, 22 nt, Human
aacucacagcuguuuggauuag

SEQ ID NO: 636353 - RNA, 22 nt, Human
cuaggcucagucucuggucugu

SEQ ID NO: 636354 - RNA, 22 nt, Human
ucacuagcauuguugaaggacu

SEQ ID NO: 636355 - RNA, 22 nt, Human
cucaguuugugugauauugucu

SEQ ID NO: 636356 - RNA, 22 nt, Human
aaagugcaguccaugaaauuaa

SEQ ID NO: 636357 - RNA, 22 nt, Human
cagcauuuaaugcagugcuucc

SEQ ID NO: 636358 - RNA, 22 nt, Human
uugagcaaaucagauuguaauu

SEQ ID NO: 636359 - RNA, 18 nt, Human
cucaggccuuucccugug

SEQ ID NO: 636360 - RNA, 22 nt, Human
aggcuggagugcaauggcguga

SEQ ID NO: 636361 - RNA, 22 nt, Human
cauuuaaagguuguggguaaaa

SEQ ID NO: 636362 - RNA, 22 nt, Human
agguaggauagauaggaagacc

SEQ ID NO: 636363 - RNA, 22 nt, Human
gcagcuggauuucaagagggag

SEQ ID NO: 636364 - RNA, 22 nt, Human
gacacaggggggcgcuagaaga

SEQ ID NO: 636365 - RNA, 22 nt, Human
ugcucuggguucuugcuguuac

SEQ ID NO: 636366 - RNA, 23 nt, Human
gccagcuuuggucugucuccuag

SEQ ID NO: 636367 - RNA, 22 nt, Human
cugccaugcaguuagucccuca

SEQ ID NO: 636368 - RNA, 22 nt, Human
ugucucuuacuuugauucuugg

SEQ ID NO: 636369 - RNA, 20 nt, Human
ugacaacaugccuuuugcuu

SEQ ID NO: 636370 - RNA, 22 nt, Human
caagaggcaaauugucuagaag

SEQ ID NO: 636371 - RNA, 22 nt, Human
gggcuccagccagcuccuugug

SEQ ID NO: 636372 - RNA, 22 nt, Human
auucuucauacagacaaguccu

SEQ ID NO: 636373 - RNA, 20 nt, Human
acaucugagaaacacuuaaa

SEQ ID NO: 636374 - RNA, 22 nt, Human
gguccugucugacaucacugcu

SEQ ID NO: 636375 - RNA, 22 nt, Human
aaucuaagccaccaguaguuuc

SEQ ID NO: 636376 - RNA, 23 nt, Human
ggccucuguguucugcccacaug

SEQ ID NO: 636377 - RNA, 22 nt, Human
acagggagucugaggggauagu

SEQ ID NO: 636378 - RNA, 22 nt, Human
gcaucauuuucuucuuccugca

SEQ ID NO: 636379 - RNA, 22 nt, Human
aaauaagugugggccagucaaa

SEQ ID NO: 636380 - RNA, 22 nt, Human
ccaggacacugcuucacagcag

SEQ ID NO: 636381 - RNA, 22 nt, Human
caggauuaaggugaggggagua

SEQ ID NO: 636382 - RNA, 22 nt, Human
uccagggccccccaguugcacg

SEQ ID NO: 636383 - RNA, 22 nt, Human
ucacagugaggcaguucuugua

SEQ ID NO: 636384 - RNA, 22 nt, Human
uuucucaguucucugcaaggag

SEQ ID NO: 636385 - RNA, 23 nt, Human
uccagcagccaagaaggguagaa

SEQ ID NO: 636386 - RNA, 22 nt, Human
ugucacagucucgugagcaucu

SEQ ID NO: 636387 - RNA, 22 nt, Human
acagagagaaacaaucagcagc

SEQ ID NO: 636388 - RNA, 22 nt, Human
aaggcuccagugaaugcuggca

SEQ ID NO: 636389 - RNA, 22 nt, Human
cccaguggggagcugagguuca

SEQ ID NO: 636390 - RNA, 22 nt, Human
uucuuucucuccacaaggcuug

SEQ ID NO: 636391 - RNA, 22 nt, Human
cacagaggauuuuuagggcagu

SEQ ID NO: 636392 - RNA, 22 nt, Human
caauugcuuuuccaagggcaga

SEQ ID NO: 636393 - RNA, 22 nt, Human
ugauucugaucaucaucauggu

SEQ ID NO: 636394 - RNA, 22 nt, Human
ugacagugaaugacaagguucu

SEQ ID NO: 636395 - RNA, 20 nt, Human
ugcuccuaccacuucugccc

SEQ ID NO: 636396 - RNA, 22 nt, Human
agagcuggcugugggugacuuu

SEQ ID NO: 636397 - RNA, 22 nt, Human
uguguauuaccauuuuacagcu

SEQ ID NO: 636398 - RNA, 22 nt, Human
uuuucugugcccugcuagcugg

SEQ ID NO: 636399 - RNA, 21 nt, Human
ugguuaguuauuggcagugcc

SEQ ID NO: 636400 - RNA, 22 nt, Human
cuuuaagacuaaauuagaguuu

SEQ ID NO: 636401 - RNA, 22 nt, Human
aggaaguuggcauuuuguuuca

SEQ ID NO: 636402 - RNA, 22 nt, Human
gcuuuuggaccucugauguuuc

SEQ ID NO: 636403 - RNA, 22 nt, Human
auccaucuugauguaauagcca

SEQ ID NO: 636404 - RNA, 22 nt, Human
uuccaaggcaacagccuaggcu

SEQ ID NO: 636405 - RNA, 22 nt, Human
aggcugagaaagugggaagaug

SEQ ID NO: 636406 - RNA, 22 nt, Human
ccuuugugagguccuguggggg

SEQ ID NO: 636407 - RNA, 22 nt, Human
uggggagaguuacaaggaaucu

SEQ ID NO: 636408 - RNA, 22 nt, Human
aagcuucacauugaacuugggu

SEQ ID NO: 636409 - RNA, 22 nt, Human
aguuucacagucugucauuguu

SEQ ID NO: 636410 - RNA, 22 nt, Human
cauggcuucgucacagagggca

SEQ ID NO: 636411 - RNA, 18 nt, Human
gacaaaaguacagacaga

SEQ ID NO: 636412 - RNA, 22 nt, Human
acccuuuagaaggcaucucagu

SEQ ID NO: 636413 - RNA, 22 nt, Human
ucuauugauuggcuuccuggau

SEQ ID NO: 636414 - RNA, 22 nt, Human
cacagaggaaaggcaguuggua

SEQ ID NO: 636415 - RNA, 22 nt, Human
caaggacacugagcuuuguaaa

SEQ ID NO: 636416 - RNA, 22 nt, Human
aggugucugggcuuuggaguca

SEQ ID NO: 636417 - RNA, 22 nt, Human
agcugcuggggagggcagacac

SEQ ID NO: 636418 - RNA, 22 nt, Human
guguucauggaugucaauuuga

SEQ ID NO: 636419 - RNA, 22 nt, Human
guggagggaaugaaucuucucu

SEQ ID NO: 636420 - RNA, 19 nt, Human
uccuggcacaguggaacca

SEQ ID NO: 636421 - RNA, 22 nt, Human
cucugggccaugcuacugcucu

SEQ ID NO: 636422 - RNA, 22 nt, Human
ugggacagggaaucugaucccc

SEQ ID NO: 636423 - RNA, 22 nt, Human
uaauauaccaaacuguaauuuu

SEQ ID NO: 636424 - RNA, 22 nt, Human
gccagcucaguuucaaaguagg

SEQ ID NO: 636425 - RNA, 22 nt, Human
aagccagguuccauggaggagc

SEQ ID NO: 636426 - RNA, 22 nt, Human
gaagauuaaacauauuuagugu

SEQ ID NO: 636427 - RNA, 22 nt, Human
guaaaaccugcuuuucaacacc

SEQ ID NO: 636428 - RNA, 22 nt, Human
ggugggguuuuaggcugcugca

SEQ ID NO: 636429 - RNA, 22 nt, Human
augcuauuaauauccagucuga

SEQ ID NO: 636430 - RNA, 22 nt, Human
cucagaaagcaaucuggugagg

SEQ ID NO: 636431 - RNA, 22 nt, Human
uuucugccaaccauuuaaacuc

SEQ ID NO: 636432 - RNA, 22 nt, Human
gugucugcuuggucaucuuuca

SEQ ID NO: 636433 - RNA, 22 nt, Human
agcugugggagaaucucugggu

SEQ ID NO: 636434 - RNA, 22 nt, Human
uagacacaaaucucagugacac

SEQ ID NO: 636435 - RNA, 22 nt, Human
gaggcacucucgacaagggugg

SEQ ID NO: 636436 - RNA, 22 nt, Human
cugauuuucaaaauguguuaaa

SEQ ID NO: 636437 - RNA, 22 nt, Human
uacuugcuuggauuucaccaga

SEQ ID NO: 636438 - RNA, 22 nt, Human
gaacacauuagucugaguuggc

SEQ ID NO: 636439 - RNA, 22 nt, Human
caaggaaguuuuaggagaggaa

SEQ ID NO: 636440 - RNA, 22 nt, Human
aggcagcugaggucuggcgccc

SEQ ID NO: 636441 - RNA, 17 nt, Human
agccugcugaucucaca

SEQ ID NO: 636442 - RNA, 19 nt, Human
aagcguuucccacuugcuu

SEQ ID NO: 636443 - RNA, 20 nt, Human
agcauuugaaauaugacuau

SEQ ID NO: 636444 - RNA, 22 nt, Human
ccuggagggcagcccauucugg

SEQ ID NO: 636445 - RNA, 22 nt, Human
uccuaaaggcugcuuuuauauu

SEQ ID NO: 636446 - RNA, 22 nt, Human
uuaugggagcaauuggggaggu

SEQ ID NO: 636447 - RNA, 22 nt, Human
aacugaacagcaggcuucuacc

SEQ ID NO: 636448 - RNA, 22 nt, Human
aggucaggagguuaagagucuu

SEQ ID NO: 636449 - RNA, 22 nt, Human
gcuuccaccuacuaaaugccac

SEQ ID NO: 636450 - RNA, 20 nt, Human
gugcagcacuuggggguagg

SEQ ID NO: 636451 - RNA, 22 nt, Human
guauagaaggaucuggugaauu

SEQ ID NO: 636452 - RNA, 22 nt, Human
agaguuugugggcuuuuccucc

SEQ ID NO: 636453 - RNA, 20 nt, Human
auucucugcucaaguggcac

SEQ ID NO: 636454 - RNA, 22 nt, Human
ggacaaaggucuggggaaccug

SEQ ID NO: 636455 - RNA, 22 nt, Human
uguuaucacuuguaaaagcaau

SEQ ID NO: 636456 - RNA, 22 nt, Human
aaggcacacaguuagauagagc

SEQ ID NO: 636457 - RNA, 22 nt, Human
ucaggcaggaagccccugcaca

SEQ ID NO: 636458 - RNA, 22 nt, Human
gcagauguuguugcugggaguu

SEQ ID NO: 636459 - RNA, 22 nt, Human
agcagcuggugagcaagcucag

SEQ ID NO: 636460 - RNA, 22 nt, Human
aaggccauuguaauguaaauau

SEQ ID NO: 636461 - RNA, 22 nt, Human
gagugaugucuguagugaagaa

SEQ ID NO: 636462 - RNA, 22 nt, Human
uucuguuuauaauuugcaguug

SEQ ID NO: 636463 - RNA, 22 nt, Human
gcgggcagggcacugguccccu

SEQ ID NO: 636464 - RNA, 22 nt, Human
uguaccuuuuucugugcaugcu

SEQ ID NO: 636465 - RNA, 22 nt, Human
uugugcuccuaugagaaucuaa

SEQ ID NO: 636466 - RNA, 22 nt, Human
gcaguguucuuguugcuuuuau

SEQ ID NO: 636467 - RNA, 22 nt, Human
aguuuauguagaauuggcaaua

SEQ ID NO: 636468 - RNA, 22 nt, Human
agcuuccuguugagagagggag

SEQ ID NO: 636469 - RNA, 22 nt, Human
uccagagaucucucuucccugu

SEQ ID NO: 636470 - RNA, 22 nt, Human
augaauaugagacugagagccu

SEQ ID NO: 636471 - RNA, 22 nt, Human
cucuuccucucaugcggucaua

SEQ ID NO: 636472 - RNA, 22 nt, Human
aggucugagucuauauacauug

SEQ ID NO: 636473 - RNA, 22 nt, Human
acuuucuguuagaugaauggau

SEQ ID NO: 636474 - RNA, 18 nt, Human
ccugcagcccaggaggcc

SEQ ID NO: 636475 - RNA, 22 nt, Human
aggggaagauuauacuuuugaa

SEQ ID NO: 636476 - RNA, 22 nt, Human
ugcuuagggcuccuccaauaga

SEQ ID NO: 636477 - RNA, 22 nt, Human
auucauguuagcccacauguag

SEQ ID NO: 636478 - RNA, 22 nt, Human
uauuguaucuuaccacauguau

SEQ ID NO: 636479 - RNA, 22 nt, Human
gggccagugagucgggagagcu

SEQ ID NO: 636480 - RNA, 22 nt, Human
guucuauucuccaguuacauau

SEQ ID NO: 636481 - RNA, 22 nt, Human
gguccaguccugcucaccacuu

SEQ ID NO: 636482 - RNA, 22 nt, Human
uuugaaagagcugauacaugaa

SEQ ID NO: 636483 - RNA, 22 nt, Human
ucuacuuuauaaguauauaagu

SEQ ID NO: 636484 - RNA, 18 nt, Human
uccugguggagaaguggu

SEQ ID NO: 636485 - RNA, 22 nt, Human
gagcuucccucugcagucccug

SEQ ID NO: 636486 - RNA, 22 nt, Human
cccugucucauugaucacuugu

SEQ ID NO: 636487 - RNA, 22 nt, Human
acauuaguuucucagaucauuu

SEQ ID NO: 636488 - RNA, 22 nt, Human
ucccaggaaugucugaaaguga

SEQ ID NO: 636489 - RNA, 22 nt, Human
aagaaguuagguguaacaauau

SEQ ID NO: 636490 - RNA, 22 nt, Human
cagaaacacuuguagagaaguu

SEQ ID NO: 636491 - RNA, 22 nt, Human
ugcccugugugugcaagcacug

SEQ ID NO: 636492 - RNA, 22 nt, Human
gucucuggcuuuaugcugguuu

SEQ ID NO: 636493 - RNA, 22 nt, Human
ucugcaacagugcccuguaaau

SEQ ID NO: 636494 - RNA, 22 nt, Human
ccagagcaauucucacagaacu

SEQ ID NO: 636495 - RNA, 22 nt, Human
gucugagggacagaguccuggc

SEQ ID NO: 636496 - RNA, 17 nt, Human
gcucagaguacacgugu

SEQ ID NO: 636497 - RNA, 22 nt, Human
cuugggggccauuaaggggccu

SEQ ID NO: 636498 - RNA, 22 nt, Human
aguguuuuauuagaacacagcc

SEQ ID NO: 636499 - RNA, 22 nt, Human
uucaguguggcccaugaagagg

SEQ ID NO: 636500 - RNA, 22 nt, Human
ccucggaggcggaggcugcagu

SEQ ID NO: 636501 - RNA, 22 nt, Human
uucagagacauguucuagauca

SEQ ID NO: 636502 - RNA, 22 nt, Human
aacacugaccucuacccucagu

SEQ ID NO: 636503 - RNA, 22 nt, Human
cuuuaaauaauacaagguccag

SEQ ID NO: 636504 - RNA, 22 nt, Human
gcugccuucccggaaugucauc

SEQ ID NO: 636505 - RNA, 20 nt, Human
cucucuccaucucaguggcc

SEQ ID NO: 636506 - RNA, 19 nt, Human
agguggccauguccagccu

SEQ ID NO: 636507 - RNA, 22 nt, Human
cucagugucuuauuguacacau

SEQ ID NO: 636508 - RNA, 22 nt, Human
cugacuccuuaccauaugcuuu

SEQ ID NO: 636509 - RNA, 22 nt, Human
augcagcuucaggauuaugaug

SEQ ID NO: 636510 - RNA, 22 nt, Human
gccauaaauugcuggucaaaau

SEQ ID NO: 636511 - RNA, 20 nt, Human
agucugccugcuccuucucc

SEQ ID NO: 636512 - RNA, 22 nt, Human
aggguagggccguagggccaug

SEQ ID NO: 636513 - RNA, 22 nt, Human
caagggaccugagauggucucu

SEQ ID NO: 636514 - RNA, 22 nt, Human
acuuugcagagccagaagagaa

SEQ ID NO: 636515 - RNA, 22 nt, Human
cucugggaccauggcaagugcg

SEQ ID NO: 636516 - RNA, 22 nt, Human
caauuagcugguacugacagga

SEQ ID NO: 636517 - RNA, 23 nt, Human
ugcaaauaacaaggaguuuaagg

SEQ ID NO: 636518 - RNA, 22 nt, Human
ggaaccacagcccccagcaggc

SEQ ID NO: 636519 - RNA, 22 nt, Human
uggucuggggaccgaggguuac

SEQ ID NO: 636520 - RNA, 22 nt, Human
ucucagugcuauccauauucca

SEQ ID NO: 636521 - RNA, 18 nt, Human
cugcuuacaaaaauaccc

SEQ ID NO: 636522 - RNA, 20 nt, Human
ucuggguugaaaucaagauc

SEQ ID NO: 636523 - RNA, 21 nt, Human
uggcagguucaaaggccuauc

SEQ ID NO: 636524 - RNA, 20 nt, Human
aggcucugccugcaggccca

SEQ ID NO: 636525 - RNA, 22 nt, Human
gauccuguuagaaauguagacu

SEQ ID NO: 636526 - RNA, 22 nt, Human
cagcucagcuuccugggugugu

SEQ ID NO: 636527 - RNA, 22 nt, Human
uucuacacugaguuuuuucccu

SEQ ID NO: 636528 - RNA, 22 nt, Human
agcagcaggcugggaugagucu

SEQ ID NO: 636529 - RNA, 22 nt, Human
guggcagcggugugcaaggagg

SEQ ID NO: 636530 - RNA, 22 nt, Human
uguuaucugguugucugauuac

SEQ ID NO: 636531 - RNA, 22 nt, Human
uggcacugccuggcagggcccc

SEQ ID NO: 636532 - RNA, 22 nt, Human
ugcccagcagggagcuaccugg

SEQ ID NO: 636533 - RNA, 22 nt, Human
uuuacagcugcuggcaagcuug

SEQ ID NO: 636534 - RNA, 22 nt, Human
caauaguaaauuacggaggaga

SEQ ID NO: 636535 - RNA, 22 nt, Human
ucagaggacuaccuucuccagu

SEQ ID NO: 636536 - RNA, 22 nt, Human
ugaaaggugacauuucuuggau

SEQ ID NO: 636537 - RNA, 22 nt, Human
gugcucugaguuugcaugucag

SEQ ID NO: 636538 - RNA, 22 nt, Human
ugugccuuaugaauucuuucug

SEQ ID NO: 636539 - RNA, 22 nt, Human
gaggagccuggccccacaucca

SEQ ID NO: 636540 - RNA, 22 nt, Human
ugaugauguuuaucuugguauu

SEQ ID NO: 636541 - RNA, 22 nt, Human
gaagccucaacaucucugcguc

SEQ ID NO: 636542 - RNA, 22 nt, Human
aucaggaucugcaucauaagaa

SEQ ID NO: 636543 - RNA, 22 nt, Human
aagagguaaugacugcuugagu

SEQ ID NO: 636544 - RNA, 22 nt, Human
cuugucuuuauuucauauucca

SEQ ID NO: 636545 - RNA, 22 nt, Human
ugcagaaguauuccaggcccca

SEQ ID NO: 636546 - RNA, 22 nt, Human
ccuuguccucugguuuccuguu

SEQ ID NO: 636547 - RNA, 22 nt, Human
uacaaugucucucaccugacuu

SEQ ID NO: 636548 - RNA, 22 nt, Human
ccagaaagacuuuuuagguacg

SEQ ID NO: 636549 - RNA, 22 nt, Human
gcuguggcuugcagcuggggcu

SEQ ID NO: 636550 - RNA, 22 nt, Human
guggaugcuuaggcagccuggg

SEQ ID NO: 636551 - RNA, 22 nt, Human
gcacaugugagaguagaggccu

SEQ ID NO: 636552 - RNA, 17 nt, Human
gguacaaacccauuuuu

SEQ ID NO: 636553 - RNA, 22 nt, Human
uccagaggcucugagggagagu

SEQ ID NO: 636554 - RNA, 22 nt, Human
aggagccuggcuggcccacagg

SEQ ID NO: 636555 - RNA, 22 nt, Human
uuuaaauguucaugauacugaa

SEQ ID NO: 636556 - RNA, 22 nt, Human
gcugucagugaggugagacaug

SEQ ID NO: 636557 - RNA, 22 nt, Human
agacagugaggcagagcuuccg

SEQ ID NO: 636558 - RNA, 22 nt, Human
agcuucuucuuggucuuuccca

SEQ ID NO: 636559 - RNA, 22 nt, Human
acaguaggaauagauguagaua

SEQ ID NO: 636560 - RNA, 22 nt, Human
uugaggaggccuuucagggcuu

SEQ ID NO: 636561 - RNA, 22 nt, Human
uuugcauuuugauaagaucacu

SEQ ID NO: 636562 - RNA, 21 nt, Human
ugcagaggcacaaacaagccc

SEQ ID NO: 636563 - RNA, 22 nt, Human
cucuggagagguucccauggga

SEQ ID NO: 636564 - RNA, 22 nt, Human
uaggccauucuuggagcuuacu

SEQ ID NO: 636565 - RNA, 22 nt, Human
aauacagagaauguuauuugga

SEQ ID NO: 636566 - RNA, 22 nt, Human
acugggcuaccccaccauuacc

SEQ ID NO: 636567 - RNA, 22 nt, Human
ucugccagaaguucugagagua

SEQ ID NO: 636568 - RNA, 22 nt, Human
gaagagagccgcgggacaucag

SEQ ID NO: 636569 - RNA, 23 nt, Human
gcccugcuccuggcugggaggga

SEQ ID NO: 636570 - RNA, 22 nt, Human
ugcagagagauccucaggguuu

SEQ ID NO: 636571 - RNA, 22 nt, Human
aauuucucaauuguuacaggug

SEQ ID NO: 636572 - RNA, 17 nt, Human
aagcauuuaauuugcua

SEQ ID NO: 636573 - RNA, 22 nt, Human
uacaaguagcucagguuuucug

SEQ ID NO: 636574 - RNA, 21 nt, Human
ugugugcauaugcauguacau

SEQ ID NO: 636575 - RNA, 22 nt, Human
uuggccacacucacuagagccc

SEQ ID NO: 636576 - RNA, 22 nt, Human
cccucugcucaggugcauaggc

SEQ ID NO: 636577 - RNA, 22 nt, Human
gaagcagcgaaguggaagggac

SEQ ID NO: 636578 - RNA, 22 nt, Human
cauguauagacacucauacagu

SEQ ID NO: 636579 - RNA, 22 nt, Human
uuccaggaccaggaagagggga

SEQ ID NO: 636580 - RNA, 22 nt, Human
uaucacuacaccuggcuaauua

SEQ ID NO: 636581 - RNA, 22 nt, Human
ccugggagguggagguugcagu

SEQ ID NO: 636582 - RNA, 22 nt, Human
uuguaugaguaugguguauagg

SEQ ID NO: 636583 - RNA, 22 nt, Human
cugccaggccuggggugcuguc

SEQ ID NO: 636584 - RNA, 22 nt, Human
aagccaguauucaauggggcua

SEQ ID NO: 636585 - RNA, 22 nt, Human
auaacuuauuagauuggagcug

SEQ ID NO: 636586 - RNA, 22 nt, Human
gauccuugcaacucugugaggu

SEQ ID NO: 636587 - RNA, 22 nt, Human
ucuaucagaguagaaggcaacg

SEQ ID NO: 636588 - RNA, 22 nt, Human
cagggcuuggaucuguggucag

SEQ ID NO: 636589 - RNA, 22 nt, Human
cugugccuuggcgcugugccac

SEQ ID NO: 636590 - RNA, 22 nt, Human
uaaagucagauaucuggguuga

SEQ ID NO: 636591 - RNA, 22 nt, Human
agaggucuuaaguuccuugaug

SEQ ID NO: 636592 - RNA, 22 nt, Human
uuccuccuuguccuaguuacug

SEQ ID NO: 636593 - RNA, 22 nt, Human
augggcugacuaaugguaaacu

SEQ ID NO: 636594 - RNA, 22 nt, Human
ugccuggaugugcuggccucac

SEQ ID NO: 636595 - RNA, 22 nt, Human
gauuucccuauaguuuucucuu

SEQ ID NO: 636596 - RNA, 22 nt, Human
gagcuuccucagccuuucucac

SEQ ID NO: 636597 - RNA, 23 nt, Human
ucuuuacauacugaugaguucuc

SEQ ID NO: 636598 - RNA, 22 nt, Human
auugucucugaauuuucagcug

SEQ ID NO: 636599 - RNA, 22 nt, Human
uugacaagaaucguugccuugg

SEQ ID NO: 636600 - RNA, 22 nt, Human
accagcuggucagggcuuuucu

SEQ ID NO: 636601 - RNA, 22 nt, Human
aaucauuguaaaugguuuuguu

SEQ ID NO: 636602 - RNA, 22 nt, Human
uugugucuggaaugcguggagc

SEQ ID NO: 636603 - RNA, 22 nt, Human
gggcuggcucccagguguugaa

SEQ ID NO: 636604 - RNA, 22 nt, Human
gccagcaaagcaaguugucagc

SEQ ID NO: 636605 - RNA, 22 nt, Human
cccacacacauuuaugauagga

SEQ ID NO: 636606 - RNA, 22 nt, Human
uuuaugacauuacaauaucaag

SEQ ID NO: 636607 - RNA, 22 nt, Human
uacauauuugucuuuguacugu

SEQ ID NO: 636608 - RNA, 22 nt, Human
ugaaaucauguaguuauugcaa

SEQ ID NO: 636609 - RNA, 18 nt, Human
ggaagauuggcuaugugc

SEQ ID NO: 636610 - RNA, 22 nt, Human
auagcaaagccuggcacaauga

SEQ ID NO: 636611 - RNA, 22 nt, Human
ucacaauaugggugugggaacu

SEQ ID NO: 636612 - RNA, 22 nt, Human
ugaugaggcuucuuggugaaca

SEQ ID NO: 636613 - RNA, 22 nt, Human
uaauuacaaagcaagcacaggg

SEQ ID NO: 636614 - RNA, 22 nt, Human
auuguaaaguacuguguacaau

SEQ ID NO: 636615 - RNA, 22 nt, Human
ucugucauaagugcugaaguau

SEQ ID NO: 636616 - RNA, 22 nt, Human
aaggucaacacugauuuuaguc

SEQ ID NO: 636617 - RNA, 22 nt, Human
gcaaagcagaacccucucuauc

SEQ ID NO: 636618 - RNA, 22 nt, Human
caaugugguggcagaugucagu

SEQ ID NO: 636619 - RNA, 22 nt, Human
acagcaagccagcuugucacug

SEQ ID NO: 636620 - RNA, 22 nt, Human
ucugauuccagaaggggcauac

SEQ ID NO: 636621 - RNA, 22 nt, Human
ggaaagaacccuggauggcugg

SEQ ID NO: 636622 - RNA, 22 nt, Human
uguggguggagugauauuagcu

SEQ ID NO: 636623 - RNA, 18 nt, Human
uggcagggaggaaauaua

SEQ ID NO: 636624 - RNA, 22 nt, Human
uagauucuggagagacagcagu

SEQ ID NO: 636625 - RNA, 17 nt, Human
cuggucccaccaagccc

SEQ ID NO: 636626 - RNA, 21 nt, Human
ugcauucuagcagcucugagg

SEQ ID NO: 636627 - RNA, 22 nt, Human
auggcccaaaaccuccucccuc

SEQ ID NO: 636628 - RNA, 22 nt, Human
gcuuuacagggcacaaagggag

SEQ ID NO: 636629 - RNA, 22 nt, Human
aaggcaguagguguuucaaacu

SEQ ID NO: 636630 - RNA, 22 nt, Human
ugugaaauguggauguuaauag

SEQ ID NO: 636631 - RNA, 22 nt, Human
auuggcaguuagugacgaggcu

SEQ ID NO: 636632 - RNA, 22 nt, Human
ggcugugcgucauccggcugca

SEQ ID NO: 636633 - RNA, 22 nt, Human
aucaguuucugugaagaacaca

SEQ ID NO: 636634 - RNA, 22 nt, Human
aaacucagauguggugaagacc

SEQ ID NO: 636635 - RNA, 18 nt, Human
augaacacugagcugaau

SEQ ID NO: 636636 - RNA, 22 nt, Human
accacauuucugaauagcauaa

SEQ ID NO: 636637 - RNA, 22 nt, Human
cuccaggguuccccgauccacu

SEQ ID NO: 636638 - RNA, 22 nt, Human
agaagugucagugcaggcagcu

SEQ ID NO: 636639 - RNA, 22 nt, Human
cccagaggugaaggagguggga

SEQ ID NO: 636640 - RNA, 21 nt, Human
agcagagugcuuugacuuugu

SEQ ID NO: 636641 - RNA, 22 nt, Human
aaggcuuugugggcugcaggca

SEQ ID NO: 636642 - RNA, 22 nt, Human
auuuacagacccucccacuaag

SEQ ID NO: 636643 - RNA, 22 nt, Human
aaagcucaucauuaggaggcua

SEQ ID NO: 636644 - RNA, 22 nt, Human
agcaagcagaauucuguccucu

SEQ ID NO: 636645 - RNA, 20 nt, Human
gcaccugaaugcaucuugga

SEQ ID NO: 636646 - RNA, 22 nt, Human
ccuggcacgaagggcugagguu

SEQ ID NO: 636647 - RNA, 22 nt, Human
gcugcugucacggugcuaaggg

SEQ ID NO: 636648 - RNA, 22 nt, Human
uaguuuaggaucuuuuuugugc

SEQ ID NO: 636649 - RNA, 22 nt, Human
cagcagcugguuauaccugugg

SEQ ID NO: 636650 - RNA, 22 nt, Human
uacuuuucuguguggcagucac

SEQ ID NO: 636651 - RNA, 22 nt, Human
guagaagugaugucauguuaua

SEQ ID NO: 636652 - RNA, 22 nt, Human
cacaucagggcugcuugggggu

SEQ ID NO: 636653 - RNA, 22 nt, Human
uauuucacagcagcucauuuaa

SEQ ID NO: 636654 - RNA, 22 nt, Human
cugucuguagacauuuuugguu

SEQ ID NO: 636655 - RNA, 21 nt, Human
ucccugaguucucugagcauc

SEQ ID NO: 636656 - RNA, 22 nt, Human
ucuagcaucuaauuauggaauc

SEQ ID NO: 636657 - RNA, 22 nt, Human
ucugucacucccugaugaugaa

SEQ ID NO: 636658 - RNA, 22 nt, Human
uuggaagggauauuggcauaug

SEQ ID NO: 636659 - RNA, 22 nt, Human
uuugagaagauguaauguuaag

SEQ ID NO: 636660 - RNA, 22 nt, Human
uggaagggagcuggaauuugga

SEQ ID NO: 636661 - RNA, 22 nt, Human
gugaagaaggcaauacaaagaa

SEQ ID NO: 636662 - RNA, 17 nt, Human
auccccagcaucuagaa

SEQ ID NO: 636663 - RNA, 22 nt, Human
cuuagggaauugggaggaugcc

SEQ ID NO: 636664 - RNA, 22 nt, Human
aaaucugggagcagcucggcca

SEQ ID NO: 636665 - RNA, 22 nt, Human
uuaguuuauaauucauuucugu

SEQ ID NO: 636666 - RNA, 22 nt, Human
acaauguaggaguaugacagua

SEQ ID NO: 636667 - RNA, 22 nt, Human
cuuuacagugaacuugcuuguc

SEQ ID NO: 636668 - RNA, 17 nt, Human
ccagguggaaucgugga

SEQ ID NO: 636669 - RNA, 22 nt, Human
cuuaugcugagaaugaaagaau

SEQ ID NO: 636670 - RNA, 22 nt, Human
uuuacaauagggucugaaugaa

SEQ ID NO: 636671 - RNA, 22 nt, Human
ccucccuucaguagagcccaau

SEQ ID NO: 636672 - RNA, 22 nt, Human
uggcucucaauggcuguacuau

SEQ ID NO: 636673 - RNA, 22 nt, Human
ucugggaacacuuugugagcuc

SEQ ID NO: 636674 - RNA, 22 nt, Human
ggccaagguguucugauaugcc

SEQ ID NO: 636675 - RNA, 22 nt, Human
ugcaggagagcuggucuggccc

SEQ ID NO: 636676 - RNA, 22 nt, Human
ugagcacagcucgcaccagcuu

SEQ ID NO: 636677 - RNA, 22 nt, Human
augugugcaucaaugauagauc

SEQ ID NO: 636678 - RNA, 22 nt, Human
cagcuggguuuaguggggugug

SEQ ID NO: 636679 - RNA, 22 nt, Human
uuaguuagaauaauacaaguaa

SEQ ID NO: 636680 - RNA, 22 nt, Human
agauccguggauuauaauuuag

SEQ ID NO: 636681 - RNA, 23 nt, Human
cccagcagauuguaaagugucca

SEQ ID NO: 636682 - RNA, 22 nt, Human
uuggcagugucugcaaaaugga

SEQ ID NO: 636683 - RNA, 22 nt, Human
aaauagcuguauuuacccugua

SEQ ID NO: 636684 - RNA, 22 nt, Human
uucagcucagcacugacaagau

SEQ ID NO: 636685 - RNA, 22 nt, Human
ggguugaggcggaugucggcgg

SEQ ID NO: 636686 - RNA, 22 nt, Human
gccugggaagacuaagugggag

SEQ ID NO: 636687 - RNA, 22 nt, Human
aaagauuaagguauuguuagcu

SEQ ID NO: 636688 - RNA, 20 nt, Human
guucucacugaucugcaggg

SEQ ID NO: 636689 - RNA, 22 nt, Human
uuugagaagcugucuugggcuc

SEQ ID NO: 636690 - RNA, 22 nt, Human
gagacugguguuugcugggcug

SEQ ID NO: 636691 - RNA, 22 nt, Human
uggaaagacauucagccgcugg

SEQ ID NO: 636692 - RNA, 20 nt, Human
uugaaugaaugucuggcuca

SEQ ID NO: 636693 - RNA, 22 nt, Human
aagccaggagcgaggccucggc

SEQ ID NO: 636694 - RNA, 22 nt, Human
aaagcaauuuaauggaccauga

SEQ ID NO: 636695 - RNA, 19 nt, Human
ggcugcugaagagaauuac

SEQ ID NO: 636696 - RNA, 22 nt, Human
cagcugccaugacauguccugc

SEQ ID NO: 636697 - RNA, 22 nt, Human
uuaaaccaccagaagccauuau

SEQ ID NO: 636698 - RNA, 22 nt, Human
cauuagaaccuauaaaaagcau

SEQ ID NO: 636699 - RNA, 23 nt, Human
cagaaaugacaguaagcacccug

SEQ ID NO: 636700 - RNA, 22 nt, Human
aaacauguaaguucagaucacc

SEQ ID NO: 636701 - RNA, 22 nt, Human
cuggcuuugcuggacugggagu

SEQ ID NO: 636702 - RNA, 22 nt, Human
aggccaggcaacauucugaagu

SEQ ID NO: 636703 - RNA, 22 nt, Human
cuuucuaauucucccauagucu

SEQ ID NO: 636704 - RNA, 22 nt, Human
ucccacagaugcuguccagagu

SEQ ID NO: 636705 - RNA, 22 nt, Human
uccugggugaaagaacaggcag

SEQ ID NO: 636706 - RNA, 22 nt, Human
ugccuguguaugugcaugcaca

SEQ ID NO: 636707 - RNA, 22 nt, Human
uucauuugggaugagucagaag

SEQ ID NO: 636708 - RNA, 22 nt, Human
ccaggcacuuguuugccaggca

SEQ ID NO: 636709 - RNA, 22 nt, Human
uuuauaaaauagacugggucua

SEQ ID NO: 636710 - RNA, 22 nt, Human
uuuugccugagagugaaaauaa

SEQ ID NO: 636711 - RNA, 22 nt, Human
gggucuccauguuaacaucacu

SEQ ID NO: 636712 - RNA, 22 nt, Human
uggcuggaggcaugcaagcucc

SEQ ID NO: 636713 - RNA, 22 nt, Human
cuucaauaggaacugcauggca

SEQ ID NO: 636714 - RNA, 22 nt, Human
aagaaucucugaucaggcuuua

SEQ ID NO: 636715 - RNA, 22 nt, Human
gaggagagggcugcgggcccac

SEQ ID NO: 636716 - RNA, 22 nt, Human
ccacaaauuagguuuugcuugu

SEQ ID NO: 636717 - RNA, 22 nt, Human
caaugacaucucccugcucuaa

SEQ ID NO: 636718 - RNA, 22 nt, Human
guggugcaggccagcaggggcg

SEQ ID NO: 636719 - RNA, 22 nt, Human
ugaucuucaccuuguucuuugg

SEQ ID NO: 636720 - RNA, 18 nt, Human
uacaugcauaaaugaagc

SEQ ID NO: 636721 - RNA, 22 nt, Human
ugcagggauuguuggcauccau

SEQ ID NO: 636722 - RNA, 22 nt, Human
cauugcacuccagcuugggcaa

SEQ ID NO: 636723 - RNA, 22 nt, Human
ucagccaguauuugagugcuca

SEQ ID NO: 636724 - RNA, 22 nt, Human
guuauuaguaagacucgcacau

SEQ ID NO: 636725 - RNA, 22 nt, Human
uugacacagaucaauauucaac

SEQ ID NO: 636726 - RNA, 22 nt, Human
uacaaaaaauugauacugacga

SEQ ID NO: 636727 - RNA, 22 nt, Human
uuugucuucccccuuuaaucag

SEQ ID NO: 636728 - RNA, 22 nt, Human
agauguaagaccuucaugaggg

SEQ ID NO: 636729 - RNA, 22 nt, Human
acaugauauaugggaaaugcuu

SEQ ID NO: 636730 - RNA, 22 nt, Human
cugggaaauugacacugauaaa

SEQ ID NO: 636731 - RNA, 22 nt, Human
augaugaagcaugguuacacug

SEQ ID NO: 636732 - RNA, 22 nt, Human
cagagcuggagggaacccuggc

SEQ ID NO: 636733 - RNA, 19 nt, Human
ccagaagggcagcuaugga

SEQ ID NO: 636734 - RNA, 22 nt, Human
uucuaaacggcuucacaggaau

SEQ ID NO: 636735 - RNA, 21 nt, Human
cauuccucggcucauagagga

SEQ ID NO: 636736 - RNA, 22 nt, Human
gagcagugggaaggaacagggu

SEQ ID NO: 636737 - RNA, 22 nt, Human
cagcccuggcuagggcgagggc

SEQ ID NO: 636738 - RNA, 22 nt, Human
augcccugggagugcuguacca

SEQ ID NO: 636739 - RNA, 22 nt, Human
ugucucaggcccaagccaguaa

SEQ ID NO: 636740 - RNA, 22 nt, Human
ucaggaaaauacugcuuaucca

SEQ ID NO: 636741 - RNA, 22 nt, Human
cuucucuuccuuugucaacuga

SEQ ID NO: 636742 - RNA, 22 nt, Human
cuagcccaggaaugccguggcc

SEQ ID NO: 636743 - RNA, 22 nt, Human
aaguuucuguucauaucucuga

SEQ ID NO: 636744 - RNA, 22 nt, Human
ggcugaaaggugggaggauggc

SEQ ID NO: 636745 - RNA, 22 nt, Human
uguuuucauggagaugguggcg

SEQ ID NO: 636746 - RNA, 22 nt, Human
gcucccagggcagcgcagaaga

SEQ ID NO: 636747 - RNA, 22 nt, Human
gggugggaaggcuaagggauug

SEQ ID NO: 636748 - RNA, 22 nt, Human
ucauugcacuccagccugggca

SEQ ID NO: 636749 - RNA, 22 nt, Human
gagacacagagaggcuguguga

SEQ ID NO: 636750 - RNA, 22 nt, Human
cacacagguaagccucuuucaa

SEQ ID NO: 636751 - RNA, 22 nt, Human
gucuccagagguuacauccugu

SEQ ID NO: 636752 - RNA, 22 nt, Human
uuuuacuuaauucuuggucaug

SEQ ID NO: 636753 - RNA, 18 nt, Human
guccugagcucugcugua

SEQ ID NO: 636754 - RNA, 22 nt, Human
ggaagacaagcaguggcugagc

SEQ ID NO: 636755 - RNA, 22 nt, Human
cucugagagcggucuguggcuu

SEQ ID NO: 636756 - RNA, 22 nt, Human
ugcagagagccagcucucucgg

SEQ ID NO: 636757 - RNA, 19 nt, Human
ucuuuguacaagucucugc

SEQ ID NO: 636758 - RNA, 22 nt, Human
ugcuuuaucugacuuggcgcug

SEQ ID NO: 636759 - RNA, 22 nt, Human
uuuugaaagaguccugcuacag

SEQ ID NO: 636760 - RNA, 22 nt, Human
aaaauugucagaaguugaucuu

SEQ ID NO: 636761 - RNA, 22 nt, Human
auguuuccauguucaauuuacu

SEQ ID NO: 636762 - RNA, 22 nt, Human
cuccuggcaggcugagugaaau

SEQ ID NO: 636763 - RNA, 20 nt, Human
gcaagcaugaagaguagaga

SEQ ID NO: 636764 - RNA, 22 nt, Human
aaaguguagagacuuuggaacc

SEQ ID NO: 636765 - RNA, 22 nt, Human
ucugccuccugcuugucccgac

SEQ ID NO: 636766 - RNA, 21 nt, Human
cugcaucucauagaacauguc

SEQ ID NO: 636767 - RNA, 22 nt, Human
cugccgaguacagccauagaaa

SEQ ID NO: 636768 - RNA, 22 nt, Human
gaugauuucuccauucccuucu

SEQ ID NO: 636769 - RNA, 22 nt, Human
ggcuuguggcaaguguuuuaag

SEQ ID NO: 636770 - RNA, 22 nt, Human
aaacuagaugaaacgaguaaag

SEQ ID NO: 636771 - RNA, 22 nt, Human
ucaggaugguccuuuaugagaa

SEQ ID NO: 636772 - RNA, 22 nt, Human
caucaaugugcagagaugaacg

SEQ ID NO: 636773 - RNA, 22 nt, Human
agaauacaucaaucuauuuucu

SEQ ID NO: 636774 - RNA, 22 nt, Human
gcaagcaaguaucuggcaggga

SEQ ID NO: 636775 - RNA, 22 nt, Human
aauuagaagcuguuagcaaaau

SEQ ID NO: 636776 - RNA, 22 nt, Human
cuggguggcuguccagccagcc

SEQ ID NO: 636777 - RNA, 22 nt, Human
uauuuugacgauuuuaugcaaa

SEQ ID NO: 636778 - RNA, 22 nt, Human
ugcaggcuguuugguggaucuc

SEQ ID NO: 636779 - RNA, 18 nt, Human
cucagggcaucagucugg

SEQ ID NO: 636780 - RNA, 22 nt, Human
uuuugccuaagaaucucucuga

SEQ ID NO: 636781 - RNA, 22 nt, Human
aucagcuuaauucucaacaggu

SEQ ID NO: 636782 - RNA, 22 nt, Human
ucaauagcauagcaauuaaugu

SEQ ID NO: 636783 - RNA, 22 nt, Human
cagagcauuuggaagccacgug

SEQ ID NO: 636784 - RNA, 22 nt, Human
gggaaaaauaaugcacagauau

SEQ ID NO: 636785 - RNA, 22 nt, Human
ggaaaauuggcgcguggggcug

SEQ ID NO: 636786 - RNA, 22 nt, Human
aacaugcaaagcuaugauguau

SEQ ID NO: 636787 - RNA, 22 nt, Human
cugggugaguugaugaaggaga

SEQ ID NO: 636788 - RNA, 22 nt, Human
cugggacuggaccucugccugg

SEQ ID NO: 636789 - RNA, 22 nt, Human
caguguauaaacuuuaacauag

SEQ ID NO: 636790 - RNA, 21 nt, Human
ucacauuucucauggguaaau

SEQ ID NO: 636791 - RNA, 22 nt, Human
agucagaauucgaucccagguc

SEQ ID NO: 636792 - RNA, 21 nt, Human
uuagaagcuaaugcagcuggu

SEQ ID NO: 636793 - RNA, 22 nt, Human
ucagaaaagacucaggggcuga

SEQ ID NO: 636794 - RNA, 22 nt, Human
uacacugaauacuaguuuuccu

SEQ ID NO: 636795 - RNA, 23 nt, Human
ugucugguuucuuuuauuuagca

SEQ ID NO: 636796 - RNA, 18 nt, Human
ugcaugcuuuuguuucca

SEQ ID NO: 636797 - RNA, 22 nt, Human
aaucuguuccugaggcaccaga

SEQ ID NO: 636798 - RNA, 23 nt, Human
gggaucuguaaaccuggagaacc

SEQ ID NO: 636799 - RNA, 22 nt, Human
gugcagcaaaguuugagauaua

SEQ ID NO: 636800 - RNA, 22 nt, Human
gcugggccccaucccucgagca

SEQ ID NO: 636801 - RNA, 22 nt, Human
ucuccucaccaccagcagcaga

SEQ ID NO: 636802 - RNA, 19 nt, Human
ucagcaucaauuugguccu

SEQ ID NO: 636803 - RNA, 22 nt, Human
agaagccauguuuaguaggaug

SEQ ID NO: 636804 - RNA, 22 nt, Human
uaggaaauucucuugcuaaguu

SEQ ID NO: 636805 - RNA, 22 nt, Human
ucugggaguggguccaaggaau

SEQ ID NO: 636806 - RNA, 22 nt, Human
ccagcuuuuccucucauugcuu

SEQ ID NO: 636807 - RNA, 22 nt, Human
ugaaugcuuuggagccuucuaa

SEQ ID NO: 636808 - RNA, 22 nt, Human
acuucucucauucagacauagc

SEQ ID NO: 636809 - RNA, 21 nt, Human
agaggccuuacaggauagacc

SEQ ID NO: 636810 - RNA, 22 nt, Human
ucccuguccugggcaaucccag

SEQ ID NO: 636811 - RNA, 22 nt, Human
aucaguuucacuugcuugcaaa

SEQ ID NO: 636812 - RNA, 22 nt, Human
ucucaagaucucaagauggccc

SEQ ID NO: 636813 - RNA, 22 nt, Human
gguggcugugagcauuauguga

SEQ ID NO: 636814 - RNA, 22 nt, Human
agggccacuggcugacggcugc

SEQ ID NO: 636815 - RNA, 22 nt, Human
aacaggcuauuucuuuacaaac

SEQ ID NO: 636816 - RNA, 22 nt, Human
auccuaaaauuguucaauuucu

SEQ ID NO: 636817 - RNA, 22 nt, Human
auuuauucuccagauggcgaga

SEQ ID NO: 636818 - RNA, 22 nt, Human
cuacaaauauguuaagguguuu

SEQ ID NO: 636819 - RNA, 22 nt, Human
ccucagggacuccaugcugcag

SEQ ID NO: 636820 - RNA, 22 nt, Human
acaacuguuggaggaacacagg

SEQ ID NO: 636821 - RNA, 22 nt, Human
aacagcaugcuggguaacauug

SEQ ID NO: 636822 - RNA, 22 nt, Human
gucccugguuugcccaggacca

SEQ ID NO: 636823 - RNA, 23 nt, Human
uuugacagcgugguuucuguggg

SEQ ID NO: 636824 - RNA, 22 nt, Human
gucuggagccugggucccugcu

SEQ ID NO: 636825 - RNA, 22 nt, Human
uguguacaggccuugcuagacu

SEQ ID NO: 636826 - RNA, 20 nt, Human
accuggcuuccucuuggcau

SEQ ID NO: 636827 - RNA, 22 nt, Human
agaggcaaugaaagcagucucu

SEQ ID NO: 636828 - RNA, 22 nt, Human
ccacguccagcuaauuuucgua

SEQ ID NO: 636829 - RNA, 22 nt, Human
uucuggagucccacagccaggg

SEQ ID NO: 636830 - RNA, 22 nt, Human
uugaaagaaggugguagagaau

SEQ ID NO: 636831 - RNA, 22 nt, Human
ucucagugggaagggcacaguu

SEQ ID NO: 636832 - RNA, 22 nt, Human
uugacuucagccuguacuugua

SEQ ID NO: 636833 - RNA, 22 nt, Human
gaggggaguaaagucauguuac

SEQ ID NO: 636834 - RNA, 22 nt, Human
uuuccagguauuaauacuguau

SEQ ID NO: 636835 - RNA, 22 nt, Human
ucauauagagggcauacaaaug

SEQ ID NO: 636836 - RNA, 22 nt, Human
cagagccuuaguucuccuagaa

SEQ ID NO: 636837 - RNA, 22 nt, Human
gggaccugggccagaggacagu

SEQ ID NO: 636838 - RNA, 22 nt, Human
uguggacucgcauggcugaggc

SEQ ID NO: 636839 - RNA, 22 nt, Human
gauuauggauggacaguggagc

SEQ ID NO: 636840 - RNA, 22 nt, Human
uagcuauuugagcauauuccag

SEQ ID NO: 636841 - RNA, 22 nt, Human
ccuggagggcgccgcacagucc

SEQ ID NO: 636842 - RNA, 22 nt, Human
cagccagaaccuaggaugagcu

SEQ ID NO: 636843 - RNA, 22 nt, Human
agcuggagaugcccagcaccgg

SEQ ID NO: 636844 - RNA, 22 nt, Human
agcuggcagagcauuuguggcc

SEQ ID NO: 636845 - RNA, 22 nt, Human
gacuggguccucugcuuauggu

SEQ ID NO: 636846 - RNA, 22 nt, Human
ggaagaugcccaacccagcuuu

SEQ ID NO: 636847 - RNA, 22 nt, Human
uuuacuacuucauugacuuacg

SEQ ID NO: 636848 - RNA, 22 nt, Human
agguccaggagauuuggcaauu

SEQ ID NO: 636849 - RNA, 22 nt, Human
accaggcagagcugggccuuaa

SEQ ID NO: 636850 - RNA, 22 nt, Human
ccuggcagcuccguggccuucc

SEQ ID NO: 636851 - RNA, 22 nt, Human
uuaugcuaagugcaacaagcca

SEQ ID NO: 636852 - RNA, 22 nt, Human
gcucagagaaguuaaggaauuu

SEQ ID NO: 636853 - RNA, 22 nt, Human
gcaggcugcccucuuguguuga

SEQ ID NO: 636854 - RNA, 21 nt, Human
aagcaggacauaugaugcccu

SEQ ID NO: 636855 - RNA, 22 nt, Human
cgugucuguguaugcaggccgu

SEQ ID NO: 636856 - RNA, 22 nt, Human
caguuucccugcuugaaaacgu

SEQ ID NO: 636857 - RNA, 22 nt, Human
aggacugggugcagagggcauc

SEQ ID NO: 636858 - RNA, 22 nt, Human
aaggagucugggccauucagag

SEQ ID NO: 636859 - RNA, 22 nt, Human
ggaggccaggaaggcucggaga

SEQ ID NO: 636860 - RNA, 22 nt, Human
aacacugagaacuguugguggu

SEQ ID NO: 636861 - RNA, 22 nt, Human
gcaugcauuuucugagagucag

SEQ ID NO: 636862 - RNA, 22 nt, Human
uggaacacugaucauugccuuu

SEQ ID NO: 636863 - RNA, 22 nt, Human
augcacuuuguaaucuguucaa

SEQ ID NO: 636864 - RNA, 22 nt, Human
gcugggcccagaucccaggauc

SEQ ID NO: 636865 - RNA, 22 nt, Human
uggucuguucaagguggcugau

SEQ ID NO: 636866 - RNA, 22 nt, Human
caggaggcccacaggccccugc

SEQ ID NO: 636867 - RNA, 18 nt, Human
auccugggccagucuuuc

SEQ ID NO: 636868 - RNA, 22 nt, Human
cagcacagcacagcggugacuc

SEQ ID NO: 636869 - RNA, 22 nt, Human
ugugaggauguaaccagaaguc

SEQ ID NO: 636870 - RNA, 22 nt, Human
agcaaagauguccggggcaagc

SEQ ID NO: 636871 - RNA, 22 nt, Human
uuaagagaagaguaucuagaac

SEQ ID NO: 636872 - RNA, 22 nt, Human
gcugugauugucagucuucaau

SEQ ID NO: 636873 - RNA, 22 nt, Human
aaacaugaauagauauuaaaca

SEQ ID NO: 636874 - RNA, 22 nt, Human
uuacauuagacccacuuucaug

SEQ ID NO: 636875 - RNA, 22 nt, Human
aguuuuguaauucucaaaaaua

SEQ ID NO: 636876 - RNA, 22 nt, Human
gagauauguuagaaagcuauug

SEQ ID NO: 636877 - RNA, 22 nt, Human
cagggucuuggcgccaucaccc

SEQ ID NO: 636878 - RNA, 19 nt, Human
caugugcaugagcacagga

SEQ ID NO: 636879 - RNA, 22 nt, Human
aaagggaggggcgauaagccgg

SEQ ID NO: 636880 - RNA, 22 nt, Human
ugucuagggagcugcucaggcu

SEQ ID NO: 636881 - RNA, 22 nt, Human
ggaauaaaaauuguuuacugua

SEQ ID NO: 636882 - RNA, 21 nt, Human
agagagaaggccauauggucc

SEQ ID NO: 636883 - RNA, 22 nt, Human
aucuggcugcugugcuuaagcu

SEQ ID NO: 636884 - RNA, 22 nt, Human
acagaauacuacagacugguua

SEQ ID NO: 636885 - RNA, 22 nt, Human
gaucugaaccuugccuguuggg

SEQ ID NO: 636886 - RNA, 19 nt, Human
uauguguguguauuuacau

SEQ ID NO: 636887 - RNA, 22 nt, Human
gguucucuaacuuugacuggag

SEQ ID NO: 636888 - RNA, 22 nt, Human
gauggguggucucagacuugcc

SEQ ID NO: 636889 - RNA, 22 nt, Human
agcugaaucuugacuaggaaga

SEQ ID NO: 636890 - RNA, 22 nt, Human
ccccagcagcaccuggggcagu

SEQ ID NO: 636891 - RNA, 19 nt, Human
ggccugaggccacagaucc

SEQ ID NO: 636892 - RNA, 22 nt, Human
uucuccuaggaucagggguccu

SEQ ID NO: 636893 - RNA, 22 nt, Human
ugggaaggacagaacauaauug

SEQ ID NO: 636894 - RNA, 22 nt, Human
agaagccauagucugggaggca

SEQ ID NO: 636895 - RNA, 22 nt, Human
ccugcuggccaguggagggcug

SEQ ID NO: 636896 - RNA, 22 nt, Human
cucauccacccucacuaggaaa

SEQ ID NO: 636897 - RNA, 22 nt, Human
augcccugagcaggccuucaag

SEQ ID NO: 636898 - RNA, 22 nt, Human
guggguggaggcgucgagggca

SEQ ID NO: 636899 - RNA, 22 nt, Human
gagccacagugguggcccacgu

SEQ ID NO: 636900 - RNA, 21 nt, Human
uccaaaccugucucuggcucu

SEQ ID NO: 636901 - RNA, 22 nt, Human
ucauuuguucaucugcucuucu

SEQ ID NO: 636902 - RNA, 22 nt, Human
gguggacaguguuagcucuggg

SEQ ID NO: 636903 - RNA, 22 nt, Human
uguauuuauauuagaaugguug

SEQ ID NO: 636904 - RNA, 22 nt, Human
aacaaugccacauuaaguguau

SEQ ID NO: 636905 - RNA, 22 nt, Human
agcuuuauauguuguuucucca

SEQ ID NO: 636906 - RNA, 22 nt, Human
gcagcaggucugucaaugucau

SEQ ID NO: 636907 - RNA, 23 nt, Human
acaaugucuguucauaaaauacc

SEQ ID NO: 636908 - RNA, 22 nt, Human
uucuuucuuggggaacacacuc

SEQ ID NO: 636909 - RNA, 22 nt, Human
agcagcaggugcuucuggaucu

SEQ ID NO: 636910 - RNA, 19 nt, Human
ggucacaaggaguugugaa

SEQ ID NO: 636911 - RNA, 22 nt, Human
accuuauuuggaaauauaauua

SEQ ID NO: 636912 - RNA, 22 nt, Human
gcagggguagagauugcuggug

SEQ ID NO: 636913 - RNA, 22 nt, Human
ugggcugaguguggaacuaguu

SEQ ID NO: 636914 - RNA, 22 nt, Human
ugauggaacagccuuugccaaa

SEQ ID NO: 636915 - RNA, 22 nt, Human
agcaggcaggaaggcagcacug

SEQ ID NO: 636916 - RNA, 22 nt, Human
uaugcuacuagaaauaaaaugg

SEQ ID NO: 636917 - RNA, 22 nt, Human
aagcugggacuuagcgcagaua

SEQ ID NO: 636918 - RNA, 22 nt, Human
ccuugacugccuucaggcuggg

SEQ ID NO: 636919 - RNA, 22 nt, Human
aggauuucugugccuggaaaau

SEQ ID NO: 636920 - RNA, 22 nt, Human
aggcucauccccacaaagcaaa

SEQ ID NO: 636921 - RNA, 22 nt, Human
auuuuuuagccaagacucugca

SEQ ID NO: 636922 - RNA, 22 nt, Human
cuagcaucagaugagaagcugu

SEQ ID NO: 636923 - RNA, 22 nt, Human
ugcuuucacuucucugcagcca

SEQ ID NO: 636924 - RNA, 22 nt, Human
aaagaaucuauauaucaccacc

SEQ ID NO: 636925 - RNA, 22 nt, Human
caaaugcuaacuucuuuccaaa

SEQ ID NO: 636926 - RNA, 22 nt, Human
gcuggcuugacagaggccuggg

SEQ ID NO: 636927 - RNA, 22 nt, Human
acaaggaggucuggggggcccu

SEQ ID NO: 636928 - RNA, 22 nt, Human
ugggcucugugccagguuggug

SEQ ID NO: 636929 - RNA, 22 nt, Human
uuacacacagagcugggccugg

SEQ ID NO: 636930 - RNA, 22 nt, Human
cacaauaaauguuugcugauga

SEQ ID NO: 636931 - RNA, 22 nt, Human
aaaauguaaagcuugaguguag

SEQ ID NO: 636932 - RNA, 22 nt, Human
gggagggaggugcugguucacg

SEQ ID NO: 636933 - RNA, 22 nt, Human
uaaaugcagcaguuucuguucu

SEQ ID NO: 636934 - RNA, 22 nt, Human
ggcuuugcauuuugauggaggu

SEQ ID NO: 636935 - RNA, 21 nt, Human
uuugagaauuggucagagugc

SEQ ID NO: 636936 - RNA, 22 nt, Human
uguggccuugcagccuggaggu

SEQ ID NO: 636937 - RNA, 22 nt, Human
ugucaauaacauuuacuucuau

SEQ ID NO: 636938 - RNA, 22 nt, Human
gagacaggcagcuaguggguca

SEQ ID NO: 636939 - RNA, 22 nt, Human
ggaacagggauuuggccugguu

SEQ ID NO: 636940 - RNA, 22 nt, Human
aauauaguucuagaaauauuuu

SEQ ID NO: 636941 - RNA, 22 nt, Human
gcacaggcucucuuggggacac

SEQ ID NO: 636942 - RNA, 22 nt, Human
gacuccagguguccaggccucc

SEQ ID NO: 636943 - RNA, 22 nt, Human
caauuucauuaauagauauaga

SEQ ID NO: 636944 - RNA, 22 nt, Human
uuugauacuuugugcaauuucu

SEQ ID NO: 636945 - RNA, 22 nt, Human
ugcuuauuaaacaugcauauuc

SEQ ID NO: 636946 - RNA, 22 nt, Human
aggccagugccuuuccagggcu

SEQ ID NO: 636947 - RNA, 22 nt, Human
uuuacagaauguugaauuuggg

SEQ ID NO: 636948 - RNA, 22 nt, Human
ucaauagaaaugcagagucuca

SEQ ID NO: 636949 - RNA, 22 nt, Human
ggacagugaaucuggagguaua

SEQ ID NO: 636950 - RNA, 22 nt, Human
ccaggaggugcuggaagaaagc

SEQ ID NO: 636951 - RNA, 22 nt, Human
uuguccaaggucccacaguuag

SEQ ID NO: 636952 - RNA, 22 nt, Human
gguaacaguauguagaguaaga

SEQ ID NO: 636953 - RNA, 22 nt, Human
ggucacaucuaaauggagcauu

SEQ ID NO: 636954 - RNA, 22 nt, Human
uuucacauguauauaggcauua

SEQ ID NO: 636955 - RNA, 22 nt, Human
ccugggucccugagagaugauu

SEQ ID NO: 636956 - RNA, 22 nt, Human
gauaaaauauguggccuuuagu

SEQ ID NO: 636957 - RNA, 23 nt, Human
auaaggcauaaagguacauugga

SEQ ID NO: 636958 - RNA, 20 nt, Human
uccugguggauacugcuuaa

SEQ ID NO: 636959 - RNA, 22 nt, Human
gaaucaaugguagauuaaguaa

SEQ ID NO: 636960 - RNA, 22 nt, Human
acuuuggggaucuacggcugga

SEQ ID NO: 636961 - RNA, 22 nt, Human
gggaugcagucagagccccugu

SEQ ID NO: 636962 - RNA, 22 nt, Human
ccagagagcuacaaggcauaaa

SEQ ID NO: 636963 - RNA, 22 nt, Human
agccaaaggcaccagagacacu

SEQ ID NO: 636964 - RNA, 22 nt, Human
aaaaugauauccugacuuuuau

SEQ ID NO: 636965 - RNA, 22 nt, Human
aggucugagcuccuuccucuga

SEQ ID NO: 636966 - RNA, 20 nt, Human
cacccuacggccucaccucc

SEQ ID NO: 636967 - RNA, 22 nt, Human
cacaaagucugcagcugcugua

SEQ ID NO: 636968 - RNA, 22 nt, Human
acaugcacucucacugugcucu

SEQ ID NO: 636969 - RNA, 22 nt, Human
cucuucuuggaaugcugacugu

SEQ ID NO: 636970 - RNA, 22 nt, Human
uccugagcucccaugaacaggc

SEQ ID NO: 636971 - RNA, 22 nt, Human
uauguaguacuuagugcauaca

SEQ ID NO: 636972 - RNA, 21 nt, Human
acagaguaguugaaacagaga

SEQ ID NO: 636973 - RNA, 22 nt, Human
ucccaccuuccguggaacccgu

SEQ ID NO: 636974 - RNA, 22 nt, Human
gcagggcaucccugagcgggug

SEQ ID NO: 636975 - RNA, 22 nt, Human
uguacauauauguauguacgca

SEQ ID NO: 636976 - RNA, 22 nt, Human
cguuuacuguguaccaggcacu

SEQ ID NO: 636977 - RNA, 22 nt, Human
cccuccucaacucuggcuucca

SEQ ID NO: 636978 - RNA, 22 nt, Human
gcacuucacaugccuuuuccug

SEQ ID NO: 636979 - RNA, 22 nt, Human
agagcucaagacgcucacagua

SEQ ID NO: 636980 - RNA, 22 nt, Human
auucugcuuaagggaggcuguc

SEQ ID NO: 636981 - RNA, 22 nt, Human
agucugaaaguauguuguaaug

SEQ ID NO: 636982 - RNA, 22 nt, Human
uccuccuccucacagucaccug

SEQ ID NO: 636983 - RNA, 22 nt, Human
ucuucacauuuuaagaaguucu

SEQ ID NO: 636984 - RNA, 22 nt, Human
ccuccaaggugagagaggaugg

SEQ ID NO: 636985 - RNA, 22 nt, Human
cagcugcaggaacaaaaaugug

SEQ ID NO: 636986 - RNA, 22 nt, Human
uguccauggggaaggggaagug

SEQ ID NO: 636987 - RNA, 22 nt, Human
uggcuuccugcacagugucugc

SEQ ID NO: 636988 - RNA, 22 nt, Human
uuaaaccacugaguggagacua

SEQ ID NO: 636989 - RNA, 22 nt, Human
uagccaguuucuuuaacagcaa

SEQ ID NO: 636990 - RNA, 22 nt, Human
gcuacauaguaacccacaaauc

SEQ ID NO: 636991 - RNA, 22 nt, Human
caaagcaaggcucaguuugaac

SEQ ID NO: 636992 - RNA, 22 nt, Human
cacaugugggaaauggugcuua

SEQ ID NO: 636993 - RNA, 22 nt, Human
gccugccuguuggcugaggugc

SEQ ID NO: 636994 - RNA, 22 nt, Human
ucaugacaucuguuuaucucaa

SEQ ID NO: 636995 - RNA, 23 nt, Human
ugcaugugaauucauacuuguuu

SEQ ID NO: 636996 - RNA, 22 nt, Human
accugcaggcacaggugugcgc

SEQ ID NO: 636997 - RNA, 22 nt, Human
aggcagugguguuugcuggugg

SEQ ID NO: 636998 - RNA, 22 nt, Human
uggcagcacggcauccacucuc

SEQ ID NO: 636999 - RNA, 22 nt, Human
cuauuucauguuccuauggccg

SEQ ID NO: 637000 - RNA, 22 nt, Human
cacccagcagcacuuaagacua

SEQ ID NO: 637001 - RNA, 22 nt, Human
cauucaaagcaggaaaggccuu

SEQ ID NO: 637002 - RNA, 22 nt, Human
gucucugugccuucuccccacc

SEQ ID NO: 637003 - RNA, 18 nt, Human
ucauuuguuuugcaugaa

SEQ ID NO: 637004 - RNA, 22 nt, Human
gcagggcacacaagaaugauaa

SEQ ID NO: 637005 - RNA, 22 nt, Human
ugcagaaauaacucauauugca

SEQ ID NO: 637006 - RNA, 22 nt, Human
caagucacuuaugugcagauau

SEQ ID NO: 637007 - RNA, 22 nt, Human
uuuaacuccuaguguguauuag

SEQ ID NO: 637008 - RNA, 22 nt, Human
ugaguaucaauuacauaguugu

SEQ ID NO: 637009 - RNA, 22 nt, Human
gcccuccccucuggguggugag

SEQ ID NO: 637010 - RNA, 22 nt, Human
aucuaagaggaugguuggaaau

SEQ ID NO: 637011 - RNA, 22 nt, Human
agcuguguguuugucaugggcg

SEQ ID NO: 637012 - RNA, 22 nt, Human
uugccaggcucugguuccagcc

SEQ ID NO: 637013 - RNA, 22 nt, Human
aaacucaaagucagaucagaga

SEQ ID NO: 637014 - RNA, 22 nt, Human
caggguagggcaagggaaccug

SEQ ID NO: 637015 - RNA, 22 nt, Human
gugcuaugauuggacagaauag

SEQ ID NO: 637016 - RNA, 22 nt, Human
cucccuggugacucccaaagcu

SEQ ID NO: 637017 - RNA, 22 nt, Human
gauucugcuuaccauuugaucu

SEQ ID NO: 637018 - RNA, 22 nt, Human
aggaauugagauccuagguuuu

SEQ ID NO: 637019 - RNA, 22 nt, Human
caguaucuccacauguaaagug

SEQ ID NO: 637020 - RNA, 22 nt, Human
gcugaaaugaaaacacaggucg

SEQ ID NO: 637021 - RNA, 20 nt, Human
guuuauacagaagaccccaa

SEQ ID NO: 637022 - RNA, 22 nt, Human
ugccacuggggcuaggacuguu

SEQ ID NO: 637023 - RNA, 22 nt, Human
ucuagcuguggucgagugagga

SEQ ID NO: 637024 - RNA, 22 nt, Human
aaucauuguucuucagauuuga

SEQ ID NO: 637025 - RNA, 22 nt, Human
agccaacuaggagauuaaggua

SEQ ID NO: 637026 - RNA, 22 nt, Human
aggucacccguuugacuaucca

SEQ ID NO: 637027 - RNA, 22 nt, Human
agagaugagaacaugcuuggau

SEQ ID NO: 637028 - RNA, 22 nt, Human
augaagucuauuuaccuaagcu

SEQ ID NO: 637029 - RNA, 20 nt, Human
gaaaugugaccucuucugug

SEQ ID NO: 637030 - RNA, 19 nt, Human
ugaguucugugguucucaa

SEQ ID NO: 637031 - RNA, 22 nt, Human
ugucacauugaauaugauuuau

SEQ ID NO: 637032 - RNA, 22 nt, Human
caggauccccaggucgccgucc

SEQ ID NO: 637033 - RNA, 22 nt, Human
ugcugggcucaaccuccagagc

SEQ ID NO: 637034 - RNA, 22 nt, Human
uuacacaauauaugguacuugg

SEQ ID NO: 637035 - RNA, 22 nt, Human
caggcagugucccaggaagcca

SEQ ID NO: 637036 - RNA, 22 nt, Human
gcuggccugggcagccugucgg

SEQ ID NO: 637037 - RNA, 22 nt, Human
uuuacaacauaggccccaagaa

SEQ ID NO: 637038 - RNA, 22 nt, Human
uuccaauggaaucaugucuuga

SEQ ID NO: 637039 - RNA, 22 nt, Human
gagcagcugagcuggaaugaga

SEQ ID NO: 637040 - RNA, 22 nt, Human
uccaguccuagaaacuggagag

SEQ ID NO: 637041 - RNA, 22 nt, Human
ucugcaggaggcuggcugcagg

SEQ ID NO: 637042 - RNA, 22 nt, Human
cugcucugcaaggcacagugau

SEQ ID NO: 637043 - RNA, 21 nt, Human
uggcucugcucagagcagucc

SEQ ID NO: 637044 - RNA, 22 nt, Human
gaccauuuguugaaaagauuau

SEQ ID NO: 637045 - RNA, 22 nt, Human
cacagugaccucuuuaaaaggg

SEQ ID NO: 637046 - RNA, 22 nt, Human
gaagccaagugcaaaugccuua

SEQ ID NO: 637047 - RNA, 22 nt, Human
cagcucuggccagaucuauccu

SEQ ID NO: 637048 - RNA, 20 nt, Human
ucuaggcaggcaggcucgug

SEQ ID NO: 637049 - RNA, 22 nt, Human
ucaaugcaaccuccaccucccg

SEQ ID NO: 637050 - RNA, 22 nt, Human
ucauuacagagauauaaucuac

SEQ ID NO: 637051 - RNA, 22 nt, Human
aagcauuguaagcagaagaugc

SEQ ID NO: 637052 - RNA, 22 nt, Human
ugcaugcaugugagcaugcaua

SEQ ID NO: 637053 - RNA, 22 nt, Human
uuugaaaggagcuuuauccaga

SEQ ID NO: 637054 - RNA, 22 nt, Human
aagcaguguucccagcuggccc

SEQ ID NO: 637055 - RNA, 22 nt, Human
uuggaacuggauuucauguagc

SEQ ID NO: 637056 - RNA, 22 nt, Human
cuguucucuggcgguggcuguu

SEQ ID NO: 637057 - RNA, 22 nt, Human
aaauuaucaugggggagaaaca

SEQ ID NO: 637058 - RNA, 19 nt, Human
agggaguuuauauuugcac

SEQ ID NO: 637059 - RNA, 22 nt, Human
acagcaggagccuucauaugcu

SEQ ID NO: 637060 - RNA, 22 nt, Human
cuucauguucugccuguggaag

SEQ ID NO: 637061 - RNA, 22 nt, Human
uuauuaugugcuagagaaugua

SEQ ID NO: 637062 - RNA, 22 nt, Human
ggagcugaugguagaagaauga

SEQ ID NO: 637063 - RNA, 22 nt, Human
agggugucagccacggaauggg

SEQ ID NO: 637064 - RNA, 22 nt, Human
cuuuggaggaaaauugagguca

SEQ ID NO: 637065 - RNA, 22 nt, Human
acugaaggaaacuuuuguguuu

SEQ ID NO: 637066 - RNA, 22 nt, Human
gcccuccaccagagcccuucuc

SEQ ID NO: 637067 - RNA, 22 nt, Human
uacuacauuaauaaaacauuca

SEQ ID NO: 637068 - RNA, 22 nt, Human
agaguaguucuuugcagagugg

SEQ ID NO: 637069 - RNA, 22 nt, Human
auugcagggacucaauaagaau

SEQ ID NO: 637070 - RNA, 22 nt, Human
uuugaagacauauuguuacaua

SEQ ID NO: 637071 - RNA, 22 nt, Human
uacagauauguaugcacuuuuu

SEQ ID NO: 637072 - RNA, 22 nt, Human
gcagguggagcaguagucuggu

SEQ ID NO: 637073 - RNA, 22 nt, Human
gcccaggccggagagcagugcu

SEQ ID NO: 637074 - RNA, 22 nt, Human
aaucuguuuaacagauuucugu

SEQ ID NO: 637075 - RNA, 22 nt, Human
cuugagucauauaaagacagag

SEQ ID NO: 637076 - RNA, 22 nt, Human
gagaggagguggcuaugacagc

SEQ ID NO: 637077 - RNA, 22 nt, Human
gaagcccacguuuggugaugua

SEQ ID NO: 637078 - RNA, 22 nt, Human
ugggucuguagggcuguccaau

SEQ ID NO: 637079 - RNA, 22 nt, Human
ggcugggccagggccuguggac

SEQ ID NO: 637080 - RNA, 19 nt, Human
acacugaucagaucagcag

SEQ ID NO: 637081 - RNA, 22 nt, Human
auaacagaauaagucauuaccg

SEQ ID NO: 637082 - RNA, 22 nt, Human
gcugcuggaugcgcuugauggu

SEQ ID NO: 637083 - RNA, 20 nt, Human
ucuguagucuaugaggcuua

SEQ ID NO: 637084 - RNA, 22 nt, Human
ucccacacuugaaacaaggcug

SEQ ID NO: 637085 - RNA, 22 nt, Human
agagacuguguccaucgugccu

SEQ ID NO: 637086 - RNA, 22 nt, Human
uaguuaggaauagcagcgacuc

SEQ ID NO: 637087 - RNA, 22 nt, Human
ucucuguguugcaggaaaaucu

SEQ ID NO: 637088 - RNA, 22 nt, Human
aauucaaucuguagauugugau

SEQ ID NO: 637089 - RNA, 22 nt, Human
ggggcucaguucggacagccug

SEQ ID NO: 637090 - RNA, 22 nt, Human
uguacagucaugcuuucuguuc

SEQ ID NO: 637091 - RNA, 22 nt, Human
uggcagcagggaggccaguguu

SEQ ID NO: 637092 - RNA, 22 nt, Human
aaugaucuggcucaggauauca

SEQ ID NO: 637093 - RNA, 22 nt, Human
cccauuuuugugugaguaauga

SEQ ID NO: 637094 - RNA, 22 nt, Human
uccaggcucucaggugucagca

SEQ ID NO: 637095 - RNA, 22 nt, Human
augauucuggugagaaugagga

SEQ ID NO: 637096 - RNA, 22 nt, Human
guuauacacauuccuggugagg

SEQ ID NO: 637097 - RNA, 22 nt, Human
cacaauguguuggguuaaguuu

SEQ ID NO: 637098 - RNA, 20 nt, Human
cugcuugggccccucuggcc

SEQ ID NO: 637099 - RNA, 22 nt, Human
ccaggacucaaugaccacaggg

SEQ ID NO: 637100 - RNA, 22 nt, Human
acaaaugauuaucacagaggag

SEQ ID NO: 637101 - RNA, 22 nt, Human
aguaaaaucuuaagcacagugg

SEQ ID NO: 637102 - RNA, 22 nt, Human
gggcucuggauggagccugcag

SEQ ID NO: 637103 - RNA, 22 nt, Human
uaaucuguaauuuuugcaauag

SEQ ID NO: 637104 - RNA, 22 nt, Human
ucauuucaaguucugacagcua

SEQ ID NO: 637105 - RNA, 22 nt, Human
aaauggcaggcucuuugcuagu

SEQ ID NO: 637106 - RNA, 22 nt, Human
ggccagcaguauauagcuaauu

SEQ ID NO: 637107 - RNA, 17 nt, Human
agcauuuguguuaacag

SEQ ID NO: 637108 - RNA, 22 nt, Human
uuuuggaacacagacauuagaa

SEQ ID NO: 637109 - RNA, 22 nt, Human
ugugcagcuaguccuggacuug

SEQ ID NO: 637110 - RNA, 22 nt, Human
ugggggugacuaucucgggaau

SEQ ID NO: 637111 - RNA, 22 nt, Human
cuuuacaccaagcagaucuuuc

SEQ ID NO: 637112 - RNA, 22 nt, Human
gaauuauaggcaaagcagucau

SEQ ID NO: 637113 - RNA, 22 nt, Human
acagaugauuuuuaugaaaaca

SEQ ID NO: 637114 - RNA, 19 nt, Human
uuuuccuucuauauguuuc

SEQ ID NO: 637115 - RNA, 22 nt, Human
cagagugauaaauauagaaauu

SEQ ID NO: 637116 - RNA, 22 nt, Human
cugggucagucugucccuaggg

SEQ ID NO: 637117 - RNA, 21 nt, Human
ucacaugcccauuacuggagc

SEQ ID NO: 637118 - RNA, 22 nt, Human
cugcugcucuugugcauuagug

SEQ ID NO: 637119 - RNA, 22 nt, Human
uugaagaugcugucucuuccag

SEQ ID NO: 637120 - RNA, 22 nt, Human
auuuggcaacauuaauugaauc

SEQ ID NO: 637121 - RNA, 22 nt, Human
guuggcucauuuuauagacagc

SEQ ID NO: 637122 - RNA, 22 nt, Human
ccaguguuugaugggauuuuca

SEQ ID NO: 637123 - RNA, 22 nt, Human
ugaagacagggucuuuaacgag

SEQ ID NO: 637124 - RNA, 22 nt, Human
ugagacgaagucuugcucuguu

SEQ ID NO: 637125 - RNA, 22 nt, Human
ggugugugguccucucacuuag

SEQ ID NO: 637126 - RNA, 22 nt, Human
ccaaggcaaugugcagcuggug

SEQ ID NO: 637127 - RNA, 22 nt, Human
aagacacagcgaaauguuccug

SEQ ID NO: 637128 - RNA, 22 nt, Human
uuggaacaaucacauccuugcu

SEQ ID NO: 637129 - RNA, 20 nt, Human
gaaucuuacuacauucucuc

SEQ ID NO: 637130 - RNA, 22 nt, Human
auuccuucuuugagaauaagca

SEQ ID NO: 637131 - RNA, 22 nt, Human
caucauuguuagggacucuaac

SEQ ID NO: 637132 - RNA, 22 nt, Human
gcugggaaugauuuuggagagg

SEQ ID NO: 637133 - RNA, 22 nt, Human
ggacuugccuuuaguuaaaaua

SEQ ID NO: 637134 - RNA, 22 nt, Human
gaagugcaaaaccacaugguaa

SEQ ID NO: 637135 - RNA, 22 nt, Human
aguggcaguggggcagggcccu

SEQ ID NO: 637136 - RNA, 22 nt, Human
ggaagaugagaaguggggcucc

SEQ ID NO: 637137 - RNA, 22 nt, Human
gauugaaauauaaauauguguu

SEQ ID NO: 637138 - RNA, 22 nt, Human
gugauaaaauucaaauagcucu

SEQ ID NO: 637139 - RNA, 22 nt, Human
gauggguagaaguggaagaggu

SEQ ID NO: 637140 - RNA, 22 nt, Human
gauguucagugguugaccauaa

SEQ ID NO: 637141 - RNA, 22 nt, Human
agagcuuugggacauuugcuag

SEQ ID NO: 637142 - RNA, 23 nt, Human
auccaugugagaauagacuagca

SEQ ID NO: 637143 - RNA, 22 nt, Human
caauaaguaauaggcaucuaau

SEQ ID NO: 637144 - RNA, 22 nt, Human
caaagcaguuuuaaucaaguag

SEQ ID NO: 637145 - RNA, 22 nt, Human
auacacuggccuuugcagagcc

SEQ ID NO: 637146 - RNA, 22 nt, Human
cucugggaaguggagacuucag

SEQ ID NO: 637147 - RNA, 22 nt, Human
uggguccuugcuggcuucaaag

SEQ ID NO: 637148 - RNA, 22 nt, Human
cucaccccuguaauuccagcac

SEQ ID NO: 637149 - RNA, 22 nt, Human
gacaauaaaaugaucuuacagu

SEQ ID NO: 637150 - RNA, 22 nt, Human
ggcucccacccauagggcgagu

SEQ ID NO: 637151 - RNA, 22 nt, Human
ccucaggugugggccagcuguc

SEQ ID NO: 637152 - RNA, 23 nt, Human
gccaggaguggguagacuaaugc

SEQ ID NO: 637153 - RNA, 22 nt, Human
aucaaauuaugugcuacaagaa

SEQ ID NO: 637154 - RNA, 22 nt, Human
uauauuaaagugcuuugcagug

SEQ ID NO: 637155 - RNA, 22 nt, Human
uacuuacagaaggaagcaauug

SEQ ID NO: 637156 - RNA, 22 nt, Human
gagcaguuuuauuucaugagac

SEQ ID NO: 637157 - RNA, 22 nt, Human
ugaaaagugaucauggauuagg

SEQ ID NO: 637158 - RNA, 22 nt, Human
auucuacaaucauguagauccu

SEQ ID NO: 637159 - RNA, 22 nt, Human
caaacauugggggcuucaacac

SEQ ID NO: 637160 - RNA, 22 nt, Human
ugaagcaaacgcuucuguuccu

SEQ ID NO: 637161 - RNA, 19 nt, Human
cugcucccuccuucuggca

SEQ ID NO: 637162 - RNA, 22 nt, Human
agcugugcugccaaguugcuga

SEQ ID NO: 637163 - RNA, 19 nt, Human
ggcugccuggagcgagggc

SEQ ID NO: 637164 - RNA, 22 nt, Human
gauuucagaagcaagaggaggu

SEQ ID NO: 637165 - RNA, 22 nt, Human
auuuguugcuagcagcacugau

SEQ ID NO: 637166 - RNA, 20 nt, Human
ugcugccuguuuuugugaau

SEQ ID NO: 637167 - RNA, 22 nt, Human
uccaggagucuagccucaggcc

SEQ ID NO: 637168 - RNA, 22 nt, Human
uaggccaaaugacuugauguuu

SEQ ID NO: 637169 - RNA, 23 nt, Human
gcugacugugaaauucuggagcu

SEQ ID NO: 637170 - RNA, 22 nt, Human
auggcccucuccuuaggucagc

SEQ ID NO: 637171 - RNA, 22 nt, Human
uguguguguuccuccucagcua

SEQ ID NO: 637172 - RNA, 19 nt, Human
ucauucaggaccaguggau

SEQ ID NO: 637173 - RNA, 22 nt, Human
ugaggcagugauguuuaagcac

SEQ ID NO: 637174 - RNA, 22 nt, Human
caggcucccugccagggccggc

SEQ ID NO: 637175 - RNA, 22 nt, Human
gaggcacugcugggccccugua

SEQ ID NO: 637176 - RNA, 22 nt, Human
cauacuuuuuagaucugccuuc

SEQ ID NO: 637177 - RNA, 22 nt, Human
aaagcuuuuguuuucguaacug

SEQ ID NO: 637178 - RNA, 22 nt, Human
gagcugagaagcagcgcuugau

SEQ ID NO: 637179 - RNA, 22 nt, Human
agaagcaguuauuuuuugcaca

SEQ ID NO: 637180 - RNA, 22 nt, Human
uuaacaguaaagaauugugcaa

SEQ ID NO: 637181 - RNA, 19 nt, Human
aggugugggggcugcagac

SEQ ID NO: 637182 - RNA, 22 nt, Human
caggggcuuaagugacagaagg

SEQ ID NO: 637183 - RNA, 22 nt, Human
guuuagaacacggaaauacuga

SEQ ID NO: 637184 - RNA, 22 nt, Human
gcucagguguuaccuccucuag

SEQ ID NO: 637185 - RNA, 22 nt, Human
gcuggcugugauuuugccaaca

SEQ ID NO: 637186 - RNA, 22 nt, Human
augcaauaguaauucuagucug

SEQ ID NO: 637187 - RNA, 22 nt, Human
ugagcaagagaaacugacugua

SEQ ID NO: 637188 - RNA, 21 nt, Human
aaagauguuucuuuuccucac

SEQ ID NO: 637189 - RNA, 22 nt, Human
cuucccuuccuggggcaauuua

SEQ ID NO: 637190 - RNA, 22 nt, Human
uaaggcacgcauaagagggggc

SEQ ID NO: 637191 - RNA, 22 nt, Human
ucagggcaucaucaugaauaua

SEQ ID NO: 637192 - RNA, 22 nt, Human
cucacagaugcugugggucagg

SEQ ID NO: 637193 - RNA, 22 nt, Human
agccucucuuuauucccagcua

SEQ ID NO: 637194 - RNA, 21 nt, Human
gggcagcacgucauuccugug

SEQ ID NO: 637195 - RNA, 22 nt, Human
uggaauucuuauucugacuuca

SEQ ID NO: 637196 - RNA, 22 nt, Human
aaguaaaauguuuccuuuauua

SEQ ID NO: 637197 - RNA, 22 nt, Human
ugcuggaggcaguggaggugcc

SEQ ID NO: 637198 - RNA, 22 nt, Human
acuccagguuuuuucacugaag

SEQ ID NO: 637199 - RNA, 22 nt, Human
ugagacagggucuugcucuguu

SEQ ID NO: 637200 - RNA, 22 nt, Human
ugggggagauugugcaucucua

SEQ ID NO: 637201 - RNA, 22 nt, Human
gaaggcaacaccaggaugcacu

SEQ ID NO: 637202 - RNA, 22 nt, Human
uaucagaagacuuacaguaucg

SEQ ID NO: 637203 - RNA, 22 nt, Human
acagagucucagggaugaaagc

SEQ ID NO: 637204 - RNA, 18 nt, Human
cugaggcuggcaggagcc

SEQ ID NO: 637205 - RNA, 22 nt, Human
uagcagcccaguuucuggccaa

SEQ ID NO: 637206 - RNA, 22 nt, Human
cugggagcgcagcaggcacaac

SEQ ID NO: 637207 - RNA, 22 nt, Human
agcaggcaggcugccagugaau

SEQ ID NO: 637208 - RNA, 22 nt, Human
ggcugaaaccguuauccacuga

SEQ ID NO: 637209 - RNA, 22 nt, Human
guuauuuaacuuuguagcaugg

SEQ ID NO: 637210 - RNA, 22 nt, Human
uuucugcagucucucagaagcc

SEQ ID NO: 637211 - RNA, 22 nt, Human
ggcagucuuucccuugagcucu

SEQ ID NO: 637212 - RNA, 22 nt, Human
ggagcugcauuuagggagccuu

SEQ ID NO: 637213 - RNA, 22 nt, Human
cccugggcucagagcagguagc

SEQ ID NO: 637214 - RNA, 22 nt, Human
ugcagagggacagccacagcuc

SEQ ID NO: 637215 - RNA, 22 nt, Human
aguuauucauuuauucuguaca

SEQ ID NO: 637216 - RNA, 22 nt, Human
ugccagcucccuuuucuccucc

SEQ ID NO: 637217 - RNA, 22 nt, Human
agggacccauagagagaccagu

SEQ ID NO: 637218 - RNA, 21 nt, Human
uccucuccaugaucuguuugu

SEQ ID NO: 637219 - RNA, 22 nt, Human
gguuuaagacaggcuucacagu

SEQ ID NO: 637220 - RNA, 22 nt, Human
ucccugcuugcucucagcccuu

SEQ ID NO: 637221 - RNA, 22 nt, Human
ccagagaggccaaggucguggu

SEQ ID NO: 637222 - RNA, 22 nt, Human
auagaucauguuaaaagcucca

SEQ ID NO: 637223 - RNA, 22 nt, Human
ugcauguauuuaaaguugcaau

SEQ ID NO: 637224 - RNA, 22 nt, Human
gccuugccgcucagcagugggg

SEQ ID NO: 637225 - RNA, 22 nt, Human
aucagugcugagagacuaucaa

SEQ ID NO: 637226 - RNA, 22 nt, Human
agucagagucuauugcuguggu

SEQ ID NO: 637227 - RNA, 22 nt, Human
uaaaugcuccauacauacacca

SEQ ID NO: 637228 - RNA, 22 nt, Human
caaggaaaagaaguauuucaga

SEQ ID NO: 637229 - RNA, 22 nt, Human
uagaagcacugacagaguuuga

SEQ ID NO: 637230 - RNA, 22 nt, Human
uagaggcaaccaguguugagaa

SEQ ID NO: 637231 - RNA, 22 nt, Human
cacagcagauccagggguugug

SEQ ID NO: 637232 - RNA, 22 nt, Human
acccucaguaaucgugcaguuu

SEQ ID NO: 637233 - RNA, 22 nt, Human
agggggugucucugauuggguu

SEQ ID NO: 637234 - RNA, 22 nt, Human
uucugggacaucuggacaguuu

SEQ ID NO: 637235 - RNA, 22 nt, Human
ggugacaguuccggagguacag

SEQ ID NO: 637236 - RNA, 22 nt, Human
auucaguuauucagagaaggga

SEQ ID NO: 637237 - RNA, 22 nt, Human
aguggcagggacuucauauaaa

SEQ ID NO: 637238 - RNA, 22 nt, Human
caggcacacaggcucccugggc

SEQ ID NO: 637239 - RNA, 22 nt, Human
cucuaauacugaccaagucacc

SEQ ID NO: 637240 - RNA, 22 nt, Human
caggaaauguauaauuuuauaa

SEQ ID NO: 637241 - RNA, 22 nt, Human
uggcagagaacacacaugauuc

SEQ ID NO: 637242 - RNA, 17 nt, Human
cuccuggccaccccucu

SEQ ID NO: 637243 - RNA, 22 nt, Human
gacuugggagucuucugagaug

SEQ ID NO: 637244 - RNA, 22 nt, Human
ucugugaaacagcucuggcaug

SEQ ID NO: 637245 - RNA, 23 nt, Human
cggacaaccauuguuuuaguauc

SEQ ID NO: 637246 - RNA, 20 nt, Human
ucccucaguuuccagcccug

SEQ ID NO: 637247 - RNA, 22 nt, Human
gaaaggucaguuccacuuccau

SEQ ID NO: 637248 - RNA, 22 nt, Human
cuggcaggcggagguugcagug

SEQ ID NO: 637249 - RNA, 22 nt, Human
agggggagacauguguguguuu

SEQ ID NO: 637250 - RNA, 22 nt, Human
ucauauaaguuuaaaacuaucu

SEQ ID NO: 637251 - RNA, 22 nt, Human
auuuccacauaagggaaauaag

SEQ ID NO: 637252 - RNA, 22 nt, Human
guuucaaaaugaugcuguaacu

SEQ ID NO: 637253 - RNA, 23 nt, Human
ugggccacuauagaaaucucuca

SEQ ID NO: 637254 - RNA, 22 nt, Human
uuuauacuccacucugcaagcg

SEQ ID NO: 637255 - RNA, 22 nt, Human
uucauucauucaugaauguuaa

SEQ ID NO: 637256 - RNA, 20 nt, Human
aggggcaccugcgacggggc

SEQ ID NO: 637257 - RNA, 22 nt, Human
augaaugacugucuacuuuggg

SEQ ID NO: 637258 - RNA, 22 nt, Human
aucuauuuuaaauggcaguaaa

SEQ ID NO: 637259 - RNA, 22 nt, Human
cccugggaaguauuccagcuau

SEQ ID NO: 637260 - RNA, 22 nt, Human
aguguguaaugccaggggcugc

SEQ ID NO: 637261 - RNA, 22 nt, Human
gucuauguaaacgucuacauua

SEQ ID NO: 637262 - RNA, 22 nt, Human
aacacugaguaucagaguuggg

SEQ ID NO: 637263 - RNA, 22 nt, Human
guacauuucaguuuccuuaaga

SEQ ID NO: 637264 - RNA, 22 nt, Human
uauuaggguaaauuugacaugc

SEQ ID NO: 637265 - RNA, 22 nt, Human
cugucccauacuaucuggguga

SEQ ID NO: 637266 - RNA, 22 nt, Human
gcagcucugacaaugccuggaa

SEQ ID NO: 637267 - RNA, 22 nt, Human
uucuaucauacuugaauacauu

SEQ ID NO: 637268 - RNA, 22 nt, Human
aagcuuuaugacuuggagacag

SEQ ID NO: 637269 - RNA, 22 nt, Human
caggcaaggaggcacugaggga

SEQ ID NO: 637270 - RNA, 22 nt, Human
auguuaugugcaagauacauaa

SEQ ID NO: 637271 - RNA, 22 nt, Human
gugagcaguggccaggguccua

SEQ ID NO: 637272 - RNA, 22 nt, Human
uuuuccuuugaaaggugagggc

SEQ ID NO: 637273 - RNA, 22 nt, Human
uagaggauuuugcauuucauau

SEQ ID NO: 637274 - RNA, 20 nt, Human
cuaagaggaggacuagguuu

SEQ ID NO: 637275 - RNA, 22 nt, Human
gacagaguuguugauguaugcu

SEQ ID NO: 637276 - RNA, 22 nt, Human
auuuagugaaacccauaaagca

SEQ ID NO: 637277 - RNA, 22 nt, Human
gacagcuucuaugugacgagca

SEQ ID NO: 637278 - RNA, 22 nt, Human
agcaugcugguguucauggcag

SEQ ID NO: 637279 - RNA, 22 nt, Human
ugggaggaucucuugaggccag

SEQ ID NO: 637280 - RNA, 22 nt, Human
agauggcugggccccaccccag

SEQ ID NO: 637281 - RNA, 20 nt, Human
acuccagguggcaugaggac

SEQ ID NO: 637282 - RNA, 22 nt, Human
ugugaauagugccgcaauaaac

SEQ ID NO: 637283 - RNA, 22 nt, Human
cauggccaaagaauuauauuuu

SEQ ID NO: 637284 - RNA, 22 nt, Human
ugguuuuaaaaacaugcugcau

SEQ ID NO: 637285 - RNA, 22 nt, Human
agugugggcccccagguuagcc

SEQ ID NO: 637286 - RNA, 22 nt, Human
aacaaaugauuguugguuggag

SEQ ID NO: 637287 - RNA, 20 nt, Human
cagaacagucugagaggcca

SEQ ID NO: 637288 - RNA, 22 nt, Human
cagauaaaggcuuacuaguagu

SEQ ID NO: 637289 - RNA, 22 nt, Human
uuccaguucuggcuuugccacu

SEQ ID NO: 637290 - RNA, 22 nt, Human
acagcuggcaggggggcaugaa

SEQ ID NO: 637291 - RNA, 22 nt, Human
aggagcagaacuguuguggagg

SEQ ID NO: 637292 - RNA, 22 nt, Human
agaaagaacguugguuaucuua

SEQ ID NO: 637293 - RNA, 22 nt, Human
uucaagucugcccagagucagc

SEQ ID NO: 637294 - RNA, 22 nt, Human
cccagccugucuuucccaauga

SEQ ID NO: 637295 - RNA, 22 nt, Human
ccaggcuguaagagugauguug

SEQ ID NO: 637296 - RNA, 22 nt, Human
ccaggcucugcaaaaucaggcu

SEQ ID NO: 637297 - RNA, 22 nt, Human
uuucacaucagagguagauuag

SEQ ID NO: 637298 - RNA, 20 nt, Human
gcucccagccugcagucccc

SEQ ID NO: 637299 - RNA, 21 nt, Human
uggcugccuggcucugugguu

SEQ ID NO: 637300 - RNA, 22 nt, Human
ucccagccaggcucuaccacuu

SEQ ID NO: 637301 - RNA, 22 nt, Human
gaggaaaugguuguucaggugg

SEQ ID NO: 637302 - RNA, 22 nt, Human
ggcccugagcugaaguacugug

SEQ ID NO: 637303 - RNA, 18 nt, Human
aacaguuuccagauucuc

SEQ ID NO: 637304 - RNA, 22 nt, Human
uagggcucagcucuagcuccug

SEQ ID NO: 637305 - RNA, 22 nt, Human
uuguuuccagcaaauaguccau

SEQ ID NO: 637306 - RNA, 22 nt, Human
uucuaaucugggcuucugcagu

SEQ ID NO: 637307 - RNA, 22 nt, Human
accagcaggccaggggcacugc

SEQ ID NO: 637308 - RNA, 22 nt, Human
aagggugcauugcgcggggcug

SEQ ID NO: 637309 - RNA, 22 nt, Human
uagcuucuggaguguuugaaaa

SEQ ID NO: 637310 - RNA, 22 nt, Human
uguacagauaaagacuguaaau

SEQ ID NO: 637311 - RNA, 22 nt, Human
uggcacugggaugcuacuguua

SEQ ID NO: 637312 - RNA, 22 nt, Human
aggcuggagggcaauggcaaga

SEQ ID NO: 637313 - RNA, 22 nt, Human
agagacugcuuuauauuguacu

SEQ ID NO: 637314 - RNA, 22 nt, Human
ugaggcucagugagcccugcag

SEQ ID NO: 637315 - RNA, 22 nt, Human
auugcuuaucuaucuuuaaguc

SEQ ID NO: 637316 - RNA, 22 nt, Human
cagccagugguugaagaugcag

SEQ ID NO: 637317 - RNA, 22 nt, Human
aauuaagaaaauguuuuaugau

SEQ ID NO: 637318 - RNA, 22 nt, Human
gcccacacaccagcucaggagg

SEQ ID NO: 637319 - RNA, 22 nt, Human
ggcauguaugugcauuuuugua

SEQ ID NO: 637320 - RNA, 22 nt, Human
ggaggugggcuaaggacucucu

SEQ ID NO: 637321 - RNA, 22 nt, Human
agggcuacugccugccuucagg

SEQ ID NO: 637322 - RNA, 22 nt, Human
aacagaguggagccaaacuuug

SEQ ID NO: 637323 - RNA, 22 nt, Human
agcaggaggagagccuggcggu

SEQ ID NO: 637324 - RNA, 22 nt, Human
gcccaggaagugacucagaugu

SEQ ID NO: 637325 - RNA, 18 nt, Human
gugggguguugugaggau

SEQ ID NO: 637326 - RNA, 22 nt, Human
aagaggaagucuccauggagag

SEQ ID NO: 637327 - RNA, 23 nt, Human
ucuugaaaagccuacagcaguuc

SEQ ID NO: 637328 - RNA, 22 nt, Human
aggcuggcuggggaugcgucuu

SEQ ID NO: 637329 - RNA, 20 nt, Human
cccaggaguuugcucuuacu

SEQ ID NO: 637330 - RNA, 20 nt, Human
accccacagaguccauugca

SEQ ID NO: 637331 - RNA, 21 nt, Human
ccagacuugaguguauguugu

SEQ ID NO: 637332 - RNA, 22 nt, Human
ucauggaagagguauuuuuugu

SEQ ID NO: 637333 - RNA, 22 nt, Human
cagucucucuuguagugcagcu

SEQ ID NO: 637334 - RNA, 22 nt, Human
gaugaagcuauuugguuggcac

SEQ ID NO: 637335 - RNA, 22 nt, Human
uuuugcuugagugcacaaaaug

SEQ ID NO: 637336 - RNA, 22 nt, Human
gccuggagcucuccacuugggg

SEQ ID NO: 637337 - RNA, 22 nt, Human
caaguucacguugcuuuuugag

SEQ ID NO: 637338 - RNA, 22 nt, Human
aauugucuucuccuuccuggca

SEQ ID NO: 637339 - RNA, 22 nt, Human
ucuucagucaauccagauguuu

SEQ ID NO: 637340 - RNA, 22 nt, Human
uuguuucccuggaucuagagcu

SEQ ID NO: 637341 - RNA, 19 nt, Human
uuuucucagcuucuagcgg

SEQ ID NO: 637342 - RNA, 22 nt, Human
agcaccugucacaagcagaagg

SEQ ID NO: 637343 - RNA, 22 nt, Human
auaugugugccauuucagcagu

SEQ ID NO: 637344 - RNA, 18 nt, Human
cagacacucugcucugca

SEQ ID NO: 637345 - RNA, 23 nt, Human
ucuuuccucagcacacaccaaga

SEQ ID NO: 637346 - RNA, 22 nt, Human
acaacuuuguagcaauuccacg

SEQ ID NO: 637347 - RNA, 22 nt, Human
ucuuauuggauaaaaggaaacc

SEQ ID NO: 637348 - RNA, 19 nt, Human
cagccucaaucccucgggc

SEQ ID NO: 637349 - RNA, 22 nt, Human
aggcuggcaaggcagaugugug

SEQ ID NO: 637350 - RNA, 22 nt, Human
gcugcuuuuuggauuuggcaca

SEQ ID NO: 637351 - RNA, 22 nt, Human
caccacuguaucccuagcacuu

SEQ ID NO: 637352 - RNA, 22 nt, Human
uaacacuugaagccauuuuugc

SEQ ID NO: 637353 - RNA, 22 nt, Human
aaggcagccagauccuuugggu

SEQ ID NO: 637354 - RNA, 20 nt, Human
uggcuucucuucacuccugu

SEQ ID NO: 637355 - RNA, 23 nt, Human
ggucagugaguucguuucucugg

SEQ ID NO: 637356 - RNA, 22 nt, Human
ugguaaaauauuacaaggcacu

SEQ ID NO: 637357 - RNA, 22 nt, Human
augucuucucuguagguaaauu

SEQ ID NO: 637358 - RNA, 22 nt, Human
agugucugugaugaggucagga

SEQ ID NO: 637359 - RNA, 18 nt, Human
uucaagaguuucucuagg

SEQ ID NO: 637360 - RNA, 22 nt, Human
agauuuuauagauaauuuccca

SEQ ID NO: 637361 - RNA, 17 nt, Human
accaccucucaccagca

SEQ ID NO: 637362 - RNA, 20 nt, Human
uacugggcaagcccacagac

SEQ ID NO: 637363 - RNA, 22 nt, Human
agcccagaggguagcagaagaa

SEQ ID NO: 637364 - RNA, 22 nt, Human
gcaugcaguaaaauucagcaac

SEQ ID NO: 637365 - RNA, 22 nt, Human
gugaaacuucacauuuugauag

SEQ ID NO: 637366 - RNA, 22 nt, Human
gaagagcugacagugucauccu

SEQ ID NO: 637367 - RNA, 20 nt, Human
ucagugcucaggcaccaggu

SEQ ID NO: 637368 - RNA, 22 nt, Human
aacaugcauuugugggauggaa

SEQ ID NO: 637369 - RNA, 22 nt, Human
uuggcucagcugggacuguuga

SEQ ID NO: 637370 - RNA, 22 nt, Human
cugguggguagagggcaucagg

SEQ ID NO: 637371 - RNA, 20 nt, Human
ucagauuuuucuaacuuuga

SEQ ID NO: 637372 - RNA, 22 nt, Human
ccaggccugugcaaggagggag

SEQ ID NO: 637373 - RNA, 22 nt, Human
cugggccuccagcucugccagc

SEQ ID NO: 637374 - RNA, 20 nt, Human
agagguucagucuggagaag

SEQ ID NO: 637375 - RNA, 23 nt, Human
gcucagguggcucagggacugau

SEQ ID NO: 637376 - RNA, 22 nt, Human
guacaaauugauacagauuuga

SEQ ID NO: 637377 - RNA, 20 nt, Human
gcauugaguauagacagaug

SEQ ID NO: 637378 - RNA, 22 nt, Human
cauggcuuuguucauauaauuu

SEQ ID NO: 637379 - RNA, 23 nt, Human
acaaugcacuuuaaaugguuccc

SEQ ID NO: 637380 - RNA, 22 nt, Human
ucugugccuuuaagaagcucau

SEQ ID NO: 637381 - RNA, 22 nt, Human
uauuuucaccuucucuggauau

SEQ ID NO: 637382 - RNA, 22 nt, Human
augacaaaaugaaugcagcuag

SEQ ID NO: 637383 - RNA, 22 nt, Human
acugagaugaauagauggcaag

SEQ ID NO: 637384 - RNA, 22 nt, Human
agagggggaaaauagagguguu

SEQ ID NO: 637385 - RNA, 22 nt, Human
ccucuucugagugagacucccu

SEQ ID NO: 637386 - RNA, 22 nt, Human
aauguauuccucaugcaagagu

SEQ ID NO: 637387 - RNA, 22 nt, Human
gcucaguguguucaagggcuca

SEQ ID NO: 637388 - RNA, 22 nt, Human
aagaguuugggcaagucauaaa

SEQ ID NO: 637389 - RNA, 22 nt, Human
gauguccugcagaaacaugaga

SEQ ID NO: 637390 - RNA, 22 nt, Human
ggaguauuguagcuuccaguuc

SEQ ID NO: 637391 - RNA, 22 nt, Human
acccagucauccuggugugaga

SEQ ID NO: 637392 - RNA, 22 nt, Human
ugcagggcacacgcacgggugu

SEQ ID NO: 637393 - RNA, 22 nt, Human
auguuauaaauagagacacugg

SEQ ID NO: 637394 - RNA, 22 nt, Human
ugcugggcagugugcccucgag

SEQ ID NO: 637395 - RNA, 22 nt, Human
guuauucugcgaugcaauccug

SEQ ID NO: 637396 - RNA, 22 nt, Human
gauaaaauucuuauuuuacccg

SEQ ID NO: 637397 - RNA, 22 nt, Human
cagcuuccaucuccacugcccu

SEQ ID NO: 637398 - RNA, 21 nt, Human
ggcuuuaugcucacccagccu

SEQ ID NO: 637399 - RNA, 22 nt, Human
gaggggcaagaaguuggccucu

SEQ ID NO: 637400 - RNA, 22 nt, Human
cugcgugucucugucucauggc

SEQ ID NO: 637401 - RNA, 22 nt, Human
uuacagauguaggaacugaagu

SEQ ID NO: 637402 - RNA, 22 nt, Human
uucuccgcuaaguucucugcag

SEQ ID NO: 637403 - RNA, 19 nt, Human
ugaagcaauaccauuuuug

SEQ ID NO: 637404 - RNA, 22 nt, Human
gccuggggccagcuugggcuga

SEQ ID NO: 637405 - RNA, 22 nt, Human
augggaaguguuagaagauuuu

SEQ ID NO: 637406 - RNA, 22 nt, Human
ucuucacauuuuagugguuugu

SEQ ID NO: 637407 - RNA, 18 nt, Human
ucccuccugccugcuucc

SEQ ID NO: 637408 - RNA, 22 nt, Human
uucugauacagucccaacacaa

SEQ ID NO: 637409 - RNA, 22 nt, Human
gcugugugaaaacugggccugg

SEQ ID NO: 637410 - RNA, 22 nt, Human
uucucuggcgcgcugugcuaug

SEQ ID NO: 637411 - RNA, 22 nt, Human
cuugcacaggaucugaaguggg

SEQ ID NO: 637412 - RNA, 22 nt, Human
uccuggaucagcgggggcaggc

SEQ ID NO: 637413 - RNA, 22 nt, Human
gggcugggauggcuugaagauu

SEQ ID NO: 637414 - RNA, 22 nt, Human
cugucaucacaguugagcagcc

SEQ ID NO: 637415 - RNA, 22 nt, Human
auguaacuuccucagggauggu

SEQ ID NO: 637416 - RNA, 22 nt, Human
aaauacauuuacagucguggcu

SEQ ID NO: 637417 - RNA, 22 nt, Human
guguauguucuacuuaauauua

SEQ ID NO: 637418 - RNA, 22 nt, Human
uuuucaguuugcacugcagugc

SEQ ID NO: 637419 - RNA, 22 nt, Human
uaaacacucacuucauagccau

SEQ ID NO: 637420 - RNA, 22 nt, Human
ugugacaagcauuguauauugg

SEQ ID NO: 637421 - RNA, 22 nt, Human
acugaucuguuuucagauucug

SEQ ID NO: 637422 - RNA, 22 nt, Human
gcugcgccggaucccacguucc

SEQ ID NO: 637423 - RNA, 22 nt, Human
cacagagacagaucuauuuugc

SEQ ID NO: 637424 - RNA, 22 nt, Human
aggcacaggaacaggaaaagag

SEQ ID NO: 637425 - RNA, 22 nt, Human
agccagggacgcugcaggcuac

SEQ ID NO: 637426 - RNA, 22 nt, Human
gaauuaaaauaguuuuggucga

SEQ ID NO: 637427 - RNA, 22 nt, Human
augauauacuuccuagaacagu

SEQ ID NO: 637428 - RNA, 22 nt, Human
guccucuggccuuucccaggac

SEQ ID NO: 637429 - RNA, 22 nt, Human
aguaaaugaaagcaauuuuaga

SEQ ID NO: 637430 - RNA, 18 nt, Human
cccggcuaauuuuuggua

SEQ ID NO: 637431 - RNA, 21 nt, Human
gacaggugauucagagcaggg

SEQ ID NO: 637432 - RNA, 22 nt, Human
ccaggcuuucuccugacucaca

SEQ ID NO: 637433 - RNA, 22 nt, Human
ggaggccaguccuggccgggcu

SEQ ID NO: 637434 - RNA, 22 nt, Human
cagcauuuggaggagaggcuuu

SEQ ID NO: 637435 - RNA, 19 nt, Human
ccuggcccugcugcgcggg

SEQ ID NO: 637436 - RNA, 20 nt, Human
auuccauaguuggcacuuuu

SEQ ID NO: 637437 - RNA, 22 nt, Human
cucccuggcagccgcacuccug

SEQ ID NO: 637438 - RNA, 22 nt, Human
guagggcucaguaaauacuuug

SEQ ID NO: 637439 - RNA, 22 nt, Human
uccuagaauaaucuuugacugc

SEQ ID NO: 637440 - RNA, 22 nt, Human
uucaaguccuuuggaaggccug

SEQ ID NO: 637441 - RNA, 22 nt, Human
uuaauuacaaaacacauagguu

SEQ ID NO: 637442 - RNA, 22 nt, Human
aagcaugggaggccuggaggag

SEQ ID NO: 637443 - RNA, 22 nt, Human
aggcacaguuucauccccgggc

SEQ ID NO: 637444 - RNA, 22 nt, Human
guccuuggagcuccccucugua

SEQ ID NO: 637445 - RNA, 22 nt, Human
cagaggcuagacugugcuuccu

SEQ ID NO: 637446 - RNA, 22 nt, Human
acacauguuuccaaaagcaccc

SEQ ID NO: 637447 - RNA, 22 nt, Human
aagcuuuaagugucagucagcc

SEQ ID NO: 637448 - RNA, 22 nt, Human
agucagucaccauuuaagaaca

SEQ ID NO: 637449 - RNA, 22 nt, Human
caggcacugugcuagauccuug

SEQ ID NO: 637450 - RNA, 22 nt, Human
uauguacaagcacacaugugac

SEQ ID NO: 637451 - RNA, 22 nt, Human
uguggcugacuccuggucccca

SEQ ID NO: 637452 - RNA, 22 nt, Human
agugucugcuuugagucaggug

SEQ ID NO: 637453 - RNA, 22 nt, Human
uugcaacauuguaaguuuauau

SEQ ID NO: 637454 - RNA, 22 nt, Human
ugggauaguagcugagagacaa

SEQ ID NO: 637455 - RNA, 22 nt, Human
uucuuuuagaauuuccuaaggu

SEQ ID NO: 637456 - RNA, 22 nt, Human
cugcucugacccuuucaccuuc

SEQ ID NO: 637457 - RNA, 22 nt, Human
gcucuggagauggagccuugag

SEQ ID NO: 637458 - RNA, 22 nt, Human
cacuguggugugagggcugaug

SEQ ID NO: 637459 - RNA, 22 nt, Human
agucuucugaauaagaaucacu

SEQ ID NO: 637460 - RNA, 22 nt, Human
gugggguguccagcagcgagcu

SEQ ID NO: 637461 - RNA, 22 nt, Human
gcacugaaugcuuuuacuguaa

SEQ ID NO: 637462 - RNA, 22 nt, Human
cugcagaugucucaauuuuauu

SEQ ID NO: 637463 - RNA, 19 nt, Human
ucucuacacuacauuucua

SEQ ID NO: 637464 - RNA, 22 nt, Human
gcuucagacugugcuucuguug

SEQ ID NO: 637465 - RNA, 22 nt, Human
ucacuccauagcuuaacucuuu

SEQ ID NO: 637466 - RNA, 22 nt, Human
auuccagaugaauugcauaguu

SEQ ID NO: 637467 - RNA, 22 nt, Human
ugcuccauucucuagccagugc

SEQ ID NO: 637468 - RNA, 22 nt, Human
gagucagaauuguauuuuaaac

SEQ ID NO: 637469 - RNA, 22 nt, Human
gaggagaggccaucguuguuau

SEQ ID NO: 637470 - RNA, 22 nt, Human
ugguuugagagugugagcuuuu

SEQ ID NO: 637471 - RNA, 22 nt, Human
gaagacaucauggagaggauag

SEQ ID NO: 637472 - RNA, 22 nt, Human
aagauucuuauuagguaauuuu

SEQ ID NO: 637473 - RNA, 22 nt, Human
agugcuuuaccuagauaauguu

SEQ ID NO: 637474 - RNA, 22 nt, Human
aagaaugucguugguauuuuaa

SEQ ID NO: 637475 - RNA, 22 nt, Human
ucacccaggauauugaagucag

SEQ ID NO: 637476 - RNA, 22 nt, Human
acugugcaaugaguaauaaacu

SEQ ID NO: 637477 - RNA, 22 nt, Human
agagcugucagcguuuuggcca

SEQ ID NO: 637478 - RNA, 20 nt, Human
uaaacaguauuuacuaggag

SEQ ID NO: 637479 - RNA, 22 nt, Human
uuuaaaaguuaucaucugucca

SEQ ID NO: 637480 - RNA, 22 nt, Human
acaaaugucuccucuuuuguua

SEQ ID NO: 637481 - RNA, 22 nt, Human
acuuaaaguaguuuuacugugg

SEQ ID NO: 637482 - RNA, 22 nt, Human
uagcaucuguacugacauaauc

SEQ ID NO: 637483 - RNA, 22 nt, Human
agccacuccuucagcgucugcu

SEQ ID NO: 637484 - RNA, 22 nt, Human
ucaucuuuguaucccuaacaca

SEQ ID NO: 637485 - RNA, 22 nt, Human
caggcucccugcaggccaguga

SEQ ID NO: 637486 - RNA, 22 nt, Human
ugcuuguccgaggugaguacuu

SEQ ID NO: 637487 - RNA, 21 nt, Human
ggcauggcaccucugggcagg

SEQ ID NO: 637488 - RNA, 22 nt, Human
agacaacaucacuaaagcugag

SEQ ID NO: 637489 - RNA, 22 nt, Human
cucuggggaaauggauauguac

SEQ ID NO: 637490 - RNA, 22 nt, Human
gucuauaagcaggggaaaacuu

SEQ ID NO: 637491 - RNA, 17 nt, Human
cuuuuaauuuacuuccc

SEQ ID NO: 637492 - RNA, 22 nt, Human
ugauuaauaucaccaccauugg

SEQ ID NO: 637493 - RNA, 22 nt, Human
uucuacuugccaaaugacacau

SEQ ID NO: 637494 - RNA, 22 nt, Human
aagcagaucugauagggcccug

SEQ ID NO: 637495 - RNA, 22 nt, Human
cugaagauucgccuuuguuuau

SEQ ID NO: 637496 - RNA, 22 nt, Human
accuuccucuaagacauuuagc

SEQ ID NO: 637497 - RNA, 22 nt, Human
ggggcucaggggaaguguccag

SEQ ID NO: 637498 - RNA, 22 nt, Human
aaauaucauucuggugcacaga

SEQ ID NO: 637499 - RNA, 22 nt, Human
ucccacaggaaaguagacauug

SEQ ID NO: 637500 - RNA, 22 nt, Human
guuccucaaaaaggagagcccc

SEQ ID NO: 637501 - RNA, 19 nt, Human
uugagaacaccaaguacug

SEQ ID NO: 637502 - RNA, 22 nt, Human
guacacacaaucucuggucagu

SEQ ID NO: 637503 - RNA, 22 nt, Human
ggcauagcggcucagcguccag

SEQ ID NO: 637504 - RNA, 22 nt, Human
ucuuuagugacaguugugcaag

SEQ ID NO: 637505 - RNA, 22 nt, Human
uuacagaagaguaacuuggcaa

SEQ ID NO: 637506 - RNA, 22 nt, Human
uccacagguaugaggccccacc

SEQ ID NO: 637507 - RNA, 22 nt, Human
cucacagcauggaauuuucugg

SEQ ID NO: 637508 - RNA, 22 nt, Human
gaggagcugggacccugucauc

SEQ ID NO: 637509 - RNA, 20 nt, Human
cagauggcacgucagggcau

SEQ ID NO: 637510 - RNA, 22 nt, Human
agaaagacaaaaugcaguggcu

SEQ ID NO: 637511 - RNA, 22 nt, Human
ucgcugugguuucuguacaugg

SEQ ID NO: 637512 - RNA, 22 nt, Human
uuuaccaagaguugucacuguu

SEQ ID NO: 637513 - RNA, 22 nt, Human
aaaguagucucuuucaucuuuu

SEQ ID NO: 637514 - RNA, 22 nt, Human
ucugagcuacgaugccugucac

SEQ ID NO: 637515 - RNA, 22 nt, Human
cauucugcauuuggaaggggca

SEQ ID NO: 637516 - RNA, 22 nt, Human
gugcaaaagcaguugugguuuu

SEQ ID NO: 637517 - RNA, 22 nt, Human
agagcacaugguuccugugucc

SEQ ID NO: 637518 - RNA, 22 nt, Human
auggauggaacucugcuguggu

SEQ ID NO: 637519 - RNA, 22 nt, Human
ccagcuggaagagugcagaacu

SEQ ID NO: 637520 - RNA, 22 nt, Human
ucagauuucuagcguuuggcca

SEQ ID NO: 637521 - RNA, 20 nt, Human
ggcauggguggggcucccag

SEQ ID NO: 637522 - RNA, 22 nt, Human
uccaggccacgaccuccuggau

SEQ ID NO: 637523 - RNA, 21 nt, Human
agguggcugcauccucagaag

SEQ ID NO: 637524 - RNA, 22 nt, Human
gaagccacaacuuuuucuuagc

SEQ ID NO: 637525 - RNA, 22 nt, Human
gggagagcgggaggugccacag

SEQ ID NO: 637526 - RNA, 22 nt, Human
cucuuaguuuaucuuugacaaa

SEQ ID NO: 637527 - RNA, 22 nt, Human
ucaggcaaggcccuuagagugu

SEQ ID NO: 637528 - RNA, 22 nt, Human
gcugugcagauguagggagugg

SEQ ID NO: 637529 - RNA, 22 nt, Human
acugauacgguuuuagagucca

SEQ ID NO: 637530 - RNA, 22 nt, Human
ucacuguaccuuccauuucauu

SEQ ID NO: 637531 - RNA, 22 nt, Human
agcaaagcacuuugcauacaua

SEQ ID NO: 637532 - RNA, 22 nt, Human
agcugacugaugaagaggccuu

SEQ ID NO: 637533 - RNA, 22 nt, Human
uacaaagugaaauaauucugag

SEQ ID NO: 637534 - RNA, 22 nt, Human
guggcccagcccuacagaggac

SEQ ID NO: 637535 - RNA, 22 nt, Human
ucagaacagcaggguguggcug

SEQ ID NO: 637536 - RNA, 22 nt, Human
ucacucaauaucccaguggggc

SEQ ID NO: 637537 - RNA, 22 nt, Human
ugaacucuccaggcaaaugauc

SEQ ID NO: 637538 - RNA, 22 nt, Human
cuucugugacguaugugaggac

SEQ ID NO: 637539 - RNA, 22 nt, Human
ucuucaugcaccucacagcuag

SEQ ID NO: 637540 - RNA, 22 nt, Human
cagaguuugcaagggcagaagc

SEQ ID NO: 637541 - RNA, 23 nt, Human
ugaaagcaaugggucuauaguau

SEQ ID NO: 637542 - RNA, 22 nt, Human
uagugcuuggcccuaccagaua

SEQ ID NO: 637543 - RNA, 22 nt, Human
aggcuaagauguggucugagca

SEQ ID NO: 637544 - RNA, 22 nt, Human
agagauggccuuaggugggaau

SEQ ID NO: 637545 - RNA, 22 nt, Human
aggcaguggaugucaggaaugg

SEQ ID NO: 637546 - RNA, 22 nt, Human
agaaaacacugcccccucucuc

SEQ ID NO: 637547 - RNA, 22 nt, Human
uuugaaauguaucaguauaggu

SEQ ID NO: 637548 - RNA, 22 nt, Human
uguaugcuuugguuguuucucu

SEQ ID NO: 637549 - RNA, 22 nt, Human
auucugagcuacuaauuaggca

SEQ ID NO: 637550 - RNA, 22 nt, Human
ugagagcugaagauauguuaac

SEQ ID NO: 637551 - RNA, 22 nt, Human
ugguccagcuugauucucuucu

SEQ ID NO: 637552 - RNA, 22 nt, Human
aaguaacuaaagauauccauuu

SEQ ID NO: 637553 - RNA, 22 nt, Human
aacagugcuucauucacacauu

SEQ ID NO: 637554 - RNA, 22 nt, Human
cuggcaguguccagcucgugau

SEQ ID NO: 637555 - RNA, 22 nt, Human
cuuggggacacagagcccaggg

SEQ ID NO: 637556 - RNA, 22 nt, Human
cacaguacuuaauucucuaaau

SEQ ID NO: 637557 - RNA, 22 nt, Human
aaagaagcauaggcuagacuuc

SEQ ID NO: 637558 - RNA, 22 nt, Human
uggagagaagaggcagugugcu

SEQ ID NO: 637559 - RNA, 22 nt, Human
cggagggguuugaacagaggag

SEQ ID NO: 637560 - RNA, 22 nt, Human
cauugcacugcagcccgggcaa

SEQ ID NO: 637561 - RNA, 22 nt, Human
auaaccugguaguauuaaaugu

SEQ ID NO: 637562 - RNA, 22 nt, Human
cauauuuauagaucuggcauuu

SEQ ID NO: 637563 - RNA, 22 nt, Human
uucuaguuaauguagcaucuug

SEQ ID NO: 637564 - RNA, 22 nt, Human
gggagccaugcuggucuucuuu

SEQ ID NO: 637565 - RNA, 19 nt, Human
ccucuuccucugacacuau

SEQ ID NO: 637566 - RNA, 22 nt, Human
uggcagaauuuuaaagacagau

SEQ ID NO: 637567 - RNA, 22 nt, Human
aagcaauagcaacaacuuuaca

SEQ ID NO: 637568 - RNA, 22 nt, Human
uuacaaguucagauuuucucau

SEQ ID NO: 637569 - RNA, 22 nt, Human
uucaagauggcugcaaauacuu

SEQ ID NO: 637570 - RNA, 22 nt, Human
cagcuucucgggagcgcaugug

SEQ ID NO: 637571 - RNA, 19 nt, Human
cucuccagcuccaguagcu

SEQ ID NO: 637572 - RNA, 22 nt, Human
gagcuucuuguuucuucaucug

SEQ ID NO: 637573 - RNA, 22 nt, Human
cugaggccccucucuugagcuu

SEQ ID NO: 637574 - RNA, 22 nt, Human
uggguuaauagaaucauuaacu

SEQ ID NO: 637575 - RNA, 22 nt, Human
uuguuuacuaagaaccugguca

SEQ ID NO: 637576 - RNA, 22 nt, Human
augcuuuauuggagacagucau

SEQ ID NO: 637577 - RNA, 22 nt, Human
ucugaaauucacaguugaguca

SEQ ID NO: 637578 - RNA, 19 nt, Human
aaacacagauuucuuacca

SEQ ID NO: 637579 - RNA, 22 nt, Human
agcauaaaggucaacguuuuag

SEQ ID NO: 637580 - RNA, 19 nt, Human
aggcccagcgcugggggcu

SEQ ID NO: 637581 - RNA, 22 nt, Human
caguggaggccuugggaccuuu

SEQ ID NO: 637582 - RNA, 22 nt, Human
acagucuacaaagugaugugug

SEQ ID NO: 637583 - RNA, 21 nt, Human
gcugcugugggccagggaggc

SEQ ID NO: 637584 - RNA, 22 nt, Human
ccuaggaagcugagauugcagu

SEQ ID NO: 637585 - RNA, 22 nt, Human
gcacccagaggucagcagugcu

SEQ ID NO: 637586 - RNA, 23 nt, Human
ucuauacauacugcagccucugg

SEQ ID NO: 637587 - RNA, 22 nt, Human
cuggugucuacuacaugguuga

SEQ ID NO: 637588 - RNA, 22 nt, Human
ggaggcugcugccucacguggg

SEQ ID NO: 637589 - RNA, 22 nt, Human
auucucaaacaagugguuugau

SEQ ID NO: 637590 - RNA, 22 nt, Human
auucagcaguuccugcuucagu

SEQ ID NO: 637591 - RNA, 22 nt, Human
gcugcaggaugaggcucugcuc

SEQ ID NO: 637592 - RNA, 22 nt, Human
cuggagagaaaugacaaagcua

SEQ ID NO: 637593 - RNA, 22 nt, Human
cuggguccuggugcugaguucu

SEQ ID NO: 637594 - RNA, 22 nt, Human
ucaggagagagaaauuggggcu

SEQ ID NO: 637595 - RNA, 22 nt, Human
guuucuuagacagacauuaucu

SEQ ID NO: 637596 - RNA, 20 nt, Human
augugucuuagagcaucagg

SEQ ID NO: 637597 - RNA, 22 nt, Human
ucauucagagagaauguuccag

SEQ ID NO: 637598 - RNA, 22 nt, Human
uuguaauuugcaaauguauugu

SEQ ID NO: 637599 - RNA, 23 nt, Human
uuugugaaaguguugagaggaga

SEQ ID NO: 637600 - RNA, 22 nt, Human
uugauucuuagcuggugauaau

SEQ ID NO: 637601 - RNA, 22 nt, Human
cuguugugaauuuaguuaccaa

SEQ ID NO: 637602 - RNA, 22 nt, Human
ccuuaaagaauaagucuuaucu

SEQ ID NO: 637603 - RNA, 23 nt, Human
cauguacagaguuugauaaagug

SEQ ID NO: 637604 - RNA, 22 nt, Human
ccagccagaaguccgggcuucu

SEQ ID NO: 637605 - RNA, 22 nt, Human
ucaagcaaguugcauauugcua

SEQ ID NO: 637606 - RNA, 22 nt, Human
cagcaaaacagccguugccugg

SEQ ID NO: 637607 - RNA, 22 nt, Human
acugcucacgcauuacuugagc

SEQ ID NO: 637608 - RNA, 22 nt, Human
ucauaguuuuacuuaguggugu

SEQ ID NO: 637609 - RNA, 22 nt, Human
ucucuggguucucacucagcac

SEQ ID NO: 637610 - RNA, 22 nt, Human
ggcagccaugcuccaggugcag

SEQ ID NO: 637611 - RNA, 22 nt, Human
aguuuuucugggaggcacugcu

SEQ ID NO: 637612 - RNA, 20 nt, Human
uggccaccacuguauaucaa

SEQ ID NO: 637613 - RNA, 22 nt, Human
ucagggaggugucugccagaga

SEQ ID NO: 637614 - RNA, 22 nt, Human
cucuguugagcauuuuuccccu

SEQ ID NO: 637615 - RNA, 22 nt, Human
ugccaccuugugcagcaggagg

SEQ ID NO: 637616 - RNA, 22 nt, Human
cuugcagaggcuguuccagaug

SEQ ID NO: 637617 - RNA, 22 nt, Human
agguaaugcauauaaagugcuu

SEQ ID NO: 637618 - RNA, 22 nt, Human
uaucuguucuuagcuauagaug

SEQ ID NO: 637619 - RNA, 22 nt, Human
ggcaggcaggagcucugucucc

SEQ ID NO: 637620 - RNA, 22 nt, Human
auuaaauuggacgcugggggaa

SEQ ID NO: 637621 - RNA, 22 nt, Human
ucugccuguggauacaugcucu

SEQ ID NO: 637622 - RNA, 23 nt, Human
ccaggaagaggccauccacaguc

SEQ ID NO: 637623 - RNA, 22 nt, Human
gcuggguccaugguccucgggu

SEQ ID NO: 637624 - RNA, 22 nt, Human
gcaggaagccuuaccaagccca

SEQ ID NO: 637625 - RNA, 22 nt, Human
ugcagggccagacuggguugga

SEQ ID NO: 637626 - RNA, 22 nt, Human
uacaaaugccugacacacagau

SEQ ID NO: 637627 - RNA, 22 nt, Human
guucacaguuaggacaacugcu

SEQ ID NO: 637628 - RNA, 22 nt, Human
caauaaagaagauuuuugcaau

SEQ ID NO: 637629 - RNA, 22 nt, Human
uuggccuccacauuuuccaggu

SEQ ID NO: 637630 - RNA, 19 nt, Human
uuuuuacaaguagguguga

SEQ ID NO: 637631 - RNA, 22 nt, Human
aguuagugagcucuugggaccu

SEQ ID NO: 637632 - RNA, 22 nt, Human
gcaggugaaagugaguagugag

SEQ ID NO: 637633 - RNA, 23 nt, Human
guuaacaugguccauggaagagc

SEQ ID NO: 637634 - RNA, 22 nt, Human
gaaaguuucuucauuaagaugu

SEQ ID NO: 637635 - RNA, 22 nt, Human
cagcuccacuugaguggggccu

SEQ ID NO: 637636 - RNA, 22 nt, Human
ucaucucuagacaggaggcugg

SEQ ID NO: 637637 - RNA, 22 nt, Human
augcaggguucugggcuagaga

SEQ ID NO: 637638 - RNA, 22 nt, Human
agucagagaauaaagaaugcau

SEQ ID NO: 637639 - RNA, 22 nt, Human
cacagaacauuuuuagaugcag

SEQ ID NO: 637640 - RNA, 22 nt, Human
ccacagaggacaacugccuggc

SEQ ID NO: 637641 - RNA, 17 nt, Human
aucugcugacauucugu

SEQ ID NO: 637642 - RNA, 21 nt, Human
aggcucagagagaaacucuug

SEQ ID NO: 637643 - RNA, 22 nt, Human
gggacaugccccucagugggug

SEQ ID NO: 637644 - RNA, 22 nt, Human
augcacaguauguagggucuau

SEQ ID NO: 637645 - RNA, 22 nt, Human
gcacucugccaggucuccugau

SEQ ID NO: 637646 - RNA, 22 nt, Human
ucugccuguugcuagaauguca

SEQ ID NO: 637647 - RNA, 22 nt, Human
aucccacaccccuacaacauau

SEQ ID NO: 637648 - RNA, 22 nt, Human
ugcagggcagauaugacuguag

SEQ ID NO: 637649 - RNA, 19 nt, Human
cugaggcaaguggugguca

SEQ ID NO: 637650 - RNA, 22 nt, Human
ugucauuuuagugcaucacuca

SEQ ID NO: 637651 - RNA, 22 nt, Human
auuacaacuguucccacugucu

SEQ ID NO: 637652 - RNA, 22 nt, Human
aggaggcuuuugcaggugccac

SEQ ID NO: 637653 - RNA, 22 nt, Human
uuguaugaucaaaagaaaugua

SEQ ID NO: 637654 - RNA, 22 nt, Human
agaagcacuagaggguauggaa

SEQ ID NO: 637655 - RNA, 23 nt, Human
ggccaggugcaccuuagagagcc

SEQ ID NO: 637656 - RNA, 22 nt, Human
aauaaguugcuucagcuuggug

SEQ ID NO: 637657 - RNA, 19 nt, Human
uuggaaggagccagagugg

SEQ ID NO: 637658 - RNA, 22 nt, Human
aaaucacuuaaauggcuuauuu

SEQ ID NO: 637659 - RNA, 22 nt, Human
gcaguggauggccagcaggggc

SEQ ID NO: 637660 - RNA, 22 nt, Human
caaugcaaugcaaugcaaugca

SEQ ID NO: 637661 - RNA, 22 nt, Human
cagggcuguuagcugcugcucu

SEQ ID NO: 637662 - RNA, 22 nt, Human
gcagauggugggggaggaguac

SEQ ID NO: 637663 - RNA, 22 nt, Human
auuaaggaagccuauucucucc

SEQ ID NO: 637664 - RNA, 22 nt, Human
cuggugccauucuguggccuag

SEQ ID NO: 637665 - RNA, 22 nt, Human
ucacugaagacugggcucuaaa

SEQ ID NO: 637666 - RNA, 22 nt, Human
gggacuguccggcagaagguac

SEQ ID NO: 637667 - RNA, 22 nt, Human
uccuuacaacuuguuauuuuuc

SEQ ID NO: 637668 - RNA, 22 nt, Human
ucucucuaggcaucuauuuuca

SEQ ID NO: 637669 - RNA, 22 nt, Human
aaguuacaguuacagaauggag

SEQ ID NO: 637670 - RNA, 22 nt, Human
augcugugccuucucugugcca

SEQ ID NO: 637671 - RNA, 22 nt, Human
ugucagcacaucuguaaucaca

SEQ ID NO: 637672 - RNA, 22 nt, Human
acugacuguggauggcagcagc

SEQ ID NO: 637673 - RNA, 22 nt, Human
cauggcaggaggcugcuggcag

SEQ ID NO: 637674 - RNA, 23 nt, Human
caggcaggaugaggacuacacuc

SEQ ID NO: 637675 - RNA, 22 nt, Human
ucaggagcucuucccuggugug

SEQ ID NO: 637676 - RNA, 21 nt, Human
ggagcuggggagcuggcccca

SEQ ID NO: 637677 - RNA, 22 nt, Human
acugcucucugcaaguagaugg

SEQ ID NO: 637678 - RNA, 22 nt, Human
aagcacauuuggaaaacaugga

SEQ ID NO: 637679 - RNA, 22 nt, Human
guccucuguagggcugggccac

SEQ ID NO: 637680 - RNA, 22 nt, Human
uccacagguauuucuccuugcu

SEQ ID NO: 637681 - RNA, 22 nt, Human
cuuuccaacucuagugaaauuu

SEQ ID NO: 637682 - RNA, 22 nt, Human
cagggcagaacauauagauagu

SEQ ID NO: 637683 - RNA, 22 nt, Human
auccauuugacauaauuucagc

SEQ ID NO: 637684 - RNA, 17 nt, Human
aucaguagcauaucaga

SEQ ID NO: 637685 - RNA, 22 nt, Human
ucagugcauuguucauuguagg

SEQ ID NO: 637686 - RNA, 22 nt, Human
caggucuggguugauggccugg

SEQ ID NO: 637687 - RNA, 22 nt, Human
caugcacacugcaacaaggacu

SEQ ID NO: 637688 - RNA, 22 nt, Human
ugggccugaaauucccauuuua

SEQ ID NO: 637689 - RNA, 22 nt, Human
accaggccaacagcuaaguuaa

SEQ ID NO: 637690 - RNA, 22 nt, Human
aggugggggcuguguccuugac

SEQ ID NO: 637691 - RNA, 22 nt, Human
ccuugcaggggaacaggcagug

SEQ ID NO: 637692 - RNA, 22 nt, Human
uuucaaucaccauaaagcaacu

SEQ ID NO: 637693 - RNA, 22 nt, Human
gaagccaggggccugacaggca

SEQ ID NO: 637694 - RNA, 22 nt, Human
cuuauacacgaacacaaggugu

SEQ ID NO: 637695 - RNA, 21 nt, Human
aggugcaggccucaagcccca

SEQ ID NO: 637696 - RNA, 22 nt, Human
ggguuaaagagcccaauguaug

SEQ ID NO: 637697 - RNA, 22 nt, Human
ugggagcaagcuggugcuggag

SEQ ID NO: 637698 - RNA, 22 nt, Human
gcuguggccgucagggaaaugg

SEQ ID NO: 637699 - RNA, 22 nt, Human
uccaggccaauguagcaggccc

SEQ ID NO: 637700 - RNA, 22 nt, Human
gguaacuuagcucauggcugug

SEQ ID NO: 637701 - RNA, 22 nt, Human
guuaaacauugcuccacggguu

SEQ ID NO: 637702 - RNA, 22 nt, Human
uuugauuccuggggcagggcug

SEQ ID NO: 637703 - RNA, 22 nt, Human
ugcugagaggaaggugcacugg

SEQ ID NO: 637704 - RNA, 22 nt, Human
uuuucucuccagguggggugau

SEQ ID NO: 637705 - RNA, 22 nt, Human
ggcaucaggguaggaagguauc

SEQ ID NO: 637706 - RNA, 22 nt, Human
cagcaaggguuauaucaaagau

SEQ ID NO: 637707 - RNA, 22 nt, Human
uccagcuugacaaaugauuuua

SEQ ID NO: 637708 - RNA, 22 nt, Human
gugcuggggagauaggaagaga

SEQ ID NO: 637709 - RNA, 22 nt, Human
ugagccagaggaggcugugugg

SEQ ID NO: 637710 - RNA, 22 nt, Human
aguuuccaaauauuguuuuagc

SEQ ID NO: 637711 - RNA, 18 nt, Human
gcagagcaucaaggguua

SEQ ID NO: 637712 - RNA, 22 nt, Human
gaguuauagauggacuauuauu

SEQ ID NO: 637713 - RNA, 22 nt, Human
auguuucaguucuaaaguuaga

SEQ ID NO: 637714 - RNA, 22 nt, Human
ucagaaagcuauaugguguguc

SEQ ID NO: 637715 - RNA, 22 nt, Human
auggagccauuccugaagacuu

SEQ ID NO: 637716 - RNA, 22 nt, Human
aauuuuacuucccucaguguag

SEQ ID NO: 637717 - RNA, 22 nt, Human
cugcccuguuuggacagcccgg

SEQ ID NO: 637718 - RNA, 22 nt, Human
uagcauucagaacugagagcaa

SEQ ID NO: 637719 - RNA, 22 nt, Human
ggcuuggaaaugguaaugagcu

SEQ ID NO: 637720 - RNA, 22 nt, Human
gcugaauaggacugucaucucu

SEQ ID NO: 637721 - RNA, 20 nt, Human
cucuuaauugcucacauuag

SEQ ID NO: 637722 - RNA, 22 nt, Human
gcccagcaccucucucaggguu

SEQ ID NO: 637723 - RNA, 22 nt, Human
caacuuuaauuugggugucaga

SEQ ID NO: 637724 - RNA, 22 nt, Human
uagcuuuaagaugagaugugga

SEQ ID NO: 637725 - RNA, 22 nt, Human
ccugguguugugaaguagccgu

SEQ ID NO: 637726 - RNA, 22 nt, Human
agcaggcugagcacccaggggg

SEQ ID NO: 637727 - RNA, 22 nt, Human
aguccuucacguccugcuuauu

SEQ ID NO: 637728 - RNA, 22 nt, Human
caggguuucuguugagaagucc

SEQ ID NO: 637729 - RNA, 22 nt, Human
caaggcauucuugcagguaggg

SEQ ID NO: 637730 - RNA, 22 nt, Human
cagagcaguaaaucuggggcac

SEQ ID NO: 637731 - RNA, 22 nt, Human
gagaagccgagucagcugagcc

SEQ ID NO: 637732 - RNA, 22 nt, Human
guccugggccugcugaggcuga

SEQ ID NO: 637733 - RNA, 22 nt, Human
agcuguguuauuagaaaccugc

SEQ ID NO: 637734 - RNA, 22 nt, Human
acaugcuuccaaauuauguugg

SEQ ID NO: 637735 - RNA, 22 nt, Human
auaaauagugugucauaaaguc

SEQ ID NO: 637736 - RNA, 22 nt, Human
cagaauuuaaguggauuauucu

SEQ ID NO: 637737 - RNA, 22 nt, Human
cagagaacuccaguggcuggcg

SEQ ID NO: 637738 - RNA, 22 nt, Human
ccagagaguaucauggagagua

SEQ ID NO: 637739 - RNA, 22 nt, Human
ugggagcaguucagguguggcu

SEQ ID NO: 637740 - RNA, 17 nt, Human
gcaguuaaauuaagaug

SEQ ID NO: 637741 - RNA, 22 nt, Human
cagggccauuggcguggcuguc

SEQ ID NO: 637742 - RNA, 22 nt, Human
gguggccuagggcccagccugu

SEQ ID NO: 637743 - RNA, 22 nt, Human
aaaugucuuugaguuuuuauaa

SEQ ID NO: 637744 - RNA, 22 nt, Human
ugcuucuguauugaaauuguua

SEQ ID NO: 637745 - RNA, 22 nt, Human
ggaaaggagaugaauaggauua

SEQ ID NO: 637746 - RNA, 22 nt, Human
ccuuuggucaccuccacucuua

SEQ ID NO: 637747 - RNA, 22 nt, Human
cucugggccaccgcugguguau

SEQ ID NO: 637748 - RNA, 18 nt, Human
ccaaggccccugcugggg

SEQ ID NO: 637749 - RNA, 22 nt, Human
cacauuccuggugcucagcagc

SEQ ID NO: 637750 - RNA, 22 nt, Human
cccugccugugggcaucaacau

SEQ ID NO: 637751 - RNA, 22 nt, Human
ucuguuuugcauaauguucuuu

SEQ ID NO: 637752 - RNA, 20 nt, Human
ccuuuauuauuuguaugaug

SEQ ID NO: 637753 - RNA, 22 nt, Human
cccugccucugaagcugcucag

SEQ ID NO: 637754 - RNA, 22 nt, Human
uucccucugcgcauugaauuuc

SEQ ID NO: 637755 - RNA, 22 nt, Human
uauagugugugagagagugaaa

SEQ ID NO: 637756 - RNA, 22 nt, Human
gaggaggaaguucucuguaggc

SEQ ID NO: 637757 - RNA, 22 nt, Human
aacugcaauaacuugugcacca

SEQ ID NO: 637758 - RNA, 19 nt, Human
augucuguugaauuucaua

SEQ ID NO: 637759 - RNA, 22 nt, Human
aacauauucagaugccaagucc

SEQ ID NO: 637760 - RNA, 22 nt, Human
caguggcacccacgggcugggc

SEQ ID NO: 637761 - RNA, 22 nt, Human
gcugucuuuccccugcuccaga

SEQ ID NO: 637762 - RNA, 22 nt, Human
uagcaagcagauuagaagaucc

SEQ ID NO: 637763 - RNA, 22 nt, Human
uauuaugauucggacguggcag

SEQ ID NO: 637764 - RNA, 22 nt, Human
ugccaggaggaggugggacaga

SEQ ID NO: 637765 - RNA, 22 nt, Human
gcuuagcacagaaugagaguuc

SEQ ID NO: 637766 - RNA, 18 nt, Human
cauuccaaguucuaccuc

SEQ ID NO: 637767 - RNA, 22 nt, Human
augucuguuaaucgacccuaau

SEQ ID NO: 637768 - RNA, 22 nt, Human
gaucuguuugccuagagauuua

SEQ ID NO: 637769 - RNA, 22 nt, Human
aaugguuugauggacaaaauga

SEQ ID NO: 637770 - RNA, 22 nt, Human
ccaggcucugucuggucagaag

SEQ ID NO: 637771 - RNA, 22 nt, Human
accauacuugaaauggauagga

SEQ ID NO: 637772 - RNA, 22 nt, Human
gacugagaaacaguacauuacc

SEQ ID NO: 637773 - RNA, 22 nt, Human
gccuuuggcucugucugaccug

SEQ ID NO: 637774 - RNA, 22 nt, Human
cuuuauauauucccaggcugcc

SEQ ID NO: 637775 - RNA, 22 nt, Human
aaggccuugccgaaggaugcca

SEQ ID NO: 637776 - RNA, 22 nt, Human
aguggcuaugcaugacuggaau

SEQ ID NO: 637777 - RNA, 22 nt, Human
uccagcuuugagauuuuaugga

SEQ ID NO: 637778 - RNA, 22 nt, Human
ucugauuagagcauucuugagu

SEQ ID NO: 637779 - RNA, 22 nt, Human
uuggcuucuggcagucuggacg

SEQ ID NO: 637780 - RNA, 22 nt, Human
ccuggaaggacaauagauagug

SEQ ID NO: 637781 - RNA, 22 nt, Human
gcaccagagggggcucugcagg

SEQ ID NO: 637782 - RNA, 22 nt, Human
ugcuucuguuacauaccagaac

SEQ ID NO: 637783 - RNA, 22 nt, Human
gggcgcgggaaggagcccgaga

SEQ ID NO: 637784 - RNA, 22 nt, Human
ggcuuggaccagucacaguggu

SEQ ID NO: 637785 - RNA, 22 nt, Human
gcccuuccuuagacagcaggau

SEQ ID NO: 637786 - RNA, 22 nt, Human
auauccaagaaacaauuaauuc

SEQ ID NO: 637787 - RNA, 20 nt, Human
cuggguggcaagcaaggggg

SEQ ID NO: 637788 - RNA, 22 nt, Human
cugcagagcaugaggaggucug

SEQ ID NO: 637789 - RNA, 22 nt, Human
cagagucaugggccgucaggca

SEQ ID NO: 637790 - RNA, 22 nt, Human
cccacccugggcuacacaucca

SEQ ID NO: 637791 - RNA, 22 nt, Human
ucccagagaaagucaaggucuu

SEQ ID NO: 637792 - RNA, 22 nt, Human
uagggcagagcuuguacacgau

SEQ ID NO: 637793 - RNA, 22 nt, Human
cauuagacacagauguauaaau

SEQ ID NO: 637794 - RNA, 22 nt, Human
auccugggcaguuuugagugcu

SEQ ID NO: 637795 - RNA, 22 nt, Human
cuccugaggggacaggacucau

SEQ ID NO: 637796 - RNA, 22 nt, Human
gcccaugcucucaggcgggccu

SEQ ID NO: 637797 - RNA, 22 nt, Human
uggcucucccaauaccuuucug

SEQ ID NO: 637798 - RNA, 22 nt, Human
ccacagggugucaucagcuuga

SEQ ID NO: 637799 - RNA, 22 nt, Human
acagccccccgcucaguuucca

SEQ ID NO: 637800 - RNA, 22 nt, Human
uuucccuacuuguaacuggaaa

SEQ ID NO: 637801 - RNA, 19 nt, Human
aaugcauggaaguuggaga

SEQ ID NO: 637802 - RNA, 23 nt, Human
gugcaugugucuuuacaguagca

SEQ ID NO: 637803 - RNA, 18 nt, Human
acagaggcagacauguau

SEQ ID NO: 637804 - RNA, 22 nt, Human
gacacagagacuugcaguugua

SEQ ID NO: 637805 - RNA, 22 nt, Human
caguaauaaagcuaaguauuuc

SEQ ID NO: 637806 - RNA, 22 nt, Human
agagaauuacagaagaauguca

SEQ ID NO: 637807 - RNA, 22 nt, Human
guuuggauagugagagauacuu

SEQ ID NO: 637808 - RNA, 22 nt, Human
uccuccugucuaccaguuccug

SEQ ID NO: 637809 - RNA, 22 nt, Human
ugaaucaguauaaauucucaaa

SEQ ID NO: 637810 - RNA, 22 nt, Human
uccagguaauuuggaugcuagu

SEQ ID NO: 637811 - RNA, 22 nt, Human
uugcuguagcucauuucacucu

SEQ ID NO: 637812 - RNA, 22 nt, Human
agagacaggauaucugcucaug

SEQ ID NO: 637813 - RNA, 22 nt, Human
gcacauggcggccagcagguga

SEQ ID NO: 637814 - RNA, 22 nt, Human
uugacuuuucuuggucacauga

SEQ ID NO: 637815 - RNA, 22 nt, Human
ucaguccugaugacaggcccaa

SEQ ID NO: 637816 - RNA, 22 nt, Human
cucagggacguuagaggacagg

SEQ ID NO: 637817 - RNA, 22 nt, Human
uuaauacaacuguugucacugg

SEQ ID NO: 637818 - RNA, 22 nt, Human
gagggcagagacagugauucac

SEQ ID NO: 637819 - RNA, 22 nt, Human
uuugaaacccgucacuuugagu

SEQ ID NO: 637820 - RNA, 22 nt, Human
auggcccugcuaccacuuuucu

SEQ ID NO: 637821 - RNA, 22 nt, Human
uuggggcaccuccccagcauuu

SEQ ID NO: 637822 - RNA, 22 nt, Human
auuugcuuuuacuauguuaaaa

SEQ ID NO: 637823 - RNA, 22 nt, Human
ccuggcuucagcauugcccucu

SEQ ID NO: 637824 - RNA, 22 nt, Human
cacaguuauauguucacaagga

SEQ ID NO: 637825 - RNA, 22 nt, Human
aguccaagguucauggcacaga

SEQ ID NO: 637826 - RNA, 22 nt, Human
guugggguaccuugaggcuggg

SEQ ID NO: 637827 - RNA, 19 nt, Human
cuguggccuccaggaggga

SEQ ID NO: 637828 - RNA, 22 nt, Human
ugauucaauaggaauugaguag

SEQ ID NO: 637829 - RNA, 18 nt, Human
uguuuauuuuucucuuac

SEQ ID NO: 637830 - RNA, 22 nt, Human
uuacagugacaguugcuaugau

SEQ ID NO: 637831 - RNA, 22 nt, Human
auuguucacugugaaucuugau

SEQ ID NO: 637832 - RNA, 22 nt, Human
acuggggaauggaacugggaau

SEQ ID NO: 637833 - RNA, 22 nt, Human
auauuuuuccaugugggacucu

SEQ ID NO: 637834 - RNA, 22 nt, Human
aggagauuguacugucaucacu

SEQ ID NO: 637835 - RNA, 22 nt, Human
augaagcaggcacagcuucagg

SEQ ID NO: 637836 - RNA, 22 nt, Human
auggagggugucagagagcgaa

SEQ ID NO: 637837 - RNA, 22 nt, Human
agcaccugcacaguggaggaaa

SEQ ID NO: 637838 - RNA, 22 nt, Human
gcagacaggcccaguggaggga

SEQ ID NO: 637839 - RNA, 19 nt, Human
uacccucagggccucauuu

SEQ ID NO: 637840 - RNA, 22 nt, Human
uaaggaaacaacuuguauuuuu

SEQ ID NO: 637841 - RNA, 22 nt, Human
acauggaaaguacuccacaauu

SEQ ID NO: 637842 - RNA, 22 nt, Human
agcuccuccugugccaggccag

SEQ ID NO: 637843 - RNA, 22 nt, Human
cacaauguauauguauaucaaa

SEQ ID NO: 637844 - RNA, 22 nt, Human
gagagugucgggggccccagga

SEQ ID NO: 637845 - RNA, 23 nt, Human
ggaaagagaggaguugugcauag

SEQ ID NO: 637846 - RNA, 21 nt, Human
agccugggaggcggagguugc

SEQ ID NO: 637847 - RNA, 19 nt, Human
aagggcugggcaccucacu

SEQ ID NO: 637848 - RNA, 21 nt, Human
acaugucuggucauuuuuagc

SEQ ID NO: 637849 - RNA, 22 nt, Human
uggggcuguccuuagucugaga

SEQ ID NO: 637850 - RNA, 22 nt, Human
ugcagagccccagauuggagag

SEQ ID NO: 637851 - RNA, 22 nt, Human
cugagcugucaggaauggaaag

SEQ ID NO: 637852 - RNA, 22 nt, Human
uggcuggcuguccagcugggca

SEQ ID NO: 637853 - RNA, 22 nt, Human
gccuccuggguucaugccauuc

SEQ ID NO: 637854 - RNA, 22 nt, Human
auguaagacuuuaagaaccuaa

SEQ ID NO: 637855 - RNA, 22 nt, Human
uccagggcauccacgcgugggg

SEQ ID NO: 637856 - RNA, 21 nt, Human
ucucaggcgagaauucuuuua

SEQ ID NO: 637857 - RNA, 22 nt, Human
ucauuucuauugcuacugucug

SEQ ID NO: 637858 - RNA, 20 nt, Human
ccucuguguccugugucaua

SEQ ID NO: 637859 - RNA, 22 nt, Human
ccagaagagaucacaguucuug

SEQ ID NO: 637860 - RNA, 22 nt, Human
augugaggaagaaagagguaag

SEQ ID NO: 637861 - RNA, 22 nt, Human
aguuauaaaaggagcacugauu

SEQ ID NO: 637862 - RNA, 22 nt, Human
ggaggaggcaaguaccagaugc

SEQ ID NO: 637863 - RNA, 21 nt, Human
ugaggccugccagucucagaa

SEQ ID NO: 637864 - RNA, 22 nt, Human
ugagcuagguccugugucagcu

SEQ ID NO: 637865 - RNA, 22 nt, Human
caaggcagugggcuaggaaccu

SEQ ID NO: 637866 - RNA, 22 nt, Human
agcaaugcuuauugcugacuau

SEQ ID NO: 637867 - RNA, 22 nt, Human
uauccauauuaagaugccucug

SEQ ID NO: 637868 - RNA, 22 nt, Human
ucuuucaaugugaaaccaugua

SEQ ID NO: 637869 - RNA, 22 nt, Human
cugcuguguuccuccugcaucu

SEQ ID NO: 637870 - RNA, 22 nt, Human
aaaaaguuucaacugccaacuc

SEQ ID NO: 637871 - RNA, 22 nt, Human
cagaguggcaugaaugaagccu

SEQ ID NO: 637872 - RNA, 22 nt, Human
caggaggcuuugggauccaagu

SEQ ID NO: 637873 - RNA, 23 nt, Human
uguaccaggaguuucagcagacu

SEQ ID NO: 637874 - RNA, 21 nt, Human
uucugggccaugcugcuucuc

SEQ ID NO: 637875 - RNA, 17 nt, Human
agagggaaaaugcgguu

SEQ ID NO: 637876 - RNA, 19 nt, Human
uaucuguuuccugcuuguc

SEQ ID NO: 637877 - RNA, 22 nt, Human
cccucuacagggaagcgcuuuc

SEQ ID NO: 637878 - RNA, 20 nt, Human
ugagggaguauugauuuccc

SEQ ID NO: 637879 - RNA, 22 nt, Human
guacccagaggcaugaucccag

SEQ ID NO: 637880 - RNA, 22 nt, Human
gggaaagacccugagucuuauu

SEQ ID NO: 637881 - RNA, 22 nt, Human
aacauaucuacggauacgauua

SEQ ID NO: 637882 - RNA, 22 nt, Human
aucauaauugcuccagugauau

SEQ ID NO: 637883 - RNA, 22 nt, Human
uauuugucuaagaggcugacag

SEQ ID NO: 637884 - RNA, 22 nt, Human
gcugcaacuguugcucucugca

SEQ ID NO: 637885 - RNA, 22 nt, Human
caggaaaaggagacuuuagcac

SEQ ID NO: 637886 - RNA, 22 nt, Human
cugcagggcauuguaacucuuu

SEQ ID NO: 637887 - RNA, 22 nt, Human
ucugggcuggcuuuaugcugac

SEQ ID NO: 637888 - RNA, 22 nt, Human
ccaaaagcagcugucugugaau

SEQ ID NO: 637889 - RNA, 22 nt, Human
aauguauaaaguguuaauaacu

SEQ ID NO: 637890 - RNA, 22 nt, Human
cagcuuggauuuuggcacgugu

SEQ ID NO: 637891 - RNA, 22 nt, Human
gggaagcugaagcuagagaaaa

SEQ ID NO: 637892 - RNA, 21 nt, Human
ucaggcagugcaaauacaugg

SEQ ID NO: 637893 - RNA, 20 nt, Human
ccucucugcccugcaaggcc

SEQ ID NO: 637894 - RNA, 22 nt, Human
cagggacuacagccagcccucc

SEQ ID NO: 637895 - RNA, 22 nt, Human
gcacugggaaugcugaugggcu

SEQ ID NO: 637896 - RNA, 22 nt, Human
ccagcugacgaugccuggucuc

SEQ ID NO: 637897 - RNA, 22 nt, Human
ugucccagacauaaguggacau

SEQ ID NO: 637898 - RNA, 22 nt, Human
aaauggaucuuuuuauaaugca

SEQ ID NO: 637899 - RNA, 22 nt, Human
aucauuagaccaaacuagagcu

SEQ ID NO: 637900 - RNA, 22 nt, Human
uuuuaaaggcuguaugaccaag

SEQ ID NO: 637901 - RNA, 22 nt, Human
ccuuucagaugggcauggaccg

SEQ ID NO: 637902 - RNA, 22 nt, Human
cucagugcagcuaggcaugaga

SEQ ID NO: 637903 - RNA, 22 nt, Human
cuuacauugugugcaugagggg

SEQ ID NO: 637904 - RNA, 22 nt, Human
gugucugcacauaggaucucaa

SEQ ID NO: 637905 - RNA, 22 nt, Human
caccuagggcaucccugcccca

SEQ ID NO: 637906 - RNA, 22 nt, Human
caggucccgccccgggcugacc

SEQ ID NO: 637907 - RNA, 22 nt, Human
cagagccaggucuaggagucuc

SEQ ID NO: 637908 - RNA, 22 nt, Human
uagaugcugaaacauggaggcg

SEQ ID NO: 637909 - RNA, 22 nt, Human
gcucccagaaccaaggcugggg

SEQ ID NO: 637910 - RNA, 22 nt, Human
aggaggcccuagagcucuagag

SEQ ID NO: 637911 - RNA, 22 nt, Human
cugugcaguggggcucuggguu

SEQ ID NO: 637912 - RNA, 22 nt, Human
aauagcaaaguuaucaaauuaa

SEQ ID NO: 637913 - RNA, 22 nt, Human
uucacagucacccuucuccaug

SEQ ID NO: 637914 - RNA, 19 nt, Human
ucugguucauuucugcugu

SEQ ID NO: 637915 - RNA, 22 nt, Human
uauucagugcgggaacucagcc

SEQ ID NO: 637916 - RNA, 22 nt, Human
aucacaucgaggagcaaucaga

SEQ ID NO: 637917 - RNA, 22 nt, Human
ugagagucucagaccuccuggu

SEQ ID NO: 637918 - RNA, 22 nt, Human
uugagucucugccaaaacacaa

SEQ ID NO: 637919 - RNA, 22 nt, Human
uguuuaaucuauaaaauggaga

SEQ ID NO: 637920 - RNA, 22 nt, Human
gguggccaggccagcucuggcc

SEQ ID NO: 637921 - RNA, 22 nt, Human
gcuucauagcauucauugccug

SEQ ID NO: 637922 - RNA, 22 nt, Human
uggcuuccuaaacugauuucca

SEQ ID NO: 637923 - RNA, 22 nt, Human
gaaggaggucugcauucuacag

SEQ ID NO: 637924 - RNA, 21 nt, Human
ggugggguaccuaagguagcu

SEQ ID NO: 637925 - RNA, 22 nt, Human
gaguuuaguggaauuuccuucu

SEQ ID NO: 637926 - RNA, 22 nt, Human
aagccacuguuuuggagugcuu

SEQ ID NO: 637927 - RNA, 22 nt, Human
guggcagggcaaugcucccucu

SEQ ID NO: 637928 - RNA, 22 nt, Human
uguggugguaaugagccagaug

SEQ ID NO: 637929 - RNA, 22 nt, Human
aguucagcuucccaggucacug

SEQ ID NO: 637930 - RNA, 22 nt, Human
gagagagacauguaaacgcggu

SEQ ID NO: 637931 - RNA, 22 nt, Human
uccauuuuucaugacuccucaa

SEQ ID NO: 637932 - RNA, 22 nt, Human
uuggaaagauuauuauuaugaa

SEQ ID NO: 637933 - RNA, 22 nt, Human
agauaauuugaguaaauuaauu

SEQ ID NO: 637934 - RNA, 22 nt, Human
aaaccuuaaaccaagcucuuga

SEQ ID NO: 637935 - RNA, 22 nt, Human
cagaguuuuaucauacguggau

SEQ ID NO: 637936 - RNA, 20 nt, Human
uugucacagcuuuccaucag

SEQ ID NO: 637937 - RNA, 22 nt, Human
gccaggcauuuauugauugaau

SEQ ID NO: 637938 - RNA, 22 nt, Human
aaugucugcucuacucaggagg

SEQ ID NO: 637939 - RNA, 22 nt, Human
agaaacaacuuguuucucuugc

SEQ ID NO: 637940 - RNA, 22 nt, Human
agggaccugcucacugccuggc

SEQ ID NO: 637941 - RNA, 19 nt, Human
uggauggagccugugguug

SEQ ID NO: 637942 - RNA, 22 nt, Human
cuggcccucggaguccagcugc

SEQ ID NO: 637943 - RNA, 22 nt, Human
uugaaauacugcauuguucagu

SEQ ID NO: 637944 - RNA, 22 nt, Human
auaaucuuguauuuccuaaagu

SEQ ID NO: 637945 - RNA, 22 nt, Human
gcacaagaaaucauggacugaa

SEQ ID NO: 637946 - RNA, 22 nt, Human
ccuuuugaggcuugggcucaga

SEQ ID NO: 637947 - RNA, 21 nt, Human
aggugggagaccauguagguc

SEQ ID NO: 637948 - RNA, 22 nt, Human
uaacaggcugaucauauauccu

SEQ ID NO: 637949 - RNA, 22 nt, Human
aaacaauuuccaccucuccuga

SEQ ID NO: 637950 - RNA, 22 nt, Human
ugagcccuaccugcucaucucc

SEQ ID NO: 637951 - RNA, 22 nt, Human
ugaguuauggagaauaaaguca

SEQ ID NO: 637952 - RNA, 22 nt, Human
uugcuuccuggaugugacuuug

SEQ ID NO: 637953 - RNA, 18 nt, Human
gcuucauggaaggguugu

SEQ ID NO: 637954 - RNA, 22 nt, Human
agccagagacugugucuguaau

SEQ ID NO: 637955 - RNA, 22 nt, Human
aaggaaagacaggacggaauuc

SEQ ID NO: 637956 - RNA, 22 nt, Human
cacuugaacuguuugaaugaga

SEQ ID NO: 637957 - RNA, 22 nt, Human
ccccaggaagccucagauuugc

SEQ ID NO: 637958 - RNA, 22 nt, Human
aaagcagcagcacguggaagag

SEQ ID NO: 637959 - RNA, 22 nt, Human
ggcuucauuucuguccuugauu

SEQ ID NO: 637960 - RNA, 22 nt, Human
uaaggcaggaacuggcuguuuu

SEQ ID NO: 637961 - RNA, 22 nt, Human
uucuugaaaauagccauguaca

SEQ ID NO: 637962 - RNA, 22 nt, Human
cauguaaaacacucagaacagu

SEQ ID NO: 637963 - RNA, 22 nt, Human
caggauguucaagggaccuaug

SEQ ID NO: 637964 - RNA, 22 nt, Human
acuuggagagauaaucccauau

SEQ ID NO: 637965 - RNA, 22 nt, Human
gacauuggcuguucauugggau

SEQ ID NO: 637966 - RNA, 22 nt, Human
agaggccgggugccugcucaga

SEQ ID NO: 637967 - RNA, 22 nt, Human
aggcccugcaggaguggggaca

SEQ ID NO: 637968 - RNA, 22 nt, Human
aggccagaaaugucagggagug

SEQ ID NO: 637969 - RNA, 22 nt, Human
ccaacaccaucugagcuccagc

SEQ ID NO: 637970 - RNA, 22 nt, Human
ccucuucugcuucaggagcacu

SEQ ID NO: 637971 - RNA, 21 nt, Human
ucuguacaucauugagucccc

SEQ ID NO: 637972 - RNA, 22 nt, Human
ugcaggaacuugguuuuacuca

SEQ ID NO: 637973 - RNA, 22 nt, Human
gagcugcuucugugugccgggu

SEQ ID NO: 637974 - RNA, 22 nt, Human
auacauguaacugcauuguaau

SEQ ID NO: 637975 - RNA, 22 nt, Human
ccagccaccgcuuguuugcacu

SEQ ID NO: 637976 - RNA, 22 nt, Human
agggcugaggcgagggagaugc

SEQ ID NO: 637977 - RNA, 22 nt, Human
uaguuuagcauacaucuucagg

SEQ ID NO: 637978 - RNA, 22 nt, Human
auggaaaucagguucauccaag

SEQ ID NO: 637979 - RNA, 18 nt, Human
cagcugccagcucaugga

SEQ ID NO: 637980 - RNA, 22 nt, Human
uaucacaauuccuauaguuugu

SEQ ID NO: 637981 - RNA, 22 nt, Human
uuuuuugucuugaagaaauggu

SEQ ID NO: 637982 - RNA, 20 nt, Human
gcagcagugcaaguccucuu

SEQ ID NO: 637983 - RNA, 22 nt, Human
agaggaucaucuaguuugacuc

SEQ ID NO: 637984 - RNA, 22 nt, Human
gugagacacccaagagucagau

SEQ ID NO: 637985 - RNA, 19 nt, Human
augagcaauaguuuuaauc

SEQ ID NO: 637986 - RNA, 22 nt, Human
uggcuccacaggccagggugug

SEQ ID NO: 637987 - RNA, 22 nt, Human
uguauacauuuaacuagauaga

SEQ ID NO: 637988 - RNA, 22 nt, Human
cacugcuuuuuuggcuauguac

SEQ ID NO: 637989 - RNA, 22 nt, Human
acuggauggugucaugagcagc

SEQ ID NO: 637990 - RNA, 22 nt, Human
agugauguugacuagcuauaag

SEQ ID NO: 637991 - RNA, 22 nt, Human
acugggcauuuugaacguucuu

SEQ ID NO: 637992 - RNA, 22 nt, Human
aagguaaucagccuuuccacaa

SEQ ID NO: 637993 - RNA, 22 nt, Human
gagggaaaauaaaauugcagua

SEQ ID NO: 637994 - RNA, 22 nt, Human
aaagucaaugauuucuccugga

SEQ ID NO: 637995 - RNA, 22 nt, Human
aguuuacaugacguguauuuca

SEQ ID NO: 637996 - RNA, 22 nt, Human
guucagcccacagagggggccg

SEQ ID NO: 637997 - RNA, 22 nt, Human
aacacuggacaggaggcuaggu

SEQ ID NO: 637998 - RNA, 22 nt, Human
acugucacuugcaacugugagg

SEQ ID NO: 637999 - RNA, 22 nt, Human
gggaacagcauaucugaagggu

SEQ ID NO: 638000 - RNA, 22 nt, Human
auucagcacaauuuggccaaua

SEQ ID NO: 638001 - RNA, 22 nt, Human
uuugcaaauauguguuucuauu

SEQ ID NO: 638002 - RNA, 22 nt, Human
ccucagucuugaauuagccaga

SEQ ID NO: 638003 - RNA, 22 nt, Human
cagaggucaagaucugaaguga

SEQ ID NO: 638004 - RNA, 22 nt, Human
ccaggagggaccgcggcauccc

SEQ ID NO: 638005 - RNA, 22 nt, Human
cccugugauguagcuagaguag

SEQ ID NO: 638006 - RNA, 22 nt, Human
cugaggcaugaaugugggcuuu

SEQ ID NO: 638007 - RNA, 22 nt, Human
uaaggcagagguaccacuaggc

SEQ ID NO: 638008 - RNA, 22 nt, Human
ccuggcuuccuucaugaccugg

SEQ ID NO: 638009 - RNA, 22 nt, Human
ggcugcuggcauugagguaggu

SEQ ID NO: 638010 - RNA, 22 nt, Human
gaguucugaacugugaaaugca

SEQ ID NO: 638011 - RNA, 22 nt, Human
ccaagcuacuuaggagucugag

SEQ ID NO: 638012 - RNA, 22 nt, Human
ucuugggcauguguuugauuuc

SEQ ID NO: 638013 - RNA, 18 nt, Human
uggcagguccagcugugg

SEQ ID NO: 638014 - RNA, 22 nt, Human
cucagcaucaugguaucugggg

SEQ ID NO: 638015 - RNA, 22 nt, Human
uucaagauggccccagugagcc

SEQ ID NO: 638016 - RNA, 22 nt, Human
ucugaggccugaagcagcagag

SEQ ID NO: 638017 - RNA, 23 nt, Human
auacauacagucuuacugacuuu

SEQ ID NO: 638018 - RNA, 22 nt, Human
auccaguuuaugucauauucuu

SEQ ID NO: 638019 - RNA, 22 nt, Human
ucuccugauaucugcagaccua

SEQ ID NO: 638020 - RNA, 22 nt, Human
uauaaaugcacuuuugaaauau

SEQ ID NO: 638021 - RNA, 22 nt, Human
agugugcugcuuaaacaguugu

SEQ ID NO: 638022 - RNA, 22 nt, Human
cggcagcaaaggaagccagguc

SEQ ID NO: 638023 - RNA, 22 nt, Human
agaaugaauuaaucaacuggaa

SEQ ID NO: 638024 - RNA, 22 nt, Human
ucaaugauaucagcaggaugug

SEQ ID NO: 638025 - RNA, 22 nt, Human
ccauggcuuacagauggagcau

SEQ ID NO: 638026 - RNA, 22 nt, Human
augcaguuuuaaaucauuucag

SEQ ID NO: 638027 - RNA, 23 nt, Human
ugugacagggucauugaaaaggg

SEQ ID NO: 638028 - RNA, 17 nt, Human
gaacaguguaagacacu

SEQ ID NO: 638029 - RNA, 22 nt, Human
uuucccuucuuuccugaguaau

SEQ ID NO: 638030 - RNA, 22 nt, Human
auaauggcuucugaguauuagg

SEQ ID NO: 638031 - RNA, 22 nt, Human
gaagucugacucuuuguaagcu

SEQ ID NO: 638032 - RNA, 22 nt, Human
ugcagcagucagucaggccugg

SEQ ID NO: 638033 - RNA, 20 nt, Human
ugacaaaugaucugauuuuc

SEQ ID NO: 638034 - RNA, 22 nt, Human
agaaaggacaucucccuuuaag

SEQ ID NO: 638035 - RNA, 22 nt, Human
gacauucauugaugucuuccuc

SEQ ID NO: 638036 - RNA, 22 nt, Human
guuagaaagugucugcuugggu

SEQ ID NO: 638037 - RNA, 22 nt, Human
cacagaauuaagggagaaauau

SEQ ID NO: 638038 - RNA, 22 nt, Human
ucucagagugacaaugagaauu

SEQ ID NO: 638039 - RNA, 22 nt, Human
uaugagaaaauaaauaucuguu

SEQ ID NO: 638040 - RNA, 22 nt, Human
ucugggauagggccagaacaug

SEQ ID NO: 638041 - RNA, 22 nt, Human
guccaugauucugugacacccu

SEQ ID NO: 638042 - RNA, 18 nt, Human
ucuucaucuccugagcug

SEQ ID NO: 638043 - RNA, 22 nt, Human
ucagggcauccauugccuguug

SEQ ID NO: 638044 - RNA, 22 nt, Human
ugucacauaauuuaucuguagg

SEQ ID NO: 638045 - RNA, 22 nt, Human
gcucagugaagggugccaagua

SEQ ID NO: 638046 - RNA, 22 nt, Human
aggcaaaucugagacauuuaaa

SEQ ID NO: 638047 - RNA, 19 nt, Human
cuucugcagggugacagug

SEQ ID NO: 638048 - RNA, 22 nt, Human
cucuggagaacuccuugugucu

SEQ ID NO: 638049 - RNA, 22 nt, Human
gugcaggagcuucuggccugac

SEQ ID NO: 638050 - RNA, 22 nt, Human
aggcagcuggcagcacccaggg

SEQ ID NO: 638051 - RNA, 22 nt, Human
aguccaauaaccucuuuccuuc

SEQ ID NO: 638052 - RNA, 22 nt, Human
ccagcucuuuuggcugagugag

SEQ ID NO: 638053 - RNA, 22 nt, Human
uagcagcugugaguaaaagcca

SEQ ID NO: 638054 - RNA, 22 nt, Human
cuggauccaucgggucccgagu

SEQ ID NO: 638055 - RNA, 22 nt, Human
gaaaggagaggguuaaggagcu

SEQ ID NO: 638056 - RNA, 22 nt, Human
uacauuaaggauauggacauga

SEQ ID NO: 638057 - RNA, 22 nt, Human
cagcaggcggcccgcgggcccg

SEQ ID NO: 638058 - RNA, 22 nt, Human
agaauauucaucuguauucuua

SEQ ID NO: 638059 - RNA, 22 nt, Human
ugcaggcauaaccgauguugau

SEQ ID NO: 638060 - RNA, 22 nt, Human
ucagacagugugaucagucucu

SEQ ID NO: 638061 - RNA, 22 nt, Human
uuuuacaaaugaggagcuggag

SEQ ID NO: 638062 - RNA, 22 nt, Human
uagaugaagggguucagcaugg

SEQ ID NO: 638063 - RNA, 22 nt, Human
ccucuaaauuguuugaaguugg

SEQ ID NO: 638064 - RNA, 22 nt, Human
agggagacacaugaggaaguca

SEQ ID NO: 638065 - RNA, 22 nt, Human
gcagggcuaggucuucuagggc

SEQ ID NO: 638066 - RNA, 22 nt, Human
gauauacagagcauucuuugau

SEQ ID NO: 638067 - RNA, 22 nt, Human
aaugaaaauuggacccuagaac

SEQ ID NO: 638068 - RNA, 21 nt, Human
caucacauuacucaaaguccu

SEQ ID NO: 638069 - RNA, 22 nt, Human
aacugcaacuuguuugauucuu

SEQ ID NO: 638070 - RNA, 22 nt, Human
uaaaguguuuguaugcagauaa

SEQ ID NO: 638071 - RNA, 22 nt, Human
ggguggcaaaggcgcugaaagg

SEQ ID NO: 638072 - RNA, 22 nt, Human
uuugaauaaacgguuaauguuc

SEQ ID NO: 638073 - RNA, 20 nt, Human
ucagguagaucuuugagguc

SEQ ID NO: 638074 - RNA, 22 nt, Human
gggcagguggcagggucucugg

SEQ ID NO: 638075 - RNA, 22 nt, Human
ucuggcucccuggagcuccaca

SEQ ID NO: 638076 - RNA, 22 nt, Human
uuucaaaugcaugucuuuccuc

SEQ ID NO: 638077 - RNA, 22 nt, Human
ggagccuguuaguugagugcuc

SEQ ID NO: 638078 - RNA, 22 nt, Human
ugacaggugauugugaacuaag

SEQ ID NO: 638079 - RNA, 22 nt, Human
uguaacuggacaagauauucau

SEQ ID NO: 638080 - RNA, 22 nt, Human
uuauuugguugcugacuuggaa

SEQ ID NO: 638081 - RNA, 22 nt, Human
gcucaggaaaacagucuaguaa

SEQ ID NO: 638082 - RNA, 22 nt, Human
uacuuucuguccuucuguuaaa

SEQ ID NO: 638083 - RNA, 22 nt, Human
auagcaacaccccaauuuucua

SEQ ID NO: 638084 - RNA, 22 nt, Human
uaugaagaagacaaaugacacu

SEQ ID NO: 638085 - RNA, 22 nt, Human
uaaaucuuguggcaaugcuucu

SEQ ID NO: 638086 - RNA, 22 nt, Human
guggagggugagcucauguuug

SEQ ID NO: 638087 - RNA, 22 nt, Human
acaguuuaugguguuuuauaua

SEQ ID NO: 638088 - RNA, 22 nt, Human
acaacuuugacccuuguucuua

SEQ ID NO: 638089 - RNA, 22 nt, Human
ucagaaucugaaaagcgcuugg

SEQ ID NO: 638090 - RNA, 22 nt, Human
acuguuaacgguaugaugcucg

SEQ ID NO: 638091 - RNA, 22 nt, Human
uacaaaaguaauuacgguuuuu

SEQ ID NO: 638092 - RNA, 22 nt, Human
agaagcaggccucacagaucug

SEQ ID NO: 638093 - RNA, 22 nt, Human
uuuuaauuuuagcccuucuggu

SEQ ID NO: 638094 - RNA, 22 nt, Human
uucuacauuuaaaaggaaaauc

SEQ ID NO: 638095 - RNA, 22 nt, Human
accacaucgggcggacacuggg

SEQ ID NO: 638096 - RNA, 22 nt, Human
ucaguguuucaguuuggaaaug

SEQ ID NO: 638097 - RNA, 22 nt, Human
uuugacaucaauacccuagaau

SEQ ID NO: 638098 - RNA, 22 nt, Human
uguaucuucaguuugucuuucc

SEQ ID NO: 638099 - RNA, 22 nt, Human
cacagaggucugggcccagcag

SEQ ID NO: 638100 - RNA, 22 nt, Human
ccuggcuggcaagaucgugaag

SEQ ID NO: 638101 - RNA, 20 nt, Human
uuaguugaguagcuccugaa

SEQ ID NO: 638102 - RNA, 22 nt, Human
gcccaggauggcuggaggugcu

SEQ ID NO: 638103 - RNA, 22 nt, Human
uuaacacuugaacucuacaugu

SEQ ID NO: 638104 - RNA, 22 nt, Human
acaugauucuugauaggcauug

SEQ ID NO: 638105 - RNA, 22 nt, Human
gcacuuggauauacaaaugaag

SEQ ID NO: 638106 - RNA, 22 nt, Human
augucucugcugugguuagcuu

SEQ ID NO: 638107 - RNA, 22 nt, Human
aagauaacaggaggaguuugua

SEQ ID NO: 638108 - RNA, 23 nt, Human
ucugagaagguuucagccagacu

SEQ ID NO: 638109 - RNA, 22 nt, Human
cacagguguccaauaccugcuu

SEQ ID NO: 638110 - RNA, 22 nt, Human
gcaguccuccugccucagccuc

SEQ ID NO: 638111 - RNA, 22 nt, Human
acagugagcgguagugauugcu

SEQ ID NO: 638112 - RNA, 22 nt, Human
uggcaguguccuacugguuggu

SEQ ID NO: 638113 - RNA, 22 nt, Human
cuccucuggaaauuccucugcc

SEQ ID NO: 638114 - RNA, 22 nt, Human
acaguguuuucuuaaggagaaa

SEQ ID NO: 638115 - RNA, 22 nt, Human
auggggaagagccagugagcug

SEQ ID NO: 638116 - RNA, 17 nt, Human
aggugcagaggcagagc

SEQ ID NO: 638117 - RNA, 22 nt, Human
ugucagaggcucagggucucag

SEQ ID NO: 638118 - RNA, 22 nt, Human
gccccaccugcuaccuuccagc

SEQ ID NO: 638119 - RNA, 22 nt, Human
cagagccagaacuagaccuugu

SEQ ID NO: 638120 - RNA, 22 nt, Human
agggcuaggaauggaacuggag

SEQ ID NO: 638121 - RNA, 22 nt, Human
cacuguaaagcgucacagggac

SEQ ID NO: 638122 - RNA, 22 nt, Human
aguaaaaauugaggugcaaaau

SEQ ID NO: 638123 - RNA, 22 nt, Human
agcuaaugauacaugcuccaca

SEQ ID NO: 638124 - RNA, 22 nt, Human
ucagaggucccuagcaggagug

SEQ ID NO: 638125 - RNA, 18 nt, Human
cuagaugagcuuggcaag

SEQ ID NO: 638126 - RNA, 22 nt, Human
aaguauucuacaaagaaauuga

SEQ ID NO: 638127 - RNA, 22 nt, Human
aaaguauguuguggcuuuuaaa

SEQ ID NO: 638128 - RNA, 22 nt, Human
gauugcuuauacacaagaugaa

SEQ ID NO: 638129 - RNA, 19 nt, Human
acugagaaccugacccagg

SEQ ID NO: 638130 - RNA, 18 nt, Human
uacagcuugaguugacug

SEQ ID NO: 638131 - RNA, 22 nt, Human
ccaugccccaccaggacgcugc

SEQ ID NO: 638132 - RNA, 22 nt, Human
acugggaaaagcuauggcaaau

SEQ ID NO: 638133 - RNA, 22 nt, Human
ucucugagcccagugucccccu

SEQ ID NO: 638134 - RNA, 22 nt, Human
uaaagcagccagggucuaagcc

SEQ ID NO: 638135 - RNA, 22 nt, Human
augaaugauuaaagaguacagu

SEQ ID NO: 638136 - RNA, 22 nt, Human
ccgcggggcgugggcucuuacc

SEQ ID NO: 638137 - RNA, 22 nt, Human
caguuaaacagauugaguguua

SEQ ID NO: 638138 - RNA, 22 nt, Human
ccacaugcucaccaagucccug

SEQ ID NO: 638139 - RNA, 22 nt, Human
ggaggccuaagguacaguuugc

SEQ ID NO: 638140 - RNA, 22 nt, Human
ccaggugucaugcgugugaccc

SEQ ID NO: 638141 - RNA, 22 nt, Human
ugggccacauuccaaaccagcu

SEQ ID NO: 638142 - RNA, 22 nt, Human
uagcaucugcguuggguuggac

SEQ ID NO: 638143 - RNA, 22 nt, Human
gaauugcucugccuggccagcc

SEQ ID NO: 638144 - RNA, 22 nt, Human
uacugucuggaguugccaaagg

SEQ ID NO: 638145 - RNA, 22 nt, Human
uguguccaucugacaggagagg

SEQ ID NO: 638146 - RNA, 22 nt, Human
gaggaaggcuaaggggcuuaga

SEQ ID NO: 638147 - RNA, 22 nt, Human
agaaguggucugucuuccagau

SEQ ID NO: 638148 - RNA, 22 nt, Human
gagaaggcugauccuuggaguu

SEQ ID NO: 638149 - RNA, 22 nt, Human
ccuagggagccugagagcagug

SEQ ID NO: 638150 - RNA, 23 nt, Human
acaggcucuuaaucagugcuccu

SEQ ID NO: 638151 - RNA, 20 nt, Human
caucaucacaugagccaauu

SEQ ID NO: 638152 - RNA, 18 nt, Human
aggcuucuuggcucaguc

SEQ ID NO: 638153 - RNA, 22 nt, Human
caguuuucuaaagucucuuuaa

SEQ ID NO: 638154 - RNA, 22 nt, Human
uacuucaauuauaugccaguua

SEQ ID NO: 638155 - RNA, 22 nt, Human
cuggcaugccuugggugccucu

SEQ ID NO: 638156 - RNA, 22 nt, Human
uccugagggcugcagucauagg

SEQ ID NO: 638157 - RNA, 22 nt, Human
caugaagcuugaagcaguccac

SEQ ID NO: 638158 - RNA, 22 nt, Human
acucugggccccagguggagcu

SEQ ID NO: 638159 - RNA, 22 nt, Human
cugccaggcacugggcucugca

SEQ ID NO: 638160 - RNA, 17 nt, Human
gcuccuucuaacuucca

SEQ ID NO: 638161 - RNA, 22 nt, Human
uucuaacuuucaagguccuuuc

SEQ ID NO: 638162 - RNA, 22 nt, Human
gcaggcguguuucacgugccag

SEQ ID NO: 638163 - RNA, 22 nt, Human
acaaauuucauaggcaaauuuu

SEQ ID NO: 638164 - RNA, 20 nt, Human
ugggagaugaucuccuugcu

SEQ ID NO: 638165 - RNA, 20 nt, Human
ggugcgaggccagagcagac

SEQ ID NO: 638166 - RNA, 20 nt, Human
guauuaggagguaaauguaa

SEQ ID NO: 638167 - RNA, 21 nt, Human
gccuguguaaauugaguuucc

SEQ ID NO: 638168 - RNA, 22 nt, Human
gugcucuguguauuaggauguc

SEQ ID NO: 638169 - RNA, 22 nt, Human
cauagagugauguaagguaugu

SEQ ID NO: 638170 - RNA, 22 nt, Human
acuuccuguaaauagaauucca

SEQ ID NO: 638171 - RNA, 22 nt, Human
aucagacucagaaaugacgugg

SEQ ID NO: 638172 - RNA, 22 nt, Human
aggacuggcagugugagggguc

SEQ ID NO: 638173 - RNA, 22 nt, Human
ccucuggcaacuucacagccca

SEQ ID NO: 638174 - RNA, 22 nt, Human
ccacagucuaugcaacaagguc

SEQ ID NO: 638175 - RNA, 22 nt, Human
gaggucugggcuugggccuggu

SEQ ID NO: 638176 - RNA, 22 nt, Human
uggcuucacaauuucauaacua

SEQ ID NO: 638177 - RNA, 22 nt, Human
acuuagcaaaucuuuuggauuc

SEQ ID NO: 638178 - RNA, 22 nt, Human
gacagcugaaggaugauucagg

SEQ ID NO: 638179 - RNA, 22 nt, Human
cagaggcugggaccucaggcau

SEQ ID NO: 638180 - RNA, 22 nt, Human
uacaacaguaaucaagguuuuu

SEQ ID NO: 638181 - RNA, 22 nt, Human
uccuggccuuagcgaggcgguc

SEQ ID NO: 638182 - RNA, 22 nt, Human
gaagcacugcauuucaagauca

SEQ ID NO: 638183 - RNA, 22 nt, Human
agguuuucagcuguauccugag

SEQ ID NO: 638184 - RNA, 22 nt, Human
uauuuauuggacaguguugcug

SEQ ID NO: 638185 - RNA, 22 nt, Human
uaguuuguaaugaggagaagua

SEQ ID NO: 638186 - RNA, 22 nt, Human
uaggacaggugaggggcugugg

SEQ ID NO: 638187 - RNA, 22 nt, Human
uccuggaguuuguggugauaug

SEQ ID NO: 638188 - RNA, 22 nt, Human
aggucugauuuuuuauucccag

SEQ ID NO: 638189 - RNA, 22 nt, Human
cugggccaucagaggggcugga

SEQ ID NO: 638190 - RNA, 22 nt, Human
uuguccuggagguuaauagagu

SEQ ID NO: 638191 - RNA, 22 nt, Human
cagaguaucccuuuagaauuaa

SEQ ID NO: 638192 - RNA, 22 nt, Human
uuucuucucaucccugaaauca

SEQ ID NO: 638193 - RNA, 17 nt, Human
cccguucucuucgcugg

SEQ ID NO: 638194 - RNA, 22 nt, Human
gaucucuggguccuguuggccu

SEQ ID NO: 638195 - RNA, 22 nt, Human
aggcuggcccaccucuugucuu

SEQ ID NO: 638196 - RNA, 22 nt, Human
agcccagagccccggccauguu

SEQ ID NO: 638197 - RNA, 22 nt, Human
ucugggaugagaucagagacac

SEQ ID NO: 638198 - RNA, 22 nt, Human
acauucucuuccuaaauauacu

SEQ ID NO: 638199 - RNA, 22 nt, Human
cuucuacacaucccucuugcuu

SEQ ID NO: 638200 - RNA, 22 nt, Human
ucaaaggguagcccagggaaga

SEQ ID NO: 638201 - RNA, 22 nt, Human
auggaacaggcucagagaugcu

SEQ ID NO: 638202 - RNA, 22 nt, Human
cucugagaaagcugugagcuaa

SEQ ID NO: 638203 - RNA, 22 nt, Human
ccaggcugcuuagccuuaucuu

SEQ ID NO: 638204 - RNA, 19 nt, Human
ggcaccuuggcuaugccug

SEQ ID NO: 638205 - RNA, 22 nt, Human
cccaggaggguggccucugccc

SEQ ID NO: 638206 - RNA, 22 nt, Human
guauaguuugcgauuugugguu

SEQ ID NO: 638207 - RNA, 22 nt, Human
gggcagccgcgugaccugccag

SEQ ID NO: 638208 - RNA, 22 nt, Human
aguguugcaugaggcaguacca

SEQ ID NO: 638209 - RNA, 17 nt, Human
cuagagagaaagagcua

SEQ ID NO: 638210 - RNA, 22 nt, Human
ggcagcaaguaggauucuuauu

SEQ ID NO: 638211 - RNA, 22 nt, Human
cagggcugaagaaauucaaaag

SEQ ID NO: 638212 - RNA, 22 nt, Human
cugcucuucccacucacuccca

SEQ ID NO: 638213 - RNA, 21 nt, Human
ccagaagcugcuugcaggcua

SEQ ID NO: 638214 - RNA, 22 nt, Human
gcagaggccugaagguggcggg

SEQ ID NO: 638215 - RNA, 22 nt, Human
cagcuuucaucagugacacuca

SEQ ID NO: 638216 - RNA, 22 nt, Human
cacauggcagaaucaugcaucu

SEQ ID NO: 638217 - RNA, 22 nt, Human
gagauaaauuuuugauaaauau

SEQ ID NO: 638218 - RNA, 21 nt, Human
acucugucuugagccaucugu

SEQ ID NO: 638219 - RNA, 22 nt, Human
cauuuucucaaugaacccucuu

SEQ ID NO: 638220 - RNA, 22 nt, Human
uggcuuccaguaaucaggauuu

SEQ ID NO: 638221 - RNA, 22 nt, Human
gccuuccaggcagggggagcag

SEQ ID NO: 638222 - RNA, 22 nt, Human
uucucuuauucuggauaugcag

SEQ ID NO: 638223 - RNA, 22 nt, Human
uuaaucacagcucugccaugag

SEQ ID NO: 638224 - RNA, 22 nt, Human
gagguggccucaagcagucuuc

SEQ ID NO: 638225 - RNA, 19 nt, Human
agguuuauggggaggguga

SEQ ID NO: 638226 - RNA, 22 nt, Human
ggaagacugcauggcauaguga

SEQ ID NO: 638227 - RNA, 19 nt, Human
ugcugcaggaugcugcugg

SEQ ID NO: 638228 - RNA, 22 nt, Human
auucaguaggucuagaauaaga

SEQ ID NO: 638229 - RNA, 22 nt, Human
aauuaaaggucauguuaaaggg

SEQ ID NO: 638230 - RNA, 22 nt, Human
auuaaaccccaguucucuuacu

SEQ ID NO: 638231 - RNA, 21 nt, Human
acaguuuauuagaguaagugc

SEQ ID NO: 638232 - RNA, 22 nt, Human
guccucugggcuuugagcaguc

SEQ ID NO: 638233 - RNA, 22 nt, Human
aagaaauggcuucaucugagua

SEQ ID NO: 638234 - RNA, 21 nt, Human
uagcaaauggagaguaagaga

SEQ ID NO: 638235 - RNA, 22 nt, Human
ugcucuggcugggaugagugca

SEQ ID NO: 638236 - RNA, 22 nt, Human
gcuugcucaacccccgucucuc

SEQ ID NO: 638237 - RNA, 17 nt, Human
agacacugagccaagua

SEQ ID NO: 638238 - RNA, 22 nt, Human
gcuucucuggccugcagggcau

SEQ ID NO: 638239 - RNA, 22 nt, Human
cucagcuacgcuuucaccagcu

SEQ ID NO: 638240 - RNA, 22 nt, Human
acuaauuguauaguugauguaa

SEQ ID NO: 638241 - RNA, 22 nt, Human
ugcuccaggcugcugaagaucu

SEQ ID NO: 638242 - RNA, 22 nt, Human
gcagcugccuauucagggcuug

SEQ ID NO: 638243 - RNA, 22 nt, Human
cugugagauguuucugguuaga

SEQ ID NO: 638244 - RNA, 22 nt, Human
aauuauguagccauaugaaaca

SEQ ID NO: 638245 - RNA, 22 nt, Human
accucuaaaaaauuagaagccu

SEQ ID NO: 638246 - RNA, 22 nt, Human
uuucucuccuccaaaccaaaga

SEQ ID NO: 638247 - RNA, 22 nt, Human
ucucucuugaaguauuagcuag

SEQ ID NO: 638248 - RNA, 22 nt, Human
cuuccugcccacuuccugcugg

SEQ ID NO: 638249 - RNA, 22 nt, Human
uaugaggcacuucauuagcugg

SEQ ID NO: 638250 - RNA, 22 nt, Human
auaguacauggguguccucaca

SEQ ID NO: 638251 - RNA, 22 nt, Human
ugggccagcacugggugcucau

SEQ ID NO: 638252 - RNA, 22 nt, Human
ccagacuggggcuccuugaggg

SEQ ID NO: 638253 - RNA, 22 nt, Human
aguuuccuuggauucaauuugg

SEQ ID NO: 638254 - RNA, 22 nt, Human
gaaagcacaguucugaccaugu

SEQ ID NO: 638255 - RNA, 22 nt, Human
acuucauuguaauauuauagca

SEQ ID NO: 638256 - RNA, 22 nt, Human
uuacuuuagaaauagucaucaa

SEQ ID NO: 638257 - RNA, 22 nt, Human
uucuggaaguuuucuccugugg

SEQ ID NO: 638258 - RNA, 20 nt, Human
uccucccccaccuuugcagc

SEQ ID NO: 638259 - RNA, 22 nt, Human
aacaaacauuaccuggugcugg

SEQ ID NO: 638260 - RNA, 22 nt, Human
uggcugagaaaaaagagcuaua

SEQ ID NO: 638261 - RNA, 21 nt, Human
uggaagggaagucuugguugu

SEQ ID NO: 638262 - RNA, 22 nt, Human
gcucugacuuccugcgcuccag

SEQ ID NO: 638263 - RNA, 22 nt, Human
ucaggaaguuuugaaucaacug

SEQ ID NO: 638264 - RNA, 22 nt, Human
aaguccagguccucauuccauc

SEQ ID NO: 638265 - RNA, 22 nt, Human
caggaacagaguggcauugucu

SEQ ID NO: 638266 - RNA, 22 nt, Human
ugggccuccuccgacagccggg

SEQ ID NO: 638267 - RNA, 22 nt, Human
ggcuucccuuuccgagaggaga

SEQ ID NO: 638268 - RNA, 22 nt, Human
agcaggguuuggggauuggcac

SEQ ID NO: 638269 - RNA, 22 nt, Human
uugagguauauucacauauauc

SEQ ID NO: 638270 - RNA, 22 nt, Human
ugggauaguggccaggaccccc

SEQ ID NO: 638271 - RNA, 22 nt, Human
ucaggaggcgucucgcuggggc

SEQ ID NO: 638272 - RNA, 22 nt, Human
cuggcugguaauggaacgacag

SEQ ID NO: 638273 - RNA, 22 nt, Human
cagcuguggagggaggaaaugc

SEQ ID NO: 638274 - RNA, 21 nt, Human
gcagccacugccuucaacaau

SEQ ID NO: 638275 - RNA, 22 nt, Human
ucaccaggcuccuguuaagaug

SEQ ID NO: 638276 - RNA, 22 nt, Human
ucugagccauaagaguacagga

SEQ ID NO: 638277 - RNA, 22 nt, Human
uugaaaaccgugggaggcugaa

SEQ ID NO: 638278 - RNA, 22 nt, Human
caggcuccuucccagggauggu

SEQ ID NO: 638279 - RNA, 22 nt, Human
ucuuauuuuuuaaugacagaga

SEQ ID NO: 638280 - RNA, 22 nt, Human
ggcuacagacugcauaagggca

SEQ ID NO: 638281 - RNA, 22 nt, Human
uaggcugggaagaaagauucuc

SEQ ID NO: 638282 - RNA, 21 nt, Human
acccaggggaagcagaaacug

SEQ ID NO: 638283 - RNA, 22 nt, Human
ucucuguguguuggcuguauau

SEQ ID NO: 638284 - RNA, 22 nt, Human
gggaaggacacagccaugacug

SEQ ID NO: 638285 - RNA, 22 nt, Human
ugcagggcuccuggcuccaauc

SEQ ID NO: 638286 - RNA, 22 nt, Human
ugagccaagcagcuucccaggg

SEQ ID NO: 638287 - RNA, 22 nt, Human
uccagcccugugucugggagag

SEQ ID NO: 638288 - RNA, 22 nt, Human
aauguauaauauuuaaugcuuu

SEQ ID NO: 638289 - RNA, 22 nt, Human
cugggcagccucacacaauguu

SEQ ID NO: 638290 - RNA, 22 nt, Human
uggguaggggacguggaagaaa

SEQ ID NO: 638291 - RNA, 22 nt, Human
uuccuucaguucagggaacccu

SEQ ID NO: 638292 - RNA, 22 nt, Human
uucuucaaaacaacacuggccu

SEQ ID NO: 638293 - RNA, 22 nt, Human
ugcagcagcagggaggaggcuc

SEQ ID NO: 638294 - RNA, 22 nt, Human
uugggccaaauagcuauuuacu

SEQ ID NO: 638295 - RNA, 22 nt, Human
ucccagauucuucugugugggc

SEQ ID NO: 638296 - RNA, 22 nt, Human
agguccugucuaucacccucgc

SEQ ID NO: 638297 - RNA, 22 nt, Human
ugaauucuggcccucucacuua

SEQ ID NO: 638298 - RNA, 22 nt, Human
aguaugaauggaaacuaccuau

SEQ ID NO: 638299 - RNA, 22 nt, Human
uauugacacuuuuuguguagcc

SEQ ID NO: 638300 - RNA, 22 nt, Human
auguguguacacacgugacucu

SEQ ID NO: 638301 - RNA, 22 nt, Human
ugggcugcuucuauuggugguc

SEQ ID NO: 638302 - RNA, 22 nt, Human
gggccagagcacagaggauguu

SEQ ID NO: 638303 - RNA, 18 nt, Human
gcaggcccuguuucuggg

SEQ ID NO: 638304 - RNA, 22 nt, Human
uaacagcuggcguuauaggaau

SEQ ID NO: 638305 - RNA, 22 nt, Human
cuaguaaagcuaugauucugcc

SEQ ID NO: 638306 - RNA, 22 nt, Human
gggagucagagagguaauggga

SEQ ID NO: 638307 - RNA, 20 nt, Human
ucagcucugugccugggaug

SEQ ID NO: 638308 - RNA, 22 nt, Human
aagauguuagaggucaugcaga

SEQ ID NO: 638309 - RNA, 22 nt, Human
caagagagaugcagcucacuca

SEQ ID NO: 638310 - RNA, 22 nt, Human
auauguuuugugcuucauuggu

SEQ ID NO: 638311 - RNA, 22 nt, Human
agagaugucgccuugcccaggg

SEQ ID NO: 638312 - RNA, 22 nt, Human
acagugcacauccugagugauu

SEQ ID NO: 638313 - RNA, 22 nt, Human
ucugugcugccauccuguggcc

SEQ ID NO: 638314 - RNA, 22 nt, Human
uuccugagucgccgagucuaug

SEQ ID NO: 638315 - RNA, 22 nt, Human
augcccugccaagcaggcuaaa

SEQ ID NO: 638316 - RNA, 22 nt, Human
guuuauuauucaacuucauguu

SEQ ID NO: 638317 - RNA, 22 nt, Human
acugggcccagugguguggcug

SEQ ID NO: 638318 - RNA, 22 nt, Human
uagacaaugccaucuugugguu

SEQ ID NO: 638319 - RNA, 22 nt, Human
uccuggcucugcugccuccuag

SEQ ID NO: 638320 - RNA, 17 nt, Human
ucugcagaggcaaaccu

SEQ ID NO: 638321 - RNA, 22 nt, Human
ccccucuuggcauugagugcca

SEQ ID NO: 638322 - RNA, 22 nt, Human
ccuaaggaaagccaaagaggcc

SEQ ID NO: 638323 - RNA, 22 nt, Human
guucgcaucuugaucauggacu

SEQ ID NO: 638324 - RNA, 22 nt, Human
gcccagcacagcuggaagaguc

SEQ ID NO: 638325 - RNA, 22 nt, Human
ccuucuccugccuuggguucau

SEQ ID NO: 638326 - RNA, 22 nt, Human
auuugugaauuaagcaugucaa

SEQ ID NO: 638327 - RNA, 20 nt, Human
ccaagagcaugcaugaggaa

SEQ ID NO: 638328 - RNA, 22 nt, Human
aaacaguauuaucaauauauuu

SEQ ID NO: 638329 - RNA, 22 nt, Human
gagcuuggcuggaccucacgga

SEQ ID NO: 638330 - RNA, 22 nt, Human
agucaguguucuccggagaggc

SEQ ID NO: 638331 - RNA, 22 nt, Human
ccaaggagcaaggcucaacaag

SEQ ID NO: 638332 - RNA, 21 nt, Human
cccucaggaaacagaaugcac

SEQ ID NO: 638333 - RNA, 21 nt, Human
uacagucuccccuguugucca

SEQ ID NO: 638334 - RNA, 22 nt, Human
agacagcagggagcaggauuca

SEQ ID NO: 638335 - RNA, 22 nt, Human
gugcaggagcaggagccauguc

SEQ ID NO: 638336 - RNA, 22 nt, Human
guggaggguuugcaaugugcag

SEQ ID NO: 638337 - RNA, 22 nt, Human
acuuagugcccuggcccuuaca

SEQ ID NO: 638338 - RNA, 22 nt, Human
uaaggagagaauuuagagguuu

SEQ ID NO: 638339 - RNA, 22 nt, Human
ccacucuugaaucaagagcuca

SEQ ID NO: 638340 - RNA, 21 nt, Human
uuacaaagcaagugcuguguc

SEQ ID NO: 638341 - RNA, 21 nt, Human
aagcuucccugcucuccaggg

SEQ ID NO: 638342 - RNA, 22 nt, Human
auuugcuuguccuggugacugu

SEQ ID NO: 638343 - RNA, 22 nt, Human
aggcuguggugcugaaggaggg

SEQ ID NO: 638344 - RNA, 22 nt, Human
ggaaaaacagucuuuauuauuu

SEQ ID NO: 638345 - RNA, 22 nt, Human
ugggccaguuauuucaccucug

SEQ ID NO: 638346 - RNA, 22 nt, Human
gacagguggggaaacuaaggua

SEQ ID NO: 638347 - RNA, 21 nt, Human
uuucccagcagagauagcugg

SEQ ID NO: 638348 - RNA, 22 nt, Human
uccaucauggcagcagcaguga

SEQ ID NO: 638349 - RNA, 22 nt, Human
uaaugcuuauguuaugcaauuu

SEQ ID NO: 638350 - RNA, 22 nt, Human
uggggcagcagaccuuucuugg

SEQ ID NO: 638351 - RNA, 22 nt, Human
aggaaagaaaggaggugcauuu

SEQ ID NO: 638352 - RNA, 22 nt, Human
ccagggugggguccaggaacca

SEQ ID NO: 638353 - RNA, 23 nt, Human
acugccagauugaagguuucuua

SEQ ID NO: 638354 - RNA, 22 nt, Human
ugugaaggcagcagcucugucc

SEQ ID NO: 638355 - RNA, 20 nt, Human
auugaaauuuuucugagauu

SEQ ID NO: 638356 - RNA, 22 nt, Human
accacuuuacagaaauggaaag

SEQ ID NO: 638357 - RNA, 22 nt, Human
ugcuggagagcuaguucugcag

SEQ ID NO: 638358 - RNA, 22 nt, Human
agccccuugcugcccucuagag

SEQ ID NO: 638359 - RNA, 22 nt, Human
cacaugaacaugcuggaaaagc

SEQ ID NO: 638360 - RNA, 22 nt, Human
ucaucugggagcuuguuagaaa

SEQ ID NO: 638361 - RNA, 22 nt, Human
uuucaguucaguuuauuauauc

SEQ ID NO: 638362 - RNA, 22 nt, Human
cagcuucauguccagguacugu

SEQ ID NO: 638363 - RNA, 22 nt, Human
cauggcagagccugcagguggg

SEQ ID NO: 638364 - RNA, 22 nt, Human
guguucaugccccagugcagga

SEQ ID NO: 638365 - RNA, 22 nt, Human
ccuccucugugcagcugugggu

SEQ ID NO: 638366 - RNA, 22 nt, Human
aucacagauugugaauaacuau

SEQ ID NO: 638367 - RNA, 19 nt, Human
gcugggcuuggguuuguag

SEQ ID NO: 638368 - RNA, 22 nt, Human
uuccucugaaauggcuuggaaa

SEQ ID NO: 638369 - RNA, 22 nt, Human
cuggauaagaguuuuacuuccu

SEQ ID NO: 638370 - RNA, 22 nt, Human
auuucccaacacauuagaaaau

SEQ ID NO: 638371 - RNA, 22 nt, Human
ucugggaagcaaauauguaaga

SEQ ID NO: 638372 - RNA, 20 nt, Human
aguaggggaaugcaagagca

SEQ ID NO: 638373 - RNA, 22 nt, Human
gucaaaaaguagucauuucugu

SEQ ID NO: 638374 - RNA, 22 nt, Human
gagagugagauaauuucacaua

SEQ ID NO: 638375 - RNA, 22 nt, Human
ggcuuugcuuuggcuguuucag

SEQ ID NO: 638376 - RNA, 20 nt, Human
aguguaugaaucuggauggg

SEQ ID NO: 638377 - RNA, 22 nt, Human
auguccaggaucuauccccaga

SEQ ID NO: 638378 - RNA, 22 nt, Human
acuuuguugaugaaauaguuuu

SEQ ID NO: 638379 - RNA, 22 nt, Human
gggucucuccuccccagcugug

SEQ ID NO: 638380 - RNA, 22 nt, Human
aagggcuggaucucucugagca

SEQ ID NO: 638381 - RNA, 22 nt, Human
cagggccugccugguuccugga

SEQ ID NO: 638382 - RNA, 22 nt, Human
acauagaucugugauucauucu

SEQ ID NO: 638383 - RNA, 22 nt, Human
uacaaugaugauacuuuacugg

SEQ ID NO: 638384 - RNA, 22 nt, Human
cugcagcuggagcaucuucuca

SEQ ID NO: 638385 - RNA, 22 nt, Human
auccaguuccaaagaucauuua

SEQ ID NO: 638386 - RNA, 22 nt, Human
agcuguguccugaagacacugc

SEQ ID NO: 638387 - RNA, 22 nt, Human
auccaaaauuuacuguagcauu

SEQ ID NO: 638388 - RNA, 22 nt, Human
acucuugaacugauuaagaaug

SEQ ID NO: 638389 - RNA, 22 nt, Human
ugaaggaaaugacggcagaaga

SEQ ID NO: 638390 - RNA, 22 nt, Human
ugcugugcaaaggugaugugag

SEQ ID NO: 638391 - RNA, 22 nt, Human
ggggauggaauguaguagugau

SEQ ID NO: 638392 - RNA, 22 nt, Human
uuccaguucacuccauuucugg

SEQ ID NO: 638393 - RNA, 22 nt, Human
uuugcauuugcaaauaaugaaa

SEQ ID NO: 638394 - RNA, 22 nt, Human
acaagauuuaaugcaacccaag

SEQ ID NO: 638395 - RNA, 22 nt, Human
cugccagagaucugggcagagu

SEQ ID NO: 638396 - RNA, 22 nt, Human
ugagggguaaguaaaggaauug

SEQ ID NO: 638397 - RNA, 22 nt, Human
ugcaggaaacagaggcucaaau

SEQ ID NO: 638398 - RNA, 23 nt, Human
uacugccuggggccagagagcgg

SEQ ID NO: 638399 - RNA, 22 nt, Human
cuugaggcugcacuccagggcc

SEQ ID NO: 638400 - RNA, 22 nt, Human
gagaggauccacaaaccaggaa

SEQ ID NO: 638401 - RNA, 22 nt, Human
uuuuaaaggcagauuauggcuu

SEQ ID NO: 638402 - RNA, 22 nt, Human
ugauguuuaauacuaugcuuuu

SEQ ID NO: 638403 - RNA, 22 nt, Human
aacuuuaaaaaauaugucuguu

SEQ ID NO: 638404 - RNA, 22 nt, Human
uaguguuccagaagcaaacaag

SEQ ID NO: 638405 - RNA, 20 nt, Human
ucacagaugaaaguucaaga

SEQ ID NO: 638406 - RNA, 22 nt, Human
caggagcccugguggguggaca

SEQ ID NO: 638407 - RNA, 22 nt, Human
uaauggaaguuaaauaugguau

SEQ ID NO: 638408 - RNA, 21 nt, Human
ccauaccuaccucaccugguu

SEQ ID NO: 638409 - RNA, 22 nt, Human
aaagccacaguucuaugucugc

SEQ ID NO: 638410 - RNA, 23 nt, Human
uaaccugagauugcaagggagcu

SEQ ID NO: 638411 - RNA, 22 nt, Human
aaagaaggaugggagaaauccu

SEQ ID NO: 638412 - RNA, 22 nt, Human
ccagccucaucgccugccuguc

SEQ ID NO: 638413 - RNA, 22 nt, Human
agucaaauaagagagagauguu

SEQ ID NO: 638414 - RNA, 23 nt, Human
ugacagagcacagugggggagau

SEQ ID NO: 638415 - RNA, 22 nt, Human
ggaccagagaagugagcaccug

SEQ ID NO: 638416 - RNA, 22 nt, Human
cuggagcuggcuuccuuccacu

SEQ ID NO: 638417 - RNA, 22 nt, Human
augucaaaucaguuuuaucaga

SEQ ID NO: 638418 - RNA, 22 nt, Human
aagacugauguccagucccaug

SEQ ID NO: 638419 - RNA, 22 nt, Human
agguggaaauggcuuuccuagg

SEQ ID NO: 638420 - RNA, 22 nt, Human
uucccaguauuaccuucaggaa

SEQ ID NO: 638421 - RNA, 22 nt, Human
cugaaccaucucuguucuguau

SEQ ID NO: 638422 - RNA, 22 nt, Human
ggaaagagaaguugggaggaau

SEQ ID NO: 638423 - RNA, 22 nt, Human
gugugugccaacuuuaugugca

SEQ ID NO: 638424 - RNA, 22 nt, Human
ugucaugccaccguuucccaga

SEQ ID NO: 638425 - RNA, 22 nt, Human
cuaguuaguucugggucauccu

SEQ ID NO: 638426 - RNA, 22 nt, Human
cuuucagucuuuacaagguugc

SEQ ID NO: 638427 - RNA, 22 nt, Human
ugggccuguugggguugaguua

SEQ ID NO: 638428 - RNA, 22 nt, Human
cuggcccauggugagcucuggg

SEQ ID NO: 638429 - RNA, 23 nt, Human
ucauggaacugggcaaucuugaa

SEQ ID NO: 638430 - RNA, 22 nt, Human
uauuuggaaacaauucacaugc

SEQ ID NO: 638431 - RNA, 23 nt, Human
uaaugccagcccugcaguuaagc

SEQ ID NO: 638432 - RNA, 22 nt, Human
cacauccuucauacucagcucu

SEQ ID NO: 638433 - RNA, 22 nt, Human
ugcugcuguaucaugccuucau

SEQ ID NO: 638434 - RNA, 22 nt, Human
ccagggcucaggcucccagugg

SEQ ID NO: 638435 - RNA, 22 nt, Human
auguucuuugaaauauuuuaga

SEQ ID NO: 638436 - RNA, 22 nt, Human
aaaauaguuaacguucagagua

SEQ ID NO: 638437 - RNA, 22 nt, Human
uuacaagauuaauuauuggagu

SEQ ID NO: 638438 - RNA, 22 nt, Human
aaggaauucaaauuuucucugg

SEQ ID NO: 638439 - RNA, 21 nt, Human
ugaguuaaaauggagagucuu

SEQ ID NO: 638440 - RNA, 22 nt, Human
gccuggcugucuggcaagguuc

SEQ ID NO: 638441 - RNA, 22 nt, Human
cagcugcuuacuagcuguguga

SEQ ID NO: 638442 - RNA, 22 nt, Human
ucuuuagacauccaguuucucu

SEQ ID NO: 638443 - RNA, 22 nt, Human
cagccucuugcacuuugaaggc

SEQ ID NO: 638444 - RNA, 18 nt, Human
gaccccgggaucugucga

SEQ ID NO: 638445 - RNA, 22 nt, Human
cagauucuucauugccccauuc

SEQ ID NO: 638446 - RNA, 22 nt, Human
ucgaauggcaaggaaagaggcu

SEQ ID NO: 638447 - RNA, 22 nt, Human
auucucugugcagauuuaagac

SEQ ID NO: 638448 - RNA, 22 nt, Human
agagcugcaauuucauguggug

SEQ ID NO: 638449 - RNA, 22 nt, Human
ucccuucuggcagcagugugag

SEQ ID NO: 638450 - RNA, 17 nt, Human
ggugaguguccaggugg

SEQ ID NO: 638451 - RNA, 23 nt, Human
ccuggggagcuguauccagagug

SEQ ID NO: 638452 - RNA, 22 nt, Human
ccagaaaauauggcuaagguga

SEQ ID NO: 638453 - RNA, 22 nt, Human
gcuguacauucuguggguuugg

SEQ ID NO: 638454 - RNA, 22 nt, Human
uucucuuuucaccaguugcuaa

SEQ ID NO: 638455 - RNA, 22 nt, Human
acaguauauauagucuaaaagc

SEQ ID NO: 638456 - RNA, 22 nt, Human
ccugccagucacuaugucaccu

SEQ ID NO: 638457 - RNA, 22 nt, Human
uugcugauucaugauuugagaa

SEQ ID NO: 638458 - RNA, 22 nt, Human
ucuggcuccacucugugcaugc

SEQ ID NO: 638459 - RNA, 22 nt, Human
aaacugcacaugaggcuggugc

SEQ ID NO: 638460 - RNA, 22 nt, Human
cucagccaugcaacaugcuggg

SEQ ID NO: 638461 - RNA, 22 nt, Human
agggagaguuugauguuuccuc

SEQ ID NO: 638462 - RNA, 22 nt, Human
agcugccagaugacagugcuau

SEQ ID NO: 638463 - RNA, 22 nt, Human
ggagcaucugaacagggagaag

SEQ ID NO: 638464 - RNA, 19 nt, Human
caagugaagccugggaugg

SEQ ID NO: 638465 - RNA, 22 nt, Human
aggcugagucaaguuaggguga

SEQ ID NO: 638466 - RNA, 23 nt, Human
uucuggcuguggguggcgucucu

SEQ ID NO: 638467 - RNA, 22 nt, Human
auuagaagauagugauuucugc

SEQ ID NO: 638468 - RNA, 22 nt, Human
aggcagugagaaauagcaagau

SEQ ID NO: 638469 - RNA, 22 nt, Human
acugggagggucuugaagaggg

SEQ ID NO: 638470 - RNA, 22 nt, Human
aguuauuuggcuauagauggua

SEQ ID NO: 638471 - RNA, 22 nt, Human
gcuugcuggugccugcaggcuc

SEQ ID NO: 638472 - RNA, 22 nt, Human
ucagagaugcagugccaccuac

SEQ ID NO: 638473 - RNA, 22 nt, Human
cagaggcagaauggagauuugg

SEQ ID NO: 638474 - RNA, 22 nt, Human
gagcucauucauucauugccug

SEQ ID NO: 638475 - RNA, 22 nt, Human
ggagaggugcaggucaguggca

SEQ ID NO: 638476 - RNA, 22 nt, Human
cagccugagccuucuguagcaa

SEQ ID NO: 638477 - RNA, 22 nt, Human
uacagcacaaagggccuuuacc

SEQ ID NO: 638478 - RNA, 22 nt, Human
cuucuugucaauuugccauugu

SEQ ID NO: 638479 - RNA, 22 nt, Human
ccugcucaacgaauauggcgau

SEQ ID NO: 638480 - RNA, 22 nt, Human
aagugauuucugccugcauguu

SEQ ID NO: 638481 - RNA, 22 nt, Human
uaacuugauaaguauucucugc

SEQ ID NO: 638482 - RNA, 22 nt, Human
ugugacuggaguccagcccacu

SEQ ID NO: 638483 - RNA, 22 nt, Human
auuauuagacuuauaugguagu

SEQ ID NO: 638484 - RNA, 22 nt, Human
uuggaaagaccgaauuccuguu

SEQ ID NO: 638485 - RNA, 22 nt, Human
ucaguguguucaauuggauagg

SEQ ID NO: 638486 - RNA, 22 nt, Human
agaaaacugcagaguagccuca

SEQ ID NO: 638487 - RNA, 22 nt, Human
ggcccucuggcuuccgcauggg

SEQ ID NO: 638488 - RNA, 22 nt, Human
ugagcccagagaucugagcuau

SEQ ID NO: 638489 - RNA, 22 nt, Human
gcaaauauuucuaauuccugaa

SEQ ID NO: 638490 - RNA, 22 nt, Human
uauuuaauuagugauuguagag

SEQ ID NO: 638491 - RNA, 22 nt, Human
uugugccuggcuuguauucaca

SEQ ID NO: 638492 - RNA, 18 nt, Human
cugccacuuaauguggug

SEQ ID NO: 638493 - RNA, 22 nt, Human
gguggcaguuacaggggcaaau

SEQ ID NO: 638494 - RNA, 22 nt, Human
aagauacaaaugucaauauugg

SEQ ID NO: 638495 - RNA, 22 nt, Human
auuaugaaguugagggacccug

SEQ ID NO: 638496 - RNA, 22 nt, Human
ugggaccugcccuggccccauc

SEQ ID NO: 638497 - RNA, 22 nt, Human
uggcuuccacugugugcccccu

SEQ ID NO: 638498 - RNA, 23 nt, Human
uguguacauacauauguacacac

SEQ ID NO: 638499 - RNA, 22 nt, Human
guuauguauugggaaauccaag

SEQ ID NO: 638500 - RNA, 22 nt, Human
ggcagugggaaauaagugagaa

SEQ ID NO: 638501 - RNA, 19 nt, Human
ugggaacuuguuagacaug

SEQ ID NO: 638502 - RNA, 22 nt, Human
ucagaggugagcuucuugcuaa

SEQ ID NO: 638503 - RNA, 22 nt, Human
gaaaugaaauagcaccaagguu

SEQ ID NO: 638504 - RNA, 22 nt, Human
aucuguguaugugaccuuaucu

SEQ ID NO: 638505 - RNA, 22 nt, Human
gucugccugcaauccagagacu

SEQ ID NO: 638506 - RNA, 22 nt, Human
agcaaggcagcuuucacugcuu

SEQ ID NO: 638507 - RNA, 22 nt, Human
aacuuucagaauccuaugcauu

SEQ ID NO: 638508 - RNA, 22 nt, Human
cagaggaugaucuggccucucu

SEQ ID NO: 638509 - RNA, 19 nt, Human
ugagaaauuccacaggaug

SEQ ID NO: 638510 - RNA, 22 nt, Human
uccaugagcuagggauucauca

SEQ ID NO: 638511 - RNA, 22 nt, Human
guacaaaguggaccugauagua

SEQ ID NO: 638512 - RNA, 23 nt, Human
cuggcuucuggggccucuguuuc

SEQ ID NO: 638513 - RNA, 22 nt, Human
uugcacuaggaaaaggcagcca

SEQ ID NO: 638514 - RNA, 22 nt, Human
ggcaggcuggcuuuguuccagg

SEQ ID NO: 638515 - RNA, 22 nt, Human
uguuauucuaguggaucacguc

SEQ ID NO: 638516 - RNA, 22 nt, Human
agggcucaauggugggcaugua

SEQ ID NO: 638517 - RNA, 22 nt, Human
uggcagagaugaagaguuguuu

SEQ ID NO: 638518 - RNA, 22 nt, Human
auuucacauuaauuugaugcuc

SEQ ID NO: 638519 - RNA, 22 nt, Human
aaaugguggcucuuuuaaauug

SEQ ID NO: 638520 - RNA, 22 nt, Human
agagugggccucugagucccag

SEQ ID NO: 638521 - RNA, 22 nt, Human
augaagauauucuuguuuucug

SEQ ID NO: 638522 - RNA, 22 nt, Human
uggcugaacuaaugugcuguuu

SEQ ID NO: 638523 - RNA, 22 nt, Human
gacauguauuaguacauauggu

SEQ ID NO: 638524 - RNA, 19 nt, Human
auuugcuugucugcucugc

SEQ ID NO: 638525 - RNA, 23 nt, Human
aaauauucuuuuuuaguaagugc

SEQ ID NO: 638526 - RNA, 22 nt, Human
acuggcaguuugagaaugcauu

SEQ ID NO: 638527 - RNA, 22 nt, Human
uucuaguuuucaguccaccagg

SEQ ID NO: 638528 - RNA, 22 nt, Human
gggccacggaaggaccaguggg

SEQ ID NO: 638529 - RNA, 22 nt, Human
cugaaugauauaagaucuuucu

SEQ ID NO: 638530 - RNA, 22 nt, Human
uuguaugcugaucaaaagcuuc

SEQ ID NO: 638531 - RNA, 22 nt, Human
uuucucggcagagaugaugggc

SEQ ID NO: 638532 - RNA, 22 nt, Human
ugagucacauccauuuuugugu

SEQ ID NO: 638533 - RNA, 22 nt, Human
aggagguguagauuuccuguca

SEQ ID NO: 638534 - RNA, 22 nt, Human
agcuucucagaagaguccugua

SEQ ID NO: 638535 - RNA, 22 nt, Human
ucuggcucuguguccccaccca

SEQ ID NO: 638536 - RNA, 22 nt, Human
aggcucaagcacugauauuuuu

SEQ ID NO: 638537 - RNA, 22 nt, Human
gaguuauuucagaaggaaagau

SEQ ID NO: 638538 - RNA, 22 nt, Human
agcaacagcccuguuucauuag

SEQ ID NO: 638539 - RNA, 22 nt, Human
cugccaaguaaugccugggcuc

SEQ ID NO: 638540 - RNA, 22 nt, Human
uguaccaagacaaaucagaaac

SEQ ID NO: 638541 - RNA, 22 nt, Human
uuccugaucccccaggacaaag

SEQ ID NO: 638542 - RNA, 22 nt, Human
aaauguccauugaauggaugag

SEQ ID NO: 638543 - RNA, 22 nt, Human
gcagcauccccaggcagcaggg

SEQ ID NO: 638544 - RNA, 22 nt, Human
acauauauuacuaguaaagaca

SEQ ID NO: 638545 - RNA, 22 nt, Human
uuguggggcaacagcaggugaa

SEQ ID NO: 638546 - RNA, 22 nt, Human
agagcuguuaauuuugcacugg

SEQ ID NO: 638547 - RNA, 22 nt, Human
auuuccagugcacugaauagaa

SEQ ID NO: 638548 - RNA, 22 nt, Human
aauaagaauugccagauuugaa

SEQ ID NO: 638549 - RNA, 22 nt, Human
agccccugcuggguguagcuca

SEQ ID NO: 638550 - RNA, 19 nt, Human
agucucugaggccuaaguu

SEQ ID NO: 638551 - RNA, 22 nt, Human
gcacagcucuccccaagacgaa

SEQ ID NO: 638552 - RNA, 22 nt, Human
ugcuguguucuccugacucacc

SEQ ID NO: 638553 - RNA, 22 nt, Human
cucagcaccccgacaggacauu

SEQ ID NO: 638554 - RNA, 22 nt, Human
ugcaggcugccuucacagagcc

SEQ ID NO: 638555 - RNA, 22 nt, Human
ugcugggcugcacccccagagu

SEQ ID NO: 638556 - RNA, 22 nt, Human
cuucuuaaauuggauugcuauu

SEQ ID NO: 638557 - RNA, 18 nt, Human
auacaagcucuguuacuu

SEQ ID NO: 638558 - RNA, 22 nt, Human
gcuuccaguccucagaggcugg

SEQ ID NO: 638559 - RNA, 22 nt, Human
uggcuuuacuuaaacugaauca

SEQ ID NO: 638560 - RNA, 22 nt, Human
aggcuugguuaauucuguguga

SEQ ID NO: 638561 - RNA, 22 nt, Human
augcaacagcugggaauaugua

SEQ ID NO: 638562 - RNA, 22 nt, Human
ggaaggaggaugcucuggccuu

SEQ ID NO: 638563 - RNA, 22 nt, Human
ugacccauggucugaucauagg

SEQ ID NO: 638564 - RNA, 15 nt, Human
uacauucauuuccac

SEQ ID NO: 638565 - RNA, 22 nt, Human
uagggcagccacccaggcugcu

SEQ ID NO: 638566 - RNA, 22 nt, Human
cucuggagcgcugcuucccgcg

SEQ ID NO: 638567 - RNA, 22 nt, Human
uucuuaagucaguaagaugcaa

SEQ ID NO: 638568 - RNA, 22 nt, Human
ggacugaaggacaaucugguuc

SEQ ID NO: 638569 - RNA, 22 nt, Human
aaacaguacucgauuuuuguag

SEQ ID NO: 638570 - RNA, 22 nt, Human
gaggcuaaggugccagacgaau

SEQ ID NO: 638571 - RNA, 22 nt, Human
ugcaaacaauuuccuauaaagu

SEQ ID NO: 638572 - RNA, 22 nt, Human
guaaaguucuauuugaauuuag

SEQ ID NO: 638573 - RNA, 20 nt, Human
aguggcugauggaaagaagc

SEQ ID NO: 638574 - RNA, 22 nt, Human
uggaggucucugucugggcagg

SEQ ID NO: 638575 - RNA, 22 nt, Human
uagugauuuucauauuacauua

SEQ ID NO: 638576 - RNA, 22 nt, Human
gggccagcucugugauguaggg

SEQ ID NO: 638577 - RNA, 19 nt, Human
uagauaaggcauuuaaucu

SEQ ID NO: 638578 - RNA, 22 nt, Human
ucuggaaugauuuccuuccccu

SEQ ID NO: 638579 - RNA, 22 nt, Human
agggucagagucaggugcagua

SEQ ID NO: 638580 - RNA, 22 nt, Human
ugaugaggacccaucaccuggu

SEQ ID NO: 638581 - RNA, 22 nt, Human
gaauaaacuccucagcuuccuu

SEQ ID NO: 638582 - RNA, 22 nt, Human
ugcaagggugacagguugcucu

SEQ ID NO: 638583 - RNA, 22 nt, Human
cuccuggcaguuccccuuguca

SEQ ID NO: 638584 - RNA, 22 nt, Human
agucauauuuagcuuguggaau

SEQ ID NO: 638585 - RNA, 20 nt, Human
ggagcugcccugggcuggag

SEQ ID NO: 638586 - RNA, 22 nt, Human
aggaaacugauguuuuuuacaa

SEQ ID NO: 638587 - RNA, 22 nt, Human
acccaggcuggaaugcaguggc

SEQ ID NO: 638588 - RNA, 22 nt, Human
acccaggcuggagugcagugac

SEQ ID NO: 638589 - RNA, 22 nt, Human
ucagccaggccaccuucagcuu

SEQ ID NO: 638590 - RNA, 17 nt, Human
uggaugugggaucugga

SEQ ID NO: 638591 - RNA, 22 nt, Human
ucagugcaguagaacuuuaguu

SEQ ID NO: 638592 - RNA, 22 nt, Human
acagauguacacucauauauaa

SEQ ID NO: 638593 - RNA, 22 nt, Human
cuggcaggaaguuagaugguaa

SEQ ID NO: 638594 - RNA, 22 nt, Human
ugugcaaauuaaguagauuuuc

SEQ ID NO: 638595 - RNA, 22 nt, Human
gaggccugaggcugccuggagc

SEQ ID NO: 638596 - RNA, 22 nt, Human
uuagaggggcugcugaauggga

SEQ ID NO: 638597 - RNA, 22 nt, Human
auuugcucuagcugcagugaau

SEQ ID NO: 638598 - RNA, 22 nt, Human
ucuaaccuuguggucugcuggu

SEQ ID NO: 638599 - RNA, 22 nt, Human
ucuuuagauguuuagaggaaga

SEQ ID NO: 638600 - RNA, 22 nt, Human
uggauggagacugauaugggua

SEQ ID NO: 638601 - RNA, 21 nt, Human
caugucuuccacacuguagua

SEQ ID NO: 638602 - RNA, 19 nt, Human
uaaaucuguauucuucaaa

SEQ ID NO: 638603 - RNA, 22 nt, Human
cccagccagccucuucccauau

SEQ ID NO: 638604 - RNA, 22 nt, Human
cagcaggacccaggaauccugc

SEQ ID NO: 638605 - RNA, 22 nt, Human
uuccaggaaaacaguuggaagu

SEQ ID NO: 638606 - RNA, 22 nt, Human
uuuacaugaguagcagauguuc

SEQ ID NO: 638607 - RNA, 22 nt, Human
uuuuccuauaugcaaagaaugc

SEQ ID NO: 638608 - RNA, 22 nt, Human
ucacagcaacacuggggcagac

SEQ ID NO: 638609 - RNA, 22 nt, Human
aaacaaguguaaacuagucugu

SEQ ID NO: 638610 - RNA, 22 nt, Human
aaagcacauaguagaaggauuu

SEQ ID NO: 638611 - RNA, 22 nt, Human
uaaagcaagacacacccauagc

SEQ ID NO: 638612 - RNA, 22 nt, Human
ucagggcaggcgagcagcugcu

SEQ ID NO: 638613 - RNA, 17 nt, Human
cccugcacccuacucuc

SEQ ID NO: 638614 - RNA, 22 nt, Human
ggcagccuccagggcacuggug

SEQ ID NO: 638615 - RNA, 22 nt, Human
uaguccuugcugggcacagagu

SEQ ID NO: 638616 - RNA, 18 nt, Human
cccacccuggcucuuagu

SEQ ID NO: 638617 - RNA, 22 nt, Human
agcuagacuuucccuuuccaug

SEQ ID NO: 638618 - RNA, 22 nt, Human
agaggccaccuucucuugagaa

SEQ ID NO: 638619 - RNA, 22 nt, Human
aggccacaagaacuaccccauc

SEQ ID NO: 638620 - RNA, 22 nt, Human
gagccugcaggccucggccuca

SEQ ID NO: 638621 - RNA, 22 nt, Human
uugagacugccuugucgucugc

SEQ ID NO: 638622 - RNA, 22 nt, Human
ccuggguccaauucuggcuugu

SEQ ID NO: 638623 - RNA, 22 nt, Human
cagcaucuggggaacauucaag

SEQ ID NO: 638624 - RNA, 22 nt, Human
gucuccagccauucucugauca

SEQ ID NO: 638625 - RNA, 22 nt, Human
cuuuuacugugaaaagaaacug

SEQ ID NO: 638626 - RNA, 21 nt, Human
aauacagugaagaauuucuuu

SEQ ID NO: 638627 - RNA, 23 nt, Human
cugagguggagagugagguaagu

SEQ ID NO: 638628 - RNA, 22 nt, Human
ccucagagaaagguauggcuga

SEQ ID NO: 638629 - RNA, 22 nt, Human
augaauguuuggugaucagaua

SEQ ID NO: 638630 - RNA, 22 nt, Human
ucccuccuggugaugaugcaaa

SEQ ID NO: 638631 - RNA, 22 nt, Human
gcagccuuccguggaccuggac

SEQ ID NO: 638632 - RNA, 22 nt, Human
uucacuuaacaucauaucauga

SEQ ID NO: 638633 - RNA, 20 nt, Human
uggcucucacccugugcgau

SEQ ID NO: 638634 - RNA, 19 nt, Human
uuuucucgugcuugucugc

SEQ ID NO: 638635 - RNA, 22 nt, Human
aauaaagacaaacaggggagcc

SEQ ID NO: 638636 - RNA, 22 nt, Human
uuugaauagaggccccucagaa

SEQ ID NO: 638637 - RNA, 22 nt, Human
cacaguuuuaucuuauacugau

SEQ ID NO: 638638 - RNA, 22 nt, Human
gcagggccagugcagagaggaa

SEQ ID NO: 638639 - RNA, 19 nt, Human
gaucagagugucagcuugu

SEQ ID NO: 638640 - RNA, 22 nt, Human
gagacugcauagauggccacaa

SEQ ID NO: 638641 - RNA, 22 nt, Human
uuugacagaaaguuauuauuuu

SEQ ID NO: 638642 - RNA, 22 nt, Human
agcuggguguucuugggccuaa

SEQ ID NO: 638643 - RNA, 22 nt, Human
ucaaaauuuuauuucucaagga

SEQ ID NO: 638644 - RNA, 22 nt, Human
agcucuguguucacagcacuaa

SEQ ID NO: 638645 - RNA, 22 nt, Human
guguggcaaggugagaaguggg

SEQ ID NO: 638646 - RNA, 22 nt, Human
ucagggaaaagucacacugggu

SEQ ID NO: 638647 - RNA, 22 nt, Human
aagggagacaguugugugagga

SEQ ID NO: 638648 - RNA, 22 nt, Human
uucaagucauguuaacugcuuc

SEQ ID NO: 638649 - RNA, 22 nt, Human
agccucucaaagaaacccugua

SEQ ID NO: 638650 - RNA, 22 nt, Human
gccagcuggcugcaggucccag

SEQ ID NO: 638651 - RNA, 22 nt, Human
uggcugaggcacagcugccgcc

SEQ ID NO: 638652 - RNA, 22 nt, Human
auccaaaggugacacagaauac

SEQ ID NO: 638653 - RNA, 21 nt, Human
ccugggcugugguuuggagac

SEQ ID NO: 638654 - RNA, 22 nt, Human
ccucagaguaggucucagcugu

SEQ ID NO: 638655 - RNA, 22 nt, Human
caugcagugguaaaaagucagg

SEQ ID NO: 638656 - RNA, 22 nt, Human
uacaaugcuguuuguuucuacu

SEQ ID NO: 638657 - RNA, 23 nt, Human
uccagggauuaaugaagucaguc

SEQ ID NO: 638658 - RNA, 22 nt, Human
agacagaaauaggagaaaccag

SEQ ID NO: 638659 - RNA, 22 nt, Human
ucuuuuguugccuacuuauuaa

SEQ ID NO: 638660 - RNA, 22 nt, Human
ugcuauuugggggcuacaugau

SEQ ID NO: 638661 - RNA, 22 nt, Human
aagaaagagaucacuccuccau

SEQ ID NO: 638662 - RNA, 22 nt, Human
agcugggugcccgaagccacgu

SEQ ID NO: 638663 - RNA, 22 nt, Human
cugagcagaggucaagauacuu

SEQ ID NO: 638664 - RNA, 22 nt, Human
gccccaggggaggugcccugca

SEQ ID NO: 638665 - RNA, 22 nt, Human
uugaagacaagggcagggguuc

SEQ ID NO: 638666 - RNA, 22 nt, Human
uucauaaugagguccuagaggc

SEQ ID NO: 638667 - RNA, 22 nt, Human
uacaauguucgcauucucucug

SEQ ID NO: 638668 - RNA, 22 nt, Human
auugggcuggccuucuggagag

SEQ ID NO: 638669 - RNA, 22 nt, Human
gcaugugggagggucuucccac

SEQ ID NO: 638670 - RNA, 22 nt, Human
uuaaggaaagauuagcauuugu

SEQ ID NO: 638671 - RNA, 22 nt, Human
agacugugagggagauacaggg

SEQ ID NO: 638672 - RNA, 22 nt, Human
ugggcaggugcuauuuuccaug

SEQ ID NO: 638673 - RNA, 22 nt, Human
ggucuggacccuccuggagugg

SEQ ID NO: 638674 - RNA, 22 nt, Human
aacauuucauuggaagcuaugu

SEQ ID NO: 638675 - RNA, 22 nt, Human
uugcaaauugcaagaguuggau

SEQ ID NO: 638676 - RNA, 22 nt, Human
ucugggaauacacacugauuua

SEQ ID NO: 638677 - RNA, 22 nt, Human
gucaacauaggccucagugagg

SEQ ID NO: 638678 - RNA, 22 nt, Human
ugaagccacuuuccagaaucac

SEQ ID NO: 638679 - RNA, 22 nt, Human
uccaguccagggaauggcugau

SEQ ID NO: 638680 - RNA, 18 nt, Human
ugcccagaaaagcaggga

SEQ ID NO: 638681 - RNA, 22 nt, Human
cucccaggacuggcucuaacug

SEQ ID NO: 638682 - RNA, 22 nt, Human
ugugccugcuagaugguugucg

SEQ ID NO: 638683 - RNA, 22 nt, Human
ggaucauuaagaauagcuacua

SEQ ID NO: 638684 - RNA, 22 nt, Human
cucucugguuucagcgaagggg

SEQ ID NO: 638685 - RNA, 22 nt, Human
ucacuuugacggccaacuucua

SEQ ID NO: 638686 - RNA, 22 nt, Human
aggggagcuugaggcauggccu

SEQ ID NO: 638687 - RNA, 22 nt, Human
augaguucaauuguuucaguca

SEQ ID NO: 638688 - RNA, 20 nt, Human
uguccccaccaaaauuucau

SEQ ID NO: 638689 - RNA, 22 nt, Human
ucugucugcgcuugcccuggug

SEQ ID NO: 638690 - RNA, 22 nt, Human
ucagaacagguuguacuauguc

SEQ ID NO: 638691 - RNA, 22 nt, Human
ugacuaaaauaggacauuaacu

SEQ ID NO: 638692 - RNA, 22 nt, Human
gguaaauuuuaugugaugaaac

SEQ ID NO: 638693 - RNA, 22 nt, Human
aaggcuccacccucauggaugc

SEQ ID NO: 638694 - RNA, 22 nt, Human
acuucauugcuaagaacaaggu

SEQ ID NO: 638695 - RNA, 22 nt, Human
ugcuggccggccaggugcugag

SEQ ID NO: 638696 - RNA, 20 nt, Human
uccugggguaagccaugguc

SEQ ID NO: 638697 - RNA, 22 nt, Human
uuagauaaaaguguucaauaaa

SEQ ID NO: 638698 - RNA, 22 nt, Human
cugaugccucucuucuuggcuu

SEQ ID NO: 638699 - RNA, 22 nt, Human
auuuguuucagggccuugguau

SEQ ID NO: 638700 - RNA, 22 nt, Human
aguuauuucaguaacauaauag

SEQ ID NO: 638701 - RNA, 22 nt, Human
cuccaagggcucccagacgucu

SEQ ID NO: 638702 - RNA, 22 nt, Human
gaaacguuaaaccauauguaau

SEQ ID NO: 638703 - RNA, 22 nt, Human
ucuuccucuucugcugagaagu

SEQ ID NO: 638704 - RNA, 19 nt, Human
ucuccagcuuugggcuuuu

SEQ ID NO: 638705 - RNA, 22 nt, Human
cuggcagcgguuugcagccugg

SEQ ID NO: 638706 - RNA, 22 nt, Human
ucuaaagacacuuuuuacaggg

SEQ ID NO: 638707 - RNA, 22 nt, Human
acaagguugauucuggcaucug

SEQ ID NO: 638708 - RNA, 22 nt, Human
auaacagaugcuucagcauaaa

SEQ ID NO: 638709 - RNA, 22 nt, Human
gguggccugcccugaucccugg

SEQ ID NO: 638710 - RNA, 22 nt, Human
auacacaugcacacaugugugu

SEQ ID NO: 638711 - RNA, 22 nt, Human
cagugucuuauuuguagcucag

SEQ ID NO: 638712 - RNA, 22 nt, Human
ugaucuuuacugcuguuuauaa

SEQ ID NO: 638713 - RNA, 22 nt, Human
acccugauauagguccaagagc

SEQ ID NO: 638714 - RNA, 22 nt, Human
ugcacaccucuccaccacucuc

SEQ ID NO: 638715 - RNA, 22 nt, Human
agacucaugacacuuccuauga

SEQ ID NO: 638716 - RNA, 22 nt, Human
gcuccagcaccuagagcagguc

SEQ ID NO: 638717 - RNA, 22 nt, Human
ggugcaaagggccuagagagug

SEQ ID NO: 638718 - RNA, 22 nt, Human
aagaaauaagacuucucugucc

SEQ ID NO: 638719 - RNA, 22 nt, Human
ccagccccgggccuuaccgugc

SEQ ID NO: 638720 - RNA, 22 nt, Human
cuccaguaucuguaggaaaagg

SEQ ID NO: 638721 - RNA, 18 nt, Human
uggaucuuuaugaggcug

SEQ ID NO: 638722 - RNA, 23 nt, Human
aaacaugcagcacaugaaugcua

SEQ ID NO: 638723 - RNA, 22 nt, Human
gggaagugaggagccccucugc

SEQ ID NO: 638724 - RNA, 22 nt, Human
guugcuuuuuugauagguggaa

SEQ ID NO: 638725 - RNA, 22 nt, Human
gccagggcugugcagguuuguu

SEQ ID NO: 638726 - RNA, 22 nt, Human
cuggcacucauaggccaguuca

SEQ ID NO: 638727 - RNA, 22 nt, Human
uguucucucuggcugccaguac

SEQ ID NO: 638728 - RNA, 22 nt, Human
caaauuuagguaacagucugua

SEQ ID NO: 638729 - RNA, 18 nt, Human
gaguguggcacugggccc

SEQ ID NO: 638730 - RNA, 22 nt, Human
ugacucuuaaauauacuguuga

SEQ ID NO: 638731 - RNA, 22 nt, Human
ugaaacacaagccugguuagug

SEQ ID NO: 638732 - RNA, 22 nt, Human
aucauucagccuaagcaaguac

SEQ ID NO: 638733 - RNA, 22 nt, Human
uuuuguuuguguccacugcagu

SEQ ID NO: 638734 - RNA, 22 nt, Human
cauaucuucugacaugaucagg

SEQ ID NO: 638735 - RNA, 22 nt, Human
gccucugcacuguggcacacca

SEQ ID NO: 638736 - RNA, 22 nt, Human
aauuagggaggacaaagguaca

SEQ ID NO: 638737 - RNA, 22 nt, Human
auuuagcaagcaggcaaauuca

SEQ ID NO: 638738 - RNA, 22 nt, Human
auccuuccuucauuugacaggu

SEQ ID NO: 638739 - RNA, 21 nt, Human
aacauuucaggauccaaauug

SEQ ID NO: 638740 - RNA, 22 nt, Human
ugaggucugcagggcugugcau

SEQ ID NO: 638741 - RNA, 22 nt, Human
uucugcaggagcccuaguguau

SEQ ID NO: 638742 - RNA, 22 nt, Human
gaggagggccuggugucccuuc

SEQ ID NO: 638743 - RNA, 22 nt, Human
ugaagccaccgaaccagaagag

SEQ ID NO: 638744 - RNA, 22 nt, Human
acagcagcgucaacuuaaaauu

SEQ ID NO: 638745 - RNA, 22 nt, Human
ugcuagaauaccuaccuggagg

SEQ ID NO: 638746 - RNA, 22 nt, Human
cugaggccggagcacugaagag

SEQ ID NO: 638747 - RNA, 21 nt, Human
cuggagucauuuucugaguag

SEQ ID NO: 638748 - RNA, 22 nt, Human
ggucuggaauaagguccaggaa

SEQ ID NO: 638749 - RNA, 22 nt, Human
aaagugcacucucagugcugcu

SEQ ID NO: 638750 - RNA, 21 nt, Human
aaccugagacccacgggacua

SEQ ID NO: 638751 - RNA, 22 nt, Human
uucuucuuucccccugugguac

SEQ ID NO: 638752 - RNA, 22 nt, Human
ucucuucuaauuuucccgagua

SEQ ID NO: 638753 - RNA, 23 nt, Human
uuucuucucgaagagggagcuua

SEQ ID NO: 638754 - RNA, 22 nt, Human
gaucaaugguguaacuuguccu

SEQ ID NO: 638755 - RNA, 22 nt, Human
ccagucccaggcagaaauccag

SEQ ID NO: 638756 - RNA, 22 nt, Human
aguuagaagugugucaucugug

SEQ ID NO: 638757 - RNA, 22 nt, Human
augggcagagcuggugggaggc

SEQ ID NO: 638758 - RNA, 22 nt, Human
gaaucucaaggcuugugaggau

SEQ ID NO: 638759 - RNA, 22 nt, Human
cucugggcaggacgccaggccu

SEQ ID NO: 638760 - RNA, 22 nt, Human
cagggugcgccacucagaugua

SEQ ID NO: 638761 - RNA, 22 nt, Human
aggcagugaugagucaugaaua

SEQ ID NO: 638762 - RNA, 22 nt, Human
ucuguccuguuuccuccugaca

SEQ ID NO: 638763 - RNA, 23 nt, Human
uggaggaaacacaucagaagacc

SEQ ID NO: 638764 - RNA, 23 nt, Human
aaagugacuuuuauaccacuaac

SEQ ID NO: 638765 - RNA, 22 nt, Human
uugcauguguaauuuuucuaaa

SEQ ID NO: 638766 - RNA, 22 nt, Human
cucaaauguuuccacuucugcu

SEQ ID NO: 638767 - RNA, 22 nt, Human
gccaggcagcagcgaggauggu

SEQ ID NO: 638768 - RNA, 22 nt, Human
agcucccaggcagucaugagga

SEQ ID NO: 638769 - RNA, 22 nt, Human
acuaggaaggcauaugggcaga

SEQ ID NO: 638770 - RNA, 22 nt, Human
accugagccuagggagguugag

SEQ ID NO: 638771 - RNA, 22 nt, Human
ccagcagagggucuuggccauu

SEQ ID NO: 638772 - RNA, 22 nt, Human
aaccauggauuucaguucaccu

SEQ ID NO: 638773 - RNA, 16 nt, Human
agcaccagaucauauc

SEQ ID NO: 638774 - RNA, 22 nt, Human
cuaggcaguccugacgguacua

SEQ ID NO: 638775 - RNA, 22 nt, Human
gaaagcacaggcucaggaacag

SEQ ID NO: 638776 - RNA, 20 nt, Human
gggcccugggauucagagca

SEQ ID NO: 638777 - RNA, 22 nt, Human
ucccagggcuuuucucaugcuu

SEQ ID NO: 638778 - RNA, 22 nt, Human
ucuggguggcuucagaggccac

SEQ ID NO: 638779 - RNA, 22 nt, Human
aggccccaaagcagugcaagua

SEQ ID NO: 638780 - RNA, 22 nt, Human
guguccaucagcagccacugug

SEQ ID NO: 638781 - RNA, 22 nt, Human
uauuuggaggccacuguugagu

SEQ ID NO: 638782 - RNA, 20 nt, Human
uuucugugaggacuguacug

SEQ ID NO: 638783 - RNA, 22 nt, Human
ucaccccuaccaaggagcacug

SEQ ID NO: 638784 - RNA, 22 nt, Human
agacuccaaaugaaagaggggg

SEQ ID NO: 638785 - RNA, 20 nt, Human
uaggcaauuaguagauaaca

SEQ ID NO: 638786 - RNA, 20 nt, Human
aagagcauaguacaggaaga

SEQ ID NO: 638787 - RNA, 22 nt, Human
uucaaucauuagaaucucaggc

SEQ ID NO: 638788 - RNA, 22 nt, Human
agguggaguuaagugugaacug

SEQ ID NO: 638789 - RNA, 23 nt, Human
ugaaauauucuuuugcaugagcu

SEQ ID NO: 638790 - RNA, 22 nt, Human
guuccaggcaguggcaacagcu

SEQ ID NO: 638791 - RNA, 22 nt, Human
cucuggaauguuuacaugcccu

SEQ ID NO: 638792 - RNA, 22 nt, Human
auauuaggugcucaauacaugc

SEQ ID NO: 638793 - RNA, 22 nt, Human
cuuccuuuccccaaucauaucg

SEQ ID NO: 638794 - RNA, 22 nt, Human
gcagggauugugcagggggcua

SEQ ID NO: 638795 - RNA, 22 nt, Human
ggccaccuggguucgacugggc

SEQ ID NO: 638796 - RNA, 22 nt, Human
gagcagcuguccccaaagcuuc

SEQ ID NO: 638797 - RNA, 22 nt, Human
uguguucuuaaaagcagugaua

SEQ ID NO: 638798 - RNA, 22 nt, Human
gcaucauucuggcucuuuccau

SEQ ID NO: 638799 - RNA, 22 nt, Human
uuucuuccccacugcaggcucu

SEQ ID NO: 638800 - RNA, 22 nt, Human
caguggcaugguugacugcagu

SEQ ID NO: 638801 - RNA, 22 nt, Human
aucaucauucuuggauaaagca

SEQ ID NO: 638802 - RNA, 22 nt, Human
acauucuauagcaagcugaucu

SEQ ID NO: 638803 - RNA, 22 nt, Human
ugaggcugaaacuggcgauaga

SEQ ID NO: 638804 - RNA, 22 nt, Human
ugaggccauggaacuagcuugg

SEQ ID NO: 638805 - RNA, 22 nt, Human
caggaaaugaggcugaagggug

SEQ ID NO: 638806 - RNA, 22 nt, Human
aucacauuuauaguggcacgca

SEQ ID NO: 638807 - RNA, 22 nt, Human
uuuuuguauaugcuucgaggau

SEQ ID NO: 638808 - RNA, 22 nt, Human
cuguccugaaagggagauuggg

SEQ ID NO: 638809 - RNA, 22 nt, Human
aucuaagauguauugagcacuu

SEQ ID NO: 638810 - RNA, 22 nt, Human
caauuacauuuauugagcauuc

SEQ ID NO: 638811 - RNA, 22 nt, Human
caacuuuagaccccaaguagcu

SEQ ID NO: 638812 - RNA, 22 nt, Human
ugacuucugggugagccagcau

SEQ ID NO: 638813 - RNA, 22 nt, Human
aaaugucugagacuucugaacu

SEQ ID NO: 638814 - RNA, 22 nt, Human
ugacacaaacaagauauuugcc

SEQ ID NO: 638815 - RNA, 19 nt, Human
gggcuccuugggccucucu

SEQ ID NO: 638816 - RNA, 22 nt, Human
cagagcagucuggagauccagc

SEQ ID NO: 638817 - RNA, 22 nt, Human
uuucagaauagcaaagcaagcu

SEQ ID NO: 638818 - RNA, 22 nt, Human
gauggcccgcuagcuggccucu

SEQ ID NO: 638819 - RNA, 22 nt, Human
gcggggcccccggccgagcucu

SEQ ID NO: 638820 - RNA, 22 nt, Human
gaagaaggugcuacacagggca

SEQ ID NO: 638821 - RNA, 22 nt, Human
aucuugaucaaggcuaucauga

SEQ ID NO: 638822 - RNA, 22 nt, Human
acuauuuguaaagagcaaacgg

SEQ ID NO: 638823 - RNA, 22 nt, Human
ccuggggaccugccucagcccu

SEQ ID NO: 638824 - RNA, 22 nt, Human
gguugacagaagaaggaugaca

SEQ ID NO: 638825 - RNA, 19 nt, Human
cuguugcuggggcucucuu

SEQ ID NO: 638826 - RNA, 18 nt, Human
uccuaacuuagauacucc

SEQ ID NO: 638827 - RNA, 22 nt, Human
aggugcuggagucugggcagga

SEQ ID NO: 638828 - RNA, 21 nt, Human
uaggggcuggggcuccagcug

SEQ ID NO: 638829 - RNA, 21 nt, Human
gucuuuuuaauugcgauuucc

SEQ ID NO: 638830 - RNA, 22 nt, Human
cugaacuuauugagugcuugcu

SEQ ID NO: 638831 - RNA, 22 nt, Human
uagcaggguccaaugugaggca

SEQ ID NO: 638832 - RNA, 22 nt, Human
gcauguguugguuuaugcaugu

SEQ ID NO: 638833 - RNA, 22 nt, Human
ugaggcucacaaaucugcauuu

SEQ ID NO: 638834 - RNA, 22 nt, Human
uggcuggagugggagaaguuua

SEQ ID NO: 638835 - RNA, 22 nt, Human
uauugcugaggauugaggcuug

SEQ ID NO: 638836 - RNA, 18 nt, Human
uccagcucacagaugggc

SEQ ID NO: 638837 - RNA, 22 nt, Human
aguguuuacagaguaguggaaa

SEQ ID NO: 638838 - RNA, 20 nt, Human
ugggguccuggaggggaucc

SEQ ID NO: 638839 - RNA, 22 nt, Human
cauuuugugcacacguggaguu

SEQ ID NO: 638840 - RNA, 22 nt, Human
caggugguuaugaggaagguga

SEQ ID NO: 638841 - RNA, 21 nt, Human
gcugggcuccagucugccgcu

SEQ ID NO: 638842 - RNA, 22 nt, Human
uauauucaacaggcuaauguca

SEQ ID NO: 638843 - RNA, 22 nt, Human
cuuuggcugacgaggaggaggc

SEQ ID NO: 638844 - RNA, 22 nt, Human
guggagaggagcagcuaccuca

SEQ ID NO: 638845 - RNA, 22 nt, Human
gugacaaaugcaaauugggcug

SEQ ID NO: 638846 - RNA, 22 nt, Human
ugauucugcccuuucuucugac

SEQ ID NO: 638847 - RNA, 22 nt, Human
gugugccuguaucaugguaacc

SEQ ID NO: 638848 - RNA, 22 nt, Human
agggcugaaacauaauccuucu

SEQ ID NO: 638849 - RNA, 22 nt, Human
gaguuacauuuggugacacuuc

SEQ ID NO: 638850 - RNA, 22 nt, Human
caggacaguauaggcuuuagga

SEQ ID NO: 638851 - RNA, 22 nt, Human
cugggcagugcagcuauagaac

SEQ ID NO: 638852 - RNA, 20 nt, Human
ccugcugggaacccucugaa

SEQ ID NO: 638853 - RNA, 19 nt, Human
ucagaauucugucucuuga

SEQ ID NO: 638854 - RNA, 22 nt, Human
cuucacaaucaccuuuucggaa

SEQ ID NO: 638855 - RNA, 22 nt, Human
aucaauaucagaucagacagga

SEQ ID NO: 638856 - RNA, 22 nt, Human
gggcauggugagggauaugaag

SEQ ID NO: 638857 - RNA, 17 nt, Human
uauguguguguuuauac

SEQ ID NO: 638858 - RNA, 22 nt, Human
uauggcuugacuugcaccggca

SEQ ID NO: 638859 - RNA, 22 nt, Human
uauguaaaaauucaucaggcug

SEQ ID NO: 638860 - RNA, 22 nt, Human
aggagcucccgugaggagacca

SEQ ID NO: 638861 - RNA, 22 nt, Human
aaggauguggcauuuuucauau

SEQ ID NO: 638862 - RNA, 22 nt, Human
uccugacuaggagggcuaaggu

SEQ ID NO: 638863 - RNA, 22 nt, Human
caggguccggcugccuggcugu

SEQ ID NO: 638864 - RNA, 21 nt, Human
ccagcugccugcacuuuggac

SEQ ID NO: 638865 - RNA, 22 nt, Human
agcagaccaggagugcacaggu

SEQ ID NO: 638866 - RNA, 22 nt, Human
gacuuugagggauacaaacauu

SEQ ID NO: 638867 - RNA, 23 nt, Human
uggguagagcugcaaggacacug

SEQ ID NO: 638868 - RNA, 22 nt, Human
agcauggggcaaugcaugugcu

SEQ ID NO: 638869 - RNA, 22 nt, Human
gccuggguccacugaucaugcu

SEQ ID NO: 638870 - RNA, 22 nt, Human
uugucugucccagcuugugcau

SEQ ID NO: 638871 - RNA, 22 nt, Human
guaaauauucccucgguuccua

SEQ ID NO: 638872 - RNA, 23 nt, Human
aucugaaaagcauuugcaguuug

SEQ ID NO: 638873 - RNA, 22 nt, Human
cuggcccagguggucguugagg

SEQ ID NO: 638874 - RNA, 22 nt, Human
gugugccaggaacuggcugcug

SEQ ID NO: 638875 - RNA, 22 nt, Human
ucuggucccugcucacuucuug

SEQ ID NO: 638876 - RNA, 22 nt, Human
ucccuccuggugagcaggggcu

SEQ ID NO: 638877 - RNA, 22 nt, Human
aagucagcacuccaggaagcca

SEQ ID NO: 638878 - RNA, 22 nt, Human
uggauaugggccauggaaaaaa

SEQ ID NO: 638879 - RNA, 22 nt, Human
gaggguggaaaggguguaccug

SEQ ID NO: 638880 - RNA, 22 nt, Human
gcuguguccaggugggggugac

SEQ ID NO: 638881 - RNA, 22 nt, Human
ccagcugggucccugcuggggc

SEQ ID NO: 638882 - RNA, 22 nt, Human
cugggagauugcuagagaugca

SEQ ID NO: 638883 - RNA, 22 nt, Human
uuuggcauuuaauaggugauca

SEQ ID NO: 638884 - RNA, 22 nt, Human
uggcagcagggccccuggagga

SEQ ID NO: 638885 - RNA, 22 nt, Human
aagcugcuggugacugggcuga

SEQ ID NO: 638886 - RNA, 22 nt, Human
ccugugccauccugagcauccc

SEQ ID NO: 638887 - RNA, 22 nt, Human
ucuuuuaaccuaacuagcuugg

SEQ ID NO: 638888 - RNA, 22 nt, Human
uucaaaccuaucuaagaaauag

SEQ ID NO: 638889 - RNA, 22 nt, Human
cuccaaggguugugggugguca

SEQ ID NO: 638890 - RNA, 22 nt, Human
acagcaucuaguacagucuagu

SEQ ID NO: 638891 - RNA, 22 nt, Human
uucacccugagccccaccucug

SEQ ID NO: 638892 - RNA, 22 nt, Human
agccaguggaauucccaggggu

SEQ ID NO: 638893 - RNA, 22 nt, Human
cucugguucagggcucccuggc

SEQ ID NO: 638894 - RNA, 22 nt, Human
agggagcuuucagguagcuuaa

SEQ ID NO: 638895 - RNA, 22 nt, Human
agugugaccuuauuuggaaaca

SEQ ID NO: 638896 - RNA, 22 nt, Human
auuauuucucacucacauaaua

SEQ ID NO: 638897 - RNA, 22 nt, Human
uuagccauauagaaaaagagcu

SEQ ID NO: 638898 - RNA, 22 nt, Human
aagcagcuuucuuuccugugaa

SEQ ID NO: 638899 - RNA, 22 nt, Human
gcuggcagagagcuggugagga

SEQ ID NO: 638900 - RNA, 22 nt, Human
ggccugagggugggcucucagu

SEQ ID NO: 638901 - RNA, 22 nt, Human
guuccuuggaagaacuugaggu

SEQ ID NO: 638902 - RNA, 22 nt, Human
aacuguuucagaaauauuguug

SEQ ID NO: 638903 - RNA, 19 nt, Human
ucagggaguuuacagcaug

SEQ ID NO: 638904 - RNA, 17 nt, Human
uggcuucccugggccac

SEQ ID NO: 638905 - RNA, 22 nt, Human
gaaaucaucugaguaauaaucu

SEQ ID NO: 638906 - RNA, 22 nt, Human
uccuucaacuuuuuacuugccc

SEQ ID NO: 638907 - RNA, 22 nt, Human
cuggagcugcuguccuugggug

SEQ ID NO: 638908 - RNA, 22 nt, Human
acagagauggcuuuucagaggc

SEQ ID NO: 638909 - RNA, 22 nt, Human
ugugaggguuuuaagggaauga

SEQ ID NO: 638910 - RNA, 22 nt, Human
cucaagacugaucgcaguggaa

SEQ ID NO: 638911 - RNA, 22 nt, Human
uuauuucauugauuucuaagac

SEQ ID NO: 638912 - RNA, 22 nt, Human
gaacuacagugcauuuucuuaa

SEQ ID NO: 638913 - RNA, 22 nt, Human
ucaggcugggagacaaucacug

SEQ ID NO: 638914 - RNA, 22 nt, Human
uaggcagaauugugggcucuaa

SEQ ID NO: 638915 - RNA, 22 nt, Human
uucccuucuaguuuugagagac

SEQ ID NO: 638916 - RNA, 22 nt, Human
ggcuguagguuggugcuggaca

SEQ ID NO: 638917 - RNA, 22 nt, Human
ccuuccagaguucagucugccc

SEQ ID NO: 638918 - RNA, 22 nt, Human
aggccugucuggggcucagcca

SEQ ID NO: 638919 - RNA, 22 nt, Human
uuguuuucagggugucauucac

SEQ ID NO: 638920 - RNA, 22 nt, Human
uauuucuugagacucgucuucc

SEQ ID NO: 638921 - RNA, 22 nt, Human
acauuuuuauucaucaaagcag

SEQ ID NO: 638922 - RNA, 18 nt, Human
ggcaggagcaagaauagg

SEQ ID NO: 638923 - RNA, 22 nt, Human
uccagcucuaacaugcugggcc

SEQ ID NO: 638924 - RNA, 22 nt, Human
gagcugugugccuggauggucu

SEQ ID NO: 638925 - RNA, 22 nt, Human
uucaaggaagaaguggcuuuga

SEQ ID NO: 638926 - RNA, 22 nt, Human
ucagaacauggcauguuccauc

SEQ ID NO: 638927 - RNA, 22 nt, Human
uuuaaaugcagacguugauuca

SEQ ID NO: 638928 - RNA, 22 nt, Human
cuucuguuacuguuagcugaag

SEQ ID NO: 638929 - RNA, 22 nt, Human
cagauucuucuguauuuuugcu

SEQ ID NO: 638930 - RNA, 22 nt, Human
aucugggccagccccaagagac

SEQ ID NO: 638931 - RNA, 22 nt, Human
aaaguucacugaccagcacugg

SEQ ID NO: 638932 - RNA, 22 nt, Human
uuguccuuuaauguuuaguauu

SEQ ID NO: 638933 - RNA, 22 nt, Human
auauucaaauuacauuuacuaa

SEQ ID NO: 638934 - RNA, 22 nt, Human
ugauucugaggacccugugacg

SEQ ID NO: 638935 - RNA, 22 nt, Human
cuggugaauauuggaggcauug

SEQ ID NO: 638936 - RNA, 22 nt, Human
uuugaucaugaagaggauaaac

SEQ ID NO: 638937 - RNA, 22 nt, Human
ucaaauaaggagucaugaccau

SEQ ID NO: 638938 - RNA, 22 nt, Human
uaaaugcaagggaaaggcaaga

SEQ ID NO: 638939 - RNA, 22 nt, Human
ucauauaccagagaguuuauau

SEQ ID NO: 638940 - RNA, 22 nt, Human
ggcugugcuuuguuagguuguc

SEQ ID NO: 638941 - RNA, 22 nt, Human
ugcagguacuugacaacuuggg

SEQ ID NO: 638942 - RNA, 22 nt, Human
aucucagggcuggagcccugga

SEQ ID NO: 638943 - RNA, 19 nt, Human
ccacuuugcuucucugggu

SEQ ID NO: 638944 - RNA, 22 nt, Human
gcagcccaggucucucucacuc

SEQ ID NO: 638945 - RNA, 22 nt, Human
ggagcugcacgcucugaagccu

SEQ ID NO: 638946 - RNA, 22 nt, Human
gaaaauguuagcuucauaguca

SEQ ID NO: 638947 - RNA, 22 nt, Human
acaaggacaugcaauuuggauu

SEQ ID NO: 638948 - RNA, 20 nt, Human
agaaaucagcauguccucug

SEQ ID NO: 638949 - RNA, 22 nt, Human
ccagccuucaccugcucugguc

SEQ ID NO: 638950 - RNA, 22 nt, Human
ccagucgugacaaccaaaaaua

SEQ ID NO: 638951 - RNA, 23 nt, Human
gcugccuccuacaaaagcccagc

SEQ ID NO: 638952 - RNA, 22 nt, Human
uccucaggauguggaguagaau

SEQ ID NO: 638953 - RNA, 22 nt, Human
ugucugugaccucuuaggcaag

SEQ ID NO: 638954 - RNA, 23 nt, Human
uccaggagcaugcuggcuggcga

SEQ ID NO: 638955 - RNA, 22 nt, Human
gcauggcuauucuaacucacau

SEQ ID NO: 638956 - RNA, 17 nt, Human
gcuuccucaugcaguuc

SEQ ID NO: 638957 - RNA, 22 nt, Human
ccaggccagagugcaguggcac

SEQ ID NO: 638958 - RNA, 21 nt, Human
aucucacagcccagagaagcc

SEQ ID NO: 638959 - RNA, 22 nt, Human
auggcucugagaaccugagcua

SEQ ID NO: 638960 - RNA, 22 nt, Human
gucaggauuggggucaugaguc

SEQ ID NO: 638961 - RNA, 22 nt, Human
augcacuugcguguuugcaaau

SEQ ID NO: 638962 - RNA, 22 nt, Human
guguauugcacauccuguagcc

SEQ ID NO: 638963 - RNA, 20 nt, Human
accccagccccucuaucuga

SEQ ID NO: 638964 - RNA, 19 nt, Human
ugaagcagcaaacucucag

SEQ ID NO: 638965 - RNA, 22 nt, Human
auuuuccuccaugugagcaguu

SEQ ID NO: 638966 - RNA, 22 nt, Human
auaguuugaaggcuguucuacu

SEQ ID NO: 638967 - RNA, 22 nt, Human
ucccugccuccuggcagugcca

SEQ ID NO: 638968 - RNA, 22 nt, Human
aguuaacuaaauuaagagacaa

SEQ ID NO: 638969 - RNA, 22 nt, Human
uuuccuuccaaaugcccgggag

SEQ ID NO: 638970 - RNA, 22 nt, Human
cauuacaaaguuauaaacaguu

SEQ ID NO: 638971 - RNA, 22 nt, Human
acuaguauugccuacuguacau

SEQ ID NO: 638972 - RNA, 22 nt, Human
cuauggugauagaaaucagaau

SEQ ID NO: 638973 - RNA, 22 nt, Human
acuacaucuugcauaucuauaa

SEQ ID NO: 638974 - RNA, 22 nt, Human
ggucuugaaggacauccagucc

SEQ ID NO: 638975 - RNA, 22 nt, Human
uguguguuggcuggagagggcu

SEQ ID NO: 638976 - RNA, 22 nt, Human
ggucagagaaaaguaggguguu

SEQ ID NO: 638977 - RNA, 22 nt, Human
caguacuuaacuuauaggagag

SEQ ID NO: 638978 - RNA, 22 nt, Human
gcuggacccggccccucaccuc

SEQ ID NO: 638979 - RNA, 22 nt, Human
ucuuggcugcugccaauuuacu

SEQ ID NO: 638980 - RNA, 21 nt, Human
uggaaggcugcucugccaggg

SEQ ID NO: 638981 - RNA, 22 nt, Human
gguugccggggcaggacuggaa

SEQ ID NO: 638982 - RNA, 22 nt, Human
gcaggagagucugugccagguu

SEQ ID NO: 638983 - RNA, 22 nt, Human
gaucugguacaggccugcagcc

SEQ ID NO: 638984 - RNA, 22 nt, Human
ugcauuaagaauuucugaggau

SEQ ID NO: 638985 - RNA, 17 nt, Human
ggacugggcggggcagg

SEQ ID NO: 638986 - RNA, 22 nt, Human
ugcaugaugguuuagauggggu

SEQ ID NO: 638987 - RNA, 22 nt, Human
uuagagaauuccaaaugacuac

SEQ ID NO: 638988 - RNA, 18 nt, Human
gucacagcagagaacugc

SEQ ID NO: 638989 - RNA, 22 nt, Human
caucuuaauaaaucuccucccu

SEQ ID NO: 638990 - RNA, 22 nt, Human
gacggggcagccagcugguggc

SEQ ID NO: 638991 - RNA, 22 nt, Human
aauuucucgguuuugauauugu

SEQ ID NO: 638992 - RNA, 17 nt, Human
gagacagcaggagcccc

SEQ ID NO: 638993 - RNA, 23 nt, Human
uaaccugaguuuuuuagaugcaa

SEQ ID NO: 638994 - RNA, 22 nt, Human
uagaguauagcuaacuguauua

SEQ ID NO: 638995 - RNA, 22 nt, Human
agagcucugcagcuggccucag

SEQ ID NO: 638996 - RNA, 22 nt, Human
aagccuucaguccguugcagag

SEQ ID NO: 638997 - RNA, 22 nt, Human
gagccuguguuuccuguagcca

SEQ ID NO: 638998 - RNA, 19 nt, Human
aggcugcccagucucugcc

SEQ ID NO: 638999 - RNA, 22 nt, Human
gggaaugugaaacaguaaggga

SEQ ID NO: 639000 - RNA, 22 nt, Human
ucagaggagcugcagaacgcug

SEQ ID NO: 639001 - RNA, 22 nt, Human
uuaacauuugugaagcauuuag

SEQ ID NO: 639002 - RNA, 22 nt, Human
agugucuucaugauguggcagc

SEQ ID NO: 639003 - RNA, 22 nt, Human
gcaguauauccauuacuucaua

SEQ ID NO: 639004 - RNA, 22 nt, Human
uguggccaaaauaaaaugaggu

SEQ ID NO: 639005 - RNA, 19 nt, Human
agcccccagacagcaggcc

SEQ ID NO: 639006 - RNA, 22 nt, Human
guugcucaggcaggaguacagu

SEQ ID NO: 639007 - RNA, 22 nt, Human
acacagaggaaagugugaaggg

SEQ ID NO: 639008 - RNA, 22 nt, Human
ucuugggcaauuucucuagagg

SEQ ID NO: 639009 - RNA, 21 nt, Human
ccaggcugggagggcaguucc

SEQ ID NO: 639010 - RNA, 22 nt, Human
gugcaugugcauccauguguac

SEQ ID NO: 639011 - RNA, 22 nt, Human
guucaaccaugauuaggaacug

SEQ ID NO: 639012 - RNA, 22 nt, Human
cauggcuuuuagcccuacauga

SEQ ID NO: 639013 - RNA, 22 nt, Human
gaucugggcuggagacugagaa

SEQ ID NO: 639014 - RNA, 22 nt, Human
auccuuuaaguuaauaaaauuc

SEQ ID NO: 639015 - RNA, 22 nt, Human
cugaaauaaaguugcuaaaauu

SEQ ID NO: 639016 - RNA, 17 nt, Human
gggacucaagauggggu

SEQ ID NO: 639017 - RNA, 22 nt, Human
ugccugccucuggcagcccugc

SEQ ID NO: 639018 - RNA, 22 nt, Human
uuguacaacguuuuaaauuuga

SEQ ID NO: 639019 - RNA, 22 nt, Human
ucuuugcauggacauguguuuu

SEQ ID NO: 639020 - RNA, 22 nt, Human
uccuugggaaacaucauguaau

SEQ ID NO: 639021 - RNA, 22 nt, Human
ccugcagagggacuggcaggaa

SEQ ID NO: 639022 - RNA, 18 nt, Human
gcuuucaauuucuuuccu

SEQ ID NO: 639023 - RNA, 22 nt, Human
uuucagaaggggagaaagguca

SEQ ID NO: 639024 - RNA, 22 nt, Human
cugaggccguuggugggccuua

SEQ ID NO: 639025 - RNA, 22 nt, Human
gcccuucauuuauaguuggaau

SEQ ID NO: 639026 - RNA, 21 nt, Human
cauugucgacauuuuccccuc

SEQ ID NO: 639027 - RNA, 22 nt, Human
ucagcagggagaggagaaugca

SEQ ID NO: 639028 - RNA, 22 nt, Human
ggggcugcugguauuuccaguu

SEQ ID NO: 639029 - RNA, 19 nt, Human
agguccugaucagcaagga

SEQ ID NO: 639030 - RNA, 22 nt, Human
aagcaaaacgugcucuaggagg

SEQ ID NO: 639031 - RNA, 23 nt, Human
uuaggcacuuaguagggccagag

SEQ ID NO: 639032 - RNA, 22 nt, Human
acuugcauuauauuuaucacaa

SEQ ID NO: 639033 - RNA, 22 nt, Human
gaagccaguguuugaagaauuu

SEQ ID NO: 639034 - RNA, 22 nt, Human
cuguagcagugugcucuuuuuc

SEQ ID NO: 639035 - RNA, 22 nt, Human
cuccccauugugaccucaucca

SEQ ID NO: 639036 - RNA, 22 nt, Human
ccacuugugaaauaaucaaaua

SEQ ID NO: 639037 - RNA, 22 nt, Human
ucuggcucucucaucacccaau

SEQ ID NO: 639038 - RNA, 22 nt, Human
aaauguguuccuuugcuacaga

SEQ ID NO: 639039 - RNA, 22 nt, Human
agaagauuauuagagacuuugu

SEQ ID NO: 639040 - RNA, 22 nt, Human
uuaaauagcucuuguagaagaa

SEQ ID NO: 639041 - RNA, 22 nt, Human
gagcuccuauggucgguggcuc

SEQ ID NO: 639042 - RNA, 22 nt, Human
gaaagcugugaaauagugcucu

SEQ ID NO: 639043 - RNA, 22 nt, Human
agaggcugcacuugcucaugau

SEQ ID NO: 639044 - RNA, 22 nt, Human
uucuagcacaagauaugaaagu

SEQ ID NO: 639045 - RNA, 22 nt, Human
gugcugucauuagcaucuagag

SEQ ID NO: 639046 - RNA, 22 nt, Human
gcucuggcuuggggcacucguc

SEQ ID NO: 639047 - RNA, 22 nt, Human
aggaggcacucacucucagggu

SEQ ID NO: 639048 - RNA, 23 nt, Human
uuucaguuccagaaaaggggagc

SEQ ID NO: 639049 - RNA, 22 nt, Human
caaggcuucacguccccagugc

SEQ ID NO: 639050 - RNA, 23 nt, Human
cauaugaauuuuagaggcaguuu

SEQ ID NO: 639051 - RNA, 22 nt, Human
gauucuggaguuaaggaugccu

SEQ ID NO: 639052 - RNA, 22 nt, Human
aucaaugacaguugaauucuac

SEQ ID NO: 639053 - RNA, 22 nt, Human
auuauuugacuugagaacaggu

SEQ ID NO: 639054 - RNA, 22 nt, Human
agaggggaaggaugugauguga

SEQ ID NO: 639055 - RNA, 18 nt, Human
uggcagagugucuguucu

SEQ ID NO: 639056 - RNA, 22 nt, Human
uuacacuucuaaaaaaagcagg

SEQ ID NO: 639057 - RNA, 22 nt, Human
caaaaguaauugcgguuuuugc

SEQ ID NO: 639058 - RNA, 22 nt, Human
cuauauucuggaauguccauuu

SEQ ID NO: 639059 - RNA, 22 nt, Human
caaauguaauugcgguuuuugc

SEQ ID NO: 639060 - RNA, 20 nt, Human
aaagucuuaugguuaauuuu

SEQ ID NO: 639061 - RNA, 22 nt, Human
ugcaggcucugugugugccugg

SEQ ID NO: 639062 - RNA, 23 nt, Human
agcagcagcaauuaaguggauau

SEQ ID NO: 639063 - RNA, 22 nt, Human
ccauggaacucaguaaauuaua

SEQ ID NO: 639064 - RNA, 22 nt, Human
ugucuucuucauaaggagagug

SEQ ID NO: 639065 - RNA, 22 nt, Human
gacuuuaaagccugacauuuua

SEQ ID NO: 639066 - RNA, 22 nt, Human
guugaauauuuuaagaguuuug

SEQ ID NO: 639067 - RNA, 23 nt, Human
agccaggggaucuugggcccugg

SEQ ID NO: 639068 - RNA, 22 nt, Human
gggacuggccaggguuuggaau

SEQ ID NO: 639069 - RNA, 22 nt, Human
agagucagaaccaagaugaggc

SEQ ID NO: 639070 - RNA, 22 nt, Human
uggccagguguggguucucaga

SEQ ID NO: 639071 - RNA, 19 nt, Human
uaguacacacucuaauucc

SEQ ID NO: 639072 - RNA, 22 nt, Human
caguccucucacucaggccuuu

SEQ ID NO: 639073 - RNA, 22 nt, Human
cagaagcuuugcucauaaccau

SEQ ID NO: 639074 - RNA, 18 nt, Human
cugcuccagucuggccag

SEQ ID NO: 639075 - RNA, 22 nt, Human
gugggccuugcagggugcaggg

SEQ ID NO: 639076 - RNA, 22 nt, Human
gacuuuggcaucuagacauugu

SEQ ID NO: 639077 - RNA, 22 nt, Human
auuauuaaaauguguuucucuu

SEQ ID NO: 639078 - RNA, 22 nt, Human
ugcacauuaguguuugagaugc

SEQ ID NO: 639079 - RNA, 22 nt, Human
uguguauuucuggaacagacua

SEQ ID NO: 639080 - RNA, 22 nt, Human
aggcugggaagguaaaguugua

SEQ ID NO: 639081 - RNA, 22 nt, Human
cagcccugaaacaaccuccucu

SEQ ID NO: 639082 - RNA, 22 nt, Human
cagaagggcagcacugggaagg

SEQ ID NO: 639083 - RNA, 22 nt, Human
uucuucugaaacagugacagac

SEQ ID NO: 639084 - RNA, 20 nt, Human
gugggcagcaggcauacugg

SEQ ID NO: 639085 - RNA, 22 nt, Human
uauguacacacacaugcaugua

SEQ ID NO: 639086 - RNA, 22 nt, Human
ugcccuugaaauacgcuugggg

SEQ ID NO: 639087 - RNA, 22 nt, Human
ggccaggagcaagccaggcucu

SEQ ID NO: 639088 - RNA, 22 nt, Human
uuggaaaaugaggcacagagag

SEQ ID NO: 639089 - RNA, 22 nt, Human
uuuggacuuagccugcagaauu

SEQ ID NO: 639090 - RNA, 20 nt, Human
aagggcagagggaacagacu

SEQ ID NO: 639091 - RNA, 22 nt, Human
auaaaugauucagcaggaaaua

SEQ ID NO: 639092 - RNA, 22 nt, Human
uagagaugaauucugcagucuu

SEQ ID NO: 639093 - RNA, 22 nt, Human
gaauuuaaaggccagaccugag

SEQ ID NO: 639094 - RNA, 22 nt, Human
cucugugcuuaugcuccauggg

SEQ ID NO: 639095 - RNA, 22 nt, Human
ugagcgugcaguaguguuggua

SEQ ID NO: 639096 - RNA, 22 nt, Human
uggcucaugcaucuuuucuaca

SEQ ID NO: 639097 - RNA, 22 nt, Human
uuucuaguaaaagcuaauuacc

SEQ ID NO: 639098 - RNA, 22 nt, Human
auauaauacaaccugcuaagug

SEQ ID NO: 639099 - RNA, 22 nt, Human
uaacagaaauagaaaugagagu

SEQ ID NO: 639100 - RNA, 22 nt, Human
ccaugccucgggaagagucugu

SEQ ID NO: 639101 - RNA, 20 nt, Human
ucugaagaaagacagggacu

SEQ ID NO: 639102 - RNA, 19 nt, Human
uggccagguacugucugcu

SEQ ID NO: 639103 - RNA, 22 nt, Human
ucucuccaacaugguggugcug

SEQ ID NO: 639104 - RNA, 22 nt, Human
caguaacagugaucaccugugg

SEQ ID NO: 639105 - RNA, 22 nt, Human
aauuagggaaaacauuugcuuu

SEQ ID NO: 639106 - RNA, 22 nt, Human
ucccagggacugggcuaggcuu

SEQ ID NO: 639107 - RNA, 22 nt, Human
gggcuccaccuagggacacugg

SEQ ID NO: 639108 - RNA, 22 nt, Human
acugggccggugcagaguaguu

SEQ ID NO: 639109 - RNA, 22 nt, Human
ggcugcagaggcgaucugaggu

SEQ ID NO: 639110 - RNA, 22 nt, Human
uuuauauaacagagacugcuau

SEQ ID NO: 639111 - RNA, 22 nt, Human
auuauacaaggcuggugccuaa

SEQ ID NO: 639112 - RNA, 22 nt, Human
uuucuuaggcucuaaaaugacu

SEQ ID NO: 639113 - RNA, 22 nt, Human
ucuuuaguauugaguuauggua

SEQ ID NO: 639114 - RNA, 22 nt, Human
gccagcagguugucaaggagcu

SEQ ID NO: 639115 - RNA, 22 nt, Human
uaugaaaauuuagcugaagcau

SEQ ID NO: 639116 - RNA, 22 nt, Human
cugaagcuugauaaacuauaaa

SEQ ID NO: 639117 - RNA, 22 nt, Human
uuacacaugcucacuuauuugu

SEQ ID NO: 639118 - RNA, 22 nt, Human
cagacacacacccuggccuagc

SEQ ID NO: 639119 - RNA, 22 nt, Human
aguuuauguuguuuauaagcca

SEQ ID NO: 639120 - RNA, 22 nt, Human
acucacaagugaugugaauggc

SEQ ID NO: 639121 - RNA, 17 nt, Human
ugcauguccuuuguucc

SEQ ID NO: 639122 - RNA, 22 nt, Human
aagaguuuccaguuguggcuca

SEQ ID NO: 639123 - RNA, 19 nt, Human
guagggacagugguucuga

SEQ ID NO: 639124 - RNA, 22 nt, Human
cucuggcuggcauugcuggacu

SEQ ID NO: 639125 - RNA, 22 nt, Human
uaaguggguuuguaaugugccu

SEQ ID NO: 639126 - RNA, 22 nt, Human
uaaacaugugagugugcauaua

SEQ ID NO: 639127 - RNA, 22 nt, Human
auggcuggaggccgggcuuccu

SEQ ID NO: 639128 - RNA, 22 nt, Human
cacucucucaggcuuuccuugu

SEQ ID NO: 639129 - RNA, 22 nt, Human
aguuagugaagcucaucacagc

SEQ ID NO: 639130 - RNA, 22 nt, Human
gggcugagauuggugcccuguc

SEQ ID NO: 639131 - RNA, 22 nt, Human
gugaacucugacucucaugccu

SEQ ID NO: 639132 - RNA, 21 nt, Human
ucaggagagcccaucuacaaa

SEQ ID NO: 639133 - RNA, 22 nt, Human
uggucagacaaaggagaauguu

SEQ ID NO: 639134 - RNA, 22 nt, Human
agaaauacuuuguaaaucucac

SEQ ID NO: 639135 - RNA, 22 nt, Human
cuguggaccugcucuuagagac

SEQ ID NO: 639136 - RNA, 22 nt, Human
ggaaucagaauuaggauuugaa

SEQ ID NO: 639137 - RNA, 22 nt, Human
agagccuggucugagauaggac

SEQ ID NO: 639138 - RNA, 22 nt, Human
aauauuuccaaggccugucagg

SEQ ID NO: 639139 - RNA, 22 nt, Human
uuucaguuaaguggcuaguccc

SEQ ID NO: 639140 - RNA, 22 nt, Human
agagagaagcaaucaguggcca

SEQ ID NO: 639141 - RNA, 21 nt, Human
gagugcagcaagguagagucu

SEQ ID NO: 639142 - RNA, 22 nt, Human
gccugcagccccucugcaguag

SEQ ID NO: 639143 - RNA, 22 nt, Human
uauuccugggccccauuccaga

SEQ ID NO: 639144 - RNA, 22 nt, Human
guuuccuggaaacauuaggaga

SEQ ID NO: 639145 - RNA, 23 nt, Human
ugcaauaugucagugcaaagugg

SEQ ID NO: 639146 - RNA, 22 nt, Human
uauugcuuaaaaaauaugugag

SEQ ID NO: 639147 - RNA, 22 nt, Human
ggcugcugcccaccccugcaug

SEQ ID NO: 639148 - RNA, 22 nt, Human
gauuguaaaacagaucauuauc

SEQ ID NO: 639149 - RNA, 22 nt, Human
uauuucugagaaccaacuuacc

SEQ ID NO: 639150 - RNA, 22 nt, Human
agcuuuaaagcauauuucuaag

SEQ ID NO: 639151 - RNA, 22 nt, Human
cuguauuagccaggugcacaag

SEQ ID NO: 639152 - RNA, 22 nt, Human
uggauggaucucaagggaauua

SEQ ID NO: 639153 - RNA, 22 nt, Human
ucccucuguucuguuccaagug

SEQ ID NO: 639154 - RNA, 22 nt, Human
ugcuugucuucaggauuauggu

SEQ ID NO: 639155 - RNA, 22 nt, Human
aggcauggguagaagagaagcc

SEQ ID NO: 639156 - RNA, 22 nt, Human
ccaggagggaggaguuccugag

SEQ ID NO: 639157 - RNA, 22 nt, Human
uugcauuguaggauguuagaag

SEQ ID NO: 639158 - RNA, 23 nt, Human
gaggcacucaggaaaugugagug

SEQ ID NO: 639159 - RNA, 22 nt, Human
uacuuauaaggaggcacacaaa

SEQ ID NO: 639160 - RNA, 22 nt, Human
aaagucauuguaauauaugcua

SEQ ID NO: 639161 - RNA, 22 nt, Human
uuacacuuuggcaagcuauuaa

SEQ ID NO: 639162 - RNA, 22 nt, Human
ucaggaagcuacugccagcagc

SEQ ID NO: 639163 - RNA, 22 nt, Human
aggaacugggcucagcaaacau

SEQ ID NO: 639164 - RNA, 22 nt, Human
uuauaacaucaaucagaguuaa

SEQ ID NO: 639165 - RNA, 22 nt, Human
caggggcaggugugagaucauc

SEQ ID NO: 639166 - RNA, 22 nt, Human
guauaucuucagaaauuauagg

SEQ ID NO: 639167 - RNA, 22 nt, Human
agcagcaccuguccucgcugcu

SEQ ID NO: 639168 - RNA, 22 nt, Human
uaguuuaguaagaggagagcug

SEQ ID NO: 639169 - RNA, 22 nt, Human
gcuuccuccuggaggucacuca

SEQ ID NO: 639170 - RNA, 22 nt, Human
ucacccagcagcugcuucugcu

SEQ ID NO: 639171 - RNA, 22 nt, Human
augcaguggcuucagugucagu

SEQ ID NO: 639172 - RNA, 22 nt, Human
uucauugaguuacugccugggc

SEQ ID NO: 639173 - RNA, 22 nt, Human
uuucaacaggaugauaauaggc

SEQ ID NO: 639174 - RNA, 22 nt, Human
ucugaggccccagcccugcaca

SEQ ID NO: 639175 - RNA, 22 nt, Human
cagagaaagggugaauuccuuc

SEQ ID NO: 639176 - RNA, 22 nt, Human
cuggcugggagcgagcugcuca

SEQ ID NO: 639177 - RNA, 22 nt, Human
uaaaucacccaucuccuaaucu

SEQ ID NO: 639178 - RNA, 22 nt, Human
ggcucacacaugacugggcucu

SEQ ID NO: 639179 - RNA, 22 nt, Human
caagggcugaacacagguuuca

SEQ ID NO: 639180 - RNA, 22 nt, Human
cugggccucauccucagaguuu

SEQ ID NO: 639181 - RNA, 22 nt, Human
aacauugaauuuaaaauacagu

SEQ ID NO: 639182 - RNA, 22 nt, Human
auggaagacagauaaggcagaa

SEQ ID NO: 639183 - RNA, 21 nt, Human
cuugaaagguagagucuacag

SEQ ID NO: 639184 - RNA, 22 nt, Human
aaaugcuuagagguguucaaau

SEQ ID NO: 639185 - RNA, 17 nt, Human
ugaggccauggcaccau

SEQ ID NO: 639186 - RNA, 22 nt, Human
uaaggcaggacuggauagcuau

SEQ ID NO: 639187 - RNA, 22 nt, Human
uuauuauugugguugcauuauc

SEQ ID NO: 639188 - RNA, 22 nt, Human
aggaaggguucuuucuguuuau

SEQ ID NO: 639189 - RNA, 22 nt, Human
gggcuacauugugagagaaguu

SEQ ID NO: 639190 - RNA, 22 nt, Human
ccuguauuagguagacaacuau

SEQ ID NO: 639191 - RNA, 22 nt, Human
uagcacugaaucacaugcugcu

SEQ ID NO: 639192 - RNA, 22 nt, Human
cagcaugaugagugcaguuugg

SEQ ID NO: 639193 - RNA, 18 nt, Human
gauucugauucuggaggc

SEQ ID NO: 639194 - RNA, 22 nt, Human
uuuaagaugguauuuuauaaag

SEQ ID NO: 639195 - RNA, 20 nt, Human
agcuucuucugucuaauuuu

SEQ ID NO: 639196 - RNA, 22 nt, Human
cccaggaaagaaaguauauggu

SEQ ID NO: 639197 - RNA, 22 nt, Human
caguuuaguccugccaccaugg

SEQ ID NO: 639198 - RNA, 22 nt, Human
uucuaaguccuaccugaaagca

SEQ ID NO: 639199 - RNA, 22 nt, Human
uuccgcuguuuaguugaaguuu

SEQ ID NO: 639200 - RNA, 22 nt, Human
cuuaguuuuugcccuggaguuu

SEQ ID NO: 639201 - RNA, 22 nt, Human
uacauugaaaucaauggaugug

SEQ ID NO: 639202 - RNA, 22 nt, Human
gaaaucuuuucaucucauuuga

SEQ ID NO: 639203 - RNA, 22 nt, Human
uccagggauguccuguagcacu

SEQ ID NO: 639204 - RNA, 22 nt, Human
uaagaaacuauggagaagaacu

SEQ ID NO: 639205 - RNA, 22 nt, Human
ggggcagaaguagugccccuga

SEQ ID NO: 639206 - RNA, 22 nt, Human
auuuccuugcaaguuucuguaa

SEQ ID NO: 639207 - RNA, 22 nt, Human
cugggcucuagaaaggaaagaa

SEQ ID NO: 639208 - RNA, 22 nt, Human
ucuugggauugcccugcaguuc

SEQ ID NO: 639209 - RNA, 22 nt, Human
auacauauccacaggagauaaa

SEQ ID NO: 639210 - RNA, 22 nt, Human
cugccuuccaaccccagacucc

SEQ ID NO: 639211 - RNA, 22 nt, Human
guggccaggagagggugggaca

SEQ ID NO: 639212 - RNA, 22 nt, Human
ugaaggugaaugucuaugggga

SEQ ID NO: 639213 - RNA, 22 nt, Human
uucuccuugaaaagcugcaucu

SEQ ID NO: 639214 - RNA, 22 nt, Human
uaaaucacuguucauuccacac

SEQ ID NO: 639215 - RNA, 22 nt, Human
uuccuucuuugugguagaaagu

SEQ ID NO: 639216 - RNA, 22 nt, Human
ugcacacaguggacaagucuug

SEQ ID NO: 639217 - RNA, 22 nt, Human
acauuucugucuuagggacugu

SEQ ID NO: 639218 - RNA, 22 nt, Human
ggagaaaggcauagcagaaccu

SEQ ID NO: 639219 - RNA, 22 nt, Human
uacaaguauggaaugauucuca

SEQ ID NO: 639220 - RNA, 22 nt, Human
gcugcagcccggcgcgccugag

SEQ ID NO: 639221 - RNA, 22 nt, Human
uggcucaggccuacgacgccuu

SEQ ID NO: 639222 - RNA, 22 nt, Human
uaugauuuguagacauuugauu

SEQ ID NO: 639223 - RNA, 22 nt, Human
uggcagcugccauguccacgug

SEQ ID NO: 639224 - RNA, 22 nt, Human
ucuggguccccgaggaaggaga

SEQ ID NO: 639225 - RNA, 22 nt, Human
gucagacugcacucaaggacag

SEQ ID NO: 639226 - RNA, 22 nt, Human
gagcuucagagaccacuuaacu

SEQ ID NO: 639227 - RNA, 22 nt, Human
aucuguaaaugcaaauguagcu

SEQ ID NO: 639228 - RNA, 22 nt, Human
uugauucuauggcuccgggagu

SEQ ID NO: 639229 - RNA, 22 nt, Human
gcagagccaggagcccaggauc

SEQ ID NO: 639230 - RNA, 22 nt, Human
gcauagucaguaggauucucaa

SEQ ID NO: 639231 - RNA, 22 nt, Human
acugccuuauaugcugugugug

SEQ ID NO: 639232 - RNA, 22 nt, Human
ugcaaagcaauguaggucagcu

SEQ ID NO: 639233 - RNA, 22 nt, Human
cugucuguacaaauguggggcc

SEQ ID NO: 639234 - RNA, 22 nt, Human
uggccacccagcugacgccuuc

SEQ ID NO: 639235 - RNA, 22 nt, Human
aagcuggagaguuucacagaug

SEQ ID NO: 639236 - RNA, 22 nt, Human
gcagaugaaguuuacaggaaac

SEQ ID NO: 639237 - RNA, 22 nt, Human
ugugacugaagugucuagaccu

SEQ ID NO: 639238 - RNA, 22 nt, Human
cauucacaauaguugaaaggug

SEQ ID NO: 639239 - RNA, 22 nt, Human
uacauguaggugacauuuuaau

SEQ ID NO: 639240 - RNA, 20 nt, Human
aagagaagaagucuuugaaa

SEQ ID NO: 639241 - RNA, 22 nt, Human
gaggcaggcagauugcuugagg

SEQ ID NO: 639242 - RNA, 22 nt, Human
ugucagagcaaugagguucagc

SEQ ID NO: 639243 - RNA, 22 nt, Human
ugcuuuguguuugaauagauaa

SEQ ID NO: 639244 - RNA, 22 nt, Human
aucuuauuuaacacagcaaaac

SEQ ID NO: 639245 - RNA, 21 nt, Human
ucucguuguauggucuugggg

SEQ ID NO: 639246 - RNA, 22 nt, Human
gccugcagaggugcugcuagcu

SEQ ID NO: 639247 - RNA, 22 nt, Human
gucagcugucuccccagagugg

SEQ ID NO: 639248 - RNA, 22 nt, Human
ucuuauaaaaggacucccauuu

SEQ ID NO: 639249 - RNA, 22 nt, Human
ucacugggagagcugacaagga

SEQ ID NO: 639250 - RNA, 22 nt, Human
cuuaagaugaggucaugcuaua

SEQ ID NO: 639251 - RNA, 22 nt, Human
acagaaacccagaaaaccucuc

SEQ ID NO: 639252 - RNA, 22 nt, Human
acacacuggcccccaguacuga

SEQ ID NO: 639253 - RNA, 22 nt, Human
gauuaugguagaaacaagaagu

SEQ ID NO: 639254 - RNA, 22 nt, Human
aauuuauuuccugccaguacac

SEQ ID NO: 639255 - RNA, 22 nt, Human
ucugucuccucugaggugccag

SEQ ID NO: 639256 - RNA, 22 nt, Human
uggcagugguaccggcucucag

SEQ ID NO: 639257 - RNA, 22 nt, Human
uccaugcagagaacugaaguac

SEQ ID NO: 639258 - RNA, 22 nt, Human
ggacugggauucuggaucugcu

SEQ ID NO: 639259 - RNA, 22 nt, Human
uagcuguucccagcucugugua

SEQ ID NO: 639260 - RNA, 22 nt, Human
gcagccagggcuaagcugggga

SEQ ID NO: 639261 - RNA, 21 nt, Human
uuuguccaccuguguucacca

SEQ ID NO: 639262 - RNA, 22 nt, Human
uccaggaggcagggcugugccc

SEQ ID NO: 639263 - RNA, 22 nt, Human
aagaacaugguaggauaacaaa

SEQ ID NO: 639264 - RNA, 20 nt, Human
uucaugggagcaaagaggcc

SEQ ID NO: 639265 - RNA, 22 nt, Human
ugcacagagagaugagacacgu

SEQ ID NO: 639266 - RNA, 22 nt, Human
uucuuaaaauucaagcuagguu

SEQ ID NO: 639267 - RNA, 22 nt, Human
agaccaagaaaggaugaggauc

SEQ ID NO: 639268 - RNA, 22 nt, Human
cauuucaguguuauucuaauuu

SEQ ID NO: 639269 - RNA, 22 nt, Human
gcuggagcuugagaggacaggg

SEQ ID NO: 639270 - RNA, 22 nt, Human
ucugucauuagccuugacugua

SEQ ID NO: 639271 - RNA, 20 nt, Human
ccagacagcaccugccuggu

SEQ ID NO: 639272 - RNA, 18 nt, Human
augaucuuagcaaauauu

SEQ ID NO: 639273 - RNA, 22 nt, Human
cacugauuaagucugcuagagg

SEQ ID NO: 639274 - RNA, 22 nt, Human
gguggccauggucagguagcgg

SEQ ID NO: 639275 - RNA, 22 nt, Human
agcuuccugucuucugcacaaa

SEQ ID NO: 639276 - RNA, 22 nt, Human
acaggcagauuaaggguaggca

SEQ ID NO: 639277 - RNA, 22 nt, Human
ugcuucuggcuuaucucgugcc

SEQ ID NO: 639278 - RNA, 17 nt, Human
cucugcagugcauggcu

SEQ ID NO: 639279 - RNA, 20 nt, Human
uacagccuauucaccacaua

SEQ ID NO: 639280 - RNA, 22 nt, Human
guugagcaaggccagagaagcc

SEQ ID NO: 639281 - RNA, 22 nt, Human
gcugucaggccaugugggccuu

SEQ ID NO: 639282 - RNA, 22 nt, Human
gaaacugugaggaucuuaacuu

SEQ ID NO: 639283 - RNA, 22 nt, Human
gcaggcuggaggcuguucuggg

SEQ ID NO: 639284 - RNA, 20 nt, Human
cugugccuccugcuaguccu

SEQ ID NO: 639285 - RNA, 22 nt, Human
caaguguccaugauagucuuag

SEQ ID NO: 639286 - RNA, 22 nt, Human
uggagcagugguccuggagaug

SEQ ID NO: 639287 - RNA, 22 nt, Human
uguaucaaggguuuauguaagc

SEQ ID NO: 639288 - RNA, 22 nt, Human
ggcugguccuuucucuguccua

SEQ ID NO: 639289 - RNA, 22 nt, Human
cccugccuacaggguuuucuuu

SEQ ID NO: 639290 - RNA, 22 nt, Human
ucagugcagcggcagcagcucu

SEQ ID NO: 639291 - RNA, 21 nt, Human
ccuuggcuggcaucuagcacc

SEQ ID NO: 639292 - RNA, 22 nt, Human
agugugagggguucuuugauau

SEQ ID NO: 639293 - RNA, 22 nt, Human
cuauaucuacauuugcuguuug

SEQ ID NO: 639294 - RNA, 22 nt, Human
cucuggccuggggccugcuccc

SEQ ID NO: 639295 - RNA, 22 nt, Human
agggcaugaagcaguggacagc

SEQ ID NO: 639296 - RNA, 22 nt, Human
uuuucuuaggugcuccaaguag

SEQ ID NO: 639297 - RNA, 22 nt, Human
ugugaaaaaaguucuagaagga

SEQ ID NO: 639298 - RNA, 22 nt, Human
cucagggaguagcacaugugga

SEQ ID NO: 639299 - RNA, 18 nt, Human
ccagaggcccgggcaggc

SEQ ID NO: 639300 - RNA, 18 nt, Human
uguacaguuaugagcauu

SEQ ID NO: 639301 - RNA, 22 nt, Human
gacacagagauaggccuguguu

SEQ ID NO: 639302 - RNA, 21 nt, Human
agccugccugaacucuguggc

SEQ ID NO: 639303 - RNA, 22 nt, Human
cauuguucaacacugacuugca

SEQ ID NO: 639304 - RNA, 22 nt, Human
agaaagcuccccaugagaugau

SEQ ID NO: 639305 - RNA, 22 nt, Human
cagcucuggcagagcccaaccc

SEQ ID NO: 639306 - RNA, 22 nt, Human
acauacauguaaaggaaauuau

SEQ ID NO: 639307 - RNA, 21 nt, Human
uggcccuggccacggcugcca

SEQ ID NO: 639308 - RNA, 21 nt, Human
ccauucuuagucaagugucuc

SEQ ID NO: 639309 - RNA, 22 nt, Human
guggaggacaaaagaagccuuu

SEQ ID NO: 639310 - RNA, 22 nt, Human
uagagaugugauauagcagagu

SEQ ID NO: 639311 - RNA, 22 nt, Human
uagcuaggguaagacuuggacc

SEQ ID NO: 639312 - RNA, 22 nt, Human
agguaaagaaagguguaacauu

SEQ ID NO: 639313 - RNA, 22 nt, Human
aggcaaggugcuacagacagug

SEQ ID NO: 639314 - RNA, 22 nt, Human
acaggcugcugagccauuugcu

SEQ ID NO: 639315 - RNA, 22 nt, Human
gcaaggcugagcacauuugcau

SEQ ID NO: 639316 - RNA, 22 nt, Human
gagggugggcuuuguuccucca

SEQ ID NO: 639317 - RNA, 22 nt, Human
gugauuucaaauauagagugag

SEQ ID NO: 639318 - RNA, 22 nt, Human
ugccugagugauguggcagcca

SEQ ID NO: 639319 - RNA, 22 nt, Human
acaguggaagaagcacugaacu

SEQ ID NO: 639320 - RNA, 22 nt, Human
aacaguuuauguaaauguccag

SEQ ID NO: 639321 - RNA, 22 nt, Human
ugccauggaaucaccuccagcu

SEQ ID NO: 639322 - RNA, 22 nt, Human
ugguuaguguauauuuggacug

SEQ ID NO: 639323 - RNA, 22 nt, Human
ggguaggcucugcaggcugggu

SEQ ID NO: 639324 - RNA, 21 nt, Human
ccugagugagaccuggcccgu

SEQ ID NO: 639325 - RNA, 22 nt, Human
aggggagcaucugugaugguua

SEQ ID NO: 639326 - RNA, 22 nt, Human
uuccucagcucagcgagagaga

SEQ ID NO: 639327 - RNA, 22 nt, Human
ugggccaggcaugugaucagca

SEQ ID NO: 639328 - RNA, 22 nt, Human
auguuucccagagcaaaucugg

SEQ ID NO: 639329 - RNA, 21 nt, Human
uccccacauuucuaaacagac

SEQ ID NO: 639330 - RNA, 22 nt, Human
uucuccagcucaucagggaggg

SEQ ID NO: 639331 - RNA, 22 nt, Human
gaaaggcaguacagcugagccu

SEQ ID NO: 639332 - RNA, 22 nt, Human
cugcguucauuuugagugcugu

SEQ ID NO: 639333 - RNA, 22 nt, Human
ucuggaaucaguggcuuacccu

SEQ ID NO: 639334 - RNA, 22 nt, Human
ucuuucaaagcaaaaugaggcu

SEQ ID NO: 639335 - RNA, 21 nt, Human
agaccucuucccuucaugcac

SEQ ID NO: 639336 - RNA, 22 nt, Human
ggcaugaguaacgugagugagg

SEQ ID NO: 639337 - RNA, 22 nt, Human
agaacaucuaaauaucugagac

SEQ ID NO: 639338 - RNA, 22 nt, Human
ucagcagguggugggcagguga

SEQ ID NO: 639339 - RNA, 22 nt, Human
aguauauuuugauuguaugugu

SEQ ID NO: 639340 - RNA, 22 nt, Human
cggauccucagucgugcgggag

SEQ ID NO: 639341 - RNA, 22 nt, Human
uucagucagugacuaagcaguu

SEQ ID NO: 639342 - RNA, 22 nt, Human
augugaaugcaguuaucuauaa

SEQ ID NO: 639343 - RNA, 22 nt, Human
gcagcuggggaggucgugggga

SEQ ID NO: 639344 - RNA, 22 nt, Human
accaucagucacauguagagaa

SEQ ID NO: 639345 - RNA, 22 nt, Human
uauguucucugcucuaggaugu

SEQ ID NO: 639346 - RNA, 22 nt, Human
aggagccaugagcaggaggcaa

SEQ ID NO: 639347 - RNA, 22 nt, Human
cagggccuuuuagcaucuucuc

SEQ ID NO: 639348 - RNA, 22 nt, Human
caccaggaugggcagguagguc

SEQ ID NO: 639349 - RNA, 22 nt, Human
cuuagcaagaaucagcugcugg

SEQ ID NO: 639350 - RNA, 22 nt, Human
cuuccucucuugcccauaagag

SEQ ID NO: 639351 - RNA, 19 nt, Human
aucauugaucuucaccccu

SEQ ID NO: 639352 - RNA, 22 nt, Human
cugagaggugacagcgugcugg

SEQ ID NO: 639353 - RNA, 22 nt, Human
cuuuucacaggaggauaagccc

SEQ ID NO: 639354 - RNA, 22 nt, Human
cuggcagcuuccuuugcaucug

SEQ ID NO: 639355 - RNA, 22 nt, Human
ccuuccuggagcccaugcagau

SEQ ID NO: 639356 - RNA, 22 nt, Human
uagaucauggaguaaaauggaa

SEQ ID NO: 639357 - RNA, 22 nt, Human
caguuuaaguagaacugagaau

SEQ ID NO: 639358 - RNA, 22 nt, Human
uuuaaccaguuuacaaagaauu

SEQ ID NO: 639359 - RNA, 22 nt, Human
aaugaaacuauauuuagagagg

SEQ ID NO: 639360 - RNA, 22 nt, Human
aagacugugucuauggcuacuc

SEQ ID NO: 639361 - RNA, 22 nt, Human
ugcagugugcuagauuuggacu

SEQ ID NO: 639362 - RNA, 22 nt, Human
uggcuaggcuccaagagcugga

SEQ ID NO: 639363 - RNA, 22 nt, Human
uauugcauccccauugugcccc

SEQ ID NO: 639364 - RNA, 22 nt, Human
acagacaguaaauaguguggcu

SEQ ID NO: 639365 - RNA, 22 nt, Human
cagcuuuauugagguauaauug

SEQ ID NO: 639366 - RNA, 22 nt, Human
aucacaggugguaggaaaagaa

SEQ ID NO: 639367 - RNA, 20 nt, Human
gcuuuuucuaauagcagucc

SEQ ID NO: 639368 - RNA, 22 nt, Human
uuccaaagcacuugauguaaag

SEQ ID NO: 639369 - RNA, 22 nt, Human
ugccauuugcugguuuucugau

SEQ ID NO: 639370 - RNA, 19 nt, Human
ucuccaaaaccaaucacua

SEQ ID NO: 639371 - RNA, 22 nt, Human
caucuguuuuugucaauuacau

SEQ ID NO: 639372 - RNA, 22 nt, Human
uaagacaugguugaucuagugu

SEQ ID NO: 639373 - RNA, 22 nt, Human
cacuauaucuguucuuguuuau

SEQ ID NO: 639374 - RNA, 22 nt, Human
ucacaauugagauccucccacc

SEQ ID NO: 639375 - RNA, 22 nt, Human
uccuggagaauggacaaugcac

SEQ ID NO: 639376 - RNA, 22 nt, Human
cacaguaugaucuaaaguaagu

SEQ ID NO: 639377 - RNA, 22 nt, Human
cagagccugcucacgucucugu

SEQ ID NO: 639378 - RNA, 22 nt, Human
uccugccuuagagcaaggaaaa

SEQ ID NO: 639379 - RNA, 22 nt, Human
cuccagcucuuaacugcggaag

SEQ ID NO: 639380 - RNA, 22 nt, Human
gccuccugcccagaugagugau

SEQ ID NO: 639381 - RNA, 23 nt, Human
uccucccugacuucuacagcaca

SEQ ID NO: 639382 - RNA, 22 nt, Human
uguacaguauauuucaaagcca

SEQ ID NO: 639383 - RNA, 22 nt, Human
ucuccuggagcaggaagguggg

SEQ ID NO: 639384 - RNA, 22 nt, Human
cugcaggguucggagaguuccc

SEQ ID NO: 639385 - RNA, 20 nt, Human
uggaguuguucugcuagguc

SEQ ID NO: 639386 - RNA, 22 nt, Human
gcagaggucucuucaaaauaau

SEQ ID NO: 639387 - RNA, 22 nt, Human
cugcagccuaggugcagcuggg

SEQ ID NO: 639388 - RNA, 22 nt, Human
guaugucaccucuccuaagcac

SEQ ID NO: 639389 - RNA, 22 nt, Human
ucuggggauggucuacuuucug

SEQ ID NO: 639390 - RNA, 22 nt, Human
ugagccguggucucugagggug

SEQ ID NO: 639391 - RNA, 22 nt, Human
gaaggaaaacagaucugccuga

SEQ ID NO: 639392 - RNA, 22 nt, Human
gaggccaugccuccugaucagu

SEQ ID NO: 639393 - RNA, 22 nt, Human
cccaggcuggaauuccaggccu

SEQ ID NO: 639394 - RNA, 22 nt, Human
uuucuaagacauuugucaucuu

SEQ ID NO: 639395 - RNA, 22 nt, Human
ugguucauagccucacaggaua

SEQ ID NO: 639396 - RNA, 22 nt, Human
aaggaucugacagacuauagaa

SEQ ID NO: 639397 - RNA, 22 nt, Human
aaggggauuuaagguaagaaga

SEQ ID NO: 639398 - RNA, 22 nt, Human
uacaacugugugaaggaaucug

SEQ ID NO: 639399 - RNA, 23 nt, Human
ucccucaggccuuaucuccaucu

SEQ ID NO: 639400 - RNA, 22 nt, Human
cugggcugucccaaccccaucc

SEQ ID NO: 639401 - RNA, 22 nt, Human
gaaguagcauguugcugccaga

SEQ ID NO: 639402 - RNA, 20 nt, Human
ugccugccccugcuuuuucc

SEQ ID NO: 639403 - RNA, 22 nt, Human
cuggcuggaggugagucacuga

SEQ ID NO: 639404 - RNA, 22 nt, Human
uguccaguccuuggggugcugu

SEQ ID NO: 639405 - RNA, 22 nt, Human
uccucuucugcccaucagaggc

SEQ ID NO: 639406 - RNA, 22 nt, Human
cagcugccccuccagggcuggg

SEQ ID NO: 639407 - RNA, 21 nt, Human
uuaaggucacuucugagccua

SEQ ID NO: 639408 - RNA, 22 nt, Human
ggcuggcuggaugaauggauua

SEQ ID NO: 639409 - RNA, 22 nt, Human
cauuuauucagcucagucgguu

SEQ ID NO: 639410 - RNA, 22 nt, Human
cucagcaguauacucugaagau

SEQ ID NO: 639411 - RNA, 22 nt, Human
auuauuuacagugugcucgaag

SEQ ID NO: 639412 - RNA, 22 nt, Human
gagaaugggaaugaaaguagca

SEQ ID NO: 639413 - RNA, 22 nt, Human
aggugauguccacagcuugcag

SEQ ID NO: 639414 - RNA, 22 nt, Human
aggcuggcugaaaaacacccuu

SEQ ID NO: 639415 - RNA, 22 nt, Human
uucauugaaccacuuuauucuu

SEQ ID NO: 639416 - RNA, 20 nt, Human
cucagcuaaacaacacugac

SEQ ID NO: 639417 - RNA, 22 nt, Human
uacauuguucaugcaugagaaa

SEQ ID NO: 639418 - RNA, 22 nt, Human
cugaggccagaacccgacccug

SEQ ID NO: 639419 - RNA, 22 nt, Human
uuauccaaacuggugaaucauu

SEQ ID NO: 639420 - RNA, 22 nt, Human
uuggccagacacuaccccccuu

SEQ ID NO: 639421 - RNA, 22 nt, Human
ugugcagaguaaggcagcuguu

SEQ ID NO: 639422 - RNA, 22 nt, Human
augucuucuguggagacaggua

SEQ ID NO: 639423 - RNA, 20 nt, Human
gggcuggcucaacuggaucc

SEQ ID NO: 639424 - RNA, 22 nt, Human
caugcuuugggucagaaaugcc

SEQ ID NO: 639425 - RNA, 23 nt, Human
caggcucccggaccaggauccgc

SEQ ID NO: 639426 - RNA, 22 nt, Human
cuucaagagaaugcagggaugu

SEQ ID NO: 639427 - RNA, 22 nt, Human
ucagaagguacagaagggaggu

SEQ ID NO: 639428 - RNA, 22 nt, Human
cuggagcagcagguggccaggg

SEQ ID NO: 639429 - RNA, 22 nt, Human
gcugccccccggacucggcggg

SEQ ID NO: 639430 - RNA, 19 nt, Human
uucuccaggcugcagaggg

SEQ ID NO: 639431 - RNA, 22 nt, Human
acagcaguggugcacugagcca

SEQ ID NO: 639432 - RNA, 22 nt, Human
gacccugaggauucccugcuga

SEQ ID NO: 639433 - RNA, 18 nt, Human
gcagagugcgucucugug

SEQ ID NO: 639434 - RNA, 22 nt, Human
accacccaccucacagcauagu

SEQ ID NO: 639435 - RNA, 22 nt, Human
cugcagagaugaagaagguggc

SEQ ID NO: 639436 - RNA, 22 nt, Human
gucuuuauauuuacuaaagaau

SEQ ID NO: 639437 - RNA, 22 nt, Human
ggguggcugagaacaggacccc

SEQ ID NO: 639438 - RNA, 22 nt, Human
gccuggaguggacuuggccccu

SEQ ID NO: 639439 - RNA, 22 nt, Human
cuuaaaggucauucuguugaua

SEQ ID NO: 639440 - RNA, 22 nt, Human
aucugacaaguuguguguauag

SEQ ID NO: 639441 - RNA, 22 nt, Human
uuuauucacucauucagccagu

SEQ ID NO: 639442 - RNA, 22 nt, Human
cacagaguggaggcuuggccug

SEQ ID NO: 639443 - RNA, 22 nt, Human
uccaggcaaagggacuagcagg

SEQ ID NO: 639444 - RNA, 22 nt, Human
ccaggcuguaaacaccuucaaa

SEQ ID NO: 639445 - RNA, 22 nt, Human
gcagaggugaguuucucagcug

SEQ ID NO: 639446 - RNA, 22 nt, Human
aaugaugguuucaucacuugaa

SEQ ID NO: 639447 - RNA, 22 nt, Human
cucucagcaggaaagcaugcaa

SEQ ID NO: 639448 - RNA, 22 nt, Human
cauagaggcuaaaauuauuugg

SEQ ID NO: 639449 - RNA, 22 nt, Human
gucccaggaacauucuggcuag

SEQ ID NO: 639450 - RNA, 22 nt, Human
aauacugaauuaguugagacaa

SEQ ID NO: 639451 - RNA, 22 nt, Human
uuuucaaagacuggaggcugau

SEQ ID NO: 639452 - RNA, 22 nt, Human
auagauccagaaaauuuauuau

SEQ ID NO: 639453 - RNA, 22 nt, Human
cuggcugcuggccugaggaugc

SEQ ID NO: 639454 - RNA, 16 nt, Human
gaucuguucuauuuca

SEQ ID NO: 639455 - RNA, 20 nt, Human
caccuggcugacugucucca

SEQ ID NO: 639456 - RNA, 22 nt, Human
gggcuucagcuggggauggagc

SEQ ID NO: 639457 - RNA, 22 nt, Human
caaaucuccuuaaagguaaaau

SEQ ID NO: 639458 - RNA, 22 nt, Human
cugagaucccaggcaggguggc

SEQ ID NO: 639459 - RNA, 22 nt, Human
ccugguucagucuuucuaugcu

SEQ ID NO: 639460 - RNA, 22 nt, Human
cuaaacaagggauuauaauuga

SEQ ID NO: 639461 - RNA, 22 nt, Human
acaguaauaaguguuggugagg

SEQ ID NO: 639462 - RNA, 22 nt, Human
aagacaauaauuuuugggcagg

SEQ ID NO: 639463 - RNA, 23 nt, Human
ugggagacuuuucauuuuguucu

SEQ ID NO: 639464 - RNA, 22 nt, Human
uugucccaggacuugcauagau

SEQ ID NO: 639465 - RNA, 22 nt, Human
ccuguuuaucuaucuagagaug

SEQ ID NO: 639466 - RNA, 22 nt, Human
cagaaugaguagcaucuucacc

SEQ ID NO: 639467 - RNA, 22 nt, Human
uguuuacauggagguuuucagc

SEQ ID NO: 639468 - RNA, 22 nt, Human
agcugcugaaugacacugcaag

SEQ ID NO: 639469 - RNA, 22 nt, Human
agcuccugcucuuugucccuaa

SEQ ID NO: 639470 - RNA, 22 nt, Human
cuuuagaauuugauauaaucaa

SEQ ID NO: 639471 - RNA, 22 nt, Human
acaacuuucuggguuaucugau

SEQ ID NO: 639472 - RNA, 22 nt, Human
cugaggcacagugaacuucucc

SEQ ID NO: 639473 - RNA, 22 nt, Human
gugcugagugcagagugcagag

SEQ ID NO: 639474 - RNA, 22 nt, Human
uugcuuuguuacugcaguuucc

SEQ ID NO: 639475 - RNA, 22 nt, Human
aaauagcagaagcagagggggu

SEQ ID NO: 639476 - RNA, 22 nt, Human
caguaugugaugcaacggaaua

SEQ ID NO: 639477 - RNA, 22 nt, Human
cugccuagauuugaauccuggc

SEQ ID NO: 639478 - RNA, 22 nt, Human
cuucuuggcugcaagucucugu

SEQ ID NO: 639479 - RNA, 22 nt, Human
agagaaugcagggcuucggaca

SEQ ID NO: 639480 - RNA, 22 nt, Human
uccaguccauggccucagucuu

SEQ ID NO: 639481 - RNA, 22 nt, Human
cuucaggauuaauuuggggccu

SEQ ID NO: 639482 - RNA, 22 nt, Human
uuggccucauggacagcucauc

SEQ ID NO: 639483 - RNA, 22 nt, Human
guuuagacuccuuggucuucug

SEQ ID NO: 639484 - RNA, 22 nt, Human
uccaggaguggggcagaggucu

SEQ ID NO: 639485 - RNA, 22 nt, Human
gccuuuaucaguuucauggcuu

SEQ ID NO: 639486 - RNA, 22 nt, Human
ugcuagaauuagguuaaacaaa

SEQ ID NO: 639487 - RNA, 22 nt, Human
aggcucaggaggagcugccgga

SEQ ID NO: 639488 - RNA, 22 nt, Human
uaaauaaguucuucauuguuug

SEQ ID NO: 639489 - RNA, 22 nt, Human
ugucacagagcaacuauuucuu

SEQ ID NO: 639490 - RNA, 22 nt, Human
caugcagcggcguuugguuuaa

SEQ ID NO: 639491 - RNA, 20 nt, Human
acacaugcauucaugugggc

SEQ ID NO: 639492 - RNA, 22 nt, Human
uucugcuguuuguaguaaugua

SEQ ID NO: 639493 - RNA, 22 nt, Human
ucaguuaagaggccacggcagu

SEQ ID NO: 639494 - RNA, 19 nt, Human
ggcaggcuggauagagagg

SEQ ID NO: 639495 - RNA, 22 nt, Human
aaagcacaggagaguucaguaa

SEQ ID NO: 639496 - RNA, 22 nt, Human
aggcuucaccugcaccugagcu

SEQ ID NO: 639497 - RNA, 22 nt, Human
aacaugauggggaagaacaaga

SEQ ID NO: 639498 - RNA, 17 nt, Human
ugcaugcgucugugaua

SEQ ID NO: 639499 - RNA, 22 nt, Human
ggaggaggcggcagaaguuccu

SEQ ID NO: 639500 - RNA, 22 nt, Human
aagcucagcaugucuccuagaa

SEQ ID NO: 639501 - RNA, 22 nt, Human
gagugcagaugaacagaagauu

SEQ ID NO: 639502 - RNA, 22 nt, Human
cuucacagaauaaacucauuau

SEQ ID NO: 639503 - RNA, 22 nt, Human
agugucuguugcuuuugcagug

SEQ ID NO: 639504 - RNA, 22 nt, Human
aucacauucuuucaaagcaguc

SEQ ID NO: 639505 - RNA, 22 nt, Human
ucucugggaauuuuuuggacau

SEQ ID NO: 639506 - RNA, 22 nt, Human
gaauaacauuggaacccugaag

SEQ ID NO: 639507 - RNA, 22 nt, Human
caaugcauacuucgaaauuuca

SEQ ID NO: 639508 - RNA, 22 nt, Human
gagcuugguguuauuucugugg

SEQ ID NO: 639509 - RNA, 22 nt, Human
ucuggagaaggaagagucuuug

SEQ ID NO: 639510 - RNA, 22 nt, Human
ugucucaguacacuccgauguu

SEQ ID NO: 639511 - RNA, 22 nt, Human
gguggccucugcaggccucgac

SEQ ID NO: 639512 - RNA, 22 nt, Human
ucucugugacugcagcuuugca

SEQ ID NO: 639513 - RNA, 22 nt, Human
acuacaaaagcacuggguauua

SEQ ID NO: 639514 - RNA, 22 nt, Human
cauggcagcuuugggaggagga

SEQ ID NO: 639515 - RNA, 22 nt, Human
ucacuuauaaaaugcaagaucu

SEQ ID NO: 639516 - RNA, 22 nt, Human
gaggaggcacuaguuagugaca

SEQ ID NO: 639517 - RNA, 22 nt, Human
aguuauuuacuccuuugucucu

SEQ ID NO: 639518 - RNA, 22 nt, Human
ggucuccauuccuucaucucac

SEQ ID NO: 639519 - RNA, 22 nt, Human
gcuccugucaucaaacaauccu

SEQ ID NO: 639520 - RNA, 22 nt, Human
gcauguggcccaaggaggcugu

SEQ ID NO: 639521 - RNA, 22 nt, Human
caguggccuugaugccucauuc

SEQ ID NO: 639522 - RNA, 22 nt, Human
uacugaaagaauacauaauuuc

SEQ ID NO: 639523 - RNA, 22 nt, Human
uggagcugauacagcuggcuuu

SEQ ID NO: 639524 - RNA, 22 nt, Human
ucauauaagagcuuuagaguca

SEQ ID NO: 639525 - RNA, 22 nt, Human
accaggaggccuggagcacaaa

SEQ ID NO: 639526 - RNA, 22 nt, Human
ggccagcucuuguccacggagg

SEQ ID NO: 639527 - RNA, 22 nt, Human
gccacuggcgcugugcagagug

SEQ ID NO: 639528 - RNA, 22 nt, Human
ucucugucccuaggagccuugc

SEQ ID NO: 639529 - RNA, 22 nt, Human
agccauuuugguaaugauaaca

SEQ ID NO: 639530 - RNA, 22 nt, Human
ccuggguagacuuugaagcauu

SEQ ID NO: 639531 - RNA, 22 nt, Human
agcacguucuucauuacuucac

SEQ ID NO: 639532 - RNA, 22 nt, Human
uacaaugcagugaccuccuuua

SEQ ID NO: 639533 - RNA, 22 nt, Human
agggcccaguggagagcugagc

SEQ ID NO: 639534 - RNA, 22 nt, Human
augaggccacaguuauagauuu

SEQ ID NO: 639535 - RNA, 22 nt, Human
uucucaggccuuugggauggga

SEQ ID NO: 639536 - RNA, 22 nt, Human
uggggcagcuccaucuauucca

SEQ ID NO: 639537 - RNA, 22 nt, Human
aaggcuuggaccagcuacagug

SEQ ID NO: 639538 - RNA, 22 nt, Human
uuaauauacaauuuuacgggcu

SEQ ID NO: 639539 - RNA, 22 nt, Human
gggggcgcacagucaccacaaa

SEQ ID NO: 639540 - RNA, 22 nt, Human
uuacuugaaaaccaccaguauu

SEQ ID NO: 639541 - RNA, 22 nt, Human
gaaauucaggacaaagacucuu

SEQ ID NO: 639542 - RNA, 22 nt, Human
cucucucuaugcguuguuccua

SEQ ID NO: 639543 - RNA, 22 nt, Human
gcagccacacuguuacagaaug

SEQ ID NO: 639544 - RNA, 22 nt, Human
ugcucugggcuaucugagaaag

SEQ ID NO: 639545 - RNA, 23 nt, Human
aggcgagcucuucuccagcacgu

SEQ ID NO: 639546 - RNA, 20 nt, Human
ugcaauguccauguuccagg

SEQ ID NO: 639547 - RNA, 22 nt, Human
uauugcuugggguacaagguau

SEQ ID NO: 639548 - RNA, 22 nt, Human
uuggccagguguccagcccagg

SEQ ID NO: 639549 - RNA, 22 nt, Human
gacauggauacuugauaagggg

SEQ ID NO: 639550 - RNA, 22 nt, Human
aguugucaccucuauucaaauc

SEQ ID NO: 639551 - RNA, 22 nt, Human
cucagaaguucagccuagagua

SEQ ID NO: 639552 - RNA, 19 nt, Human
acauugaauuuucuucuuu

SEQ ID NO: 639553 - RNA, 22 nt, Human
uauuagcagacaagcugcugga

SEQ ID NO: 639554 - RNA, 22 nt, Human
acauuuaguaugagucucugua

SEQ ID NO: 639555 - RNA, 22 nt, Human
cagucucuuuucagcuccaucc

SEQ ID NO: 639556 - RNA, 22 nt, Human
agcaauaacagaaaacuuuccu

SEQ ID NO: 639557 - RNA, 21 nt, Human
aguguccuuuuacugugaaua

SEQ ID NO: 639558 - RNA, 21 nt, Human
agagggagaguggcccuucca

SEQ ID NO: 639559 - RNA, 22 nt, Human
ugccugcccugaaaacugccca

SEQ ID NO: 639560 - RNA, 22 nt, Human
ggugcccagcgaaguggcugug

SEQ ID NO: 639561 - RNA, 22 nt, Human
ccucccacauugaggacaugcu

SEQ ID NO: 639562 - RNA, 22 nt, Human
auggcugugcagagauugggaa

SEQ ID NO: 639563 - RNA, 17 nt, Human
caaaccaguaagacugc

SEQ ID NO: 639564 - RNA, 22 nt, Human
aagaaccuauaugcugaugaau

SEQ ID NO: 639565 - RNA, 22 nt, Human
agaaaugcauuagcacauauag

SEQ ID NO: 639566 - RNA, 22 nt, Human
uccuggagcuuccuucauggua

SEQ ID NO: 639567 - RNA, 22 nt, Human
aggagcacugagccagcauggg

SEQ ID NO: 639568 - RNA, 22 nt, Human
uagaaaugugauaauagcuuaa

SEQ ID NO: 639569 - RNA, 22 nt, Human
uacugcauguguuugaugaugg

SEQ ID NO: 639570 - RNA, 22 nt, Human
ugccccucuaggcccuguucua

SEQ ID NO: 639571 - RNA, 22 nt, Human
uugacucuaaauuuacuuuucc

SEQ ID NO: 639572 - RNA, 22 nt, Human
ucaggaggccaccaggaccugu

SEQ ID NO: 639573 - RNA, 22 nt, Human
uauugcuuugugucauaagcaa

SEQ ID NO: 639574 - RNA, 21 nt, Human
acaggagaccgccuggcaguc

SEQ ID NO: 639575 - RNA, 22 nt, Human
agucucuuuguggacucugccu

SEQ ID NO: 639576 - RNA, 22 nt, Human
cugagaaaugcauuuuuccagc

SEQ ID NO: 639577 - RNA, 22 nt, Human
uccagcauuuuucaauagaauu

SEQ ID NO: 639578 - RNA, 22 nt, Human
ugggaccugaagcagguuggca

SEQ ID NO: 639579 - RNA, 22 nt, Human
uguggcaggaugcggaagaugc

SEQ ID NO: 639580 - RNA, 22 nt, Human
cucugcagaggcccaaggcuga

SEQ ID NO: 639581 - RNA, 19 nt, Human
agcaaauauaauaguguuc

SEQ ID NO: 639582 - RNA, 19 nt, Human
uagcucugucuuauuccaa

SEQ ID NO: 639583 - RNA, 22 nt, Human
aaacugcaauuacuuuugcagc

SEQ ID NO: 639584 - RNA, 22 nt, Human
agggaggagaauggacuccuuc

SEQ ID NO: 639585 - RNA, 22 nt, Human
caguaaaugguacguauauuuu

SEQ ID NO: 639586 - RNA, 21 nt, Human
gcucuccagggccagcccagg

SEQ ID NO: 639587 - RNA, 22 nt, Human
ugcagguggcagcggggcacca

SEQ ID NO: 639588 - RNA, 22 nt, Human
aaccauuugccauuaucuuaag

SEQ ID NO: 639589 - RNA, 20 nt, Human
agccagaagaaggcuggaga

SEQ ID NO: 639590 - RNA, 22 nt, Human
ggccacucggccaccccugccg

SEQ ID NO: 639591 - RNA, 22 nt, Human
gcuggccaggugcuuugguucu

SEQ ID NO: 639592 - RNA, 22 nt, Human
cuuuccugccuuauucauucau

SEQ ID NO: 639593 - RNA, 22 nt, Human
ggaggugaggccguagggugug

SEQ ID NO: 639594 - RNA, 22 nt, Human
uuggaagguucuggucaugguu

SEQ ID NO: 639595 - RNA, 22 nt, Human
ucugggagccugaaagugaaug

SEQ ID NO: 639596 - RNA, 22 nt, Human
ccguguguaugguggaacugcu

SEQ ID NO: 639597 - RNA, 22 nt, Human
cagggcccagucccugcuguca

SEQ ID NO: 639598 - RNA, 22 nt, Human
aaacaguuucauuuucaugacc

SEQ ID NO: 639599 - RNA, 19 nt, Human
cuuuucaagccaucaguuu

SEQ ID NO: 639600 - RNA, 22 nt, Human
acugcuuacccggccugacuuc

SEQ ID NO: 639601 - RNA, 22 nt, Human
cugggccuggacgggcagaucu

SEQ ID NO: 639602 - RNA, 22 nt, Human
uuugcaguguucaucaguauuu

SEQ ID NO: 639603 - RNA, 22 nt, Human
ccguuaaucccauaauauggau

SEQ ID NO: 639604 - RNA, 22 nt, Human
cauacuuacuguguaccaggug

SEQ ID NO: 639605 - RNA, 22 nt, Human
cugaaagcauuaacuccacuuc

SEQ ID NO: 639606 - RNA, 22 nt, Human
ugcacacauguauguauaugug

SEQ ID NO: 639607 - RNA, 22 nt, Human
gauaaacuggaaccauugccuc

SEQ ID NO: 639608 - RNA, 21 nt, Human
agcagccauggaugguaugua

SEQ ID NO: 639609 - RNA, 22 nt, Human
cacagugucugugcuucagugu

SEQ ID NO: 639610 - RNA, 22 nt, Human
acuuuguuuccauauuuguagc

SEQ ID NO: 639611 - RNA, 22 nt, Human
ggcaggugaccuggccucccag

SEQ ID NO: 639612 - RNA, 22 nt, Human
gcuucuggugaggccucaggaa

SEQ ID NO: 639613 - RNA, 22 nt, Human
uuucuguagugugguauguagg

SEQ ID NO: 639614 - RNA, 15 nt, Human
agcugccugggugcu

SEQ ID NO: 639615 - RNA, 18 nt, Human
ugagaggcuauuuuuugc

SEQ ID NO: 639616 - RNA, 16 nt, Human
uggcugagagaggguu

SEQ ID NO: 639617 - RNA, 22 nt, Human
uuuucuaaaauauccaggacag

SEQ ID NO: 639618 - RNA, 22 nt, Human
gaaucuuauuuuuaaaucuucc

SEQ ID NO: 639619 - RNA, 22 nt, Human
cagccucuuuccacaucaggca

SEQ ID NO: 639620 - RNA, 22 nt, Human
uauaaacuccucuugcauuccu

SEQ ID NO: 639621 - RNA, 22 nt, Human
ggccugcuauuggugggcagac

SEQ ID NO: 639622 - RNA, 22 nt, Human
ucagucuauccagcucagaucc

SEQ ID NO: 639623 - RNA, 22 nt, Human
uagcuuuaggaugguucucuug

SEQ ID NO: 639624 - RNA, 22 nt, Human
gaucgaguuguuuguucugggg

SEQ ID NO: 639625 - RNA, 22 nt, Human
uauuucacucaguauaccauag

SEQ ID NO: 639626 - RNA, 22 nt, Human
aagaugguuauuucaucaccua

SEQ ID NO: 639627 - RNA, 22 nt, Human
aggugcacugucuaauuagguc

SEQ ID NO: 639628 - RNA, 22 nt, Human
cagcagugugcaggugugcugg

SEQ ID NO: 639629 - RNA, 23 nt, Human
cacaccaggagccgucugggcca

SEQ ID NO: 639630 - RNA, 22 nt, Human
ucuuuguacuuucuggcugucc

SEQ ID NO: 639631 - RNA, 22 nt, Human
agauuggaucaagcagcaguug

SEQ ID NO: 639632 - RNA, 22 nt, Human
ugcauauacccgcauuuacaua

SEQ ID NO: 639633 - RNA, 22 nt, Human
uaggaaauuagaacuuggaaac

SEQ ID NO: 639634 - RNA, 22 nt, Human
agugcuuuagagaaauggugcu

SEQ ID NO: 639635 - RNA, 22 nt, Human
uguggcugcaaaggaaggcugc

SEQ ID NO: 639636 - RNA, 22 nt, Human
auuauucaaauucccacuauac

SEQ ID NO: 639637 - RNA, 22 nt, Human
gcugccuuccaaagaguuuuau

SEQ ID NO: 639638 - RNA, 22 nt, Human
aaacuucuggcuacaagcaaua

SEQ ID NO: 639639 - RNA, 22 nt, Human
gcugggcaaugccagagaggag

SEQ ID NO: 639640 - RNA, 22 nt, Human
cauggcccucuucuggagcaau

SEQ ID NO: 639641 - RNA, 22 nt, Human
uaaggccaggcuguggucggca

SEQ ID NO: 639642 - RNA, 22 nt, Human
agcccugcaggaugagggaggu

SEQ ID NO: 639643 - RNA, 22 nt, Human
ccauaagguugaaaacuguaca

SEQ ID NO: 639644 - RNA, 22 nt, Human
agagaguucuuucuaguugaag

SEQ ID NO: 639645 - RNA, 22 nt, Human
gugugagaagggaauguaaagc

SEQ ID NO: 639646 - RNA, 22 nt, Human
gcuggcccagcgcccagggcag

SEQ ID NO: 639647 - RNA, 22 nt, Human
aguguguaauucagugcccagc

SEQ ID NO: 639648 - RNA, 22 nt, Human
aggccuuccucggagacaggga

SEQ ID NO: 639649 - RNA, 22 nt, Human
gguuugcauucugaaaggcuca

SEQ ID NO: 639650 - RNA, 22 nt, Human
aacuuuacacugcuuuacauga

SEQ ID NO: 639651 - RNA, 22 nt, Human
ggagccagaggcugcugcugug

SEQ ID NO: 639652 - RNA, 22 nt, Human
acaacuguuagacacuucuaag

SEQ ID NO: 639653 - RNA, 22 nt, Human
caaggccaugagcagcgagugu

SEQ ID NO: 639654 - RNA, 22 nt, Human
uuggccaaaggaaagacuacug

SEQ ID NO: 639655 - RNA, 23 nt, Human
agcauggaauaggaaagaggcag

SEQ ID NO: 639656 - RNA, 22 nt, Human
cucagcucugacaggaggcauc

SEQ ID NO: 639657 - RNA, 22 nt, Human
cagugcccaagaugugccaugc

SEQ ID NO: 639658 - RNA, 22 nt, Human
uuggaacuuaacccugauaggu

SEQ ID NO: 639659 - RNA, 22 nt, Human
agcuccagcccuaguacagcug

SEQ ID NO: 639660 - RNA, 22 nt, Human
gugggcagacagugcuuugcag

SEQ ID NO: 639661 - RNA, 22 nt, Human
aguacacuaugguaacuggagu

SEQ ID NO: 639662 - RNA, 22 nt, Human
gggauggcucaaaggagucagg

SEQ ID NO: 639663 - RNA, 22 nt, Human
agaguccaugaagacagcugag

SEQ ID NO: 639664 - RNA, 22 nt, Human
agagacuguacguggcaaguau

SEQ ID NO: 639665 - RNA, 22 nt, Human
agcagggcucuguggagggugg

SEQ ID NO: 639666 - RNA, 22 nt, Human
uggaagaauauggggguacaga

SEQ ID NO: 639667 - RNA, 22 nt, Human
aacugcuuguagugacuugccu

SEQ ID NO: 639668 - RNA, 22 nt, Human
auggcuuuguguucagagcuga

SEQ ID NO: 639669 - RNA, 22 nt, Human
uagcaucucaaccuccugaaag

SEQ ID NO: 639670 - RNA, 22 nt, Human
cacagcagaacuuaauuucaaa

SEQ ID NO: 639671 - RNA, 22 nt, Human
ucagggcagguuaacuugggug

SEQ ID NO: 639672 - RNA, 22 nt, Human
uucuuugaaauacuguuuugcc

SEQ ID NO: 639673 - RNA, 22 nt, Human
cuaucaaacagccauuaauaua

SEQ ID NO: 639674 - RNA, 22 nt, Human
gaacaaacacaucccagcagug

SEQ ID NO: 639675 - RNA, 22 nt, Human
guggagugcaacgguuggaguu

SEQ ID NO: 639676 - RNA, 22 nt, Human
uucauuugucugcuauagaucc

SEQ ID NO: 639677 - RNA, 23 nt, Human
guuccuucauguggucauugguu

SEQ ID NO: 639678 - RNA, 22 nt, Human
guggcccugucccaggccuccu

SEQ ID NO: 639679 - RNA, 22 nt, Human
cagcaauaagccagguuagaca

SEQ ID NO: 639680 - RNA, 22 nt, Human
agagcacaggcucuggagucua

SEQ ID NO: 639681 - RNA, 21 nt, Human
uuacuuuugcaccaaccuaau

SEQ ID NO: 639682 - RNA, 22 nt, Human
aacuccagguccuuugaaucug

SEQ ID NO: 639683 - RNA, 22 nt, Human
ugguuuugcuccaguauaaaua

SEQ ID NO: 639684 - RNA, 22 nt, Human
gucagaggaggcugaguaggaa

SEQ ID NO: 639685 - RNA, 22 nt, Human
acaugaaacccagccguggucc

SEQ ID NO: 639686 - RNA, 22 nt, Human
caguaacaugucuguuaagaaa

SEQ ID NO: 639687 - RNA, 23 nt, Human
ucaaaggaggcaucguucugcag

SEQ ID NO: 639688 - RNA, 22 nt, Human
uguggagaugugagcaagggga

SEQ ID NO: 639689 - RNA, 22 nt, Human
agaaaacauuacauaggugugu

SEQ ID NO: 639690 - RNA, 22 nt, Human
gcuaggaggcccugcacgcuua

SEQ ID NO: 639691 - RNA, 22 nt, Human
auuugcugagcucaaagaaaag

SEQ ID NO: 639692 - RNA, 22 nt, Human
gggcuggaucuccugcaggcag

SEQ ID NO: 639693 - RNA, 22 nt, Human
cagguccugccuugguuacccu

SEQ ID NO: 639694 - RNA, 22 nt, Human
gcucagaggaugcuccuuuaug

SEQ ID NO: 639695 - RNA, 22 nt, Human
ggcugccucuggaagcuggaga

SEQ ID NO: 639696 - RNA, 22 nt, Human
uuuuaguuacugcaguagcaaa

SEQ ID NO: 639697 - RNA, 22 nt, Human
cuggcuuuucaaacuguucagu

SEQ ID NO: 639698 - RNA, 22 nt, Human
gggugggguguaucggauccua

SEQ ID NO: 639699 - RNA, 22 nt, Human
caccugaagauuuagagauuga

SEQ ID NO: 639700 - RNA, 22 nt, Human
aaauagaauuggaagcagaguu

SEQ ID NO: 639701 - RNA, 22 nt, Human
gccugagggcuccuagcaggcu

SEQ ID NO: 639702 - RNA, 22 nt, Human
uagaaagaacuucauguaaaac

SEQ ID NO: 639703 - RNA, 22 nt, Human
ucaauuacuaaccaaauaaugu

SEQ ID NO: 639704 - RNA, 22 nt, Human
ggcugcagagcuggugcccugg

SEQ ID NO: 639705 - RNA, 22 nt, Human
aagaggaggauugaugugggag

SEQ ID NO: 639706 - RNA, 22 nt, Human
auaagcagggucaaaugccuac

SEQ ID NO: 639707 - RNA, 22 nt, Human
ucccugugggaugaggacucug

SEQ ID NO: 639708 - RNA, 22 nt, Human
cugggccuagcaacagaggagu

SEQ ID NO: 639709 - RNA, 22 nt, Human
cagggacccuacuagcucacac

SEQ ID NO: 639710 - RNA, 22 nt, Human
augcuguggaugccuugcccca

SEQ ID NO: 639711 - RNA, 22 nt, Human
aacucacacaaguauugccugc

SEQ ID NO: 639712 - RNA, 22 nt, Human
agguggagaucagggacuaagg

SEQ ID NO: 639713 - RNA, 22 nt, Human
acagaaauuagcagugaguuua

SEQ ID NO: 639714 - RNA, 22 nt, Human
guuucuuaaauguagcaggacc

SEQ ID NO: 639715 - RNA, 20 nt, Human
ggaccagcugucugaggggc

SEQ ID NO: 639716 - RNA, 22 nt, Human
accaggaggccuugguucugag

SEQ ID NO: 639717 - RNA, 22 nt, Human
agcugaggaggaaugaugggua

SEQ ID NO: 639718 - RNA, 22 nt, Human
aaggaagagcaaagaauuaugu

SEQ ID NO: 639719 - RNA, 22 nt, Human
caacauauuuuccaagagugaa

SEQ ID NO: 639720 - RNA, 22 nt, Human
gcuucuggaagcauaugcaaga

SEQ ID NO: 639721 - RNA, 22 nt, Human
aggaguguugcuucagggaagc

SEQ ID NO: 639722 - RNA, 22 nt, Human
ugaggccagaguuuuuaauucc

SEQ ID NO: 639723 - RNA, 22 nt, Human
ugggccuccugcccuggccuag

SEQ ID NO: 639724 - RNA, 22 nt, Human
agcuuugggcagaagaggauuc

SEQ ID NO: 639725 - RNA, 22 nt, Human
aaaggagagugagucagaugcc

SEQ ID NO: 639726 - RNA, 19 nt, Human
ucaguggagaaaggggaag

SEQ ID NO: 639727 - RNA, 22 nt, Human
ggagguagucugagucauaggc

SEQ ID NO: 639728 - RNA, 22 nt, Human
aggcuccaugcuaagcgauaug

SEQ ID NO: 639729 - RNA, 22 nt, Human
uuugcaaacuuuccucuggacc

SEQ ID NO: 639730 - RNA, 22 nt, Human
gaggaggguuggccuuagguag

SEQ ID NO: 639731 - RNA, 18 nt, Human
ggccagcuccugaggcag

SEQ ID NO: 639732 - RNA, 22 nt, Human
ucagcagaguggaacauuguca

SEQ ID NO: 639733 - RNA, 22 nt, Human
gcugcuguccuucaagucugcg

SEQ ID NO: 639734 - RNA, 22 nt, Human
acuguaaccaguguggugagag

SEQ ID NO: 639735 - RNA, 22 nt, Human
uaauuauaacaguuacaucuua

SEQ ID NO: 639736 - RNA, 22 nt, Human
ccuggcucugagguaugccugg

SEQ ID NO: 639737 - RNA, 22 nt, Human
ggagccugacagugcccagcau

SEQ ID NO: 639738 - RNA, 22 nt, Human
auggagcuaaauuguaaucaua

SEQ ID NO: 639739 - RNA, 22 nt, Human
uacaguucuuugaaggaucuag

SEQ ID NO: 639740 - RNA, 22 nt, Human
uucucaggccccugccuggacu

SEQ ID NO: 639741 - RNA, 22 nt, Human
aaaucguuauaauguuaagccu

SEQ ID NO: 639742 - RNA, 22 nt, Human
uggcauguggcuuugagucauc

SEQ ID NO: 639743 - RNA, 22 nt, Human
uaacuguauuuuaggucucauu

SEQ ID NO: 639744 - RNA, 23 nt, Human
ggggacagagggcagcccgcauc

SEQ ID NO: 639745 - RNA, 22 nt, Human
cugcagcaucgccaccugccuc

SEQ ID NO: 639746 - RNA, 22 nt, Human
uagaguguccaacacauaggag

SEQ ID NO: 639747 - RNA, 22 nt, Human
uauuucucuucaaaauugaugu

SEQ ID NO: 639748 - RNA, 22 nt, Human
ugcaauaucagauucaacacau

SEQ ID NO: 639749 - RNA, 22 nt, Human
acaguguguccuaaaggucugg

SEQ ID NO: 639750 - RNA, 22 nt, Human
gcuuccccuccaagcacugccu

SEQ ID NO: 639751 - RNA, 22 nt, Human
uggagagaugucuguucaaggu

SEQ ID NO: 639752 - RNA, 21 nt, Human
ugguggagugugcugagcaug

SEQ ID NO: 639753 - RNA, 22 nt, Human
ugcuucaaguugaaauauucuu

SEQ ID NO: 639754 - RNA, 22 nt, Human
cugccugcgccaccaccacguc

SEQ ID NO: 639755 - RNA, 22 nt, Human
guggaaggugaaggagcagcga

SEQ ID NO: 639756 - RNA, 22 nt, Human
gccacagcccgagcaccaugag

SEQ ID NO: 639757 - RNA, 22 nt, Human
aaucauguccaucuuaacuuuc

SEQ ID NO: 639758 - RNA, 22 nt, Human
ugagcaucuuuuuacagguuua

SEQ ID NO: 639759 - RNA, 22 nt, Human
ccagcuaggcuugcacucuugu

SEQ ID NO: 639760 - RNA, 22 nt, Human
uuacacauuaacaggcagcuaa

SEQ ID NO: 639761 - RNA, 22 nt, Human
caggcucccuaagucagcagcc

SEQ ID NO: 639762 - RNA, 22 nt, Human
agagccacugggagacagagca

SEQ ID NO: 639763 - RNA, 22 nt, Human
acacauuagugcucugucucau

SEQ ID NO: 639764 - RNA, 22 nt, Human
uagauaaaagggcaaagggcau

SEQ ID NO: 639765 - RNA, 22 nt, Human
uggaucugcucuaugaacugcu

SEQ ID NO: 639766 - RNA, 22 nt, Human
gcagucaucaguccuuuaauua

SEQ ID NO: 639767 - RNA, 21 nt, Human
aacugcaaaugaugcuggaga

SEQ ID NO: 639768 - RNA, 22 nt, Human
ucuggguuugaaguagagccca

SEQ ID NO: 639769 - RNA, 22 nt, Human
acaaaacaguguuccugccccu

SEQ ID NO: 639770 - RNA, 22 nt, Human
ucuaggagaaccaucagggagg

SEQ ID NO: 639771 - RNA, 22 nt, Human
agaagcugacagaugcagcagg

SEQ ID NO: 639772 - RNA, 20 nt, Human
aguuauaguaucuagccaug

SEQ ID NO: 639773 - RNA, 22 nt, Human
agucccagugagaugaaccagg

SEQ ID NO: 639774 - RNA, 22 nt, Human
uccacaugaccauugugcuccu

SEQ ID NO: 639775 - RNA, 22 nt, Human
gcuccaguggacugggggaggc

SEQ ID NO: 639776 - RNA, 22 nt, Human
ugaguucucacccauucuucuu

SEQ ID NO: 639777 - RNA, 22 nt, Human
ugcuguguggaugugaagaauc

SEQ ID NO: 639778 - RNA, 22 nt, Human
auuugcaauuacucaugucauu

SEQ ID NO: 639779 - RNA, 22 nt, Human
ggcugcugaguuggccaggaga

SEQ ID NO: 639780 - RNA, 22 nt, Human
acauucauugagcaacaacaau

SEQ ID NO: 639781 - RNA, 17 nt, Human
aggaaacauuuucuuuc

SEQ ID NO: 639782 - RNA, 21 nt, Human
aaaugaaugugguagugcaag

SEQ ID NO: 639783 - RNA, 22 nt, Human
accugggaggcagagguugcag

SEQ ID NO: 639784 - RNA, 22 nt, Human
uuugucauguuuuguaaugucu

SEQ ID NO: 639785 - RNA, 19 nt, Human
uucagcauuauauucuagc

SEQ ID NO: 639786 - RNA, 22 nt, Human
aggccugaggaccagauaaaug

SEQ ID NO: 639787 - RNA, 22 nt, Human
ugcaacauuauuaaacuaagca

SEQ ID NO: 639788 - RNA, 22 nt, Human
ugaagcagagugaaggugaauu

SEQ ID NO: 639789 - RNA, 22 nt, Human
gaggcagcucuucugaaugggg

SEQ ID NO: 639790 - RNA, 23 nt, Human
acuugauuauuguugauagauuc

SEQ ID NO: 639791 - RNA, 22 nt, Human
ucaggcagaccaccgugggcag

SEQ ID NO: 639792 - RNA, 22 nt, Human
caaggugaacuugcuguacagc

SEQ ID NO: 639793 - RNA, 22 nt, Human
caggccaggcugcauuugcccc

SEQ ID NO: 639794 - RNA, 22 nt, Human
aauuccaggguuagcucauuug

SEQ ID NO: 639795 - RNA, 22 nt, Human
agccagcuguguggucaggcaa

SEQ ID NO: 639796 - RNA, 22 nt, Human
ugcuuuauggagcccaucucau

SEQ ID NO: 639797 - RNA, 18 nt, Human
uaugagaagauuagcaau

SEQ ID NO: 639798 - RNA, 22 nt, Human
gcugaggagcgagaacucugcu

SEQ ID NO: 639799 - RNA, 22 nt, Human
agcuguggaagacugucagggu

SEQ ID NO: 639800 - RNA, 22 nt, Human
cuacucugaauugaagugauau

SEQ ID NO: 639801 - RNA, 22 nt, Human
augcuguguuuuaaauggaaau

SEQ ID NO: 639802 - RNA, 22 nt, Human
cgcuggggcuuuuugcuugaga

SEQ ID NO: 639803 - RNA, 23 nt, Human
uauuuggaaagagggaagaagac

SEQ ID NO: 639804 - RNA, 22 nt, Human
uuccaaagugcuggaauuacau

SEQ ID NO: 639805 - RNA, 18 nt, Human
ugagagugugugcucuug

SEQ ID NO: 639806 - RNA, 22 nt, Human
cccaggcuccugacucauucua

SEQ ID NO: 639807 - RNA, 22 nt, Human
augaaaugauugaaaucuuuac

SEQ ID NO: 639808 - RNA, 22 nt, Human
cauauuuaguguuuggagaucg

SEQ ID NO: 639809 - RNA, 22 nt, Human
uaauguuuuucucaacauugcu

SEQ ID NO: 639810 - RNA, 22 nt, Human
cagacuguagaguuugagaagu

SEQ ID NO: 639811 - RNA, 22 nt, Human
agcugcccuguggggaggguug

SEQ ID NO: 639812 - RNA, 22 nt, Human
caucacaggcauuuugaguguc

SEQ ID NO: 639813 - RNA, 22 nt, Human
aaggcaugauguaaucaaugau

SEQ ID NO: 639814 - RNA, 22 nt, Human
ugauuuuauuggugaggaaauu

SEQ ID NO: 639815 - RNA, 22 nt, Human
guacacauacuauucaaagaga

SEQ ID NO: 639816 - RNA, 19 nt, Human
uacuuauuagaaauauggg

SEQ ID NO: 639817 - RNA, 22 nt, Human
acagaauugauggaaaucucag

SEQ ID NO: 639818 - RNA, 22 nt, Human
aguaaauuucugcauguguacu

SEQ ID NO: 639819 - RNA, 22 nt, Human
aucacauuacaaaggacuccag

SEQ ID NO: 639820 - RNA, 22 nt, Human
cugggcacacucugcuccagcu

SEQ ID NO: 639821 - RNA, 22 nt, Human
gggaucugcuccagagggaaaa

SEQ ID NO: 639822 - RNA, 22 nt, Human
agacauauauugcaauucacug

SEQ ID NO: 639823 - RNA, 22 nt, Human
agcugugggauuugggugugcc

SEQ ID NO: 639824 - RNA, 19 nt, Human
agugaaauggaguauucaa

SEQ ID NO: 639825 - RNA, 22 nt, Human
ucagagccaaucauggugcauu

SEQ ID NO: 639826 - RNA, 22 nt, Human
uuuaauuguuguggguacauag

SEQ ID NO: 639827 - RNA, 22 nt, Human
uguugauuaguguuuagacuua

SEQ ID NO: 639828 - RNA, 22 nt, Human
auguuucugaguguauauacau

SEQ ID NO: 639829 - RNA, 22 nt, Human
gauccagcuucuacacagagcu

SEQ ID NO: 639830 - RNA, 22 nt, Human
aacuccucucuggugguucguc

SEQ ID NO: 639831 - RNA, 22 nt, Human
ggaaagggaguuuugcuuauga

SEQ ID NO: 639832 - RNA, 21 nt, Human
acugggcuagccugacuucug

SEQ ID NO: 639833 - RNA, 22 nt, Human
ucaugcuuaaaagacacuugag

SEQ ID NO: 639834 - RNA, 22 nt, Human
ucugggaguaaggccuaggcau

SEQ ID NO: 639835 - RNA, 22 nt, Human
ucugagccccuagaacugagcg

SEQ ID NO: 639836 - RNA, 22 nt, Human
aagaguuucugggucaaggauu

SEQ ID NO: 639837 - RNA, 22 nt, Human
uuauuccaaaucaugguugcau

SEQ ID NO: 639838 - RNA, 20 nt, Human
ucucaguuucuagagucagg

SEQ ID NO: 639839 - RNA, 22 nt, Human
ucuuucuguaagcuccauggaa

SEQ ID NO: 639840 - RNA, 22 nt, Human
gugggagcccucagggaggugc

SEQ ID NO: 639841 - RNA, 20 nt, Human
auucugcuuucugauagagc

SEQ ID NO: 639842 - RNA, 22 nt, Human
gagaggaauaucauuauauuag

SEQ ID NO: 639843 - RNA, 22 nt, Human
uuuguacauauaaaucuuguau

SEQ ID NO: 639844 - RNA, 22 nt, Human
guggggcugaguggagccagaa

SEQ ID NO: 639845 - RNA, 22 nt, Human
ggaggugacgaaaagaaauugu

SEQ ID NO: 639846 - RNA, 22 nt, Human
acagcagcugccuucaggcucu

SEQ ID NO: 639847 - RNA, 22 nt, Human
aaauguauccuacuuccugagu

SEQ ID NO: 639848 - RNA, 22 nt, Human
gcagcccucggguacucacgug

SEQ ID NO: 639849 - RNA, 22 nt, Human
ugucccagauacuggacauaga

SEQ ID NO: 639850 - RNA, 22 nt, Human
cuugcugggguaagucugugcu

SEQ ID NO: 639851 - RNA, 22 nt, Human
uggcucuuuucacguccccucu

SEQ ID NO: 639852 - RNA, 22 nt, Human
ucucucuucaacccuuaacuag

SEQ ID NO: 639853 - RNA, 22 nt, Human
aagacaauuuauguuaggguca

SEQ ID NO: 639854 - RNA, 22 nt, Human
ucagcaguagagggggcacagu

SEQ ID NO: 639855 - RNA, 22 nt, Human
caggaacuggaacccuggccga

SEQ ID NO: 639856 - RNA, 22 nt, Human
aaguggaagagaaguuaucuua

SEQ ID NO: 639857 - RNA, 22 nt, Human
uucucacaggauuucuuuuagu

SEQ ID NO: 639858 - RNA, 22 nt, Human
ucacugucuuuuaaggugguua

SEQ ID NO: 639859 - RNA, 22 nt, Human
gcugugcagucuuuggugugcc

SEQ ID NO: 639860 - RNA, 22 nt, Human
uccagucacuucauuuuacaga

SEQ ID NO: 639861 - RNA, 22 nt, Human
uggauaaacucacuguaaguug

SEQ ID NO: 639862 - RNA, 22 nt, Human
uacaaagcaaaucaucuaagag

SEQ ID NO: 639863 - RNA, 22 nt, Human
ugaugcuguuccaguuauauug

SEQ ID NO: 639864 - RNA, 22 nt, Human
ugcacacacggagauaggcuuu

SEQ ID NO: 639865 - RNA, 22 nt, Human
gcagcacauauaaacaaagaga

SEQ ID NO: 639866 - RNA, 22 nt, Human
ggcucuggaauguguagucagg

SEQ ID NO: 639867 - RNA, 19 nt, Human
ggacacagaaagcugcauu

SEQ ID NO: 639868 - RNA, 21 nt, Human
uagagccagugguguucugac

SEQ ID NO: 639869 - RNA, 22 nt, Human
gaagagcugcaguuuccugggc

SEQ ID NO: 639870 - RNA, 22 nt, Human
augugucuugagggggauggag

SEQ ID NO: 639871 - RNA, 22 nt, Human
auuagaagaggcugacgaaugu

SEQ ID NO: 639872 - RNA, 22 nt, Human
caaaagucuguccuuuaacuuc

SEQ ID NO: 639873 - RNA, 22 nt, Human
cagaggcuuauaccugauuagg

SEQ ID NO: 639874 - RNA, 22 nt, Human
ugccuagaacuuuauucuuuau

SEQ ID NO: 639875 - RNA, 22 nt, Human
acuccuggguugcaguccucaa

SEQ ID NO: 639876 - RNA, 22 nt, Human
guggcuuggaccagucacagug

SEQ ID NO: 639877 - RNA, 22 nt, Human
agcccuccaaagguugggggag

SEQ ID NO: 639878 - RNA, 22 nt, Human
cccaaguauuccuccucugccc

SEQ ID NO: 639879 - RNA, 22 nt, Human
augcacaagaggcuagaaaaga

SEQ ID NO: 639880 - RNA, 22 nt, Human
gcaggcaguuauuuaguagaau

SEQ ID NO: 639881 - RNA, 22 nt, Human
acugagcaaugcagugggagcg

SEQ ID NO: 639882 - RNA, 22 nt, Human
aacccauuaauccuugcaagca

SEQ ID NO: 639883 - RNA, 22 nt, Human
augucuguggcauuauauguuu

SEQ ID NO: 639884 - RNA, 22 nt, Human
aggaaagaaguacauucucaug

SEQ ID NO: 639885 - RNA, 21 nt, Human
ccagggauguugaacugaaag

SEQ ID NO: 639886 - RNA, 22 nt, Human
gccuaauaacuagcuguguaac

SEQ ID NO: 639887 - RNA, 23 nt, Human
auuuacagcugugugagcaaguu

SEQ ID NO: 639888 - RNA, 23 nt, Human
uuucagcauucuaguucagguuc

SEQ ID NO: 639889 - RNA, 22 nt, Human
uagaacuaaagaacaacuuuga

SEQ ID NO: 639890 - RNA, 21 nt, Human
uuucagaccuaucuuugaagg

SEQ ID NO: 639891 - RNA, 22 nt, Human
cacagaggcaugacccugcccu

SEQ ID NO: 639892 - RNA, 22 nt, Human
ucacaugcucaccuaagccaca

SEQ ID NO: 639893 - RNA, 22 nt, Human
aggucaagaguaaauuugggua

SEQ ID NO: 639894 - RNA, 22 nt, Human
caucuaauaccucauuuaaucu

SEQ ID NO: 639895 - RNA, 22 nt, Human
gcuuugcacagugcuguguuaa

SEQ ID NO: 639896 - RNA, 22 nt, Human
cgcgcugcagacagcggaggcc

SEQ ID NO: 639897 - RNA, 22 nt, Human
acucuucaugcuaugcucaacu

SEQ ID NO: 639898 - RNA, 22 nt, Human
uucugcucuuggcuuugcuggu

SEQ ID NO: 639899 - RNA, 22 nt, Human
agggucucugggaguagggcac

SEQ ID NO: 639900 - RNA, 22 nt, Human
ucuguguauaggguugugcgcu

SEQ ID NO: 639901 - RNA, 22 nt, Human
agaggccuuucuguugagugaa

SEQ ID NO: 639902 - RNA, 22 nt, Human
ggaagaagggucauuggcagcc

SEQ ID NO: 639903 - RNA, 22 nt, Human
caguuaccagaucgcaggaggu

SEQ ID NO: 639904 - RNA, 22 nt, Human
aucaugacauacuuuugagaag

SEQ ID NO: 639905 - RNA, 22 nt, Human
cagcaauaaugucuacaaaucu

SEQ ID NO: 639906 - RNA, 22 nt, Human
caacagaagguguacuacugaa

SEQ ID NO: 639907 - RNA, 22 nt, Human
cauuuacauaacaguaacgcug

SEQ ID NO: 639908 - RNA, 19 nt, Human
ucagucuaggaaugagcua

SEQ ID NO: 639909 - RNA, 22 nt, Human
cuacaaugacagaauugaguag

SEQ ID NO: 639910 - RNA, 22 nt, Human
aggagccaaacauauugagaga

SEQ ID NO: 639911 - RNA, 22 nt, Human
cuucauuaacuauuggaaugca

SEQ ID NO: 639912 - RNA, 22 nt, Human
aaaucaacuugugacguuaggu

SEQ ID NO: 639913 - RNA, 22 nt, Human
agcugccuguaaaaugugugau

SEQ ID NO: 639914 - RNA, 22 nt, Human
ucugagaagcgggagccuguga

SEQ ID NO: 639915 - RNA, 22 nt, Human
ggcuguggcagcuggaaguggu

SEQ ID NO: 639916 - RNA, 22 nt, Human
aaaugcaauuguauguacucca

SEQ ID NO: 639917 - RNA, 22 nt, Human
ccagagcuaaacacacaggcug

SEQ ID NO: 639918 - RNA, 22 nt, Human
gacacagcuuucugaagagcau

SEQ ID NO: 639919 - RNA, 22 nt, Human
ucccaagcaaugagucagggcc

SEQ ID NO: 639920 - RNA, 22 nt, Human
gaguagcauucuagaguaugcu

SEQ ID NO: 639921 - RNA, 22 nt, Human
uacacauauguguguauaugug

SEQ ID NO: 639922 - RNA, 22 nt, Human
uaggaaguagauagguuguucu

SEQ ID NO: 639923 - RNA, 22 nt, Human
caggucucccauccccucuguu

SEQ ID NO: 639924 - RNA, 22 nt, Human
gcacuucaccacuguccugguu

SEQ ID NO: 639925 - RNA, 22 nt, Human
ugacuccaaacagaaaacgaau

SEQ ID NO: 639926 - RNA, 22 nt, Human
aagaaaaucaguucuggucagu

SEQ ID NO: 639927 - RNA, 22 nt, Human
auguagcugcagaugauaaugc

SEQ ID NO: 639928 - RNA, 22 nt, Human
agcacagaaugagguggaagug

SEQ ID NO: 639929 - RNA, 22 nt, Human
aucaagagaaggggaagaugaa

SEQ ID NO: 639930 - RNA, 22 nt, Human
ucugggagaagcugaugugaag

SEQ ID NO: 639931 - RNA, 22 nt, Human
acuuguguuaccaagguuuggu

SEQ ID NO: 639932 - RNA, 22 nt, Human
uuucacauguggaaugccaggu

SEQ ID NO: 639933 - RNA, 22 nt, Human
uagcacaaguaucugcuuuucc

SEQ ID NO: 639934 - RNA, 22 nt, Human
agggccugucuguagaacugaa

SEQ ID NO: 639935 - RNA, 22 nt, Human
uggcagagguauauugggagga

SEQ ID NO: 639936 - RNA, 22 nt, Human
ugaacaguuucaagaaaacuuu

SEQ ID NO: 639937 - RNA, 22 nt, Human
ucacucucuaagcaugacagac

SEQ ID NO: 639938 - RNA, 22 nt, Human
aagcagcauccugggcagaccu

SEQ ID NO: 639939 - RNA, 22 nt, Human
gucugcuuuuguuuuacuggua

SEQ ID NO: 639940 - RNA, 22 nt, Human
auguuaaauaaucccuuaaagc

SEQ ID NO: 639941 - RNA, 22 nt, Human
gagcuggccucaggcacaggag

SEQ ID NO: 639942 - RNA, 22 nt, Human
cuccaggcuggggugcagguug

SEQ ID NO: 639943 - RNA, 23 nt, Human
uugauuucaaaugcagagaacac

SEQ ID NO: 639944 - RNA, 22 nt, Human
aagcagcacagcaaugacucua

SEQ ID NO: 639945 - RNA, 22 nt, Human
ggcauccaaauaccaagaugua

SEQ ID NO: 639946 - RNA, 22 nt, Human
uucauugauuccaggcucuucu

SEQ ID NO: 639947 - RNA, 22 nt, Human
cugccuggggaaugugaggauu

SEQ ID NO: 639948 - RNA, 22 nt, Human
ucagaggucacacagcaaguuu

SEQ ID NO: 639949 - RNA, 22 nt, Human
ggccccagguagaagauauaga

SEQ ID NO: 639950 - RNA, 21 nt, Human
uagguauuucuaucaugucuc

SEQ ID NO: 639951 - RNA, 17 nt, Human
aagacccuagucuaccc

SEQ ID NO: 639952 - RNA, 22 nt, Human
ggucuucaggucuaguugguau

SEQ ID NO: 639953 - RNA, 22 nt, Human
cagcuugaaauauuaggagaug

SEQ ID NO: 639954 - RNA, 22 nt, Human
gaggagacauauuuuugaagca

SEQ ID NO: 639955 - RNA, 22 nt, Human
cugaagaaauaugauugcuuaa

SEQ ID NO: 639956 - RNA, 23 nt, Human
uccuucagagccucccuccaagc

SEQ ID NO: 639957 - RNA, 22 nt, Human
cuuccuggcaugggucucauga

SEQ ID NO: 639958 - RNA, 22 nt, Human
cuuuacacaaugauuuucuuua

SEQ ID NO: 639959 - RNA, 22 nt, Human
ucagaaaccccaacaauggaga

SEQ ID NO: 639960 - RNA, 22 nt, Human
gucuggagccacugcugcugcu

SEQ ID NO: 639961 - RNA, 22 nt, Human
uggcuucugucccugcuacauu

SEQ ID NO: 639962 - RNA, 22 nt, Human
gcuguaugugaggccacaguga

SEQ ID NO: 639963 - RNA, 22 nt, Human
aaacucuaguuaugaaguuugu

SEQ ID NO: 639964 - RNA, 22 nt, Human
ugggccacgucaucucccacaa

SEQ ID NO: 639965 - RNA, 23 nt, Human
auuucuaggggauuuucuggugc

SEQ ID NO: 639966 - RNA, 22 nt, Human
guuagaccauagaaagagcauc

SEQ ID NO: 639967 - RNA, 22 nt, Human
cugagguccuugacugcuugcc

SEQ ID NO: 639968 - RNA, 22 nt, Human
uccugaauuucccagcaugaac

SEQ ID NO: 639969 - RNA, 18 nt, Human
guccacagauucuucacu

SEQ ID NO: 639970 - RNA, 22 nt, Human
ggaagaaagacauuuauuuuga

SEQ ID NO: 639971 - RNA, 22 nt, Human
acauuucuggaguuucucaaca

SEQ ID NO: 639972 - RNA, 17 nt, Human
caucuuuaaaauccuga

SEQ ID NO: 639973 - RNA, 22 nt, Human
uucaaugcauauagauauagaa

SEQ ID NO: 639974 - RNA, 22 nt, Human
cacaggcucuucucacuugauu

SEQ ID NO: 639975 - RNA, 22 nt, Human
caggcagcguccugcuuccugu

SEQ ID NO: 639976 - RNA, 22 nt, Human
ggaaacugcuuacacuagaggg

SEQ ID NO: 639977 - RNA, 22 nt, Human
ggcuggcauccagggaaaucca

SEQ ID NO: 639978 - RNA, 22 nt, Human
augaucagggcagaagcagaag

SEQ ID NO: 639979 - RNA, 22 nt, Human
cuccuucaaaagucauaguaaa

SEQ ID NO: 639980 - RNA, 22 nt, Human
gcagccucagggcacucagaug

SEQ ID NO: 639981 - RNA, 22 nt, Human
uuucagaccugcugugcuaucu

SEQ ID NO: 639982 - RNA, 22 nt, Human
ggcucuggguaaggcguuugac

SEQ ID NO: 639983 - RNA, 22 nt, Human
agauccaggguuggauuugcau

SEQ ID NO: 639984 - RNA, 22 nt, Human
gagcucaguguagucauggcuu

SEQ ID NO: 639985 - RNA, 22 nt, Human
aaaacacaagaagcaggguaca

SEQ ID NO: 639986 - RNA, 22 nt, Human
cugcuaaaccucucugagagcu

SEQ ID NO: 639987 - RNA, 22 nt, Human
uuaagagggugaugcuagcauu

SEQ ID NO: 639988 - RNA, 22 nt, Human
cagcagcuaaggcauguuccug

SEQ ID NO: 639989 - RNA, 22 nt, Human
ugaaacugaaagguauuuauag

SEQ ID NO: 639990 - RNA, 22 nt, Human
uccaucaggcucgugggcucuc

SEQ ID NO: 639991 - RNA, 22 nt, Human
ccuucagucccauguuucucuu

SEQ ID NO: 639992 - RNA, 22 nt, Human
ucuagggaacaugggucaagcu

SEQ ID NO: 639993 - RNA, 22 nt, Human
agcagggccucuggcacugguc

SEQ ID NO: 639994 - RNA, 22 nt, Human
uucaggaagguccuauagcaga

SEQ ID NO: 639995 - RNA, 22 nt, Human
agaggccacaccagccucccgu

SEQ ID NO: 639996 - RNA, 22 nt, Human
gacuguuagaauguaaaauaua

SEQ ID NO: 639997 - RNA, 22 nt, Human
cagugacguaaacugcaugugc

SEQ ID NO: 639998 - RNA, 22 nt, Human
uugcaaaaacugcaauuacuuu

SEQ ID NO: 639999 - RNA, 22 nt, Human
aagcucucuguccccuggacug

SEQ ID NO: 640000 - RNA, 22 nt, Human
uuccuggggcgacuguaucuga

SEQ ID NO: 640001 - RNA, 22 nt, Human
gcugaggaggugugguuaggug

SEQ ID NO: 640002 - RNA, 22 nt, Human
acuuggaaagaugcaacacagu

SEQ ID NO: 640003 - RNA, 17 nt, Human
uguucucuucagaaauc

SEQ ID NO: 640004 - RNA, 22 nt, Human
cacaguggaaguccaggauccc

SEQ ID NO: 640005 - RNA, 21 nt, Human
uccugccuuaguccagagcag

SEQ ID NO: 640006 - RNA, 22 nt, Human
ggaaggcagugaaggggcugau

SEQ ID NO: 640007 - RNA, 22 nt, Human
augaggcagcugcuggagaacg

SEQ ID NO: 640008 - RNA, 22 nt, Human
aaauugcuggauccuacuccca

SEQ ID NO: 640009 - RNA, 22 nt, Human
gaggcugcaggcaaugcugccc

SEQ ID NO: 640010 - RNA, 22 nt, Human
cuggggcugcgguggaggagcc

SEQ ID NO: 640011 - RNA, 22 nt, Human
cuuucuuuguccaccaacaaug

SEQ ID NO: 640012 - RNA, 19 nt, Human
ucucacaucagcuccuagc

SEQ ID NO: 640013 - RNA, 20 nt, Human
ccuucagaacuuacauagua

SEQ ID NO: 640014 - RNA, 22 nt, Human
auacuuuuaauuccuucugagu

SEQ ID NO: 640015 - RNA, 22 nt, Human
aggcuaggaaucaagccuuucu

SEQ ID NO: 640016 - RNA, 23 nt, Human
ugcaggacuacucgagcacugcu

SEQ ID NO: 640017 - RNA, 22 nt, Human
cacaugaucacuucuugaaaau

SEQ ID NO: 640018 - RNA, 22 nt, Human
gccaguguuuauagcagugagg

SEQ ID NO: 640019 - RNA, 22 nt, Human
ccuuuacaguaugguuguauca

SEQ ID NO: 640020 - RNA, 22 nt, Human
uccucuucaaaaggauuuccuu

SEQ ID NO: 640021 - RNA, 19 nt, Human
aacauggaacuggagaggg

SEQ ID NO: 640022 - RNA, 21 nt, Human
uggcacugcuuagcagguucc

SEQ ID NO: 640023 - RNA, 22 nt, Human
agaucacagagccaagauucca

SEQ ID NO: 640024 - RNA, 22 nt, Human
auuuggaacuuauaauaaguuu

SEQ ID NO: 640025 - RNA, 22 nt, Human
ccagcucucaaggcucccuggg

SEQ ID NO: 640026 - RNA, 22 nt, Human
gggaagaguaacuagcccaugu

SEQ ID NO: 640027 - RNA, 22 nt, Human
ggucccaggauugguugcgcag

SEQ ID NO: 640028 - RNA, 22 nt, Human
auuuguacaaauuuauguuagu

SEQ ID NO: 640029 - RNA, 22 nt, Human
uaaccugcaacagaucugucuu

SEQ ID NO: 640030 - RNA, 22 nt, Human
uuuugugagaugcguaugaaug

SEQ ID NO: 640031 - RNA, 22 nt, Human
uacaugcuuccaacugccccau

SEQ ID NO: 640032 - RNA, 22 nt, Human
gacagcuggcaguggaaaggug

SEQ ID NO: 640033 - RNA, 22 nt, Human
acaguggggucuuaauagaaca

SEQ ID NO: 640034 - RNA, 22 nt, Human
uugcagaacuuaaagacagagu

SEQ ID NO: 640035 - RNA, 20 nt, Human
cccaggcagagcuagcggca

SEQ ID NO: 640036 - RNA, 22 nt, Human
cugggcugcaucaaagaggcau

SEQ ID NO: 640037 - RNA, 22 nt, Human
aggcgcugcgcuggggccagaa

SEQ ID NO: 640038 - RNA, 21 nt, Human
uggcagagugcagucuauaca

SEQ ID NO: 640039 - RNA, 22 nt, Human
cugacccauauaagaguggagg

SEQ ID NO: 640040 - RNA, 22 nt, Human
gagucuuugguaaagucugcug

SEQ ID NO: 640041 - RNA, 22 nt, Human
agaauacaucuagugcugcaug

SEQ ID NO: 640042 - RNA, 22 nt, Human
ucucacagcaucauugcucaug

SEQ ID NO: 640043 - RNA, 22 nt, Human
ggggcucacaccucccuaaggg

SEQ ID NO: 640044 - RNA, 22 nt, Human
cuaauuuaaugaaugagucuua

SEQ ID NO: 640045 - RNA, 22 nt, Human
uaugacauugcuuuuuagaacu

SEQ ID NO: 640046 - RNA, 22 nt, Human
ucacacacauggauaguauuuu

SEQ ID NO: 640047 - RNA, 22 nt, Human
ugcuucugaaguggaugggugc

SEQ ID NO: 640048 - RNA, 22 nt, Human
ucccuggggcaguggcucggag

SEQ ID NO: 640049 - RNA, 20 nt, Human
cguccccuugagcagguccc

SEQ ID NO: 640050 - RNA, 22 nt, Human
gagcaacaguuuaugguuuuuc

SEQ ID NO: 640051 - RNA, 22 nt, Human
ugggacagugugccuugcuccu

SEQ ID NO: 640052 - RNA, 22 nt, Human
uggcaacaccuggaagacaugg

SEQ ID NO: 640053 - RNA, 22 nt, Human
gucugccuggaggcagcugcug

SEQ ID NO: 640054 - RNA, 22 nt, Human
ggacacaagcuccggggcugca

SEQ ID NO: 640055 - RNA, 20 nt, Human
cuacuuuaggcacugagaau

SEQ ID NO: 640056 - RNA, 22 nt, Human
agucuucacucuucacuacuau

SEQ ID NO: 640057 - RNA, 22 nt, Human
ucccucugguccucgguggaga

SEQ ID NO: 640058 - RNA, 22 nt, Human
uaguggggccugggaggguucc

SEQ ID NO: 640059 - RNA, 23 nt, Human
aacugcaagguugcugggaagua

SEQ ID NO: 640060 - RNA, 22 nt, Human
cagauauaguggcuugccuggg

SEQ ID NO: 640061 - RNA, 22 nt, Human
aggacuaauuucaggggauaua

SEQ ID NO: 640062 - RNA, 23 nt, Human
auucagaauuguguguuuguaua

SEQ ID NO: 640063 - RNA, 22 nt, Human
cuggcagcuggaggcuagaggc

SEQ ID NO: 640064 - RNA, 22 nt, Human
ugcuuucaaaggcuuucuagau

SEQ ID NO: 640065 - RNA, 22 nt, Human
uguguguuaacuuauuuaaugu

SEQ ID NO: 640066 - RNA, 22 nt, Human
uuuauugaguaucuacuaugug

SEQ ID NO: 640067 - RNA, 17 nt, Human
ccuguguuugcuccuuc

SEQ ID NO: 640068 - RNA, 22 nt, Human
uucuggaaccaacaugccaguu

SEQ ID NO: 640069 - RNA, 22 nt, Human
agccagggcugcgagcagacag

SEQ ID NO: 640070 - RNA, 22 nt, Human
uaaagcauguuucaguaagguu

SEQ ID NO: 640071 - RNA, 23 nt, Human
cagaaagcccuuuccccacagua

SEQ ID NO: 640072 - RNA, 22 nt, Human
aaaagagucuuaggcagucaua

SEQ ID NO: 640073 - RNA, 22 nt, Human
uggcauguucucuuagcagcuc

SEQ ID NO: 640074 - RNA, 21 nt, Human
ccugagggugguugugaagau

SEQ ID NO: 640075 - RNA, 22 nt, Human
uuacaguaauguauuauuuaac

SEQ ID NO: 640076 - RNA, 22 nt, Human
aucaguuuaaaugggcuguugg

SEQ ID NO: 640077 - RNA, 22 nt, Human
ccuggacuuucaggacuacugu

SEQ ID NO: 640078 - RNA, 22 nt, Human
uucaguuggccauaccccuaga

SEQ ID NO: 640079 - RNA, 22 nt, Human
cuuuuacacucaucugggaggg

SEQ ID NO: 640080 - RNA, 22 nt, Human
uugaggucuugaguacugggga

SEQ ID NO: 640081 - RNA, 22 nt, Human
cugcugggggacacagguccgg

SEQ ID NO: 640082 - RNA, 22 nt, Human
caggcugaggguuaggccuuag

SEQ ID NO: 640083 - RNA, 22 nt, Human
gcccaggacucagggugucgcg

SEQ ID NO: 640084 - RNA, 17 nt, Human
cagggcugucugccuag

SEQ ID NO: 640085 - RNA, 22 nt, Human
uuacuguuuugguaccucauug

SEQ ID NO: 640086 - RNA, 22 nt, Human
agauggagaaugacaauuaagg

SEQ ID NO: 640087 - RNA, 22 nt, Human
uuuacuguucaacuugcaagua

SEQ ID NO: 640088 - RNA, 22 nt, Human
uaauacacugcuuuuuguaacu

SEQ ID NO: 640089 - RNA, 22 nt, Human
guucacauccuugugaggauuu

SEQ ID NO: 640090 - RNA, 22 nt, Human
gaaguagauucguugcaucuug

SEQ ID NO: 640091 - RNA, 22 nt, Human
aggcucagcugguggugaucgc

SEQ ID NO: 640092 - RNA, 22 nt, Human
agagacugauggaucaccaaau

SEQ ID NO: 640093 - RNA, 22 nt, Human
auccugggaagcugacauugaa

SEQ ID NO: 640094 - RNA, 22 nt, Human
uccauguggccagacacuggca

SEQ ID NO: 640095 - RNA, 22 nt, Human
cacagagauuagaauuagacua

SEQ ID NO: 640096 - RNA, 22 nt, Human
uggcucagcgguggcagcagac

SEQ ID NO: 640097 - RNA, 22 nt, Human
ggccaugccaggcugccuggga

SEQ ID NO: 640098 - RNA, 22 nt, Human
aggcuagauagagggucaucuu

SEQ ID NO: 640099 - RNA, 23 nt, Human
uuauggagugccagacauuuggc

SEQ ID NO: 640100 - RNA, 22 nt, Human
uuuauuagauuaucaaagaggu

SEQ ID NO: 640101 - RNA, 22 nt, Human
acacagagcaaaucaugacaga

SEQ ID NO: 640102 - RNA, 16 nt, Human
uggcagagguucagcc

SEQ ID NO: 640103 - RNA, 22 nt, Human
cagacagagucuucccaucagu

SEQ ID NO: 640104 - RNA, 22 nt, Human
acagucucuccacacugcaggg

SEQ ID NO: 640105 - RNA, 22 nt, Human
agacagugagaaugaguugaaa

SEQ ID NO: 640106 - RNA, 20 nt, Human
cacugaagacuucuugcuca

SEQ ID NO: 640107 - RNA, 22 nt, Human
gggggcgggagacagcagugac

SEQ ID NO: 640108 - RNA, 21 nt, Human
acagaacuguauagugauaaa

SEQ ID NO: 640109 - RNA, 17 nt, Human
uggucauuuuaauuuua

SEQ ID NO: 640110 - RNA, 19 nt, Human
ggagccagcuguggaaggc

SEQ ID NO: 640111 - RNA, 22 nt, Human
aguacaaguagaaugcuacaag

SEQ ID NO: 640112 - RNA, 22 nt, Human
gcuccccauugaucugcaggcu

SEQ ID NO: 640113 - RNA, 19 nt, Human
agucucuucggaggagguu

SEQ ID NO: 640114 - RNA, 22 nt, Human
acguagcacugagagaugcagg

SEQ ID NO: 640115 - RNA, 22 nt, Human
uggcugagagaagacggggaag

SEQ ID NO: 640116 - RNA, 22 nt, Human
uagcagcaggggaaacagcugu

SEQ ID NO: 640117 - RNA, 22 nt, Human
auggaaagcuaagccauuuacc

SEQ ID NO: 640118 - RNA, 22 nt, Human
gggagaguagcuggaagguucu

SEQ ID NO: 640119 - RNA, 22 nt, Human
ccuuugguaacauuccaaccuu

SEQ ID NO: 640120 - RNA, 22 nt, Human
aucagagaccggucaagucaug

SEQ ID NO: 640121 - RNA, 23 nt, Human
aaacuucaguagugucaucagcc

SEQ ID NO: 640122 - RNA, 19 nt, Human
cagaacaggaccaggggcc

SEQ ID NO: 640123 - RNA, 22 nt, Human
cuguuuauucucaucuaaaaug

SEQ ID NO: 640124 - RNA, 22 nt, Human
uguauuuaguccagucucucau

SEQ ID NO: 640125 - RNA, 22 nt, Human
aagacugucuuuucugagugac

SEQ ID NO: 640126 - RNA, 22 nt, Human
acagcagcaauagcagugacau

SEQ ID NO: 640127 - RNA, 22 nt, Human
uuucaugagauuccuccacauc

SEQ ID NO: 640128 - RNA, 22 nt, Human
ggaggccaggugggagucaucu

SEQ ID NO: 640129 - RNA, 22 nt, Human
ccuggcagguggcgcccucggc

SEQ ID NO: 640130 - RNA, 22 nt, Human
agaggcaaguucagagcuagga

SEQ ID NO: 640131 - RNA, 22 nt, Human
ucaauagauaaagcuacauaaa

SEQ ID NO: 640132 - RNA, 22 nt, Human
gcagcuuuguaaaguaugaagc

SEQ ID NO: 640133 - RNA, 22 nt, Human
acucugagccaccagaucccca

SEQ ID NO: 640134 - RNA, 21 nt, Human
uagcaaagccagauguauauu

SEQ ID NO: 640135 - RNA, 22 nt, Human
uccuucagcugcuaggaaauga

SEQ ID NO: 640136 - RNA, 22 nt, Human
agagcuucacuggagagcacau

SEQ ID NO: 640137 - RNA, 22 nt, Human
guuccugaagggacuggugcag

SEQ ID NO: 640138 - RNA, 22 nt, Human
gaccauuuuuacagagcauuca

SEQ ID NO: 640139 - RNA, 22 nt, Human
uggguccuugccaucuuggagu

SEQ ID NO: 640140 - RNA, 22 nt, Human
gcccagcuccauucuuggugag

SEQ ID NO: 640141 - RNA, 22 nt, Human
ucugggugacccugggcaaggc

SEQ ID NO: 640142 - RNA, 22 nt, Human
cuuuuuguuguauaagcccuuu

SEQ ID NO: 640143 - RNA, 22 nt, Human
cagccaggcccagaucaugcug

SEQ ID NO: 640144 - RNA, 22 nt, Human
gccuaacuuggcuuuguucacc

SEQ ID NO: 640145 - RNA, 22 nt, Human
cagcaucaccgccauuucugau

SEQ ID NO: 640146 - RNA, 22 nt, Human
ccugggcugaagucaagugugg

SEQ ID NO: 640147 - RNA, 22 nt, Human
cccaagggguguugauggagga

SEQ ID NO: 640148 - RNA, 22 nt, Human
uuuucucuuguuaauguacuga

SEQ ID NO: 640149 - RNA, 22 nt, Human
ccucucuguagcagcccccagu

SEQ ID NO: 640150 - RNA, 22 nt, Human
agaugagaauuuuuagagugcu

SEQ ID NO: 640151 - RNA, 22 nt, Human
accaagcuagaacauuacaggc

SEQ ID NO: 640152 - RNA, 22 nt, Human
ugcacagaucugguggcaagga

SEQ ID NO: 640153 - RNA, 22 nt, Human
cacuggugccagagaacagaau

SEQ ID NO: 640154 - RNA, 22 nt, Human
augaccugaggccuuacucuag

SEQ ID NO: 640155 - RNA, 22 nt, Human
uauggcuuucaaaggaacucgg

SEQ ID NO: 640156 - RNA, 22 nt, Human
uuuaaaaucagaugggaguugg

SEQ ID NO: 640157 - RNA, 19 nt, Human
aauaagcuuggguaaaacu

SEQ ID NO: 640158 - RNA, 22 nt, Human
ugaaaugauaucugauaacaaa

SEQ ID NO: 640159 - RNA, 22 nt, Human
aagcauuugguucugaagacuc

SEQ ID NO: 640160 - RNA, 22 nt, Human
uuugggaaacuuaggggucaga

SEQ ID NO: 640161 - RNA, 22 nt, Human
agggccagcugcagaauuagca

SEQ ID NO: 640162 - RNA, 22 nt, Human
ugaugaaugucauacauaauga

SEQ ID NO: 640163 - RNA, 22 nt, Human
ucuggcccugcugcugugagca

SEQ ID NO: 640164 - RNA, 22 nt, Human
gcugcccugccucagacuccuc

SEQ ID NO: 640165 - RNA, 22 nt, Human
agagaaggguagcccauucucc

SEQ ID NO: 640166 - RNA, 22 nt, Human
cauaauuaaauucugggcaaga

SEQ ID NO: 640167 - RNA, 22 nt, Human
uaaccuacaugagaacuuuaaa

SEQ ID NO: 640168 - RNA, 22 nt, Human
ugaaaugauguacaagaaggca

SEQ ID NO: 640169 - RNA, 22 nt, Human
ucugggauaagaccacagauuu

SEQ ID NO: 640170 - RNA, 22 nt, Human
cugccauguuaccugcacaggu

SEQ ID NO: 640171 - RNA, 22 nt, Human
uuucucccuuuauaagacugua

SEQ ID NO: 640172 - RNA, 22 nt, Human
ucccagaaucuuuggaagagca

SEQ ID NO: 640173 - RNA, 22 nt, Human
uagcaucagccacaccuuguac

SEQ ID NO: 640174 - RNA, 22 nt, Human
acaucauuucuaguuccuguca

SEQ ID NO: 640175 - RNA, 22 nt, Human
agucacaguuccuacccaguaa

SEQ ID NO: 640176 - RNA, 22 nt, Human
ccagggcugagacuguauuggg

SEQ ID NO: 640177 - RNA, 22 nt, Human
agcagcagauuauggucuacau

SEQ ID NO: 640178 - RNA, 22 nt, Human
agagccaggcucccauggggca

SEQ ID NO: 640179 - RNA, 22 nt, Human
agugcuggaaagggacggagga

SEQ ID NO: 640180 - RNA, 22 nt, Human
uaauuuuaauaguauguggcau

SEQ ID NO: 640181 - RNA, 17 nt, Human
auuucacuuagcaugag

SEQ ID NO: 640182 - RNA, 22 nt, Human
aggcucagcccaagguggagag

SEQ ID NO: 640183 - RNA, 22 nt, Human
agaguguuucagucuuccuaga

SEQ ID NO: 640184 - RNA, 22 nt, Human
gacuuuaaaaguuugugcuugg

SEQ ID NO: 640185 - RNA, 20 nt, Human
aacauugcuucaauguaacc

SEQ ID NO: 640186 - RNA, 22 nt, Human
cuggagcagguuuaggaguccc

SEQ ID NO: 640187 - RNA, 22 nt, Human
uguuuugguuuucaccgagucc

SEQ ID NO: 640188 - RNA, 22 nt, Human
uuuauagucgucucaguaauaa

SEQ ID NO: 640189 - RNA, 22 nt, Human
cugggccagaccuuguggucuu

SEQ ID NO: 640190 - RNA, 22 nt, Human
uggcagcaguggagguagaaag

SEQ ID NO: 640191 - RNA, 22 nt, Human
acaggccuacgaagucaggugc

SEQ ID NO: 640192 - RNA, 22 nt, Human
agaugaauccacacauggcaaa

SEQ ID NO: 640193 - RNA, 22 nt, Human
augauucucugcuacucuaaau

SEQ ID NO: 640194 - RNA, 19 nt, Human
cagaguuacauggcugugg

SEQ ID NO: 640195 - RNA, 22 nt, Human
ugaagaaucccagggaauuugg

SEQ ID NO: 640196 - RNA, 19 nt, Human
ggacauuugaguuguuuau

SEQ ID NO: 640197 - RNA, 19 nt, Human
ugugugcccucaccacaua

SEQ ID NO: 640198 - RNA, 23 nt, Human
gcccauggagucuggaucuggcc

SEQ ID NO: 640199 - RNA, 22 nt, Human
ucccaguggugggugcacauuu

SEQ ID NO: 640200 - RNA, 22 nt, Human
agaucagaaagccaauaucaua

SEQ ID NO: 640201 - RNA, 22 nt, Human
aguuucucucaguauagaauag

SEQ ID NO: 640202 - RNA, 17 nt, Human
agcaccuguccaguccc

SEQ ID NO: 640203 - RNA, 22 nt, Human
auaugcuuccaaguuauuccac

SEQ ID NO: 640204 - RNA, 22 nt, Human
gagacaucauaaugaaguuucc

SEQ ID NO: 640205 - RNA, 18 nt, Human
agcugcuuuuggcuuaaa

SEQ ID NO: 640206 - RNA, 22 nt, Human
gggggagcuguuauuggcaggg

SEQ ID NO: 640207 - RNA, 22 nt, Human
uaugcauaauuggauaaguaga

SEQ ID NO: 640208 - RNA, 22 nt, Human
gcuguggcccuuggcaucugcg

SEQ ID NO: 640209 - RNA, 22 nt, Human
auaacagaguugggaagugaaa

SEQ ID NO: 640210 - RNA, 22 nt, Human
cuuuggcaacacaugugggaca

SEQ ID NO: 640211 - RNA, 21 nt, Human
ucauauuucucuugcuauugu

SEQ ID NO: 640212 - RNA, 22 nt, Human
ggcaaaguuuucaucucauaac

SEQ ID NO: 640213 - RNA, 22 nt, Human
gcuucccaaacuuguggauaga

SEQ ID NO: 640214 - RNA, 22 nt, Human
aggcuucauguagaugguuccc

SEQ ID NO: 640215 - RNA, 22 nt, Human
uguucaaaaauaucuucugcaa

SEQ ID NO: 640216 - RNA, 18 nt, Human
ucucaaaaauaauggcuu

SEQ ID NO: 640217 - RNA, 22 nt, Human
uuacaaugaugggauucagcca

SEQ ID NO: 640218 - RNA, 22 nt, Human
uagauugauugcaaagacaggc

SEQ ID NO: 640219 - RNA, 22 nt, Human
gaccaccagagguccgugggua

SEQ ID NO: 640220 - RNA, 20 nt, Human
uccaggcagacagcuauggg

SEQ ID NO: 640221 - RNA, 22 nt, Human
agcuggccggccuccaggugga

SEQ ID NO: 640222 - RNA, 22 nt, Human
ucugauauaaaagugacauuca

SEQ ID NO: 640223 - RNA, 22 nt, Human
uucuguggcaguuugggaggug

SEQ ID NO: 640224 - RNA, 22 nt, Human
caugcaucgaugaaugcguggg

SEQ ID NO: 640225 - RNA, 22 nt, Human
cagugcagguggcagaggacag

SEQ ID NO: 640226 - RNA, 22 nt, Human
aauagcauuuuuaagggaauca

SEQ ID NO: 640227 - RNA, 22 nt, Human
uuucacaggccuuuuguagccc

SEQ ID NO: 640228 - RNA, 22 nt, Human
uugucugaagucacacagaugc

SEQ ID NO: 640229 - RNA, 22 nt, Human
guccaaauuuuucacauguaga

SEQ ID NO: 640230 - RNA, 23 nt, Human
auauucacgccgccagagguccc

SEQ ID NO: 640231 - RNA, 22 nt, Human
ggcacugagcgggcucugagcg

SEQ ID NO: 640232 - RNA, 18 nt, Human
acagaacucaggggcacc

SEQ ID NO: 640233 - RNA, 22 nt, Human
agugcuggcccauagcugcugg

SEQ ID NO: 640234 - RNA, 22 nt, Human
ugcaauaacccaguaucuguga

SEQ ID NO: 640235 - RNA, 22 nt, Human
gaggcucaccuagggagcacug

SEQ ID NO: 640236 - RNA, 23 nt, Human
ucucagaaaggagaaguaauuug

SEQ ID NO: 640237 - RNA, 18 nt, Human
ggagagugacagagucgu

SEQ ID NO: 640238 - RNA, 22 nt, Human
gaggcugguaggaaaggaaaca

SEQ ID NO: 640239 - RNA, 21 nt, Human
uccuccuucaaguccuggccu

SEQ ID NO: 640240 - RNA, 22 nt, Human
uguuuauagauggccacaauga

SEQ ID NO: 640241 - RNA, 22 nt, Human
gagagugagauccuccugggga

SEQ ID NO: 640242 - RNA, 22 nt, Human
ucuuucuuauuaugcucaaugu

SEQ ID NO: 640243 - RNA, 17 nt, Human
ugugcauagaauaauga

SEQ ID NO: 640244 - RNA, 20 nt, Human
ucuuggagaggguggacuua

SEQ ID NO: 640245 - RNA, 22 nt, Human
uauccauaguuuauagaucaag

SEQ ID NO: 640246 - RNA, 22 nt, Human
ugcucagacuuaagaagaucag

SEQ ID NO: 640247 - RNA, 22 nt, Human
ugcacugauccugaccagugaa

SEQ ID NO: 640248 - RNA, 22 nt, Human
cagaugaacucuauccuguggc

SEQ ID NO: 640249 - RNA, 22 nt, Human
gcaguagugucaguacagcaaa

SEQ ID NO: 640250 - RNA, 22 nt, Human
agggacgccgugcgggaccgug

SEQ ID NO: 640251 - RNA, 22 nt, Human
gcuauuuauuaaaauagugaag

SEQ ID NO: 640252 - RNA, 22 nt, Human
ggccagcccagugguccucucu

SEQ ID NO: 640253 - RNA, 22 nt, Human
uugaaugaauaaaagaguaagg

SEQ ID NO: 640254 - RNA, 22 nt, Human
uaagcaaaggauuuugaucuuu

SEQ ID NO: 640255 - RNA, 23 nt, Human
acuuuagauaaauuaugugcaca

SEQ ID NO: 640256 - RNA, 21 nt, Human
ucucuguauccauggguucca

SEQ ID NO: 640257 - RNA, 22 nt, Human
augaaauuugcugcuaaguucc

SEQ ID NO: 640258 - RNA, 22 nt, Human
uaaggcagcugagcuucuaaca

SEQ ID NO: 640259 - RNA, 22 nt, Human
ccugggagccgacugacugugc

SEQ ID NO: 640260 - RNA, 17 nt, Human
ugcuccuguggcagccu

SEQ ID NO: 640261 - RNA, 22 nt, Human
ccucuguguccuggucauugaa

SEQ ID NO: 640262 - RNA, 22 nt, Human
cagcacuucagcauucagauuu

SEQ ID NO: 640263 - RNA, 22 nt, Human
uccugaauuguugagaagcagc

SEQ ID NO: 640264 - RNA, 22 nt, Human
agauuuguugugagcaggaaua

SEQ ID NO: 640265 - RNA, 22 nt, Human
uaaggcagguaugguaccaggc

SEQ ID NO: 640266 - RNA, 22 nt, Human
cuccaggagggcuuccugugau

SEQ ID NO: 640267 - RNA, 22 nt, Human
agaauacaauuguucaguaaua

SEQ ID NO: 640268 - RNA, 22 nt, Human
cugagaggcggagcuugcagug

SEQ ID NO: 640269 - RNA, 22 nt, Human
auugugaauugagaguacuucu

SEQ ID NO: 640270 - RNA, 22 nt, Human
ccaggccagcaggcacaccugc

SEQ ID NO: 640271 - RNA, 19 nt, Human
aucuuuggguccugaaggg

SEQ ID NO: 640272 - RNA, 22 nt, Human
cuggucaugccagguuugcugc

SEQ ID NO: 640273 - RNA, 22 nt, Human
cagcaggagcagucagacuccu

SEQ ID NO: 640274 - RNA, 22 nt, Human
gcugcagcuguaggacacaauu

SEQ ID NO: 640275 - RNA, 22 nt, Human
cugcaaaagucauugugguuuu

SEQ ID NO: 640276 - RNA, 22 nt, Human
uucuuuucaagaggggcaagga

SEQ ID NO: 640277 - RNA, 22 nt, Human
uaacaauaguguuugcuaguca

SEQ ID NO: 640278 - RNA, 22 nt, Human
ugcaguuuuggccauugaaggc

SEQ ID NO: 640279 - RNA, 22 nt, Human
auucaguguaguuauuaucuuu

SEQ ID NO: 640280 - RNA, 22 nt, Human
uucucuggcgguguguuuuccu

SEQ ID NO: 640281 - RNA, 22 nt, Human
cugucauuuucuuccaauauaa

SEQ ID NO: 640282 - RNA, 22 nt, Human
agucucagggccacccggggaa

SEQ ID NO: 640283 - RNA, 22 nt, Human
ccagugugcaaucucuggcuua

SEQ ID NO: 640284 - RNA, 22 nt, Human
uccugggagcccuugcuccacc

SEQ ID NO: 640285 - RNA, 22 nt, Human
agugauggcauauauagaugug

SEQ ID NO: 640286 - RNA, 22 nt, Human
aggaccugacauuguguuuucu

SEQ ID NO: 640287 - RNA, 22 nt, Human
agcaggcacaagaaagggaggu

SEQ ID NO: 640288 - RNA, 22 nt, Human
uuguacauuuguucaguucuga

SEQ ID NO: 640289 - RNA, 22 nt, Human
ugcacacacaggagucuccucc

SEQ ID NO: 640290 - RNA, 22 nt, Human
gcucaggccuggcuauccauug

SEQ ID NO: 640291 - RNA, 22 nt, Human
ugcaugcucaaguuaguuguga

SEQ ID NO: 640292 - RNA, 19 nt, Human
ccacagagcaugcugaggc

SEQ ID NO: 640293 - RNA, 22 nt, Human
gcaggucuagaagcugccucug

SEQ ID NO: 640294 - RNA, 22 nt, Human
cugccugcacugccuggcucca

SEQ ID NO: 640295 - RNA, 22 nt, Human
uaaaaagcagcugagauuuucu

SEQ ID NO: 640296 - RNA, 22 nt, Human
cuucuuuacuuucuagaaauaa

SEQ ID NO: 640297 - RNA, 22 nt, Human
acaacuuuaauggguuucagcu

SEQ ID NO: 640298 - RNA, 22 nt, Human
gagggggucuaugagguagagc

SEQ ID NO: 640299 - RNA, 22 nt, Human
auacauucaaaggaaggauaga

SEQ ID NO: 640300 - RNA, 22 nt, Human
aguuuuauguucacagaaggau

SEQ ID NO: 640301 - RNA, 22 nt, Human
uaacacugguuaucccugugca

SEQ ID NO: 640302 - RNA, 19 nt, Human
cugggccagaaucagcuca

SEQ ID NO: 640303 - RNA, 22 nt, Human
caguucugagcuuucccagaag

SEQ ID NO: 640304 - RNA, 22 nt, Human
aguguuucuggaaucaguguuu

SEQ ID NO: 640305 - RNA, 22 nt, Human
cauggcuuagaaguuccagccc

SEQ ID NO: 640306 - RNA, 22 nt, Human
auuuccaucaucauuaggccua

SEQ ID NO: 640307 - RNA, 22 nt, Human
uccagcugcugacccaguagcc

SEQ ID NO: 640308 - RNA, 22 nt, Human
guaggcagucucucaggugauc

SEQ ID NO: 640309 - RNA, 22 nt, Human
gacaggauguauuggcaagagg

SEQ ID NO: 640310 - RNA, 22 nt, Human
agucagugaaaacuagaauguu

SEQ ID NO: 640311 - RNA, 19 nt, Human
guucuuuucaccucugugc

SEQ ID NO: 640312 - RNA, 22 nt, Human
uggcccugacuuggaggccuga

SEQ ID NO: 640313 - RNA, 22 nt, Human
uuacaaagcguugagacaagua

SEQ ID NO: 640314 - RNA, 22 nt, Human
cggcuggaagcuggacaggccg

SEQ ID NO: 640315 - RNA, 22 nt, Human
ggcagcucaccucugguccagg

SEQ ID NO: 640316 - RNA, 22 nt, Human
agucagcuuggcuccucccaug

SEQ ID NO: 640317 - RNA, 21 nt, Human
aaccagagccaggcucucagc

SEQ ID NO: 640318 - RNA, 19 nt, Human
gcgaggaagucacuguggu

SEQ ID NO: 640319 - RNA, 22 nt, Human
ucauccaguaugacuggugucu

SEQ ID NO: 640320 - RNA, 22 nt, Human
ugguucauaauuugcacuacug

SEQ ID NO: 640321 - RNA, 23 nt, Human
acacaauagaguacuauucagcc

SEQ ID NO: 640322 - RNA, 21 nt, Human
auuuuguacauagaauuuguc

SEQ ID NO: 640323 - RNA, 22 nt, Human
acauccauguuguaauguuccu

SEQ ID NO: 640324 - RNA, 18 nt, Human
cauugacaguauaucuuu

SEQ ID NO: 640325 - RNA, 22 nt, Human
agcuuuauucaugauuucaggg

SEQ ID NO: 640326 - RNA, 22 nt, Human
caugaaauauuaguaacuguuu

SEQ ID NO: 640327 - RNA, 22 nt, Human
cccugccuucuuggccuuuaaa

SEQ ID NO: 640328 - RNA, 22 nt, Human
guauuacauuuaguaauuaggc

SEQ ID NO: 640329 - RNA, 21 nt, Human
uaucugcuuuuuaaggcucac

SEQ ID NO: 640330 - RNA, 22 nt, Human
accagcauugcuuuggguuaua

SEQ ID NO: 640331 - RNA, 22 nt, Human
aagcauucugcauuuucaaaga

SEQ ID NO: 640332 - RNA, 22 nt, Human
uacaagauaagaauuggcaagg

SEQ ID NO: 640333 - RNA, 22 nt, Human
uugauucuauguuguugucuca

SEQ ID NO: 640334 - RNA, 22 nt, Human
cagcccagcagucuuagccugc

SEQ ID NO: 640335 - RNA, 22 nt, Human
auuguaagagguuuggcugugu

SEQ ID NO: 640336 - RNA, 22 nt, Human
ugggcuggugagggaucauuua

SEQ ID NO: 640337 - RNA, 22 nt, Human
acaugaauauaugaaguucaac

SEQ ID NO: 640338 - RNA, 22 nt, Human
ucugaaggugcuagagaaagcu

SEQ ID NO: 640339 - RNA, 22 nt, Human
gcuuucugguuugugcuacagg

SEQ ID NO: 640340 - RNA, 22 nt, Human
ccaggcaauucugaaagcauuu

SEQ ID NO: 640341 - RNA, 22 nt, Human
auuucagacuguguuggaaaau

SEQ ID NO: 640342 - RNA, 22 nt, Human
ggcaggugcuugucgaaggccu

SEQ ID NO: 640343 - RNA, 22 nt, Human
gcuaggcucggaagcagcaggg

SEQ ID NO: 640344 - RNA, 22 nt, Human
auguuuacagaggaagugccuc

SEQ ID NO: 640345 - RNA, 22 nt, Human
gaagacauguuuuuaauaugua

SEQ ID NO: 640346 - RNA, 22 nt, Human
cuguggcugccucaccuacagg

SEQ ID NO: 640347 - RNA, 22 nt, Human
guaaauuauuucaagaucaucu

SEQ ID NO: 640348 - RNA, 22 nt, Human
uccuugaagagugggcggucga

SEQ ID NO: 640349 - RNA, 22 nt, Human
auucagaagcuauucuuaguuc

SEQ ID NO: 640350 - RNA, 22 nt, Human
uacguuuuaaacacggagccag

SEQ ID NO: 640351 - RNA, 22 nt, Human
auuuuguuuccuuuggaguaga

SEQ ID NO: 640352 - RNA, 22 nt, Human
guacaugugcacaaugugcagg

SEQ ID NO: 640353 - RNA, 21 nt, Human
uggcagggguaguaguacagc

SEQ ID NO: 640354 - RNA, 22 nt, Human
caugaagucacuggagcuuuca

SEQ ID NO: 640355 - RNA, 19 nt, Human
acuaaaaaugauguuugag

SEQ ID NO: 640356 - RNA, 22 nt, Human
ccugaacaaauggcauagccaa

SEQ ID NO: 640357 - RNA, 22 nt, Human
aacaacugaaaagcuuuuucug

SEQ ID NO: 640358 - RNA, 22 nt, Human
ccuuuagaaagucaguaguugc

SEQ ID NO: 640359 - RNA, 22 nt, Human
acuugcaaagugagggaguguu

SEQ ID NO: 640360 - RNA, 21 nt, Human
uagcaaauugcuauuaaggca

SEQ ID NO: 640361 - RNA, 19 nt, Human
ucaaaggcaaggaggaacu

SEQ ID NO: 640362 - RNA, 22 nt, Human
agauauucuagaaccuaguaga

SEQ ID NO: 640363 - RNA, 22 nt, Human
cucccagggccaucgagucacu

SEQ ID NO: 640364 - RNA, 22 nt, Human
gcaggagugugucuaauacuca

SEQ ID NO: 640365 - RNA, 22 nt, Human
aacuauguuaauaaguuucauu

SEQ ID NO: 640366 - RNA, 22 nt, Human
uucaaguaaugcuacuccuaug

SEQ ID NO: 640367 - RNA, 22 nt, Human
gcugggacaggcuuggcccugu

SEQ ID NO: 640368 - RNA, 22 nt, Human
caguagcaggcaggugcuuuug

SEQ ID NO: 640369 - RNA, 22 nt, Human
gcaaggcugcugccacccaucu

SEQ ID NO: 640370 - RNA, 22 nt, Human
ugggccugaguuugggaacugg

SEQ ID NO: 640371 - RNA, 22 nt, Human
aucaaugcuugccaaauggaag

SEQ ID NO: 640372 - RNA, 22 nt, Human
cccaggaagagugaguggcauu

SEQ ID NO: 640373 - RNA, 22 nt, Human
uuaacugagaggaucugaguag

SEQ ID NO: 640374 - RNA, 22 nt, Human
ucugucucaaguucuugcacuc

SEQ ID NO: 640375 - RNA, 14 nt, Human
acacuguguuuaga

SEQ ID NO: 640376 - RNA, 22 nt, Human
agaaacauauucagugaguaau

SEQ ID NO: 640377 - RNA, 22 nt, Human
auuugcuuuaagguauaaaagg

SEQ ID NO: 640378 - RNA, 22 nt, Human
ugguccuucuugaagagugagu

SEQ ID NO: 640379 - RNA, 22 nt, Human
ucugcauauuuaucaugagucu

SEQ ID NO: 640380 - RNA, 22 nt, Human
ggcuuccaugugaaauucuuug

SEQ ID NO: 640381 - RNA, 22 nt, Human
uauaucuuauaugugcagguac

SEQ ID NO: 640382 - RNA, 22 nt, Human
uccaaauacauuuacuguauuu

SEQ ID NO: 640383 - RNA, 22 nt, Human
agccagggucucucgcucuguu

SEQ ID NO: 640384 - RNA, 22 nt, Human
ucuuuguuugccuuuaucaaga

SEQ ID NO: 640385 - RNA, 22 nt, Human
acccacugucaucucugaccac

SEQ ID NO: 640386 - RNA, 22 nt, Human
ugccugcucuuaccacucuccc

SEQ ID NO: 640387 - RNA, 22 nt, Human
ggagcucugugucucuccugcc

SEQ ID NO: 640388 - RNA, 22 nt, Human
gguggccauucuaccgccuucu

SEQ ID NO: 640389 - RNA, 22 nt, Human
gagauggaaucuguguggaggg

SEQ ID NO: 640390 - RNA, 22 nt, Human
aucaggaaagaguggaacucug

SEQ ID NO: 640391 - RNA, 22 nt, Human
aggucugacuucaagccugugg

SEQ ID NO: 640392 - RNA, 22 nt, Human
ccucucuguaagggucccuccc

SEQ ID NO: 640393 - RNA, 22 nt, Human
gauaaguuauguaacuugcuca

SEQ ID NO: 640394 - RNA, 22 nt, Human
caggaaauuuugugaucuguuc

SEQ ID NO: 640395 - RNA, 22 nt, Human
gagcacuguacucauuugcacu

SEQ ID NO: 640396 - RNA, 22 nt, Human
ucuggaaaagcgauaaaccauu

SEQ ID NO: 640397 - RNA, 22 nt, Human
aaguuuugaaauacugaagugu

SEQ ID NO: 640398 - RNA, 22 nt, Human
cauguguuuugucauuucaaua

SEQ ID NO: 640399 - RNA, 22 nt, Human
uuccuggggcuccagcuaccag

SEQ ID NO: 640400 - RNA, 22 nt, Human
gcccgcagagaucuuuaacaaa

SEQ ID NO: 640401 - RNA, 22 nt, Human
gcauggaauucccuuaugggcc

SEQ ID NO: 640402 - RNA, 22 nt, Human
cuucacaggcaagucuguuuuu

SEQ ID NO: 640403 - RNA, 22 nt, Human
ggacccugggcuugcuccuggg

SEQ ID NO: 640404 - RNA, 22 nt, Human
aaaaggaggucacuuuauuccu

SEQ ID NO: 640405 - RNA, 22 nt, Human
cacauaauugaacgugaugagu

SEQ ID NO: 640406 - RNA, 22 nt, Human
aacugcuuguaaauaauguuga

SEQ ID NO: 640407 - RNA, 22 nt, Human
cucagggccaaggaugcuguug

SEQ ID NO: 640408 - RNA, 22 nt, Human
agggcucuuccuuugccucuca

SEQ ID NO: 640409 - RNA, 21 nt, Human
uguggcagauguugggaggca

SEQ ID NO: 640410 - RNA, 20 nt, Human
gcagcugcccccagucccug

SEQ ID NO: 640411 - RNA, 22 nt, Human
cugcugccccugagcucagccu

SEQ ID NO: 640412 - RNA, 22 nt, Human
ccuuucucuaucgacccaucgc

SEQ ID NO: 640413 - RNA, 22 nt, Human
ugugugucuggaagcucaggga

SEQ ID NO: 640414 - RNA, 22 nt, Human
ccuuccaggcuggaggcuuggg

SEQ ID NO: 640415 - RNA, 22 nt, Human
gcugugcccagcuccagcucug

SEQ ID NO: 640416 - RNA, 22 nt, Human
gagggugcucugagcccuuuug

SEQ ID NO: 640417 - RNA, 22 nt, Human
caccagguuccgggcagagcug

SEQ ID NO: 640418 - RNA, 22 nt, Human
agccucagggcucugcgcagac

SEQ ID NO: 640419 - RNA, 19 nt, Human
acaaagugcgugcucuuuu

SEQ ID NO: 640420 - RNA, 20 nt, Human
agggcagagggauuacaggc

SEQ ID NO: 640421 - RNA, 22 nt, Human
ucagaggaugcuguucuuuaau

SEQ ID NO: 640422 - RNA, 22 nt, Human
ccaguccacgucaagaagaggu

SEQ ID NO: 640423 - RNA, 22 nt, Human
ugguccuggccuugaccccagg

SEQ ID NO: 640424 - RNA, 22 nt, Human
uagugucuauugaccggaaaga

SEQ ID NO: 640425 - RNA, 22 nt, Human
uaaugaacacagaauuucacuu

SEQ ID NO: 640426 - RNA, 22 nt, Human
ucugauguugaugcuucugccu

SEQ ID NO: 640427 - RNA, 22 nt, Human
uauaauuuggggaaaguggugu

SEQ ID NO: 640428 - RNA, 22 nt, Human
agugacaucaugucagcaaagu

SEQ ID NO: 640429 - RNA, 22 nt, Human
agugagcauucguuuggaaccc

SEQ ID NO: 640430 - RNA, 22 nt, Human
uucuaaugaaaucuguacagua

SEQ ID NO: 640431 - RNA, 22 nt, Human
cuucccuuuuuaugucuucagc

SEQ ID NO: 640432 - RNA, 22 nt, Human
uacauggugguggcacuugacu

SEQ ID NO: 640433 - RNA, 18 nt, Human
caguggcauaguugagua

SEQ ID NO: 640434 - RNA, 22 nt, Human
uuccaggcugaugggccacagg

SEQ ID NO: 640435 - RNA, 22 nt, Human
uuuccucugucaugacagcuga

SEQ ID NO: 640436 - RNA, 22 nt, Human
uacaagauuaaaacuuauacca

SEQ ID NO: 640437 - RNA, 21 nt, Human
agcaccaguuuuaugccaggc

SEQ ID NO: 640438 - RNA, 22 nt, Human
cauaugaaauaugaguugaaca

SEQ ID NO: 640439 - RNA, 22 nt, Human
acagucaaaugucuaucuucuu

SEQ ID NO: 640440 - RNA, 22 nt, Human
gaacuuuaccauuuagguaacu

SEQ ID NO: 640441 - RNA, 22 nt, Human
caggcuccauuaaucauccugc

SEQ ID NO: 640442 - RNA, 22 nt, Human
cagcagaggcacgucugugaau

SEQ ID NO: 640443 - RNA, 22 nt, Human
aagugacuauuugaguacauca

SEQ ID NO: 640444 - RNA, 22 nt, Human
gcuguacaucacaauuugcugu

SEQ ID NO: 640445 - RNA, 21 nt, Human
uccaggccaugguggggaggc

SEQ ID NO: 640446 - RNA, 22 nt, Human
uaaugcacauagaaguacuuag

SEQ ID NO: 640447 - RNA, 22 nt, Human
cuuccugcaacaccuguguugc

SEQ ID NO: 640448 - RNA, 22 nt, Human
ggcaaaaaccacaauuacuuuu

SEQ ID NO: 640449 - RNA, 22 nt, Human
aggcucuccuccccaggaccau

SEQ ID NO: 640450 - RNA, 22 nt, Human
agugaagaggaaguggggcaca

SEQ ID NO: 640451 - RNA, 22 nt, Human
ucuaaggacauuggcuuuggag

SEQ ID NO: 640452 - RNA, 18 nt, Human
uauaaccuguuuugaugg

SEQ ID NO: 640453 - RNA, 22 nt, Human
cccaggcugguccugaacuccu

SEQ ID NO: 640454 - RNA, 22 nt, Human
uaaagacaaacccacuaggguu

SEQ ID NO: 640455 - RNA, 22 nt, Human
auguggcuggugacugccguac

SEQ ID NO: 640456 - RNA, 22 nt, Human
guugaaagaucauguggcugcc

SEQ ID NO: 640457 - RNA, 22 nt, Human
cugaggaagacagcagcugugu

SEQ ID NO: 640458 - RNA, 22 nt, Human
agccagagaacagcaggaaaug

SEQ ID NO: 640459 - RNA, 22 nt, Human
agccucugacugucagcaaggu

SEQ ID NO: 640460 - RNA, 22 nt, Human
acaggaugauaaaggauggcca

SEQ ID NO: 640461 - RNA, 22 nt, Human
acacugaaucagaaauuguugg

SEQ ID NO: 640462 - RNA, 22 nt, Human
uuuaagauucaguaaggcaaac

SEQ ID NO: 640463 - RNA, 22 nt, Human
gauucaggccugcaucucagca

SEQ ID NO: 640464 - RNA, 22 nt, Human
aagcagaauuuaauagaaaggu

SEQ ID NO: 640465 - RNA, 22 nt, Human
aauucacauguugaaguccuaa

SEQ ID NO: 640466 - RNA, 22 nt, Human
uccuuuuuauaguuagagaaac

SEQ ID NO: 640467 - RNA, 22 nt, Human
guacacucccccugugaaguug

SEQ ID NO: 640468 - RNA, 22 nt, Human
aauggcaaaaggauaacaagga

SEQ ID NO: 640469 - RNA, 22 nt, Human
uugccccuggucagaggaggcu

SEQ ID NO: 640470 - RNA, 22 nt, Human
acuuuaaaaagagccuucuaac

SEQ ID NO: 640471 - RNA, 22 nt, Human
auggacagguacugcagugggu

SEQ ID NO: 640472 - RNA, 18 nt, Human
uuucacaaccuccagagg

SEQ ID NO: 640473 - RNA, 22 nt, Human
cuugcaggauuuugcugcugua

SEQ ID NO: 640474 - RNA, 22 nt, Human
aaaggaagugccacucuucuuc

SEQ ID NO: 640475 - RNA, 18 nt, Human
acacuuccugguggugug

SEQ ID NO: 640476 - RNA, 22 nt, Human
uauuucucucacgguugccugg

SEQ ID NO: 640477 - RNA, 22 nt, Human
cuucuugagcauggguaguacu

SEQ ID NO: 640478 - RNA, 22 nt, Human
uugauuacaaaguagauacauu

SEQ ID NO: 640479 - RNA, 22 nt, Human
accaggcagucaccguccagga

SEQ ID NO: 640480 - RNA, 22 nt, Human
uucauugacugguucguuaagu

SEQ ID NO: 640481 - RNA, 22 nt, Human
agugaguggguuacagauggga

SEQ ID NO: 640482 - RNA, 22 nt, Human
gagauucuuuccagaacuuuga

SEQ ID NO: 640483 - RNA, 16 nt, Human
uggggaagcucgugag

SEQ ID NO: 640484 - RNA, 22 nt, Human
auguacacacacaucuuugcgu

SEQ ID NO: 640485 - RNA, 22 nt, Human
uguuaacauaguggcgcaucug

SEQ ID NO: 640486 - RNA, 22 nt, Human
caggaaguggggucauggagua

SEQ ID NO: 640487 - RNA, 22 nt, Human
acagcagcauaaacugacuaag

SEQ ID NO: 640488 - RNA, 22 nt, Human
uucucaggguuugugcaggcuu

SEQ ID NO: 640489 - RNA, 22 nt, Human
uuuuccucugcagagcaguuag

SEQ ID NO: 640490 - RNA, 22 nt, Human
guaacauuuacaguuccuagag

SEQ ID NO: 640491 - RNA, 22 nt, Human
agcugccucugcugguuuagaa

SEQ ID NO: 640492 - RNA, 22 nt, Human
auucuucugccuacuuucaucc

SEQ ID NO: 640493 - RNA, 22 nt, Human
uuucaaagaguuguaaauuacu

SEQ ID NO: 640494 - RNA, 22 nt, Human
caugcuuauauggaaaggaaga

SEQ ID NO: 640495 - RNA, 22 nt, Human
augcaaagcacacacagaaucc

SEQ ID NO: 640496 - RNA, 22 nt, Human
aauauuucuccuucguuauagc

SEQ ID NO: 640497 - RNA, 22 nt, Human
uccaggcucagcacuugcuacu

SEQ ID NO: 640498 - RNA, 22 nt, Human
cagagcugggcauggugaaagg

SEQ ID NO: 640499 - RNA, 21 nt, Human
agguuccugagucaugccuua

SEQ ID NO: 640500 - RNA, 22 nt, Human
cagcagcaacaauagcggucac

SEQ ID NO: 640501 - RNA, 21 nt, Human
acuggccaccacuggcagggg

SEQ ID NO: 640502 - RNA, 22 nt, Human
aaguuuguagcuggaugucugu

SEQ ID NO: 640503 - RNA, 23 nt, Human
agaguggccuacucacacucauu

SEQ ID NO: 640504 - RNA, 22 nt, Human
ucacagaguuaaaaguuucuuu

SEQ ID NO: 640505 - RNA, 22 nt, Human
agauuugcggcuuuacuuugca

SEQ ID NO: 640506 - RNA, 22 nt, Human
ugaggcucagagcaccugcucc

SEQ ID NO: 640507 - RNA, 22 nt, Human
ucuggcuguguaauauguguag

SEQ ID NO: 640508 - RNA, 22 nt, Human
ucugcugccaccuuguggugag

SEQ ID NO: 640509 - RNA, 22 nt, Human
cacagcuagacuaauugcuggg

SEQ ID NO: 640510 - RNA, 22 nt, Human
aaaggucagcugccaucguucu

SEQ ID NO: 640511 - RNA, 22 nt, Human
gagcuggugcucuugucaagac

SEQ ID NO: 640512 - RNA, 22 nt, Human
gacuguacuugagagaggaacu

SEQ ID NO: 640513 - RNA, 22 nt, Human
agccagggauggcagugcccag

SEQ ID NO: 640514 - RNA, 22 nt, Human
gucugagacuuuuucugugugg

SEQ ID NO: 640515 - RNA, 22 nt, Human
acuccccaaaacuaaccaugca

SEQ ID NO: 640516 - RNA, 22 nt, Human
aucagaaaaaugagaagagcug

SEQ ID NO: 640517 - RNA, 22 nt, Human
uuucaaacugggagugagggga

SEQ ID NO: 640518 - RNA, 22 nt, Human
ucugcugugaaaggugaauauu

SEQ ID NO: 640519 - RNA, 22 nt, Human
agucuuuccugcuugacuguuc

SEQ ID NO: 640520 - RNA, 22 nt, Human
acaguggagcucagaugaaaau

SEQ ID NO: 640521 - RNA, 22 nt, Human
ucuacauuuuaacaagaugccc

SEQ ID NO: 640522 - RNA, 22 nt, Human
ugugcaguuucuauguugucca

SEQ ID NO: 640523 - RNA, 22 nt, Human
uaaggccaaggggccauagucu

SEQ ID NO: 640524 - RNA, 22 nt, Human
auggcuuuuuagacuuugguac

SEQ ID NO: 640525 - RNA, 22 nt, Human
acuguaacgccagcuuuaaaug

SEQ ID NO: 640526 - RNA, 22 nt, Human
cacagaacugguuaauagcaga

SEQ ID NO: 640527 - RNA, 22 nt, Human
cuugagcuaggaaggcugaggc

SEQ ID NO: 640528 - RNA, 22 nt, Human
aauucaucauuuuauagcuagu

SEQ ID NO: 640529 - RNA, 22 nt, Human
cugcuuuauagggcuuccaugu

SEQ ID NO: 640530 - RNA, 21 nt, Human
uaaagaagaugaaugugauca

SEQ ID NO: 640531 - RNA, 22 nt, Human
cauggcuucaugaggguuuugc

SEQ ID NO: 640532 - RNA, 22 nt, Human
cucugccugccacuguucaggc

SEQ ID NO: 640533 - RNA, 22 nt, Human
ugaggauggaaugcugugcaag

SEQ ID NO: 640534 - RNA, 22 nt, Human
uaagauaugguaggaaguuugg

SEQ ID NO: 640535 - RNA, 17 nt, Human
ggccuguguggcugcag

SEQ ID NO: 640536 - RNA, 23 nt, Human
ugagcucuauggaggacugaacc

SEQ ID NO: 640537 - RNA, 18 nt, Human
agcaagcaguuuucaugu

SEQ ID NO: 640538 - RNA, 22 nt, Human
acaggagccaaacacaugccag

SEQ ID NO: 640539 - RNA, 22 nt, Human
uacugcauagacacugggauau

SEQ ID NO: 640540 - RNA, 22 nt, Human
aauccuggcugcguuggccagc

SEQ ID NO: 640541 - RNA, 22 nt, Human
cuuggacccacucccagaauug

SEQ ID NO: 640542 - RNA, 22 nt, Human
cuucacaucucccuaaaacagc

SEQ ID NO: 640543 - RNA, 22 nt, Human
uugaaugauccuaucuagcaca

SEQ ID NO: 640544 - RNA, 22 nt, Human
cugucaaauucauaacacuuau

SEQ ID NO: 640545 - RNA, 22 nt, Human
ucaguuuuguauguuguaaguc

SEQ ID NO: 640546 - RNA, 22 nt, Human
guagggacuuguuuuacuagua

SEQ ID NO: 640547 - RNA, 22 nt, Human
gugggcuggauuugcuugcaga

SEQ ID NO: 640548 - RNA, 22 nt, Human
agaccaggucuuuauggcucca

SEQ ID NO: 640549 - RNA, 22 nt, Human
ucacacuucaaaggguuagauc

SEQ ID NO: 640550 - RNA, 22 nt, Human
acugugaaucacuacuaguaga

SEQ ID NO: 640551 - RNA, 22 nt, Human
uauggguaggccugccgccugu

SEQ ID NO: 640552 - RNA, 22 nt, Human
gcaagcaguuacccaggauucg

SEQ ID NO: 640553 - RNA, 22 nt, Human
caggcccagggagggagaccaa

SEQ ID NO: 640554 - RNA, 22 nt, Human
guauagguuuggcucucuccag

SEQ ID NO: 640555 - RNA, 23 nt, Human
ggccacuuugugucaguaugugc

SEQ ID NO: 640556 - RNA, 22 nt, Human
uggccaggcagguagaacggcc

SEQ ID NO: 640557 - RNA, 22 nt, Human
agccaggauuggcugagccuua

SEQ ID NO: 640558 - RNA, 22 nt, Human
uggcauguguguguaggauaca

SEQ ID NO: 640559 - RNA, 22 nt, Human
aagugguugcuugugagucccc

SEQ ID NO: 640560 - RNA, 22 nt, Human
acugcaggagacacagcugcug

SEQ ID NO: 640561 - RNA, 22 nt, Human
aagauuucagaguuugggggaa

SEQ ID NO: 640562 - RNA, 22 nt, Human
uucaaagcugcagacuccuggg

SEQ ID NO: 640563 - RNA, 22 nt, Human
ugccaagagggcagagggcagu

SEQ ID NO: 640564 - RNA, 22 nt, Human
uugcauugggagugaggagacc

SEQ ID NO: 640565 - RNA, 22 nt, Human
auuuucaucgcuagguuggccu

SEQ ID NO: 640566 - RNA, 22 nt, Human
cugccuggucucaggcaugggg

SEQ ID NO: 640567 - RNA, 22 nt, Human
uuccaggaggcauucuuaguuu

SEQ ID NO: 640568 - RNA, 22 nt, Human
uccugcugagcgucugucauuu

SEQ ID NO: 640569 - RNA, 22 nt, Human
ugcagagugggagaggugcggg

SEQ ID NO: 640570 - RNA, 22 nt, Human
gcaggugggggucggugcaucu

SEQ ID NO: 640571 - RNA, 22 nt, Human
agucugcacucagguggagguc

SEQ ID NO: 640572 - RNA, 22 nt, Human
guggcucaguuaacuuccaugu

SEQ ID NO: 640573 - RNA, 22 nt, Human
cagggugagugggaagcagcgu

SEQ ID NO: 640574 - RNA, 22 nt, Human
aucagagaaguuucacuggcau

SEQ ID NO: 640575 - RNA, 22 nt, Human
uccaggaguuugagacugcagu

SEQ ID NO: 640576 - RNA, 22 nt, Human
aaacugcaaugacagguaggag

SEQ ID NO: 640577 - RNA, 22 nt, Human
aaaagguuuugaguacaaauau

SEQ ID NO: 640578 - RNA, 22 nt, Human
auggcaguagaaugggggaaaa

SEQ ID NO: 640579 - RNA, 22 nt, Human
cagggaaacuaggaaauaagcu

SEQ ID NO: 640580 - RNA, 22 nt, Human
ucuguuauauagauaaugugug

SEQ ID NO: 640581 - RNA, 22 nt, Human
gcagaagaccaugguggaaaga

SEQ ID NO: 640582 - RNA, 22 nt, Human
guccugggcggagggcugcugu

SEQ ID NO: 640583 - RNA, 22 nt, Human
ggaggucaaauggagggcuggg

SEQ ID NO: 640584 - RNA, 22 nt, Human
gcaaaaauuccagggacgacuc

SEQ ID NO: 640585 - RNA, 22 nt, Human
aggcucaguucuguggugagcc

SEQ ID NO: 640586 - RNA, 22 nt, Human
aacauugaaauauuugcaauag

SEQ ID NO: 640587 - RNA, 22 nt, Human
cacagaauuuucucuuuacaau

SEQ ID NO: 640588 - RNA, 22 nt, Human
uaggaagcuaugggagauguga

SEQ ID NO: 640589 - RNA, 22 nt, Human
gcuucucuuguccaagggcagg

SEQ ID NO: 640590 - RNA, 22 nt, Human
uuuauuauagugguggggacug

SEQ ID NO: 640591 - RNA, 22 nt, Human
gacuggcucacuccacuccuau

SEQ ID NO: 640592 - RNA, 19 nt, Human
ggcugccuuuccuuaccag

SEQ ID NO: 640593 - RNA, 22 nt, Human
cauauauuauggacugcagaau

SEQ ID NO: 640594 - RNA, 22 nt, Human
auucagaauggcaaacuucuag

SEQ ID NO: 640595 - RNA, 22 nt, Human
caaaaagcuuagguaacaagcc

SEQ ID NO: 640596 - RNA, 22 nt, Human
gcucacaggucuguggcuauug

SEQ ID NO: 640597 - RNA, 22 nt, Human
gggcagguacuggguggugagc

SEQ ID NO: 640598 - RNA, 22 nt, Human
gugugcugagugacugucauca

SEQ ID NO: 640599 - RNA, 22 nt, Human
cuggcuccaucacugggugaug

SEQ ID NO: 640600 - RNA, 22 nt, Human
cagcaacuccuauauugaaagc

SEQ ID NO: 640601 - RNA, 22 nt, Human
gaagcccagggcguggccgggc

SEQ ID NO: 640602 - RNA, 22 nt, Human
gguguggcugugaguuuuugau

SEQ ID NO: 640603 - RNA, 22 nt, Human
aagcaaagagauaaccuuuugg

SEQ ID NO: 640604 - RNA, 22 nt, Human
ugcuggaacucagugaaucauu

SEQ ID NO: 640605 - RNA, 22 nt, Human
aguguggucgggagcgcggggc

SEQ ID NO: 640606 - RNA, 22 nt, Human
agacacuggcacuggggaagcc

SEQ ID NO: 640607 - RNA, 22 nt, Human
uuuguacaugaaugugcaccca

SEQ ID NO: 640608 - RNA, 22 nt, Human
ucaggaagcugcucuggguggu

SEQ ID NO: 640609 - RNA, 22 nt, Human
acaucccacagaaacauacaua

SEQ ID NO: 640610 - RNA, 19 nt, Human
gcuucuguuugggcuuaga

SEQ ID NO: 640611 - RNA, 22 nt, Human
uuucuucucuaaucucaaugau

SEQ ID NO: 640612 - RNA, 22 nt, Human
gcucugcucuaacauuccugac

SEQ ID NO: 640613 - RNA, 22 nt, Human
caccagggacaaugcuaggggu

SEQ ID NO: 640614 - RNA, 22 nt, Human
ugcagaguggauucuguauacc

SEQ ID NO: 640615 - RNA, 22 nt, Human
aguucacaccaaaguuagguag

SEQ ID NO: 640616 - RNA, 22 nt, Human
cuucagaagccugcagccuuug

SEQ ID NO: 640617 - RNA, 22 nt, Human
gugagcaguuguauaaagacuu

SEQ ID NO: 640618 - RNA, 22 nt, Human
gggcuggcaucaguugccgaga

SEQ ID NO: 640619 - RNA, 22 nt, Human
ccugggcuuccacgagcagagg

SEQ ID NO: 640620 - RNA, 22 nt, Human
aggguauguuuuaggcugaguu

SEQ ID NO: 640621 - RNA, 22 nt, Human
cccaggagguuggggcuacagu

SEQ ID NO: 640622 - RNA, 20 nt, Human
ucugaacacaauauaucccc

SEQ ID NO: 640623 - RNA, 22 nt, Human
uaagauuauacuuaaagagaaa

SEQ ID NO: 640624 - RNA, 22 nt, Human
aaaagucugcucucauuucaga

SEQ ID NO: 640625 - RNA, 22 nt, Human
caccccugggcugggcacacag

SEQ ID NO: 640626 - RNA, 18 nt, Human
cucaccauucugcccaau

SEQ ID NO: 640627 - RNA, 23 nt, Human
aggauccugguacaggagcagag

SEQ ID NO: 640628 - RNA, 22 nt, Human
cccaaggccuucaagccagcuc

SEQ ID NO: 640629 - RNA, 23 nt, Human
guuaccuuacuucugugaucuuc

SEQ ID NO: 640630 - RNA, 22 nt, Human
agccaggcgggucuuugcuccu

SEQ ID NO: 640631 - RNA, 22 nt, Human
acugaagcacauuugccaugaa

SEQ ID NO: 640632 - RNA, 22 nt, Human
acacaugaaucacugguggaag

SEQ ID NO: 640633 - RNA, 22 nt, Human
cagcagguuaacagaggcuggu

SEQ ID NO: 640634 - RNA, 22 nt, Human
gcucugcuggagggaaagagaa

SEQ ID NO: 640635 - RNA, 22 nt, Human
ugccugcccacgacuacagcag

SEQ ID NO: 640636 - RNA, 22 nt, Human
ugaaguuuaagguuagauaagu

SEQ ID NO: 640637 - RNA, 22 nt, Human
uggccuggugucugcgaggccu

SEQ ID NO: 640638 - RNA, 22 nt, Human
uguccaaugcccuuuccacaug

SEQ ID NO: 640639 - RNA, 22 nt, Human
cugcccuggucccauggcugau

SEQ ID NO: 640640 - RNA, 19 nt, Human
cugcucuccuugacuugga

SEQ ID NO: 640641 - RNA, 22 nt, Human
gcagcccugcagcuccacaccg

SEQ ID NO: 640642 - RNA, 22 nt, Human
gcuguggcuguacagagaccau

SEQ ID NO: 640643 - RNA, 22 nt, Human
ucucagaaaaacuuugagggua

SEQ ID NO: 640644 - RNA, 21 nt, Human
ucuccucccggggagaggccg

SEQ ID NO: 640645 - RNA, 22 nt, Human
ugaaagauaaguuauuauguac

SEQ ID NO: 640646 - RNA, 21 nt, Human
acaguacuugagaucuuuuga

SEQ ID NO: 640647 - RNA, 22 nt, Human
uuauugcugcuaacauuuuaug

SEQ ID NO: 640648 - RNA, 23 nt, Human
augagguaaagaucagcuuuaaa

SEQ ID NO: 640649 - RNA, 22 nt, Human
uccagggcauggggagagagug

SEQ ID NO: 640650 - RNA, 22 nt, Human
caucaaaucugacuuuucuucc

SEQ ID NO: 640651 - RNA, 22 nt, Human
ccugucugcaugagugagcaua

SEQ ID NO: 640652 - RNA, 22 nt, Human
ccugcccuaugaccagcuucac

SEQ ID NO: 640653 - RNA, 18 nt, Human
aagcacagguguuucagg

SEQ ID NO: 640654 - RNA, 22 nt, Human
cugaaauuccauuucagccaca

SEQ ID NO: 640655 - RNA, 22 nt, Human
gugcggaucgguguccuccaaa

SEQ ID NO: 640656 - RNA, 22 nt, Human
ccaggcaggcagcguucucagg

SEQ ID NO: 640657 - RNA, 22 nt, Human
aagaauaucuguuuuauuuagg

SEQ ID NO: 640658 - RNA, 22 nt, Human
aauggcuuugaguauuuucugg

SEQ ID NO: 640659 - RNA, 22 nt, Human
acacaugagaaacaucaguugu

SEQ ID NO: 640660 - RNA, 21 nt, Human
ggcacagccugaaaugccuca

SEQ ID NO: 640661 - RNA, 22 nt, Human
auaugcacauacauacauaggu

SEQ ID NO: 640662 - RNA, 22 nt, Human
gcacacaugcguguauaugggu

SEQ ID NO: 640663 - RNA, 22 nt, Human
agaauuacauaaauacaugaau

SEQ ID NO: 640664 - RNA, 22 nt, Human
gccagacacuccccugggcagg

SEQ ID NO: 640665 - RNA, 22 nt, Human
cauuccaaggccaagucuaaga

SEQ ID NO: 640666 - RNA, 22 nt, Human
aaguaaauaucuguagucuuua

SEQ ID NO: 640667 - RNA, 22 nt, Human
gcucugaacuuccaccuuuuca

SEQ ID NO: 640668 - RNA, 22 nt, Human
ugggggaacuguugcgcgcggg

SEQ ID NO: 640669 - RNA, 20 nt, Human
uuguuuaaaggugaagaggc

SEQ ID NO: 640670 - RNA, 22 nt, Human
auauggaagagccugggaauuu

SEQ ID NO: 640671 - RNA, 22 nt, Human
uccaggugugcucugugcccug

SEQ ID NO: 640672 - RNA, 22 nt, Human
guuuauugauaaaagcuggaca

SEQ ID NO: 640673 - RNA, 22 nt, Human
acaauucaagaugagauucagg

SEQ ID NO: 640674 - RNA, 21 nt, Human
aaaguguguggggaagaagga

SEQ ID NO: 640675 - RNA, 22 nt, Human
aaccacagagcccccucagaug

SEQ ID NO: 640676 - RNA, 22 nt, Human
cuuaaccagaaaaugcacuugu

SEQ ID NO: 640677 - RNA, 22 nt, Human
ugguggccaauucacagggcuc

SEQ ID NO: 640678 - RNA, 22 nt, Human
ucagcaggcucugguugaccau

SEQ ID NO: 640679 - RNA, 22 nt, Human
augcaaauaagugcaggcgugg

SEQ ID NO: 640680 - RNA, 22 nt, Human
uguggguguucucacuuagaua

SEQ ID NO: 640681 - RNA, 22 nt, Human
ugugacugagcugcagaguguc

SEQ ID NO: 640682 - RNA, 22 nt, Human
gcaggugauucacccugggccu

SEQ ID NO: 640683 - RNA, 22 nt, Human
guuaagugaaugucaugucagg

SEQ ID NO: 640684 - RNA, 22 nt, Human
cacacacucuuccuggcaccua

SEQ ID NO: 640685 - RNA, 22 nt, Human
gaugcacuuucuuuucaacagu

SEQ ID NO: 640686 - RNA, 19 nt, Human
guacaauguguuguuggua

SEQ ID NO: 640687 - RNA, 22 nt, Human
ucagggaagacuucuuagagga

SEQ ID NO: 640688 - RNA, 23 nt, Human
aaauaugucugagggcaaagaau

SEQ ID NO: 640689 - RNA, 22 nt, Human
gcauuuauuaucugccaggcac

SEQ ID NO: 640690 - RNA, 18 nt, Human
cugaaggauccaggugua

SEQ ID NO: 640691 - RNA, 22 nt, Human
cagcuucuccauucuucuggcu

SEQ ID NO: 640692 - RNA, 19 nt, Human
gucuucugaauguggcugc

SEQ ID NO: 640693 - RNA, 23 nt, Human
uuuauucucagauacauaggucu

SEQ ID NO: 640694 - RNA, 22 nt, Human
agagugaaguuuuugaaaguga

SEQ ID NO: 640695 - RNA, 22 nt, Human
uccauuuagcuggcaaacaaug

SEQ ID NO: 640696 - RNA, 22 nt, Human
gccaaagcagucuugccucugc

SEQ ID NO: 640697 - RNA, 22 nt, Human
caggaggcagaggaugcccagu

SEQ ID NO: 640698 - RNA, 22 nt, Human
acagggcaccugagguaggaag

SEQ ID NO: 640699 - RNA, 22 nt, Human
uccagcuguacuuuguccuggc

SEQ ID NO: 640700 - RNA, 22 nt, Human
gcugaggauuacuugaagucag

SEQ ID NO: 640701 - RNA, 22 nt, Human
augugagcagggagaugcugcc

SEQ ID NO: 640702 - RNA, 22 nt, Human
gcucugugaaggguguugcuca

SEQ ID NO: 640703 - RNA, 19 nt, Human
augucuggguaacagcugc

SEQ ID NO: 640704 - RNA, 23 nt, Human
aggacaguggaauuuagggauug

SEQ ID NO: 640705 - RNA, 22 nt, Human
uaggccacucuccuuugucuca

SEQ ID NO: 640706 - RNA, 22 nt, Human
uggcuggcuuguucacugacug

SEQ ID NO: 640707 - RNA, 22 nt, Human
gcacagcucgagcucaggaggg

SEQ ID NO: 640708 - RNA, 19 nt, Human
ugcauauaucuaugaaaga

SEQ ID NO: 640709 - RNA, 22 nt, Human
cacuguuuggcuccuguacuua

SEQ ID NO: 640710 - RNA, 22 nt, Human
ugacagugucaguuuccuaaua

SEQ ID NO: 640711 - RNA, 22 nt, Human
caaaauuguugaugcugcuuug

SEQ ID NO: 640712 - RNA, 21 nt, Human
caaggacagguugcagggcaa

SEQ ID NO: 640713 - RNA, 22 nt, Human
uguauauucacugagcaagggg

SEQ ID NO: 640714 - RNA, 22 nt, Human
agcagcaaggaagcgaggaugg

SEQ ID NO: 640715 - RNA, 22 nt, Human
uauuugcuuugguccuccaagc

SEQ ID NO: 640716 - RNA, 22 nt, Human
cuuggcagcuacacagguaaga

SEQ ID NO: 640717 - RNA, 22 nt, Human
gacaggacuucacuguguugcc

SEQ ID NO: 640718 - RNA, 22 nt, Human
aaggaaaugaagcugauguugg

SEQ ID NO: 640719 - RNA, 22 nt, Human
gucuucugucugucuggcaugu

SEQ ID NO: 640720 - RNA, 23 nt, Human
cuggggcucauugcaguagccau

SEQ ID NO: 640721 - RNA, 22 nt, Human
uguauuagagcaguagaauuau

SEQ ID NO: 640722 - RNA, 22 nt, Human
uaggugcuggauaaagaauggu

SEQ ID NO: 640723 - RNA, 22 nt, Human
cuuccucccggcccaugcucug

SEQ ID NO: 640724 - RNA, 22 nt, Human
ugucuccucaacucaugcucga

SEQ ID NO: 640725 - RNA, 22 nt, Human
gcacacaguauaugcucauuaa

SEQ ID NO: 640726 - RNA, 22 nt, Human
auucccaccugaaaaagguagg

SEQ ID NO: 640727 - RNA, 22 nt, Human
ugcuucuuacucauaugcugau

SEQ ID NO: 640728 - RNA, 22 nt, Human
cauuucugugacacuuccaucu

SEQ ID NO: 640729 - RNA, 22 nt, Human
uuuagcaaguauuuacugacua

SEQ ID NO: 640730 - RNA, 22 nt, Human
uaauucagcugaacaacugugu

SEQ ID NO: 640731 - RNA, 22 nt, Human
ugacagaacuuuuucacaucuc

SEQ ID NO: 640732 - RNA, 22 nt, Human
ccuucugugugcccacguuuau

SEQ ID NO: 640733 - RNA, 22 nt, Human
gccucugcaccaguacugugcc

SEQ ID NO: 640734 - RNA, 16 nt, Human
ccuuuucucaucucua

SEQ ID NO: 640735 - RNA, 22 nt, Human
aaaucaaaagacauguguuuua

SEQ ID NO: 640736 - RNA, 22 nt, Human
gguacaaggagugaagguuugg

SEQ ID NO: 640737 - RNA, 22 nt, Human
gugacauugcuaggaacagauu

SEQ ID NO: 640738 - RNA, 22 nt, Human
cacaugaagauucaacuggaug

SEQ ID NO: 640739 - RNA, 22 nt, Human
ugaaagaagugucacauugcca

SEQ ID NO: 640740 - RNA, 22 nt, Human
ggagucaggagcaggcugggcu

SEQ ID NO: 640741 - RNA, 22 nt, Human
uuacugcacgugggacauauau

SEQ ID NO: 640742 - RNA, 22 nt, Human
agcaucuaaacuaucaguuuga

SEQ ID NO: 640743 - RNA, 22 nt, Human
uuccaaauuccaauccccugaa

SEQ ID NO: 640744 - RNA, 22 nt, Human
ugcuggccucggcgcugggccu

SEQ ID NO: 640745 - RNA, 22 nt, Human
uuaacuggggaagcauuucaug

SEQ ID NO: 640746 - RNA, 22 nt, Human
ucuucugaagguaggaagcauu

SEQ ID NO: 640747 - RNA, 22 nt, Human
agcagcauguugggaugugaaa

SEQ ID NO: 640748 - RNA, 22 nt, Human
uauuugcugugcuuauuccauu

SEQ ID NO: 640749 - RNA, 22 nt, Human
aaucagaaagaggucauguugc

SEQ ID NO: 640750 - RNA, 22 nt, Human
agcacaguugguaaaauuguua

SEQ ID NO: 640751 - RNA, 22 nt, Human
aaagaaucacauccuucagcaa

SEQ ID NO: 640752 - RNA, 22 nt, Human
ucuggccucuugggaugcuccc

SEQ ID NO: 640753 - RNA, 22 nt, Human
cuguagccaguuuggccucacc

SEQ ID NO: 640754 - RNA, 22 nt, Human
cagaggcugauggcuguagcca

SEQ ID NO: 640755 - RNA, 22 nt, Human
cuaaauguuuuaucuuccuggc

SEQ ID NO: 640756 - RNA, 22 nt, Human
uucuaaguuacuguuauggucu

SEQ ID NO: 640757 - RNA, 22 nt, Human
cucuggaggucagguguggugg

SEQ ID NO: 640758 - RNA, 22 nt, Human
agagccugugauugucaucacc

SEQ ID NO: 640759 - RNA, 22 nt, Human
ggagggagucagcugauuagaa

SEQ ID NO: 640760 - RNA, 23 nt, Human
gcucugagggcuuaucccuccca

SEQ ID NO: 640761 - RNA, 22 nt, Human
aggcugaggaucccuguguucu

SEQ ID NO: 640762 - RNA, 22 nt, Human
cagagggaguuucugagguugc

SEQ ID NO: 640763 - RNA, 18 nt, Human
ugaggcucagagacggug

SEQ ID NO: 640764 - RNA, 22 nt, Human
aaugaaauguagcuuauccaua

SEQ ID NO: 640765 - RNA, 16 nt, Human
gagggcagaggcggaa

SEQ ID NO: 640766 - RNA, 22 nt, Human
ccucaccucagucugggccuca

SEQ ID NO: 640767 - RNA, 22 nt, Human
agagaaggaaagcugacauggg

SEQ ID NO: 640768 - RNA, 22 nt, Human
guucugucugagcaccacagga

SEQ ID NO: 640769 - RNA, 22 nt, Human
aggauuuggggaagaaaacacu

SEQ ID NO: 640770 - RNA, 22 nt, Human
cccugugcugucaugcugggcg

SEQ ID NO: 640771 - RNA, 22 nt, Human
caguccuguguuaaacaagagc

SEQ ID NO: 640772 - RNA, 22 nt, Human
agggcaucuaguucccucucuu

SEQ ID NO: 640773 - RNA, 22 nt, Human
uggagggcauagcuguucuuuc

SEQ ID NO: 640774 - RNA, 22 nt, Human
ucugcuggaaaaccagggaauu

SEQ ID NO: 640775 - RNA, 22 nt, Human
agugcauauaugaagaguauga

SEQ ID NO: 640776 - RNA, 22 nt, Human
gcaggcugugguauguugggca

SEQ ID NO: 640777 - RNA, 22 nt, Human
uggaaagguaggauuucaagac

SEQ ID NO: 640778 - RNA, 22 nt, Human
caggcaccaacuuccuggggag

SEQ ID NO: 640779 - RNA, 22 nt, Human
aaaguccuugcaguuuccucuu

SEQ ID NO: 640780 - RNA, 20 nt, Human
gcucaggugacagucaggag

SEQ ID NO: 640781 - RNA, 20 nt, Human
uuuuccucguguuuguucua

SEQ ID NO: 640782 - RNA, 20 nt, Human
ucacaacuccaucauuuccc

SEQ ID NO: 640783 - RNA, 22 nt, Human
guucaugugguuuuuaaaggau

SEQ ID NO: 640784 - RNA, 22 nt, Human
cggcuggugucgggcacagcaa

SEQ ID NO: 640785 - RNA, 22 nt, Human
gcugauguauauagugauugag

SEQ ID NO: 640786 - RNA, 22 nt, Human
caacugugaauuuuaugauacc

SEQ ID NO: 640787 - RNA, 22 nt, Human
ugcuauugugaacagugccaca

SEQ ID NO: 640788 - RNA, 22 nt, Human
cagcucuuccuacccuaguugg

SEQ ID NO: 640789 - RNA, 22 nt, Human
uucugaaauuucaacuuuacua

SEQ ID NO: 640790 - RNA, 22 nt, Human
uucaggaugcagagguuguagu

SEQ ID NO: 640791 - RNA, 22 nt, Human
cagugcugugcuggaagcuguu

SEQ ID NO: 640792 - RNA, 20 nt, Human
agacaaugagugacagaguu

SEQ ID NO: 640793 - RNA, 22 nt, Human
uacauacaagcauucaauuuua

SEQ ID NO: 640794 - RNA, 22 nt, Human
agacacagauuuuggaaaagau

SEQ ID NO: 640795 - RNA, 22 nt, Human
ucuacuauguuucuuaaauaga

SEQ ID NO: 640796 - RNA, 20 nt, Human
ugccugcccagguccugcac

SEQ ID NO: 640797 - RNA, 22 nt, Human
agcaaagaagacacaggcuuca

SEQ ID NO: 640798 - RNA, 22 nt, Human
ucagaccucugaccuugccaaa

SEQ ID NO: 640799 - RNA, 22 nt, Human
uccagccugaacuuuguccaga

SEQ ID NO: 640800 - RNA, 22 nt, Human
caggaaagaaaugagaacacca

SEQ ID NO: 640801 - RNA, 22 nt, Human
cuguauuuuuuaagugaucugg

SEQ ID NO: 640802 - RNA, 22 nt, Human
uuauuuccuaaaucucuuuguu

SEQ ID NO: 640803 - RNA, 21 nt, Human
acugcaaacagcagagacuga

SEQ ID NO: 640804 - RNA, 22 nt, Human
ucuccaaauaguuauauuuaga

SEQ ID NO: 640805 - RNA, 22 nt, Human
uugcuuccucgaggccagcgug

SEQ ID NO: 640806 - RNA, 22 nt, Human
uccuuucaccaaaaaguguugu

SEQ ID NO: 640807 - RNA, 18 nt, Human
cccagugcucacugccuc

SEQ ID NO: 640808 - RNA, 22 nt, Human
aaguuuaguauuagggaaaagu

SEQ ID NO: 640809 - RNA, 22 nt, Human
agcuacuucccuguaggaaaca

SEQ ID NO: 640810 - RNA, 22 nt, Human
aacugcaaaaaugguagucuua

SEQ ID NO: 640811 - RNA, 23 nt, Human
cuuugccacccagagccugacag

SEQ ID NO: 640812 - RNA, 22 nt, Human
ucuggcuuguguccuuccuugc

SEQ ID NO: 640813 - RNA, 22 nt, Human
uccaagcauguggucaggagcc

SEQ ID NO: 640814 - RNA, 22 nt, Human
uagguagcuuuggcguuucuug

SEQ ID NO: 640815 - RNA, 22 nt, Human
gacacagcuugaugagggcuuu

SEQ ID NO: 640816 - RNA, 22 nt, Human
uuagaaaucaccucugaagauc

SEQ ID NO: 640817 - RNA, 22 nt, Human
ggaaguuugggagcugguaauc

SEQ ID NO: 640818 - RNA, 22 nt, Human
aucagcaaguccuguuaauucu

SEQ ID NO: 640819 - RNA, 22 nt, Human
uacauguguucuguuucaaguu

SEQ ID NO: 640820 - RNA, 22 nt, Human
auguuagaaggaauguuaaaag

SEQ ID NO: 640821 - RNA, 22 nt, Human
ucugggagguguuuugagaacu

SEQ ID NO: 640822 - RNA, 22 nt, Human
accugcccacuucccaugacau

SEQ ID NO: 640823 - RNA, 22 nt, Human
ucauagaaauggaaaguauauu

SEQ ID NO: 640824 - RNA, 23 nt, Human
gggggcugguugacucucugcag

SEQ ID NO: 640825 - RNA, 23 nt, Human
gugugccuuuaucuucuguacuc

SEQ ID NO: 640826 - RNA, 22 nt, Human
agugacagccaaauccauccau

SEQ ID NO: 640827 - RNA, 22 nt, Human
cugguggaggugccaggauuug

SEQ ID NO: 640828 - RNA, 22 nt, Human
gcugcccuacccgaggcacucu

SEQ ID NO: 640829 - RNA, 22 nt, Human
gggaaugagagucagcccagga

SEQ ID NO: 640830 - RNA, 22 nt, Human
aguggggccgcgguccugcccu

SEQ ID NO: 640831 - RNA, 22 nt, Human
ugggcaaguaucggacucugag

SEQ ID NO: 640832 - RNA, 22 nt, Human
uucuuuacaguggguuuugaau

SEQ ID NO: 640833 - RNA, 22 nt, Human
ucaacaaugggucuguaaugga

SEQ ID NO: 640834 - RNA, 22 nt, Human
auucaguucuaaggucagugcc

SEQ ID NO: 640835 - RNA, 22 nt, Human
uuuuccuucuagagcagauuuc

SEQ ID NO: 640836 - RNA, 22 nt, Human
aguaaacauguaauuguucauu

SEQ ID NO: 640837 - RNA, 22 nt, Human
aguggacauucugcacuuggag

SEQ ID NO: 640838 - RNA, 22 nt, Human
uuagugcucacguguuagaaag

SEQ ID NO: 640839 - RNA, 22 nt, Human
cacagacuugagaagcaccuua

SEQ ID NO: 640840 - RNA, 22 nt, Human
auguuaaauagccauuuguuug

SEQ ID NO: 640841 - RNA, 22 nt, Human
ggaggugggauuaggaccuaaa

SEQ ID NO: 640842 - RNA, 22 nt, Human
ugcagcugauuaaagggcagac

SEQ ID NO: 640843 - RNA, 23 nt, Human
ugggcgaggcaggaguggagcac

SEQ ID NO: 640844 - RNA, 22 nt, Human
ugcuggccugggcugcaccuug

SEQ ID NO: 640845 - RNA, 18 nt, Human
agacccucuaagggcagu

SEQ ID NO: 640846 - RNA, 22 nt, Human
uguccuguaggaggcagaacaa

SEQ ID NO: 640847 - RNA, 22 nt, Human
ucuucuguauuguuaacucagg

SEQ ID NO: 640848 - RNA, 22 nt, Human
uaguuuauaguuagcgagcacg

SEQ ID NO: 640849 - RNA, 22 nt, Human
gggcugccuuucuucugggagc

SEQ ID NO: 640850 - RNA, 22 nt, Human
ucccacaccugucuauuccuag

SEQ ID NO: 640851 - RNA, 22 nt, Human
cagggcuucgcuccuggugcac

SEQ ID NO: 640852 - RNA, 22 nt, Human
gagaugcuuuguguauagacaa

SEQ ID NO: 640853 - RNA, 22 nt, Human
uagauaacuugcaccuacagga

SEQ ID NO: 640854 - RNA, 18 nt, Human
ucuacccucucagagucu

SEQ ID NO: 640855 - RNA, 22 nt, Human
agcuccagagccacauccauca

SEQ ID NO: 640856 - RNA, 22 nt, Human
gagaugaaucauuccaugguca

SEQ ID NO: 640857 - RNA, 22 nt, Human
cagcagcuuuugcauucucauu

SEQ ID NO: 640858 - RNA, 22 nt, Human
cccagcuccgagcuccgagccg

SEQ ID NO: 640859 - RNA, 21 nt, Human
uugcugcccucccuuuccuca

SEQ ID NO: 640860 - RNA, 22 nt, Human
cucagagaguuaagugaauuac

SEQ ID NO: 640861 - RNA, 22 nt, Human
auacaguagacaaucucaugaa

SEQ ID NO: 640862 - RNA, 22 nt, Human
gcuuuccuggcccugucccugc

SEQ ID NO: 640863 - RNA, 22 nt, Human
uuuggucuuggauuuaucagug

SEQ ID NO: 640864 - RNA, 21 nt, Human
ggaaaauuccauacacccacg

SEQ ID NO: 640865 - RNA, 22 nt, Human
ccauccugcaggaccuccauau

SEQ ID NO: 640866 - RNA, 22 nt, Human
cacccaggacaggccagaugug

SEQ ID NO: 640867 - RNA, 22 nt, Human
guuucacagaugguguucauau

SEQ ID NO: 640868 - RNA, 22 nt, Human
aacagcuucaucacauggcaua

SEQ ID NO: 640869 - RNA, 22 nt, Human
cccucccugaagaaguuacucu

SEQ ID NO: 640870 - RNA, 22 nt, Human
gaggguggguacaccagcccuc

SEQ ID NO: 640871 - RNA, 22 nt, Human
aaugcacauaaauauggucuua

SEQ ID NO: 640872 - RNA, 22 nt, Human
agaagugccgaaaggaagacag

SEQ ID NO: 640873 - RNA, 22 nt, Human
gaagguuuugauuccacugaau

SEQ ID NO: 640874 - RNA, 20 nt, Human
gaacauggcagguggagggg

SEQ ID NO: 640875 - RNA, 22 nt, Human
uugagucugugcccuaugcugu

SEQ ID NO: 640876 - RNA, 22 nt, Human
auagugaaaaugcugucagcau

SEQ ID NO: 640877 - RNA, 22 nt, Human
aaguuccucuucucugcaggga

SEQ ID NO: 640878 - RNA, 22 nt, Human
agcugaaguccucgcggugcua

SEQ ID NO: 640879 - RNA, 22 nt, Human
ccucuggcaagugauuuaucau

SEQ ID NO: 640880 - RNA, 22 nt, Human
guucaaggaagggaggaaagcc

SEQ ID NO: 640881 - RNA, 22 nt, Human
aauaaaauggucaguuuucuca

SEQ ID NO: 640882 - RNA, 21 nt, Human
ggucaguggcuuucuugcacc

SEQ ID NO: 640883 - RNA, 23 nt, Human
uccaggagaaccccugucugucc

SEQ ID NO: 640884 - RNA, 22 nt, Human
agcagugaguaacacagaccag

SEQ ID NO: 640885 - RNA, 22 nt, Human
agguccugaagauuuuacuaga

SEQ ID NO: 640886 - RNA, 22 nt, Human
aagucauugguagcuugauagg

SEQ ID NO: 640887 - RNA, 20 nt, Human
cccugugauuggcaaguguc

SEQ ID NO: 640888 - RNA, 22 nt, Human
ucagagagguuggugauaagaa

SEQ ID NO: 640889 - RNA, 22 nt, Human
auucagagauuguuauucagac

SEQ ID NO: 640890 - RNA, 22 nt, Human
gcuauucauggagcauguacug

SEQ ID NO: 640891 - RNA, 22 nt, Human
cucacugacugcaagucaaguu

SEQ ID NO: 640892 - RNA, 22 nt, Human
uacacuguuugaacuguggucg

SEQ ID NO: 640893 - RNA, 22 nt, Human
uauucaaagugcgaggucaggg

SEQ ID NO: 640894 - RNA, 19 nt, Human
ccagcagacacagcugccc

SEQ ID NO: 640895 - RNA, 22 nt, Human
aggggccuggacauggacgcgc

SEQ ID NO: 640896 - RNA, 22 nt, Human
aaauaugacuagaaugccaggu

SEQ ID NO: 640897 - RNA, 20 nt, Human
uguacacaguacuuuacaau

SEQ ID NO: 640898 - RNA, 22 nt, Human
uacagauagaauuagugaguua

SEQ ID NO: 640899 - RNA, 22 nt, Human
uucaauucugaugaaggcaaua

SEQ ID NO: 640900 - RNA, 22 nt, Human
uccuggcagagagcaugaggcc

SEQ ID NO: 640901 - RNA, 22 nt, Human
aggagaggcaucaagaaaaucg

SEQ ID NO: 640902 - RNA, 22 nt, Human
ccacaaggccuguggggcugcu

SEQ ID NO: 640903 - RNA, 22 nt, Human
cugcucuccccaggccagucug

SEQ ID NO: 640904 - RNA, 22 nt, Human
uuucaccaagguaaccuuugau

SEQ ID NO: 640905 - RNA, 22 nt, Human
agauacaaaggccuacagagca

SEQ ID NO: 640906 - RNA, 19 nt, Human
gcucaggcugugugugggg

SEQ ID NO: 640907 - RNA, 22 nt, Human
aggcagcagacuguuaaucaga

SEQ ID NO: 640908 - RNA, 22 nt, Human
aauacagauauucagugguacu

SEQ ID NO: 640909 - RNA, 22 nt, Human
aaacugcaauuauguuugcaga

SEQ ID NO: 640910 - RNA, 22 nt, Human
aggagcugcaaauauuaguaau

SEQ ID NO: 640911 - RNA, 22 nt, Human
cugcaggguuuuucaaggacaa

SEQ ID NO: 640912 - RNA, 22 nt, Human
uaauugcuaauccugccuucua

SEQ ID NO: 640913 - RNA, 22 nt, Human
uugugugguagcuucauugaac

SEQ ID NO: 640914 - RNA, 17 nt, Human
aaucucaguggcuuaag

SEQ ID NO: 640915 - RNA, 22 nt, Human
cauagaaucauagcacauuuga

SEQ ID NO: 640916 - RNA, 22 nt, Human
aguucacuuucuguaguggaag

SEQ ID NO: 640917 - RNA, 22 nt, Human
aauaauacugcauguaaggugc

SEQ ID NO: 640918 - RNA, 22 nt, Human
ugaauaaaguauguccugggaa

SEQ ID NO: 640919 - RNA, 22 nt, Human
agcaguuuggaaaauacuagaa

SEQ ID NO: 640920 - RNA, 22 nt, Human
uuuuaauuuugcaaaucuggug

SEQ ID NO: 640921 - RNA, 22 nt, Human
gcucucagguacaaagcugugu

SEQ ID NO: 640922 - RNA, 22 nt, Human
caaagcaguauuggauucuuua

SEQ ID NO: 640923 - RNA, 23 nt, Human
ggggccugcaccggucugcgcgg

SEQ ID NO: 640924 - RNA, 22 nt, Human
acagacauauuuggcccauagc

SEQ ID NO: 640925 - RNA, 22 nt, Human
gacacucuccuccaguggauag

SEQ ID NO: 640926 - RNA, 22 nt, Human
uugcaauugcuauggagagcgu

SEQ ID NO: 640927 - RNA, 22 nt, Human
aggaagaugggagagcucugga

SEQ ID NO: 640928 - RNA, 19 nt, Human
uugguggugguuuugguuc

SEQ ID NO: 640929 - RNA, 22 nt, Human
ugccuauucaauauaugcauuu

SEQ ID NO: 640930 - RNA, 22 nt, Human
cuggcagguuuggugucuggug

SEQ ID NO: 640931 - RNA, 22 nt, Human
ucugacuuggcgcucuugucuu

SEQ ID NO: 640932 - RNA, 22 nt, Human
gcugagaggcagccagacccuc

SEQ ID NO: 640933 - RNA, 22 nt, Human
aagauuuucucaacuguauuug

SEQ ID NO: 640934 - RNA, 22 nt, Human
acucugggaucuugaaaagagu

SEQ ID NO: 640935 - RNA, 22 nt, Human
acuccauacaauggcaggcugu

SEQ ID NO: 640936 - RNA, 22 nt, Human
cagagacaaugucucugcuugu

SEQ ID NO: 640937 - RNA, 20 nt, Human
agacccucuggacugggccc

SEQ ID NO: 640938 - RNA, 22 nt, Human
gauguguguuuauacauauauu

SEQ ID NO: 640939 - RNA, 22 nt, Human
aaagaucuaugggcauuuagcu

SEQ ID NO: 640940 - RNA, 22 nt, Human
ugcauacacaugugcacauacg

SEQ ID NO: 640941 - RNA, 22 nt, Human
cucuccagaucugcugagccag

SEQ ID NO: 640942 - RNA, 22 nt, Human
cucagcuggcaauucuggcucc

SEQ ID NO: 640943 - RNA, 22 nt, Human
cucuccuccaggaacucacagu

SEQ ID NO: 640944 - RNA, 22 nt, Human
cuuggucauuuggggcugcuau

SEQ ID NO: 640945 - RNA, 22 nt, Human
agcauccuccuucccagagaug

SEQ ID NO: 640946 - RNA, 22 nt, Human
uuuaucuguccuuugccaguga

SEQ ID NO: 640947 - RNA, 22 nt, Human
uccaggagaccagauguaggcc

SEQ ID NO: 640948 - RNA, 22 nt, Human
aucuggcuauuucuggucgggg

SEQ ID NO: 640949 - RNA, 22 nt, Human
ggugcagugguguggcaaaggg

SEQ ID NO: 640950 - RNA, 20 nt, Human
uuuaccaaaggaguuaugau

SEQ ID NO: 640951 - RNA, 22 nt, Human
ugaguauuuuaaguucucaauc

SEQ ID NO: 640952 - RNA, 22 nt, Human
uguauuuuuagaccuuuagacc

SEQ ID NO: 640953 - RNA, 22 nt, Human
cccagggaagccauuucugacu

SEQ ID NO: 640954 - RNA, 22 nt, Human
cugugaugacaggcagggccaa

SEQ ID NO: 640955 - RNA, 17 nt, Human
accuggagaccaagucc

SEQ ID NO: 640956 - RNA, 22 nt, Human
guuuaauuuuagguugucaagc

SEQ ID NO: 640957 - RNA, 22 nt, Human
ugaggcaugguccugagggagc

SEQ ID NO: 640958 - RNA, 22 nt, Human
ugcucaguuaagcagaggaaau

SEQ ID NO: 640959 - RNA, 22 nt, Human
ucuauuuuuauaguugaagugc

SEQ ID NO: 640960 - RNA, 22 nt, Human
gccaggaaaaaggguggccaau

SEQ ID NO: 640961 - RNA, 22 nt, Human
aucuggggucagacagcccugg

SEQ ID NO: 640962 - RNA, 22 nt, Human
acguuugcuuucuuuggccugg

SEQ ID NO: 640963 - RNA, 22 nt, Human
uuuguucugaaaacucaagucc

SEQ ID NO: 640964 - RNA, 22 nt, Human
acagggcucccagcaggucugu

SEQ ID NO: 640965 - RNA, 22 nt, Human
gccaccuggacagcugugcccu

SEQ ID NO: 640966 - RNA, 22 nt, Human
cuccagggggcauccacacagc

SEQ ID NO: 640967 - RNA, 22 nt, Human
gagaguucuaccucugaaggcg

SEQ ID NO: 640968 - RNA, 22 nt, Human
cugggcugcggugguagguugu

SEQ ID NO: 640969 - RNA, 22 nt, Human
ugauugaauucaaaugcaaucu

SEQ ID NO: 640970 - RNA, 23 nt, Human
cauuugauccucacaauaaaugg

SEQ ID NO: 640971 - RNA, 22 nt, Human
cuggcaggcaaauuggugggag

SEQ ID NO: 640972 - RNA, 22 nt, Human
uuuacacuugaggaaacugagg

SEQ ID NO: 640973 - RNA, 22 nt, Human
uucagagguagagaggaucuug

SEQ ID NO: 640974 - RNA, 22 nt, Human
acacauuuauuacaugcaugug

SEQ ID NO: 640975 - RNA, 22 nt, Human
uucucugggacaggaacaguuu

SEQ ID NO: 640976 - RNA, 22 nt, Human
aguacacagaauucuacuuguu

SEQ ID NO: 640977 - RNA, 21 nt, Human
aucagaaucucuagauuugga

SEQ ID NO: 640978 - RNA, 22 nt, Human
aaaaauguuaucuacuguccga

SEQ ID NO: 640979 - RNA, 22 nt, Human
aaccucucccuuugugucccug

SEQ ID NO: 640980 - RNA, 22 nt, Human
ucugauaaaugccaucuuuuug

SEQ ID NO: 640981 - RNA, 22 nt, Human
uacauugugauaggaagucacc

SEQ ID NO: 640982 - RNA, 22 nt, Human
uccugcagcugaagcucaugug

SEQ ID NO: 640983 - RNA, 22 nt, Human
acaggccagccugggguaaggu

SEQ ID NO: 640984 - RNA, 17 nt, Human
gccugcaggcccgcaga

SEQ ID NO: 640985 - RNA, 22 nt, Human
ucaguguuuguggcaaauguua

SEQ ID NO: 640986 - RNA, 22 nt, Human
uagcagcagugguguauuuaga

SEQ ID NO: 640987 - RNA, 22 nt, Human
ccuugcucaagcuagugacggg

SEQ ID NO: 640988 - RNA, 22 nt, Human
ucuauuagauuauucucaagga

SEQ ID NO: 640989 - RNA, 22 nt, Human
aacaugauuuaguauaaugcag

SEQ ID NO: 640990 - RNA, 22 nt, Human
ucauugucuugauaugauuguc

SEQ ID NO: 640991 - RNA, 22 nt, Human
augcacaggacagccucuacuc

SEQ ID NO: 640992 - RNA, 22 nt, Human
ucaguauaauugcuggcacuga

SEQ ID NO: 640993 - RNA, 22 nt, Human
uuucugugguggguaguucaga

SEQ ID NO: 640994 - RNA, 22 nt, Human
aggucuggaggcggagucagga

SEQ ID NO: 640995 - RNA, 22 nt, Human
gcuccucuauuccccacauuuu

SEQ ID NO: 640996 - RNA, 22 nt, Human
aagagcagccuccaggggugga

SEQ ID NO: 640997 - RNA, 22 nt, Human
ugacuccacaauuugacuuaua

SEQ ID NO: 640998 - RNA, 22 nt, Human
aguauuuagcauagugguuagu

SEQ ID NO: 640999 - RNA, 22 nt, Human
gucuggcauaugcaaagugcau

SEQ ID NO: 641000 - RNA, 22 nt, Human
uggcagaaguucacuaguagcu

SEQ ID NO: 641001 - RNA, 22 nt, Human
cuauagaaacaaccucucuuuc

SEQ ID NO: 641002 - RNA, 22 nt, Human
uguauuuucuucuggaagcuua

SEQ ID NO: 641003 - RNA, 22 nt, Human
aacuuucugucugagcugcaga

SEQ ID NO: 641004 - RNA, 22 nt, Human
ggcuccugggaugggacugagc

SEQ ID NO: 641005 - RNA, 22 nt, Human
ucugagguggggcuggagcauu

SEQ ID NO: 641006 - RNA, 22 nt, Human
ucaggggcccuucccucagcag

SEQ ID NO: 641007 - RNA, 22 nt, Human
uucaguccucacaaccucacua

SEQ ID NO: 641008 - RNA, 22 nt, Human
cuggcagcgcagcaugaagucg

SEQ ID NO: 641009 - RNA, 22 nt, Human
ggcugccugcucaggugcggcg

SEQ ID NO: 641010 - RNA, 22 nt, Human
uguccugugaccuggcaccaca

SEQ ID NO: 641011 - RNA, 22 nt, Human
uccacaggaaagcaccucccau

SEQ ID NO: 641012 - RNA, 22 nt, Human
cuucagaaauaacaacaauuac

SEQ ID NO: 641013 - RNA, 22 nt, Human
cuccuggagggccaaagaaaua

SEQ ID NO: 641014 - RNA, 22 nt, Human
aaagccauaagccuaauacuaa

SEQ ID NO: 641015 - RNA, 22 nt, Human
gcugcagagggaggggcucgca

SEQ ID NO: 641016 - RNA, 22 nt, Human
gcagggcagaccuccagccuau

SEQ ID NO: 641017 - RNA, 22 nt, Human
ucaagucccagcucuucacuua

SEQ ID NO: 641018 - RNA, 22 nt, Human
ccucccagugccuccagagcag

SEQ ID NO: 641019 - RNA, 22 nt, Human
aggaggguggggucugccuguc

SEQ ID NO: 641020 - RNA, 22 nt, Human
gacaguggaaugacccuuugag

SEQ ID NO: 641021 - RNA, 22 nt, Human
gugugccaccagucaaggugaa

SEQ ID NO: 641022 - RNA, 19 nt, Human
cuguuauugucagagcucc

SEQ ID NO: 641023 - RNA, 22 nt, Human
aauagcugauuagccuacaaua

SEQ ID NO: 641024 - RNA, 22 nt, Human
gagcugccuguugcauagcaac

SEQ ID NO: 641025 - RNA, 22 nt, Human
guuuaugcacuugguuuguguc

SEQ ID NO: 641026 - RNA, 22 nt, Human
acaguguuuuagaaaagcuuga

SEQ ID NO: 641027 - RNA, 19 nt, Human
accugcaguaauaauuccu

SEQ ID NO: 641028 - RNA, 22 nt, Human
aaugucuuuugcaguucaagau

SEQ ID NO: 641029 - RNA, 22 nt, Human
uuguccugucaggcugggggcu

SEQ ID NO: 641030 - RNA, 22 nt, Human
ugugacuguggacuuuuguggg

SEQ ID NO: 641031 - RNA, 22 nt, Human
aagccacugagauuucacugca

SEQ ID NO: 641032 - RNA, 22 nt, Human
ucuuugaaagcuguucuagagu

SEQ ID NO: 641033 - RNA, 22 nt, Human
ucugcuggugaugaccucauaa

SEQ ID NO: 641034 - RNA, 22 nt, Human
agcuccuccugagugucuggga

SEQ ID NO: 641035 - RNA, 19 nt, Human
accaggcuuauggucagug

SEQ ID NO: 641036 - RNA, 22 nt, Human
uugaggucuguguaggcagcaa

SEQ ID NO: 641037 - RNA, 22 nt, Human
agagccaggcggcugggcaccu

SEQ ID NO: 641038 - RNA, 22 nt, Human
agugucugaacugggugcugac

SEQ ID NO: 641039 - RNA, 22 nt, Human
caugcucucuggcaacuugugu

SEQ ID NO: 641040 - RNA, 22 nt, Human
ggccagcuuauuagcucagagg

SEQ ID NO: 641041 - RNA, 22 nt, Human
uguacuuauuuuaugucagcac

SEQ ID NO: 641042 - RNA, 22 nt, Human
caguucuggaguuucauucuuu

SEQ ID NO: 641043 - RNA, 22 nt, Human
aagcccugcagucucugccaca

SEQ ID NO: 641044 - RNA, 23 nt, Human
acagugucugcugcaagauaucu

SEQ ID NO: 641045 - RNA, 22 nt, Human
aacacagacauagugauuacag

SEQ ID NO: 641046 - RNA, 22 nt, Human
aacugugggagaaggcgaugug

SEQ ID NO: 641047 - RNA, 22 nt, Human
aucuuuaaagacaugugaacuu

SEQ ID NO: 641048 - RNA, 22 nt, Human
auuccaaagguuaaugcccauu

SEQ ID NO: 641049 - RNA, 19 nt, Human
uggcagcauugguaccuug

SEQ ID NO: 641050 - RNA, 22 nt, Human
gaugaaggggcuggugcccucu

SEQ ID NO: 641051 - RNA, 22 nt, Human
gcacagaaccagacaugaggca

SEQ ID NO: 641052 - RNA, 22 nt, Human
auaauccauuaauuaaugacca

SEQ ID NO: 641053 - RNA, 22 nt, Human
caguuuuaggacauguggaugu

SEQ ID NO: 641054 - RNA, 22 nt, Human
ucucucuggagcuggggcauga

SEQ ID NO: 641055 - RNA, 22 nt, Human
cuuccucuguguccugggcuug

SEQ ID NO: 641056 - RNA, 22 nt, Human
acagcccagcucuuucucugca

SEQ ID NO: 641057 - RNA, 23 nt, Human
uagagcaguagaucaccauggga

SEQ ID NO: 641058 - RNA, 22 nt, Human
gucucuguuauuuccaggguca

SEQ ID NO: 641059 - RNA, 22 nt, Human
uagaauaugauuaauuuucuua

SEQ ID NO: 641060 - RNA, 22 nt, Human
cccugugcacacacuucacucu

SEQ ID NO: 641061 - RNA, 18 nt, Human
gccuuuggacugcuccca

SEQ ID NO: 641062 - RNA, 22 nt, Human
gaaggcuugcagcucuguggca

SEQ ID NO: 641063 - RNA, 22 nt, Human
aagaacauaaacagaaggacag

SEQ ID NO: 641064 - RNA, 22 nt, Human
caggacaguuggcaucugcugc

SEQ ID NO: 641065 - RNA, 22 nt, Human
ugagcacagcuuucacuagaaa

SEQ ID NO: 641066 - RNA, 22 nt, Human
aagacagugaucucugagagau

SEQ ID NO: 641067 - RNA, 22 nt, Human
agcuggaacccgggugggcagc

SEQ ID NO: 641068 - RNA, 22 nt, Human
gugcagcugugugagagcucca

SEQ ID NO: 641069 - RNA, 22 nt, Human
agaaggcucauuugacugcauu

SEQ ID NO: 641070 - RNA, 22 nt, Human
guuuuccugaaacugauggugu

SEQ ID NO: 641071 - RNA, 22 nt, Human
ggaccuuccuggcuccuggggu

SEQ ID NO: 641072 - RNA, 22 nt, Human
caggauauaucucuaguguugg

SEQ ID NO: 641073 - RNA, 22 nt, Human
aagaagcagagcuguggguguu

SEQ ID NO: 641074 - RNA, 22 nt, Human
ugaggcaggagguugagaacug

SEQ ID NO: 641075 - RNA, 22 nt, Human
gggcaccagcggccgcacugcc

SEQ ID NO: 641076 - RNA, 22 nt, Human
uguaaagagaaugguauaugga

SEQ ID NO: 641077 - RNA, 22 nt, Human
acaggguggggauggugagcuu

SEQ ID NO: 641078 - RNA, 22 nt, Human
agcuggucagaguggggauaga

SEQ ID NO: 641079 - RNA, 22 nt, Human
aggcugaggaucguacuuucca

SEQ ID NO: 641080 - RNA, 22 nt, Human
uaguggggaaggaggacaagaa

SEQ ID NO: 641081 - RNA, 22 nt, Human
uucucugguuugcuguuucuga

SEQ ID NO: 641082 - RNA, 22 nt, Human
uucuuucuuuguaguccugaac

SEQ ID NO: 641083 - RNA, 22 nt, Human
auugaggagcagagauggggua

SEQ ID NO: 641084 - RNA, 22 nt, Human
ucaggcugguccccacagugga

SEQ ID NO: 641085 - RNA, 22 nt, Human
uuauuauuuuguguacagcaaa

SEQ ID NO: 641086 - RNA, 22 nt, Human
gauuucaaaaguagauccauca

SEQ ID NO: 641087 - RNA, 22 nt, Human
ucuggcuccugaguccaugcuc

SEQ ID NO: 641088 - RNA, 22 nt, Human
gauugcuucuggaaagcaguuu

SEQ ID NO: 641089 - RNA, 22 nt, Human
ugccugagguggucugcaaaug

SEQ ID NO: 641090 - RNA, 22 nt, Human
gggccuccggggugagcugugg

SEQ ID NO: 641091 - RNA, 22 nt, Human
agucauuucuguagucauguuu

SEQ ID NO: 641092 - RNA, 22 nt, Human
uaaagguuaguagcagggaaac

SEQ ID NO: 641093 - RNA, 22 nt, Human
cuaucauuuuacaugguuggug

SEQ ID NO: 641094 - RNA, 22 nt, Human
gcucugcucccucaaaugacau

SEQ ID NO: 641095 - RNA, 22 nt, Human
acaauuuuccccauagguuauc

SEQ ID NO: 641096 - RNA, 22 nt, Human
uggguaggccaggaagcagugu

SEQ ID NO: 641097 - RNA, 22 nt, Human
uucugagacaauugagagucua

SEQ ID NO: 641098 - RNA, 22 nt, Human
agcaagauuuuucagguuagua

SEQ ID NO: 641099 - RNA, 22 nt, Human
uccaggagguaugaguggcccc

SEQ ID NO: 641100 - RNA, 22 nt, Human
uccagagccuuuccacccacuu

SEQ ID NO: 641101 - RNA, 22 nt, Human
cuccuggacauggagcggagga

SEQ ID NO: 641102 - RNA, 22 nt, Human
uaggaauuuugcaugggaauuu

SEQ ID NO: 641103 - RNA, 22 nt, Human
gcucugugcuagaacuaagaau

SEQ ID NO: 641104 - RNA, 22 nt, Human
agaaggaaggaagcauucuguu

SEQ ID NO: 641105 - RNA, 20 nt, Human
agcuccugaggguuacuuuc

SEQ ID NO: 641106 - RNA, 17 nt, Human
ccucuuccucucagcug

SEQ ID NO: 641107 - RNA, 22 nt, Human
agggcugguauguccaugaaag

SEQ ID NO: 641108 - RNA, 22 nt, Human
ucuuauuauuguuguaaaagca

SEQ ID NO: 641109 - RNA, 22 nt, Human
agaaaauuuaaagagacacaca

SEQ ID NO: 641110 - RNA, 22 nt, Human
ccaggugcuagcaaucacuguc

SEQ ID NO: 641111 - RNA, 22 nt, Human
acaggauggagauaauagaaaa

SEQ ID NO: 641112 - RNA, 22 nt, Human
uguucuuaacuuuuguguauau

SEQ ID NO: 641113 - RNA, 22 nt, Human
gaggugggguuuuguucuugaa

SEQ ID NO: 641114 - RNA, 22 nt, Human
ugucaccagcugcuccucagga

SEQ ID NO: 641115 - RNA, 22 nt, Human
ugggguugccucccgcccugga

SEQ ID NO: 641116 - RNA, 18 nt, Human
gccagagggcccaagguc

SEQ ID NO: 641117 - RNA, 22 nt, Human
ccacagaaaauaaagcacgauu

SEQ ID NO: 641118 - RNA, 22 nt, Human
uggcccugccgccacgacgucu

SEQ ID NO: 641119 - RNA, 22 nt, Human
cugugugcauaguugugcucaa

SEQ ID NO: 641120 - RNA, 22 nt, Human
ugggcagggucucuguuaucag

SEQ ID NO: 641121 - RNA, 22 nt, Human
uccagaggugaacacccaggca

SEQ ID NO: 641122 - RNA, 22 nt, Human
gccuggugauaagcagugaccu

SEQ ID NO: 641123 - RNA, 22 nt, Human
gaagaacugaaaguugaugcac

SEQ ID NO: 641124 - RNA, 22 nt, Human
ucaugcaguuacuguuaugcaa

SEQ ID NO: 641125 - RNA, 22 nt, Human
uuuuuccuagugcuuucuggua

SEQ ID NO: 641126 - RNA, 22 nt, Human
aggucauuccuugucuucuugc

SEQ ID NO: 641127 - RNA, 18 nt, Human
ucuguggagagggcaguu

SEQ ID NO: 641128 - RNA, 22 nt, Human
guggccuuggcuucuacccuga

SEQ ID NO: 641129 - RNA, 22 nt, Human
gggcugacagcacgccuucugu

SEQ ID NO: 641130 - RNA, 20 nt, Human
caaauggcuuuuauuuccuu

SEQ ID NO: 641131 - RNA, 22 nt, Human
cauacaagcguucaauagaugu

SEQ ID NO: 641132 - RNA, 22 nt, Human
cuuauauuuuaggaacagacaa

SEQ ID NO: 641133 - RNA, 22 nt, Human
gccugcagccucaagggcugag

SEQ ID NO: 641134 - RNA, 22 nt, Human
caguaccagucaccacauugau

SEQ ID NO: 641135 - RNA, 22 nt, Human
aaguccuuuccaguccugugau

SEQ ID NO: 641136 - RNA, 22 nt, Human
uuaauuugaccauaaauaucuu

SEQ ID NO: 641137 - RNA, 22 nt, Human
ucacuguuuugccugcacuucc

SEQ ID NO: 641138 - RNA, 22 nt, Human
agcaggcuuucaagagucuucu

SEQ ID NO: 641139 - RNA, 20 nt, Human
agggaacaauggacgcuguc

SEQ ID NO: 641140 - RNA, 22 nt, Human
acaggggcuccgaaggugaggg

SEQ ID NO: 641141 - RNA, 22 nt, Human
auucaaacacuuugagaaguuc

SEQ ID NO: 641142 - RNA, 22 nt, Human
guucuaauaggagaaaagacag

SEQ ID NO: 641143 - RNA, 21 nt, Human
uggagcugccacuuguccucc

SEQ ID NO: 641144 - RNA, 22 nt, Human
uugccguccuuacuccagcgga

SEQ ID NO: 641145 - RNA, 22 nt, Human
agcccagcagaaaguccagccu

SEQ ID NO: 641146 - RNA, 22 nt, Human
gggacugggagauccuccuggc

SEQ ID NO: 641147 - RNA, 17 nt, Human
aaguccagccugcagcu

SEQ ID NO: 641148 - RNA, 17 nt, Human
caacuucacaaacuguc

SEQ ID NO: 641149 - RNA, 22 nt, Human
uauuuaaaauaagccccagugg

SEQ ID NO: 641150 - RNA, 22 nt, Human
uaucauucuucucaccuuugaa

SEQ ID NO: 641151 - RNA, 22 nt, Human
uuucuucugagaucagggagaa

SEQ ID NO: 641152 - RNA, 18 nt, Human
uccaggucccaggggaag

SEQ ID NO: 641153 - RNA, 22 nt, Human
uaaucauauggguaauccaaug

SEQ ID NO: 641154 - RNA, 22 nt, Human
ccuagccuucggccuacccauc

SEQ ID NO: 641155 - RNA, 22 nt, Human
auaagagcuagucuuuuccuug

SEQ ID NO: 641156 - RNA, 22 nt, Human
uucaaugaggauagaacuggau

SEQ ID NO: 641157 - RNA, 22 nt, Human
aagccaaggagaauggccucag

SEQ ID NO: 641158 - RNA, 22 nt, Human
ugcauugggagucagugcugaa

SEQ ID NO: 641159 - RNA, 22 nt, Human
aauuugauuuucuuaaaccaua

SEQ ID NO: 641160 - RNA, 22 nt, Human
cagagggcucaguccugcugga

SEQ ID NO: 641161 - RNA, 22 nt, Human
uacaguaguaagaaugccuuau

SEQ ID NO: 641162 - RNA, 22 nt, Human
ugucuuuaagcaaacaguguuu

SEQ ID NO: 641163 - RNA, 22 nt, Human
uggcaugcaagaggaggcuccc

SEQ ID NO: 641164 - RNA, 22 nt, Human
cuuacaacuuguaugugauugu

SEQ ID NO: 641165 - RNA, 18 nt, Human
uacaggaagggguucucg

SEQ ID NO: 641166 - RNA, 22 nt, Human
gagaaaggcauuccuaugcaaa

SEQ ID NO: 641167 - RNA, 22 nt, Human
acaugggacagagaaagaggcc

SEQ ID NO: 641168 - RNA, 22 nt, Human
uugucucuacagagaguaguag

SEQ ID NO: 641169 - RNA, 22 nt, Human
aaaccuuugccuggaagggagu

SEQ ID NO: 641170 - RNA, 22 nt, Human
uucuuucucacucuuuaggaag

SEQ ID NO: 641171 - RNA, 22 nt, Human
uacagaggcacaugcaauuuuc

SEQ ID NO: 641172 - RNA, 22 nt, Human
aagcagcauaugacagcaucca

SEQ ID NO: 641173 - RNA, 19 nt, Human
ccagucccauacaggagau

SEQ ID NO: 641174 - RNA, 22 nt, Human
uccagaggcagcugcggucagg

SEQ ID NO: 641175 - RNA, 22 nt, Human
acaguggaagcaugaugcuauc

SEQ ID NO: 641176 - RNA, 22 nt, Human
uagagcuggccgggacagcugg

SEQ ID NO: 641177 - RNA, 22 nt, Human
acagcagguuuuaacuuugaag

SEQ ID NO: 641178 - RNA, 21 nt, Human
agucugagguggggccuagga

SEQ ID NO: 641179 - RNA, 22 nt, Human
acaaguuaccaaaaaagauuca

SEQ ID NO: 641180 - RNA, 22 nt, Human
uaucucuugcaugcuuuuuaga

SEQ ID NO: 641181 - RNA, 22 nt, Human
cuuggacuuuagucucucucca

SEQ ID NO: 641182 - RNA, 22 nt, Human
agggucuguuguuuguucugga

SEQ ID NO: 641183 - RNA, 22 nt, Human
caguuuuaaauuguuagauaau

SEQ ID NO: 641184 - RNA, 22 nt, Human
ucagacagauuuugacacuugc

SEQ ID NO: 641185 - RNA, 22 nt, Human
guucacaucacuucacugaacc

SEQ ID NO: 641186 - RNA, 22 nt, Human
uuacagagggcuucucugaacu

SEQ ID NO: 641187 - RNA, 22 nt, Human
ggcugcugaaguguggcaaucu

SEQ ID NO: 641188 - RNA, 22 nt, Human
ccagcuggugacauccccaacc

SEQ ID NO: 641189 - RNA, 20 nt, Human
ugagaaaguagagacucagg

SEQ ID NO: 641190 - RNA, 22 nt, Human
gaggcagcagggcugguuccuu

SEQ ID NO: 641191 - RNA, 22 nt, Human
gucuggagagcugagcagaguu

SEQ ID NO: 641192 - RNA, 22 nt, Human
cacacauuccaaaaucaagggu

SEQ ID NO: 641193 - RNA, 22 nt, Human
cuguuacuguauuuaaucaucu

SEQ ID NO: 641194 - RNA, 22 nt, Human
ggcuggcagaagugugcuggcu

SEQ ID NO: 641195 - RNA, 22 nt, Human
aggaaugucugagaaagaggca

SEQ ID NO: 641196 - RNA, 22 nt, Human
ugcugugucuuucugugaaaag

SEQ ID NO: 641197 - RNA, 20 nt, Human
aaucacaguuaacucuuucu

SEQ ID NO: 641198 - RNA, 22 nt, Human
acacauauaugugcguguauau

SEQ ID NO: 641199 - RNA, 22 nt, Human
uggcagcuccggguaggggcug

SEQ ID NO: 641200 - RNA, 22 nt, Human
gucugcccugcagacaugccuc

SEQ ID NO: 641201 - RNA, 22 nt, Human
cuaauaauagagguggcauuug

SEQ ID NO: 641202 - RNA, 22 nt, Human
aggaagcugccugggaugggaa

SEQ ID NO: 641203 - RNA, 22 nt, Human
aauugcacuuuagcaaugguga

SEQ ID NO: 641204 - RNA, 22 nt, Human
gccaccuggacucagagccagg

SEQ ID NO: 641205 - RNA, 22 nt, Human
aaacugcacacgaugugccuga

SEQ ID NO: 641206 - RNA, 22 nt, Human
gaugccugcauuucaggagagu

SEQ ID NO: 641207 - RNA, 22 nt, Human
ccaagcauuucuagccagucac

SEQ ID NO: 641208 - RNA, 22 nt, Human
cgauggagagguccugauaguu

SEQ ID NO: 641209 - RNA, 18 nt, Human
uuugcaaaggaaguaugg

SEQ ID NO: 641210 - RNA, 22 nt, Human
uuccaugacaccgagggaaguc

SEQ ID NO: 641211 - RNA, 22 nt, Human
ugacagaaauaguucuuaauuu

SEQ ID NO: 641212 - RNA, 22 nt, Human
cucccucacaaagcauucucuu

SEQ ID NO: 641213 - RNA, 22 nt, Human
cccucugaccuccugccacagu

SEQ ID NO: 641214 - RNA, 22 nt, Human
caggacccaucagccaggcacu

SEQ ID NO: 641215 - RNA, 22 nt, Human
cucucccuugggugggcuuugg

SEQ ID NO: 641216 - RNA, 22 nt, Human
aggcucaggucucaggucuggc

SEQ ID NO: 641217 - RNA, 22 nt, Human
cgcaggcacagaguggacagcg

SEQ ID NO: 641218 - RNA, 20 nt, Human
accauuaauguaagcuuugu

SEQ ID NO: 641219 - RNA, 22 nt, Human
auuuuagcuguccaguggauug

SEQ ID NO: 641220 - RNA, 22 nt, Human
ugcuugggaauguggagucaga

SEQ ID NO: 641221 - RNA, 22 nt, Human
caauacaucaggucaaaaugug

SEQ ID NO: 641222 - RNA, 20 nt, Human
ucugcccaccccggcuccca

SEQ ID NO: 641223 - RNA, 22 nt, Human
gcauccagguagagcuugcggg

SEQ ID NO: 641224 - RNA, 22 nt, Human
aagagaaggugaggaagccggu

SEQ ID NO: 641225 - RNA, 22 nt, Human
auucugagaggcacaaugugga

SEQ ID NO: 641226 - RNA, 22 nt, Human
ccagcauucacacugguuccuu

SEQ ID NO: 641227 - RNA, 19 nt, Human
uauuuucguggaggccuau

SEQ ID NO: 641228 - RNA, 22 nt, Human
gacagggcauggugcagaguuc

SEQ ID NO: 641229 - RNA, 22 nt, Human
uggaacaagacagcauagagcu

SEQ ID NO: 641230 - RNA, 22 nt, Human
uuguagaaaauucucuuggaua

SEQ ID NO: 641231 - RNA, 21 nt, Human
cugauaauuguuaaauuauuu

SEQ ID NO: 641232 - RNA, 22 nt, Human
ugcacaaauuuguguaugcuca

SEQ ID NO: 641233 - RNA, 20 nt, Human
uacaaagaaugagguucagg

SEQ ID NO: 641234 - RNA, 22 nt, Human
ggaggccuugccugcaggcaca

SEQ ID NO: 641235 - RNA, 22 nt, Human
acauaacacucuucucuaguga

SEQ ID NO: 641236 - RNA, 21 nt, Human
gccagcugcagggcuuccuug

SEQ ID NO: 641237 - RNA, 22 nt, Human
gugcacagauucagagguuuug

SEQ ID NO: 641238 - RNA, 22 nt, Human
cagcuccaaagccccacugucc

SEQ ID NO: 641239 - RNA, 22 nt, Human
augagagucucagagucucuuc

SEQ ID NO: 641240 - RNA, 22 nt, Human
uuugagaaacugauuauuaugg

SEQ ID NO: 641241 - RNA, 22 nt, Human
cccauggcagucagagauaaga

SEQ ID NO: 641242 - RNA, 22 nt, Human
aucaucuugaaagucuauguuu

SEQ ID NO: 641243 - RNA, 22 nt, Human
uguguuaaggugcaucuagugc

SEQ ID NO: 641244 - RNA, 22 nt, Human
gaggcagagacuccaccuucag

SEQ ID NO: 641245 - RNA, 22 nt, Human
gggcuccuccucugacuguggc

SEQ ID NO: 641246 - RNA, 23 nt, Human
uaucauuucagcucucugccugg

SEQ ID NO: 641247 - RNA, 22 nt, Human
ucucaguggacgugucugucuu

SEQ ID NO: 641248 - RNA, 22 nt, Human
uguuucaggaccuaucuuuuag

SEQ ID NO: 641249 - RNA, 21 nt, Human
aggagaccggcuuguuugugc

SEQ ID NO: 641250 - RNA, 22 nt, Human
ugggcuccguugccuggggcag

SEQ ID NO: 641251 - RNA, 22 nt, Human
ucaaugucugucuaucuauuua

SEQ ID NO: 641252 - RNA, 22 nt, Human
agcgauucacacacugggcugu

SEQ ID NO: 641253 - RNA, 19 nt, Human
caccccaguccucuuuccc

SEQ ID NO: 641254 - RNA, 22 nt, Human
uuugaaagacagaauauuuuug

SEQ ID NO: 641255 - RNA, 22 nt, Human
aggagcugugaaugggaggggu

SEQ ID NO: 641256 - RNA, 22 nt, Human
aagcgacugcagguuaaaacaa

SEQ ID NO: 641257 - RNA, 22 nt, Human
cugccaggggccucacaggcca

SEQ ID NO: 641258 - RNA, 22 nt, Human
agucccuucucaaagugugcgg

SEQ ID NO: 641259 - RNA, 22 nt, Human
ccagggcuucagagguuuuggc

SEQ ID NO: 641260 - RNA, 19 nt, Human
gaggggaggaauugacaag

SEQ ID NO: 641261 - RNA, 22 nt, Human
ugagcuguaaggcugucacuga

SEQ ID NO: 641262 - RNA, 23 nt, Human
aaaugacuaaauguucuuauaga

SEQ ID NO: 641263 - RNA, 22 nt, Human
gagcugcuggauauguggccug

SEQ ID NO: 641264 - RNA, 21 nt, Human
aggaguugcuguggccugguu

SEQ ID NO: 641265 - RNA, 21 nt, Human
ggacuuggaugguggcaguag

SEQ ID NO: 641266 - RNA, 22 nt, Human
acucugccuuucagcagaugaa

SEQ ID NO: 641267 - RNA, 22 nt, Human
aaauugcugggucccacccaag

SEQ ID NO: 641268 - RNA, 22 nt, Human
aagugacaccucuucccuuucc

SEQ ID NO: 641269 - RNA, 21 nt, Human
ugcagcuggguucugguuugc

SEQ ID NO: 641270 - RNA, 22 nt, Human
uggcuacaguggcauaucaaau

SEQ ID NO: 641271 - RNA, 22 nt, Human
gaagcacugugcugcuaaguug

SEQ ID NO: 641272 - RNA, 22 nt, Human
ucauuuacaugucuuucucuga

SEQ ID NO: 641273 - RNA, 22 nt, Human
gcugucacaaauauuucucagc

SEQ ID NO: 641274 - RNA, 22 nt, Human
acucugggauuguuucugguau

SEQ ID NO: 641275 - RNA, 22 nt, Human
uagacagugagcuaugaguggu

SEQ ID NO: 641276 - RNA, 22 nt, Human
acuguuucucaaauuauguggu

SEQ ID NO: 641277 - RNA, 22 nt, Human
gcugucugcugggucgcucagg

SEQ ID NO: 641278 - RNA, 22 nt, Human
acuuuucugcagaugaucucuu

SEQ ID NO: 641279 - RNA, 22 nt, Human
gcugucaguuuuacccacagac

SEQ ID NO: 641280 - RNA, 22 nt, Human
gaagagcuuaguuguccuagaa

SEQ ID NO: 641281 - RNA, 22 nt, Human
uuuccacacaggcucuacuacu

SEQ ID NO: 641282 - RNA, 20 nt, Human
ggaacacuguucauucugua

SEQ ID NO: 641283 - RNA, 22 nt, Human
gucuccugcccccggugcuugg

SEQ ID NO: 641284 - RNA, 22 nt, Human
caaaugcuggcccugcuacuua

SEQ ID NO: 641285 - RNA, 18 nt, Human
cuggcuuucuuauccauc

SEQ ID NO: 641286 - RNA, 22 nt, Human
gagcuagaguuuguaggguaga

SEQ ID NO: 641287 - RNA, 22 nt, Human
ugcaggcugcaccccugcccug

SEQ ID NO: 641288 - RNA, 19 nt, Human
gggcccagcauggaggguu

SEQ ID NO: 641289 - RNA, 22 nt, Human
uguggagaagaaggccacugca

SEQ ID NO: 641290 - RNA, 22 nt, Human
gggauggccuagacuagcuugg

SEQ ID NO: 641291 - RNA, 22 nt, Human
agcccuccucacaucagcgucc

SEQ ID NO: 641292 - RNA, 22 nt, Human
uagcuuuuauccacugcuuuug

SEQ ID NO: 641293 - RNA, 22 nt, Human
agcagcugcagagggcuccccc

SEQ ID NO: 641294 - RNA, 22 nt, Human
ucucacccaacgugcaaugagu

SEQ ID NO: 641295 - RNA, 22 nt, Human
ugcagggccuuguugaugugcu

SEQ ID NO: 641296 - RNA, 22 nt, Human
ucacacaggguucuggucucau

SEQ ID NO: 641297 - RNA, 22 nt, Human
aaacauuugcaacucgguuugg

SEQ ID NO: 641298 - RNA, 22 nt, Human
cauggccacaucuagcugcaag

SEQ ID NO: 641299 - RNA, 22 nt, Human
gaccucuugcacccuggcucuu

SEQ ID NO: 641300 - RNA, 22 nt, Human
uuaaagcccagcauauacuagg

SEQ ID NO: 641301 - RNA, 22 nt, Human
acuccuggggcugccaucacag

SEQ ID NO: 641302 - RNA, 22 nt, Human
ccugucuacauaacugugugaa

SEQ ID NO: 641303 - RNA, 19 nt, Human
gcuuuucuccuucaagcca

SEQ ID NO: 641304 - RNA, 22 nt, Human
aucagcucauuuugauggaaau

SEQ ID NO: 641305 - RNA, 22 nt, Human
gaaauuuauuaucuacaucauu

SEQ ID NO: 641306 - RNA, 22 nt, Human
uggguaaacugggucuggagag

SEQ ID NO: 641307 - RNA, 22 nt, Human
ucauccugucucacuuuuugcu

SEQ ID NO: 641308 - RNA, 22 nt, Human
ugggucaguuugggggccagcc

SEQ ID NO: 641309 - RNA, 22 nt, Human
uuugacaggacuaacauauggc

SEQ ID NO: 641310 - RNA, 22 nt, Human
uguguucauuucucucugcugu

SEQ ID NO: 641311 - RNA, 22 nt, Human
gauccccaggacuagggggugg

SEQ ID NO: 641312 - RNA, 22 nt, Human
auggcuugucuaugagugcucu

SEQ ID NO: 641313 - RNA, 22 nt, Human
accugcuuuauuccuccugccu

SEQ ID NO: 641314 - RNA, 22 nt, Human
ucaggcuuggugcuccagugcc

SEQ ID NO: 641315 - RNA, 22 nt, Human
uugaagagugccuuccagacau

SEQ ID NO: 641316 - RNA, 22 nt, Human
gaaggccacaaaaaaugucaua

SEQ ID NO: 641317 - RNA, 22 nt, Human
ucauguuauugacucauaauau

SEQ ID NO: 641318 - RNA, 22 nt, Human
gggcugagggguaucucauggg

SEQ ID NO: 641319 - RNA, 20 nt, Human
agaagucagcucagaaguga

SEQ ID NO: 641320 - RNA, 22 nt, Human
cagaagugaaugugauaaacca

SEQ ID NO: 641321 - RNA, 22 nt, Human
cauuuacagugagaguuuuuac

SEQ ID NO: 641322 - RNA, 22 nt, Human
aagauucuagaggaacuucuua

SEQ ID NO: 641323 - RNA, 22 nt, Human
gaacacagugugaucguauguc

SEQ ID NO: 641324 - RNA, 22 nt, Human
uccucagaauggauggcagggg

SEQ ID NO: 641325 - RNA, 22 nt, Human
ccucgaccuccccaggcucagg

SEQ ID NO: 641326 - RNA, 22 nt, Human
uggagguggcaucugacagcug

SEQ ID NO: 641327 - RNA, 22 nt, Human
aaaggucuugucuugacagagu

SEQ ID NO: 641328 - RNA, 22 nt, Human
ucucagugauggcccauuugga

SEQ ID NO: 641329 - RNA, 22 nt, Human
gcauuucugugcauacacauga

SEQ ID NO: 641330 - RNA, 22 nt, Human
uauguacucaucaacuauugaa

SEQ ID NO: 641331 - RNA, 23 nt, Human
ccagucucacguauacaggauuu

SEQ ID NO: 641332 - RNA, 22 nt, Human
gauuaacaaauuucauauccaa

SEQ ID NO: 641333 - RNA, 22 nt, Human
ggggccuuggaucugugccccg

SEQ ID NO: 641334 - RNA, 22 nt, Human
augggcugacccagucguggca

SEQ ID NO: 641335 - RNA, 22 nt, Human
aggaagccuggggcugcccucg

SEQ ID NO: 641336 - RNA, 20 nt, Human
ggcaagcaacugagggagga

SEQ ID NO: 641337 - RNA, 20 nt, Human
cugaaagacguaacagugca

SEQ ID NO: 641338 - RNA, 22 nt, Human
aguggcagagucaggguuugga

SEQ ID NO: 641339 - RNA, 22 nt, Human
auguacauuuuccuaauguuuu

SEQ ID NO: 641340 - RNA, 22 nt, Human
acugcuucuccaaugaauuaga

SEQ ID NO: 641341 - RNA, 22 nt, Human
ggaccugcucucccaguucucu

SEQ ID NO: 641342 - RNA, 17 nt, Human
gcugccugcaacugacu

SEQ ID NO: 641343 - RNA, 22 nt, Human
auucccaucgucaacuucacug

SEQ ID NO: 641344 - RNA, 22 nt, Human
auaaaugugaauuagagcuuug

SEQ ID NO: 641345 - RNA, 22 nt, Human
ccacccuguguuuuugccauug

SEQ ID NO: 641346 - RNA, 22 nt, Human
auuuauugagacuuaacaaccc

SEQ ID NO: 641347 - RNA, 22 nt, Human
uaucacauaguguuuaguaaau

SEQ ID NO: 641348 - RNA, 18 nt, Human
gcagggacacagggucac

SEQ ID NO: 641349 - RNA, 22 nt, Human
guuauuuuaucucugagagguu

SEQ ID NO: 641350 - RNA, 22 nt, Human
gggagggaggugaugcuuggcu

SEQ ID NO: 641351 - RNA, 22 nt, Human
uugaaacaguagcucauagacc

SEQ ID NO: 641352 - RNA, 22 nt, Human
uggcccaggugcaagagacaga

SEQ ID NO: 641353 - RNA, 22 nt, Human
gccacaugucaugugcucagua

SEQ ID NO: 641354 - RNA, 22 nt, Human
aggguauaaagagcaagcagaa

SEQ ID NO: 641355 - RNA, 22 nt, Human
uaacaaugcaaaaugaauuuag

SEQ ID NO: 641356 - RNA, 22 nt, Human
aggccugcagcaggagcaaacc

SEQ ID NO: 641357 - RNA, 22 nt, Human
ugcaggcucacccuggagcuga

SEQ ID NO: 641358 - RNA, 22 nt, Human
ggcuccagaggccuuaccugca

SEQ ID NO: 641359 - RNA, 21 nt, Human
cagacaugagucucagcuuug

SEQ ID NO: 641360 - RNA, 22 nt, Human
cugcaguagcagagcugaguag

SEQ ID NO: 641361 - RNA, 22 nt, Human
ugaagccagggacugacacuuc

SEQ ID NO: 641362 - RNA, 22 nt, Human
caugucacaauucuuaauggga

SEQ ID NO: 641363 - RNA, 22 nt, Human
caaugucugggagaccugugau

SEQ ID NO: 641364 - RNA, 22 nt, Human
cugggccugucagggcuuuuug

SEQ ID NO: 641365 - RNA, 19 nt, Human
ucagcccaggcugggaagc

SEQ ID NO: 641366 - RNA, 22 nt, Human
aucauucaaaugauuuggaggu

SEQ ID NO: 641367 - RNA, 22 nt, Human
uucagacacagcgcugggaaau

SEQ ID NO: 641368 - RNA, 22 nt, Human
aauaagaacaacuaagguuuau

SEQ ID NO: 641369 - RNA, 22 nt, Human
ucugaggugucacaaggccagg

SEQ ID NO: 641370 - RNA, 22 nt, Human
ugcuccguucuucugcuucuug

SEQ ID NO: 641371 - RNA, 23 nt, Human
gggaagugaggagccccucagcc

SEQ ID NO: 641372 - RNA, 22 nt, Human
ggagacagugguagggccuaag

SEQ ID NO: 641373 - RNA, 22 nt, Human
cccuggcugccagucaccagac

SEQ ID NO: 641374 - RNA, 22 nt, Human
uucaaaugcaaguuacuacuuu

SEQ ID NO: 641375 - RNA, 22 nt, Human
ucuuuuaagccucuggcauagg

SEQ ID NO: 641376 - RNA, 22 nt, Human
aacagcagggacuugaauggaa

SEQ ID NO: 641377 - RNA, 22 nt, Human
auuucaacguuagauguaauag

SEQ ID NO: 641378 - RNA, 22 nt, Human
gcugcucagugggccugagccu

SEQ ID NO: 641379 - RNA, 22 nt, Human
agaaaaacuaagaguggguggu

SEQ ID NO: 641380 - RNA, 22 nt, Human
gugagcagaauaaggguugaga

SEQ ID NO: 641381 - RNA, 21 nt, Human
acacaacaggcagucauuuuc

SEQ ID NO: 641382 - RNA, 22 nt, Human
uucacaaaaaugcugaacaguu

SEQ ID NO: 641383 - RNA, 22 nt, Human
uuaugcaaagaaauagacuaau

SEQ ID NO: 641384 - RNA, 22 nt, Human
ugcugcucucagccaccaggaa

SEQ ID NO: 641385 - RNA, 22 nt, Human
uaguucuugguucuuaguucuu

SEQ ID NO: 641386 - RNA, 22 nt, Human
ucucugggcccagaccuuccuu

SEQ ID NO: 641387 - RNA, 22 nt, Human
caggcagacauuuuugacauag

SEQ ID NO: 641388 - RNA, 22 nt, Human
uuuugugacagaaagauuaagu

SEQ ID NO: 641389 - RNA, 17 nt, Human
aggugcuggagcaucag

SEQ ID NO: 641390 - RNA, 21 nt, Human
agaggccaagucaucauuucc

SEQ ID NO: 641391 - RNA, 22 nt, Human
gcucaguguucaucuguaugca

SEQ ID NO: 641392 - RNA, 22 nt, Human
augggcagggcaguguauaaga

SEQ ID NO: 641393 - RNA, 22 nt, Human
ccagauucauagaaacucauag

SEQ ID NO: 641394 - RNA, 22 nt, Human
ucccugggcaucacguugcuuc

SEQ ID NO: 641395 - RNA, 22 nt, Human
cuucuuguaaacgguuccccga

SEQ ID NO: 641396 - RNA, 22 nt, Human
ugcugcuuugauguguaaauca

SEQ ID NO: 641397 - RNA, 22 nt, Human
uuucugaacuugguacuggagc

SEQ ID NO: 641398 - RNA, 22 nt, Human
cuggcugcuuguuuugaugggu

SEQ ID NO: 641399 - RNA, 22 nt, Human
acagccuggccugaguuaaggc

SEQ ID NO: 641400 - RNA, 22 nt, Human
gaaaggccauuucugaggguuu

SEQ ID NO: 641401 - RNA, 22 nt, Human
cuggcccagagcucuggccuuu

SEQ ID NO: 641402 - RNA, 22 nt, Human
cauugucucuugucauuuagua

SEQ ID NO: 641403 - RNA, 22 nt, Human
uuauugaagcaagcuuuucuga

SEQ ID NO: 641404 - RNA, 22 nt, Human
uucauauuucuuuaaggacuuu

SEQ ID NO: 641405 - RNA, 22 nt, Human
aaucgaaagcugagggagcauu

SEQ ID NO: 641406 - RNA, 22 nt, Human
uuggcugguaagccaaaugaaa

SEQ ID NO: 641407 - RNA, 22 nt, Human
ggcuucucgugccgaagcaaga

SEQ ID NO: 641408 - RNA, 22 nt, Human
ggcugagcacuuuaggcaggag

SEQ ID NO: 641409 - RNA, 22 nt, Human
ugcuggcuguguaccaucucaa

SEQ ID NO: 641410 - RNA, 22 nt, Human
gggaguggggcuuaccuugaag

SEQ ID NO: 641411 - RNA, 22 nt, Human
gcugaggcuuagcuaaaaauuu

SEQ ID NO: 641412 - RNA, 22 nt, Human
acuuuggcacagaacuuccauu

SEQ ID NO: 641413 - RNA, 22 nt, Human
uggagaugaacauggugauguu

SEQ ID NO: 641414 - RNA, 22 nt, Human
uuuccuggaccaacugagauug

SEQ ID NO: 641415 - RNA, 22 nt, Human
ucagugccaugggcagacaggc

SEQ ID NO: 641416 - RNA, 22 nt, Human
uucucugagauagacuaagugg

SEQ ID NO: 641417 - RNA, 22 nt, Human
ugaaggaaugaguauacuguuu

SEQ ID NO: 641418 - RNA, 22 nt, Human
gugaacaggagaaagugaugga

SEQ ID NO: 641419 - RNA, 20 nt, Human
accaggccccgggcccugca

SEQ ID NO: 641420 - RNA, 22 nt, Human
ccugcacuaccuggggcugcug

SEQ ID NO: 641421 - RNA, 22 nt, Human
gaaauaaccucaugcaccauga

SEQ ID NO: 641422 - RNA, 22 nt, Human
uauuccuuggcaaaaaauauau

SEQ ID NO: 641423 - RNA, 22 nt, Human
gcagcguggggacaggagcuca

SEQ ID NO: 641424 - RNA, 23 nt, Human
gcccucaguagaaaauguuagaa

SEQ ID NO: 641425 - RNA, 22 nt, Human
cugggccacaaaaaacuccugu

SEQ ID NO: 641426 - RNA, 22 nt, Human
accuggaugcuggccuugccuu

SEQ ID NO: 641427 - RNA, 21 nt, Human
uaagaacauuaucuucuuccu

SEQ ID NO: 641428 - RNA, 22 nt, Human
caugcagauuugcugagauaau

SEQ ID NO: 641429 - RNA, 22 nt, Human
caggcagaaauuuuguuucauu

SEQ ID NO: 641430 - RNA, 22 nt, Human
agaugugggcaauggaauggag

SEQ ID NO: 641431 - RNA, 22 nt, Human
ugacaaagacaaagauaugucc

SEQ ID NO: 641432 - RNA, 22 nt, Human
aagaugugcuaucaacuggaga

SEQ ID NO: 641433 - RNA, 22 nt, Human
ucugucugccuugugagggcac

SEQ ID NO: 641434 - RNA, 22 nt, Human
aaagugcaaggauuacaggcau

SEQ ID NO: 641435 - RNA, 22 nt, Human
cuccugggcuaugucugcuugg

SEQ ID NO: 641436 - RNA, 22 nt, Human
ucuggcuuuccuggagcaagaa

SEQ ID NO: 641437 - RNA, 22 nt, Human
augggcaguguauuggaaggaa

SEQ ID NO: 641438 - RNA, 22 nt, Human
auauuuguuuggcagaguucag

SEQ ID NO: 641439 - RNA, 22 nt, Human
auuauuaaagcuuaggucuuau

SEQ ID NO: 641440 - RNA, 22 nt, Human
guggcagucgcugacagauaca

SEQ ID NO: 641441 - RNA, 22 nt, Human
ucaccaauaauaacuugagaau

SEQ ID NO: 641442 - RNA, 22 nt, Human
aagucugagagaaacucucuca

SEQ ID NO: 641443 - RNA, 22 nt, Human
ucaaggaaggucuguugcucca

SEQ ID NO: 641444 - RNA, 21 nt, Human
aucuggaaauucugccagaga

SEQ ID NO: 641445 - RNA, 22 nt, Human
cugauggaugcuacguaagagg

SEQ ID NO: 641446 - RNA, 22 nt, Human
ggcugggcagcagcuguuaagc

SEQ ID NO: 641447 - RNA, 22 nt, Human
ggcuuugcccuggacugaggca

SEQ ID NO: 641448 - RNA, 22 nt, Human
aacaauuagacugacgguauua

SEQ ID NO: 641449 - RNA, 22 nt, Human
ggcucagacucccaggcccucu

SEQ ID NO: 641450 - RNA, 22 nt, Human
cuuccagcuuguggcgcuuucc

SEQ ID NO: 641451 - RNA, 22 nt, Human
uucagggacuuagugucaguuu

SEQ ID NO: 641452 - RNA, 22 nt, Human
ggaagggaguaguuggaaugca

SEQ ID NO: 641453 - RNA, 22 nt, Human
cccugauguuuucucugccuuu

SEQ ID NO: 641454 - RNA, 22 nt, Human
gcagaaguaccucguucuaguu

SEQ ID NO: 641455 - RNA, 21 nt, Human
ucagcagaaggaccacuaggg

SEQ ID NO: 641456 - RNA, 22 nt, Human
gggcugaucgcuugagcucagg

SEQ ID NO: 641457 - RNA, 22 nt, Human
agccacaaaggcuugccucgga

SEQ ID NO: 641458 - RNA, 22 nt, Human
agccucucuuucugguggcuaa

SEQ ID NO: 641459 - RNA, 22 nt, Human
gaauccaggguuguuugagcua

SEQ ID NO: 641460 - RNA, 22 nt, Human
gagcacaguccuuuuguuaaaa

SEQ ID NO: 641461 - RNA, 22 nt, Human
agggaauucacuggaacgcccu

SEQ ID NO: 641462 - RNA, 22 nt, Human
gugggcugcccuugaggucagc

SEQ ID NO: 641463 - RNA, 22 nt, Human
caguccuggagcccuucuuggc

SEQ ID NO: 641464 - RNA, 22 nt, Human
uuaauccauggcaguuauuaaa

SEQ ID NO: 641465 - RNA, 22 nt, Human
ccugcugcuuaggccauauuuc

SEQ ID NO: 641466 - RNA, 16 nt, Human
gaggcuggcagauguc

SEQ ID NO: 641467 - RNA, 23 nt, Human
uucaucaguugcuguugcagaac

SEQ ID NO: 641468 - RNA, 22 nt, Human
aauagcauaagaugucaaauag

SEQ ID NO: 641469 - RNA, 22 nt, Human
ucugcagagguaauuuacagau

SEQ ID NO: 641470 - RNA, 22 nt, Human
ccucuggguaucuguggaagua

SEQ ID NO: 641471 - RNA, 22 nt, Human
uucacauggcaauagagaggga

SEQ ID NO: 641472 - RNA, 22 nt, Human
auuaacacuuuggagucugcuc

SEQ ID NO: 641473 - RNA, 22 nt, Human
uuagaaucagaagagagguauu

SEQ ID NO: 641474 - RNA, 22 nt, Human
ugccaucacugaacuucugaaa

SEQ ID NO: 641475 - RNA, 22 nt, Human
uuugcaaaaugaggugaagagu

SEQ ID NO: 641476 - RNA, 22 nt, Human
uacacuuguucaaacagcaaaa

SEQ ID NO: 641477 - RNA, 22 nt, Human
acaauauuugggggcaguuugu

SEQ ID NO: 641478 - RNA, 22 nt, Human
acagacuguuugguucaugucu

SEQ ID NO: 641479 - RNA, 23 nt, Human
gcuggcuggcaguaaagguuguu

SEQ ID NO: 641480 - RNA, 22 nt, Human
agaugaaagauuuuuauagaga

SEQ ID NO: 641481 - RNA, 22 nt, Human
gucugaauucuguguaacucua

SEQ ID NO: 641482 - RNA, 22 nt, Human
ccagagagauugcuucuaaaga

SEQ ID NO: 641483 - RNA, 23 nt, Human
auauggcuguuguguguuaacau

SEQ ID NO: 641484 - RNA, 22 nt, Human
uuccaggaugggcuguccuacu

SEQ ID NO: 641485 - RNA, 22 nt, Human
aaugaucaccugguaaagagag

SEQ ID NO: 641486 - RNA, 22 nt, Human
aagggcuggccacauucugggu

SEQ ID NO: 641487 - RNA, 22 nt, Human
ggcucccuggaaaucccgaggc

SEQ ID NO: 641488 - RNA, 22 nt, Human
auuucugauaaacguaagcugc

SEQ ID NO: 641489 - RNA, 22 nt, Human
agaggcugaaugaugucaucau

SEQ ID NO: 641490 - RNA, 22 nt, Human
acuagggaaaguuauguucaca

SEQ ID NO: 641491 - RNA, 22 nt, Human
uugcuuuacauguucugguaaa

SEQ ID NO: 641492 - RNA, 22 nt, Human
ucuacugugguccuuguaacca

SEQ ID NO: 641493 - RNA, 22 nt, Human
ccuggagccccucuggccagcc

SEQ ID NO: 641494 - RNA, 22 nt, Human
augcaggagagcauguuuaaga

SEQ ID NO: 641495 - RNA, 22 nt, Human
agggagcuauuucaggguuauu

SEQ ID NO: 641496 - RNA, 22 nt, Human
gccaugaggcuccgagaaguca

SEQ ID NO: 641497 - RNA, 22 nt, Human
cauggccaggcacgcgcauagc

SEQ ID NO: 641498 - RNA, 22 nt, Human
aauugcuuguuuucggucauaa

SEQ ID NO: 641499 - RNA, 22 nt, Human
ugggccacacacagaagaauca

SEQ ID NO: 641500 - RNA, 22 nt, Human
cacccacauuccaucacucugc

SEQ ID NO: 641501 - RNA, 22 nt, Human
acacuggaccauuuaaacuuga

SEQ ID NO: 641502 - RNA, 22 nt, Human
auauucuugugauuauaaagua

SEQ ID NO: 641503 - RNA, 22 nt, Human
cccugggaguccacugauguca

SEQ ID NO: 641504 - RNA, 22 nt, Human
uguggccugggaaaugaguguu

SEQ ID NO: 641505 - RNA, 22 nt, Human
agacauaggauuccacauagca

SEQ ID NO: 641506 - RNA, 22 nt, Human
ggaauauagccaguaacaguca

SEQ ID NO: 641507 - RNA, 22 nt, Human
ucuguuuaaugggaaugauacu

SEQ ID NO: 641508 - RNA, 22 nt, Human
uaaugucuccaggguugaccua

SEQ ID NO: 641509 - RNA, 22 nt, Human
uuggcccuccaccuggcugugc

SEQ ID NO: 641510 - RNA, 22 nt, Human
cagagcugcgcuuuuuccuggu

SEQ ID NO: 641511 - RNA, 22 nt, Human
uuucugcaucucuacaguuguu

SEQ ID NO: 641512 - RNA, 23 nt, Human
ucugugcuacaaaucgcgucugu

SEQ ID NO: 641513 - RNA, 20 nt, Human
cucaguguggccugaguguu

SEQ ID NO: 641514 - RNA, 22 nt, Human
uacagcugcaaggguuucuggg

SEQ ID NO: 641515 - RNA, 22 nt, Human
cuuccucuagccuaguaaugcc

SEQ ID NO: 641516 - RNA, 23 nt, Human
agcacacuuguacaaugcccuag

SEQ ID NO: 641517 - RNA, 22 nt, Human
ugagguaauaaguguuuguuuu

SEQ ID NO: 641518 - RNA, 19 nt, Human
uuccccuccccagggauag

SEQ ID NO: 641519 - RNA, 22 nt, Human
uucaguuccuuaucauaggguu

SEQ ID NO: 641520 - RNA, 22 nt, Human
cguucacaucguauuauuggga

SEQ ID NO: 641521 - RNA, 20 nt, Human
agagccuugaggaagaugau

SEQ ID NO: 641522 - RNA, 22 nt, Human
gcuuccagagacugagcucuuc

SEQ ID NO: 641523 - RNA, 22 nt, Human
uguggggcugugguguucuucu

SEQ ID NO: 641524 - RNA, 22 nt, Human
acagaaauauagaagguaggaa

SEQ ID NO: 641525 - RNA, 23 nt, Human
gaccuggcuuugaaucuugacuc

SEQ ID NO: 641526 - RNA, 21 nt, Human
cgggcuggccgggcccucacc

SEQ ID NO: 641527 - RNA, 22 nt, Human
uuauuaagugccuacaauaaag

SEQ ID NO: 641528 - RNA, 22 nt, Human
cugccuguuuccucuugcuccc

SEQ ID NO: 641529 - RNA, 22 nt, Human
auaauccaugucuagaguaaag

SEQ ID NO: 641530 - RNA, 22 nt, Human
cugucuucuaccuucaaccucc

SEQ ID NO: 641531 - RNA, 22 nt, Human
ccuugucuugcacagaugcagc

SEQ ID NO: 641532 - RNA, 22 nt, Human
guucuuccucauugcuuugaag

SEQ ID NO: 641533 - RNA, 22 nt, Human
aagaaauauugggccuuauaaa

SEQ ID NO: 641534 - RNA, 22 nt, Human
ucagcaguuuuauaugcagcuu

SEQ ID NO: 641535 - RNA, 22 nt, Human
acugggcaccaucaugagaugg

SEQ ID NO: 641536 - RNA, 22 nt, Human
ucccuggaacagagagacaacg

SEQ ID NO: 641537 - RNA, 22 nt, Human
uuuuggaaugaggaacauccag

SEQ ID NO: 641538 - RNA, 21 nt, Human
cuuugguuucugacuugcaua

SEQ ID NO: 641539 - RNA, 22 nt, Human
uuuucucaggugcuuaucuaag

SEQ ID NO: 641540 - RNA, 22 nt, Human
acaggcucuggggcaggauggc

SEQ ID NO: 641541 - RNA, 22 nt, Human
uuucugaagggcagcagacucu

SEQ ID NO: 641542 - RNA, 22 nt, Human
aaggugucggguuagcucagcc

SEQ ID NO: 641543 - RNA, 22 nt, Human
ucugucagccccucagcuguca

SEQ ID NO: 641544 - RNA, 22 nt, Human
uggaagaauaggauagaagaac

SEQ ID NO: 641545 - RNA, 22 nt, Human
gcccacacagcagauccuuugg

SEQ ID NO: 641546 - RNA, 22 nt, Human
aagugucugcaaaaugacagag

SEQ ID NO: 641547 - RNA, 22 nt, Human
augaggcaggagugcaguggca

SEQ ID NO: 641548 - RNA, 22 nt, Human
ugggcugcuucucaaaugucuc

SEQ ID NO: 641549 - RNA, 18 nt, Human
cagcucuucuccaguaac

SEQ ID NO: 641550 - RNA, 22 nt, Human
accuuuaucgccaucauugugc

SEQ ID NO: 641551 - RNA, 22 nt, Human
gcugcucuccauggccgugagu

SEQ ID NO: 641552 - RNA, 22 nt, Human
aaaugaacaguugcauucucug

SEQ ID NO: 641553 - RNA, 22 nt, Human
ugggagcaccuugagggcagaa

SEQ ID NO: 641554 - RNA, 22 nt, Human
gaaacagcuuuaagugauacug

SEQ ID NO: 641555 - RNA, 18 nt, Human
gacaggugggugagacca

SEQ ID NO: 641556 - RNA, 22 nt, Human
uccagguauuacuaaguguuaa

SEQ ID NO: 641557 - RNA, 22 nt, Human
cauagaauaugugugauuguua

SEQ ID NO: 641558 - RNA, 18 nt, Human
uugcuucuuuucucuagg

SEQ ID NO: 641559 - RNA, 22 nt, Human
uuuuaagaacuguucugugcuu

SEQ ID NO: 641560 - RNA, 22 nt, Human
uugcaaaggggaauaaagcaau

SEQ ID NO: 641561 - RNA, 22 nt, Human
ccuuugggugaauuccucucuu

SEQ ID NO: 641562 - RNA, 22 nt, Human
cagggcaguuugugccuaugag

SEQ ID NO: 641563 - RNA, 22 nt, Human
uccugagcccuguaggacccug

SEQ ID NO: 641564 - RNA, 22 nt, Human
ggccagaaaguuaagcuguggc

SEQ ID NO: 641565 - RNA, 22 nt, Human
auucucucuucugcugcccgug

SEQ ID NO: 641566 - RNA, 22 nt, Human
aggcuccaugguucucccucag

SEQ ID NO: 641567 - RNA, 22 nt, Human
gagagugaggccugggaaucua

SEQ ID NO: 641568 - RNA, 22 nt, Human
ucacaugaggcauccccgggca

SEQ ID NO: 641569 - RNA, 22 nt, Human
gggaaggaaaguuauuagcaga

SEQ ID NO: 641570 - RNA, 22 nt, Human
cccaggccuggucugggccagu

SEQ ID NO: 641571 - RNA, 22 nt, Human
gacagcagggacauguaggaag

SEQ ID NO: 641572 - RNA, 22 nt, Human
acaaaggcaggauugacuuagu

SEQ ID NO: 641573 - RNA, 22 nt, Human
gagacacaggugguuccuguca

SEQ ID NO: 641574 - RNA, 22 nt, Human
ucauaaaaguacucauguucau

SEQ ID NO: 641575 - RNA, 22 nt, Human
aaagccuuggucaucugguucc

SEQ ID NO: 641576 - RNA, 22 nt, Human
acaucugacaugaucuucagua

SEQ ID NO: 641577 - RNA, 22 nt, Human
caccagaacaagacaggagaau

SEQ ID NO: 641578 - RNA, 22 nt, Human
cugcagaggguuugagcauccu

SEQ ID NO: 641579 - RNA, 22 nt, Human
gccaguggcccucuggagaagg

SEQ ID NO: 641580 - RNA, 19 nt, Human
gcugucugaugcugagguc

SEQ ID NO: 641581 - RNA, 22 nt, Human
ugggucagacagccagugggcc

SEQ ID NO: 641582 - RNA, 22 nt, Human
ucucuuuacuuucaccaauuug

SEQ ID NO: 641583 - RNA, 22 nt, Human
ugcuuaauaggaguugaacauu

SEQ ID NO: 641584 - RNA, 22 nt, Human
auguguaucuaagguguucuau

SEQ ID NO: 641585 - RNA, 22 nt, Human
uuuuuaucuuguaugugucucu

SEQ ID NO: 641586 - RNA, 22 nt, Human
uguucacaaggugaugcuuuga

SEQ ID NO: 641587 - RNA, 22 nt, Human
agcugcagcguucauuuuucca

SEQ ID NO: 641588 - RNA, 22 nt, Human
agcagguguuggcugggccauc

SEQ ID NO: 641589 - RNA, 22 nt, Human
gauauauuuggaccagagcauu

SEQ ID NO: 641590 - RNA, 18 nt, Human
agugcaugcuaggggaag

SEQ ID NO: 641591 - RNA, 22 nt, Human
gaggagagagggacugucugca

SEQ ID NO: 641592 - RNA, 22 nt, Human
agccagagauccaucccuagga

SEQ ID NO: 641593 - RNA, 22 nt, Human
uggcagcuugaaugcagucuuu

SEQ ID NO: 641594 - RNA, 22 nt, Human
gcuacaggggucaguccuuugc

SEQ ID NO: 641595 - RNA, 22 nt, Human
cuguggggaagauagaaccgac

SEQ ID NO: 641596 - RNA, 22 nt, Human
cucuacucuuaacacagcuagg

SEQ ID NO: 641597 - RNA, 22 nt, Human
auauacaguuuuacaggguuuc

SEQ ID NO: 641598 - RNA, 22 nt, Human
cuggguaaguuccuaaggcuca

SEQ ID NO: 641599 - RNA, 22 nt, Human
uuucccuuugcacucuacaauu

SEQ ID NO: 641600 - RNA, 22 nt, Human
caaugaaaaugaggacuccugu

SEQ ID NO: 641601 - RNA, 22 nt, Human
cuuggaggaaaggcagggagac

SEQ ID NO: 641602 - RNA, 22 nt, Human
agguggggaggagugucucuuu

SEQ ID NO: 641603 - RNA, 21 nt, Human
augaagucuaugcuucugugu

SEQ ID NO: 641604 - RNA, 22 nt, Human
cugcuucacguugugccuuguu

SEQ ID NO: 641605 - RNA, 21 nt, Human
gauuuuaaagagacugccaca

SEQ ID NO: 641606 - RNA, 22 nt, Human
gaagcccaggcuuccuuggcuu

SEQ ID NO: 641607 - RNA, 22 nt, Human
ucuuccaagguugcacacuauc

SEQ ID NO: 641608 - RNA, 22 nt, Human
agaaucaauucacugcugcagc

SEQ ID NO: 641609 - RNA, 22 nt, Human
ccucacucuuguccuggcaggu

SEQ ID NO: 641610 - RNA, 22 nt, Human
ccaguguguucccugccucacu

SEQ ID NO: 641611 - RNA, 22 nt, Human
acauuuggcaagaaagagaaac

SEQ ID NO: 641612 - RNA, 22 nt, Human
cuaggcuggagugcauuggcgu

SEQ ID NO: 641613 - RNA, 22 nt, Human
cuuagcuagaggcaauuauguu

SEQ ID NO: 641614 - RNA, 22 nt, Human
aguguuuaucagacaagcccug

SEQ ID NO: 641615 - RNA, 22 nt, Human
ggugguugcauaggccagcagc

SEQ ID NO: 641616 - RNA, 22 nt, Human
ccagaggcggagguuugcagug

SEQ ID NO: 641617 - RNA, 22 nt, Human
agagugguacuucuuuuucuuc

SEQ ID NO: 641618 - RNA, 22 nt, Human
aaugucauagcaaagagaguga

SEQ ID NO: 641619 - RNA, 22 nt, Human
ucagaacauugacauucuuauu

SEQ ID NO: 641620 - RNA, 23 nt, Human
agggaaauacugcaauuuuugga

SEQ ID NO: 641621 - RNA, 22 nt, Human
ggccuagggaguggccaugccu

SEQ ID NO: 641622 - RNA, 19 nt, Human
agagucugugcucuuccua

SEQ ID NO: 641623 - RNA, 22 nt, Human
aggcugucuuccucccucuugg

SEQ ID NO: 641624 - RNA, 22 nt, Human
cuggggggagcugcguccagca

SEQ ID NO: 641625 - RNA, 22 nt, Human
uccuggagaacugauucgcggg

SEQ ID NO: 641626 - RNA, 22 nt, Human
augcuggggccucagaccagaa

SEQ ID NO: 641627 - RNA, 22 nt, Human
gcaaauauucaagacuuuucca

SEQ ID NO: 641628 - RNA, 23 nt, Human
ugacaaagcgagacuccagcuca

SEQ ID NO: 641629 - RNA, 22 nt, Human
aacuaucacaaacagagugucu

SEQ ID NO: 641630 - RNA, 22 nt, Human
aauguggccacuuuuuucuggg

SEQ ID NO: 641631 - RNA, 21 nt, Human
caaaaggauaggaaauuaggg

SEQ ID NO: 641632 - RNA, 22 nt, Human
cugagcccuugcuuaugcuucc

SEQ ID NO: 641633 - RNA, 22 nt, Human
ggcagcaugagccuggugaauu

SEQ ID NO: 641634 - RNA, 20 nt, Human
agggcccaggaagagaguua

SEQ ID NO: 641635 - RNA, 19 nt, Human
uugcauuguaguuggacug

SEQ ID NO: 641636 - RNA, 22 nt, Human
ucugaccugcaggcacagcaau

SEQ ID NO: 641637 - RNA, 22 nt, Human
agcuagccuaggcagagugcau

SEQ ID NO: 641638 - RNA, 22 nt, Human
gcccugcccuguugaaacuaga

SEQ ID NO: 641639 - RNA, 22 nt, Human
ucaggcccagagucacggaucc

SEQ ID NO: 641640 - RNA, 22 nt, Human
uacaguuuuggugaugaugaug

SEQ ID NO: 641641 - RNA, 22 nt, Human
caugcagucuggagccuucugu

SEQ ID NO: 641642 - RNA, 22 nt, Human
ggugguggagccagcugggagu

SEQ ID NO: 641643 - RNA, 22 nt, Human
caaugucaugauuuuccauuag

SEQ ID NO: 641644 - RNA, 22 nt, Human
acaaggcugaacagugaagccg

SEQ ID NO: 641645 - RNA, 22 nt, Human
cuccuggaggauagugacuggg

SEQ ID NO: 641646 - RNA, 22 nt, Human
cuccagcuagggcuggcuuacu

SEQ ID NO: 641647 - RNA, 19 nt, Human
ggggagaacuagagacagc

SEQ ID NO: 641648 - RNA, 22 nt, Human
uuacaugggcuugugaguccuu

SEQ ID NO: 641649 - RNA, 22 nt, Human
guccagggggcuuaagcaaacu

SEQ ID NO: 641650 - RNA, 22 nt, Human
uguacaauguguuuguuggcuu

SEQ ID NO: 641651 - RNA, 22 nt, Human
cagccagguaugggcgugcggg

SEQ ID NO: 641652 - RNA, 22 nt, Human
uacaucauuuuggagaugagca

SEQ ID NO: 641653 - RNA, 22 nt, Human
ucugacauuuugagaaugacau

SEQ ID NO: 641654 - RNA, 22 nt, Human
ugaugcauugccgacuuacugg

SEQ ID NO: 641655 - RNA, 19 nt, Human
acuuugcaugugugucuaa

SEQ ID NO: 641656 - RNA, 20 nt, Human
cugcugugauucccuccucc

SEQ ID NO: 641657 - RNA, 22 nt, Human
agcuggcauacuuugcuaggaa

SEQ ID NO: 641658 - RNA, 22 nt, Human
ugcagcugacccacuccagucc

SEQ ID NO: 641659 - RNA, 22 nt, Human
caugccugccuggugggcgugg

SEQ ID NO: 641660 - RNA, 22 nt, Human
acagcuugggaugcuuuauuuc

SEQ ID NO: 641661 - RNA, 22 nt, Human
cauguguauuauucuuguggaa

SEQ ID NO: 641662 - RNA, 22 nt, Human
uuucuaggacaugauaggauau

SEQ ID NO: 641663 - RNA, 22 nt, Human
uuacuacauuguaacacaguac

SEQ ID NO: 641664 - RNA, 22 nt, Human
ccagagggccuuuggaguuauc

SEQ ID NO: 641665 - RNA, 22 nt, Human
ucucagagcuucagaaagcacc

SEQ ID NO: 641666 - RNA, 22 nt, Human
agugcuuugagcguuugaaaag

SEQ ID NO: 641667 - RNA, 22 nt, Human
ucugagcuuuuauuaucaaccu

SEQ ID NO: 641668 - RNA, 22 nt, Human
caugcacagugauaucugaaga

SEQ ID NO: 641669 - RNA, 22 nt, Human
uuguugaauggauaaauaaauu

SEQ ID NO: 641670 - RNA, 22 nt, Human
ggucacaagguacuguaagaaa

SEQ ID NO: 641671 - RNA, 22 nt, Human
ugcuucucccaaccagggccug

SEQ ID NO: 641672 - RNA, 22 nt, Human
uguucucuuuuccugcugagcc

SEQ ID NO: 641673 - RNA, 22 nt, Human
aguguguacauaauuguacgcc

SEQ ID NO: 641674 - RNA, 22 nt, Human
uaugagaagaacaggugacuuu

SEQ ID NO: 641675 - RNA, 22 nt, Human
caguuucagaaucaaaacauca

SEQ ID NO: 641676 - RNA, 22 nt, Human
ccacugauccugacuuuggagc

SEQ ID NO: 641677 - RNA, 20 nt, Human
cuguuugcuaucaugagcug

SEQ ID NO: 641678 - RNA, 22 nt, Human
agaggaaggaugcauauccaaa

SEQ ID NO: 641679 - RNA, 22 nt, Human
auuuauugagagggaggggaau

SEQ ID NO: 641680 - RNA, 22 nt, Human
aauguguauaugaacauacagg

SEQ ID NO: 641681 - RNA, 22 nt, Human
uacaggaggauuaucaaaggau

SEQ ID NO: 641682 - RNA, 22 nt, Human
acacagcuaugggguaggaaac

SEQ ID NO: 641683 - RNA, 22 nt, Human
ucuuugcuccacacucuagaga

SEQ ID NO: 641684 - RNA, 22 nt, Human
acuguauaaggcauagguaagc

SEQ ID NO: 641685 - RNA, 22 nt, Human
caggcagccaggggaccugucc

SEQ ID NO: 641686 - RNA, 22 nt, Human
aggacugaugauggugcugaca

SEQ ID NO: 641687 - RNA, 22 nt, Human
augaggcagcugacagcuguuc

SEQ ID NO: 641688 - RNA, 22 nt, Human
uugcagcuucaagcagguugac

SEQ ID NO: 641689 - RNA, 22 nt, Human
agacaaaugaacaaauauguga

SEQ ID NO: 641690 - RNA, 22 nt, Human
cugagguguuuaguaggggcgg

SEQ ID NO: 641691 - RNA, 22 nt, Human
aggcuuuauuugaucuauaugc

SEQ ID NO: 641692 - RNA, 22 nt, Human
ggcuggccucaggguccucgcu

SEQ ID NO: 641693 - RNA, 22 nt, Human
ucccaggcuaggccucugcguu

SEQ ID NO: 641694 - RNA, 22 nt, Human
caugcacauguggcuauguaau

SEQ ID NO: 641695 - RNA, 23 nt, Human
ccuggcacacaguugacauggaa

SEQ ID NO: 641696 - RNA, 22 nt, Human
cuguacaauguuaccuauuuau

SEQ ID NO: 641697 - RNA, 22 nt, Human
agugucugagccagaauuagaa

SEQ ID NO: 641698 - RNA, 22 nt, Human
gccuggagggcucuagagaggc

SEQ ID NO: 641699 - RNA, 22 nt, Human
uucaguguuaaucuugggagaa

SEQ ID NO: 641700 - RNA, 18 nt, Human
aaguggcacaggagugca

SEQ ID NO: 641701 - RNA, 22 nt, Human
uuugccucucagagucuacaca

SEQ ID NO: 641702 - RNA, 22 nt, Human
acugacucuuguuaacuucagc

SEQ ID NO: 641703 - RNA, 22 nt, Human
cuucacauaaacaaagggccau

SEQ ID NO: 641704 - RNA, 22 nt, Human
uuggccagagaccagagcaggg

SEQ ID NO: 641705 - RNA, 22 nt, Human
uucuuucucaacaugaauguuu

SEQ ID NO: 641706 - RNA, 22 nt, Human
uggcugcuuguuuuagugaggc

SEQ ID NO: 641707 - RNA, 22 nt, Human
gucugcccggccuuccuccacc

SEQ ID NO: 641708 - RNA, 22 nt, Human
uggccacccacccuaaucuuuc

SEQ ID NO: 641709 - RNA, 21 nt, Human
cauugagauaggagagauugu

SEQ ID NO: 641710 - RNA, 22 nt, Human
uugugagcauguuuacuugauu

SEQ ID NO: 641711 - RNA, 22 nt, Human
uucuggagggcaugcugcugcc

SEQ ID NO: 641712 - RNA, 22 nt, Human
uagggguggagcuaagaguccc

SEQ ID NO: 641713 - RNA, 22 nt, Human
uagcacaucuucuuggccugca

SEQ ID NO: 641714 - RNA, 23 nt, Human
uguaaaaugggguaguguuacca

SEQ ID NO: 641715 - RNA, 22 nt, Human
uacauuccuguuagcaucuaag

SEQ ID NO: 641716 - RNA, 22 nt, Human
ucuguuuugugucucucuggug

SEQ ID NO: 641717 - RNA, 22 nt, Human
acagagagggagugauaaaucc

SEQ ID NO: 641718 - RNA, 22 nt, Human
uucaagaugccagggacgcggc

SEQ ID NO: 641719 - RNA, 22 nt, Human
gagcuugggugccaugcugagc

SEQ ID NO: 641720 - RNA, 22 nt, Human
cagugauuaaaacaugacagcc

SEQ ID NO: 641721 - RNA, 22 nt, Human
acugcccuuguccuggcacacc

SEQ ID NO: 641722 - RNA, 22 nt, Human
uagauacaggcucucugagccu

SEQ ID NO: 641723 - RNA, 22 nt, Human
ccauucuuucagugucucaugu

SEQ ID NO: 641724 - RNA, 22 nt, Human
ucagagaaguaggcuaauggug

SEQ ID NO: 641725 - RNA, 23 nt, Human
cugcuccaggacagcauggaggu

SEQ ID NO: 641726 - RNA, 22 nt, Human
cuggacuucucuucaaagacag

SEQ ID NO: 641727 - RNA, 22 nt, Human
cacauccuaucagucacgguuu

SEQ ID NO: 641728 - RNA, 22 nt, Human
gcaagcaguucgcagcccgccu

SEQ ID NO: 641729 - RNA, 22 nt, Human
uguuacacccacaaaaaauucc

SEQ ID NO: 641730 - RNA, 22 nt, Human
gaaacccaaacuaagacaguag

SEQ ID NO: 641731 - RNA, 22 nt, Human
ccagagggcuugguuugggcca

SEQ ID NO: 641732 - RNA, 23 nt, Human
acugauucuugaaguugacaagu

SEQ ID NO: 641733 - RNA, 22 nt, Human
aaguggcacgcuuuuuggaguu

SEQ ID NO: 641734 - RNA, 22 nt, Human
agaggcaccgucugcagcgugc

SEQ ID NO: 641735 - RNA, 22 nt, Human
ccugcugugaccggggagcagg

SEQ ID NO: 641736 - RNA, 22 nt, Human
aagugugagccagcccuuugca

SEQ ID NO: 641737 - RNA, 22 nt, Human
ugcucuucggggccacugcuug

SEQ ID NO: 641738 - RNA, 22 nt, Human
cuucuggguaauucuucuucau

SEQ ID NO: 641739 - RNA, 22 nt, Human
uuacacaucuagacccauuuuu

SEQ ID NO: 641740 - RNA, 22 nt, Human
guucugggaagguggaccuguu

SEQ ID NO: 641741 - RNA, 21 nt, Human
gaauggcaccauuagcauaua

SEQ ID NO: 641742 - RNA, 22 nt, Human
gucuguggaguugcuugcugga

SEQ ID NO: 641743 - RNA, 22 nt, Human
cagugguugcuugcauggcucc

SEQ ID NO: 641744 - RNA, 22 nt, Human
cagaauggcuuuuauggcucag

SEQ ID NO: 641745 - RNA, 22 nt, Human
ucuuuauugcuacugguuuguc

SEQ ID NO: 641746 - RNA, 22 nt, Human
agccuggaggaggaguugagca

SEQ ID NO: 641747 - RNA, 20 nt, Human
aaguuuggagucaggagacc

SEQ ID NO: 641748 - RNA, 22 nt, Human
ugagggucuggaaucugggcuu

SEQ ID NO: 641749 - RNA, 23 nt, Human
ucagcuucauugucuucuauggc

SEQ ID NO: 641750 - RNA, 22 nt, Human
cagcugugacagccaguugaug

SEQ ID NO: 641751 - RNA, 22 nt, Human
acaugcaggaaaaugcacagau

SEQ ID NO: 641752 - RNA, 19 nt, Human
ugagagugaggaaggcuuc

SEQ ID NO: 641753 - RNA, 22 nt, Human
guucauuuuucccuaaugagua

SEQ ID NO: 641754 - RNA, 22 nt, Human
agcuggagcuucaagcagguaa

SEQ ID NO: 641755 - RNA, 22 nt, Human
ccugggccugaaaacauuucuc

SEQ ID NO: 641756 - RNA, 21 nt, Human
gcagccaggacuuugggcugg

SEQ ID NO: 641757 - RNA, 23 nt, Human
agccuggcaccugcagaucggag

SEQ ID NO: 641758 - RNA, 22 nt, Human
uugaccauaccuccaggcaguu

SEQ ID NO: 641759 - RNA, 22 nt, Human
gcagagguccuagccaggaguc

SEQ ID NO: 641760 - RNA, 22 nt, Human
acaggcugcccgcuccccaccu

SEQ ID NO: 641761 - RNA, 23 nt, Human
gccagccuugcucuccugcagcc

SEQ ID NO: 641762 - RNA, 22 nt, Human
ccugccaggcuuugggcuucug

SEQ ID NO: 641763 - RNA, 22 nt, Human
aauuucaaacuaauaggaacca

SEQ ID NO: 641764 - RNA, 22 nt, Human
uccaggaggccucauuuccugu

SEQ ID NO: 641765 - RNA, 19 nt, Human
uuugugaagaaaaugaugc

SEQ ID NO: 641766 - RNA, 22 nt, Human
auguuauuuuggaaaauacaaa

SEQ ID NO: 641767 - RNA, 22 nt, Human
gagccuggccuccugccucagc

SEQ ID NO: 641768 - RNA, 23 nt, Human
agcuucauugaccuccgcagggg

SEQ ID NO: 641769 - RNA, 22 nt, Human
uaugagaaucugcaguaugcuu

SEQ ID NO: 641770 - RNA, 20 nt, Human
acaugaaaggaaacaggaaa

SEQ ID NO: 641771 - RNA, 22 nt, Human
acuccagggugacucugucuga

SEQ ID NO: 641772 - RNA, 18 nt, Human
uaaauugcuucaccugag

SEQ ID NO: 641773 - RNA, 23 nt, Human
gagugcagaauagacaugcagug

SEQ ID NO: 641774 - RNA, 22 nt, Human
aaaguccagggaaagagcgucu

SEQ ID NO: 641775 - RNA, 22 nt, Human
cacaguaagaaaugaagaggua

SEQ ID NO: 641776 - RNA, 22 nt, Human
ccugaaaaucaagguaguuugg

SEQ ID NO: 641777 - RNA, 22 nt, Human
uucuguguggguagcuccuguu

SEQ ID NO: 641778 - RNA, 22 nt, Human
gcagcauugugagguccugccc

SEQ ID NO: 641779 - RNA, 22 nt, Human
cacaugugcaaauacugaggcu

SEQ ID NO: 641780 - RNA, 22 nt, Human
gaagggagaagguugggugacg

SEQ ID NO: 641781 - RNA, 22 nt, Human
uuucaaacauagaucugaauau

SEQ ID NO: 641782 - RNA, 22 nt, Human
ugggcagagucguggggaauag

SEQ ID NO: 641783 - RNA, 19 nt, Human
ucucagaauuaagagugcu

SEQ ID NO: 641784 - RNA, 19 nt, Human
gaaaggcugcugcuaccug

SEQ ID NO: 641785 - RNA, 21 nt, Human
ggcugcagggagcccuggggu

SEQ ID NO: 641786 - RNA, 22 nt, Human
uuccagagaggcucauguuccc

SEQ ID NO: 641787 - RNA, 18 nt, Human
ggagcccacggcguccca

SEQ ID NO: 641788 - RNA, 22 nt, Human
uccacagggccuuucuggugug

SEQ ID NO: 641789 - RNA, 22 nt, Human
gcuggccugaccagccacaggc

SEQ ID NO: 641790 - RNA, 22 nt, Human
cugagccccucugaccucagag

SEQ ID NO: 641791 - RNA, 22 nt, Human
cucacagcugcuucaggaucca

SEQ ID NO: 641792 - RNA, 22 nt, Human
acuuagcaccuauggcauuuuu

SEQ ID NO: 641793 - RNA, 22 nt, Human
gagcauuuuugucugcauuuua

SEQ ID NO: 641794 - RNA, 22 nt, Human
aaggccagcuuguagggcuggu

SEQ ID NO: 641795 - RNA, 22 nt, Human
ugucauggggaaaauaacagac

SEQ ID NO: 641796 - RNA, 22 nt, Human
agcugagguuaguauaaaugug

SEQ ID NO: 641797 - RNA, 21 nt, Human
uauacagaggggaacaggaga

SEQ ID NO: 641798 - RNA, 22 nt, Human
aggucagcaugcuccucucugu

SEQ ID NO: 641799 - RNA, 22 nt, Human
cagcucuuccucccaccggaca

SEQ ID NO: 641800 - RNA, 22 nt, Human
aacuugaaacuguuccagaaaa

SEQ ID NO: 641801 - RNA, 22 nt, Human
caaugguugaacccugucauga

SEQ ID NO: 641802 - RNA, 22 nt, Human
ugcaguggaagagguggagauc

SEQ ID NO: 641803 - RNA, 22 nt, Human
uguuacaguacuacaauucugc

SEQ ID NO: 641804 - RNA, 22 nt, Human
gaugcaaacugugacauagagu

SEQ ID NO: 641805 - RNA, 22 nt, Human
ccuguuuauccaugccaauccu

SEQ ID NO: 641806 - RNA, 22 nt, Human
gcagcccaaaaaagagguagau

SEQ ID NO: 641807 - RNA, 22 nt, Human
gugccuggcagggucagcugcu

SEQ ID NO: 641808 - RNA, 22 nt, Human
gagcuuccauggacgccaucug

SEQ ID NO: 641809 - RNA, 20 nt, Human
accuugaacccgccagccau

SEQ ID NO: 641810 - RNA, 22 nt, Human
ugaacacaguucugaugagcuu

SEQ ID NO: 641811 - RNA, 22 nt, Human
gagcuguguucaugaggagaaa

SEQ ID NO: 641812 - RNA, 22 nt, Human
agugggcuuacugagggagugu

SEQ ID NO: 641813 - RNA, 22 nt, Human
ucagcacugucuauuagugaga

SEQ ID NO: 641814 - RNA, 23 nt, Human
cuccaaggcccaacugucuaggc

SEQ ID NO: 641815 - RNA, 18 nt, Human
ucucuuuuccccucauug

SEQ ID NO: 641816 - RNA, 22 nt, Human
auggaacagauuaaagugaggg

SEQ ID NO: 641817 - RNA, 22 nt, Human
ugacaauggguggacaagauag

SEQ ID NO: 641818 - RNA, 22 nt, Human
gggcuggaggagauccagaggc

SEQ ID NO: 641819 - RNA, 22 nt, Human
ggcucuugcccgcccaggcugg

SEQ ID NO: 641820 - RNA, 22 nt, Human
uuguucuugccaagacaugaag

SEQ ID NO: 641821 - RNA, 22 nt, Human
ugccuucuucucccuggcucag

SEQ ID NO: 641822 - RNA, 22 nt, Human
uuggucagucagagaauggagu

SEQ ID NO: 641823 - RNA, 17 nt, Human
cagugaucauuacauua

SEQ ID NO: 641824 - RNA, 23 nt, Human
uauguguaaggagaaggagugag

SEQ ID NO: 641825 - RNA, 22 nt, Human
aguauaauuagauaucaaaagu

SEQ ID NO: 641826 - RNA, 22 nt, Human
uggcucacuguagccuugaccu

SEQ ID NO: 641827 - RNA, 22 nt, Human
guggccuuaagaaacaaacaac

SEQ ID NO: 641828 - RNA, 22 nt, Human
gaaaaagugaccuugguagcua

SEQ ID NO: 641829 - RNA, 22 nt, Human
ucugaggacagugcugugccug

SEQ ID NO: 641830 - RNA, 17 nt, Human
aggaagggcaaguuucu

SEQ ID NO: 641831 - RNA, 21 nt, Human
gcuguugcccgccgccucuuc

SEQ ID NO: 641832 - RNA, 22 nt, Human
agagacaggguuuugccauguu

SEQ ID NO: 641833 - RNA, 22 nt, Human
gcaggucuggagggcacugggg

SEQ ID NO: 641834 - RNA, 21 nt, Human
gcagaggaaugguauacauaa

SEQ ID NO: 641835 - RNA, 22 nt, Human
gacagcaggaugugaggggaug

SEQ ID NO: 641836 - RNA, 22 nt, Human
ccccugcuggccugcugguuuc

SEQ ID NO: 641837 - RNA, 22 nt, Human
acugugauguucucuaucuugg

SEQ ID NO: 641838 - RNA, 22 nt, Human
ucagggugaaccaggcaggaau

SEQ ID NO: 641839 - RNA, 22 nt, Human
agcaagcauugcugguuagguc

SEQ ID NO: 641840 - RNA, 22 nt, Human
auacaugaggaggcuggaaaca

SEQ ID NO: 641841 - RNA, 22 nt, Human
uauggcuuuucuuuccuagugu

SEQ ID NO: 641842 - RNA, 22 nt, Human
aacaucaguauucucaucugua

SEQ ID NO: 641843 - RNA, 22 nt, Human
uagccauguguggaacacagcc

SEQ ID NO: 641844 - RNA, 19 nt, Human
cccaggagcaguauugaug

SEQ ID NO: 641845 - RNA, 22 nt, Human
cccagcuggccagguggcuuug

SEQ ID NO: 641846 - RNA, 22 nt, Human
guccaaauuccacagauuucuc

SEQ ID NO: 641847 - RNA, 22 nt, Human
agggacccugaugacugaggag

SEQ ID NO: 641848 - RNA, 23 nt, Human
uucuuucaagaaguucacagugc

SEQ ID NO: 641849 - RNA, 22 nt, Human
uccugaggacccugucaggggc

SEQ ID NO: 641850 - RNA, 22 nt, Human
cuggcccugguaaggacaccca

SEQ ID NO: 641851 - RNA, 22 nt, Human
aagucagugcuagcuaauggcu

SEQ ID NO: 641852 - RNA, 22 nt, Human
uggcucagugaagagauaacuu

SEQ ID NO: 641853 - RNA, 22 nt, Human
ucucuacacaggauucacauga

SEQ ID NO: 641854 - RNA, 22 nt, Human
ucuuucuugugggugcccuuuu

SEQ ID NO: 641855 - RNA, 20 nt, Human
uucaucagcaaagcacagca

SEQ ID NO: 641856 - RNA, 23 nt, Human
gguuggcuguacccaggcucccu

SEQ ID NO: 641857 - RNA, 22 nt, Human
aaguccagacuccuuugcgugg

SEQ ID NO: 641858 - RNA, 22 nt, Human
uugucucugggacaugguauua

SEQ ID NO: 641859 - RNA, 19 nt, Human
ggcagacacaguugacaug

SEQ ID NO: 641860 - RNA, 22 nt, Human
uagcuuuaaaaaucaucaaagc

SEQ ID NO: 641861 - RNA, 22 nt, Human
ucagaggccuugguuaugguau

SEQ ID NO: 641862 - RNA, 22 nt, Human
uccaggacuagcauuucugaua

SEQ ID NO: 641863 - RNA, 22 nt, Human
agucugucuuuggcuucaccac

SEQ ID NO: 641864 - RNA, 22 nt, Human
cugccuguuagucuagcaguua

SEQ ID NO: 641865 - RNA, 22 nt, Human
agaaaguuuggggcugggcacg

SEQ ID NO: 641866 - RNA, 22 nt, Human
uaugcacauuaucuaauccauu

SEQ ID NO: 641867 - RNA, 22 nt, Human
ucuuuucaucauuuaauaggua

SEQ ID NO: 641868 - RNA, 22 nt, Human
cuggccugagaaugcuacccuu

SEQ ID NO: 641869 - RNA, 19 nt, Human
uccaggaggcugccauuga

SEQ ID NO: 641870 - RNA, 22 nt, Human
guucaaagcuccugguacagua

SEQ ID NO: 641871 - RNA, 22 nt, Human
acuguacuguguauuguagaau

SEQ ID NO: 641872 - RNA, 22 nt, Human
uguguucaucaugauaucaggu

SEQ ID NO: 641873 - RNA, 22 nt, Human
gaggcugcugccaucauuaggu

SEQ ID NO: 641874 - RNA, 20 nt, Human
gcagccucaacaggcacagc

SEQ ID NO: 641875 - RNA, 22 nt, Human
acugcagacucuacaguuauaa

SEQ ID NO: 641876 - RNA, 22 nt, Human
ggcuguggucugggugcucccc

SEQ ID NO: 641877 - RNA, 22 nt, Human
caagguuuugcuuguaagggaa

SEQ ID NO: 641878 - RNA, 22 nt, Human
cugcccagaaucacucacucga

SEQ ID NO: 641879 - RNA, 22 nt, Human
gagauggggucagcugggacau

SEQ ID NO: 641880 - RNA, 20 nt, Human
gugcccugugggcuauuuuc

SEQ ID NO: 641881 - RNA, 20 nt, Human
uguguauaaauauauguuuc

SEQ ID NO: 641882 - RNA, 22 nt, Human
acugggccaggggcuuuggagc

SEQ ID NO: 641883 - RNA, 22 nt, Human
cuguccauauucaagggguagg

SEQ ID NO: 641884 - RNA, 19 nt, Human
acauuggacauggaucuug

SEQ ID NO: 641885 - RNA, 22 nt, Human
acaguuacauuaaacaaaagga

SEQ ID NO: 641886 - RNA, 22 nt, Human
cucacaauuuuucagugacuau

SEQ ID NO: 641887 - RNA, 22 nt, Human
gcugugaguggaguucugugcu

SEQ ID NO: 641888 - RNA, 19 nt, Human
ugucaccuucugucaguuu

SEQ ID NO: 641889 - RNA, 21 nt, Human
auggcuucucaggugcacuga

SEQ ID NO: 641890 - RNA, 22 nt, Human
ucucuacagacacuguugacuu

SEQ ID NO: 641891 - RNA, 22 nt, Human
gcauccucccggugcugcuggc

SEQ ID NO: 641892 - RNA, 22 nt, Human
aguaacuuaggagauacauggg

SEQ ID NO: 641893 - RNA, 22 nt, Human
ccagagcugaugggcccagggu

SEQ ID NO: 641894 - RNA, 22 nt, Human
uggcuccagaucugucuccugu

SEQ ID NO: 641895 - RNA, 22 nt, Human
gcuguuucuaagcugguuccua

SEQ ID NO: 641896 - RNA, 22 nt, Human
acaugcauacacguacauaccu

SEQ ID NO: 641897 - RNA, 17 nt, Human
ucuggguuuaaauccca

SEQ ID NO: 641898 - RNA, 22 nt, Human
aaaaccaggcguuuccuauuau

SEQ ID NO: 641899 - RNA, 22 nt, Human
augcaugaugaacuugcuuuca

SEQ ID NO: 641900 - RNA, 22 nt, Human
cugagacccagacaccugagga

SEQ ID NO: 641901 - RNA, 22 nt, Human
cacagugacauuagugagaaaa

SEQ ID NO: 641902 - RNA, 22 nt, Human
guguggucgaaguucucccgga

SEQ ID NO: 641903 - RNA, 20 nt, Human
agaauucuuacccuuugaug

SEQ ID NO: 641904 - RNA, 22 nt, Human
guauuuuaagugacuacuaggu

SEQ ID NO: 641905 - RNA, 22 nt, Human
cagcuagggaguggcagagcuu

SEQ ID NO: 641906 - RNA, 22 nt, Human
acauauauuuucacacaugguu

SEQ ID NO: 641907 - RNA, 22 nt, Human
ucugaguugaggaaaugcauuu

SEQ ID NO: 641908 - RNA, 22 nt, Human
aaugcugagggaugagagaggc

SEQ ID NO: 641909 - RNA, 22 nt, Human
augagaaagaguuguaucuaga

SEQ ID NO: 641910 - RNA, 22 nt, Human
aagggcucugcugucucucccc

SEQ ID NO: 641911 - RNA, 22 nt, Human
agccuggagguaaugaggaaac

SEQ ID NO: 641912 - RNA, 22 nt, Human
gcugcccauuccacuggauggu

SEQ ID NO: 641913 - RNA, 22 nt, Human
ccuggugcccccaagccagcug

SEQ ID NO: 641914 - RNA, 19 nt, Human
acagugucuguauauaaau

SEQ ID NO: 641915 - RNA, 22 nt, Human
agcugcuacugcucugccagag

SEQ ID NO: 641916 - RNA, 22 nt, Human
cuggagagaauguucauugcag

SEQ ID NO: 641917 - RNA, 22 nt, Human
cgcagggccgcgagcgggacca

SEQ ID NO: 641918 - RNA, 22 nt, Human
ugcuggggcucugaccacucca

SEQ ID NO: 641919 - RNA, 20 nt, Human
aggaaaaauggaaacuggag

SEQ ID NO: 641920 - RNA, 22 nt, Human
ugcugccaggucuugcugucca

SEQ ID NO: 641921 - RNA, 22 nt, Human
ggguuggauuacuuagggagaa

SEQ ID NO: 641922 - RNA, 22 nt, Human
uggagaugcacgagcaggugga

SEQ ID NO: 641923 - RNA, 22 nt, Human
ucacucuggaguccgcuaccag

SEQ ID NO: 641924 - RNA, 22 nt, Human
augaaacuaaacuacauaaguu

SEQ ID NO: 641925 - RNA, 22 nt, Human
uuucucaaaagacagaagugaa

SEQ ID NO: 641926 - RNA, 22 nt, Human
ccaggugugcucugcaguggau

SEQ ID NO: 641927 - RNA, 22 nt, Human
ucuucugugagaauucaagcaa

SEQ ID NO: 641928 - RNA, 22 nt, Human
cacugagagaugugucacagca

SEQ ID NO: 641929 - RNA, 22 nt, Human
gugucgugcuugccauggguac

SEQ ID NO: 641930 - RNA, 22 nt, Human
gcuccagguggcuuauuuguau

SEQ ID NO: 641931 - RNA, 22 nt, Human
uaaauuguuuucuagaaguugu

SEQ ID NO: 641932 - RNA, 22 nt, Human
ugcauuaucuuuaauguucuca

SEQ ID NO: 641933 - RNA, 22 nt, Human
gagagugauucccucccauaga

SEQ ID NO: 641934 - RNA, 22 nt, Human
gacccaggguggucaccugaaa

SEQ ID NO: 641935 - RNA, 22 nt, Human
uucucuuacauuuucucagccu

SEQ ID NO: 641936 - RNA, 22 nt, Human
agcuucuugggcuuuacacaaa

SEQ ID NO: 641937 - RNA, 22 nt, Human
ugcuucuggcacuugagggggu

SEQ ID NO: 641938 - RNA, 22 nt, Human
cuugcugugugguguucucaga

SEQ ID NO: 641939 - RNA, 22 nt, Human
caugaaaaauuuacuguuaaca

SEQ ID NO: 641940 - RNA, 22 nt, Human
ugccauuuguuacuaucaggac

SEQ ID NO: 641941 - RNA, 22 nt, Human
uccagggcaggugcugggcucu

SEQ ID NO: 641942 - RNA, 22 nt, Human
aggccagaaauuuggaguaugu

SEQ ID NO: 641943 - RNA, 22 nt, Human
uccuggccucugagucaagaac

SEQ ID NO: 641944 - RNA, 19 nt, Human
cagaacagaggucauggcc

SEQ ID NO: 641945 - RNA, 22 nt, Human
uuuuuaagagucuggaaauagu

SEQ ID NO: 641946 - RNA, 22 nt, Human
ucacaaagcuuugauaagcaga

SEQ ID NO: 641947 - RNA, 22 nt, Human
uaugcaaacaguucaggugaca

SEQ ID NO: 641948 - RNA, 22 nt, Human
ugcucuguauucuauggcaguu

SEQ ID NO: 641949 - RNA, 22 nt, Human
uucugaauccucgaaacauagc

SEQ ID NO: 641950 - RNA, 22 nt, Human
gccagcugagcaaauuccagcu

SEQ ID NO: 641951 - RNA, 22 nt, Human
gaagagcuuagacagaaucaaa

SEQ ID NO: 641952 - RNA, 22 nt, Human
aauguugcagagugauugucca

SEQ ID NO: 641953 - RNA, 22 nt, Human
auguguauuuuguacuauuggg

SEQ ID NO: 641954 - RNA, 22 nt, Human
gcuguggcucucacaagcaaau

SEQ ID NO: 641955 - RNA, 22 nt, Human
uggaaguugaaucucagucaug

SEQ ID NO: 641956 - RNA, 22 nt, Human
agccagaggaacuugaugacug

SEQ ID NO: 641957 - RNA, 22 nt, Human
acaaacacgagacgccacugug

SEQ ID NO: 641958 - RNA, 22 nt, Human
agcaggaguguccccuggcugu

SEQ ID NO: 641959 - RNA, 22 nt, Human
uuuaaacuaacaguacacguug

SEQ ID NO: 641960 - RNA, 22 nt, Human
uccaguugcccaucucucuucu

SEQ ID NO: 641961 - RNA, 22 nt, Human
cauuuguacauguugucuucuu

SEQ ID NO: 641962 - RNA, 22 nt, Human
aacaguaucuuuuaucagaaau

SEQ ID NO: 641963 - RNA, 22 nt, Human
acuagaaauuacucagaauaaa

SEQ ID NO: 641964 - RNA, 22 nt, Human
uuuguugaguuacagagaugaa

SEQ ID NO: 641965 - RNA, 22 nt, Human
cuugcucauuaaguagcucaca

SEQ ID NO: 641966 - RNA, 22 nt, Human
uucaugaacgaacauauguaua

SEQ ID NO: 641967 - RNA, 22 nt, Human
gaggagcccagcaccaucacuu

SEQ ID NO: 641968 - RNA, 22 nt, Human
aagucacagcuaaauagcuaag

SEQ ID NO: 641969 - RNA, 22 nt, Human
ugcuucaaggacacugacuuuu

SEQ ID NO: 641970 - RNA, 22 nt, Human
gacagggcgcccagccuguuuc

SEQ ID NO: 641971 - RNA, 22 nt, Human
ggaggccaggaagagccgcccu

SEQ ID NO: 641972 - RNA, 22 nt, Human
uggacucaccuugaguuagcca

SEQ ID NO: 641973 - RNA, 23 nt, Human
ucuacccacacugcucuagaagg

SEQ ID NO: 641974 - RNA, 22 nt, Human
aguuacaugugaauagaaagua

SEQ ID NO: 641975 - RNA, 22 nt, Human
ucugugacucauaucuguagau

SEQ ID NO: 641976 - RNA, 22 nt, Human
uggaccugcuggaugggcaggu

SEQ ID NO: 641977 - RNA, 22 nt, Human
ugucuucaaauauugaaauccu

SEQ ID NO: 641978 - RNA, 22 nt, Human
uuuccugugcuuaacaaauauu

SEQ ID NO: 641979 - RNA, 22 nt, Human
ugucauuuaaagcuuuccagau

SEQ ID NO: 641980 - RNA, 21 nt, Human
ugcaggaguguaaugugaccc

SEQ ID NO: 641981 - RNA, 22 nt, Human
cugccuccuggcugauggguag

SEQ ID NO: 641982 - RNA, 22 nt, Human
uggccagauucaugcauguauc

SEQ ID NO: 641983 - RNA, 22 nt, Human
agcaauuauuguauaagaacaa

SEQ ID NO: 641984 - RNA, 22 nt, Human
aaggcagcaggauuuggugacu

SEQ ID NO: 641985 - RNA, 22 nt, Human
gagggcuccucacauucucuau

SEQ ID NO: 641986 - RNA, 22 nt, Human
cucagcugcagccuggcuggca

SEQ ID NO: 641987 - RNA, 22 nt, Human
agaggaagccauugcuuacuga

SEQ ID NO: 641988 - RNA, 22 nt, Human
cugcugugcuuguggccacccg

SEQ ID NO: 641989 - RNA, 18 nt, Human
ccuggcacacuggcucau

SEQ ID NO: 641990 - RNA, 22 nt, Human
auaaguguguaaggcauucugu

SEQ ID NO: 641991 - RNA, 22 nt, Human
gaguguggaucccagaagcaga

SEQ ID NO: 641992 - RNA, 22 nt, Human
ugccaggcucagccccuaucuu

SEQ ID NO: 641993 - RNA, 22 nt, Human
agacauuuugcaauggguagcu

SEQ ID NO: 641994 - RNA, 22 nt, Human
uaaagccaacacuuuacugcuc

SEQ ID NO: 641995 - RNA, 22 nt, Human
uuucuuggagcucuuagggucg

SEQ ID NO: 641996 - RNA, 22 nt, Human
uggcaguggcuuugcuggugga

SEQ ID NO: 641997 - RNA, 22 nt, Human
gcagcuggacccacacggcuua

SEQ ID NO: 641998 - RNA, 22 nt, Human
ccugguggagaggggcggagcg

SEQ ID NO: 641999 - RNA, 22 nt, Human
ccugccuggcugucagcagagc

SEQ ID NO: 642000 - RNA, 22 nt, Human
ggcugagaggacgucgggcuca

SEQ ID NO: 642001 - RNA, 22 nt, Human
aaugagggggaugggaaagugu

SEQ ID NO: 642002 - RNA, 22 nt, Human
cucucagugccacacagccauu

SEQ ID NO: 642003 - RNA, 20 nt, Human
gccaacgcgcuggggcugcc

SEQ ID NO: 642004 - RNA, 22 nt, Human
ccucagacucagugcguuguga

SEQ ID NO: 642005 - RNA, 22 nt, Human
aagucagaaaacagagcaauua

SEQ ID NO: 642006 - RNA, 22 nt, Human
aggugugggaaacgggugaccu

SEQ ID NO: 642007 - RNA, 22 nt, Human
uuuacugaacugcuaguacagg

SEQ ID NO: 642008 - RNA, 22 nt, Human
uugauuaaucccaugugaguag

SEQ ID NO: 642009 - RNA, 19 nt, Human
cccucauucacuuauucuc

SEQ ID NO: 642010 - RNA, 22 nt, Human
uggcuucugcuuucaguggagg

SEQ ID NO: 642011 - RNA, 22 nt, Human
ucauaaaugcagugucauaaau

SEQ ID NO: 642012 - RNA, 22 nt, Human
gcuggaggauggacuggaagaa

SEQ ID NO: 642013 - RNA, 22 nt, Human
gggcagcaugucacuagcaugg

SEQ ID NO: 642014 - RNA, 22 nt, Human
gcagcaucagguucacugcgug

SEQ ID NO: 642015 - RNA, 22 nt, Human
aaagcucacaguaauacaaggc

SEQ ID NO: 642016 - RNA, 22 nt, Human
gcucucugcaagucagcagccu

SEQ ID NO: 642017 - RNA, 22 nt, Human
gaagccacccuccuuccagccc

SEQ ID NO: 642018 - RNA, 22 nt, Human
ucccuggggauguuggccugcc

SEQ ID NO: 642019 - RNA, 22 nt, Human
acuccagggcuccaucccuugu

SEQ ID NO: 642020 - RNA, 22 nt, Human
gaacuccagaugacucaggaac

SEQ ID NO: 642021 - RNA, 22 nt, Human
ucuaugaagugcgaagaggcac

SEQ ID NO: 642022 - RNA, 22 nt, Human
uucagaggcuguaugacuagau

SEQ ID NO: 642023 - RNA, 22 nt, Human
aagugcauauuuuuguuguaga

SEQ ID NO: 642024 - RNA, 22 nt, Human
caucuuaauuucuaacaggcac

SEQ ID NO: 642025 - RNA, 22 nt, Human
uauuccugguguuggcuggguc

SEQ ID NO: 642026 - RNA, 22 nt, Human
gcugcagagaugggugcccuuu

SEQ ID NO: 642027 - RNA, 22 nt, Human
auaguacaaucaguuaauuagu

SEQ ID NO: 642028 - RNA, 22 nt, Human
agccagagcagggaauuggaca

SEQ ID NO: 642029 - RNA, 22 nt, Human
ucauggauaaaauauugguuaa

SEQ ID NO: 642030 - RNA, 22 nt, Human
cugaggaaugagugaggagcca

SEQ ID NO: 642031 - RNA, 22 nt, Human
ugcaauuuucagaaauuccaaa

SEQ ID NO: 642032 - RNA, 22 nt, Human
cccagccugugacagccguccu

SEQ ID NO: 642033 - RNA, 22 nt, Human
uggaagauaagagauugggaag

SEQ ID NO: 642034 - RNA, 22 nt, Human
cucagagaaaugucacaacaau

SEQ ID NO: 642035 - RNA, 22 nt, Human
uccucuccaggugagccgaaau

SEQ ID NO: 642036 - RNA, 22 nt, Human
uuuuauugguaaugauaaaagu

SEQ ID NO: 642037 - RNA, 22 nt, Human
gaauuagguaauagaacuagua

SEQ ID NO: 642038 - RNA, 22 nt, Human
guguccagggccguguugucuu

SEQ ID NO: 642039 - RNA, 22 nt, Human
uggcagagaacacggcugaucu

SEQ ID NO: 642040 - RNA, 22 nt, Human
ccaggaccuggagcucuaugaa

SEQ ID NO: 642041 - RNA, 17 nt, Human
uccagagcacagagcuc

SEQ ID NO: 642042 - RNA, 22 nt, Human
uggguccugucuccuuguucug

SEQ ID NO: 642043 - RNA, 22 nt, Human
uuagccaggggagcagcuuguc

SEQ ID NO: 642044 - RNA, 19 nt, Human
ccuuugaaucaggacacuu

SEQ ID NO: 642045 - RNA, 22 nt, Human
cugaggcacuaacaaggacaag

SEQ ID NO: 642046 - RNA, 22 nt, Human
ccagcugucagugugaaaauaa

SEQ ID NO: 642047 - RNA, 22 nt, Human
cuguguuugaugagaagccacc

SEQ ID NO: 642048 - RNA, 22 nt, Human
gcaaagucucaagacccaagug

SEQ ID NO: 642049 - RNA, 22 nt, Human
caauucaauggcaaaguauugu

SEQ ID NO: 642050 - RNA, 22 nt, Human
gagcagugguugaacagaggca

SEQ ID NO: 642051 - RNA, 22 nt, Human
cuggagccaugucuugacugcu

SEQ ID NO: 642052 - RNA, 22 nt, Human
caugcuuuuugacaacaagcug

SEQ ID NO: 642053 - RNA, 22 nt, Human
ucuaaacacuaagucuugaugc

SEQ ID NO: 642054 - RNA, 22 nt, Human
uugcauuacauuugcucagucu

SEQ ID NO: 642055 - RNA, 22 nt, Human
ugcuuggagaaucagucccagc

SEQ ID NO: 642056 - RNA, 22 nt, Human
gcagccauugagcgaaaaaauc

SEQ ID NO: 642057 - RNA, 22 nt, Human
uccagaaaauuuuacagugccu

SEQ ID NO: 642058 - RNA, 22 nt, Human
uucuucucucauagauuaaggu

SEQ ID NO: 642059 - RNA, 22 nt, Human
aaggcagucaguuguuuugaaa

SEQ ID NO: 642060 - RNA, 22 nt, Human
uggauaaaaugacauuaccuga

SEQ ID NO: 642061 - RNA, 22 nt, Human
aaugaagcaguuuucaucaagu

SEQ ID NO: 642062 - RNA, 22 nt, Human
aagaguuugucagaucugcacg

SEQ ID NO: 642063 - RNA, 22 nt, Human
ugcuuuauuaagagagaaauuu

SEQ ID NO: 642064 - RNA, 19 nt, Human
uuucuuccaaagacuaugg

SEQ ID NO: 642065 - RNA, 22 nt, Human
ccugagguggcugcagcacugc

SEQ ID NO: 642066 - RNA, 22 nt, Human
uuuaacagauaguuucuucugu

SEQ ID NO: 642067 - RNA, 22 nt, Human
uaugucugcuugguuuuggaau

SEQ ID NO: 642068 - RNA, 22 nt, Human
uuauuuggcaaugcuucaccau

SEQ ID NO: 642069 - RNA, 22 nt, Human
caggggcuagcacuuaauguuu

SEQ ID NO: 642070 - RNA, 22 nt, Human
guacagaaggauuucuaguagu

SEQ ID NO: 642071 - RNA, 22 nt, Human
gugugcguuccuaguaaacgug

SEQ ID NO: 642072 - RNA, 22 nt, Human
acugaauaaggugaaugcucug

SEQ ID NO: 642073 - RNA, 22 nt, Human
ggcaugggguguauguggcacg

SEQ ID NO: 642074 - RNA, 22 nt, Human
gcucugcugggugggcaguuau

SEQ ID NO: 642075 - RNA, 22 nt, Human
cugggcagcuguaucagggagu

SEQ ID NO: 642076 - RNA, 22 nt, Human
agggcaucucuaacagucuccu

SEQ ID NO: 642077 - RNA, 22 nt, Human
agagagcauugaggaaaucuuc

SEQ ID NO: 642078 - RNA, 22 nt, Human
ccuccuggaggcucuaagggag

SEQ ID NO: 642079 - RNA, 22 nt, Human
gccuggagcucggcugagggcg

SEQ ID NO: 642080 - RNA, 19 nt, Human
acagaaauuaguuauuuuc

SEQ ID NO: 642081 - RNA, 22 nt, Human
cugggccucacccuagaccaau

SEQ ID NO: 642082 - RNA, 22 nt, Human
ucucccagugucuggcagucag

SEQ ID NO: 642083 - RNA, 22 nt, Human
uaggaaaaagaggcuggcaagg

SEQ ID NO: 642084 - RNA, 22 nt, Human
uuuaaggcagugaaacuauucu

SEQ ID NO: 642085 - RNA, 22 nt, Human
guuauucuuuuauagcaauaca

SEQ ID NO: 642086 - RNA, 22 nt, Human
aggaaagguagcgugccagcag

SEQ ID NO: 642087 - RNA, 22 nt, Human
aaacuucauggauaauauaaag

SEQ ID NO: 642088 - RNA, 23 nt, Human
uacagaaggaguagucacuaaga

SEQ ID NO: 642089 - RNA, 22 nt, Human
gccagcuuggccaguggccagu

SEQ ID NO: 642090 - RNA, 22 nt, Human
ucauguuuggaguuugcucacu

SEQ ID NO: 642091 - RNA, 22 nt, Human
acucccucucuaguccuugcaa

SEQ ID NO: 642092 - RNA, 22 nt, Human
gacccguggcaggcugccugcu

SEQ ID NO: 642093 - RNA, 22 nt, Human
gggcuccaguuuggccaggaag

SEQ ID NO: 642094 - RNA, 18 nt, Human
cccacggugcuguagggc

SEQ ID NO: 642095 - RNA, 22 nt, Human
uggugagcucuuuagacuggga

SEQ ID NO: 642096 - RNA, 22 nt, Human
gcucccugccuacacggaccuu

SEQ ID NO: 642097 - RNA, 22 nt, Human
ugucacuucaguuuugaaacaa

SEQ ID NO: 642098 - RNA, 22 nt, Human
gcuggcugguccagcaggggcu

SEQ ID NO: 642099 - RNA, 22 nt, Human
ucugucuucaucagcaugugau

SEQ ID NO: 642100 - RNA, 22 nt, Human
uauguacaaucagcaguucaua

SEQ ID NO: 642101 - RNA, 22 nt, Human
ccauugaauuagaaggggaagg

SEQ ID NO: 642102 - RNA, 22 nt, Human
uuuuuguagucauuagaagagg

SEQ ID NO: 642103 - RNA, 22 nt, Human
ucugcagaacuuuaugagcaaa

SEQ ID NO: 642104 - RNA, 22 nt, Human
cauccguuaauaaaaagacagu

SEQ ID NO: 642105 - RNA, 23 nt, Human
ugaaugauggugcuccucaucuu

SEQ ID NO: 642106 - RNA, 22 nt, Human
uucuuucagaacacaagugauu

SEQ ID NO: 642107 - RNA, 22 nt, Human
auggcuguagucaucugaaggc

SEQ ID NO: 642108 - RNA, 22 nt, Human
aucuaagaguuaacaucaagaa

SEQ ID NO: 642109 - RNA, 22 nt, Human
uuugggaacucuaucauggaaa

SEQ ID NO: 642110 - RNA, 22 nt, Human
cuuagcaugugguguccuugua

SEQ ID NO: 642111 - RNA, 22 nt, Human
uggcaggggaggugcuugcuua

SEQ ID NO: 642112 - RNA, 17 nt, Human
uggcuucagauguacau

SEQ ID NO: 642113 - RNA, 22 nt, Human
cagggcuugaucugcauccugc

SEQ ID NO: 642114 - RNA, 18 nt, Human
cuaagaggucguuucuca

SEQ ID NO: 642115 - RNA, 22 nt, Human
uugcuguaggcugauugcugaa

SEQ ID NO: 642116 - RNA, 22 nt, Human
uuccuuucacguuuuaaugcac

SEQ ID NO: 642117 - RNA, 22 nt, Human
gcgugggcuggacugggaugaa

SEQ ID NO: 642118 - RNA, 22 nt, Human
cacucugcagcugaagggcugg

SEQ ID NO: 642119 - RNA, 22 nt, Human
ugggcucucgucccugcagaag

SEQ ID NO: 642120 - RNA, 22 nt, Human
cuuuccugaaaucucuucugca

SEQ ID NO: 642121 - RNA, 22 nt, Human
uucauccauaugcagagagcuu

SEQ ID NO: 642122 - RNA, 23 nt, Human
ugugaauugaggacaucaaaagc

SEQ ID NO: 642123 - RNA, 22 nt, Human
uuguacuugccauagaacaaca

SEQ ID NO: 642124 - RNA, 22 nt, Human
aguugaaauuaagagagaguuu

SEQ ID NO: 642125 - RNA, 22 nt, Human
acuucucuuccccggaacucua

SEQ ID NO: 642126 - RNA, 22 nt, Human
uagcuucuauacaacuucagca

SEQ ID NO: 642127 - RNA, 22 nt, Human
auaaaaccaaagcagcaguguu

SEQ ID NO: 642128 - RNA, 22 nt, Human
ggauacaacuagaagauggcag

SEQ ID NO: 642129 - RNA, 22 nt, Human
acaagaauuauuucuaguuaac

SEQ ID NO: 642130 - RNA, 22 nt, Human
gccaggcacaguucuaggugcu

SEQ ID NO: 642131 - RNA, 22 nt, Human
ggggugagugcucagccccgga

SEQ ID NO: 642132 - RNA, 22 nt, Human
cugguggagaugccuggccccu

SEQ ID NO: 642133 - RNA, 22 nt, Human
uguacauuuagagcucaauaga

SEQ ID NO: 642134 - RNA, 22 nt, Human
agcuguggggaggaggcuagca

SEQ ID NO: 642135 - RNA, 22 nt, Human
cucucagacacccauuuggaaa

SEQ ID NO: 642136 - RNA, 22 nt, Human
cagagggagcccuccaggagca

SEQ ID NO: 642137 - RNA, 22 nt, Human
augggccaggcuugggaugaca

SEQ ID NO: 642138 - RNA, 22 nt, Human
uguggcuccacuccacauuaau

SEQ ID NO: 642139 - RNA, 22 nt, Human
uguggcucggccagcugcugaa

SEQ ID NO: 642140 - RNA, 22 nt, Human
gaguccaggcuguugcucaucu

SEQ ID NO: 642141 - RNA, 22 nt, Human
ugcccaggaucuggcgaugcuc

SEQ ID NO: 642142 - RNA, 22 nt, Human
agcggcugcuccgcaggcuggc

SEQ ID NO: 642143 - RNA, 22 nt, Human
agcagagcuauucuugugcaau

SEQ ID NO: 642144 - RNA, 22 nt, Human
agucccuuuagucuggagagcu

SEQ ID NO: 642145 - RNA, 22 nt, Human
aggcacaaaagcagggugacca

SEQ ID NO: 642146 - RNA, 20 nt, Human
aucuggcucagauccugcag

SEQ ID NO: 642147 - RNA, 22 nt, Human
cuuucacagcacaagccugccu

SEQ ID NO: 642148 - RNA, 22 nt, Human
ggcagacacaaaaacauaaggu

SEQ ID NO: 642149 - RNA, 22 nt, Human
aacaugaaacccaaacagaaua

SEQ ID NO: 642150 - RNA, 22 nt, Human
uggucucugugcucgggcaugg

SEQ ID NO: 642151 - RNA, 22 nt, Human
uuuaguauucucuauuuccauc

SEQ ID NO: 642152 - RNA, 22 nt, Human
ggaaugaagaaauagauggugu

SEQ ID NO: 642153 - RNA, 22 nt, Human
cugggaggugcagcaaaaauca

SEQ ID NO: 642154 - RNA, 19 nt, Human
ucuccaggugccccaaaca

SEQ ID NO: 642155 - RNA, 22 nt, Human
aguaucaucuccauuucacuga

SEQ ID NO: 642156 - RNA, 22 nt, Human
aaaaagacagaggaugaggcag

SEQ ID NO: 642157 - RNA, 22 nt, Human
auuacaugagagaauguaaaua

SEQ ID NO: 642158 - RNA, 22 nt, Human
cacaauuuggugcuaaagaaag

SEQ ID NO: 642159 - RNA, 22 nt, Human
cuuggcuguugggcauugagaa

SEQ ID NO: 642160 - RNA, 22 nt, Human
ugggccaggauuucaagacccu

SEQ ID NO: 642161 - RNA, 22 nt, Human
ccuguggcugccacuuggguga

SEQ ID NO: 642162 - RNA, 22 nt, Human
uuacaacacuacuuauccuuga

SEQ ID NO: 642163 - RNA, 21 nt, Human
ggcugcuggggguuggcacag

SEQ ID NO: 642164 - RNA, 22 nt, Human
uuauacacguuuauggagcuac

SEQ ID NO: 642165 - RNA, 23 nt, Human
ucucagugccgauugcauacaca

SEQ ID NO: 642166 - RNA, 22 nt, Human
caaaggcaugugaguauaugug

SEQ ID NO: 642167 - RNA, 22 nt, Human
cuggccaggcggccccugcaug

SEQ ID NO: 642168 - RNA, 22 nt, Human
aucuuuucuguuugcuaugucu

SEQ ID NO: 642169 - RNA, 22 nt, Human
uugugcauuucucugagugugu

SEQ ID NO: 642170 - RNA, 22 nt, Human
uccauuuucuaaguaucacuua

SEQ ID NO: 642171 - RNA, 22 nt, Human
auucugcuaguuaauaucucuc

SEQ ID NO: 642172 - RNA, 22 nt, Human
aagucucuuuaccucuccaggc

SEQ ID NO: 642173 - RNA, 22 nt, Human
aacauucugguucuaaaaaccu

SEQ ID NO: 642174 - RNA, 22 nt, Human
ggugcugauaguaacaauaaua

SEQ ID NO: 642175 - RNA, 22 nt, Human
uuacauguacugguuugacuua

SEQ ID NO: 642176 - RNA, 22 nt, Human
uuucuauuggcgucacuguugu

SEQ ID NO: 642177 - RNA, 22 nt, Human
ggcccuugcagcaggcgcuggc

SEQ ID NO: 642178 - RNA, 22 nt, Human
cucaugugucugguaggagcuu

SEQ ID NO: 642179 - RNA, 22 nt, Human
uucucuggacuauuugcacucc

SEQ ID NO: 642180 - RNA, 22 nt, Human
uugcauuuaaguagauguuaca

SEQ ID NO: 642181 - RNA, 22 nt, Human
gcccuggauggcaggagccauc

SEQ ID NO: 642182 - RNA, 21 nt, Human
ucccagagugcuugggacugc

SEQ ID NO: 642183 - RNA, 22 nt, Human
acaggucaacgagagcaggcaa

SEQ ID NO: 642184 - RNA, 22 nt, Human
gagggaccuuuacacagacauu

SEQ ID NO: 642185 - RNA, 22 nt, Human
caggcucagcucuggccagugc

SEQ ID NO: 642186 - RNA, 22 nt, Human
ucuccuaauuaaaugcucuuau

SEQ ID NO: 642187 - RNA, 22 nt, Human
uaccugaauuaccaaaagcuuu

SEQ ID NO: 642188 - RNA, 22 nt, Human
gcccugagugccuguguaagaa

SEQ ID NO: 642189 - RNA, 22 nt, Human
uugugucuggauuucagcuuuc

SEQ ID NO: 642190 - RNA, 22 nt, Human
aaugcuuugagggaagaugaaa

SEQ ID NO: 642191 - RNA, 22 nt, Human
uacagaguggugagaucuuuug

SEQ ID NO: 642192 - RNA, 23 nt, Human
acagagguccaaacaguauaagc

SEQ ID NO: 642193 - RNA, 22 nt, Human
cucucuggacuugaguaucagc

SEQ ID NO: 642194 - RNA, 22 nt, Human
agcagguggccuccugucuguc

SEQ ID NO: 642195 - RNA, 22 nt, Human
guggaggagaggcgccuugcgg

SEQ ID NO: 642196 - RNA, 22 nt, Human
ucacauucucagcaucuauaca

SEQ ID NO: 642197 - RNA, 22 nt, Human
ccuucagagguguagauugcgu

SEQ ID NO: 642198 - RNA, 22 nt, Human
aacuauauaaucugaaagugaa

SEQ ID NO: 642199 - RNA, 22 nt, Human
aacuacaauauguauguaugua

SEQ ID NO: 642200 - RNA, 22 nt, Human
ucuggccugaaaguccaugcuu

SEQ ID NO: 642201 - RNA, 21 nt, Human
ugauucugcauuucuaacagg

SEQ ID NO: 642202 - RNA, 22 nt, Human
ugggugagugggaaaagcccag

SEQ ID NO: 642203 - RNA, 22 nt, Human
gaugccuccaaaugagggcaga

SEQ ID NO: 642204 - RNA, 22 nt, Human
cucuguccuaugcuugauagaa

SEQ ID NO: 642205 - RNA, 22 nt, Human
agugcaauguguacagaaaaau

SEQ ID NO: 642206 - RNA, 22 nt, Human
aaguuuacauaagugaugauga

SEQ ID NO: 642207 - RNA, 22 nt, Human
uacaaagaggcagcuccauuuu

SEQ ID NO: 642208 - RNA, 20 nt, Human
agaaaugugaaaggcugagu

SEQ ID NO: 642209 - RNA, 22 nt, Human
uccacagggaugccugcggcuu

SEQ ID NO: 642210 - RNA, 22 nt, Human
aaagauuagauaagauagauuu

SEQ ID NO: 642211 - RNA, 22 nt, Human
uuaacucucccuccuuacaucc

SEQ ID NO: 642212 - RNA, 22 nt, Human
uuccuucucuguggggaaggca

SEQ ID NO: 642213 - RNA, 22 nt, Human
auucuuaauugccaugcuguau

SEQ ID NO: 642214 - RNA, 22 nt, Human
aacuggaaccuuuuauucaguc

SEQ ID NO: 642215 - RNA, 22 nt, Human
gagcugggccucagaacacagu

SEQ ID NO: 642216 - RNA, 22 nt, Human
aaucuggacacaguucucaugc

SEQ ID NO: 642217 - RNA, 22 nt, Human
aguggcugauuacaaacugagu

SEQ ID NO: 642218 - RNA, 22 nt, Human
uucauugaaauuaagcccaacu

SEQ ID NO: 642219 - RNA, 22 nt, Human
agaucuggcccucagcuugauu

SEQ ID NO: 642220 - RNA, 22 nt, Human
cuucaaguugggcggcgggcag

SEQ ID NO: 642221 - RNA, 18 nt, Human
caggccucuugaucuucc

SEQ ID NO: 642222 - RNA, 18 nt, Human
aaaugcuaggcuacauga

SEQ ID NO: 642223 - RNA, 22 nt, Human
aaagcagccugcucauccugga

SEQ ID NO: 642224 - RNA, 22 nt, Human
agguuucuccuuuaaagcaugg

SEQ ID NO: 642225 - RNA, 22 nt, Human
ugcuugucacauacaggagcau

SEQ ID NO: 642226 - RNA, 16 nt, Human
uggaggcaucuggccc

SEQ ID NO: 642227 - RNA, 22 nt, Human
ugugugcagccucugucuuugg

SEQ ID NO: 642228 - RNA, 22 nt, Human
cacagauagaccuuaugagauu

SEQ ID NO: 642229 - RNA, 22 nt, Human
gcauccaaaccauucaucagcc

SEQ ID NO: 642230 - RNA, 22 nt, Human
cagcuucagcgugacaccagug

SEQ ID NO: 642231 - RNA, 22 nt, Human
cuccagguauuacuguuuuccc

SEQ ID NO: 642232 - RNA, 22 nt, Human
gucccugggaugcccuucuggg

SEQ ID NO: 642233 - RNA, 22 nt, Human
ucccucagcaggaacuggccug

SEQ ID NO: 642234 - RNA, 22 nt, Human
uguuacaauauuaucaacugag

SEQ ID NO: 642235 - RNA, 22 nt, Human
uggugcaaaacuaauugcgguu

SEQ ID NO: 642236 - RNA, 22 nt, Human
auuuugcuuuauguaaauaugu

SEQ ID NO: 642237 - RNA, 22 nt, Human
cugagcuuccaguuccuccagg

SEQ ID NO: 642238 - RNA, 22 nt, Human
auagaauuacaguguguuugga

SEQ ID NO: 642239 - RNA, 22 nt, Human
cuuuaucuaggguaagaaaacc

SEQ ID NO: 642240 - RNA, 21 nt, Human
uggccaaacuggagcauuuga

SEQ ID NO: 642241 - RNA, 23 nt, Human
agagcaucaugaugcuaagucug

SEQ ID NO: 642242 - RNA, 22 nt, Human
ucaaaacacuauuaccuuuaau

SEQ ID NO: 642243 - RNA, 22 nt, Human
uugggaggucauaaaucuguuc

SEQ ID NO: 642244 - RNA, 22 nt, Human
cagcuccaucuugcuuauacca

SEQ ID NO: 642245 - RNA, 22 nt, Human
aagcaaagaguuuaguggguga

SEQ ID NO: 642246 - RNA, 22 nt, Human
gggccugugcacaguucuguua

SEQ ID NO: 642247 - RNA, 22 nt, Human
auuccuuuggacuccuccuugc

SEQ ID NO: 642248 - RNA, 22 nt, Human
cugucgccugguccucucugga

SEQ ID NO: 642249 - RNA, 22 nt, Human
gaauugauugauauguacugua

SEQ ID NO: 642250 - RNA, 22 nt, Human
ccagagaggccuuggcaagaca

SEQ ID NO: 642251 - RNA, 23 nt, Human
ucagaacaguucuuggugcauag

SEQ ID NO: 642252 - RNA, 22 nt, Human
agacacugaauguuuggugguc

SEQ ID NO: 642253 - RNA, 22 nt, Human
gucccaggcagagucaggaggg

SEQ ID NO: 642254 - RNA, 22 nt, Human
ggcuggucacaccacugcaggg

SEQ ID NO: 642255 - RNA, 22 nt, Human
ugcagguggacacgggagacgg

SEQ ID NO: 642256 - RNA, 21 nt, Human
gaguggaacgcucuucacacc

SEQ ID NO: 642257 - RNA, 22 nt, Human
caagcagccccaacaugaggau

SEQ ID NO: 642258 - RNA, 23 nt, Human
ucucugggugggcugugucuaua

SEQ ID NO: 642259 - RNA, 22 nt, Human
ugggacacacaaggucagcucu

SEQ ID NO: 642260 - RNA, 22 nt, Human
uuugugacuugcuucucagaau

SEQ ID NO: 642261 - RNA, 22 nt, Human
gaaguucucaaggaucacagaa

SEQ ID NO: 642262 - RNA, 22 nt, Human
cuuauuauaaaauccuguuuga

SEQ ID NO: 642263 - RNA, 22 nt, Human
gcucagcugcaccuggagagcc

SEQ ID NO: 642264 - RNA, 22 nt, Human
ucucuugugguuuuguaguuga

SEQ ID NO: 642265 - RNA, 22 nt, Human
agccagugcagcuggaaauuca

SEQ ID NO: 642266 - RNA, 22 nt, Human
aaugcaaacuucuuguuacuug

SEQ ID NO: 642267 - RNA, 22 nt, Human
aaaaugugcaguuuuuaagcug

SEQ ID NO: 642268 - RNA, 20 nt, Human
aucugcugagaaugaaaggc

SEQ ID NO: 642269 - RNA, 22 nt, Human
uucuuucaauagcuggcauaug

SEQ ID NO: 642270 - RNA, 22 nt, Human
augguuuauuagcugcacaggc

SEQ ID NO: 642271 - RNA, 22 nt, Human
gcucucugcagccuccuuggag

SEQ ID NO: 642272 - RNA, 19 nt, Human
gugaggucuuuccuuuugu

SEQ ID NO: 642273 - RNA, 22 nt, Human
acuguaaauuacauaagaacag

SEQ ID NO: 642274 - RNA, 22 nt, Human
aauccagcacauggacacaguc

SEQ ID NO: 642275 - RNA, 22 nt, Human
uggcuucuagagcccauccuuc

SEQ ID NO: 642276 - RNA, 22 nt, Human
cacauuucucuaccucacacaa

SEQ ID NO: 642277 - RNA, 22 nt, Human
ugggguugaagaaaggaucuag

SEQ ID NO: 642278 - RNA, 22 nt, Human
uguguauguuuugagguugcua

SEQ ID NO: 642279 - RNA, 19 nt, Human
ugcauaaauuauauacuuu

SEQ ID NO: 642280 - RNA, 22 nt, Human
uggagagcugguucaaagcaga

SEQ ID NO: 642281 - RNA, 22 nt, Human
ucaugcuuuguuaauguggcac

SEQ ID NO: 642282 - RNA, 22 nt, Human
aguggcuuauguuuagaaucau

SEQ ID NO: 642283 - RNA, 22 nt, Human
uuucauaauauccagagauuuu

SEQ ID NO: 642284 - RNA, 22 nt, Human
gaagagaugacaaaggagcaug

SEQ ID NO: 642285 - RNA, 22 nt, Human
ugcaguguuccuguggguuuau

SEQ ID NO: 642286 - RNA, 22 nt, Human
ucuuuugugauucuucaguuac

SEQ ID NO: 642287 - RNA, 22 nt, Human
ccacccugugcaggcgugggua

SEQ ID NO: 642288 - RNA, 22 nt, Human
cccagaugcagguucaagagua

SEQ ID NO: 642289 - RNA, 22 nt, Human
acaugcagaauucuuagagagc

SEQ ID NO: 642290 - RNA, 22 nt, Human
ucagcuuuuaaaaacaagaagu

SEQ ID NO: 642291 - RNA, 22 nt, Human
cuguccauuuugaauuuucagu

SEQ ID NO: 642292 - RNA, 22 nt, Human
uaucuaaauggaauauuccaga

SEQ ID NO: 642293 - RNA, 22 nt, Human
agcagcaucucuuauugcagug

SEQ ID NO: 642294 - RNA, 22 nt, Human
ucacuccucaggcuagcaucau

SEQ ID NO: 642295 - RNA, 22 nt, Human
ggcucugccauuuccuagcugc

SEQ ID NO: 642296 - RNA, 22 nt, Human
agcagcuucagaggcgggcgca

SEQ ID NO: 642297 - RNA, 22 nt, Human
gagguucauucagcucugucac

SEQ ID NO: 642298 - RNA, 22 nt, Human
uaguauuuccuguaagcuauag

SEQ ID NO: 642299 - RNA, 22 nt, Human
ucugggagacguguguugucag

SEQ ID NO: 642300 - RNA, 21 nt, Human
ugacugaaauagaauuuagcu

SEQ ID NO: 642301 - RNA, 22 nt, Human
aaacuguauuccauccucauca

SEQ ID NO: 642302 - RNA, 23 nt, Human
ugucuccaucucauuacuugggg

SEQ ID NO: 642303 - RNA, 22 nt, Human
aagcccuguccggggggaagaa

SEQ ID NO: 642304 - RNA, 22 nt, Human
agcuuuaugggagcuuagauaa

SEQ ID NO: 642305 - RNA, 22 nt, Human
uuagcaaacucuguuagauucu

SEQ ID NO: 642306 - RNA, 22 nt, Human
acuccugugggcauggcacccc

SEQ ID NO: 642307 - RNA, 22 nt, Human
acuucaugaacuaagggaucgg

SEQ ID NO: 642308 - RNA, 22 nt, Human
ccuggaaaacaugggaaucaca

SEQ ID NO: 642309 - RNA, 22 nt, Human
cucuuuacucuguguuauuguu

SEQ ID NO: 642310 - RNA, 22 nt, Human
cagaggcaggaagaugggcagu

SEQ ID NO: 642311 - RNA, 22 nt, Human
aaggaagaugaggugcugcuua

SEQ ID NO: 642312 - RNA, 22 nt, Human
uuggccuuguuaaggaggcccu

SEQ ID NO: 642313 - RNA, 22 nt, Human
uaucuauuccaaauaucagcgu

SEQ ID NO: 642314 - RNA, 22 nt, Human
agagggcugccucagucagcua

SEQ ID NO: 642315 - RNA, 22 nt, Human
agccagccaguucacuaggaaa

SEQ ID NO: 642316 - RNA, 22 nt, Human
uguggcccagaugagugugcua

SEQ ID NO: 642317 - RNA, 22 nt, Human
uugauucaguaaagcuaaauuu

SEQ ID NO: 642318 - RNA, 22 nt, Human
ugugaaauauuuauauacucaa

SEQ ID NO: 642319 - RNA, 22 nt, Human
auggggggaugaaggaguccaa

SEQ ID NO: 642320 - RNA, 18 nt, Human
uguagaaaagauaggaau

SEQ ID NO: 642321 - RNA, 22 nt, Human
uacuuguuuuguguuccuaaac

SEQ ID NO: 642322 - RNA, 22 nt, Human
aggcuaggguaacagauguggc

SEQ ID NO: 642323 - RNA, 22 nt, Human
uccagcucaaauucagcuucca

SEQ ID NO: 642324 - RNA, 22 nt, Human
aauaauccugcccgucucuccg

SEQ ID NO: 642325 - RNA, 22 nt, Human
uaaccuuuggugaaauauuaac

SEQ ID NO: 642326 - RNA, 22 nt, Human
gccccuuccaucaugugaggac

SEQ ID NO: 642327 - RNA, 22 nt, Human
gccagcugggccuuagggcugg

SEQ ID NO: 642328 - RNA, 21 nt, Human
aggaaugcugaggcucacuuu

SEQ ID NO: 642329 - RNA, 18 nt, Human
cuccagagcugugagaca

SEQ ID NO: 642330 - RNA, 22 nt, Human
uccaaagaacauugcugagacc

SEQ ID NO: 642331 - RNA, 22 nt, Human
ucuaaaugugguagucauaaga

SEQ ID NO: 642332 - RNA, 22 nt, Human
ccucccacuucuugcugagguc

SEQ ID NO: 642333 - RNA, 22 nt, Human
guguacauauugagucugcuga

SEQ ID NO: 642334 - RNA, 22 nt, Human
ccuccaggccuugcagguuaac

SEQ ID NO: 642335 - RNA, 22 nt, Human
aaaucagaaaauauggagagga

SEQ ID NO: 642336 - RNA, 20 nt, Human
cugcugugugugccucagcc

SEQ ID NO: 642337 - RNA, 22 nt, Human
acaugaaaaauguuugcaguuu

SEQ ID NO: 642338 - RNA, 22 nt, Human
guguuaaccagcuaaacuuugc

SEQ ID NO: 642339 - RNA, 22 nt, Human
cagaugaaggccugaaugucua

SEQ ID NO: 642340 - RNA, 20 nt, Human
agcaggcugcagggugaaau

SEQ ID NO: 642341 - RNA, 22 nt, Human
cugcagagaguaacugaaauau

SEQ ID NO: 642342 - RNA, 22 nt, Human
auagugggaauuacgauauacu

SEQ ID NO: 642343 - RNA, 22 nt, Human
aaagucucaggcaaaccaggac

SEQ ID NO: 642344 - RNA, 22 nt, Human
gugccagagcaaucaggcucug

SEQ ID NO: 642345 - RNA, 22 nt, Human
aaauaagaaauucuucuuugca

SEQ ID NO: 642346 - RNA, 17 nt, Human
uuaucuugcuguuucua

SEQ ID NO: 642347 - RNA, 22 nt, Human
ugccuugcagguuuuaaauaca

SEQ ID NO: 642348 - RNA, 22 nt, Human
uuagauaacaguagaauaucaa

SEQ ID NO: 642349 - RNA, 22 nt, Human
auuuucaaaacaucugcugugu

SEQ ID NO: 642350 - RNA, 22 nt, Human
agagcuguuugucuagagagug

SEQ ID NO: 642351 - RNA, 22 nt, Human
cccagacauaacagcagagagg

SEQ ID NO: 642352 - RNA, 22 nt, Human
agugcagggccugcccagcagg

SEQ ID NO: 642353 - RNA, 22 nt, Human
acaggaacuguuaucucagaug

SEQ ID NO: 642354 - RNA, 22 nt, Human
acauugugauccgacugauuaa

SEQ ID NO: 642355 - RNA, 22 nt, Human
cacaugaagagagucuaguaau

SEQ ID NO: 642356 - RNA, 22 nt, Human
uuuggaaaguugucacuuuaga

SEQ ID NO: 642357 - RNA, 20 nt, Human
caacacugcccauuguuugc

SEQ ID NO: 642358 - RNA, 22 nt, Human
ugccaggcagugucagauugag

SEQ ID NO: 642359 - RNA, 22 nt, Human
cucaguacuuuauguauaugau

SEQ ID NO: 642360 - RNA, 22 nt, Human
cccuccagccauggacccaggu

SEQ ID NO: 642361 - RNA, 20 nt, Human
ucuggacucuaagguauauu

SEQ ID NO: 642362 - RNA, 22 nt, Human
aaagagaacuuuuacccaagaa

SEQ ID NO: 642363 - RNA, 22 nt, Human
aacaugcucuuccuggcuaguc

SEQ ID NO: 642364 - RNA, 18 nt, Human
ugcagccuguagucuugu

SEQ ID NO: 642365 - RNA, 22 nt, Human
cagcucagacgcaggucgagca

SEQ ID NO: 642366 - RNA, 22 nt, Human
agccugccugugaggcuuugag

SEQ ID NO: 642367 - RNA, 22 nt, Human
gcagggaaacaggugcuaagga

SEQ ID NO: 642368 - RNA, 22 nt, Human
aguucucagaauugcaccucaa

SEQ ID NO: 642369 - RNA, 17 nt, Human
ggugagaccucccacuc

SEQ ID NO: 642370 - RNA, 22 nt, Human
gcucucagggugauggcauacu

SEQ ID NO: 642371 - RNA, 22 nt, Human
ggcuggucucagugcuggguuc

SEQ ID NO: 642372 - RNA, 22 nt, Human
gcuccaggguggaugacaauuc

SEQ ID NO: 642373 - RNA, 20 nt, Human
agaaggcaggagacaaaagg

SEQ ID NO: 642374 - RNA, 22 nt, Human
aggucaaggcugcagugagcug

SEQ ID NO: 642375 - RNA, 22 nt, Human
caggaggggguggaguuucgcc

SEQ ID NO: 642376 - RNA, 22 nt, Human
gucugagacugggcacauaccu

SEQ ID NO: 642377 - RNA, 22 nt, Human
ggugcagcugcagccugggagc

SEQ ID NO: 642378 - RNA, 22 nt, Human
cauuuacuguugaaucccuagc

SEQ ID NO: 642379 - RNA, 22 nt, Human
uucauacucacuccaauaacug

SEQ ID NO: 642380 - RNA, 22 nt, Human
aauugcuuguuucuuuaacuga

SEQ ID NO: 642381 - RNA, 22 nt, Human
cgucugccuaaggacugccuuc

SEQ ID NO: 642382 - RNA, 22 nt, Human
acucaucugccauuccuguacc

SEQ ID NO: 642383 - RNA, 22 nt, Human
ccaggucuggcacuggccaguc

SEQ ID NO: 642384 - RNA, 22 nt, Human
aaggaguuuggguagucauaca

SEQ ID NO: 642385 - RNA, 22 nt, Human
ugugcucuaccucagugucauu

SEQ ID NO: 642386 - RNA, 22 nt, Human
aagcuuuaaggaauuuuaugga

SEQ ID NO: 642387 - RNA, 22 nt, Human
agcaccauuuaucaucuaggua

SEQ ID NO: 642388 - RNA, 23 nt, Human
aguccccuacauaguuccugggg

SEQ ID NO: 642389 - RNA, 22 nt, Human
gcugucacacauggccccagcu

SEQ ID NO: 642390 - RNA, 22 nt, Human
cucuccaggcgagguccuacug

SEQ ID NO: 642391 - RNA, 22 nt, Human
gucucucugacugguccacacc

SEQ ID NO: 642392 - RNA, 22 nt, Human
ugucaggagccaccagcacucc

SEQ ID NO: 642393 - RNA, 22 nt, Human
cuaaugaagcugcuuucuauga

SEQ ID NO: 642394 - RNA, 22 nt, Human
aggacccaagcacaguuccugg

SEQ ID NO: 642395 - RNA, 22 nt, Human
aaagcaagucucuacaaaguac

SEQ ID NO: 642396 - RNA, 22 nt, Human
uuucaauguaacauuuccaggc

SEQ ID NO: 642397 - RNA, 20 nt, Human
caggcacacucauuccugcu

SEQ ID NO: 642398 - RNA, 22 nt, Human
cuuuuaaugggagcaguauuug

SEQ ID NO: 642399 - RNA, 22 nt, Human
cauucugggucuggcucaggga

SEQ ID NO: 642400 - RNA, 21 nt, Human
gcuuugaugcugccuugcucc

SEQ ID NO: 642401 - RNA, 22 nt, Human
aaacucucuuuucuucaguagg

SEQ ID NO: 642402 - RNA, 22 nt, Human
uucuuugugcugaagaagcccu

SEQ ID NO: 642403 - RNA, 22 nt, Human
ggcaggugcgcauguugcauua

SEQ ID NO: 642404 - RNA, 22 nt, Human
auaauguguucaucuuacaauu

SEQ ID NO: 642405 - RNA, 21 nt, Human
agcaggaggcagucacagcuc

SEQ ID NO: 642406 - RNA, 22 nt, Human
aauauuauacagucaaccucuu

SEQ ID NO: 642407 - RNA, 22 nt, Human
ucaggaacccuggucuccugcu

SEQ ID NO: 642408 - RNA, 22 nt, Human
caggcacccagcccagucgcac

SEQ ID NO: 642409 - RNA, 17 nt, Human
ucaaauccucugucugg

SEQ ID NO: 642410 - RNA, 22 nt, Human
aucaaaguaucucaauauggua

SEQ ID NO: 642411 - RNA, 22 nt, Human
ucagggcaagucucagaagguu

SEQ ID NO: 642412 - RNA, 22 nt, Human
cacugcuugcaguaugagugga

SEQ ID NO: 642413 - RNA, 22 nt, Human
gcaaugcauaacagagugggcc

SEQ ID NO: 642414 - RNA, 22 nt, Human
agugucugaugcacaguugucc

SEQ ID NO: 642415 - RNA, 22 nt, Human
ugccaauuagagacauccaucu

SEQ ID NO: 642416 - RNA, 22 nt, Human
ucucugugaguggaaggcaccc

SEQ ID NO: 642417 - RNA, 22 nt, Human
gcagggcugaaggucccaggcc

SEQ ID NO: 642418 - RNA, 22 nt, Human
caggguccccgggucuccugug

SEQ ID NO: 642419 - RNA, 22 nt, Human
ucccagagacaucauuucuccg

SEQ ID NO: 642420 - RNA, 22 nt, Human
ccuccagcgcgauccacuccgg

SEQ ID NO: 642421 - RNA, 22 nt, Human
cauagacauucagcacucacua

SEQ ID NO: 642422 - RNA, 16 nt, Human
aaauggcuuaggcuua

SEQ ID NO: 642423 - RNA, 22 nt, Human
gcucugggugaacuuggagcaa

SEQ ID NO: 642424 - RNA, 22 nt, Human
gagccugcccagcccuguccac

SEQ ID NO: 642425 - RNA, 22 nt, Human
gccagcccagcuccaggggaaa

SEQ ID NO: 642426 - RNA, 23 nt, Human
cuucaucaaaaguuaacacuagu

SEQ ID NO: 642427 - RNA, 22 nt, Human
accugggagucacaccugagaa

SEQ ID NO: 642428 - RNA, 22 nt, Human
ucccucuacagggaagcgcuuu

SEQ ID NO: 642429 - RNA, 22 nt, Human
gcuggccacauugugccguccu

SEQ ID NO: 642430 - RNA, 22 nt, Human
ugcuucuccauugaugcuaagu

SEQ ID NO: 642431 - RNA, 22 nt, Human
gaucacaugaauggaauagaag

SEQ ID NO: 642432 - RNA, 22 nt, Human
cugccugcugauuaguauuguc

SEQ ID NO: 642433 - RNA, 22 nt, Human
caaauagauuguucaauccuga

SEQ ID NO: 642434 - RNA, 22 nt, Human
aggcacugaagaacucuuuuug

SEQ ID NO: 642435 - RNA, 22 nt, Human
agcugaagcaacaacaggaugg

SEQ ID NO: 642436 - RNA, 22 nt, Human
auugaacuauaauuaugauuug

SEQ ID NO: 642437 - RNA, 22 nt, Human
cucugggcacauuuuccaggac

SEQ ID NO: 642438 - RNA, 22 nt, Human
ucugggaaugaggcccagcgau

SEQ ID NO: 642439 - RNA, 18 nt, Human
gcucugcccaggcugccc

SEQ ID NO: 642440 - RNA, 22 nt, Human
gagccauacaaccuauaaagug

SEQ ID NO: 642441 - RNA, 22 nt, Human
uagcucuggagucuucucagaa

SEQ ID NO: 642442 - RNA, 22 nt, Human
uuguucaucuggaacccagagc

SEQ ID NO: 642443 - RNA, 22 nt, Human
uggggauguaaaugaggugaua

SEQ ID NO: 642444 - RNA, 22 nt, Human
aaauauuagggagaacagggac

SEQ ID NO: 642445 - RNA, 22 nt, Human
uagggcagccuuauagcuccca

SEQ ID NO: 642446 - RNA, 20 nt, Human
accaauguuagcuuaguacu

SEQ ID NO: 642447 - RNA, 22 nt, Human
gggaacagaggaggguguugcu

SEQ ID NO: 642448 - RNA, 22 nt, Human
aguaagugagucacugugcugg

SEQ ID NO: 642449 - RNA, 22 nt, Human
auucacaguucauuagcuguaa

SEQ ID NO: 642450 - RNA, 22 nt, Human
acacagugguguuuacaaaauu

SEQ ID NO: 642451 - RNA, 22 nt, Human
acagcaguggguugccaguggg

SEQ ID NO: 642452 - RNA, 22 nt, Human
uacuuguucuuucaagagauag

SEQ ID NO: 642453 - RNA, 22 nt, Human
aggagccugaaucagaggguga

SEQ ID NO: 642454 - RNA, 22 nt, Human
agucagggguuggacggggcca

SEQ ID NO: 642455 - RNA, 22 nt, Human
aagugacacauggcacuucuau

SEQ ID NO: 642456 - RNA, 22 nt, Human
agugaggaaauccauuaucaag

SEQ ID NO: 642457 - RNA, 19 nt, Human
auguuuuaugcugauggga

SEQ ID NO: 642458 - RNA, 22 nt, Human
auccagggauaaaaguaagguu

SEQ ID NO: 642459 - RNA, 22 nt, Human
uagaggcuccuguguguagguu

SEQ ID NO: 642460 - RNA, 22 nt, Human
agugcacagcgugauguauugg

SEQ ID NO: 642461 - RNA, 22 nt, Human
uaucugugaaauguguuuguau

SEQ ID NO: 642462 - RNA, 22 nt, Human
gcagggcaggauuugaacccag

SEQ ID NO: 642463 - RNA, 22 nt, Human
cuguuauuuggaggaugcuugg

SEQ ID NO: 642464 - RNA, 22 nt, Human
cuggaggcuggcuuccccuggc

SEQ ID NO: 642465 - RNA, 22 nt, Human
gcaaggaagagcagguggugcu

SEQ ID NO: 642466 - RNA, 18 nt, Human
uuugcuuuccuucuucag

SEQ ID NO: 642467 - RNA, 22 nt, Human
ugcugccucugcugauauggcc

SEQ ID NO: 642468 - RNA, 22 nt, Human
uggggagcccacucaccucccc

SEQ ID NO: 642469 - RNA, 22 nt, Human
agaaaguucacugguauauuuu

SEQ ID NO: 642470 - RNA, 23 nt, Human
uguauacacccugugcaucuggg

SEQ ID NO: 642471 - RNA, 22 nt, Human
uguaagauauucagcuuauuga

SEQ ID NO: 642472 - RNA, 20 nt, Human
uacaguucuguagaaguaga

SEQ ID NO: 642473 - RNA, 22 nt, Human
ugguccugcuugcugcuuaaga

SEQ ID NO: 642474 - RNA, 22 nt, Human
gagucugaggggagagcugggu

SEQ ID NO: 642475 - RNA, 22 nt, Human
ggggaaauuguggcugacagug

SEQ ID NO: 642476 - RNA, 22 nt, Human
uuacacagaugguuaguagagg

SEQ ID NO: 642477 - RNA, 22 nt, Human
ugacaauugugggcaguuugug

SEQ ID NO: 642478 - RNA, 22 nt, Human
gggugggccacugagcagcgug

SEQ ID NO: 642479 - RNA, 22 nt, Human
uccuggcugccgucguccugcg

SEQ ID NO: 642480 - RNA, 22 nt, Human
ucagggaaugaugcacacaguu

SEQ ID NO: 642481 - RNA, 22 nt, Human
guuccucauccagucaugacua

SEQ ID NO: 642482 - RNA, 22 nt, Human
aagggagguaaagcuauuuaaa

SEQ ID NO: 642483 - RNA, 22 nt, Human
caggaacauuuaaccacagggu

SEQ ID NO: 642484 - RNA, 22 nt, Human
uaucuguuaugggcugaauugc

SEQ ID NO: 642485 - RNA, 22 nt, Human
uccaggucugguuggacagguu

SEQ ID NO: 642486 - RNA, 22 nt, Human
auucauaucauagaguuauuga

SEQ ID NO: 642487 - RNA, 22 nt, Human
uuucuguaaguggcaaauaaug

SEQ ID NO: 642488 - RNA, 22 nt, Human
ugugccagaaaauaugcugagg

SEQ ID NO: 642489 - RNA, 17 nt, Human
ggcagagcugacagggc

SEQ ID NO: 642490 - RNA, 22 nt, Human
auuugcuuucagguauaaaagg

SEQ ID NO: 642491 - RNA, 22 nt, Human
ccgggagacuuugagcaccaug

SEQ ID NO: 642492 - RNA, 17 nt, Human
gagauggguggaucacc

SEQ ID NO: 642493 - RNA, 22 nt, Human
cuccucucaaaaguagguugac

SEQ ID NO: 642494 - RNA, 22 nt, Human
cucacagauauuugcuucaggu

SEQ ID NO: 642495 - RNA, 22 nt, Human
cucucugguacauagaguuugg

SEQ ID NO: 642496 - RNA, 22 nt, Human
cagauagcaauuugggcagggg

SEQ ID NO: 642497 - RNA, 22 nt, Human
ugagacagcccuucugcacagg

SEQ ID NO: 642498 - RNA, 22 nt, Human
uacagaaacagcgugguuagaa

SEQ ID NO: 642499 - RNA, 22 nt, Human
uccucccugcacucagugaagu

SEQ ID NO: 642500 - RNA, 22 nt, Human
aaaggaguuacucauaaagcuu

SEQ ID NO: 642501 - RNA, 22 nt, Human
uggcaugaagucagcagcuggg

SEQ ID NO: 642502 - RNA, 23 nt, Human
ucacaucugccguaguguauucu

SEQ ID NO: 642503 - RNA, 22 nt, Human
uuggcucugaaacccaagcucu

SEQ ID NO: 642504 - RNA, 22 nt, Human
cugugccacugccccaggccuc

SEQ ID NO: 642505 - RNA, 22 nt, Human
gacaacaauaauguggagcuga

SEQ ID NO: 642506 - RNA, 22 nt, Human
gcagagugccgagauggaagcg

SEQ ID NO: 642507 - RNA, 22 nt, Human
ugggcccugacuucaagcaucc

SEQ ID NO: 642508 - RNA, 22 nt, Human
gaauaaucauaucgucucacau

SEQ ID NO: 642509 - RNA, 23 nt, Human
cugaagagccaacaaaaagcuug

SEQ ID NO: 642510 - RNA, 22 nt, Human
guuuccagucaacuugugugug

SEQ ID NO: 642511 - RNA, 19 nt, Human
uggcauugguccagauaaa

SEQ ID NO: 642512 - RNA, 22 nt, Human
gaccucagauuuucccaggcca

SEQ ID NO: 642513 - RNA, 22 nt, Human
gugugggacgggugaguggcca

SEQ ID NO: 642514 - RNA, 23 nt, Human
agagaaucauggaaacucuuucu

SEQ ID NO: 642515 - RNA, 20 nt, Human
acagucgccuaucaaccagg

SEQ ID NO: 642516 - RNA, 22 nt, Human
acaaaaguguaggaauuccuua

SEQ ID NO: 642517 - RNA, 22 nt, Human
auuguugggucucacuccuaga

SEQ ID NO: 642518 - RNA, 22 nt, Human
gggcugagcuaagcuggguuga

SEQ ID NO: 642519 - RNA, 22 nt, Human
aaaguagaguuguggaauuacu

SEQ ID NO: 642520 - RNA, 21 nt, Human
aagaaagauaauuaaggaccc

SEQ ID NO: 642521 - RNA, 22 nt, Human
gcaggcuugcccggccuccuuc

SEQ ID NO: 642522 - RNA, 22 nt, Human
gucccaggugcccagugggcag

SEQ ID NO: 642523 - RNA, 22 nt, Human
agccuggcugggaagagccucu

SEQ ID NO: 642524 - RNA, 22 nt, Human
aaccaugucuuguuuuccuagu

SEQ ID NO: 642525 - RNA, 22 nt, Human
guuuagaauucuaacuuuaagg

SEQ ID NO: 642526 - RNA, 22 nt, Human
gggggaugcucaggaggcugcu

SEQ ID NO: 642527 - RNA, 22 nt, Human
aaaucccugauaauguaggucu

SEQ ID NO: 642528 - RNA, 19 nt, Human
ggcugucuggcguguggau

SEQ ID NO: 642529 - RNA, 22 nt, Human
auauucucugcugcuuuugugu

SEQ ID NO: 642530 - RNA, 22 nt, Human
gugugacccaaggacacucucu

SEQ ID NO: 642531 - RNA, 22 nt, Human
uaagauguaagaucagagcuug

SEQ ID NO: 642532 - RNA, 22 nt, Human
ugccgccugguuucuccgcccc

SEQ ID NO: 642533 - RNA, 22 nt, Human
uguagcucuccagccagcaagg

SEQ ID NO: 642534 - RNA, 22 nt, Human
uuuuaacuuaaaauacauagau

SEQ ID NO: 642535 - RNA, 22 nt, Human
uuugcaaagugcuugcagagua

SEQ ID NO: 642536 - RNA, 22 nt, Human
gcaugugucuccccaguggagg

SEQ ID NO: 642537 - RNA, 22 nt, Human
acacauuaggcagugcuuaaau

SEQ ID NO: 642538 - RNA, 22 nt, Human
gaagcaagugcaaggaagaggc

SEQ ID NO: 642539 - RNA, 22 nt, Human
augcuaaaugcuggggguacau

SEQ ID NO: 642540 - RNA, 22 nt, Human
gagauauuuauucauacuguca

SEQ ID NO: 642541 - RNA, 22 nt, Human
auuuucuguaacuauuucuaua

SEQ ID NO: 642542 - RNA, 22 nt, Human
ugagaaaacucaaagacagauc

SEQ ID NO: 642543 - RNA, 22 nt, Human
uuuaauuauaucugggcaguua

SEQ ID NO: 642544 - RNA, 22 nt, Human
cugcugccuuccaaaggccagg

SEQ ID NO: 642545 - RNA, 21 nt, Human
gcugcccaacccugcaucucc

SEQ ID NO: 642546 - RNA, 22 nt, Human
aguucucaggucagcugagucu

SEQ ID NO: 642547 - RNA, 22 nt, Human
acagugaggacagggacugugu

SEQ ID NO: 642548 - RNA, 22 nt, Human
cccuggagggcagacagaugcc

SEQ ID NO: 642549 - RNA, 22 nt, Human
ucugguccccauuccagguggg

SEQ ID NO: 642550 - RNA, 22 nt, Human
uuucagaguuauguaagaaaau

SEQ ID NO: 642551 - RNA, 22 nt, Human
uaauuuacucagauguucaauc

SEQ ID NO: 642552 - RNA, 21 nt, Human
agacugccaucuuugggccac

SEQ ID NO: 642553 - RNA, 22 nt, Human
ugugggagaaggaagcaagcug

SEQ ID NO: 642554 - RNA, 22 nt, Human
gugugcugcccaacucgcagau

SEQ ID NO: 642555 - RNA, 19 nt, Human
caaggguugggucugucau

SEQ ID NO: 642556 - RNA, 22 nt, Human
uuuuaucuaccuaugcucauuu

SEQ ID NO: 642557 - RNA, 22 nt, Human
ugagcagaagauuggaacuuac

SEQ ID NO: 642558 - RNA, 22 nt, Human
ugaugaaaaccagaacucucau

SEQ ID NO: 642559 - RNA, 22 nt, Human
cucaucagaaauaccugacaaa

SEQ ID NO: 642560 - RNA, 22 nt, Human
uugaaaguagcagcugcauaug

SEQ ID NO: 642561 - RNA, 22 nt, Human
cuagcaggucaaaccagcugau

SEQ ID NO: 642562 - RNA, 22 nt, Human
aagccuggcacauuggagucug

SEQ ID NO: 642563 - RNA, 22 nt, Human
ggcuccaggcuccuauuucacu

SEQ ID NO: 642564 - RNA, 22 nt, Human
ggccccagcagacccuccucug

SEQ ID NO: 642565 - RNA, 22 nt, Human
augcaguauaaaucauuucugg

SEQ ID NO: 642566 - RNA, 18 nt, Human
aggcccuggccucgaaca

SEQ ID NO: 642567 - RNA, 21 nt, Human
uaggccacauggguuggagau

SEQ ID NO: 642568 - RNA, 22 nt, Human
ugagaaaacaguuuguaauaau

SEQ ID NO: 642569 - RNA, 17 nt, Human
aggaagcgagcuggccu

SEQ ID NO: 642570 - RNA, 22 nt, Human
acagugcaggucucaacaauua

SEQ ID NO: 642571 - RNA, 22 nt, Human
uucacaggcuuggagguggggg

SEQ ID NO: 642572 - RNA, 22 nt, Human
ucagucaccuugacuauagcug

SEQ ID NO: 642573 - RNA, 22 nt, Human
ucugucugcucauuuaccucag

SEQ ID NO: 642574 - RNA, 22 nt, Human
agacaucagcuugugugcaggg

SEQ ID NO: 642575 - RNA, 22 nt, Human
caaauguugcuguaauguuugu

SEQ ID NO: 642576 - RNA, 22 nt, Human
cagcuccagccugacaccaaga

SEQ ID NO: 642577 - RNA, 22 nt, Human
gcaggacacagaugcaaggcca

SEQ ID NO: 642578 - RNA, 22 nt, Human
ccacagccauuccagggaggcu

SEQ ID NO: 642579 - RNA, 22 nt, Human
ugagcuguacuccuccccaggg

SEQ ID NO: 642580 - RNA, 22 nt, Human
ucugaaaucuaaugcucugugg

SEQ ID NO: 642581 - RNA, 22 nt, Human
ugagaugguucacagagaaggc

SEQ ID NO: 642582 - RNA, 22 nt, Human
ugcaggaacagaacucacuccc

SEQ ID NO: 642583 - RNA, 22 nt, Human
cauacauaugcauguguguaua

SEQ ID NO: 642584 - RNA, 23 nt, Human
aaugcuggaaauucaggcaugau

SEQ ID NO: 642585 - RNA, 23 nt, Human
ccagcuccgugagccucgggcuc

SEQ ID NO: 642586 - RNA, 22 nt, Human
aagggcucuguugccauuucag

SEQ ID NO: 642587 - RNA, 22 nt, Human
uauaguaaaauuuucauuuaug

SEQ ID NO: 642588 - RNA, 22 nt, Human
acaacugucaguaaagaauauu

SEQ ID NO: 642589 - RNA, 22 nt, Human
uuaauugggugcaacagcugaa

SEQ ID NO: 642590 - RNA, 22 nt, Human
cuuuuccucaggaggagacgcg

SEQ ID NO: 642591 - RNA, 22 nt, Human
auaaucuggucuuuguaugagu

SEQ ID NO: 642592 - RNA, 22 nt, Human
ggacagagggcaggagcccaga

SEQ ID NO: 642593 - RNA, 22 nt, Human
gaggagaagcuauuggaaggac

SEQ ID NO: 642594 - RNA, 22 nt, Human
agaggccagaaaguaugccacc

SEQ ID NO: 642595 - RNA, 22 nt, Human
agggcagagggugccucaccug

SEQ ID NO: 642596 - RNA, 19 nt, Human
gcucucccucucaguugag

SEQ ID NO: 642597 - RNA, 22 nt, Human
gucugcuuugucuuucaugaua

SEQ ID NO: 642598 - RNA, 17 nt, Human
agguucagguuacauuc

SEQ ID NO: 642599 - RNA, 22 nt, Human
auagacagcgcauuaaaaaugu

SEQ ID NO: 642600 - RNA, 22 nt, Human
cagcacugcuucgcagccaggg

SEQ ID NO: 642601 - RNA, 22 nt, Human
agucaaagaugaccgaguuccu

SEQ ID NO: 642602 - RNA, 22 nt, Human
guccaucuguaggagggacaca

SEQ ID NO: 642603 - RNA, 22 nt, Human
ucauguuuuugccauaugacuc

SEQ ID NO: 642604 - RNA, 22 nt, Human
uuccggaagguucucuagaauu

SEQ ID NO: 642605 - RNA, 22 nt, Human
gucugcccuuccucuccacgau

SEQ ID NO: 642606 - RNA, 22 nt, Human
uuucucaguaauguccuggaau

SEQ ID NO: 642607 - RNA, 22 nt, Human
cgaggaagaaguuugagucaag

SEQ ID NO: 642608 - RNA, 22 nt, Human
agcagcaggugaccucgaugcc

SEQ ID NO: 642609 - RNA, 22 nt, Human
agcacaaauauaaaaaugucug

SEQ ID NO: 642610 - RNA, 22 nt, Human
cacugaaccguaaaugauuuag

SEQ ID NO: 642611 - RNA, 22 nt, Human
ugggcaggcaagugaauaccuu

SEQ ID NO: 642612 - RNA, 22 nt, Human
gccagcugugcuuuuccuaaaa

SEQ ID NO: 642613 - RNA, 22 nt, Human
guccaugauucuguguaguaga

SEQ ID NO: 642614 - RNA, 22 nt, Human
ccuugcucaucccccagugccu

SEQ ID NO: 642615 - RNA, 22 nt, Human
gugauuaaugccaaugggccuu

SEQ ID NO: 642616 - RNA, 22 nt, Human
ggaggaagggcccaggcuuuau

SEQ ID NO: 642617 - RNA, 22 nt, Human
ugacaacauugaguuaugugca

SEQ ID NO: 642618 - RNA, 22 nt, Human
gugcccugcaugccccggguau

SEQ ID NO: 642619 - RNA, 22 nt, Human
uauugucacgucuuaauucuag

SEQ ID NO: 642620 - RNA, 22 nt, Human
uucggcuuuccaguuugucucg

SEQ ID NO: 642621 - RNA, 22 nt, Human
aaacuucagacuccccacuucu

SEQ ID NO: 642622 - RNA, 19 nt, Human
auucuuugguguccauuuc

SEQ ID NO: 642623 - RNA, 22 nt, Human
gcagaaagcuuagaggguuugc

SEQ ID NO: 642624 - RNA, 22 nt, Human
uuacaagaugggaaagggaagu

SEQ ID NO: 642625 - RNA, 20 nt, Human
ucagccagcuaacaugggga

SEQ ID NO: 642626 - RNA, 22 nt, Human
ugcaggaaguuuccugaacuuu

SEQ ID NO: 642627 - RNA, 22 nt, Human
ucucaggggauucacuggcacc

SEQ ID NO: 642628 - RNA, 22 nt, Human
ugccaaguggagcucaggaauc

SEQ ID NO: 642629 - RNA, 22 nt, Human
ucuuuaucuggcucagagacac

SEQ ID NO: 642630 - RNA, 22 nt, Human
caggccagcagggccuccgugg

SEQ ID NO: 642631 - RNA, 19 nt, Human
cuccuucccugguuucugu

SEQ ID NO: 642632 - RNA, 22 nt, Human
uguucagaaaacagauaacuaa

SEQ ID NO: 642633 - RNA, 22 nt, Human
cagcucugccucuggggcugag

SEQ ID NO: 642634 - RNA, 19 nt, Human
cugcuccaggagcugggga

SEQ ID NO: 642635 - RNA, 22 nt, Human
uguggcugugccgucacacgug

SEQ ID NO: 642636 - RNA, 16 nt, Human
gggcaggaaucagggu

SEQ ID NO: 642637 - RNA, 22 nt, Human
acucucucugauggaacuuuag

SEQ ID NO: 642638 - RNA, 22 nt, Human
cuuguccccagcagguugguuu

SEQ ID NO: 642639 - RNA, 22 nt, Human
gccagcugguaggcaccuagcc

SEQ ID NO: 642640 - RNA, 22 nt, Human
uuucuguauuuaaaagaucugg

SEQ ID NO: 642641 - RNA, 22 nt, Human
ccuucuagcaaaucaacauaaa

SEQ ID NO: 642642 - RNA, 22 nt, Human
auuuggaaaagcgguaacuugc

SEQ ID NO: 642643 - RNA, 22 nt, Human
acacacuggagguaaauggggu

SEQ ID NO: 642644 - RNA, 23 nt, Human
uuucuguuggguauauauccaag

SEQ ID NO: 642645 - RNA, 22 nt, Human
uuuuccuguuaaaucugggcac

SEQ ID NO: 642646 - RNA, 20 nt, Human
ccugggguacacuggcaugu

SEQ ID NO: 642647 - RNA, 22 nt, Human
uugcuuuauuccuagcccuugu

SEQ ID NO: 642648 - RNA, 22 nt, Human
uuauucuguuggcccucucauc

SEQ ID NO: 642649 - RNA, 22 nt, Human
ugguccagacuuugaccucuca

SEQ ID NO: 642650 - RNA, 22 nt, Human
agaaaagugcucuagugagagc

SEQ ID NO: 642651 - RNA, 22 nt, Human
ggguaauuggggccuugcagug

SEQ ID NO: 642652 - RNA, 22 nt, Human
uguuuauaaauuuucuugccau

SEQ ID NO: 642653 - RNA, 22 nt, Human
aaacuguaaacacagcaguaca

SEQ ID NO: 642654 - RNA, 22 nt, Human
gaggcagcagaacauggaagag

SEQ ID NO: 642655 - RNA, 22 nt, Human
augcaucuuaucaaaaauuaua

SEQ ID NO: 642656 - RNA, 22 nt, Human
gcucccuggaauguuggcugcc

SEQ ID NO: 642657 - RNA, 20 nt, Human
ucuuacaaucguuacaucca

SEQ ID NO: 642658 - RNA, 22 nt, Human
uccauccauggauggaaaugug

SEQ ID NO: 642659 - RNA, 22 nt, Human
ugcauuuuuaacaaggcuaauu

SEQ ID NO: 642660 - RNA, 22 nt, Human
auguuucugaaguuuacagaua

SEQ ID NO: 642661 - RNA, 22 nt, Human
ggcucagagaccugcgaucuga

SEQ ID NO: 642662 - RNA, 22 nt, Human
cuucugcugcuguucaugguug

SEQ ID NO: 642663 - RNA, 22 nt, Human
acacaugcucauaaauaaauag

SEQ ID NO: 642664 - RNA, 22 nt, Human
acuggagcugagagcaugggua

SEQ ID NO: 642665 - RNA, 22 nt, Human
gaggaaccacucugagaagcca

SEQ ID NO: 642666 - RNA, 22 nt, Human
aggcuucuaggaaacuuucugg

SEQ ID NO: 642667 - RNA, 22 nt, Human
aagcuuccugcaugggacugcu

SEQ ID NO: 642668 - RNA, 22 nt, Human
aggcuguccucucuugcucagu

SEQ ID NO: 642669 - RNA, 22 nt, Human
caagcagggauacugcagggag

SEQ ID NO: 642670 - RNA, 22 nt, Human
cagugcugagagccuggccagg

SEQ ID NO: 642671 - RNA, 20 nt, Human
uucaugguguauuucuuucu

SEQ ID NO: 642672 - RNA, 22 nt, Human
uagaggcacagucuauguagag

SEQ ID NO: 642673 - RNA, 22 nt, Human
gugacucacacaggccugggcu

SEQ ID NO: 642674 - RNA, 22 nt, Human
ugccugaaugaucagucagauu

SEQ ID NO: 642675 - RNA, 22 nt, Human
agugugugcuguuccccggagg

SEQ ID NO: 642676 - RNA, 22 nt, Human
guauucagaaggaugaucuagu

SEQ ID NO: 642677 - RNA, 22 nt, Human
auucaucuguacuucaauaucu

SEQ ID NO: 642678 - RNA, 22 nt, Human
acagcuccuacugaagccaugu

SEQ ID NO: 642679 - RNA, 22 nt, Human
ccaggacagugaacauguaaga

SEQ ID NO: 642680 - RNA, 22 nt, Human
ucaaggcuaaacuuucagagua

SEQ ID NO: 642681 - RNA, 22 nt, Human
aaguuuaucccucucacaguua

SEQ ID NO: 642682 - RNA, 22 nt, Human
augcuucagugcuaccuucaaa

SEQ ID NO: 642683 - RNA, 23 nt, Human
ugcaacaaugaggaaagcuacug

SEQ ID NO: 642684 - RNA, 22 nt, Human
aagauuuuuuuccacagacuca

SEQ ID NO: 642685 - RNA, 23 nt, Human
auguauuuaaauuucagugauga

SEQ ID NO: 642686 - RNA, 22 nt, Human
cauuuguuuagaagucuuuaua

SEQ ID NO: 642687 - RNA, 22 nt, Human
ugaaacaagggaccguccuuuc

SEQ ID NO: 642688 - RNA, 22 nt, Human
gugcuuuacuggcagugaugua

SEQ ID NO: 642689 - RNA, 22 nt, Human
uuguuacauggacaacuguaug

SEQ ID NO: 642690 - RNA, 17 nt, Human
uugcagacuuuuuauua

SEQ ID NO: 642691 - RNA, 23 nt, Human
uggcuggcgccugccucacccug

SEQ ID NO: 642692 - RNA, 22 nt, Human
uuguuacagcagugauuucaga

SEQ ID NO: 642693 - RNA, 22 nt, Human
uaacuuuuacuuaccaucugag

SEQ ID NO: 642694 - RNA, 22 nt, Human
agcuuuaucccuugcccaucga

SEQ ID NO: 642695 - RNA, 20 nt, Human
ccagaagguaggauggaaca

SEQ ID NO: 642696 - RNA, 22 nt, Human
auguaucaugcaggguccauga

SEQ ID NO: 642697 - RNA, 22 nt, Human
acuuaaaaccagacagcgucau

SEQ ID NO: 642698 - RNA, 15 nt, Human
auuauuugugcucag

SEQ ID NO: 642699 - RNA, 22 nt, Human
accaaaaauuguggggcugaau

SEQ ID NO: 642700 - RNA, 22 nt, Human
caaauaauuacuauccucacuu

SEQ ID NO: 642701 - RNA, 22 nt, Human
uauuugauagagauaaaugaua

SEQ ID NO: 642702 - RNA, 21 nt, Human
acucugcugcgggcuuggccu

SEQ ID NO: 642703 - RNA, 22 nt, Human
ugcugccuguuguggggccacg

SEQ ID NO: 642704 - RNA, 22 nt, Human
cagaggcagugggguugcuccu

SEQ ID NO: 642705 - RNA, 22 nt, Human
cacauuuaaagguugaagcuga

SEQ ID NO: 642706 - RNA, 22 nt, Human
uugucuuucccagcuucuagag

SEQ ID NO: 642707 - RNA, 22 nt, Human
gcugccugguuucucagcugca

SEQ ID NO: 642708 - RNA, 22 nt, Human
acagauacucagcucuaugcuu

SEQ ID NO: 642709 - RNA, 22 nt, Human
ucccagcacuguaauucuuugg

SEQ ID NO: 642710 - RNA, 22 nt, Human
aauugugcuaugauuaugaaag

SEQ ID NO: 642711 - RNA, 22 nt, Human
uggucugaaggacuucugaggg

SEQ ID NO: 642712 - RNA, 22 nt, Human
uuggccaauuuagaacguguug

SEQ ID NO: 642713 - RNA, 22 nt, Human
cuuuagcaacgaugaugauauu

SEQ ID NO: 642714 - RNA, 22 nt, Human
gcuuccaaugcuucuaucacau

SEQ ID NO: 642715 - RNA, 22 nt, Human
agcuagaauauugaucugaaau

SEQ ID NO: 642716 - RNA, 22 nt, Human
ugcccugcagugagugcgucug

SEQ ID NO: 642717 - RNA, 22 nt, Human
aaaguuugcaauuuauguuaau

SEQ ID NO: 642718 - RNA, 22 nt, Human
cagacacuaggugacagagugc

SEQ ID NO: 642719 - RNA, 22 nt, Human
gggcuucaguucugaccaucuu

SEQ ID NO: 642720 - RNA, 22 nt, Human
uccuugggaaaucacuagcacu

SEQ ID NO: 642721 - RNA, 22 nt, Human
agaacauuugucgaucaauuug

SEQ ID NO: 642722 - RNA, 22 nt, Human
acaguuaauaaguaguaaguca

SEQ ID NO: 642723 - RNA, 22 nt, Human
acaauaugggauauacauuuua

SEQ ID NO: 642724 - RNA, 22 nt, Human
agauggaguuguagcagugacu

SEQ ID NO: 642725 - RNA, 22 nt, Human
cagggcauaagaugaggcugua

SEQ ID NO: 642726 - RNA, 22 nt, Human
uaaaucacaucgaaaucugggu

SEQ ID NO: 642727 - RNA, 22 nt, Human
aaaucaugguggaagaaacaga

SEQ ID NO: 642728 - RNA, 22 nt, Human
agcagccauuuaaaaugaauug

SEQ ID NO: 642729 - RNA, 23 nt, Human
ugcugaaguguuggcccugccca

SEQ ID NO: 642730 - RNA, 22 nt, Human
aauguuaauucacagccaaaua

SEQ ID NO: 642731 - RNA, 22 nt, Human
uuccaggcaugucagacauagg

SEQ ID NO: 642732 - RNA, 22 nt, Human
gucuccagauauccuacacaac

SEQ ID NO: 642733 - RNA, 19 nt, Human
gagguucacgcgcuggaug

SEQ ID NO: 642734 - RNA, 22 nt, Human
ggccuuccuggcggcucagggu

SEQ ID NO: 642735 - RNA, 22 nt, Human
ccugucuuagggaaagacugga

SEQ ID NO: 642736 - RNA, 22 nt, Human
aggugcccaucaccucacaguc

SEQ ID NO: 642737 - RNA, 22 nt, Human
caugcaaaauguauuuuauuag

SEQ ID NO: 642738 - RNA, 22 nt, Human
uccuugaaaagaaugucuccau

SEQ ID NO: 642739 - RNA, 18 nt, Human
augggaggggccaagaga

SEQ ID NO: 642740 - RNA, 22 nt, Human
ucuuugcaaauguuauuaucuu

SEQ ID NO: 642741 - RNA, 22 nt, Human
cagagucaauguccaagaagcu

SEQ ID NO: 642742 - RNA, 22 nt, Human
ucucuccuccacaccgggugcu

SEQ ID NO: 642743 - RNA, 22 nt, Human
uuacacagaaauuuuauugccu

SEQ ID NO: 642744 - RNA, 22 nt, Human
gguuucaaugagaagugcuugu

SEQ ID NO: 642745 - RNA, 18 nt, Human
auaucagcuacuucaugg

SEQ ID NO: 642746 - RNA, 22 nt, Human
gagcugaguguccuaggcaugg

SEQ ID NO: 642747 - RNA, 22 nt, Human
gccuugcuuugcuucuggacag

SEQ ID NO: 642748 - RNA, 18 nt, Human
uauaaccucuguuacuca

SEQ ID NO: 642749 - RNA, 22 nt, Human
ggcaugcauguuguuuuaggug

SEQ ID NO: 642750 - RNA, 22 nt, Human
aaugugaacuuugucauguaac

SEQ ID NO: 642751 - RNA, 22 nt, Human
caguagugaaaagcagcccagc

SEQ ID NO: 642752 - RNA, 22 nt, Human
aaacugcuuuccacaguggcua

SEQ ID NO: 642753 - RNA, 22 nt, Human
gggcugcugccaaucacagccu

SEQ ID NO: 642754 - RNA, 19 nt, Human
gggcacagccuccccccag

SEQ ID NO: 642755 - RNA, 22 nt, Human
agcauuuucugagaguauagau

SEQ ID NO: 642756 - RNA, 22 nt, Human
uagcacaguguucacaacagug

SEQ ID NO: 642757 - RNA, 22 nt, Human
auuagcauauuaaauagucauu

SEQ ID NO: 642758 - RNA, 22 nt, Human
uccugggcccaggcugccaggg

SEQ ID NO: 642759 - RNA, 22 nt, Human
uaguuuuagucccauuuuacag

SEQ ID NO: 642760 - RNA, 22 nt, Human
uguguaaauuuauuuacauaaa

SEQ ID NO: 642761 - RNA, 22 nt, Human
accugcccaugaaaauggggag

SEQ ID NO: 642762 - RNA, 22 nt, Human
ucaucacuguaucauugauaga

SEQ ID NO: 642763 - RNA, 22 nt, Human
ccugcugggccugagcaaugag

SEQ ID NO: 642764 - RNA, 22 nt, Human
ucaguguucagcggugugugca

SEQ ID NO: 642765 - RNA, 22 nt, Human
ccaucccuucucuggccagcag

SEQ ID NO: 642766 - RNA, 21 nt, Human
uucaagucucuaggacuucuc

SEQ ID NO: 642767 - RNA, 22 nt, Human
auggagcugugugaauauucau

SEQ ID NO: 642768 - RNA, 22 nt, Human
aagcaggagagccugggugagc

SEQ ID NO: 642769 - RNA, 22 nt, Human
ugucuuuagccagcagucuucu

SEQ ID NO: 642770 - RNA, 22 nt, Human
cuggugguucaggagaauggcu

SEQ ID NO: 642771 - RNA, 22 nt, Human
gcucagaggccacuguuggaaa

SEQ ID NO: 642772 - RNA, 22 nt, Human
uuaaaaauauguagggcccgau

SEQ ID NO: 642773 - RNA, 22 nt, Human
cuguuauuucugccaggugagu

SEQ ID NO: 642774 - RNA, 22 nt, Human
ucugcugucacucauuugcuuc

SEQ ID NO: 642775 - RNA, 22 nt, Human
aaauauuguuuugguaagcuuc

SEQ ID NO: 642776 - RNA, 22 nt, Human
cagcugaggucaaagaagcagg

SEQ ID NO: 642777 - RNA, 22 nt, Human
aaaagcaaggcagucugucuga

SEQ ID NO: 642778 - RNA, 22 nt, Human
ccaggaagacacaugcucaucc

SEQ ID NO: 642779 - RNA, 22 nt, Human
aucugucuauguggcuauguau

SEQ ID NO: 642780 - RNA, 22 nt, Human
ugucucuggcccaugagcagag

SEQ ID NO: 642781 - RNA, 22 nt, Human
ugcauggaacggucuccugguc

SEQ ID NO: 642782 - RNA, 22 nt, Human
agugucugggcucccuuggagc

SEQ ID NO: 642783 - RNA, 22 nt, Human
cucaggcuaagaaggccaagug

SEQ ID NO: 642784 - RNA, 22 nt, Human
cucugugcucccaugcuaguaa

SEQ ID NO: 642785 - RNA, 22 nt, Human
ggcuccuguccuccuggagcuc

SEQ ID NO: 642786 - RNA, 22 nt, Human
caguguuuugagaagggcacgu

SEQ ID NO: 642787 - RNA, 22 nt, Human
aauaucaguauauuguaucagu

SEQ ID NO: 642788 - RNA, 22 nt, Human
ugacagacuuuacuucuccuau

SEQ ID NO: 642789 - RNA, 22 nt, Human
ggagaggagcuauugggggcuc

SEQ ID NO: 642790 - RNA, 22 nt, Human
uaagaacauuuucggaaagaua

SEQ ID NO: 642791 - RNA, 22 nt, Human
cuucucaacugcacuugccagg

SEQ ID NO: 642792 - RNA, 22 nt, Human
uauagcaaaauaguuuccacac

SEQ ID NO: 642793 - RNA, 22 nt, Human
uuaauccaauaacaagguucaa

SEQ ID NO: 642794 - RNA, 22 nt, Human
cagaggcuuugcccuggaaacc

SEQ ID NO: 642795 - RNA, 22 nt, Human
uggaauggaaacaaacugagga

SEQ ID NO: 642796 - RNA, 22 nt, Human
caacuuuaugauugguuuguca

SEQ ID NO: 642797 - RNA, 22 nt, Human
uuuaucuuuaggacuuugcaga

SEQ ID NO: 642798 - RNA, 17 nt, Human
uacaaugugauucaauc

SEQ ID NO: 642799 - RNA, 22 nt, Human
ugguguggggauaagcacucug

SEQ ID NO: 642800 - RNA, 22 nt, Human
cucuccccacacccucugcaug

SEQ ID NO: 642801 - RNA, 22 nt, Human
uauuucuugaguggucaguuuc

SEQ ID NO: 642802 - RNA, 22 nt, Human
uauuguaucuucuguuuagaag

SEQ ID NO: 642803 - RNA, 19 nt, Human
agugcauuuuauguuucaa

SEQ ID NO: 642804 - RNA, 20 nt, Human
cuggccagaacgccuacaca

SEQ ID NO: 642805 - RNA, 22 nt, Human
uccucagggcggccuccgucuu

SEQ ID NO: 642806 - RNA, 23 nt, Human
aggagccagcccuguucucagua

SEQ ID NO: 642807 - RNA, 22 nt, Human
ugcaggguguccggaggaucac

SEQ ID NO: 642808 - RNA, 19 nt, Human
ccugugugggguagagauc

SEQ ID NO: 642809 - RNA, 22 nt, Human
uauauuccaguucaucucuuga

SEQ ID NO: 642810 - RNA, 22 nt, Human
caagugucuauaucagugcuug

SEQ ID NO: 642811 - RNA, 22 nt, Human
auguuaacugaagccauucucg

SEQ ID NO: 642812 - RNA, 22 nt, Human
cagaggcacagugcgggccacu

SEQ ID NO: 642813 - RNA, 22 nt, Human
ugcucccaaacgaccuacugug

SEQ ID NO: 642814 - RNA, 22 nt, Human
ugggaaaguguagccugcaggc

SEQ ID NO: 642815 - RNA, 22 nt, Human
auucuuuuaagccccagggauu

SEQ ID NO: 642816 - RNA, 22 nt, Human
caagggggcaggaucacacuug

SEQ ID NO: 642817 - RNA, 22 nt, Human
acaaugaugcagaugaguaaga

SEQ ID NO: 642818 - RNA, 23 nt, Human
uuacaaguucugaaauuuccuuc

SEQ ID NO: 642819 - RNA, 22 nt, Human
gaggcagcgggucaggaccgug

SEQ ID NO: 642820 - RNA, 22 nt, Human
aauuuucugccuagcaaaaacu

SEQ ID NO: 642821 - RNA, 22 nt, Human
uacuauuuauggagugguuauu

SEQ ID NO: 642822 - RNA, 22 nt, Human
cucuuucaguucugauagucuc

SEQ ID NO: 642823 - RNA, 22 nt, Human
cugcacaguguuggaagcugcc

SEQ ID NO: 642824 - RNA, 20 nt, Human
ucaggcaguggggaaaggca

SEQ ID NO: 642825 - RNA, 22 nt, Human
cacuauuuucucuucagauggc

SEQ ID NO: 642826 - RNA, 22 nt, Human
ugcuucucuguucuaacccuug

SEQ ID NO: 642827 - RNA, 22 nt, Human
caagucugaccucugggugaag

SEQ ID NO: 642828 - RNA, 19 nt, Human
cuggaccuggaggcccgga

SEQ ID NO: 642829 - RNA, 22 nt, Human
gccacagcggggccgcuagagc

SEQ ID NO: 642830 - RNA, 22 nt, Human
gagcagcagguggggcuggcuu

SEQ ID NO: 642831 - RNA, 23 nt, Human
uguguacacaauagaugagguuu

SEQ ID NO: 642832 - RNA, 22 nt, Human
uucuuucugaauacaguugagu

SEQ ID NO: 642833 - RNA, 22 nt, Human
uaggguggagacuggaagcagg

SEQ ID NO: 642834 - RNA, 22 nt, Human
uuugaugaaccuauauaauuug

SEQ ID NO: 642835 - RNA, 22 nt, Human
gggauaggaaacuuagguacac

SEQ ID NO: 642836 - RNA, 22 nt, Human
aucucuguaaaccauaaauuga

SEQ ID NO: 642837 - RNA, 22 nt, Human
uguauaugagucugaguguaca

SEQ ID NO: 642838 - RNA, 22 nt, Human
gugccugcagcaauccauggca

SEQ ID NO: 642839 - RNA, 22 nt, Human
uucuagucuauggcuagauagu

SEQ ID NO: 642840 - RNA, 19 nt, Human
ucuugcagccccagcaggc

SEQ ID NO: 642841 - RNA, 22 nt, Human
cacaggaagcugacugcuggca

SEQ ID NO: 642842 - RNA, 22 nt, Human
cgagaguuagcuaggagucaca

SEQ ID NO: 642843 - RNA, 20 nt, Human
ugguggacuuuggcauggcu

SEQ ID NO: 642844 - RNA, 20 nt, Human
uguucugucgucuuucuuca

SEQ ID NO: 642845 - RNA, 22 nt, Human
gcccaaggucccauggcagcac

SEQ ID NO: 642846 - RNA, 22 nt, Human
gucugcuguagguaggacagca

SEQ ID NO: 642847 - RNA, 22 nt, Human
cacuaaguugguguuaauuagu

SEQ ID NO: 642848 - RNA, 22 nt, Human
agcugccauccgaggugucaga

SEQ ID NO: 642849 - RNA, 22 nt, Human
cugcuuccauggucuggagacu

SEQ ID NO: 642850 - RNA, 22 nt, Human
acaaaaaccguggauucagcau

SEQ ID NO: 642851 - RNA, 22 nt, Human
auauucugccucacuacaguug

SEQ ID NO: 642852 - RNA, 22 nt, Human
uuugucuaauugcaaggcaagu

SEQ ID NO: 642853 - RNA, 22 nt, Human
aaagaucacgucccaggacucg

SEQ ID NO: 642854 - RNA, 20 nt, Human
acacauauagcagcauaaac

SEQ ID NO: 642855 - RNA, 19 nt, Human
ggcaccuuggucuuggacu

SEQ ID NO: 642856 - RNA, 22 nt, Human
uacauuugcuuugauuuucagc

SEQ ID NO: 642857 - RNA, 22 nt, Human
agcugccagggacugggcaugg

SEQ ID NO: 642858 - RNA, 22 nt, Human
uccaugcagaggagcugguggc

SEQ ID NO: 642859 - RNA, 22 nt, Human
ucugagcuauguaagacuugga

SEQ ID NO: 642860 - RNA, 22 nt, Human
ggcuuuugcuguguuuuccaga

SEQ ID NO: 642861 - RNA, 22 nt, Human
ucuuaaagagcgcaauuugagg

SEQ ID NO: 642862 - RNA, 22 nt, Human
gacuuuugaauaagguaggaua

SEQ ID NO: 642863 - RNA, 22 nt, Human
gagcuggcacagaaggaucuua

SEQ ID NO: 642864 - RNA, 22 nt, Human
acacugguaggaagagauggcu

SEQ ID NO: 642865 - RNA, 22 nt, Human
caccugagacuccucaccauga

SEQ ID NO: 642866 - RNA, 22 nt, Human
ugccagagaagacccagucacu

SEQ ID NO: 642867 - RNA, 22 nt, Human
gcugcugggcacccccugagcu

SEQ ID NO: 642868 - RNA, 22 nt, Human
cuagcacuuagggauuguuaug

SEQ ID NO: 642869 - RNA, 22 nt, Human
auuugcuucuugcuuccagcac

SEQ ID NO: 642870 - RNA, 22 nt, Human
cugugaaaucaaccuugagccc

SEQ ID NO: 642871 - RNA, 22 nt, Human
uuuuugcuaauccccagccacu

SEQ ID NO: 642872 - RNA, 22 nt, Human
uuucacauaucaacucuauccu

SEQ ID NO: 642873 - RNA, 22 nt, Human
ccuaauuugauuuuaaauagcc

SEQ ID NO: 642874 - RNA, 22 nt, Human
acagugggacagugacggggga

SEQ ID NO: 642875 - RNA, 19 nt, Human
acauuuagaauguacuugc

SEQ ID NO: 642876 - RNA, 22 nt, Human
ugcaauuuggggaagaaagaga

SEQ ID NO: 642877 - RNA, 22 nt, Human
ugcagggccuugggaugugucc

SEQ ID NO: 642878 - RNA, 22 nt, Human
gcugggcugcccaaccucugac

SEQ ID NO: 642879 - RNA, 22 nt, Human
agucccagugagaugagccacg

SEQ ID NO: 642880 - RNA, 16 nt, Human
aucuaagaugugcauu

SEQ ID NO: 642881 - RNA, 22 nt, Human
agaccugggugcccugugcuuu

SEQ ID NO: 642882 - RNA, 22 nt, Human
gccucugcaucaucacuccagc

SEQ ID NO: 642883 - RNA, 22 nt, Human
guugaaugaaucauucuaugua

SEQ ID NO: 642884 - RNA, 22 nt, Human
cucagcauucaauguccagucc

SEQ ID NO: 642885 - RNA, 22 nt, Human
auuaucuugauaaaauggcagu

SEQ ID NO: 642886 - RNA, 22 nt, Human
cacugugucagaguaugaugau

SEQ ID NO: 642887 - RNA, 22 nt, Human
uuguagcuuaucaaggcuguuu

SEQ ID NO: 642888 - RNA, 22 nt, Human
gcacagggaggcuggccuggcc

SEQ ID NO: 642889 - RNA, 21 nt, Human
uaacuuuugugccuaucuugu

SEQ ID NO: 642890 - RNA, 18 nt, Human
gagcccugagucugcaca

SEQ ID NO: 642891 - RNA, 22 nt, Human
gugacucuuaaagcaaaucuug

SEQ ID NO: 642892 - RNA, 22 nt, Human
cuguggaguguagaugcugggu

SEQ ID NO: 642893 - RNA, 22 nt, Human
uggugagauaacuuucggcaag

SEQ ID NO: 642894 - RNA, 22 nt, Human
aaauguacugauacuuauuuua

SEQ ID NO: 642895 - RNA, 22 nt, Human
auuuccaugucgguauuuuaua

SEQ ID NO: 642896 - RNA, 22 nt, Human
uggacuggaaugcugauccucu

SEQ ID NO: 642897 - RNA, 22 nt, Human
ggcaggcugggagucaucagag

SEQ ID NO: 642898 - RNA, 22 nt, Human
gucagagcugugcaaggcugag

SEQ ID NO: 642899 - RNA, 22 nt, Human
ggaggaagcacacggcuuguau

SEQ ID NO: 642900 - RNA, 22 nt, Human
acugcaugauaauaauagcaga

SEQ ID NO: 642901 - RNA, 22 nt, Human
agugggggcagagccucucucg

SEQ ID NO: 642902 - RNA, 23 nt, Human
uccuccugacacagccugaguga

SEQ ID NO: 642903 - RNA, 22 nt, Human
auuuaaauuuucugauggagag

SEQ ID NO: 642904 - RNA, 22 nt, Human
uguuucaagcaauagcauuuca

SEQ ID NO: 642905 - RNA, 22 nt, Human
uaagcacuuuauaugcuuuauc

SEQ ID NO: 642906 - RNA, 22 nt, Human
aacacaugaaaguuggugagua

SEQ ID NO: 642907 - RNA, 22 nt, Human
cagcagcuacuuggagcagcag

SEQ ID NO: 642908 - RNA, 22 nt, Human
ugagauaagcaaggauaaaggu

SEQ ID NO: 642909 - RNA, 22 nt, Human
ugccucagagaccugacaguac

SEQ ID NO: 642910 - RNA, 22 nt, Human
gcagauggagauaaauggaacu

SEQ ID NO: 642911 - RNA, 22 nt, Human
guggcagguuauaagcaucuca

SEQ ID NO: 642912 - RNA, 22 nt, Human
uuucagucuuauuuuguugaua

SEQ ID NO: 642913 - RNA, 22 nt, Human
acaguccuagcugcaaagaagu

SEQ ID NO: 642914 - RNA, 22 nt, Human
aguccaaggagagacagcauuu

SEQ ID NO: 642915 - RNA, 22 nt, Human
acagagccacuuuggugccuac

SEQ ID NO: 642916 - RNA, 22 nt, Human
auuggucagaguaaauuuauuu

SEQ ID NO: 642917 - RNA, 22 nt, Human
gaguuacauggacauucucucc

SEQ ID NO: 642918 - RNA, 22 nt, Human
ccugucugcagauaucucaggu

SEQ ID NO: 642919 - RNA, 22 nt, Human
uugcuuauuugauuaaaugucu

SEQ ID NO: 642920 - RNA, 22 nt, Human
cuccuucagucugcguggcugu

SEQ ID NO: 642921 - RNA, 22 nt, Human
gcugugcuauaucucugagugu

SEQ ID NO: 642922 - RNA, 22 nt, Human
cccuuggaggaagcucuaggcu

SEQ ID NO: 642923 - RNA, 22 nt, Human
guggaagggucacagccccuac

SEQ ID NO: 642924 - RNA, 22 nt, Human
ucaacaaauacuuaaagcagag

SEQ ID NO: 642925 - RNA, 22 nt, Human
gcaggcugagaguccaagaagg

SEQ ID NO: 642926 - RNA, 22 nt, Human
uugcacagaguggauauucagu

SEQ ID NO: 642927 - RNA, 22 nt, Human
cagcaaauacuacuaguuuuua

SEQ ID NO: 642928 - RNA, 22 nt, Human
uugugcagagaaaucuuucuug

SEQ ID NO: 642929 - RNA, 22 nt, Human
ugcuugucuucaggaaugcuga

SEQ ID NO: 642930 - RNA, 22 nt, Human
ccugaguugucaguugcuguag

SEQ ID NO: 642931 - RNA, 22 nt, Human
uuggagagauuuaggucucagu

SEQ ID NO: 642932 - RNA, 22 nt, Human
auucccacagcugguauaaaua

SEQ ID NO: 642933 - RNA, 22 nt, Human
guguggcugauugacaugguca

SEQ ID NO: 642934 - RNA, 22 nt, Human
gggagcugucaucaguguuguc

SEQ ID NO: 642935 - RNA, 22 nt, Human
uaggaauuaugaugcuaucaag

SEQ ID NO: 642936 - RNA, 22 nt, Human
aacaugcauauagguaaaugga

SEQ ID NO: 642937 - RNA, 22 nt, Human
agaaaugucaggaaagaagucc

SEQ ID NO: 642938 - RNA, 22 nt, Human
cugcuguccaaccugcacucgc

SEQ ID NO: 642939 - RNA, 22 nt, Human
ugcuuccaauucaaaucugugg

SEQ ID NO: 642940 - RNA, 20 nt, Human
gcaggcagggaaugggggug

SEQ ID NO: 642941 - RNA, 22 nt, Human
ccccagcugagauuugaggaga

SEQ ID NO: 642942 - RNA, 22 nt, Human
uucucucuggaccugggaugcg

SEQ ID NO: 642943 - RNA, 22 nt, Human
ccucaggaaaugaauaaauggc

SEQ ID NO: 642944 - RNA, 22 nt, Human
gccuuggcugccaagcugcuga

SEQ ID NO: 642945 - RNA, 22 nt, Human
cagaauaagcuguguugucaag

SEQ ID NO: 642946 - RNA, 22 nt, Human
auauagcacuuguuuugcaugu

SEQ ID NO: 642947 - RNA, 22 nt, Human
uuguaugaucccauuuagugaa

SEQ ID NO: 642948 - RNA, 22 nt, Human
ugcagaggugugcauucuuaag

SEQ ID NO: 642949 - RNA, 22 nt, Human
augaaucaagugagaacagcau

SEQ ID NO: 642950 - RNA, 22 nt, Human
ugagacacucucgggcacauuu

SEQ ID NO: 642951 - RNA, 22 nt, Human
guuggcuaugagagcuuuagug

SEQ ID NO: 642952 - RNA, 22 nt, Human
acuguauuuccaacagacaaau

SEQ ID NO: 642953 - RNA, 22 nt, Human
ucucuguucauggcacuauguc

SEQ ID NO: 642954 - RNA, 22 nt, Human
gggaccaggucagggcucugac

SEQ ID NO: 642955 - RNA, 22 nt, Human
cccucugccucugaguaggaca

SEQ ID NO: 642956 - RNA, 22 nt, Human
uuucaaauaccauaaaccuaau

SEQ ID NO: 642957 - RNA, 22 nt, Human
aagcaaggcaaccuauguccag

SEQ ID NO: 642958 - RNA, 22 nt, Human
gcucuggcccaaacccuuucua

SEQ ID NO: 642959 - RNA, 22 nt, Human
ccucugugauuucugagccaau

SEQ ID NO: 642960 - RNA, 22 nt, Human
ugcacaaaggcucccugcugag

SEQ ID NO: 642961 - RNA, 22 nt, Human
aaagcaauagguuaggucaaga

SEQ ID NO: 642962 - RNA, 22 nt, Human
agaguuccacguacagcuuuug

SEQ ID NO: 642963 - RNA, 22 nt, Human
cagcaguggaacuacccaggga

SEQ ID NO: 642964 - RNA, 22 nt, Human
cuccaaggauucuggacccuug

SEQ ID NO: 642965 - RNA, 22 nt, Human
ugagucagucugcccuggcuuc

SEQ ID NO: 642966 - RNA, 22 nt, Human
gagucagguuucugccuauaga

SEQ ID NO: 642967 - RNA, 22 nt, Human
aaggaggcccucuccuucugga

SEQ ID NO: 642968 - RNA, 22 nt, Human
cucuccuuucacuaaauauucu

SEQ ID NO: 642969 - RNA, 22 nt, Human
augcaacagucaguacauccgg

SEQ ID NO: 642970 - RNA, 22 nt, Human
gagggguguggagccaucaguu

SEQ ID NO: 642971 - RNA, 22 nt, Human
aaacugcacuuuauuuugucaa

SEQ ID NO: 642972 - RNA, 22 nt, Human
uggcuacaaguguguuuaguuu

SEQ ID NO: 642973 - RNA, 22 nt, Human
aaacagagagauguauguggag

SEQ ID NO: 642974 - RNA, 22 nt, Human
cugcucuguucccccaucaucu

SEQ ID NO: 642975 - RNA, 22 nt, Human
uguagcagugucuaccacauua

SEQ ID NO: 642976 - RNA, 22 nt, Human
ggcuaggccucaggccugccug

SEQ ID NO: 642977 - RNA, 22 nt, Human
ucagacagaaggacuauuugaa

SEQ ID NO: 642978 - RNA, 22 nt, Human
gagguuagaggucagugcaguc

SEQ ID NO: 642979 - RNA, 22 nt, Human
aaguuugugguuauacuugauu

SEQ ID NO: 642980 - RNA, 23 nt, Human
cagcagcugccugguuuuuuggu

SEQ ID NO: 642981 - RNA, 22 nt, Human
gucaaaacacuggggaauguug

SEQ ID NO: 642982 - RNA, 22 nt, Human
gcugcccuguccggcucuccug

SEQ ID NO: 642983 - RNA, 22 nt, Human
uuguauuugauugucauaucgu

SEQ ID NO: 642984 - RNA, 22 nt, Human
cugugaggcggaaaggacucuc

SEQ ID NO: 642985 - RNA, 22 nt, Human
cuuccagguaggccuaaggcag

SEQ ID NO: 642986 - RNA, 22 nt, Human
ugucucuccacacagccagugc

SEQ ID NO: 642987 - RNA, 22 nt, Human
cugggucuaaaaauucucagau

SEQ ID NO: 642988 - RNA, 22 nt, Human
auggaaauaucuuuagagcuua

SEQ ID NO: 642989 - RNA, 22 nt, Human
uguggcaggaagagcuucugag

SEQ ID NO: 642990 - RNA, 22 nt, Human
caguccuuucugaaauccuaua

SEQ ID NO: 642991 - RNA, 22 nt, Human
uucacacagcaacuguaugaau

SEQ ID NO: 642992 - RNA, 19 nt, Human
cucuuacagaauagacaca

SEQ ID NO: 642993 - RNA, 22 nt, Human
agucaagguggaccagaaaaau

SEQ ID NO: 642994 - RNA, 22 nt, Human
uguagggagaagagaggcaccu

SEQ ID NO: 642995 - RNA, 21 nt, Human
ucgugcagcagcugaggcuug

SEQ ID NO: 642996 - RNA, 22 nt, Human
acaggagggacaccuuccugcu

SEQ ID NO: 642997 - RNA, 22 nt, Human
uuuaaaauuuagaccucuccac

SEQ ID NO: 642998 - RNA, 20 nt, Human
aaguuucaugcucuggggau

SEQ ID NO: 642999 - RNA, 22 nt, Human
cagggauggagagacuacuggc

SEQ ID NO: 643000 - RNA, 22 nt, Human
ugggcugccagcucuccagaug

SEQ ID NO: 643001 - RNA, 22 nt, Human
guuaaugccauuaggaaauuua

SEQ ID NO: 643002 - RNA, 22 nt, Human
gcugucacauuuggagcacugg

SEQ ID NO: 643003 - RNA, 22 nt, Human
ugaaauucaaaacacauuuguc

SEQ ID NO: 643004 - RNA, 21 nt, Human
auggcugaugauauugaacau

SEQ ID NO: 643005 - RNA, 22 nt, Human
uccaugugcuuccucaggggaa

SEQ ID NO: 643006 - RNA, 18 nt, Human
uccuccuuuggccuuuuc

SEQ ID NO: 643007 - RNA, 20 nt, Human
auccuggaauccaaauggag

SEQ ID NO: 643008 - RNA, 22 nt, Human
cucuuuaagcuccuaacagcca

SEQ ID NO: 643009 - RNA, 22 nt, Human
ugaucuagguuggcuucaacug

SEQ ID NO: 643010 - RNA, 22 nt, Human
ggucucagcuggaguccuuggu

SEQ ID NO: 643011 - RNA, 22 nt, Human
auuuacagguagaauuuuaagu

SEQ ID NO: 643012 - RNA, 19 nt, Human
uggcuucuucgguguuccc

SEQ ID NO: 643013 - RNA, 22 nt, Human
ugucccaggcugaaguacagug

SEQ ID NO: 643014 - RNA, 22 nt, Human
acacaagaaguuaaugggcaaa

SEQ ID NO: 643015 - RNA, 22 nt, Human
acugcagagguggggugcagag

SEQ ID NO: 643016 - RNA, 22 nt, Human
uugcaaauaaacaaguauacau

SEQ ID NO: 643017 - RNA, 22 nt, Human
ugcuggccgugagcucucggga

SEQ ID NO: 643018 - RNA, 23 nt, Human
uggcacagaggaccaugcuuugc

SEQ ID NO: 643019 - RNA, 22 nt, Human
cuugccagggacucagucaggg

SEQ ID NO: 643020 - RNA, 22 nt, Human
gacugggaggguucagcugggu

SEQ ID NO: 643021 - RNA, 22 nt, Human
auagaaucuuuguaaaacacuu

SEQ ID NO: 643022 - RNA, 22 nt, Human
guggccagugggaaugggcuca

SEQ ID NO: 643023 - RNA, 22 nt, Human
uuuuuauaccaccucucacuua

SEQ ID NO: 643024 - RNA, 22 nt, Human
caggcuguguuccuggaacccc

SEQ ID NO: 643025 - RNA, 21 nt, Human
cucuggagucaagagcuucca

SEQ ID NO: 643026 - RNA, 22 nt, Human
cugugucugaauaacucugugu

SEQ ID NO: 643027 - RNA, 22 nt, Human
uugcauuuuuagaugcuucugu

SEQ ID NO: 643028 - RNA, 22 nt, Human
uagcaaccuauggauagagaag

SEQ ID NO: 643029 - RNA, 23 nt, Human
auguuauuauuagcagucuugcc

SEQ ID NO: 643030 - RNA, 23 nt, Human
ugggcucagcuuccaguggggag

SEQ ID NO: 643031 - RNA, 22 nt, Human
aguguuuauuagauuucccuuu

SEQ ID NO: 643032 - RNA, 22 nt, Human
uagaaggaggacuggcaguguu

SEQ ID NO: 643033 - RNA, 22 nt, Human
cugggggcaagcagacagcugu

SEQ ID NO: 643034 - RNA, 19 nt, Human
caguaucauugcacauagu

SEQ ID NO: 643035 - RNA, 21 nt, Human
ucuugugugggaaacaauuug

SEQ ID NO: 643036 - RNA, 23 nt, Human
agucuucauuguauuuccagacc

SEQ ID NO: 643037 - RNA, 22 nt, Human
uggccaugaaggaggcagcaga

SEQ ID NO: 643038 - RNA, 22 nt, Human
ucauguuuuagcugcaaaauga

SEQ ID NO: 643039 - RNA, 22 nt, Human
guucagcaagaauguuucuauu

SEQ ID NO: 643040 - RNA, 22 nt, Human
gcacagaggaugaggcagcucu

SEQ ID NO: 643041 - RNA, 22 nt, Human
auucugagaaaugcauugucag

SEQ ID NO: 643042 - RNA, 22 nt, Human
ucucagcaaggaaagaggcagg

SEQ ID NO: 643043 - RNA, 22 nt, Human
agaggcuggauugagcauagac

SEQ ID NO: 643044 - RNA, 22 nt, Human
accucugcaguagggcugugcc

SEQ ID NO: 643045 - RNA, 22 nt, Human
ccagugugguuuaggauaggga

SEQ ID NO: 643046 - RNA, 22 nt, Human
gcccacagcucguuccucuccu

SEQ ID NO: 643047 - RNA, 22 nt, Human
auuggcaaggcugcggugucug

SEQ ID NO: 643048 - RNA, 22 nt, Human
uagauucucugcuggcugacau

SEQ ID NO: 643049 - RNA, 22 nt, Human
aagauuuacuagcauaauagcu

SEQ ID NO: 643050 - RNA, 22 nt, Human
aaucacuuagaacccaggaagu

SEQ ID NO: 643051 - RNA, 22 nt, Human
ggggcuguugaaguuaguugag

SEQ ID NO: 643052 - RNA, 22 nt, Human
aggcuggcuuugguagcauggu

SEQ ID NO: 643053 - RNA, 22 nt, Human
uucucacaggaaguaggacuuu

SEQ ID NO: 643054 - RNA, 22 nt, Human
gaguguaguucauuccguccua

SEQ ID NO: 643055 - RNA, 22 nt, Human
aauagcauguaaguuuaaaaga

SEQ ID NO: 643056 - RNA, 22 nt, Human
gccacagccucugggaaaacuc

SEQ ID NO: 643057 - RNA, 22 nt, Human
caggacccaaccucccugcucu

SEQ ID NO: 643058 - RNA, 22 nt, Human
ggcagccauacucagaccuggg

SEQ ID NO: 643059 - RNA, 22 nt, Human
ggaggcgcggcucggcugugcc

SEQ ID NO: 643060 - RNA, 22 nt, Human
uuauuccauugucuuuugacuu

SEQ ID NO: 643061 - RNA, 22 nt, Human
ugcugagguuucgucugcuugc

SEQ ID NO: 643062 - RNA, 22 nt, Human
ugcuauuucucugcuguaaaau

SEQ ID NO: 643063 - RNA, 18 nt, Human
ggaaguaggaagaggaag

SEQ ID NO: 643064 - RNA, 22 nt, Human
agugcuggguacuguucccauu

SEQ ID NO: 643065 - RNA, 22 nt, Human
gcucugugaccuuaggcaaguu

SEQ ID NO: 643066 - RNA, 22 nt, Human
aaacaacuucugcacuaugggu

SEQ ID NO: 643067 - RNA, 22 nt, Human
cacaggcugcccgcagcuggga

SEQ ID NO: 643068 - RNA, 22 nt, Human
caccugagcacuggggccgccc

SEQ ID NO: 643069 - RNA, 22 nt, Human
aguacacucaagaaaccgguaa

SEQ ID NO: 643070 - RNA, 17 nt, Human
acaggcagaucaccuga

SEQ ID NO: 643071 - RNA, 22 nt, Human
aagaaugagcucaaagaucuua

SEQ ID NO: 643072 - RNA, 22 nt, Human
auauuauuuucccuggaguugu

SEQ ID NO: 643073 - RNA, 18 nt, Human
gcucagcuaugggagguu

SEQ ID NO: 643074 - RNA, 22 nt, Human
aagcaucucauucuugccuguc

SEQ ID NO: 643075 - RNA, 22 nt, Human
gggaucagaaacauagcccuga

SEQ ID NO: 643076 - RNA, 22 nt, Human
uugggacagaaaaggagaagau

SEQ ID NO: 643077 - RNA, 22 nt, Human
gaacaggguuugagaggcuuag

SEQ ID NO: 643078 - RNA, 22 nt, Human
cuguggcaggaagggacuagca

SEQ ID NO: 643079 - RNA, 23 nt, Human
aacaccaaggcucagagagauaa

SEQ ID NO: 643080 - RNA, 22 nt, Human
ugucagcauugcgucacugagc

SEQ ID NO: 643081 - RNA, 22 nt, Human
gaggggcguccugagugggccu

SEQ ID NO: 643082 - RNA, 22 nt, Human
cauucaaaugugccacuguccu

SEQ ID NO: 643083 - RNA, 22 nt, Human
caaggcuauaauguugcuggaa

SEQ ID NO: 643084 - RNA, 22 nt, Human
ucguuuuagguggacauugugu

SEQ ID NO: 643085 - RNA, 22 nt, Human
ucuucagacuguuguucuuuug

SEQ ID NO: 643086 - RNA, 22 nt, Human
gaaggcuggggccuucucaucu

SEQ ID NO: 643087 - RNA, 22 nt, Human
gucagcgugcucagccuauuau

SEQ ID NO: 643088 - RNA, 22 nt, Human
auucuggauauuacuuaucuau

SEQ ID NO: 643089 - RNA, 22 nt, Human
cuggagugaggucugggagccu

SEQ ID NO: 643090 - RNA, 23 nt, Human
uuuugacaggaggaagguguuga

SEQ ID NO: 643091 - RNA, 22 nt, Human
guuggcacuucauaauaugaaa

SEQ ID NO: 643092 - RNA, 22 nt, Human
augcccaaugucacaauuuuug

SEQ ID NO: 643093 - RNA, 22 nt, Human
gugcagugaaaaaagaaugucc

SEQ ID NO: 643094 - RNA, 22 nt, Human
gcaaaauuaaacuuagcaucau

SEQ ID NO: 643095 - RNA, 22 nt, Human
gacauuuaugaaggagauaugc

SEQ ID NO: 643096 - RNA, 22 nt, Human
gaccaggcccaggugcaaggga

SEQ ID NO: 643097 - RNA, 22 nt, Human
ugccuugggauauauggacacu

SEQ ID NO: 643098 - RNA, 23 nt, Human
uugucugugcuuuuccaguugcu

SEQ ID NO: 643099 - RNA, 22 nt, Human
cacaggaguuaacauaauuaag

SEQ ID NO: 643100 - RNA, 22 nt, Human
aaaguuccuuuuauagacauga

SEQ ID NO: 643101 - RNA, 22 nt, Human
cuucaugaugaccaacugccau

SEQ ID NO: 643102 - RNA, 22 nt, Human
uccuagaacagcccaccuggaa

SEQ ID NO: 643103 - RNA, 22 nt, Human
aaacaccaagagcuagcuauua

SEQ ID NO: 643104 - RNA, 22 nt, Human
agcccugguagccugcugccau

SEQ ID NO: 643105 - RNA, 19 nt, Human
acacagggaucagaggguu

SEQ ID NO: 643106 - RNA, 22 nt, Human
ucccucucuagccuguucagua

SEQ ID NO: 643107 - RNA, 22 nt, Human
aagguuaguaaguaucuuaugu

SEQ ID NO: 643108 - RNA, 22 nt, Human
aaggagugauauaugggugcua

SEQ ID NO: 643109 - RNA, 22 nt, Human
aaauguacacuuugcaucuuga

SEQ ID NO: 643110 - RNA, 22 nt, Human
ugcaacaguggggcaugcugaa

SEQ ID NO: 643111 - RNA, 23 nt, Human
aacagcaggaugauagaggaggu

SEQ ID NO: 643112 - RNA, 22 nt, Human
auucuaaauguaauuuagaauu

SEQ ID NO: 643113 - RNA, 22 nt, Human
acuuucugucaucuagacaagu

SEQ ID NO: 643114 - RNA, 22 nt, Human
uccaggaccaaagacacaugua

SEQ ID NO: 643115 - RNA, 22 nt, Human
cagagccuaaaacgacuccacu

SEQ ID NO: 643116 - RNA, 22 nt, Human
agauuuuaguguagaggacuug

SEQ ID NO: 643117 - RNA, 22 nt, Human
auggcuguuccugggaguucua

SEQ ID NO: 643118 - RNA, 22 nt, Human
gcagcugagagaagaacagggc

SEQ ID NO: 643119 - RNA, 22 nt, Human
uucugcucaguaguaagagugc

SEQ ID NO: 643120 - RNA, 22 nt, Human
acagucuuuaauuucuuugugg

SEQ ID NO: 643121 - RNA, 22 nt, Human
auaacaauagugguagugcugg

SEQ ID NO: 643122 - RNA, 22 nt, Human
auuucagcagcccauguuugga

SEQ ID NO: 643123 - RNA, 22 nt, Human
ggagaggugaauggcugcucua

SEQ ID NO: 643124 - RNA, 22 nt, Human
uccuucaguucaauuaguccgu

SEQ ID NO: 643125 - RNA, 22 nt, Human
gaagccaacauuccaaguagaa

SEQ ID NO: 643126 - RNA, 22 nt, Human
gagaaggagcucaaauauggcu

SEQ ID NO: 643127 - RNA, 22 nt, Human
ccccacuugcucagcaugucca

SEQ ID NO: 643128 - RNA, 22 nt, Human
ucauccgugaagccaaagaaau

SEQ ID NO: 643129 - RNA, 22 nt, Human
cagguggcauugucccgccagc

SEQ ID NO: 643130 - RNA, 22 nt, Human
auaagaaacauuauucuuucca

SEQ ID NO: 643131 - RNA, 22 nt, Human
uugcuguuucucugugucuggu

SEQ ID NO: 643132 - RNA, 18 nt, Human
agagaugggaguuggaaa

SEQ ID NO: 643133 - RNA, 22 nt, Human
ggagcccuuggcaccuaguagg

SEQ ID NO: 643134 - RNA, 22 nt, Human
gcuucugguagaauucaauaga

SEQ ID NO: 643135 - RNA, 22 nt, Human
ccugugguuuacaugacaguua

SEQ ID NO: 643136 - RNA, 22 nt, Human
gaggcugggaaguccaauauca

SEQ ID NO: 643137 - RNA, 22 nt, Human
caucuugaugcuuugacagguu

SEQ ID NO: 643138 - RNA, 23 nt, Human
auuuuaaccuugacuaacaugca

SEQ ID NO: 643139 - RNA, 22 nt, Human
guguagcuuuggagugggaggc

SEQ ID NO: 643140 - RNA, 22 nt, Human
ucacaugcuugaggaaagaaaa

SEQ ID NO: 643141 - RNA, 18 nt, Human
cucugcuaaugggcagcu

SEQ ID NO: 643142 - RNA, 22 nt, Human
auacuucucaugggcucugagc

SEQ ID NO: 643143 - RNA, 22 nt, Human
acaugcauaggagaagucuuua

SEQ ID NO: 643144 - RNA, 22 nt, Human
caggcacacagcacauggccug

SEQ ID NO: 643145 - RNA, 22 nt, Human
agcaauauuuaaagguuugcaa

SEQ ID NO: 643146 - RNA, 22 nt, Human
ggcucccugccuguccucaguc

SEQ ID NO: 643147 - RNA, 22 nt, Human
agcagcuaaguagcgcaguuaa

SEQ ID NO: 643148 - RNA, 23 nt, Human
gggcugcuccaggccaaggcugg

SEQ ID NO: 643149 - RNA, 22 nt, Human
acuguacaacugcugagcagaa

SEQ ID NO: 643150 - RNA, 22 nt, Human
gcugggcuucacagagccuuua

SEQ ID NO: 643151 - RNA, 22 nt, Human
ucacuggggagcacugacaugu

SEQ ID NO: 643152 - RNA, 17 nt, Human
cagugcagauaagugag

SEQ ID NO: 643153 - RNA, 22 nt, Human
uauuuuacuuuaaagcgagaga

SEQ ID NO: 643154 - RNA, 22 nt, Human
uccuaacugcccugggcaaggu

SEQ ID NO: 643155 - RNA, 22 nt, Human
uuuuugcaccaaccuaauagaa

SEQ ID NO: 643156 - RNA, 22 nt, Human
ucacuggaaaugcacagcugua

SEQ ID NO: 643157 - RNA, 22 nt, Human
agcugugugcccaugguggagg

SEQ ID NO: 643158 - RNA, 22 nt, Human
auucuucaaagagugucaaagu

SEQ ID NO: 643159 - RNA, 22 nt, Human
acaguccuuguguggaacauua

SEQ ID NO: 643160 - RNA, 22 nt, Human
uggcaucauagccaaggugcuu

SEQ ID NO: 643161 - RNA, 22 nt, Human
uuacagauacuuuguaggcaag

SEQ ID NO: 643162 - RNA, 22 nt, Human
gugaaguuuuaguauauguaga

SEQ ID NO: 643163 - RNA, 22 nt, Human
acucaggcuucaggcacagcug

SEQ ID NO: 643164 - RNA, 22 nt, Human
cugaggagauccccccagaagu

SEQ ID NO: 643165 - RNA, 22 nt, Human
uuaucuguuguuuuaguacaau

SEQ ID NO: 643166 - RNA, 22 nt, Human
auguggcuaguccaauuaauga

SEQ ID NO: 643167 - RNA, 22 nt, Human
ucugaagauuaccagcuaaaug

SEQ ID NO: 643168 - RNA, 22 nt, Human
aggagcugcaaaaccggccgcu

SEQ ID NO: 643169 - RNA, 22 nt, Human
aguuauauuccauagauucaga

SEQ ID NO: 643170 - RNA, 22 nt, Human
ccccagcugcauacuugccaag

SEQ ID NO: 643171 - RNA, 22 nt, Human
uaacaguauagccuaacauuuc

SEQ ID NO: 643172 - RNA, 22 nt, Human
uccucugguuauacuugcaccc

SEQ ID NO: 643173 - RNA, 23 nt, Human
cauauucaaaacuggaccacucu

SEQ ID NO: 643174 - RNA, 22 nt, Human
accauuuaauaaguauuuccau

SEQ ID NO: 643175 - RNA, 22 nt, Human
gccccuccgggcgcgucauagc

SEQ ID NO: 643176 - RNA, 20 nt, Human
gcucagggaauucaggaagc

SEQ ID NO: 643177 - RNA, 22 nt, Human
cagaagcagauucuaaagcaag

SEQ ID NO: 643178 - RNA, 22 nt, Human
agugucugugaggggaauuccu

SEQ ID NO: 643179 - RNA, 22 nt, Human
caauugcuuucuuaccaagaga

SEQ ID NO: 643180 - RNA, 22 nt, Human
ugccucagucagcuucccuggg

SEQ ID NO: 643181 - RNA, 22 nt, Human
uuuucucaagauccaaugcacu

SEQ ID NO: 643182 - RNA, 22 nt, Human
ucaacccuuccuccauauuucc

SEQ ID NO: 643183 - RNA, 22 nt, Human
ucagccagggcagagcagguga

SEQ ID NO: 643184 - RNA, 22 nt, Human
ggcaggcagaggcugagacagg

SEQ ID NO: 643185 - RNA, 22 nt, Human
uuggcugaagguuaagugcugg

SEQ ID NO: 643186 - RNA, 22 nt, Human
auaugcuggaguacaggaaaua

SEQ ID NO: 643187 - RNA, 22 nt, Human
gccugagagaacugaccaagag

SEQ ID NO: 643188 - RNA, 22 nt, Human
caucucauccugcccuaaaaca

SEQ ID NO: 643189 - RNA, 22 nt, Human
gcaaggcucccgcagcccaggg

SEQ ID NO: 643190 - RNA, 22 nt, Human
uuuagauaaugcucaagcaauu

SEQ ID NO: 643191 - RNA, 22 nt, Human
caggugaagaggauaaaaaguu

SEQ ID NO: 643192 - RNA, 19 nt, Human
ggccaccucucuucccagg

SEQ ID NO: 643193 - RNA, 22 nt, Human
agcugcucuuugaaggacacuu

SEQ ID NO: 643194 - RNA, 22 nt, Human
uuggggcucugaaaaagaugua

SEQ ID NO: 643195 - RNA, 22 nt, Human
ccagggcugccuggccgugugu

SEQ ID NO: 643196 - RNA, 21 nt, Human
ccagcuccaggaccuuggauc

SEQ ID NO: 643197 - RNA, 18 nt, Human
uugagaaauaagcacuaa

SEQ ID NO: 643198 - RNA, 22 nt, Human
gugaagaccagggaacgcuggc

SEQ ID NO: 643199 - RNA, 22 nt, Human
ugggcucugcugcguaccaguu

SEQ ID NO: 643200 - RNA, 21 nt, Human
ugaucacaugaaaaccaugca

SEQ ID NO: 643201 - RNA, 22 nt, Human
cccacugcugcucuccauggca

SEQ ID NO: 643202 - RNA, 22 nt, Human
gcccaagguauaucagagacag

SEQ ID NO: 643203 - RNA, 22 nt, Human
uagugauuuagaauucaaaugu

SEQ ID NO: 643204 - RNA, 22 nt, Human
uguacacaaccuacagucugcu

SEQ ID NO: 643205 - RNA, 22 nt, Human
ugccauauugaugugcuguacc

SEQ ID NO: 643206 - RNA, 22 nt, Human
cagguaagagacggauuggccc

SEQ ID NO: 643207 - RNA, 22 nt, Human
gggagagagaaaacguggcgca

SEQ ID NO: 643208 - RNA, 22 nt, Human
auguucuuggauguuguguaua

SEQ ID NO: 643209 - RNA, 22 nt, Human
acaugccagcccauuuaaaugg

SEQ ID NO: 643210 - RNA, 22 nt, Human
gggcacuguacacugugcaugg

SEQ ID NO: 643211 - RNA, 22 nt, Human
gacagugagagucuacacccuc

SEQ ID NO: 643212 - RNA, 22 nt, Human
ggcugugggaugcauaggagcu

SEQ ID NO: 643213 - RNA, 22 nt, Human
ucaggcagcauuaaacuucagc

SEQ ID NO: 643214 - RNA, 22 nt, Human
gagcagcuaaaauucucaugca

SEQ ID NO: 643215 - RNA, 22 nt, Human
gccagguggcugagcagcugca

SEQ ID NO: 643216 - RNA, 22 nt, Human
uggcagggccuaccccaauauc

SEQ ID NO: 643217 - RNA, 22 nt, Human
gccagcucucauuguauaggcu

SEQ ID NO: 643218 - RNA, 22 nt, Human
caguuuuagcuagagcaaacca

SEQ ID NO: 643219 - RNA, 17 nt, Human
aacaguaagcccuguuu

SEQ ID NO: 643220 - RNA, 22 nt, Human
auacaaguuaaugagaaugaca

SEQ ID NO: 643221 - RNA, 22 nt, Human
uugagcaaagcagccauucauu

SEQ ID NO: 643222 - RNA, 22 nt, Human
cuuugugauaguguuaagacca

SEQ ID NO: 643223 - RNA, 22 nt, Human
uaauuccuagaaauuauucuca

SEQ ID NO: 643224 - RNA, 22 nt, Human
gaggcugacggcaccaucuucu

SEQ ID NO: 643225 - RNA, 18 nt, Human
cugcuugggagacgucag

SEQ ID NO: 643226 - RNA, 22 nt, Human
ugcuauaagcuccacgcuguag

SEQ ID NO: 643227 - RNA, 22 nt, Human
aguuucuucauccaaaaaaugg

SEQ ID NO: 643228 - RNA, 22 nt, Human
cugugaauguuauaucucaaug

SEQ ID NO: 643229 - RNA, 22 nt, Human
ccauccagaaacuuccaucccc

SEQ ID NO: 643230 - RNA, 22 nt, Human
agcugcaguaaagcucuccagg

SEQ ID NO: 643231 - RNA, 22 nt, Human
cucaggcugugaugugauggca

SEQ ID NO: 643232 - RNA, 23 nt, Human
ccacugaagaauccagggaguuu

SEQ ID NO: 643233 - RNA, 22 nt, Human
cccagggagguagcaggagaaa

SEQ ID NO: 643234 - RNA, 22 nt, Human
cucugagaauaugagcucuuug

SEQ ID NO: 643235 - RNA, 22 nt, Human
uuauuuauguuaacagucgaga

SEQ ID NO: 643236 - RNA, 22 nt, Human
uugggccaaggcagaucuccaa

SEQ ID NO: 643237 - RNA, 22 nt, Human
ugcaggaauuuuuugcagaaag

SEQ ID NO: 643238 - RNA, 22 nt, Human
uccugccuguuuaccuguacuu

SEQ ID NO: 643239 - RNA, 22 nt, Human
agucagagagcucucagcauag

SEQ ID NO: 643240 - RNA, 22 nt, Human
aacaggcucuucauuuccagag

SEQ ID NO: 643241 - RNA, 22 nt, Human
augguccuuauggccgugauau

SEQ ID NO: 643242 - RNA, 22 nt, Human
ggaagggccucgggcgugggac

SEQ ID NO: 643243 - RNA, 22 nt, Human
caggucagaggcgcagccccca

SEQ ID NO: 643244 - RNA, 22 nt, Human
augcauguauucaugugugaca

SEQ ID NO: 643245 - RNA, 22 nt, Human
uggccugcuuucauuugaugcu

SEQ ID NO: 643246 - RNA, 22 nt, Human
uccagcccucuggcccgcggug

SEQ ID NO: 643247 - RNA, 22 nt, Human
uggcccaggcgaggugggcaga

SEQ ID NO: 643248 - RNA, 22 nt, Human
ccugauucaguggugcccagag

SEQ ID NO: 643249 - RNA, 22 nt, Human
cacacugauaggcuugacaggc

SEQ ID NO: 643250 - RNA, 22 nt, Human
ugaggcaguauuuuagugacuu

SEQ ID NO: 643251 - RNA, 22 nt, Human
auaguugagaucagauucaacu

SEQ ID NO: 643252 - RNA, 22 nt, Human
gaccaggcuguuccagucuaac

SEQ ID NO: 643253 - RNA, 22 nt, Human
cuuaaagaaauugaggagagga

SEQ ID NO: 643254 - RNA, 21 nt, Human
ggagucagggucuggcugggg

SEQ ID NO: 643255 - RNA, 22 nt, Human
aauuuuauuaacuggauguagc

SEQ ID NO: 643256 - RNA, 22 nt, Human
cagcaucuaaucuucaugccgg

SEQ ID NO: 643257 - RNA, 22 nt, Human
gcaggaguaucuauacauuaaa

SEQ ID NO: 643258 - RNA, 22 nt, Human
gaagagguagcauuggcaggug

SEQ ID NO: 643259 - RNA, 22 nt, Human
ugcucagggacaauggagaggg

SEQ ID NO: 643260 - RNA, 22 nt, Human
aggagccuccuucucaugugca

SEQ ID NO: 643261 - RNA, 22 nt, Human
ucagaggguggcugggagcauc

SEQ ID NO: 643262 - RNA, 22 nt, Human
aacaaugaccacacaauguacu

SEQ ID NO: 643263 - RNA, 22 nt, Human
gugcuuuaaaccacugugcugu

SEQ ID NO: 643264 - RNA, 22 nt, Human
ccacuguuuccuuucugcuggc

SEQ ID NO: 643265 - RNA, 23 nt, Human
uaggccagggugaccuggggaga

SEQ ID NO: 643266 - RNA, 22 nt, Human
caacuuuugacacgugugcuaa

SEQ ID NO: 643267 - RNA, 22 nt, Human
aucacauggaaugauuuuagac

SEQ ID NO: 643268 - RNA, 22 nt, Human
uaccugcaaaguuccuuuugcc

SEQ ID NO: 643269 - RNA, 22 nt, Human
aggcauccucucugccuugagg

SEQ ID NO: 643270 - RNA, 22 nt, Human
ugccuugcuucaaucaaaccgu

SEQ ID NO: 643271 - RNA, 22 nt, Human
auuuacagaagcauguaauagc

SEQ ID NO: 643272 - RNA, 22 nt, Human
gacuguggucuguucuccaggu

SEQ ID NO: 643273 - RNA, 22 nt, Human
agcuggugcugaagcucuugag

SEQ ID NO: 643274 - RNA, 22 nt, Human
caaggaaacaugaaaugcauug

SEQ ID NO: 643275 - RNA, 22 nt, Human
cagggaggaugggcuguuuugc

SEQ ID NO: 643276 - RNA, 22 nt, Human
uccuuacaugcuuccuuauaca

SEQ ID NO: 643277 - RNA, 19 nt, Human
acuucugaggaacugcaca

SEQ ID NO: 643278 - RNA, 22 nt, Human
uccagccccggcuuccuuacag

SEQ ID NO: 643279 - RNA, 22 nt, Human
gccaaaguaccuagcccucugc

SEQ ID NO: 643280 - RNA, 22 nt, Human
ugugaggcuggcaggggccagg

SEQ ID NO: 643281 - RNA, 22 nt, Human
auggaaguuggaaccauucaua

SEQ ID NO: 643282 - RNA, 22 nt, Human
gcaggucuggcauagagccugc

SEQ ID NO: 643283 - RNA, 22 nt, Human
uuagauguggacuuauguuauu

SEQ ID NO: 643284 - RNA, 22 nt, Human
uccucuucuguggauucccuga

SEQ ID NO: 643285 - RNA, 22 nt, Human
uuacaugaugauuucauaaaca

SEQ ID NO: 643286 - RNA, 22 nt, Human
ccugagaauaauucuccauagc

SEQ ID NO: 643287 - RNA, 22 nt, Human
ucuggcaucacucgcaagagca

SEQ ID NO: 643288 - RNA, 22 nt, Human
caagaugggcaccccagcaccu

SEQ ID NO: 643289 - RNA, 22 nt, Human
ucagcacaggucuugcaaaaca

SEQ ID NO: 643290 - RNA, 22 nt, Human
aggcagccaucugcaggaagga

SEQ ID NO: 643291 - RNA, 22 nt, Human
ucuggcucaucucuccagguaa

SEQ ID NO: 643292 - RNA, 22 nt, Human
ucucucagggggaaggcugaag

SEQ ID NO: 643293 - RNA, 22 nt, Human
aagcuauauuauauuuguguuu

SEQ ID NO: 643294 - RNA, 22 nt, Human
aaaugcucucuaauguaauaca

SEQ ID NO: 643295 - RNA, 22 nt, Human
ugcacagcgggugucugucagg

SEQ ID NO: 643296 - RNA, 22 nt, Human
accaaaugcuuggcugcuguga

SEQ ID NO: 643297 - RNA, 22 nt, Human
gcucauucagccagggcccggu

SEQ ID NO: 643298 - RNA, 22 nt, Human
uaguauaugucuaugguuguag

SEQ ID NO: 643299 - RNA, 22 nt, Human
gaacagagaagcuuuacuaaag

SEQ ID NO: 643300 - RNA, 22 nt, Human
acucagaaugucacugagggac

SEQ ID NO: 643301 - RNA, 23 nt, Human
uucaaaacuggaaaaucagaugc

SEQ ID NO: 643302 - RNA, 22 nt, Human
gucagugcuugaagggcagaga

SEQ ID NO: 643303 - RNA, 22 nt, Human
gcagcaggugugcuuuuaauga

SEQ ID NO: 643304 - RNA, 22 nt, Human
uuggcuucuugugaaaucugag

SEQ ID NO: 643305 - RNA, 22 nt, Human
ggcugaaggaugaaagcugcag

SEQ ID NO: 643306 - RNA, 22 nt, Human
cugaggagggaaguccccaaag

SEQ ID NO: 643307 - RNA, 22 nt, Human
gcuguggaaaugccuaacauga

SEQ ID NO: 643308 - RNA, 22 nt, Human
ucaggcagaauuaucaaaagau

SEQ ID NO: 643309 - RNA, 22 nt, Human
ucaggaaauggaauucuugugu

SEQ ID NO: 643310 - RNA, 22 nt, Human
ugcuggaguggcacuguguggc

SEQ ID NO: 643311 - RNA, 22 nt, Human
cucucugaggcaggccuguggg

SEQ ID NO: 643312 - RNA, 22 nt, Human
gcacugaaugccaaaguguagg

SEQ ID NO: 643313 - RNA, 22 nt, Human
agcccugcgugccaggggacug

SEQ ID NO: 643314 - RNA, 22 nt, Human
ucaaaucucauugccuaaaacu

SEQ ID NO: 643315 - RNA, 22 nt, Human
cgccccagaugcaagacaaaga

SEQ ID NO: 643316 - RNA, 22 nt, Human
uccugggcuguggccccgggca

SEQ ID NO: 643317 - RNA, 22 nt, Human
ugccaggccacguagcuucaag

SEQ ID NO: 643318 - RNA, 22 nt, Human
aucaugacagagucugccaucc

SEQ ID NO: 643319 - RNA, 22 nt, Human
ugucccagacacaguaugcgcu

SEQ ID NO: 643320 - RNA, 21 nt, Human
acuuaaauuccuugauauuua

SEQ ID NO: 643321 - RNA, 22 nt, Human
agcugaacgugcuucugcagca

SEQ ID NO: 643322 - RNA, 22 nt, Human
uuccuucuagagcuuguuuagg

SEQ ID NO: 643323 - RNA, 22 nt, Human
cucacuggcaagacuacaggug

SEQ ID NO: 643324 - RNA, 22 nt, Human
gcagcugcagguggucccaugc

SEQ ID NO: 643325 - RNA, 22 nt, Human
aaggaguggggcauaucacaga

SEQ ID NO: 643326 - RNA, 22 nt, Human
caaaggcugccacuguggcugu

SEQ ID NO: 643327 - RNA, 22 nt, Human
aaucagacuauuaaagucucuu

SEQ ID NO: 643328 - RNA, 22 nt, Human
uacuggagauggaaugcuuuug

SEQ ID NO: 643329 - RNA, 22 nt, Human
aaguuugguccuucuaagaaga

SEQ ID NO: 643330 - RNA, 22 nt, Human
ucuucaugauacccuaagccac

SEQ ID NO: 643331 - RNA, 22 nt, Human
gccagcuguaagcagugauucu

SEQ ID NO: 643332 - RNA, 22 nt, Human
uuucuaucuaggguuagaguga

SEQ ID NO: 643333 - RNA, 22 nt, Human
uuuauauugggagucguuuuga

SEQ ID NO: 643334 - RNA, 22 nt, Human
uauauaacuacuauuuugcuca

SEQ ID NO: 643335 - RNA, 22 nt, Human
acuguggaugccaaaggggagg

SEQ ID NO: 643336 - RNA, 22 nt, Human
gagaggccugagaggcugcgga

SEQ ID NO: 643337 - RNA, 22 nt, Human
ggggaggcugaugugggcaaag

SEQ ID NO: 643338 - RNA, 22 nt, Human
aggcuuuggggcauucuguguu

SEQ ID NO: 643339 - RNA, 22 nt, Human
aguggcuggucuaaggucacag

SEQ ID NO: 643340 - RNA, 22 nt, Human
cuuguauuccccuaucucuaaa

SEQ ID NO: 643341 - RNA, 22 nt, Human
uucugugcucaaaacuuuccaa

SEQ ID NO: 643342 - RNA, 22 nt, Human
aaauguccuuagagaaaaguca

SEQ ID NO: 643343 - RNA, 21 nt, Human
acagcagcaaucugucuuucc

SEQ ID NO: 643344 - RNA, 22 nt, Human
gcccuggagggccagcgacugg

SEQ ID NO: 643345 - RNA, 22 nt, Human
augcauuggauaagaaccccau

SEQ ID NO: 643346 - RNA, 23 nt, Human
uguacaaguacgaccucucccuc

SEQ ID NO: 643347 - RNA, 22 nt, Human
cuugcuuguuuaguucacagau

SEQ ID NO: 643348 - RNA, 22 nt, Human
uagcaaagaccaaagcuaguug

SEQ ID NO: 643349 - RNA, 22 nt, Human
uaaaugugcacagguuagaagg

SEQ ID NO: 643350 - RNA, 22 nt, Human
accaaggaguuugguauuuuag

SEQ ID NO: 643351 - RNA, 22 nt, Human
auacaaguugugauaauguaaa

SEQ ID NO: 643352 - RNA, 22 nt, Human
aaccagcuccucaccccauugu

SEQ ID NO: 643353 - RNA, 22 nt, Human
uccugggguguguuuugcugcu

SEQ ID NO: 643354 - RNA, 19 nt, Human
acaggggccuuuccagggu

SEQ ID NO: 643355 - RNA, 22 nt, Human
agccaacaacucugagcccagu

SEQ ID NO: 643356 - RNA, 22 nt, Human
gaggagcaagaaauagugccca

SEQ ID NO: 643357 - RNA, 22 nt, Human
gagcugaaucagagauauuauu

SEQ ID NO: 643358 - RNA, 19 nt, Human
cacaguccuauguuuauca

SEQ ID NO: 643359 - RNA, 22 nt, Human
uccugaaauuuguuuuaauucu

SEQ ID NO: 643360 - RNA, 22 nt, Human
cagcagccacuagagggcucac

SEQ ID NO: 643361 - RNA, 22 nt, Human
ucagcaggcaggaggcaugcca

SEQ ID NO: 643362 - RNA, 22 nt, Human
auuguuaacuauagcaucuggu

SEQ ID NO: 643363 - RNA, 22 nt, Human
cauucauucuguaaguaacuau

SEQ ID NO: 643364 - RNA, 22 nt, Human
uccaggaggacugagggggcug

SEQ ID NO: 643365 - RNA, 22 nt, Human
gggcagugggaccaggcaccag

SEQ ID NO: 643366 - RNA, 22 nt, Human
agguuaggaagauacagaaugu

SEQ ID NO: 643367 - RNA, 22 nt, Human
gugggcagaacauuuguaggcu

SEQ ID NO: 643368 - RNA, 22 nt, Human
agagcagguggcaacucuggga

SEQ ID NO: 643369 - RNA, 22 nt, Human
gcuggcagguaaagccccgggg

SEQ ID NO: 643370 - RNA, 22 nt, Human
ucacaggacagccuuccacccg

SEQ ID NO: 643371 - RNA, 22 nt, Human
ggagagagaccuccaugcccag

SEQ ID NO: 643372 - RNA, 22 nt, Human
aauucagugguuucugcaacaa

SEQ ID NO: 643373 - RNA, 22 nt, Human
ugguaaggauuguagaaacgaa

SEQ ID NO: 643374 - RNA, 22 nt, Human
gugcagacuuacagauuauccc

SEQ ID NO: 643375 - RNA, 22 nt, Human
cucccgugauccuggaggagag

SEQ ID NO: 643376 - RNA, 22 nt, Human
uuggcaccucccuaggaagaag

SEQ ID NO: 643377 - RNA, 20 nt, Human
gagcaucugucugcugugca

SEQ ID NO: 643378 - RNA, 22 nt, Human
aggggcuuauguuucuccaggc

SEQ ID NO: 643379 - RNA, 22 nt, Human
aacugcaguuaccuuugcacca

SEQ ID NO: 643380 - RNA, 22 nt, Human
gagcucagaggauucuggggag

SEQ ID NO: 643381 - RNA, 22 nt, Human
uuucaaguuaaauggggucuuu

SEQ ID NO: 643382 - RNA, 22 nt, Human
ccaagaggcagaaugcagagaa

SEQ ID NO: 643383 - RNA, 22 nt, Human
cacuggaccaaggaaacucuuc

SEQ ID NO: 643384 - RNA, 22 nt, Human
uaagaacagugacagccaacau

SEQ ID NO: 643385 - RNA, 22 nt, Human
gccaagcuuauaugaugcuuga

SEQ ID NO: 643386 - RNA, 22 nt, Human
ccaugcauauaauagugccugg

SEQ ID NO: 643387 - RNA, 22 nt, Human
cccaggcuggagugcaauggug

SEQ ID NO: 643388 - RNA, 22 nt, Human
gaaaccagauaagggaggcuga

SEQ ID NO: 643389 - RNA, 18 nt, Human
ccuacaucauugugagag

SEQ ID NO: 643390 - RNA, 22 nt, Human
uuacacaaaaauaagauauggc

SEQ ID NO: 643391 - RNA, 22 nt, Human
uauuuugcaaaccugaguuuga

SEQ ID NO: 643392 - RNA, 22 nt, Human
uccagcugugcuccaggaggug

SEQ ID NO: 643393 - RNA, 22 nt, Human
augcuuguacuaaaaaaauauu

SEQ ID NO: 643394 - RNA, 22 nt, Human
aaguggcuuugagcuucugcca

SEQ ID NO: 643395 - RNA, 22 nt, Human
gggacaggcugagacuugagcu

SEQ ID NO: 643396 - RNA, 22 nt, Human
cugcuuuaucugagacaaguca

SEQ ID NO: 643397 - RNA, 22 nt, Human
ugcuggagacucacucaggugc

SEQ ID NO: 643398 - RNA, 22 nt, Human
ucugcauugucccagaagugac

SEQ ID NO: 643399 - RNA, 22 nt, Human
cuguacauauacauuuuuuucc

SEQ ID NO: 643400 - RNA, 23 nt, Human
cccuggagcuagucugagcagag

SEQ ID NO: 643401 - RNA, 21 nt, Human
ucaggaggcucagacuccugc

SEQ ID NO: 643402 - RNA, 22 nt, Human
gacacaggaaucaccuuggaug

SEQ ID NO: 643403 - RNA, 22 nt, Human
cuuagcuuuguccuaggucucu

SEQ ID NO: 643404 - RNA, 22 nt, Human
uucugugugucucagcaagcug

SEQ ID NO: 643405 - RNA, 22 nt, Human
uagacacuagggauuuaguacu

SEQ ID NO: 643406 - RNA, 22 nt, Human
cgugugcgugcauaugcacaag

SEQ ID NO: 643407 - RNA, 18 nt, Human
guguuacaggagugcagc

SEQ ID NO: 643408 - RNA, 22 nt, Human
uccacagcuuuuaaaugucuag

SEQ ID NO: 643409 - RNA, 22 nt, Human
gauacauugaggguggaggacc

SEQ ID NO: 643410 - RNA, 22 nt, Human
ucaccgccuugcccggccgggc

SEQ ID NO: 643411 - RNA, 22 nt, Human
ccaggcuggaaucaauauucug

SEQ ID NO: 643412 - RNA, 20 nt, Human
uccagcccagcagccugaca

SEQ ID NO: 643413 - RNA, 21 nt, Human
gcuugccuuccuaucuuuggc

SEQ ID NO: 643414 - RNA, 22 nt, Human
uaaaguuauaaauuaccuguca

SEQ ID NO: 643415 - RNA, 22 nt, Human
ugauuacacagcaguaauuuca

SEQ ID NO: 643416 - RNA, 22 nt, Human
uggcagcagcuaacuuaggcag

SEQ ID NO: 643417 - RNA, 20 nt, Human
acagugcauggggggacagc

SEQ ID NO: 643418 - RNA, 22 nt, Human
ucccugccugacagcacccacc

SEQ ID NO: 643419 - RNA, 22 nt, Human
uuuugugagcugagaaauguau

SEQ ID NO: 643420 - RNA, 22 nt, Human
uaacuucuuugguuuaaagaga

SEQ ID NO: 643421 - RNA, 22 nt, Human
gcucccagcuggagccucaaca

SEQ ID NO: 643422 - RNA, 22 nt, Human
gagggaugugccugaaggcagg

SEQ ID NO: 643423 - RNA, 22 nt, Human
cucagccccaauuugcccucuu

SEQ ID NO: 643424 - RNA, 22 nt, Human
cacugcuuauaaauucuaggca

SEQ ID NO: 643425 - RNA, 22 nt, Human
uguggccuuauuuguauggggg

SEQ ID NO: 643426 - RNA, 22 nt, Human
cuagggaccucagcuccuggag

SEQ ID NO: 643427 - RNA, 22 nt, Human
ggugccuuccugccagccgcaa

SEQ ID NO: 643428 - RNA, 22 nt, Human
uaaccuggaugugccaacguga

SEQ ID NO: 643429 - RNA, 22 nt, Human
ugagaagcugcugacuuagccu

SEQ ID NO: 643430 - RNA, 22 nt, Human
aaaggucuuuuuucuaacacca

SEQ ID NO: 643431 - RNA, 22 nt, Human
gggcuucuauucaagucuguuu

SEQ ID NO: 643432 - RNA, 22 nt, Human
gcccauggcagaacugugagca

SEQ ID NO: 643433 - RNA, 22 nt, Human
ggcuucagugacuggugcccuc

SEQ ID NO: 643434 - RNA, 22 nt, Human
uauguacuaacuuucauucuag

SEQ ID NO: 643435 - RNA, 22 nt, Human
ccaggacugcagggggcgagga

SEQ ID NO: 643436 - RNA, 22 nt, Human
augaggcuaugaauggggagau

SEQ ID NO: 643437 - RNA, 22 nt, Human
ggguuagguucuagaggcacaa

SEQ ID NO: 643438 - RNA, 22 nt, Human
ccugccucccagagguccucua

SEQ ID NO: 643439 - RNA, 22 nt, Human
ucaaaauuucagcacuagcccu

SEQ ID NO: 643440 - RNA, 22 nt, Human
augaaggacaacaggggagcag

SEQ ID NO: 643441 - RNA, 22 nt, Human
gcugugcugauucauucccugc

SEQ ID NO: 643442 - RNA, 22 nt, Human
ggcucuguaaagugacaccugc

SEQ ID NO: 643443 - RNA, 22 nt, Human
uagaaguggcaacacucagaaa

SEQ ID NO: 643444 - RNA, 22 nt, Human
ugcagacaagucgugggaucuu

SEQ ID NO: 643445 - RNA, 20 nt, Human
ucauuccaaauaguucagca

SEQ ID NO: 643446 - RNA, 22 nt, Human
ugggagcucacaggccuggcuc

SEQ ID NO: 643447 - RNA, 23 nt, Human
cagaagcaccuguugacugcugc

SEQ ID NO: 643448 - RNA, 22 nt, Human
cuagggaacaagaugcccaggg

SEQ ID NO: 643449 - RNA, 22 nt, Human
ucacaaagugaagugugucaug

SEQ ID NO: 643450 - RNA, 22 nt, Human
caggaaaucacucugauuuugg

SEQ ID NO: 643451 - RNA, 22 nt, Human
gaguccuggagaaacgcaggug

SEQ ID NO: 643452 - RNA, 22 nt, Human
cauaguuauaaggcaacacugu

SEQ ID NO: 643453 - RNA, 22 nt, Human
caaaguccuagaacagugcuug

SEQ ID NO: 643454 - RNA, 22 nt, Human
acagagcaacuuuauuucaugg

SEQ ID NO: 643455 - RNA, 22 nt, Human
auaaaguggagguaguauucau

SEQ ID NO: 643456 - RNA, 22 nt, Human
gaggcgagaagcuggagauggu

SEQ ID NO: 643457 - RNA, 22 nt, Human
caguggguaggaaaggcucuuc

SEQ ID NO: 643458 - RNA, 22 nt, Human
auguaugcauguauguaucgcu

SEQ ID NO: 643459 - RNA, 22 nt, Human
aguggggacuuaugccagcauu

SEQ ID NO: 643460 - RNA, 22 nt, Human
uggaaaacaaagcucucauuau

SEQ ID NO: 643461 - RNA, 22 nt, Human
auacacuggacaucauugcauu

SEQ ID NO: 643462 - RNA, 22 nt, Human
ggucccugcccaaagcccuugg

SEQ ID NO: 643463 - RNA, 22 nt, Human
cuggcagggcucuuugggugcu

SEQ ID NO: 643464 - RNA, 22 nt, Human
cugucuuuuuagagaguaggau

SEQ ID NO: 643465 - RNA, 21 nt, Human
ccagagguucugggccucccu

SEQ ID NO: 643466 - RNA, 22 nt, Human
aagacauuacuggaaucugacu

SEQ ID NO: 643467 - RNA, 22 nt, Human
agcagagugugaaggcagggcu

SEQ ID NO: 643468 - RNA, 22 nt, Human
uaugcauagguaucuauacuca

SEQ ID NO: 643469 - RNA, 22 nt, Human
gagugucugugacagcucauga

SEQ ID NO: 643470 - RNA, 22 nt, Human
auuuggaaacaauuauauucuu

SEQ ID NO: 643471 - RNA, 18 nt, Human
agagaaagaccaaagcau

SEQ ID NO: 643472 - RNA, 20 nt, Human
auuccucagccccagccuca

SEQ ID NO: 643473 - RNA, 17 nt, Human
gcugagaaggggaagag

SEQ ID NO: 643474 - RNA, 22 nt, Human
gagcccagcucuaccucagacu

SEQ ID NO: 643475 - RNA, 22 nt, Human
aaauacauacacuguacguggc

SEQ ID NO: 643476 - RNA, 22 nt, Human
acuuucuauucccacagagaua

SEQ ID NO: 643477 - RNA, 21 nt, Human
gcucccugcucagcuccuggg

SEQ ID NO: 643478 - RNA, 22 nt, Human
aagcagagccugagacagggau

SEQ ID NO: 643479 - RNA, 22 nt, Human
augccuccucaaaucugccaca

SEQ ID NO: 643480 - RNA, 22 nt, Human
ugggacaguuguccuccacucu

SEQ ID NO: 643481 - RNA, 22 nt, Human
acuguucuccuuuggcuauauc

SEQ ID NO: 643482 - RNA, 22 nt, Human
ugauuguuuccuauguacaccu

SEQ ID NO: 643483 - RNA, 22 nt, Human
uaagagaugguuaucaaaagca

SEQ ID NO: 643484 - RNA, 22 nt, Human
gaccagagaaaggcacuggaag

SEQ ID NO: 643485 - RNA, 22 nt, Human
aaugcuuccuccucaccucagg

SEQ ID NO: 643486 - RNA, 22 nt, Human
uaguucaggaagagaaacaaca

SEQ ID NO: 643487 - RNA, 22 nt, Human
uaugugaagagauuaaaaaaua

SEQ ID NO: 643488 - RNA, 22 nt, Human
gagucagaagaaacuauuuaca

SEQ ID NO: 643489 - RNA, 22 nt, Human
ggggcggggcucugagaagcau

SEQ ID NO: 643490 - RNA, 22 nt, Human
ucuuggaauaccccgaagguca

SEQ ID NO: 643491 - RNA, 22 nt, Human
gaggguggaagagcugcugaga

SEQ ID NO: 643492 - RNA, 22 nt, Human
uuugacaugugcuuauaacuuu

SEQ ID NO: 643493 - RNA, 22 nt, Human
uggucagcuucagaguguucca

SEQ ID NO: 643494 - RNA, 23 nt, Human
aguuuguaaagaaauauuugcac

SEQ ID NO: 643495 - RNA, 22 nt, Human
gacuguggcuaaugguguuagg

SEQ ID NO: 643496 - RNA, 22 nt, Human
gaggccagcgcgcagcacuuuu

SEQ ID NO: 643497 - RNA, 22 nt, Human
gagaaguuucugguuugcauag

SEQ ID NO: 643498 - RNA, 22 nt, Human
uugucugagaaagugaguugcu

SEQ ID NO: 643499 - RNA, 20 nt, Human
cugcaaaaugacauuaggaa

SEQ ID NO: 643500 - RNA, 22 nt, Human
ugcauugcauuugucaugaaga

SEQ ID NO: 643501 - RNA, 22 nt, Human
ucccagggccgcaaacgaguuu

SEQ ID NO: 643502 - RNA, 22 nt, Human
cagcuguuacucugaguaaaug

SEQ ID NO: 643503 - RNA, 19 nt, Human
ggcagagcuccugcuuucu

SEQ ID NO: 643504 - RNA, 22 nt, Human
caggagguacauagauucagau

SEQ ID NO: 643505 - RNA, 22 nt, Human
uuagaaaauuugcuucuuugga

SEQ ID NO: 643506 - RNA, 22 nt, Human
cagacacagcaauucuguguug

SEQ ID NO: 643507 - RNA, 21 nt, Human
cucuugugucagagccagagg

SEQ ID NO: 643508 - RNA, 22 nt, Human
aguucacagaauggccagaacu

SEQ ID NO: 643509 - RNA, 22 nt, Human
acagcagacacaggcacgcugu

SEQ ID NO: 643510 - RNA, 22 nt, Human
cugagcacugggcacauagcug

SEQ ID NO: 643511 - RNA, 22 nt, Human
caucauugaacacuucuuccug

SEQ ID NO: 643512 - RNA, 22 nt, Human
uucauuccugagcccauauuua

SEQ ID NO: 643513 - RNA, 22 nt, Human
gcucacagucugcugagugcag

SEQ ID NO: 643514 - RNA, 22 nt, Human
uuuagugccugggccaguucca

SEQ ID NO: 643515 - RNA, 22 nt, Human
uccagcucugcugugcgccggu

SEQ ID NO: 643516 - RNA, 22 nt, Human
ucccccucauuaccucauucaa

SEQ ID NO: 643517 - RNA, 22 nt, Human
accaaauaggcuuccuggguug

SEQ ID NO: 643518 - RNA, 23 nt, Human
cccagguguggaggcgguggcag

SEQ ID NO: 643519 - RNA, 22 nt, Human
ugaaguuucuugaaucuuggag

SEQ ID NO: 643520 - RNA, 22 nt, Human
cccaggaccgcgcggcugagcg

SEQ ID NO: 643521 - RNA, 23 nt, Human
cagguggcuccacgagggguggg

SEQ ID NO: 643522 - RNA, 22 nt, Human
aaauuauaggugccaccuugga

SEQ ID NO: 643523 - RNA, 22 nt, Human
aauuggcaagcaaguuauccag

SEQ ID NO: 643524 - RNA, 22 nt, Human
guccagagaagggaggggacuc

SEQ ID NO: 643525 - RNA, 22 nt, Human
agauacauggaacgucaaaccu

SEQ ID NO: 643526 - RNA, 22 nt, Human
aacacauagacguuugauauca

SEQ ID NO: 643527 - RNA, 22 nt, Human
uacaauagggagguuuagggga

SEQ ID NO: 643528 - RNA, 22 nt, Human
ugucugggauguaauuccugcc

SEQ ID NO: 643529 - RNA, 22 nt, Human
auucaguuagccacagcuauuc

SEQ ID NO: 643530 - RNA, 22 nt, Human
uuugaaaaaggccuuugguaug

SEQ ID NO: 643531 - RNA, 22 nt, Human
ucuccaggagaaauaugaagga

SEQ ID NO: 643532 - RNA, 20 nt, Human
cugaagaguggccugaucug

SEQ ID NO: 643533 - RNA, 22 nt, Human
gaaaucugcccagugcacuggu

SEQ ID NO: 643534 - RNA, 22 nt, Human
gaggaaggucccaucagaauuu

SEQ ID NO: 643535 - RNA, 22 nt, Human
cugggguggagauuggcaaucu

SEQ ID NO: 643536 - RNA, 22 nt, Human
aguuuacaacaguagcuaugga

SEQ ID NO: 643537 - RNA, 21 nt, Human
ccaggggcaaauugucguuuc

SEQ ID NO: 643538 - RNA, 22 nt, Human
cugggugacagagugagauggu

SEQ ID NO: 643539 - RNA, 22 nt, Human
cuggacagcccucacugugugc

SEQ ID NO: 643540 - RNA, 20 nt, Human
ugacucugcaaccgucucuc

SEQ ID NO: 643541 - RNA, 17 nt, Human
ucagggaaugagguugu

SEQ ID NO: 643542 - RNA, 22 nt, Human
cugcaucugcauaaucaacuuc

SEQ ID NO: 643543 - RNA, 22 nt, Human
ccugggugaaauaguccucaag

SEQ ID NO: 643544 - RNA, 22 nt, Human
uuguguauuuccugaagguaag

SEQ ID NO: 643545 - RNA, 22 nt, Human
uuggagguuucccaacuguggg

SEQ ID NO: 643546 - RNA, 22 nt, Human
caggcagccuucucgucucaca

SEQ ID NO: 643547 - RNA, 22 nt, Human
cuagccaugggcauuaaaggua

SEQ ID NO: 643548 - RNA, 22 nt, Human
ggcauuaacucuguuucaauuu

SEQ ID NO: 643549 - RNA, 22 nt, Human
gccacaggcuccagcaucagua

SEQ ID NO: 643550 - RNA, 22 nt, Human
uuuugugagcccauaaaugcca

SEQ ID NO: 643551 - RNA, 22 nt, Human
uuccacagguuucagacuguuc

SEQ ID NO: 643552 - RNA, 22 nt, Human
agcauuuagucuuuauugcagc

SEQ ID NO: 643553 - RNA, 22 nt, Human
ggagugcuuugaagccuucauu

SEQ ID NO: 643554 - RNA, 22 nt, Human
ccaggagcagggcuggcugcac

SEQ ID NO: 643555 - RNA, 22 nt, Human
ucucugugagauuuguauuaag

SEQ ID NO: 643556 - RNA, 22 nt, Human
gaggaaaauauucagggagguu

SEQ ID NO: 643557 - RNA, 22 nt, Human
gcaguguuaaacaacugcugcu

SEQ ID NO: 643558 - RNA, 22 nt, Human
gcacagccggaccgaggaaaag

SEQ ID NO: 643559 - RNA, 22 nt, Human
guguccauucacugcaacacuu

SEQ ID NO: 643560 - RNA, 22 nt, Human
gauuuccuugcauauugguaau

SEQ ID NO: 643561 - RNA, 22 nt, Human
uuucuagcugacaaaaauguuu

SEQ ID NO: 643562 - RNA, 22 nt, Human
gguaacaacccuacaaauccac

SEQ ID NO: 643563 - RNA, 18 nt, Human
uggcuccugccuccugca

SEQ ID NO: 643564 - RNA, 22 nt, Human
uucuuacaucuauaaaguuggg

SEQ ID NO: 643565 - RNA, 20 nt, Human
auauaccaucccacaacagg

SEQ ID NO: 643566 - RNA, 22 nt, Human
gacagccuggcuuaaucugucu

SEQ ID NO: 643567 - RNA, 18 nt, Human
aagcugcccucaggcagg

SEQ ID NO: 643568 - RNA, 22 nt, Human
acccagagugucugucucaguc

SEQ ID NO: 643569 - RNA, 22 nt, Human
ccucacugucaucaguaguuau

SEQ ID NO: 643570 - RNA, 22 nt, Human
cagaaugcaaauuuuauaauau

SEQ ID NO: 643571 - RNA, 22 nt, Human
aacacugagaggggaguggcac

SEQ ID NO: 643572 - RNA, 22 nt, Human
aaagccagagcaagcugucaca

SEQ ID NO: 643573 - RNA, 22 nt, Human
caggggcaagaaugcugucagc

SEQ ID NO: 643574 - RNA, 22 nt, Human
aguggcaguagaugagcugguu

SEQ ID NO: 643575 - RNA, 22 nt, Human
gauuucaagcccccagagauuc

SEQ ID NO: 643576 - RNA, 22 nt, Human
uguuaggacuccccagaagcug

SEQ ID NO: 643577 - RNA, 23 nt, Human
uguagcugucugagcagacacug

SEQ ID NO: 643578 - RNA, 22 nt, Human
ccagguggaggugugagguccu

SEQ ID NO: 643579 - RNA, 22 nt, Human
aggaacugucauguauugcuca

SEQ ID NO: 643580 - RNA, 22 nt, Human
agaggccagaaggcgcaccccg

SEQ ID NO: 643581 - RNA, 21 nt, Human
gccagggaagagaguuggcug

SEQ ID NO: 643582 - RNA, 16 nt, Human
augcugcuauuagagg

SEQ ID NO: 643583 - RNA, 22 nt, Human
cacugucuauuaauauaacuua

SEQ ID NO: 643584 - RNA, 18 nt, Human
aguugcuuauucugugca

SEQ ID NO: 643585 - RNA, 22 nt, Human
cuccugggcucauaucauucag

SEQ ID NO: 643586 - RNA, 20 nt, Human
gcagggcaucuuggccccca

SEQ ID NO: 643587 - RNA, 22 nt, Human
ggacauggagcauguagagaaa

SEQ ID NO: 643588 - RNA, 22 nt, Human
acauucuuucgaugucugauuu

SEQ ID NO: 643589 - RNA, 22 nt, Human
aaaucaugaggacauuaugcca

SEQ ID NO: 643590 - RNA, 22 nt, Human
guuccaggacccuggccucuga

SEQ ID NO: 643591 - RNA, 22 nt, Human
uugugaauggugccgcaauaaa

SEQ ID NO: 643592 - RNA, 22 nt, Human
uggcucaugccuguaaucuuag

SEQ ID NO: 643593 - RNA, 22 nt, Human
caggcaaguucauuuccaggca

SEQ ID NO: 643594 - RNA, 22 nt, Human
aaagcaaugucucugccugguu

SEQ ID NO: 643595 - RNA, 22 nt, Human
ugcagcuucuuguccugugauu

SEQ ID NO: 643596 - RNA, 18 nt, Human
gagagcugcuaccuagcu

SEQ ID NO: 643597 - RNA, 22 nt, Human
ucucucauaagaugaguacuua

SEQ ID NO: 643598 - RNA, 22 nt, Human
gaagagcugcacacuggggacu

SEQ ID NO: 643599 - RNA, 22 nt, Human
uucuacacaccucugaggacau

SEQ ID NO: 643600 - RNA, 22 nt, Human
cugcuggcaagcccaguuggag

SEQ ID NO: 643601 - RNA, 22 nt, Human
acaugggaucaaugaggcaggc

SEQ ID NO: 643602 - RNA, 22 nt, Human
uuccuucuggaggcuccagggg

SEQ ID NO: 643603 - RNA, 22 nt, Human
cuuacaagaccaaagaaaggau

SEQ ID NO: 643604 - RNA, 22 nt, Human
auaaggcaagcugucaguuugu

SEQ ID NO: 643605 - RNA, 22 nt, Human
agguaguuuugacuucauggcu

SEQ ID NO: 643606 - RNA, 22 nt, Human
uuguuacaucuuauguaagugg

SEQ ID NO: 643607 - RNA, 22 nt, Human
auuuagaaccccuuccaaccug

SEQ ID NO: 643608 - RNA, 22 nt, Human
ggcaguggugggaggcucgcuc

SEQ ID NO: 643609 - RNA, 22 nt, Human
uucucaugaaacucgcuuccuc

SEQ ID NO: 643610 - RNA, 22 nt, Human
uaugugugcuuuuuccaugcau

SEQ ID NO: 643611 - RNA, 22 nt, Human
uagugucugauccguaguuaca

SEQ ID NO: 643612 - RNA, 22 nt, Human
uuggcuucauugaucucacuuu

SEQ ID NO: 643613 - RNA, 22 nt, Human
ccuccccugcucagaacucugg

SEQ ID NO: 643614 - RNA, 21 nt, Human
gcugcucgagauccagugcuu

SEQ ID NO: 643615 - RNA, 22 nt, Human
gagccaggggucagcuccgagg

SEQ ID NO: 643616 - RNA, 22 nt, Human
ugagcuaaguacucucaucaag

SEQ ID NO: 643617 - RNA, 22 nt, Human
aggcaggugcuuaugacuugcu

SEQ ID NO: 643618 - RNA, 22 nt, Human
ccugggugaaaucucuccugca

SEQ ID NO: 643619 - RNA, 22 nt, Human
aaggcacugcuuugcugcgccc

SEQ ID NO: 643620 - RNA, 22 nt, Human
ggucugaauuccagccccucug

SEQ ID NO: 643621 - RNA, 22 nt, Human
uugaauaauauguucaggagga

SEQ ID NO: 643622 - RNA, 22 nt, Human
uuuucugccugcguguuuagga

SEQ ID NO: 643623 - RNA, 22 nt, Human
agagaauuaacauuccauggcu

SEQ ID NO: 643624 - RNA, 22 nt, Human
gcuugggauaugcugauguaaa

SEQ ID NO: 643625 - RNA, 22 nt, Human
uugcauuuguggcauggguguu

SEQ ID NO: 643626 - RNA, 22 nt, Human
uugcaaaaucauuucucaggau

SEQ ID NO: 643627 - RNA, 22 nt, Human
cacagcugcccccucucuaacu

SEQ ID NO: 643628 - RNA, 22 nt, Human
gcaugaaaugagcgaauauaau

SEQ ID NO: 643629 - RNA, 22 nt, Human
gauguggaugaucuuagauggu

SEQ ID NO: 643630 - RNA, 22 nt, Human
ccugcagagccacgugccagcg

SEQ ID NO: 643631 - RNA, 22 nt, Human
gcugagagugagcacuggauau

SEQ ID NO: 643632 - RNA, 22 nt, Human
ggccugagcagacagcaugaug

SEQ ID NO: 643633 - RNA, 22 nt, Human
aucauucugauggucaaugcua

SEQ ID NO: 643634 - RNA, 22 nt, Human
uuaauuggccucuuagagguua

SEQ ID NO: 643635 - RNA, 22 nt, Human
guaagcauucauugucuguaua

SEQ ID NO: 643636 - RNA, 21 nt, Human
acuguuaagacguagcugggg

SEQ ID NO: 643637 - RNA, 22 nt, Human
uugcaucacaguaucucuguaa

SEQ ID NO: 643638 - RNA, 22 nt, Human
aggcaggaaaaucgcuugaacc

SEQ ID NO: 643639 - RNA, 19 nt, Human
gucccuucacuccugcugg

SEQ ID NO: 643640 - RNA, 22 nt, Human
uugugugugagccuucaccaca

SEQ ID NO: 643641 - RNA, 22 nt, Human
uaaguguugguaauuacaauga

SEQ ID NO: 643642 - RNA, 19 nt, Human
cuggagauagggccuuuaa

SEQ ID NO: 643643 - RNA, 22 nt, Human
ucagaaguuaauacgaggagaa

SEQ ID NO: 643644 - RNA, 22 nt, Human
ugucaaugaagauaugaauaau

SEQ ID NO: 643645 - RNA, 22 nt, Human
ugcucuggaauaguccuaggca

SEQ ID NO: 643646 - RNA, 22 nt, Human
cgcugggggaacuucagccaau

SEQ ID NO: 643647 - RNA, 22 nt, Human
uucuagaugauaaaccagcagc

SEQ ID NO: 643648 - RNA, 22 nt, Human
uccagcagguguuugccaacuu

SEQ ID NO: 643649 - RNA, 22 nt, Human
uguuacuuaucucacgugaugc

SEQ ID NO: 643650 - RNA, 22 nt, Human
aauugcuucauuaacauuuagg

SEQ ID NO: 643651 - RNA, 22 nt, Human
ugcccccagacagaauccaguu

SEQ ID NO: 643652 - RNA, 22 nt, Human
cuagaaacauuacauguguuaa

SEQ ID NO: 643653 - RNA, 22 nt, Human
ugggucaggcugggaguccuga

SEQ ID NO: 643654 - RNA, 22 nt, Human
cuaaggaagugacagugggauu

SEQ ID NO: 643655 - RNA, 22 nt, Human
gcugaggccccagggugauggg

SEQ ID NO: 643656 - RNA, 22 nt, Human
auuaggcauauaugcuuuuaau

SEQ ID NO: 643657 - RNA, 22 nt, Human
uauaaaacagaaagcacuaccu

SEQ ID NO: 643658 - RNA, 22 nt, Human
uaugcacauugguuuccucauu

SEQ ID NO: 643659 - RNA, 22 nt, Human
uuuucagagagcuuuuaugucc

SEQ ID NO: 643660 - RNA, 20 nt, Human
aaagucccuuagugggagca

SEQ ID NO: 643661 - RNA, 22 nt, Human
cccugugggccaugugucuaca

SEQ ID NO: 643662 - RNA, 22 nt, Human
uggccacaucugaaaugagugu

SEQ ID NO: 643663 - RNA, 22 nt, Human
ugaggucauggcugauauuucc

SEQ ID NO: 643664 - RNA, 22 nt, Human
cagcauggacagggguggcguu

SEQ ID NO: 643665 - RNA, 21 nt, Human
uggcugcaagcagcugccucc

SEQ ID NO: 643666 - RNA, 22 nt, Human
cugcagccucaaccuccugagc

SEQ ID NO: 643667 - RNA, 19 nt, Human
uacauuccacacaaucucu

SEQ ID NO: 643668 - RNA, 22 nt, Human
ucauaagugguuuauaugcuug

SEQ ID NO: 643669 - RNA, 22 nt, Human
gacaggugaaacagcaagguaa

SEQ ID NO: 643670 - RNA, 22 nt, Human
aagaugcacaauguggcaauua

SEQ ID NO: 643671 - RNA, 22 nt, Human
aaggaggguucccagguccugg

SEQ ID NO: 643672 - RNA, 22 nt, Human
gcauggcaagaucaggagacca

SEQ ID NO: 643673 - RNA, 22 nt, Human
ucuuuaacaggaauuauuacag

SEQ ID NO: 643674 - RNA, 22 nt, Human
ccaggauacugcucucugcugc

SEQ ID NO: 643675 - RNA, 22 nt, Human
uuuggagaaaaguugagaccau

SEQ ID NO: 643676 - RNA, 22 nt, Human
guggacguuaggauuguguaga

SEQ ID NO: 643677 - RNA, 22 nt, Human
uacuuuggguuuagaauaaacu

SEQ ID NO: 643678 - RNA, 23 nt, Human
cucaccaagcgccgccgcugugu

SEQ ID NO: 643679 - RNA, 22 nt, Human
uucuuuaccacuacucuuccaa

SEQ ID NO: 643680 - RNA, 22 nt, Human
uaggagccugcucugcagggac

SEQ ID NO: 643681 - RNA, 22 nt, Human
aguuuuugagaauuuacuaugu

SEQ ID NO: 643682 - RNA, 22 nt, Human
uuauaagacuguagugaguauu

SEQ ID NO: 643683 - RNA, 22 nt, Human
ccaguccugcucccugaccacc

SEQ ID NO: 643684 - RNA, 21 nt, Human
agcagcagaucuggugagggc

SEQ ID NO: 643685 - RNA, 22 nt, Human
caauguuugaguaggagcauaa

SEQ ID NO: 643686 - RNA, 22 nt, Human
aguggggaguuuccagaugugu

SEQ ID NO: 643687 - RNA, 22 nt, Human
ugucucugucucccagguugug

SEQ ID NO: 643688 - RNA, 22 nt, Human
cuuauuagaaagaaaagacaug

SEQ ID NO: 643689 - RNA, 22 nt, Human
uuacaguagauacaaugaguaa

SEQ ID NO: 643690 - RNA, 22 nt, Human
ucucuccucuagucaggguggu

SEQ ID NO: 643691 - RNA, 17 nt, Human
agcugccuugcuugagc

SEQ ID NO: 643692 - RNA, 22 nt, Human
ccuggggauucugacacggagu

SEQ ID NO: 643693 - RNA, 22 nt, Human
auggagguggaagaaugaguua

SEQ ID NO: 643694 - RNA, 22 nt, Human
acuggagcccguggaggcgcag

SEQ ID NO: 643695 - RNA, 22 nt, Human
aaagcaauugugguuuuuguca

SEQ ID NO: 643696 - RNA, 22 nt, Human
uaagugcaugauugaacuuggc

SEQ ID NO: 643697 - RNA, 22 nt, Human
cuguccaugcauguugucugcu

SEQ ID NO: 643698 - RNA, 22 nt, Human
cugcucaguaauaguccuaucu

SEQ ID NO: 643699 - RNA, 22 nt, Human
aucuccaguccugguuuccugg

SEQ ID NO: 643700 - RNA, 22 nt, Human
aacauuuauugagcaccuacug

SEQ ID NO: 643701 - RNA, 22 nt, Human
cuccaggcucguccaagaucga

SEQ ID NO: 643702 - RNA, 22 nt, Human
aggaucuucauugugcugcaaa

SEQ ID NO: 643703 - RNA, 21 nt, Human
uuuauucucagauacagggag

SEQ ID NO: 643704 - RNA, 22 nt, Human
uguuucauguggacauaguugu

SEQ ID NO: 643705 - RNA, 22 nt, Human
ugagcaguaggucugaauagug

SEQ ID NO: 643706 - RNA, 22 nt, Human
uccugaagcaguuagcaugagc

SEQ ID NO: 643707 - RNA, 22 nt, Human
cugcuuuaaucccugccuggaa

SEQ ID NO: 643708 - RNA, 22 nt, Human
cauauguauuucucauaauuag

SEQ ID NO: 643709 - RNA, 22 nt, Human
uagaaagcagaaaccaucagag

SEQ ID NO: 643710 - RNA, 22 nt, Human
agacaggagagggaacugccgg

SEQ ID NO: 643711 - RNA, 22 nt, Human
auuacaaucgagagaaacaaau

SEQ ID NO: 643712 - RNA, 22 nt, Human
agauuauuuaagacaggaacca

SEQ ID NO: 643713 - RNA, 22 nt, Human
gagggcugaaguguuuuaugag

SEQ ID NO: 643714 - RNA, 22 nt, Human
ccagcccuucccaacuggccag

SEQ ID NO: 643715 - RNA, 22 nt, Human
uggagaauaggggccacuggug

SEQ ID NO: 643716 - RNA, 19 nt, Human
uaaaaugucuguggucagu

SEQ ID NO: 643717 - RNA, 22 nt, Human
ugaaaugacaaagguuuuucuu

SEQ ID NO: 643718 - RNA, 22 nt, Human
ugcucucucaggccuggcccac

SEQ ID NO: 643719 - RNA, 18 nt, Human
ccucccucauuuucccag

SEQ ID NO: 643720 - RNA, 22 nt, Human
cagggcuugcaggagaaaguuu

SEQ ID NO: 643721 - RNA, 22 nt, Human
cauggcugaaauucuucgcuug

SEQ ID NO: 643722 - RNA, 22 nt, Human
agguggcagaugggggugcucg

SEQ ID NO: 643723 - RNA, 22 nt, Human
gcaggaagaugagcucagguaa

SEQ ID NO: 643724 - RNA, 22 nt, Human
cagaggaggccaccgcauaggc

SEQ ID NO: 643725 - RNA, 22 nt, Human
ucucuaguugaggacugagcag

SEQ ID NO: 643726 - RNA, 23 nt, Human
acagugaaacacgcaguaagagu

SEQ ID NO: 643727 - RNA, 22 nt, Human
agacagcugccuccaccacagc

SEQ ID NO: 643728 - RNA, 22 nt, Human
agggcagcuggaagguggcuuc

SEQ ID NO: 643729 - RNA, 22 nt, Human
auauuacucugauuuaguaaau

SEQ ID NO: 643730 - RNA, 22 nt, Human
ccaaggcuggagugcaguggcg

SEQ ID NO: 643731 - RNA, 22 nt, Human
ccacccugccuugggccaguga

SEQ ID NO: 643732 - RNA, 22 nt, Human
uuagaaagaacuuuagauauca

SEQ ID NO: 643733 - RNA, 22 nt, Human
guuacaaaugccaaagcugaga

SEQ ID NO: 643734 - RNA, 22 nt, Human
ugcagcagggaccucuauguga

SEQ ID NO: 643735 - RNA, 22 nt, Human
ggcaggugcugggagcaucuca

SEQ ID NO: 643736 - RNA, 22 nt, Human
ucuggagcugggggcuuaguau

SEQ ID NO: 643737 - RNA, 22 nt, Human
gaagacuacuguugcacucaua

SEQ ID NO: 643738 - RNA, 22 nt, Human
cuccaagucggcugcagcugga

SEQ ID NO: 643739 - RNA, 22 nt, Human
ugagcaggggagagcgaaugug

SEQ ID NO: 643740 - RNA, 22 nt, Human
agaagcagaaaagggcacuuuu

SEQ ID NO: 643741 - RNA, 22 nt, Human
ggcagaagguugaaguaauuug

SEQ ID NO: 643742 - RNA, 22 nt, Human
gcaaauacauguugagcaccua

SEQ ID NO: 643743 - RNA, 22 nt, Human
uucauugauuuccuuggaauaa

SEQ ID NO: 643744 - RNA, 22 nt, Human
uuuauucuaacuugcugcucua

SEQ ID NO: 643745 - RNA, 22 nt, Human
ccagggcugcucauuggcuggu

SEQ ID NO: 643746 - RNA, 22 nt, Human
caaaugcaugagaaauaagagg

SEQ ID NO: 643747 - RNA, 22 nt, Human
agagaguuguaccacacucaua

SEQ ID NO: 643748 - RNA, 22 nt, Human
auuuuguggcagaugcagaacc

SEQ ID NO: 643749 - RNA, 22 nt, Human
uuucagucaugaguuguuuuca

SEQ ID NO: 643750 - RNA, 22 nt, Human
agugcccugucacuggaacuga

SEQ ID NO: 643751 - RNA, 22 nt, Human
aaauaguuacuucugcugucuu

SEQ ID NO: 643752 - RNA, 22 nt, Human
uagggcucagaguccaguuucu

SEQ ID NO: 643753 - RNA, 22 nt, Human
uccugcaggccuguucccagua

SEQ ID NO: 643754 - RNA, 22 nt, Human
guuacauggagcaaugaugcau

SEQ ID NO: 643755 - RNA, 22 nt, Human
uccugccucaggcucuggagua

SEQ ID NO: 643756 - RNA, 22 nt, Human
ugggcccugcccuugucugucc

SEQ ID NO: 643757 - RNA, 22 nt, Human
ccucaaauugucaaauaagaau

SEQ ID NO: 643758 - RNA, 22 nt, Human
ugggcagugagaaaggucaggu

SEQ ID NO: 643759 - RNA, 22 nt, Human
agcuccagaagccugcaaggua

SEQ ID NO: 643760 - RNA, 22 nt, Human
uggagguugggaugcuugugau

SEQ ID NO: 643761 - RNA, 22 nt, Human
gugucacaugguuuacugcagc

SEQ ID NO: 643762 - RNA, 22 nt, Human
ugggcuccuugggagcaaguga

SEQ ID NO: 643763 - RNA, 22 nt, Human
auacauagcaggguaguagauc

SEQ ID NO: 643764 - RNA, 22 nt, Human
auucaacauauucugaguaaaa

SEQ ID NO: 643765 - RNA, 22 nt, Human
aaugugcugguaacugcuuugc

SEQ ID NO: 643766 - RNA, 22 nt, Human
agaaugcaucuaaaagcagaga

SEQ ID NO: 643767 - RNA, 20 nt, Human
cagugcaacugaagaacuga

SEQ ID NO: 643768 - RNA, 22 nt, Human
cucuuccuacagucugcuaugc

SEQ ID NO: 643769 - RNA, 22 nt, Human
auucuagcugaguaucagcccc

SEQ ID NO: 643770 - RNA, 22 nt, Human
agccucuggcccuagacugcuu

SEQ ID NO: 643771 - RNA, 22 nt, Human
gggacccucaacaucugcuucu

SEQ ID NO: 643772 - RNA, 22 nt, Human
accaggagacaugaccaaugag

SEQ ID NO: 643773 - RNA, 22 nt, Human
aacauugcagcuuaauugcagg

SEQ ID NO: 643774 - RNA, 20 nt, Human
uacaauauucccacuuugcu

SEQ ID NO: 643775 - RNA, 22 nt, Human
agagcuaagaaacagaauugcu

SEQ ID NO: 643776 - RNA, 22 nt, Human
caagguuuuggaagauuuucgu

SEQ ID NO: 643777 - RNA, 22 nt, Human
uacaggaacugggcaggacauu

SEQ ID NO: 643778 - RNA, 22 nt, Human
ccacagcugaccgcaggugagc

SEQ ID NO: 643779 - RNA, 22 nt, Human
gcucagugugguccucagaugu

SEQ ID NO: 643780 - RNA, 22 nt, Human
ggcccugcgauuagguggcagg

SEQ ID NO: 643781 - RNA, 22 nt, Human
ucccaggauuuuaggcucucag

SEQ ID NO: 643782 - RNA, 22 nt, Human
uuccucaucugugcaccucacu

SEQ ID NO: 643783 - RNA, 22 nt, Human
cuguggcuaugguguacauacu

SEQ ID NO: 643784 - RNA, 22 nt, Human
uagccccagcuacucggaagcu

SEQ ID NO: 643785 - RNA, 22 nt, Human
aggggcuggcuuaucugagagu

SEQ ID NO: 643786 - RNA, 22 nt, Human
ccugaauaggcucugcucaaaa

SEQ ID NO: 643787 - RNA, 22 nt, Human
ucccaggacaggccacauggaa

SEQ ID NO: 643788 - RNA, 22 nt, Human
uucucuccagacugcagugggu

SEQ ID NO: 643789 - RNA, 22 nt, Human
agcugccuuaaauuacuuugug

SEQ ID NO: 643790 - RNA, 22 nt, Human
cacaguguuugauuuaggggcc

SEQ ID NO: 643791 - RNA, 22 nt, Human
aaacacugaagaccuaucuggu

SEQ ID NO: 643792 - RNA, 22 nt, Human
uuguucuuuugcuuagacagau

SEQ ID NO: 643793 - RNA, 22 nt, Human
gagacugcugguaaagauggga

SEQ ID NO: 643794 - RNA, 22 nt, Human
uucuuguucugguucuguuagc

SEQ ID NO: 643795 - RNA, 20 nt, Human
gauggguauugaagucaccu

SEQ ID NO: 643796 - RNA, 22 nt, Human
uuacauguuuaugugguacaug

SEQ ID NO: 643797 - RNA, 22 nt, Human
ugaacacauaaggcuuuccugu

SEQ ID NO: 643798 - RNA, 22 nt, Human
ucccuucacagaugcgauguuu

SEQ ID NO: 643799 - RNA, 22 nt, Human
uuggcuaacacgcguuuuguuc

SEQ ID NO: 643800 - RNA, 22 nt, Human
agaggcugugcccaccaggcaa

SEQ ID NO: 643801 - RNA, 22 nt, Human
gccuggugucuccccaaggaag

SEQ ID NO: 643802 - RNA, 19 nt, Human
cccagaggaaugccuggaa

SEQ ID NO: 643803 - RNA, 22 nt, Human
uguuuacuccagcugauggaac

SEQ ID NO: 643804 - RNA, 22 nt, Human
ucagcugagcuccagcucauag

SEQ ID NO: 643805 - RNA, 22 nt, Human
ucuggccuacuggaguccauga

SEQ ID NO: 643806 - RNA, 22 nt, Human
aaaguauuugugauuuuuacca

SEQ ID NO: 643807 - RNA, 22 nt, Human
uuagaaagaguauaccagaaac

SEQ ID NO: 643808 - RNA, 22 nt, Human
aacaguauugguugaacucaag

SEQ ID NO: 643809 - RNA, 22 nt, Human
uuucagacagauucuucucagu

SEQ ID NO: 643810 - RNA, 22 nt, Human
uggaggcauugugacugcugaa

SEQ ID NO: 643811 - RNA, 19 nt, Human
ggugggugaccuccccacc

SEQ ID NO: 643812 - RNA, 22 nt, Human
ccucagagguguggcaucucug

SEQ ID NO: 643813 - RNA, 22 nt, Human
cuggcuguggucacagguaacu

SEQ ID NO: 643814 - RNA, 22 nt, Human
gaguguggugaacaggagcacc

SEQ ID NO: 643815 - RNA, 22 nt, Human
uuccuuguggaaacuauggacg

SEQ ID NO: 643816 - RNA, 22 nt, Human
guucacaauuuuuacugauugg

SEQ ID NO: 643817 - RNA, 22 nt, Human
aggugcugccccgagaaggaug

SEQ ID NO: 643818 - RNA, 22 nt, Human
ucagcuuccucugugguuccag

SEQ ID NO: 643819 - RNA, 22 nt, Human
cacuucaaucucugccuccauc

SEQ ID NO: 643820 - RNA, 22 nt, Human
agggagcugcucugcuuccgug

SEQ ID NO: 643821 - RNA, 22 nt, Human
uuugacauugccaauuugcuca

SEQ ID NO: 643822 - RNA, 22 nt, Human
acaggguuguggccuuaaaggc

SEQ ID NO: 643823 - RNA, 22 nt, Human
aauaguuugaauuuaucagaug

SEQ ID NO: 643824 - RNA, 22 nt, Human
caugcauuguaauuuuuagucu

SEQ ID NO: 643825 - RNA, 22 nt, Human
ucucuuaauaaguaaauacuga

SEQ ID NO: 643826 - RNA, 22 nt, Human
ccagcuuuuggggugacaauuu

SEQ ID NO: 643827 - RNA, 22 nt, Human
acaguauacauugauuaggacc

SEQ ID NO: 643828 - RNA, 22 nt, Human
guacacauauuuccaaggguaa

SEQ ID NO: 643829 - RNA, 22 nt, Human
uauuacaagaaagggcaugaau

SEQ ID NO: 643830 - RNA, 22 nt, Human
ugcugagcgcauccggcggccg

SEQ ID NO: 643831 - RNA, 22 nt, Human
cagggagcuuugucuucucauu

SEQ ID NO: 643832 - RNA, 22 nt, Human
agaggacaaaaugagaagugcu

SEQ ID NO: 643833 - RNA, 22 nt, Human
ggagcuguugauuguuugagga

SEQ ID NO: 643834 - RNA, 22 nt, Human
cagccugccgucagccagguag

SEQ ID NO: 643835 - RNA, 22 nt, Human
uaggaagggcucagggcucggu

SEQ ID NO: 643836 - RNA, 22 nt, Human
cagcaucucccaggcauuugcc

SEQ ID NO: 643837 - RNA, 22 nt, Human
aaggugaacugguaaugacaga

SEQ ID NO: 643838 - RNA, 22 nt, Human
ggcuuaaguccugaauuuaugc

SEQ ID NO: 643839 - RNA, 22 nt, Human
acauaucuuucccucuccugaa

SEQ ID NO: 643840 - RNA, 21 nt, Human
gugcccuguucccacaugccc

SEQ ID NO: 643841 - RNA, 22 nt, Human
ccucuucucaacuccagccaga

SEQ ID NO: 643842 - RNA, 22 nt, Human
gauguagagggaagauuuuaaa

SEQ ID NO: 643843 - RNA, 22 nt, Human
ccugucacauauuugcuguuca

SEQ ID NO: 643844 - RNA, 22 nt, Human
uccagaggcaaaaagguaugga

SEQ ID NO: 643845 - RNA, 22 nt, Human
gggcagaggggcgcuucccucu

SEQ ID NO: 643846 - RNA, 22 nt, Human
agguaaagacugcaaggagaau

SEQ ID NO: 643847 - RNA, 22 nt, Human
ucacagacgccuccccucgccu

SEQ ID NO: 643848 - RNA, 22 nt, Human
acaggaggagcagcugugugcc

SEQ ID NO: 643849 - RNA, 20 nt, Human
gcuccaagccccuuuagagg

SEQ ID NO: 643850 - RNA, 22 nt, Human
guccuugcuugagacaggcagu

SEQ ID NO: 643851 - RNA, 22 nt, Human
gggacgagaucuuggcagugug

SEQ ID NO: 643852 - RNA, 22 nt, Human
ucugaaagucugaaacaguguc

SEQ ID NO: 643853 - RNA, 22 nt, Human
aggcagcaugggcccagagucc

SEQ ID NO: 643854 - RNA, 22 nt, Human
uggccacccccaaugucaguag

SEQ ID NO: 643855 - RNA, 22 nt, Human
uuauacaguuuauacuuagaau

SEQ ID NO: 643856 - RNA, 22 nt, Human
ugaggugaccgcagaugggaag

SEQ ID NO: 643857 - RNA, 21 nt, Human
cuguggccuggcuagcaccgu

SEQ ID NO: 643858 - RNA, 22 nt, Human
aaugcauuguugauuuggagug

SEQ ID NO: 643859 - RNA, 22 nt, Human
aucucuggcaaugcagcaucgu

SEQ ID NO: 643860 - RNA, 22 nt, Human
cccaggccccagggcuugucag

SEQ ID NO: 643861 - RNA, 17 nt, Human
gcagcagagagacccuc

SEQ ID NO: 643862 - RNA, 22 nt, Human
caugcacaacauacucaagagg

SEQ ID NO: 643863 - RNA, 22 nt, Human
agcagcagggugauagugccca

SEQ ID NO: 643864 - RNA, 22 nt, Human
ugggaguagaugaggagugggc

SEQ ID NO: 643865 - RNA, 23 nt, Human
agacauuuuaauaaggacuuuuu

SEQ ID NO: 643866 - RNA, 22 nt, Human
caccugggcuaaacuaugcagg

SEQ ID NO: 643867 - RNA, 22 nt, Human
gccccacagccugcggucucag

SEQ ID NO: 643868 - RNA, 22 nt, Human
ugucaaccagguauuuuggucu

SEQ ID NO: 643869 - RNA, 22 nt, Human
cucacaggguucuaucgaagag

SEQ ID NO: 643870 - RNA, 22 nt, Human
cuggaaggguacauaggaaacu

SEQ ID NO: 643871 - RNA, 22 nt, Human
uguuaaaugagauuggaauuug

SEQ ID NO: 643872 - RNA, 22 nt, Human
ugccucugaggaagauuguguu

SEQ ID NO: 643873 - RNA, 22 nt, Human
cacaguguagacuaauaauaga

SEQ ID NO: 643874 - RNA, 22 nt, Human
guggcacagugggagagcccca

SEQ ID NO: 643875 - RNA, 22 nt, Human
agucauuuucugccuguaaucu

SEQ ID NO: 643876 - RNA, 22 nt, Human
uggcaaagaugguucucaccau

SEQ ID NO: 643877 - RNA, 22 nt, Human
agcuggagauucuggggacagu

SEQ ID NO: 643878 - RNA, 22 nt, Human
uuacaguaaucgaguguugugg

SEQ ID NO: 643879 - RNA, 22 nt, Human
cuggcuguaugcuggccucaga

SEQ ID NO: 643880 - RNA, 22 nt, Human
uggcacagaccuuaucuucucu

SEQ ID NO: 643881 - RNA, 22 nt, Human
cugcucuguuaauuaaacuuug

SEQ ID NO: 643882 - RNA, 22 nt, Human
uuccaggacuucauggcucuga

SEQ ID NO: 643883 - RNA, 22 nt, Human
auugaagauucugacaucagaa

SEQ ID NO: 643884 - RNA, 22 nt, Human
ugucaccaaguugaugaaugca

SEQ ID NO: 643885 - RNA, 22 nt, Human
ucuuccagagccuccaucccua

SEQ ID NO: 643886 - RNA, 22 nt, Human
cuggaaggcggagguuguagug

SEQ ID NO: 643887 - RNA, 21 nt, Human
aaggcuccuccucuaggccuc

SEQ ID NO: 643888 - RNA, 22 nt, Human
gcagcaucuagggcacuggccu

SEQ ID NO: 643889 - RNA, 22 nt, Human
ccaggaggucugaguguggaca

SEQ ID NO: 643890 - RNA, 22 nt, Human
ccagcucugcuugcccagucag

SEQ ID NO: 643891 - RNA, 22 nt, Human
aaacugucauuggaugcauuug

SEQ ID NO: 643892 - RNA, 22 nt, Human
aggcaguggagaagguuuguga

SEQ ID NO: 643893 - RNA, 17 nt, Human
gucaacaggauuucuuu

SEQ ID NO: 643894 - RNA, 22 nt, Human
ucacaccaguuuccuuucaauu

SEQ ID NO: 643895 - RNA, 20 nt, Human
augucugaaguaauccauuu

SEQ ID NO: 643896 - RNA, 22 nt, Human
cacaguguuccagagcaguggu

SEQ ID NO: 643897 - RNA, 21 nt, Human
agagacugucacugcaguacc

SEQ ID NO: 643898 - RNA, 22 nt, Human
aggcaguguauugcuagcggcu

SEQ ID NO: 643899 - RNA, 22 nt, Human
aauguuguuggcucuucaugau

SEQ ID NO: 643900 - RNA, 22 nt, Human
ugaaagcacucacuucugcucu

SEQ ID NO: 643901 - RNA, 22 nt, Human
cugggccugugggcacacggac

SEQ ID NO: 643902 - RNA, 22 nt, Human
uuuuuguauagaaaugaacuaa

SEQ ID NO: 643903 - RNA, 22 nt, Human
gugaggccgcacgccccggagu

SEQ ID NO: 643904 - RNA, 22 nt, Human
gccagccaagauugagaaggua

SEQ ID NO: 643905 - RNA, 22 nt, Human
gcugcuguuccuccaguggauc

SEQ ID NO: 643906 - RNA, 22 nt, Human
gagauucugagaaguuaagucc

SEQ ID NO: 643907 - RNA, 22 nt, Human
caguggcugugaccagggaccu

SEQ ID NO: 643908 - RNA, 22 nt, Human
uggagcagcaucacuuugagcu

SEQ ID NO: 643909 - RNA, 22 nt, Human
gaggagacggggugccuggagc

SEQ ID NO: 643910 - RNA, 22 nt, Human
uuuaaauuuagaagaaacacug

SEQ ID NO: 643911 - RNA, 22 nt, Human
uccacagacuauuaagugaucu

SEQ ID NO: 643912 - RNA, 22 nt, Human
uuugugaucuccucccucuaga

SEQ ID NO: 643913 - RNA, 22 nt, Human
ggaacauuggcauuuuaaggcu

SEQ ID NO: 643914 - RNA, 22 nt, Human
ggcugcucugcacaggggcugg

SEQ ID NO: 643915 - RNA, 22 nt, Human
agucucugugagcucccaaugg

SEQ ID NO: 643916 - RNA, 22 nt, Human
caggcacagacgcaaacuucuu

SEQ ID NO: 643917 - RNA, 18 nt, Human
cauucuuggcagcuuuug

SEQ ID NO: 643918 - RNA, 20 nt, Human
uauuugaaauggccaagugu

SEQ ID NO: 643919 - RNA, 22 nt, Human
ccugggaggcuguuuccagccu

SEQ ID NO: 643920 - RNA, 22 nt, Human
ggcagucauuuaaucccugcau

SEQ ID NO: 643921 - RNA, 22 nt, Human
agcugccugggcuuguacaccu

SEQ ID NO: 643922 - RNA, 19 nt, Human
uagcccuggccaucaugag

SEQ ID NO: 643923 - RNA, 22 nt, Human
aaggggagaugucaugggcccu

SEQ ID NO: 643924 - RNA, 22 nt, Human
aggguaggguaaaugaugcauc

SEQ ID NO: 643925 - RNA, 22 nt, Human
aacauuucauaacuugacuuuu

SEQ ID NO: 643926 - RNA, 22 nt, Human
uuuuccuuagcuucucugcgag

SEQ ID NO: 643927 - RNA, 22 nt, Human
uccucugggccuauuuguucac

SEQ ID NO: 643928 - RNA, 22 nt, Human
uggcuaugaggagcgcaggugu

SEQ ID NO: 643929 - RNA, 22 nt, Human
ugcaggcuggcagugcugaaau

SEQ ID NO: 643930 - RNA, 22 nt, Human
gaguuaaaggaaaauaacuuua

SEQ ID NO: 643931 - RNA, 17 nt, Human
ugaguggccgggggaca

SEQ ID NO: 643932 - RNA, 22 nt, Human
ugaaugugggagagcuggcaau

SEQ ID NO: 643933 - RNA, 22 nt, Human
gcucaggucuuacccaugccug

SEQ ID NO: 643934 - RNA, 22 nt, Human
uauuuccuugagacggagucuc

SEQ ID NO: 643935 - RNA, 18 nt, Human
ccugccagucuggagcag

SEQ ID NO: 643936 - RNA, 22 nt, Human
ccuagcagggaagcagugagga

SEQ ID NO: 643937 - RNA, 22 nt, Human
gaggagagaugguagauugggu

SEQ ID NO: 643938 - RNA, 22 nt, Human
agcagguggauuuagacgggag

SEQ ID NO: 643939 - RNA, 22 nt, Human
uggggcucaccuaggcuggaag

SEQ ID NO: 643940 - RNA, 22 nt, Human
gagacacaaacacauuuagagg

SEQ ID NO: 643941 - RNA, 21 nt, Human
acacauuaugagcauagacuc

SEQ ID NO: 643942 - RNA, 22 nt, Human
ggagcaagucccaggcacuagu

SEQ ID NO: 643943 - RNA, 22 nt, Human
guuguuuuuguucucuauagcu

SEQ ID NO: 643944 - RNA, 22 nt, Human
aggucaagggcaagagugaggu

SEQ ID NO: 643945 - RNA, 22 nt, Human
gaaagccauagcccagcuuuac

SEQ ID NO: 643946 - RNA, 22 nt, Human
ugcugcuuggaaauggggcuga

SEQ ID NO: 643947 - RNA, 22 nt, Human
uggcacccaguggagcugugcu

SEQ ID NO: 643948 - RNA, 22 nt, Human
uggccaguagauaggcaggcaa

SEQ ID NO: 643949 - RNA, 22 nt, Human
ucaggcauggcucuuccucagg

SEQ ID NO: 643950 - RNA, 21 nt, Human
ugucagcacgcaugaggccag

SEQ ID NO: 643951 - RNA, 22 nt, Human
uuuuuauaacucuuuugugaca

SEQ ID NO: 643952 - RNA, 22 nt, Human
caagguuucgaguucccaacca

SEQ ID NO: 643953 - RNA, 22 nt, Human
agcagcucuuaacaaagcaugg

SEQ ID NO: 643954 - RNA, 22 nt, Human
ugugaccauaauuuguaaauaa

SEQ ID NO: 643955 - RNA, 22 nt, Human
gcacaaguuucuucauuguuca

SEQ ID NO: 643956 - RNA, 22 nt, Human
cuagccagauuuaaagagagac

SEQ ID NO: 643957 - RNA, 22 nt, Human
ucagggacuaggugcugccuga

SEQ ID NO: 643958 - RNA, 20 nt, Human
gcacugaagguuccagggga

SEQ ID NO: 643959 - RNA, 22 nt, Human
ucuccuuugaaaguuaggacug

SEQ ID NO: 643960 - RNA, 22 nt, Human
auugaacauacauauccacacc

SEQ ID NO: 643961 - RNA, 19 nt, Human
ccugggagucagcugaagg

SEQ ID NO: 643962 - RNA, 22 nt, Human
uagugucuagugaguuugaugc

SEQ ID NO: 643963 - RNA, 22 nt, Human
cuuggggcuuuguguguaggau

SEQ ID NO: 643964 - RNA, 22 nt, Human
aauaucuguuguucuaagccac

SEQ ID NO: 643965 - RNA, 23 nt, Human
aaguuaguuucaauaaagcaauu

SEQ ID NO: 643966 - RNA, 22 nt, Human
acuguguaugauauguacuggg

SEQ ID NO: 643967 - RNA, 22 nt, Human
acuugcuugggccaucucgcuu

SEQ ID NO: 643968 - RNA, 22 nt, Human
ccuaggaguucgaagcugcagu

SEQ ID NO: 643969 - RNA, 22 nt, Human
ucuuuccuuagaauaauucuuu

SEQ ID NO: 643970 - RNA, 22 nt, Human
ucucagagagcuguguuuuccu

SEQ ID NO: 643971 - RNA, 22 nt, Human
aggcacagagagguuaaaugca

SEQ ID NO: 643972 - RNA, 22 nt, Human
uggcugccuagucccucagccu

SEQ ID NO: 643973 - RNA, 22 nt, Human
uugagguccccaguacccacug

SEQ ID NO: 643974 - RNA, 22 nt, Human
agaaauguaauugcaacugucu

SEQ ID NO: 643975 - RNA, 22 nt, Human
acccuuucuuacucacacgcuc

SEQ ID NO: 643976 - RNA, 22 nt, Human
auucacaaagaagggaaguaca

SEQ ID NO: 643977 - RNA, 22 nt, Human
gggcaugagagggcagcuggca

SEQ ID NO: 643978 - RNA, 22 nt, Human
uagggcuccacucccagagauu

SEQ ID NO: 643979 - RNA, 22 nt, Human
aaccuagaaguuagaguaucau

SEQ ID NO: 643980 - RNA, 20 nt, Human
aggaacuggaagggaggaaa

SEQ ID NO: 643981 - RNA, 22 nt, Human
ggcaggcauugcaacauguaca

SEQ ID NO: 643982 - RNA, 22 nt, Human
caaagauuuuagaauuugcaau

SEQ ID NO: 643983 - RNA, 22 nt, Human
guguggggagcugcagccacau

SEQ ID NO: 643984 - RNA, 22 nt, Human
uaggcuaggcugaagguuuugg

SEQ ID NO: 643985 - RNA, 19 nt, Human
acaauagaaaagucuuuug

SEQ ID NO: 643986 - RNA, 22 nt, Human
aagucuuuuugaaucuauaacu

SEQ ID NO: 643987 - RNA, 22 nt, Human
uaaagacaugcaaagucuaauu

SEQ ID NO: 643988 - RNA, 22 nt, Human
ugccugccucaggccgagugcu

SEQ ID NO: 643989 - RNA, 21 nt, Human
ugcagaaagcggcuugaagca

SEQ ID NO: 643990 - RNA, 22 nt, Human
agacucugagacaugaaccauc

SEQ ID NO: 643991 - RNA, 22 nt, Human
gugcaggguagcgacggcagga

SEQ ID NO: 643992 - RNA, 22 nt, Human
uuuggcucugugucuucaccca

SEQ ID NO: 643993 - RNA, 22 nt, Human
ugaggcccuagggcaugggaga

SEQ ID NO: 643994 - RNA, 22 nt, Human
caugaugucacagagaagcaca

SEQ ID NO: 643995 - RNA, 22 nt, Human
ccuggcagguuacaaccaguua

SEQ ID NO: 643996 - RNA, 22 nt, Human
gguacaauucugggguaugcuc

SEQ ID NO: 643997 - RNA, 22 nt, Human
ucaguuucuucaucucccuaac

SEQ ID NO: 643998 - RNA, 22 nt, Human
cuguacaaaguagcugcuggga

SEQ ID NO: 643999 - RNA, 22 nt, Human
ccagagaggggaagggcuugcc

SEQ ID NO: 644000 - RNA, 22 nt, Human
uuguagaacaugcagcacaaug

SEQ ID NO: 644001 - RNA, 22 nt, Human
augugcauuaaaugucaauguu

SEQ ID NO: 644002 - RNA, 22 nt, Human
uacagaauauagaagcuggaag

SEQ ID NO: 644003 - RNA, 17 nt, Human
cuggagaagccugugga

SEQ ID NO: 644004 - RNA, 22 nt, Human
cagaguccaauugcucagagcg

SEQ ID NO: 644005 - RNA, 22 nt, Human
ugguuucugcccucagagcuca

SEQ ID NO: 644006 - RNA, 22 nt, Human
uucagccagucaucagucuugu

SEQ ID NO: 644007 - RNA, 22 nt, Human
agucacauggacucaggaugac

SEQ ID NO: 644008 - RNA, 22 nt, Human
guuuucagccaggagcacauuu

SEQ ID NO: 644009 - RNA, 22 nt, Human
uugcuuuucccugucucugauu

SEQ ID NO: 644010 - RNA, 22 nt, Human
aauguagaugagauauuuuuug

SEQ ID NO: 644011 - RNA, 22 nt, Human
gcccugagacugaagaacuguc

SEQ ID NO: 644012 - RNA, 22 nt, Human
caaauagacuuaagcaucugua

SEQ ID NO: 644013 - RNA, 20 nt, Human
ggcuucuuuacaucuguguu

SEQ ID NO: 644014 - RNA, 22 nt, Human
ucauacaacuaagaguuucaga

SEQ ID NO: 644015 - RNA, 22 nt, Human
aagcuucuuagaaugcaugugc

SEQ ID NO: 644016 - RNA, 22 nt, Human
gaaaauaggcugcaucuccuuc

SEQ ID NO: 644017 - RNA, 22 nt, Human
ggagucugugucuugaagcagu

SEQ ID NO: 644018 - RNA, 22 nt, Human
gggaaggcaccaugguguucca

SEQ ID NO: 644019 - RNA, 22 nt, Human
uaggaagguccaugucuuaucu

SEQ ID NO: 644020 - RNA, 22 nt, Human
gaucuuuacuacugccuucucu

SEQ ID NO: 644021 - RNA, 22 nt, Human
agugcuuuguaguuucauugug

SEQ ID NO: 644022 - RNA, 22 nt, Human
ugcuucuguauuuugggcuuga

SEQ ID NO: 644023 - RNA, 22 nt, Human
aagggcugagaaguggggcugg

SEQ ID NO: 644024 - RNA, 22 nt, Human
gggagaagaaugugucaauugu

SEQ ID NO: 644025 - RNA, 22 nt, Human
uggcuccagauuuccugcugca

SEQ ID NO: 644026 - RNA, 22 nt, Human
agggccagucguguauuacugu

SEQ ID NO: 644027 - RNA, 22 nt, Human
uccugggagcaugaagagggau

SEQ ID NO: 644028 - RNA, 22 nt, Human
cugggaguacugggggauguca

SEQ ID NO: 644029 - RNA, 22 nt, Human
agaggccuaauugcuacccuuu

SEQ ID NO: 644030 - RNA, 22 nt, Human
ucucagaauaaauuccuaacuu

SEQ ID NO: 644031 - RNA, 22 nt, Human
uuuguccuugaaucaauucaca

SEQ ID NO: 644032 - RNA, 22 nt, Human
uucugcucuaauguacaccagc

SEQ ID NO: 644033 - RNA, 22 nt, Human
gagcaagacucacugcaucuug

SEQ ID NO: 644034 - RNA, 22 nt, Human
uagggcucacugagaugaauau

SEQ ID NO: 644035 - RNA, 22 nt, Human
gaaauagaucucugggaugcaa

SEQ ID NO: 644036 - RNA, 23 nt, Human
aaacugcuuccaauuccugccau

SEQ ID NO: 644037 - RNA, 22 nt, Human
uuucauugucaauaaacuguau

SEQ ID NO: 644038 - RNA, 22 nt, Human
ccugugcauccgguggucauug

SEQ ID NO: 644039 - RNA, 22 nt, Human
uuccgcuggggccgccuggcgg

SEQ ID NO: 644040 - RNA, 22 nt, Human
aauaaagaauggaugagaucgu

SEQ ID NO: 644041 - RNA, 22 nt, Human
uucccaaaauauaacaguuaac

SEQ ID NO: 644042 - RNA, 15 nt, Human
cauaucacugggaau

SEQ ID NO: 644043 - RNA, 22 nt, Human
aaagccaugaauguuauagagg

SEQ ID NO: 644044 - RNA, 22 nt, Human
gggaagagaccguacccuggcc

SEQ ID NO: 644045 - RNA, 22 nt, Human
cugugaggccuuuggccagaua

SEQ ID NO: 644046 - RNA, 22 nt, Human
gugaaggcuacaagagaucaag

SEQ ID NO: 644047 - RNA, 22 nt, Human
ucaucauaauauggaaucuugu

SEQ ID NO: 644048 - RNA, 22 nt, Human
ucucacagcaggggccaggucu

SEQ ID NO: 644049 - RNA, 22 nt, Human
uccaggggacacuguuucucca

SEQ ID NO: 644050 - RNA, 22 nt, Human
ucccacuggacgucugugcugg

SEQ ID NO: 644051 - RNA, 22 nt, Human
aaucaaaaccuacagagguaau

SEQ ID NO: 644052 - RNA, 22 nt, Human
aaucagagucccaagaucugua

SEQ ID NO: 644053 - RNA, 22 nt, Human
uaaauagaaucuaaacugcuca

SEQ ID NO: 644054 - RNA, 22 nt, Human
cuuggagaaaggaaagggcuug

SEQ ID NO: 644055 - RNA, 22 nt, Human
uccuggagccaggacccuuccc

SEQ ID NO: 644056 - RNA, 22 nt, Human
aguaaucugauuuuauagcuau

SEQ ID NO: 644057 - RNA, 22 nt, Human
auugucgcuuauuuaggugcuu

SEQ ID NO: 644058 - RNA, 22 nt, Human
auuuagacaccagcuuguaagg

SEQ ID NO: 644059 - RNA, 22 nt, Human
gcuuuagaaaugaguaaauuag

SEQ ID NO: 644060 - RNA, 23 nt, Human
accaggagccaagaucucccugg

SEQ ID NO: 644061 - RNA, 22 nt, Human
uuuggcaacggagaacuuacuc

SEQ ID NO: 644062 - RNA, 22 nt, Human
ccagggugugggcgucggcacg

SEQ ID NO: 644063 - RNA, 22 nt, Human
ggaacugaaugucucgguauaa

SEQ ID NO: 644064 - RNA, 22 nt, Human
acuuuacaauauccugugacuu

SEQ ID NO: 644065 - RNA, 22 nt, Human
aaaggcuaugagauagaagaua

SEQ ID NO: 644066 - RNA, 22 nt, Human
agccaggccagacucacacccu

SEQ ID NO: 644067 - RNA, 22 nt, Human
uacaauguacuuccuugcacag

SEQ ID NO: 644068 - RNA, 22 nt, Human
cugaucuuaaguaacauuauuu

SEQ ID NO: 644069 - RNA, 22 nt, Human
cuuaaaguauugguuuaaccaa

SEQ ID NO: 644070 - RNA, 22 nt, Human
uuucccacacaguccacugcag

SEQ ID NO: 644071 - RNA, 22 nt, Human
acaggugcaugcuaccaugucu

SEQ ID NO: 644072 - RNA, 22 nt, Human
uagagaauggccuugaaguagu

SEQ ID NO: 644073 - RNA, 22 nt, Human
aaacagcugcacugcugauguc

SEQ ID NO: 644074 - RNA, 22 nt, Human
gucagcauugcagauauauggc

SEQ ID NO: 644075 - RNA, 22 nt, Human
ccaggcucugagaggaauguga

SEQ ID NO: 644076 - RNA, 22 nt, Human
aggcucuggcuacuacagagcu

SEQ ID NO: 644077 - RNA, 22 nt, Human
caugaaggaauuaagguaagga

SEQ ID NO: 644078 - RNA, 19 nt, Human
ugugugcaugcgcacgugu

SEQ ID NO: 644079 - RNA, 22 nt, Human
cagcagaggaaagcaaaucuaa

SEQ ID NO: 644080 - RNA, 22 nt, Human
cucuucauuaguuccuguccca

SEQ ID NO: 644081 - RNA, 22 nt, Human
cauguguuaaucuuucugcaaa

SEQ ID NO: 644082 - RNA, 22 nt, Human
ucagaacaauugggaaccauua

SEQ ID NO: 644083 - RNA, 22 nt, Human
agcgcgcugucagacuggcucg

SEQ ID NO: 644084 - RNA, 22 nt, Human
aauugacagaaaguuuacgagg

SEQ ID NO: 644085 - RNA, 22 nt, Human
cauggcaggaaggacaugcacu

SEQ ID NO: 644086 - RNA, 22 nt, Human
ucugagggugggagaaggagcu

SEQ ID NO: 644087 - RNA, 22 nt, Human
agccaucauuucugucacuggc

SEQ ID NO: 644088 - RNA, 22 nt, Human
ggccuggaaugcuuuccuacca

SEQ ID NO: 644089 - RNA, 22 nt, Human
cugaagcucuccaguuuguuuc

SEQ ID NO: 644090 - RNA, 22 nt, Human
uaguagcaggggguaccucuca

SEQ ID NO: 644091 - RNA, 22 nt, Human
uggccagguugggcuuugcagc

SEQ ID NO: 644092 - RNA, 22 nt, Human
ccagggcacguugggacaguac

SEQ ID NO: 644093 - RNA, 22 nt, Human
uauaaagaauccagaagagaca

SEQ ID NO: 644094 - RNA, 22 nt, Human
augcugaagaaucacagggacu

SEQ ID NO: 644095 - RNA, 22 nt, Human
accaggccaaaaucauauuuac

SEQ ID NO: 644096 - RNA, 22 nt, Human
cuguggcuaggauuauuccuga

SEQ ID NO: 644097 - RNA, 22 nt, Human
ggggggcagcuguccuggccau

SEQ ID NO: 644098 - RNA, 22 nt, Human
augcaugcacacacugcauugc

SEQ ID NO: 644099 - RNA, 22 nt, Human
gcagggaccuaugacgauggaa

SEQ ID NO: 644100 - RNA, 22 nt, Human
uuuucacauugucccagcacua

SEQ ID NO: 644101 - RNA, 22 nt, Human
ggcccugggcccucuagcuugu

SEQ ID NO: 644102 - RNA, 17 nt, Human
aaucuguuuacagucag

SEQ ID NO: 644103 - RNA, 23 nt, Human
gugauuucagggaacagaaucag

SEQ ID NO: 644104 - RNA, 22 nt, Human
ucucuacaaaaauuagcaugca

SEQ ID NO: 644105 - RNA, 22 nt, Human
uccucucugcacuggcccugcc

SEQ ID NO: 644106 - RNA, 19 nt, Human
agcagcagcuaccacuugu

SEQ ID NO: 644107 - RNA, 22 nt, Human
caguccuuagucuggauggcuu

SEQ ID NO: 644108 - RNA, 22 nt, Human
uuagaguuaggauuugucuuua

SEQ ID NO: 644109 - RNA, 22 nt, Human
ggaaguguuugugcagauggcc

SEQ ID NO: 644110 - RNA, 20 nt, Human
gugucugcauauagcaggug

SEQ ID NO: 644111 - RNA, 22 nt, Human
uuauaugauugagcaucuuggu

SEQ ID NO: 644112 - RNA, 21 nt, Human
ccaggcagagcugugaguucu

SEQ ID NO: 644113 - RNA, 22 nt, Human
ggucucgagccaggcagcugca

SEQ ID NO: 644114 - RNA, 22 nt, Human
ccaguggacuucucccuguggu

SEQ ID NO: 644115 - RNA, 22 nt, Human
ucuuucccgccagagcaugagu

SEQ ID NO: 644116 - RNA, 22 nt, Human
acuguaaauuuugguugcaggu

SEQ ID NO: 644117 - RNA, 22 nt, Human
uuugcacacacaauaacaaaug

SEQ ID NO: 644118 - RNA, 22 nt, Human
aauagcugggaccugaauuagc

SEQ ID NO: 644119 - RNA, 22 nt, Human
acugcucucuuugcaggggcua

SEQ ID NO: 644120 - RNA, 22 nt, Human
cacagcugcccuaacuguacuc

SEQ ID NO: 644121 - RNA, 22 nt, Human
acucuggcacuggguaccucag

SEQ ID NO: 644122 - RNA, 22 nt, Human
cagaugaggggcauauaacaau

SEQ ID NO: 644123 - RNA, 22 nt, Human
cuggcagcaggucacacgcaga

SEQ ID NO: 644124 - RNA, 22 nt, Human
gguugcaaacuccugggaucaa

SEQ ID NO: 644125 - RNA, 22 nt, Human
aagccauucaucuaauguccug

SEQ ID NO: 644126 - RNA, 22 nt, Human
aaagggagcauggcugcaggga

SEQ ID NO: 644127 - RNA, 21 nt, Human
agagagggagaugaaacaucc

SEQ ID NO: 644128 - RNA, 22 nt, Human
ggaaaucaaggggacaaauugu

SEQ ID NO: 644129 - RNA, 22 nt, Human
aggaugagauuccagggucaau

SEQ ID NO: 644130 - RNA, 22 nt, Human
agcaggaacgaguucaugggga

SEQ ID NO: 644131 - RNA, 22 nt, Human
acagcacagagugguauggcug

SEQ ID NO: 644132 - RNA, 22 nt, Human
uccccaggaaggcccuuccugg

SEQ ID NO: 644133 - RNA, 22 nt, Human
cucucucuuguguugcugcaga

SEQ ID NO: 644134 - RNA, 22 nt, Human
gucuccugccacacucaguccc

SEQ ID NO: 644135 - RNA, 22 nt, Human
gcaguguuccuucuacuggggc

SEQ ID NO: 644136 - RNA, 22 nt, Human
auguuuuuggcuucaaguuucu

SEQ ID NO: 644137 - RNA, 20 nt, Human
aaacaagguugcucugagga

SEQ ID NO: 644138 - RNA, 22 nt, Human
ugcugcuguuuccuacaucuca

SEQ ID NO: 644139 - RNA, 22 nt, Human
aucacagagcucccuuccacug

SEQ ID NO: 644140 - RNA, 22 nt, Human
gaggcugcuuugaugacaggag

SEQ ID NO: 644141 - RNA, 22 nt, Human
ugcuggcaccagaaugacugca

SEQ ID NO: 644142 - RNA, 22 nt, Human
ugagugggaccugcguguguca

SEQ ID NO: 644143 - RNA, 22 nt, Human
ucacagcauugaguguacuaga

SEQ ID NO: 644144 - RNA, 22 nt, Human
cccaggcagucuggcucuaaag

SEQ ID NO: 644145 - RNA, 22 nt, Human
acaugcuuugauguauuuugca

SEQ ID NO: 644146 - RNA, 22 nt, Human
aggaacauucucauuuccugcc

SEQ ID NO: 644147 - RNA, 22 nt, Human
ccaaaggaugucccuguguuuu

SEQ ID NO: 644148 - RNA, 22 nt, Human
guggcagagccgugcagguagg

SEQ ID NO: 644149 - RNA, 22 nt, Human
uccuuaaaugaacucugcauga

SEQ ID NO: 644150 - RNA, 22 nt, Human
cagcugcuguaacagaauacuu

SEQ ID NO: 644151 - RNA, 19 nt, Human
ggagcuugguggcuguggc

SEQ ID NO: 644152 - RNA, 22 nt, Human
agaucagagaugcuaaaagagc

SEQ ID NO: 644153 - RNA, 19 nt, Human
uucauuuguaucugcucac

SEQ ID NO: 644154 - RNA, 22 nt, Human
agagcuguucaacguagcaaug

SEQ ID NO: 644155 - RNA, 22 nt, Human
uggugaggccaaagccaugaca

SEQ ID NO: 644156 - RNA, 22 nt, Human
caaagccauagaguagauaaga

SEQ ID NO: 644157 - RNA, 22 nt, Human
ugaggaggcccagguuggggcu

SEQ ID NO: 644158 - RNA, 22 nt, Human
gaagcugggucgcugggauccu

SEQ ID NO: 644159 - RNA, 21 nt, Human
ugcaggcuacuucugacucua

SEQ ID NO: 644160 - RNA, 22 nt, Human
cuccucagucaggucuaggguc

SEQ ID NO: 644161 - RNA, 22 nt, Human
gcaguguuuuacagaccagcau

SEQ ID NO: 644162 - RNA, 21 nt, Human
cauuucaugauuauagaaaug

SEQ ID NO: 644163 - RNA, 22 nt, Human
uagaaaguaaaucaguuuuauu

SEQ ID NO: 644164 - RNA, 22 nt, Human
agcagacuccauugagugaguc

SEQ ID NO: 644165 - RNA, 22 nt, Human
auaucacaaacaagucuguacu

SEQ ID NO: 644166 - RNA, 22 nt, Human
aauaggaagucacaucaaggga

SEQ ID NO: 644167 - RNA, 22 nt, Human
cuaaaugcccuacaaugacugg

SEQ ID NO: 644168 - RNA, 22 nt, Human
aaggaaagcugugguucugaga

SEQ ID NO: 644169 - RNA, 21 nt, Human
guuaagccuugaggugauugu

SEQ ID NO: 644170 - RNA, 22 nt, Human
agaaccugccuuuacucuccuu

SEQ ID NO: 644171 - RNA, 22 nt, Human
aaaguagaggcauugaucaggu

SEQ ID NO: 644172 - RNA, 22 nt, Human
auauggaaugguaaucuacaau

SEQ ID NO: 644173 - RNA, 22 nt, Human
auucaauaaauaugcuacaugg

SEQ ID NO: 644174 - RNA, 22 nt, Human
gcuguggccuggcgcagagcug

SEQ ID NO: 644175 - RNA, 19 nt, Human
acaguccagcuguuuguac

SEQ ID NO: 644176 - RNA, 22 nt, Human
ucugagcuguggccauucuucc

SEQ ID NO: 644177 - RNA, 22 nt, Human
cacaaaaguaggaggcaggcgg

SEQ ID NO: 644178 - RNA, 22 nt, Human
augcaaaaguaauugcaauuuu

SEQ ID NO: 644179 - RNA, 22 nt, Human
aauuuccagaucagaugacuca

SEQ ID NO: 644180 - RNA, 22 nt, Human
gucauuucuguuucuucagugc

SEQ ID NO: 644181 - RNA, 22 nt, Human
uagacauuagguagguucaugg

SEQ ID NO: 644182 - RNA, 18 nt, Human
uaaauauauuucccccuu

SEQ ID NO: 644183 - RNA, 22 nt, Human
uccguugacuuggaagcccuga

SEQ ID NO: 644184 - RNA, 22 nt, Human
ccugaggagauuguggcugggg

SEQ ID NO: 644185 - RNA, 22 nt, Human
uuugaaguccaucuggcccagu

SEQ ID NO: 644186 - RNA, 20 nt, Human
acuuaguuuuucucacagga

SEQ ID NO: 644187 - RNA, 22 nt, Human
gagccagugaucagacagggag

SEQ ID NO: 644188 - RNA, 22 nt, Human
cugagccagggccacacaugga

SEQ ID NO: 644189 - RNA, 22 nt, Human
uucuccuuuguaauucucaucc

SEQ ID NO: 644190 - RNA, 22 nt, Human
cucuggcuuuaaggaugccaca

SEQ ID NO: 644191 - RNA, 22 nt, Human
aggggcuccucucugagaguag

SEQ ID NO: 644192 - RNA, 19 nt, Human
gcucagagggcccugugcu

SEQ ID NO: 644193 - RNA, 23 nt, Human
uuguacagcccagauuccucuuc

SEQ ID NO: 644194 - RNA, 22 nt, Human
cuguggcauuuagagguugcgu

SEQ ID NO: 644195 - RNA, 22 nt, Human
auguuaccuuguucuccaaaaa

SEQ ID NO: 644196 - RNA, 22 nt, Human
uggcagaguucgcugugccuuu

SEQ ID NO: 644197 - RNA, 22 nt, Human
acaugcaagcagccgugcagau

SEQ ID NO: 644198 - RNA, 22 nt, Human
ccugaggucuagagucagggug

SEQ ID NO: 644199 - RNA, 23 nt, Human
gccugggacucaggaggagcuca

SEQ ID NO: 644200 - RNA, 22 nt, Human
uaugaaauuuaaacacagauca

SEQ ID NO: 644201 - RNA, 22 nt, Human
uacaugcuccuuaugagaaucu

SEQ ID NO: 644202 - RNA, 22 nt, Human
gcagcugcuggagggaggcagg

SEQ ID NO: 644203 - RNA, 22 nt, Human
acaguaacaccuacucuguccc

SEQ ID NO: 644204 - RNA, 22 nt, Human
ugaagacaguuuuacucaugag

SEQ ID NO: 644205 - RNA, 22 nt, Human
aguaacagagcauggguucaga

SEQ ID NO: 644206 - RNA, 21 nt, Human
gugaagacuuugccuuuaaga

SEQ ID NO: 644207 - RNA, 22 nt, Human
uagcaagaggugaagguuucau

SEQ ID NO: 644208 - RNA, 22 nt, Human
gcagcugcuguggcaucaagcu

SEQ ID NO: 644209 - RNA, 22 nt, Human
ugagggaggccuccaucugcca

SEQ ID NO: 644210 - RNA, 22 nt, Human
ugcugagguuguggagugcauu

SEQ ID NO: 644211 - RNA, 22 nt, Human
ugggccuggcccuguggaggag

SEQ ID NO: 644212 - RNA, 22 nt, Human
uucugcugguaacuauguuuca

SEQ ID NO: 644213 - RNA, 22 nt, Human
acuuguuuacaagcaguucuga

SEQ ID NO: 644214 - RNA, 22 nt, Human
auggcauugaguaaagucagua

SEQ ID NO: 644215 - RNA, 22 nt, Human
uacauaaugagcuaguuaaguu

SEQ ID NO: 644216 - RNA, 22 nt, Human
aagcaucucaccugcccccacg

SEQ ID NO: 644217 - RNA, 22 nt, Human
gaggcuccucauucaguaugcu

SEQ ID NO: 644218 - RNA, 22 nt, Human
ucuaauuccauuaaauugaugu

SEQ ID NO: 644219 - RNA, 22 nt, Human
auuauuauauagggaaaguccc

SEQ ID NO: 644220 - RNA, 22 nt, Human
ccuaggcuuguuuucaucagcu

SEQ ID NO: 644221 - RNA, 22 nt, Human
ugaauuguggcuuuuuccaauu

SEQ ID NO: 644222 - RNA, 22 nt, Human
auuaucucaagggauagcagau

SEQ ID NO: 644223 - RNA, 22 nt, Human
ugacaguuguauuacaugggaa

SEQ ID NO: 644224 - RNA, 22 nt, Human
gagggcucuacucaccacccug

SEQ ID NO: 644225 - RNA, 22 nt, Human
aaagacauggaacuagagaugg

SEQ ID NO: 644226 - RNA, 22 nt, Human
cccauuuaucccaagguuacuc

SEQ ID NO: 644227 - RNA, 22 nt, Human
ucaagagagugcugcuuggggu

SEQ ID NO: 644228 - RNA, 22 nt, Human
gugaccauuugacauauccuug

SEQ ID NO: 644229 - RNA, 22 nt, Human
uacagacauucaauuuugaccc

SEQ ID NO: 644230 - RNA, 22 nt, Human
agagucugaggaggaccaacag

SEQ ID NO: 644231 - RNA, 22 nt, Human
aggaaaggauuggcuucucugu

SEQ ID NO: 644232 - RNA, 17 nt, Human
ucuggaugucauggaag

SEQ ID NO: 644233 - RNA, 21 nt, Human
acuuggcagaacgcagaaggc

SEQ ID NO: 644234 - RNA, 22 nt, Human
uuucacauggacuuuuuguucu

SEQ ID NO: 644235 - RNA, 19 nt, Human
gcugcugcuccucccucgc

SEQ ID NO: 644236 - RNA, 22 nt, Human
caacauuugugaugagcaaacu

SEQ ID NO: 644237 - RNA, 22 nt, Human
uagugugguaucuucuauggaa

SEQ ID NO: 644238 - RNA, 22 nt, Human
agggugcagaacaaauuaagac

SEQ ID NO: 644239 - RNA, 19 nt, Human
cugucugguucauguguuc

SEQ ID NO: 644240 - RNA, 22 nt, Human
cagggccuguacaagucccacc

SEQ ID NO: 644241 - RNA, 22 nt, Human
cagcccgucacacgcuagcauc

SEQ ID NO: 644242 - RNA, 21 nt, Human
ucuuuacauuugccucuugca

SEQ ID NO: 644243 - RNA, 22 nt, Human
gaguuaaauauuuucugaaguu

SEQ ID NO: 644244 - RNA, 22 nt, Human
aguuuuauguagacaauucauu

SEQ ID NO: 644245 - RNA, 22 nt, Human
gugcagagugucuguggacuga

SEQ ID NO: 644246 - RNA, 22 nt, Human
agcagccacagcagaucugagu

SEQ ID NO: 644247 - RNA, 22 nt, Human
aaaugcacgcuacccagcuaga

SEQ ID NO: 644248 - RNA, 20 nt, Human
cugacagaaaauauuucauc

SEQ ID NO: 644249 - RNA, 22 nt, Human
agcuuuaugcuuccuacaagcu

SEQ ID NO: 644250 - RNA, 22 nt, Human
gacaugucggauagaaugaguu

SEQ ID NO: 644251 - RNA, 22 nt, Human
agcagaugaaucccagauaaag

SEQ ID NO: 644252 - RNA, 22 nt, Human
cugccagggcauccuguggugg

SEQ ID NO: 644253 - RNA, 22 nt, Human
gggcucuguggaugugagagcu

SEQ ID NO: 644254 - RNA, 22 nt, Human
ggggcugcucccaccccugagg

SEQ ID NO: 644255 - RNA, 22 nt, Human
gaaacuuacuuacucacauuuc

SEQ ID NO: 644256 - RNA, 22 nt, Human
aggucgaguuucggggcuacuu

SEQ ID NO: 644257 - RNA, 21 nt, Human
ggcaagaaacacaaucaagua

SEQ ID NO: 644258 - RNA, 22 nt, Human
gaaaggucuuccggucuuccag

SEQ ID NO: 644259 - RNA, 22 nt, Human
augaagaaacuguucugggugg

SEQ ID NO: 644260 - RNA, 22 nt, Human
acccucaggcagaauguauucu

SEQ ID NO: 644261 - RNA, 21 nt, Human
agccugcaauguagguaccgg

SEQ ID NO: 644262 - RNA, 22 nt, Human
cacagugauugauuuuuacuuu

SEQ ID NO: 644263 - RNA, 22 nt, Human
aggacaugaagaaagggcaagg

SEQ ID NO: 644264 - RNA, 23 nt, Human
ccuguggcaaguagaugagauga

SEQ ID NO: 644265 - RNA, 22 nt, Human
gcagagcucaugccugcaccuc

SEQ ID NO: 644266 - RNA, 22 nt, Human
guuuccuagaucaguguucuua

SEQ ID NO: 644267 - RNA, 22 nt, Human
aauaaauguuaagauugucuca

SEQ ID NO: 644268 - RNA, 22 nt, Human
ucuccuccuuuuuucaacauag

SEQ ID NO: 644269 - RNA, 22 nt, Human
acuguauucuagucauguuugu

SEQ ID NO: 644270 - RNA, 22 nt, Human
gacaaagcagacaagauaauuc

SEQ ID NO: 644271 - RNA, 22 nt, Human
aggaaagcucccaguagggcuc

SEQ ID NO: 644272 - RNA, 22 nt, Human
agggccagcagcuuggccaacc

SEQ ID NO: 644273 - RNA, 22 nt, Human
augauggaugucacagucugua

SEQ ID NO: 644274 - RNA, 20 nt, Human
cagcugccuggcucugggau

SEQ ID NO: 644275 - RNA, 22 nt, Human
ugcucugguccucccucggcgc

SEQ ID NO: 644276 - RNA, 22 nt, Human
gcucaggcaggagugcaguggc

SEQ ID NO: 644277 - RNA, 17 nt, Human
agaaacugaggcucagu

SEQ ID NO: 644278 - RNA, 22 nt, Human
guacaaaugagaguucuguuuu

SEQ ID NO: 644279 - RNA, 19 nt, Human
ugagacagagaccaguucu

SEQ ID NO: 644280 - RNA, 22 nt, Human
aaggcuuuuaacuacuguuuua

SEQ ID NO: 644281 - RNA, 22 nt, Human
gcuucagagauuucacuaguuu

SEQ ID NO: 644282 - RNA, 22 nt, Human
cccaggccagaacuugguugcu

SEQ ID NO: 644283 - RNA, 22 nt, Human
cagcccagugcauuuguguacu

SEQ ID NO: 644284 - RNA, 22 nt, Human
uagaggugagccaucaaggggc

SEQ ID NO: 644285 - RNA, 22 nt, Human
aaacaggcaucacucagcaaag

SEQ ID NO: 644286 - RNA, 22 nt, Human
aagggcagggaguuugugucua

SEQ ID NO: 644287 - RNA, 22 nt, Human
gcagaggucaaauaccucauuu

SEQ ID NO: 644288 - RNA, 22 nt, Human
guggcugagcagcagagagcug

SEQ ID NO: 644289 - RNA, 22 nt, Human
cagggcacuuaaauugccucgu

SEQ ID NO: 644290 - RNA, 22 nt, Human
cuggucaggggauggggcucag

SEQ ID NO: 644291 - RNA, 22 nt, Human
gguugguaacucccugugcagu

SEQ ID NO: 644292 - RNA, 22 nt, Human
guggagacgggacagaagcuaa

SEQ ID NO: 644293 - RNA, 22 nt, Human
gcccagugcccuagaaugcacu

SEQ ID NO: 644294 - RNA, 22 nt, Human
acacccagcuuuugaaugcccu

SEQ ID NO: 644295 - RNA, 22 nt, Human
aauucugcucuuaacauaaugu

SEQ ID NO: 644296 - RNA, 22 nt, Human
aagccaggaagggagcuguccc

SEQ ID NO: 644297 - RNA, 22 nt, Human
ugcauuuauuugaauugaucua

SEQ ID NO: 644298 - RNA, 22 nt, Human
gucuaaacaaaaaugcaccuuu

SEQ ID NO: 644299 - RNA, 22 nt, Human
uugcccaccuuagucuucagac

SEQ ID NO: 644300 - RNA, 22 nt, Human
ugauugaacugagcuucaagau

SEQ ID NO: 644301 - RNA, 22 nt, Human
acccaggaugauaauguucaca

SEQ ID NO: 644302 - RNA, 22 nt, Human
caggcacaagaagcaaauguua

SEQ ID NO: 644303 - RNA, 22 nt, Human
uuaaaucaggcaucauuucagu

SEQ ID NO: 644304 - RNA, 22 nt, Human
ucuggcagcagcaucaguggcu

SEQ ID NO: 644305 - RNA, 22 nt, Human
acauuucugcauguaggguaau

SEQ ID NO: 644306 - RNA, 22 nt, Human
aagcuggacacugacccacugu

SEQ ID NO: 644307 - RNA, 22 nt, Human
uuugaaugagaauuauugucau

SEQ ID NO: 644308 - RNA, 22 nt, Human
uggcugggccgggccuugugcc

SEQ ID NO: 644309 - RNA, 22 nt, Human
ugcccugcugugccuggagcca

SEQ ID NO: 644310 - RNA, 22 nt, Human
acacagaguuugacacauggga

SEQ ID NO: 644311 - RNA, 22 nt, Human
gcaguuauguauguguuugaga

SEQ ID NO: 644312 - RNA, 22 nt, Human
aaucugucuucuuuugugguuu

SEQ ID NO: 644313 - RNA, 22 nt, Human
uagggcaauauuucccagaaaa

SEQ ID NO: 644314 - RNA, 22 nt, Human
ugcuccaggagcaaccuuugag

SEQ ID NO: 644315 - RNA, 22 nt, Human
cgggagcacgggaggcggagcu

SEQ ID NO: 644316 - RNA, 22 nt, Human
cucagggggaaucaggucacag

SEQ ID NO: 644317 - RNA, 22 nt, Human
aaaccuuuucagcugaauggag

SEQ ID NO: 644318 - RNA, 22 nt, Human
cauuuaauccauagaggaaugu

SEQ ID NO: 644319 - RNA, 22 nt, Human
uuucacagcagaauuucugagg

SEQ ID NO: 644320 - RNA, 22 nt, Human
cagcacaguguuagguaauuug

SEQ ID NO: 644321 - RNA, 22 nt, Human
uugacacaaacagugauguagu

SEQ ID NO: 644322 - RNA, 22 nt, Human
ugauuuuuggaucugagcugca

SEQ ID NO: 644323 - RNA, 22 nt, Human
ucugggcuuuacacugugcuua

SEQ ID NO: 644324 - RNA, 22 nt, Human
auuuguaucuucuaauauuauc

SEQ ID NO: 644325 - RNA, 22 nt, Human
ugugugccccagaugaguagcu

SEQ ID NO: 644326 - RNA, 22 nt, Human
cagcuauagauggacugaagag

SEQ ID NO: 644327 - RNA, 22 nt, Human
ucugcacagagacccuugccag

SEQ ID NO: 644328 - RNA, 22 nt, Human
uuuucauuguuacuaugagcua

SEQ ID NO: 644329 - RNA, 19 nt, Human
uucucuauuaugucuucuc

SEQ ID NO: 644330 - RNA, 22 nt, Human
ucugcuuucuugcgcagaugug

SEQ ID NO: 644331 - RNA, 22 nt, Human
gccuucaguaguauccucauga

SEQ ID NO: 644332 - RNA, 22 nt, Human
gucagugugaguugauuccaua

SEQ ID NO: 644333 - RNA, 22 nt, Human
agacccuugcagucugguuguc

SEQ ID NO: 644334 - RNA, 18 nt, Human
uggguggcuagggaguuu

SEQ ID NO: 644335 - RNA, 22 nt, Human
ucagaacagcucucagauaucc

SEQ ID NO: 644336 - RNA, 22 nt, Human
aguucaaagcugcaguaaugga

SEQ ID NO: 644337 - RNA, 17 nt, Human
accaaugucagacaaag

SEQ ID NO: 644338 - RNA, 20 nt, Human
cagagcuguuauggaugaug

SEQ ID NO: 644339 - RNA, 22 nt, Human
ucagcugcucaaauuuauguca

SEQ ID NO: 644340 - RNA, 22 nt, Human
ggcuguggggccggguacagug

SEQ ID NO: 644341 - RNA, 22 nt, Human
cacaccagauggcagcguggga

SEQ ID NO: 644342 - RNA, 22 nt, Human
uugggggguugaggaguagaua

SEQ ID NO: 644343 - RNA, 22 nt, Human
ccauugaaccccucuaggccac

SEQ ID NO: 644344 - RNA, 22 nt, Human
ugauucuguaagucauauuguu

SEQ ID NO: 644345 - RNA, 18 nt, Human
acuggcuuuagcaucaga

SEQ ID NO: 644346 - RNA, 22 nt, Human
cagggccccagggaugucugcu

SEQ ID NO: 644347 - RNA, 22 nt, Human
guuaucuucuauuucucauacu

SEQ ID NO: 644348 - RNA, 22 nt, Human
accucuuugaaccucaguguga

SEQ ID NO: 644349 - RNA, 22 nt, Human
aucugcuguguguaauggaaug

SEQ ID NO: 644350 - RNA, 22 nt, Human
ucauugcagaaauaaaggugaa

SEQ ID NO: 644351 - RNA, 22 nt, Human
uuuaaucuucaaaauagucuua

SEQ ID NO: 644352 - RNA, 17 nt, Human
gcagccagugcagcagg

SEQ ID NO: 644353 - RNA, 22 nt, Human
ugcuccagggcugccagacccu

SEQ ID NO: 644354 - RNA, 22 nt, Human
aacacagaagugccaagagcca

SEQ ID NO: 644355 - RNA, 22 nt, Human
cuccugagggaugcuuaggcuu

SEQ ID NO: 644356 - RNA, 22 nt, Human
uaugugcauuauuaccagugga

SEQ ID NO: 644357 - RNA, 22 nt, Human
agaagacagagucuacauucua

SEQ ID NO: 644358 - RNA, 22 nt, Human
guugggaagcagauggaugagc

SEQ ID NO: 644359 - RNA, 22 nt, Human
agcuccugcuugacagaagagg

SEQ ID NO: 644360 - RNA, 22 nt, Human
aagauuuucagugccuaaaaca

SEQ ID NO: 644361 - RNA, 22 nt, Human
acaguguuuggcaaugcaugca

SEQ ID NO: 644362 - RNA, 22 nt, Human
uguauuccaaaaugcugaggau

SEQ ID NO: 644363 - RNA, 22 nt, Human
auuauaaauauuuucuaggggu

SEQ ID NO: 644364 - RNA, 22 nt, Human
uuucucugaggcuggccucccu

SEQ ID NO: 644365 - RNA, 22 nt, Human
cagccagcuggcacugugagua

SEQ ID NO: 644366 - RNA, 19 nt, Human
caagauuuguucacacaug

SEQ ID NO: 644367 - RNA, 22 nt, Human
aggugcagcugguggagucugg

SEQ ID NO: 644368 - RNA, 22 nt, Human
augcagauguuccuacuguguu

SEQ ID NO: 644369 - RNA, 22 nt, Human
aggcaggucacaugcuuggcga

SEQ ID NO: 644370 - RNA, 22 nt, Human
ggcccagccggcgagucucgcg

SEQ ID NO: 644371 - RNA, 22 nt, Human
ucagguaaguguaauauauaga

SEQ ID NO: 644372 - RNA, 22 nt, Human
guccugagcccucagcacagca

SEQ ID NO: 644373 - RNA, 22 nt, Human
gcuggccugagggccgaggcuc

SEQ ID NO: 644374 - RNA, 22 nt, Human
ggagcagccuguguagacgggg

SEQ ID NO: 644375 - RNA, 23 nt, Human
cauguacacacagcuguacagug

SEQ ID NO: 644376 - RNA, 22 nt, Human
gaagaacugacaaacuagauca

SEQ ID NO: 644377 - RNA, 22 nt, Human
acagggcuuguugaaagcggag

SEQ ID NO: 644378 - RNA, 22 nt, Human
ggcuggcuuucucuccgcaccu

SEQ ID NO: 644379 - RNA, 22 nt, Human
ugccuguguccccuucuuggca

SEQ ID NO: 644380 - RNA, 22 nt, Human
gcuccuccaauauggacuccuc

SEQ ID NO: 644381 - RNA, 19 nt, Human
agacacaucacauuucucc

SEQ ID NO: 644382 - RNA, 20 nt, Human
uauuacacacaaugagcagu

SEQ ID NO: 644383 - RNA, 22 nt, Human
agugcacuggcaccaucucagc

SEQ ID NO: 644384 - RNA, 22 nt, Human
ucugggucuuuacccauggaau

SEQ ID NO: 644385 - RNA, 22 nt, Human
aggcagugccuggaccccagcu

SEQ ID NO: 644386 - RNA, 19 nt, Human
ucuagcaacccacugcaug

SEQ ID NO: 644387 - RNA, 22 nt, Human
ggacaggccgccucgguggggg

SEQ ID NO: 644388 - RNA, 22 nt, Human
cagggcaggaugcugugauuau

SEQ ID NO: 644389 - RNA, 22 nt, Human
uguguaaaagauuaguuuacua

SEQ ID NO: 644390 - RNA, 22 nt, Human
cucccaggggagucaucugcuu

SEQ ID NO: 644391 - RNA, 22 nt, Human
agagcugcccacacagcagauu

SEQ ID NO: 644392 - RNA, 20 nt, Human
ugggcagcacugcuggcugg

SEQ ID NO: 644393 - RNA, 22 nt, Human
guagggcaacaugggcacuagg

SEQ ID NO: 644394 - RNA, 22 nt, Human
ugagccagccuugcagcugugc

SEQ ID NO: 644395 - RNA, 19 nt, Human
cagugcuguucauucagug

SEQ ID NO: 644396 - RNA, 22 nt, Human
gcagggcuguaauuugagccug

SEQ ID NO: 644397 - RNA, 22 nt, Human
gcuucaugcuugcuccaaagcu

SEQ ID NO: 644398 - RNA, 23 nt, Human
cauggaaaacugaaagcugaccu

SEQ ID NO: 644399 - RNA, 22 nt, Human
gcuuuaugcaaaccugguacuu

SEQ ID NO: 644400 - RNA, 22 nt, Human
agccggccauguggucuugugc

SEQ ID NO: 644401 - RNA, 22 nt, Human
cucucccuggccagcugugcag

SEQ ID NO: 644402 - RNA, 22 nt, Human
accaugccaguggcagccagac

SEQ ID NO: 644403 - RNA, 22 nt, Human
agcugggacagacaacuauguu

SEQ ID NO: 644404 - RNA, 22 nt, Human
cuauucuguguauuuacuggcu

SEQ ID NO: 644405 - RNA, 22 nt, Human
uuucagauggagguuuaggaca

SEQ ID NO: 644406 - RNA, 22 nt, Human
ggugggguauuugguacuugua

SEQ ID NO: 644407 - RNA, 22 nt, Human
uuaaaugagauguucagauauu

SEQ ID NO: 644408 - RNA, 22 nt, Human
ggucuggccucgggcaccccca

SEQ ID NO: 644409 - RNA, 22 nt, Human
uuguauucauugcuuacccaau

SEQ ID NO: 644410 - RNA, 22 nt, Human
guucacagcaaaccuaugaacu

SEQ ID NO: 644411 - RNA, 22 nt, Human
cuucacacccacuaaaaugaug

SEQ ID NO: 644412 - RNA, 22 nt, Human
aaugacuuugaaauauuugagu

SEQ ID NO: 644413 - RNA, 22 nt, Human
uugguuuguucaccaucaagca

SEQ ID NO: 644414 - RNA, 22 nt, Human
aaaggaauauucaaaacaguca

SEQ ID NO: 644415 - RNA, 22 nt, Human
gagagggagccagccaggaacc

SEQ ID NO: 644416 - RNA, 21 nt, Human
auccuauuucugaaaaccugc

SEQ ID NO: 644417 - RNA, 22 nt, Human
aaugucaaaggcuauacauuca

SEQ ID NO: 644418 - RNA, 22 nt, Human
gagcuagguugagacucacuua

SEQ ID NO: 644419 - RNA, 22 nt, Human
uuaguagaauguuauagcaauu

SEQ ID NO: 644420 - RNA, 20 nt, Human
uucaaguugggucucuggcu

SEQ ID NO: 644421 - RNA, 22 nt, Human
guucuucaucauuaacacucug

SEQ ID NO: 644422 - RNA, 22 nt, Human
gggucagaguucaggucgaggg

SEQ ID NO: 644423 - RNA, 22 nt, Human
uccagugguuugaaaggggugu

SEQ ID NO: 644424 - RNA, 22 nt, Human
aagugguuuuaagagguuccuu

SEQ ID NO: 644425 - RNA, 22 nt, Human
gcuuaaaguuguaaauuagaga

SEQ ID NO: 644426 - RNA, 22 nt, Human
gccuccugacuuacacugagcu

SEQ ID NO: 644427 - RNA, 22 nt, Human
caagagcuacccugugccauau

SEQ ID NO: 644428 - RNA, 22 nt, Human
aguucacauaucuguuuuauuu

SEQ ID NO: 644429 - RNA, 22 nt, Human
augacacauaaaacaaggacug

SEQ ID NO: 644430 - RNA, 22 nt, Human
acauucuucagcuuugucaggc

SEQ ID NO: 644431 - RNA, 22 nt, Human
gggaaggcagugggaggaacug

SEQ ID NO: 644432 - RNA, 22 nt, Human
uacugaagcaccauuaaagaca

SEQ ID NO: 644433 - RNA, 22 nt, Human
gcuguggggagagaacacacaa

SEQ ID NO: 644434 - RNA, 22 nt, Human
agcccagcacugggggcccagc

SEQ ID NO: 644435 - RNA, 22 nt, Human
uuagccauuaaauuacaaggug

SEQ ID NO: 644436 - RNA, 22 nt, Human
uauuugaaggcauacauuuuga

SEQ ID NO: 644437 - RNA, 22 nt, Human
ccucagcucccaugagaucugc

SEQ ID NO: 644438 - RNA, 22 nt, Human
aaguugauuuaaacuacuaguc

SEQ ID NO: 644439 - RNA, 22 nt, Human
ugggaagauaugagugaccaac

SEQ ID NO: 644440 - RNA, 22 nt, Human
aggcuggaaagggaccagagug

SEQ ID NO: 644441 - RNA, 23 nt, Human
uuuggcauguuaacuucacuuac

SEQ ID NO: 644442 - RNA, 22 nt, Human
auuuccaagaaagcuuuaggau

SEQ ID NO: 644443 - RNA, 21 nt, Human
caguauuuuaagcagugaguu

SEQ ID NO: 644444 - RNA, 22 nt, Human
gugugggcagggccgugcuccc

SEQ ID NO: 644445 - RNA, 22 nt, Human
uacuucaaacaaugguacaaac

SEQ ID NO: 644446 - RNA, 22 nt, Human
gagagaagggggauaugagccu

SEQ ID NO: 644447 - RNA, 22 nt, Human
agcccaggagguggagguugca

SEQ ID NO: 644448 - RNA, 22 nt, Human
ggcugggccgcggcuacccaga

SEQ ID NO: 644449 - RNA, 22 nt, Human
caggccugaguguggaagucuu

SEQ ID NO: 644450 - RNA, 22 nt, Human
acagugacacucaggugggaug

SEQ ID NO: 644451 - RNA, 21 nt, Human
aaaugcuuuguauauaucugu

SEQ ID NO: 644452 - RNA, 22 nt, Human
uucuggcuuuaggcuuuucaag

SEQ ID NO: 644453 - RNA, 22 nt, Human
uagaaacugauagucuugugcu

SEQ ID NO: 644454 - RNA, 22 nt, Human
uucacaggauauaugugcaggg

SEQ ID NO: 644455 - RNA, 22 nt, Human
ugccucauaacacuccuggagu

SEQ ID NO: 644456 - RNA, 22 nt, Human
cagggcucaucugugugaccag

SEQ ID NO: 644457 - RNA, 22 nt, Human
ugggaagagggguauaaagaag

SEQ ID NO: 644458 - RNA, 22 nt, Human
ucaugucaguuucuucuauaaa

SEQ ID NO: 644459 - RNA, 22 nt, Human
cauaaaguaggcaagcauucca

SEQ ID NO: 644460 - RNA, 22 nt, Human
uccugagggcucggggcucaug

SEQ ID NO: 644461 - RNA, 22 nt, Human
ugucagggauuuaaagacacaa

SEQ ID NO: 644462 - RNA, 22 nt, Human
aaacugaaguagauucugaaau

SEQ ID NO: 644463 - RNA, 22 nt, Human
uucuucugaaacauaaucaaua

SEQ ID NO: 644464 - RNA, 22 nt, Human
agaugauauacuacauggcuuc

SEQ ID NO: 644465 - RNA, 22 nt, Human
agagccuugcucuaaauuucuc

SEQ ID NO: 644466 - RNA, 20 nt, Human
gcccaggaauuugcauuucu

SEQ ID NO: 644467 - RNA, 23 nt, Human
cucuccaccuucccacccaggga

SEQ ID NO: 644468 - RNA, 22 nt, Human
acaguguucuuggcgcugagug

SEQ ID NO: 644469 - RNA, 22 nt, Human
cccucuggcucuucucaggccg

SEQ ID NO: 644470 - RNA, 22 nt, Human
augauuuuucagcagaggaucu

SEQ ID NO: 644471 - RNA, 22 nt, Human
uggucugauagucugaaaauga

SEQ ID NO: 644472 - RNA, 22 nt, Human
acccaggaggcaagguugcagu

SEQ ID NO: 644473 - RNA, 22 nt, Human
gcggagggcgagcccgcggagc

SEQ ID NO: 644474 - RNA, 22 nt, Human
aauuuccaaauuucugucacac

SEQ ID NO: 644475 - RNA, 22 nt, Human
guggaaugaauagauuugcauu

SEQ ID NO: 644476 - RNA, 22 nt, Human
uucucucugagagcaucuggaa

SEQ ID NO: 644477 - RNA, 19 nt, Human
agaaucaucuugaagugau

SEQ ID NO: 644478 - RNA, 22 nt, Human
ugauuguaugauugaaauauuu

SEQ ID NO: 644479 - RNA, 22 nt, Human
acucuuauuuugaaguaauaau

SEQ ID NO: 644480 - RNA, 22 nt, Human
caugcuaagucauaaaagagua

SEQ ID NO: 644481 - RNA, 22 nt, Human
augcuaaauccagaagcaguca

SEQ ID NO: 644482 - RNA, 22 nt, Human
uucugugugccagaguugugcu

SEQ ID NO: 644483 - RNA, 22 nt, Human
cuuugcuuacuggugucugcau

SEQ ID NO: 644484 - RNA, 22 nt, Human
ccauggcauuuuaugugucuua

SEQ ID NO: 644485 - RNA, 22 nt, Human
uguggcagggauacugaggcag

SEQ ID NO: 644486 - RNA, 22 nt, Human
cugcaggggccucgagcacagg

SEQ ID NO: 644487 - RNA, 22 nt, Human
cugggaguguucuaggucacau

SEQ ID NO: 644488 - RNA, 22 nt, Human
agcucugggcugacaugcuccc

SEQ ID NO: 644489 - RNA, 22 nt, Human
uuuagggaauagaagaucugaa

SEQ ID NO: 644490 - RNA, 23 nt, Human
uaauucacauauacauugcuuca

SEQ ID NO: 644491 - RNA, 22 nt, Human
aagacacugggggcugcagcca

SEQ ID NO: 644492 - RNA, 22 nt, Human
gcagcuuggugaaaggugaugg

SEQ ID NO: 644493 - RNA, 22 nt, Human
agggugcagaaggagccuagga

SEQ ID NO: 644494 - RNA, 20 nt, Human
auacacauauucuugcaacu

SEQ ID NO: 644495 - RNA, 22 nt, Human
uccuucagaaccugugauggaa

SEQ ID NO: 644496 - RNA, 22 nt, Human
gcugggcuggaaggccaaggca

SEQ ID NO: 644497 - RNA, 22 nt, Human
ccucuguggucugucuaaugca

SEQ ID NO: 644498 - RNA, 22 nt, Human
ugucacaugaagccaacauagc

SEQ ID NO: 644499 - RNA, 18 nt, Human
gggaucaggcugccuagg

SEQ ID NO: 644500 - RNA, 22 nt, Human
aaccugagauacuggucuuuau

SEQ ID NO: 644501 - RNA, 22 nt, Human
gagggccagccugccaagggcc

SEQ ID NO: 644502 - RNA, 22 nt, Human
agugggccaaauggaggcaagu

SEQ ID NO: 644503 - RNA, 22 nt, Human
cauuuuacugacucuugaauua

SEQ ID NO: 644504 - RNA, 22 nt, Human
guacacacuguuugaucauuuc

SEQ ID NO: 644505 - RNA, 22 nt, Human
gcacugggaagaaugagccugu

SEQ ID NO: 644506 - RNA, 22 nt, Human
gaaugacauugagccauaacau

SEQ ID NO: 644507 - RNA, 22 nt, Human
gccaccaggagcccaguccaaa

SEQ ID NO: 644508 - RNA, 22 nt, Human
guauuucaucuugaaaaccagu

SEQ ID NO: 644509 - RNA, 22 nt, Human
gucugaggaagaugcaggggga

SEQ ID NO: 644510 - RNA, 22 nt, Human
uccagggcuugacagggugccu

SEQ ID NO: 644511 - RNA, 22 nt, Human
auagcaaaggacaauagucagu

SEQ ID NO: 644512 - RNA, 22 nt, Human
cagaaaccugucuggaguggga

SEQ ID NO: 644513 - RNA, 22 nt, Human
uggucugacuugcuuuggacag

SEQ ID NO: 644514 - RNA, 22 nt, Human
ccucucuuuccuacaccuugga

SEQ ID NO: 644515 - RNA, 22 nt, Human
acucaggaagaaagcagcuggu

SEQ ID NO: 644516 - RNA, 22 nt, Human
agcagagccaggucucucugua

SEQ ID NO: 644517 - RNA, 22 nt, Human
gaaguacaaaggacauggaaac

SEQ ID NO: 644518 - RNA, 18 nt, Human
ggagccagucugucucug

SEQ ID NO: 644519 - RNA, 22 nt, Human
gcccagggugaagugcaguugu

SEQ ID NO: 644520 - RNA, 22 nt, Human
agcucuuacauuuaggucuaug

SEQ ID NO: 644521 - RNA, 19 nt, Human
gcaggguggcagagcucuu

SEQ ID NO: 644522 - RNA, 22 nt, Human
cuuccuugcggccccugccuag

SEQ ID NO: 644523 - RNA, 22 nt, Human
uccaaaggcaaaacuguggugu

SEQ ID NO: 644524 - RNA, 20 nt, Human
cuuugguggggguagcccag

SEQ ID NO: 644525 - RNA, 22 nt, Human
uggcaggauuugcccggaagga

SEQ ID NO: 644526 - RNA, 22 nt, Human
agcaguggccuggggcucugug

SEQ ID NO: 644527 - RNA, 22 nt, Human
agcagcaugaugacagagucuc

SEQ ID NO: 644528 - RNA, 22 nt, Human
aauauaaugcuguuuuaugcca

SEQ ID NO: 644529 - RNA, 22 nt, Human
ugcauuuauaaaauguucgugg

SEQ ID NO: 644530 - RNA, 20 nt, Human
cucuuuucacucucaguggu

SEQ ID NO: 644531 - RNA, 22 nt, Human
uaagaaacauuuuuaugacagu

SEQ ID NO: 644532 - RNA, 22 nt, Human
uuauuucccugaggguugcagg

SEQ ID NO: 644533 - RNA, 22 nt, Human
uuugccugggaauucuagugua

SEQ ID NO: 644534 - RNA, 22 nt, Human
aaggccaggccagaugacaguc

SEQ ID NO: 644535 - RNA, 22 nt, Human
gucuguaauuauuaaagaaagg

SEQ ID NO: 644536 - RNA, 22 nt, Human
uggacagcaaacauggagagaa

SEQ ID NO: 644537 - RNA, 22 nt, Human
gcugucccgcugacuuccagcu

SEQ ID NO: 644538 - RNA, 22 nt, Human
uagcuucagggaaaccacugcu

SEQ ID NO: 644539 - RNA, 22 nt, Human
uguacacaaugauaaauuauua

SEQ ID NO: 644540 - RNA, 22 nt, Human
augggcugagaaucaagaauau

SEQ ID NO: 644541 - RNA, 22 nt, Human
gcucucugccuuucucaaugac

SEQ ID NO: 644542 - RNA, 22 nt, Human
cccaucacagacacuggguuau

SEQ ID NO: 644543 - RNA, 22 nt, Human
uagaaaugaauguuuaaaaguc

SEQ ID NO: 644544 - RNA, 22 nt, Human
gugcccuccguguucauagagc

SEQ ID NO: 644545 - RNA, 22 nt, Human
aacauugcaaauaagcuugcag

SEQ ID NO: 644546 - RNA, 22 nt, Human
uccguauuugacuauugcaccg

SEQ ID NO: 644547 - RNA, 22 nt, Human
auucucagggaguauuuucuau

SEQ ID NO: 644548 - RNA, 22 nt, Human
ugcuggaaauauauuuguuuau

SEQ ID NO: 644549 - RNA, 22 nt, Human
cuucccagacgggguggcagcc

SEQ ID NO: 644550 - RNA, 22 nt, Human
cuucuagauuuuuguaauuguu

SEQ ID NO: 644551 - RNA, 22 nt, Human
auggacagggcacaggcgcaga

SEQ ID NO: 644552 - RNA, 22 nt, Human
ccagaggcuggguucaccucag

SEQ ID NO: 644553 - RNA, 22 nt, Human
ggguagcaugugucagaguuug

SEQ ID NO: 644554 - RNA, 22 nt, Human
gcaccagcugccuucugugccc

SEQ ID NO: 644555 - RNA, 22 nt, Human
cuguauuucuuggacaguugcu

SEQ ID NO: 644556 - RNA, 22 nt, Human
aggaauguuaagaaggucuacc

SEQ ID NO: 644557 - RNA, 23 nt, Human
ucugggcugcuuaaggaucaagg

SEQ ID NO: 644558 - RNA, 22 nt, Human
uggaagcggugcuggcccaugg

SEQ ID NO: 644559 - RNA, 17 nt, Human
gcccucagcuuuaacca

SEQ ID NO: 644560 - RNA, 22 nt, Human
agcucaggucauuccagggaug

SEQ ID NO: 644561 - RNA, 22 nt, Human
agaagcagcuuucaaggugauu

SEQ ID NO: 644562 - RNA, 22 nt, Human
ccagccuggggaggcagcuucu

SEQ ID NO: 644563 - RNA, 22 nt, Human
aguucuaagaugcuccacagag

SEQ ID NO: 644564 - RNA, 22 nt, Human
aagccaguguggucugcccauu

SEQ ID NO: 644565 - RNA, 22 nt, Human
uccuucagggcugaccacaggc

SEQ ID NO: 644566 - RNA, 17 nt, Human
aagagaggcugagcugg

SEQ ID NO: 644567 - RNA, 22 nt, Human
aauagcagaagacuaguagaca

SEQ ID NO: 644568 - RNA, 20 nt, Human
uacuucugaggcacucugaa

SEQ ID NO: 644569 - RNA, 22 nt, Human
caggcaggugcagauuccucuu

SEQ ID NO: 644570 - RNA, 23 nt, Human
ucagcagcagaagugcugggaug

SEQ ID NO: 644571 - RNA, 22 nt, Human
ggagguggagguugcaaugagc

SEQ ID NO: 644572 - RNA, 22 nt, Human
gccuggcaggccugggccagca

SEQ ID NO: 644573 - RNA, 22 nt, Human
cccacagggcugcugauggcag

SEQ ID NO: 644574 - RNA, 22 nt, Human
aaugcauucuuucauggaccug

SEQ ID NO: 644575 - RNA, 22 nt, Human
agcagggcuccugaaagccgcg

SEQ ID NO: 644576 - RNA, 22 nt, Human
ggacaagccugugaguggguuu

SEQ ID NO: 644577 - RNA, 22 nt, Human
cuuguuuucuaaaacaucauuu

SEQ ID NO: 644578 - RNA, 22 nt, Human
augaagaugugaaggcuggauu

SEQ ID NO: 644579 - RNA, 22 nt, Human
agcaccauugcaaauauggcag

SEQ ID NO: 644580 - RNA, 22 nt, Human
auauacacagagcuuaugguga

SEQ ID NO: 644581 - RNA, 22 nt, Human
ccugccugcggcccgcggggag

SEQ ID NO: 644582 - RNA, 20 nt, Human
auguaugcaaaugucuucca

SEQ ID NO: 644583 - RNA, 22 nt, Human
gaaggaaaggucucaugccuuu

SEQ ID NO: 644584 - RNA, 22 nt, Human
uguguuuuaaauggaaauuuga

SEQ ID NO: 644585 - RNA, 22 nt, Human
agcaguuuuuauaacacuggaa

SEQ ID NO: 644586 - RNA, 22 nt, Human
uggcccuggcugaguuagauuu

SEQ ID NO: 644587 - RNA, 22 nt, Human
ugcaaauauuccaugcuguuca

SEQ ID NO: 644588 - RNA, 18 nt, Human
gcagcugacacuggaguu

SEQ ID NO: 644589 - RNA, 22 nt, Human
cuccagcuucccucagcugugg

SEQ ID NO: 644590 - RNA, 22 nt, Human
uaguaaacagcucugccacaau

SEQ ID NO: 644591 - RNA, 22 nt, Human
ugagcagagaugacugggcauu

SEQ ID NO: 644592 - RNA, 22 nt, Human
aaggcagccucugccagccggg

SEQ ID NO: 644593 - RNA, 22 nt, Human
gcauuuggaacuugguugagau

SEQ ID NO: 644594 - RNA, 20 nt, Human
gccaugaggggaggugacug

SEQ ID NO: 644595 - RNA, 22 nt, Human
guagugcuuucaucuggagugu

SEQ ID NO: 644596 - RNA, 22 nt, Human
ggcugagaguggaucccaggga

SEQ ID NO: 644597 - RNA, 22 nt, Human
gcugggaagaacaggagagaau

SEQ ID NO: 644598 - RNA, 22 nt, Human
uaccuuuugcuuauuaugacac

SEQ ID NO: 644599 - RNA, 22 nt, Human
gagguagccacagauagagacu

SEQ ID NO: 644600 - RNA, 22 nt, Human
gcacaacaccaagggagguauc

SEQ ID NO: 644601 - RNA, 22 nt, Human
uccugcagguggaugauucucu

SEQ ID NO: 644602 - RNA, 18 nt, Human
ucucuugcaucuucugua

SEQ ID NO: 644603 - RNA, 22 nt, Human
ugucucugaaauauguggcucc

SEQ ID NO: 644604 - RNA, 19 nt, Human
ccuggccagacuucugccc

SEQ ID NO: 644605 - RNA, 22 nt, Human
acuuccagcaccucaagcggaa

SEQ ID NO: 644606 - RNA, 22 nt, Human
acuucagagaaagagggaauuc

SEQ ID NO: 644607 - RNA, 22 nt, Human
ucuuuguaagaaauucuuccgu

SEQ ID NO: 644608 - RNA, 22 nt, Human
aagagcuggaugaagaaaucaa

SEQ ID NO: 644609 - RNA, 22 nt, Human
gggcugggaauggcuaaguaug

SEQ ID NO: 644610 - RNA, 17 nt, Human
uagcugccccgaaugcu

SEQ ID NO: 644611 - RNA, 22 nt, Human
uccacaugacuucuaauaacug

SEQ ID NO: 644612 - RNA, 22 nt, Human
cuuacauuuaaucaugugucau

SEQ ID NO: 644613 - RNA, 22 nt, Human
cuggaggggcuggcaugguagc

SEQ ID NO: 644614 - RNA, 22 nt, Human
acaguaaggguaaauaagaaca

SEQ ID NO: 644615 - RNA, 22 nt, Human
ggcugaguucucuugcugaauc

SEQ ID NO: 644616 - RNA, 22 nt, Human
acucugaagaagacuuccagac

SEQ ID NO: 644617 - RNA, 22 nt, Human
cugccccacaggcuugguaggg

SEQ ID NO: 644618 - RNA, 22 nt, Human
gaggagcuugaggcuaggagcc

SEQ ID NO: 644619 - RNA, 22 nt, Human
aaagugcaccugcuucuucuug

SEQ ID NO: 644620 - RNA, 22 nt, Human
uaggagacauugaucccaagaa

SEQ ID NO: 644621 - RNA, 22 nt, Human
uucaagacugcgacuaaugccc

SEQ ID NO: 644622 - RNA, 21 nt, Human
acuuugggcacuuuccugccc

SEQ ID NO: 644623 - RNA, 22 nt, Human
caacauauauaaggauuuacua

SEQ ID NO: 644624 - RNA, 22 nt, Human
cugugccagccugucccaggag

SEQ ID NO: 644625 - RNA, 22 nt, Human
ucugauaucgcacuaaacucug

SEQ ID NO: 644626 - RNA, 22 nt, Human
cugggcacaaguggcccuggau

SEQ ID NO: 644627 - RNA, 22 nt, Human
auucugcuaguaacagaugaag

SEQ ID NO: 644628 - RNA, 22 nt, Human
ugauuagacaaaggaaucaugc

SEQ ID NO: 644629 - RNA, 22 nt, Human
aggcugugcaauuaggguaaga

SEQ ID NO: 644630 - RNA, 22 nt, Human
ggaggcauuauggggaagacuu

SEQ ID NO: 644631 - RNA, 23 nt, Human
uggcaaagcauucuuauaacagu

SEQ ID NO: 644632 - RNA, 22 nt, Human
uuuaucaguagcaaaguuuuaa

SEQ ID NO: 644633 - RNA, 22 nt, Human
gagcagaacuacucacauaucg

SEQ ID NO: 644634 - RNA, 22 nt, Human
agaaauaaucagcuuaggggca

SEQ ID NO: 644635 - RNA, 22 nt, Human
aacauuuaugguagucauugca

SEQ ID NO: 644636 - RNA, 22 nt, Human
auacuuugcuaguaucagugug

SEQ ID NO: 644637 - RNA, 22 nt, Human
ucaucugaagauugcuguucaa

SEQ ID NO: 644638 - RNA, 22 nt, Human
acugaauaauggucugugaucu

SEQ ID NO: 644639 - RNA, 22 nt, Human
ugacugugccuguugaaugaau

SEQ ID NO: 644640 - RNA, 22 nt, Human
uacaaucaggcucuagcuucuc

SEQ ID NO: 644641 - RNA, 22 nt, Human
acccaugugcucuuuuguaccc

SEQ ID NO: 644642 - RNA, 22 nt, Human
ugagggagcugaccuuucugug

SEQ ID NO: 644643 - RNA, 23 nt, Human
gugagcagcaccaugaggcuaga

SEQ ID NO: 644644 - RNA, 16 nt, Human
auucacaaggcaucgg

SEQ ID NO: 644645 - RNA, 18 nt, Human
cuccuccacagccccugc

SEQ ID NO: 644646 - RNA, 22 nt, Human
uuuccuugcacauugguuucca

SEQ ID NO: 644647 - RNA, 22 nt, Human
uuucugccagguuucuggauga

SEQ ID NO: 644648 - RNA, 22 nt, Human
auggccagucaagccucuggcu

SEQ ID NO: 644649 - RNA, 22 nt, Human
guuuccuguuucucagcagccc

SEQ ID NO: 644650 - RNA, 22 nt, Human
agcuggccagaugucccaaaga

SEQ ID NO: 644651 - RNA, 22 nt, Human
ggcacucagagauucaggcugu

SEQ ID NO: 644652 - RNA, 22 nt, Human
ucaggagaaggcaauguggaaa

SEQ ID NO: 644653 - RNA, 22 nt, Human
ucuggaaguuagaggaggaaag

SEQ ID NO: 644654 - RNA, 23 nt, Human
aucugaaaaggcauuuucuuccc

SEQ ID NO: 644655 - RNA, 22 nt, Human
aacuuuucacaggcuagcucuu

SEQ ID NO: 644656 - RNA, 22 nt, Human
ucagcccuagccucaguccagg

SEQ ID NO: 644657 - RNA, 22 nt, Human
augcauauauacauacacaguc

SEQ ID NO: 644658 - RNA, 22 nt, Human
cugggucuccggcagccucggg

SEQ ID NO: 644659 - RNA, 22 nt, Human
acuguagcugccacuggaugca

SEQ ID NO: 644660 - RNA, 22 nt, Human
aggcuggugcuuccuagggcag

SEQ ID NO: 644661 - RNA, 22 nt, Human
aggucugaguagagaaaaggca

SEQ ID NO: 644662 - RNA, 22 nt, Human
agugccuggcacauggaaggug

SEQ ID NO: 644663 - RNA, 22 nt, Human
aaauuagaagugcucaggaaua

SEQ ID NO: 644664 - RNA, 22 nt, Human
cuucccugagcuuucucaggcu

SEQ ID NO: 644665 - RNA, 22 nt, Human
aaugaacaagaaagacuuugag

SEQ ID NO: 644666 - RNA, 22 nt, Human
uaucaguagaacaauggacauu

SEQ ID NO: 644667 - RNA, 20 nt, Human
auauaauaaauuuugguuac

SEQ ID NO: 644668 - RNA, 22 nt, Human
cacuggcagauuugggaucugg

SEQ ID NO: 644669 - RNA, 22 nt, Human
ugaacuuagugggaauaucucu

SEQ ID NO: 644670 - RNA, 18 nt, Human
gauauauaggaggaaagu

SEQ ID NO: 644671 - RNA, 22 nt, Human
ucugccugaaccacucuuggag

SEQ ID NO: 644672 - RNA, 22 nt, Human
gcagggaaggggcaugcuggag

SEQ ID NO: 644673 - RNA, 22 nt, Human
uuggagagcaguaaaccacacu

SEQ ID NO: 644674 - RNA, 22 nt, Human
gcuuucugaagcaguguuucuc

SEQ ID NO: 644675 - RNA, 22 nt, Human
agaauaaucacugaaguucaaa

SEQ ID NO: 644676 - RNA, 22 nt, Human
augaaugcuuauuaaauugaaa

SEQ ID NO: 644677 - RNA, 22 nt, Human
ccugggcaaaugccagagacaa

SEQ ID NO: 644678 - RNA, 20 nt, Human
cuggaguguagcaguggcug

SEQ ID NO: 644679 - RNA, 22 nt, Human
ugaaugcacugcucuccuagga

SEQ ID NO: 644680 - RNA, 22 nt, Human
uggaugagucugagauugggca

SEQ ID NO: 644681 - RNA, 22 nt, Human
uacaaaguuuucuuggauugag

SEQ ID NO: 644682 - RNA, 22 nt, Human
gacacagacaguuagagguaau

SEQ ID NO: 644683 - RNA, 22 nt, Human
uaugagugguugaaugguaaac

SEQ ID NO: 644684 - RNA, 22 nt, Human
aaagagaaacuuagaagccuga

SEQ ID NO: 644685 - RNA, 22 nt, Human
aaacaaagcaucuugcuaugca

SEQ ID NO: 644686 - RNA, 19 nt, Human
ucaaggcucccugagggau

SEQ ID NO: 644687 - RNA, 22 nt, Human
gcugcucuguuaauugcuguaa

SEQ ID NO: 644688 - RNA, 22 nt, Human
cucaguuugagggguagguguu

SEQ ID NO: 644689 - RNA, 22 nt, Human
ccugggugguuccggcaaggag

SEQ ID NO: 644690 - RNA, 22 nt, Human
gggagcuuaagacaguuccaau

SEQ ID NO: 644691 - RNA, 22 nt, Human
uggcacgacaauuggcaccaau

SEQ ID NO: 644692 - RNA, 22 nt, Human
ccagggcuggugggagaugcug

SEQ ID NO: 644693 - RNA, 22 nt, Human
ugcugagagauuuaaagggcca

SEQ ID NO: 644694 - RNA, 22 nt, Human
uuacaaaguuuaagguggcacu

SEQ ID NO: 644695 - RNA, 22 nt, Human
uacauauuguccauaguugcuu

SEQ ID NO: 644696 - RNA, 22 nt, Human
auuuaguguguauugcuauuau

SEQ ID NO: 644697 - RNA, 22 nt, Human
guuuaaguuucagaagcuaaga

SEQ ID NO: 644698 - RNA, 22 nt, Human
cuaaagaauuuugcuugaccag

SEQ ID NO: 644699 - RNA, 22 nt, Human
guggcucacgucugucaucuca

SEQ ID NO: 644700 - RNA, 22 nt, Human
guccucuggaagaugaguucuu

SEQ ID NO: 644701 - RNA, 20 nt, Human
gcugggggugugcugaguga

SEQ ID NO: 644702 - RNA, 22 nt, Human
gggcgggguggcucaugccugu

SEQ ID NO: 644703 - RNA, 22 nt, Human
uuguguauuuuuugauacuaac

SEQ ID NO: 644704 - RNA, 22 nt, Human
ggaaucagagcagaggcuguua

SEQ ID NO: 644705 - RNA, 22 nt, Human
uuugugugaaaauauuuaaguu

SEQ ID NO: 644706 - RNA, 22 nt, Human
uagagagagcugugguggcucu

SEQ ID NO: 644707 - RNA, 22 nt, Human
guccuccauggucuugaaguaa

SEQ ID NO: 644708 - RNA, 22 nt, Human
uauguuucauucuuuucuggua

SEQ ID NO: 644709 - RNA, 22 nt, Human
ugacucuguaccugucugccuu

SEQ ID NO: 644710 - RNA, 22 nt, Human
uaucauuuuacugugacauuuu

SEQ ID NO: 644711 - RNA, 22 nt, Human
uuccuucuuguaaugaucugcc

SEQ ID NO: 644712 - RNA, 22 nt, Human
uuacacaugucucaguggaaau

SEQ ID NO: 644713 - RNA, 21 nt, Human
gccugcaguuuugaagcccuu

SEQ ID NO: 644714 - RNA, 22 nt, Human
agggccaguaaauguuuccuca

SEQ ID NO: 644715 - RNA, 22 nt, Human
ucauccauacuauugagaggca

SEQ ID NO: 644716 - RNA, 22 nt, Human
gauucuggcaaaauccuggcuu

SEQ ID NO: 644717 - RNA, 22 nt, Human
caagcuuuccauuacacacauu

SEQ ID NO: 644718 - RNA, 22 nt, Human
ugucaccuuuacccuuuuauag

SEQ ID NO: 644719 - RNA, 22 nt, Human
auugaacuaaauaagcagucau

SEQ ID NO: 644720 - RNA, 22 nt, Human
aauccugugugacucuggggag

SEQ ID NO: 644721 - RNA, 22 nt, Human
cacaggaagaucucccagaggu

SEQ ID NO: 644722 - RNA, 22 nt, Human
ucucaucucaaauuguaauccc

SEQ ID NO: 644723 - RNA, 22 nt, Human
aggauggggucugcagccuggu

SEQ ID NO: 644724 - RNA, 22 nt, Human
gcauuuguuccgcuuugucauc

SEQ ID NO: 644725 - RNA, 22 nt, Human
ggccugugcugucagcccuagu

SEQ ID NO: 644726 - RNA, 22 nt, Human
uuacagauucaagcucuuugaa

SEQ ID NO: 644727 - RNA, 22 nt, Human
aaugucaaacagagcagagcua

SEQ ID NO: 644728 - RNA, 19 nt, Human
ucauaaggagagaggaaau

SEQ ID NO: 644729 - RNA, 14 nt, Human
uccagagcuuuccg

SEQ ID NO: 644730 - RNA, 22 nt, Human
gggcuccaguuguccccaggau

SEQ ID NO: 644731 - RNA, 22 nt, Human
ucagcucuacacacaccugugu

SEQ ID NO: 644732 - RNA, 22 nt, Human
aaauugauguucccaguugaaa

SEQ ID NO: 644733 - RNA, 23 nt, Human
ucuuuucaaugguucuuuaugug

SEQ ID NO: 644734 - RNA, 22 nt, Human
guauacaugugguaaaaugcac

SEQ ID NO: 644735 - RNA, 22 nt, Human
aaccacaacacuaaaugcuggu

SEQ ID NO: 644736 - RNA, 22 nt, Human
uggcucagcugucacagccugg

SEQ ID NO: 644737 - RNA, 22 nt, Human
ucugcugcuacagacucucuag

SEQ ID NO: 644738 - RNA, 22 nt, Human
gcaaacauucaggaguacagga

SEQ ID NO: 644739 - RNA, 22 nt, Human
ugggccuugcugagcuauggag

SEQ ID NO: 644740 - RNA, 22 nt, Human
agaagucagccacagugggaga

SEQ ID NO: 644741 - RNA, 22 nt, Human
caagguuucuaugcucaaagga

SEQ ID NO: 644742 - RNA, 20 nt, Human
gcccuggacguggccucggc

SEQ ID NO: 644743 - RNA, 22 nt, Human
uaaaucacuccuaauaaucagu

SEQ ID NO: 644744 - RNA, 22 nt, Human
uucuaagucacucagauuuugg

SEQ ID NO: 644745 - RNA, 22 nt, Human
cgcaggcuuuagaaucugcuac

SEQ ID NO: 644746 - RNA, 22 nt, Human
acucugcccuaggccucugggg

SEQ ID NO: 644747 - RNA, 20 nt, Human
cacuguggcacauugguuua

SEQ ID NO: 644748 - RNA, 22 nt, Human
aggacaauugagaguuuguuga

SEQ ID NO: 644749 - RNA, 22 nt, Human
ucauuuacuggauccauaagca

SEQ ID NO: 644750 - RNA, 22 nt, Human
ggagggugcuuaaguuguguuu

SEQ ID NO: 644751 - RNA, 22 nt, Human
cccucucuuagaagaaacacag

SEQ ID NO: 644752 - RNA, 22 nt, Human
gucagaggggacaagacacaga

SEQ ID NO: 644753 - RNA, 23 nt, Human
uggagcugggcagcugggaaagu

SEQ ID NO: 644754 - RNA, 23 nt, Human
uuuauauuccuaaugucuugagc

SEQ ID NO: 644755 - RNA, 22 nt, Human
accugcaguggccacuccuaau

SEQ ID NO: 644756 - RNA, 21 nt, Human
ugcuccagggcagcuuccagc

SEQ ID NO: 644757 - RNA, 21 nt, Human
cacaagacacauaggguguuu

SEQ ID NO: 644758 - RNA, 22 nt, Human
uggaggaaguggcuggccagaa

SEQ ID NO: 644759 - RNA, 22 nt, Human
uucacauuugcccuuaugugug

SEQ ID NO: 644760 - RNA, 19 nt, Human
aguaugucuaugagucuuu

SEQ ID NO: 644761 - RNA, 22 nt, Human
uccugaaaugugcacaugacau

SEQ ID NO: 644762 - RNA, 22 nt, Human
ugcuucugaugugagcagcccc

SEQ ID NO: 644763 - RNA, 22 nt, Human
uccugggcaaagaggggcagug

SEQ ID NO: 644764 - RNA, 22 nt, Human
uuuaauuuuccugguaggccug

SEQ ID NO: 644765 - RNA, 21 nt, Human
ugggaugggucugggaccagc

SEQ ID NO: 644766 - RNA, 18 nt, Human
caggaauggaugggauuu

SEQ ID NO: 644767 - RNA, 19 nt, Human
agauaagaguugacugugg

SEQ ID NO: 644768 - RNA, 22 nt, Human
aaagucuuaauguaaguuuagu

SEQ ID NO: 644769 - RNA, 18 nt, Human
uuggcuucuuuccuuccu

SEQ ID NO: 644770 - RNA, 22 nt, Human
uuuagagagaauuuucaaagug

SEQ ID NO: 644771 - RNA, 22 nt, Human
ccucagugaguguuuccuucuu

SEQ ID NO: 644772 - RNA, 22 nt, Human
ggcugugaacccuggcagugug

SEQ ID NO: 644773 - RNA, 22 nt, Human
gaagcuaaaccacagcuaagaa

SEQ ID NO: 644774 - RNA, 22 nt, Human
uaagucaucccauaacagugcu

SEQ ID NO: 644775 - RNA, 22 nt, Human
cacaugaucgucaugugaaagu

SEQ ID NO: 644776 - RNA, 22 nt, Human
augcagcuauuugagcauguca

SEQ ID NO: 644777 - RNA, 22 nt, Human
agcuguggcagcacuuuggagu

SEQ ID NO: 644778 - RNA, 19 nt, Human
gcuggauggauccuggagu

SEQ ID NO: 644779 - RNA, 22 nt, Human
aggcugugaacucuaugcugaa

SEQ ID NO: 644780 - RNA, 22 nt, Human
guucacaaauaugcacuuacga

SEQ ID NO: 644781 - RNA, 22 nt, Human
ugggcagauguccucugaagug

SEQ ID NO: 644782 - RNA, 22 nt, Human
uaaagugcccagggaaagcggg

SEQ ID NO: 644783 - RNA, 22 nt, Human
uaggccacgaaggagaugauag

SEQ ID NO: 644784 - RNA, 22 nt, Human
agagacuggaguuacgaguuca

SEQ ID NO: 644785 - RNA, 23 nt, Human
ggaagcucacguaguccugcacu

SEQ ID NO: 644786 - RNA, 22 nt, Human
ugcuggagcuccgggcuguagg

SEQ ID NO: 644787 - RNA, 22 nt, Human
gugucccaggagaggagacaau

SEQ ID NO: 644788 - RNA, 22 nt, Human
aggaauuuagacagggcauaaa

SEQ ID NO: 644789 - RNA, 19 nt, Human
uggggcuguguuuugaccc

SEQ ID NO: 644790 - RNA, 22 nt, Human
gugcucacugugagacguccug

SEQ ID NO: 644791 - RNA, 22 nt, Human
uuuacccauucagacucacuug

SEQ ID NO: 644792 - RNA, 18 nt, Human
gccagagcauaucuccag

SEQ ID NO: 644793 - RNA, 22 nt, Human
agagaacagcauugcagcuuug

SEQ ID NO: 644794 - RNA, 22 nt, Human
agaagccaugguaugcaacuac

SEQ ID NO: 644795 - RNA, 22 nt, Human
augacagaggagugcaggugau

SEQ ID NO: 644796 - RNA, 22 nt, Human
gcacagguugcaaaaguucaca

SEQ ID NO: 644797 - RNA, 22 nt, Human
uugcuuuacggcaaggccccag

SEQ ID NO: 644798 - RNA, 22 nt, Human
acacuccagggagggagggaau

SEQ ID NO: 644799 - RNA, 22 nt, Human
uccucaggucaaagcaggagaa

SEQ ID NO: 644800 - RNA, 22 nt, Human
agucacugucaaagccacacac

SEQ ID NO: 644801 - RNA, 22 nt, Human
cagugccaugucugagccccua

SEQ ID NO: 644802 - RNA, 22 nt, Human
acugaugaaaacuaauaaauua

SEQ ID NO: 644803 - RNA, 22 nt, Human
cugaaaauguuacacaggaaga

SEQ ID NO: 644804 - RNA, 19 nt, Human
aaaucagaaucugcauuuu

SEQ ID NO: 644805 - RNA, 22 nt, Human
gcugguccacauccugguacgu

SEQ ID NO: 644806 - RNA, 22 nt, Human
ggguaggcagugcguccugccu

SEQ ID NO: 644807 - RNA, 20 nt, Human
gcagaugagacucacagagg

SEQ ID NO: 644808 - RNA, 22 nt, Human
ccuggggaaucuugcaggggaa

SEQ ID NO: 644809 - RNA, 22 nt, Human
uagaagaucuuaaaagcugacu

SEQ ID NO: 644810 - RNA, 22 nt, Human
ccuccauguaaagguccccuca

SEQ ID NO: 644811 - RNA, 22 nt, Human
auuauucaauguuauuucagug

SEQ ID NO: 644812 - RNA, 22 nt, Human
ucauggaugggcccagcucugu

SEQ ID NO: 644813 - RNA, 22 nt, Human
aaauaguucagccacggugacu

SEQ ID NO: 644814 - RNA, 17 nt, Human
auuuccucagggcugag

SEQ ID NO: 644815 - RNA, 23 nt, Human
aaggccagaauuucaauggugcc

SEQ ID NO: 644816 - RNA, 22 nt, Human
cuccuguugcacuaguuccuga

SEQ ID NO: 644817 - RNA, 22 nt, Human
ucuucauguauacucaugguac

SEQ ID NO: 644818 - RNA, 22 nt, Human
augucugcaaauaucugccagu

SEQ ID NO: 644819 - RNA, 22 nt, Human
uuacacaacaucuguauuauua

SEQ ID NO: 644820 - RNA, 19 nt, Human
ccaggccaucccaguuccc

SEQ ID NO: 644821 - RNA, 22 nt, Human
cacugcuaugaugaugauauuu

SEQ ID NO: 644822 - RNA, 22 nt, Human
caggguggcaggcaccauggcc

SEQ ID NO: 644823 - RNA, 22 nt, Human
ugaagagaagaaaauuaucuuu

SEQ ID NO: 644824 - RNA, 22 nt, Human
gaaagcacugugagaucuuguu

SEQ ID NO: 644825 - RNA, 22 nt, Human
aaauguuccauuauuguguaau

SEQ ID NO: 644826 - RNA, 22 nt, Human
ugggcuguccagcaccugggcu

SEQ ID NO: 644827 - RNA, 22 nt, Human
uagaggggaaucugccuccucu

SEQ ID NO: 644828 - RNA, 22 nt, Human
ggcaggcuccaagcauccuaug

SEQ ID NO: 644829 - RNA, 22 nt, Human
aggcuggagagugcaguggcgu

SEQ ID NO: 644830 - RNA, 22 nt, Human
aaccuuugaggggagcucuuuc

SEQ ID NO: 644831 - RNA, 22 nt, Human
uacauguaguucacugguggca

SEQ ID NO: 644832 - RNA, 22 nt, Human
augcugagguguguuuaauuua

SEQ ID NO: 644833 - RNA, 22 nt, Human
ucuucaauuuagaauggauuua

SEQ ID NO: 644834 - RNA, 22 nt, Human
uacauaguauucacauuguuuu

SEQ ID NO: 644835 - RNA, 22 nt, Human
uuccaugaaagugaaauggagc

SEQ ID NO: 644836 - RNA, 22 nt, Human
agcuggagaucaugcugauacu

SEQ ID NO: 644837 - RNA, 23 nt, Human
agaucacauaguuaucagaugac

SEQ ID NO: 644838 - RNA, 22 nt, Human
uggggugacagugcagugguca

SEQ ID NO: 644839 - RNA, 22 nt, Human
uuacagcaaagugcgcagaccu

SEQ ID NO: 644840 - RNA, 22 nt, Human
ggagggugggucauucuuacau

SEQ ID NO: 644841 - RNA, 22 nt, Human
agguggcucugacagcucuggu

SEQ ID NO: 644842 - RNA, 22 nt, Human
agcccaugguguacucuguggc

SEQ ID NO: 644843 - RNA, 22 nt, Human
ucacagaauugacaugggaauc

SEQ ID NO: 644844 - RNA, 17 nt, Human
ucugucuugacugucac

SEQ ID NO: 644845 - RNA, 22 nt, Human
gccaggcagacaggucaucagg

SEQ ID NO: 644846 - RNA, 22 nt, Human
cccaggguccggauaacccugg

SEQ ID NO: 644847 - RNA, 22 nt, Human
uggcuaaacccuaguaaauuaa

SEQ ID NO: 644848 - RNA, 22 nt, Human
uaaaucacaaauuuucucauuu

SEQ ID NO: 644849 - RNA, 22 nt, Human
cucuugaagcaggggccaguuc

SEQ ID NO: 644850 - RNA, 22 nt, Human
augggcaguaacaguggcaguc

SEQ ID NO: 644851 - RNA, 22 nt, Human
caggaagucgcagagcuggggg

SEQ ID NO: 644852 - RNA, 22 nt, Human
guuucucagcaugucaguacaa

SEQ ID NO: 644853 - RNA, 22 nt, Human
guaaccugggauguagcacaga

SEQ ID NO: 644854 - RNA, 22 nt, Human
uguugcgaugaagagcuucacg

SEQ ID NO: 644855 - RNA, 22 nt, Human
uggagagcuccuauuugcuguc

SEQ ID NO: 644856 - RNA, 22 nt, Human
uucaccuggcacaugugagccu

SEQ ID NO: 644857 - RNA, 22 nt, Human
uguguuucagaaccuucuuuca

SEQ ID NO: 644858 - RNA, 22 nt, Human
ccugggcaucaacaagcagaga

SEQ ID NO: 644859 - RNA, 22 nt, Human
cagagggcucuuggcugccugc

SEQ ID NO: 644860 - RNA, 22 nt, Human
cucaggauuaaggaaucuaaau

SEQ ID NO: 644861 - RNA, 22 nt, Human
cagcuuuuuagaaucuagggca

SEQ ID NO: 644862 - RNA, 22 nt, Human
acacugagauuuuccugacacc

SEQ ID NO: 644863 - RNA, 22 nt, Human
ugugcagaaacugggaaggaag

SEQ ID NO: 644864 - RNA, 22 nt, Human
caaauugcuaacugucagacua

SEQ ID NO: 644865 - RNA, 22 nt, Human
ucucccucuguaagaucagggg

SEQ ID NO: 644866 - RNA, 18 nt, Human
gcccagaggucugggccc

SEQ ID NO: 644867 - RNA, 22 nt, Human
uuguggcagaccaugagucuaa

SEQ ID NO: 644868 - RNA, 22 nt, Human
aaaacuguaggaauugggugcc

SEQ ID NO: 644869 - RNA, 22 nt, Human
cauucauauuugcaguauaccu

SEQ ID NO: 644870 - RNA, 22 nt, Human
aucuggaacaaagcuuaggaau

SEQ ID NO: 644871 - RNA, 22 nt, Human
caggcacuguguuaggcacugu

SEQ ID NO: 644872 - RNA, 22 nt, Human
agcauuuaggagaauuugagaa

SEQ ID NO: 644873 - RNA, 22 nt, Human
acagccaggagccaugggcagg

SEQ ID NO: 644874 - RNA, 22 nt, Human
gcccaggaggcagagguugugg

SEQ ID NO: 644875 - RNA, 22 nt, Human
ugaggcucaagaaagauuuguu

SEQ ID NO: 644876 - RNA, 22 nt, Human
uucagacaggcagcugggcugg

SEQ ID NO: 644877 - RNA, 22 nt, Human
ucuaauugcaauucucagagau

SEQ ID NO: 644878 - RNA, 22 nt, Human
aucuggcucucucauuuacaaa

SEQ ID NO: 644879 - RNA, 22 nt, Human
uaccuggaaaaguuauaugugu

SEQ ID NO: 644880 - RNA, 22 nt, Human
uccucagcuuugguuuacucau

SEQ ID NO: 644881 - RNA, 22 nt, Human
uauuuuguuaauaauccagucc

SEQ ID NO: 644882 - RNA, 22 nt, Human
ugccagggccauagggagucua

SEQ ID NO: 644883 - RNA, 22 nt, Human
gauauaaauuaaucaagugcaa

SEQ ID NO: 644884 - RNA, 22 nt, Human
cguuaguggaguuugaagcugu

SEQ ID NO: 644885 - RNA, 22 nt, Human
agauuucaaugugagcauuagu

SEQ ID NO: 644886 - RNA, 18 nt, Human
uugagggaggggcagagu

SEQ ID NO: 644887 - RNA, 22 nt, Human
gugcaggaucucagaacaagug

SEQ ID NO: 644888 - RNA, 22 nt, Human
accauccaaacugcuuucugug

SEQ ID NO: 644889 - RNA, 22 nt, Human
cauggggaugaggcugagacuu

SEQ ID NO: 644890 - RNA, 22 nt, Human
auguugcacaaaguccauccau

SEQ ID NO: 644891 - RNA, 22 nt, Human
caggagauguaagacuucuguu

SEQ ID NO: 644892 - RNA, 19 nt, Human
ucaaugcaugaaaucagcc

SEQ ID NO: 644893 - RNA, 23 nt, Human
agaggcaggaguggcuugcccgg

SEQ ID NO: 644894 - RNA, 22 nt, Human
cuguugucccugggagcucagc

SEQ ID NO: 644895 - RNA, 22 nt, Human
cuccccauggcaacaguuaugg

SEQ ID NO: 644896 - RNA, 22 nt, Human
ccucacugcuauguguuugcuc

SEQ ID NO: 644897 - RNA, 22 nt, Human
ugagccuggagucguggagggg

SEQ ID NO: 644898 - RNA, 22 nt, Human
guauuccugcaaauagcaguga

SEQ ID NO: 644899 - RNA, 22 nt, Human
aaguuccugggccaaguccagg

SEQ ID NO: 644900 - RNA, 22 nt, Human
ugugcuuugguuuuacaggaug

SEQ ID NO: 644901 - RNA, 22 nt, Human
aucacaguggcagggauuuggg

SEQ ID NO: 644902 - RNA, 18 nt, Human
gagaggagccagaauuuu

SEQ ID NO: 644903 - RNA, 19 nt, Human
uuucagacauuucaaauuu

SEQ ID NO: 644904 - RNA, 21 nt, Human
uccagccaguaaaugcucagc

SEQ ID NO: 644905 - RNA, 22 nt, Human
aaauagcauaaaauaggaagcu

SEQ ID NO: 644906 - RNA, 22 nt, Human
ggcuccuggcaucuggugggua

SEQ ID NO: 644907 - RNA, 22 nt, Human
ucagcacuuuuuaaagcagcau

SEQ ID NO: 644908 - RNA, 23 nt, Human
ugugggcgcauuguaaggguagc

SEQ ID NO: 644909 - RNA, 22 nt, Human
ccccaggacguggcccucauag

SEQ ID NO: 644910 - RNA, 19 nt, Human
ccugucugucuucagcuag

SEQ ID NO: 644911 - RNA, 22 nt, Human
uagaaaugauugguugagcucu

SEQ ID NO: 644912 - RNA, 22 nt, Human
gcuccugucuuggggcacuggc

SEQ ID NO: 644913 - RNA, 22 nt, Human
uguaaguaguaauggaaggaca

SEQ ID NO: 644914 - RNA, 22 nt, Human
acccagagauggaccuggcugc

SEQ ID NO: 644915 - RNA, 22 nt, Human
agaagcugcguuuauuuaaauc

SEQ ID NO: 644916 - RNA, 22 nt, Human
augugucuggcauggcucuauu

SEQ ID NO: 644917 - RNA, 22 nt, Human
augggaggaagagaagaugucu

SEQ ID NO: 644918 - RNA, 17 nt, Human
ugcagcaaaugggggac

SEQ ID NO: 644919 - RNA, 22 nt, Human
ucacccagggacugugauggaa

SEQ ID NO: 644920 - RNA, 22 nt, Human
cagagagagucaaaucuuugcu

SEQ ID NO: 644921 - RNA, 22 nt, Human
agaaugugaagauuuugaauua

SEQ ID NO: 644922 - RNA, 22 nt, Human
augauguaauggaaagaacaga

SEQ ID NO: 644923 - RNA, 22 nt, Human
uccagggaucuuuagagucuuu

SEQ ID NO: 644924 - RNA, 22 nt, Human
ugaaggcccuaucuccauauac

SEQ ID NO: 644925 - RNA, 22 nt, Human
gaacuucuucaacauaauggac

SEQ ID NO: 644926 - RNA, 22 nt, Human
gcugccucugcacagcucacuc

SEQ ID NO: 644927 - RNA, 22 nt, Human
uucccaggacucugggugucuu

SEQ ID NO: 644928 - RNA, 22 nt, Human
aguuuacagaugcuacaggagc

SEQ ID NO: 644929 - RNA, 22 nt, Human
ccacuggcuuuuccuaggucuc

SEQ ID NO: 644930 - RNA, 22 nt, Human
gaacagacuuggaggagugauc

SEQ ID NO: 644931 - RNA, 22 nt, Human
gucuucuuguguugccugucuu

SEQ ID NO: 644932 - RNA, 22 nt, Human
uccuguuuaggcuguggucugg

SEQ ID NO: 644933 - RNA, 22 nt, Human
uuagcaagaaagauugcagcac

SEQ ID NO: 644934 - RNA, 19 nt, Human
auaaggcaauuggauuugg

SEQ ID NO: 644935 - RNA, 22 nt, Human
gcaugcaggaaguuuuuuggga

SEQ ID NO: 644936 - RNA, 22 nt, Human
uuggcccacaguaccaugcugu

SEQ ID NO: 644937 - RNA, 22 nt, Human
uuaggaaauuccaccuguauuc

SEQ ID NO: 644938 - RNA, 19 nt, Human
aaaguguuuucuuuucugu

SEQ ID NO: 644939 - RNA, 22 nt, Human
uaguuacagcaggcaggauaua

SEQ ID NO: 644940 - RNA, 22 nt, Human
aaaaauaggucaaccguguaug

SEQ ID NO: 644941 - RNA, 22 nt, Human
auguuuaugcaaacaugugagu

SEQ ID NO: 644942 - RNA, 22 nt, Human
uacuccugcugauccugccagc

SEQ ID NO: 644943 - RNA, 22 nt, Human
ggacugggccagggguuggacu

SEQ ID NO: 644944 - RNA, 22 nt, Human
gagccuggauugucaccgacuu

SEQ ID NO: 644945 - RNA, 22 nt, Human
auguguucacgugcacaugugc

SEQ ID NO: 644946 - RNA, 22 nt, Human
cugccaggccucaucccagcca

SEQ ID NO: 644947 - RNA, 22 nt, Human
caggaagggaaaauaguucggg

SEQ ID NO: 644948 - RNA, 22 nt, Human
agcugucugugaacacagcauu

SEQ ID NO: 644949 - RNA, 22 nt, Human
cagauaaaauuaauauuaccaa

SEQ ID NO: 644950 - RNA, 22 nt, Human
uagggcuuugcgauggcuauuc

SEQ ID NO: 644951 - RNA, 22 nt, Human
auguaacuucugugaaucugac

SEQ ID NO: 644952 - RNA, 22 nt, Human
agugcaaauuauuuaccugauu

SEQ ID NO: 644953 - RNA, 22 nt, Human
cuggugccuccucccugugcuu

SEQ ID NO: 644954 - RNA, 22 nt, Human
aauaguccucuccuuggaauuu

SEQ ID NO: 644955 - RNA, 22 nt, Human
uuagcacuggauuucaucagaa

SEQ ID NO: 644956 - RNA, 22 nt, Human
acagugcagugugaugaguauu

SEQ ID NO: 644957 - RNA, 22 nt, Human
agaguucacacucagugcaccc

SEQ ID NO: 644958 - RNA, 22 nt, Human
ggcagugagucccggagaggcc

SEQ ID NO: 644959 - RNA, 22 nt, Human
acuccagggcuccaccccagau

SEQ ID NO: 644960 - RNA, 22 nt, Human
gcugcuuccuuuccugcugacc

SEQ ID NO: 644961 - RNA, 22 nt, Human
augcaggauuagaaaguugccu

SEQ ID NO: 644962 - RNA, 22 nt, Human
augaacaauaaucaugucuaug

SEQ ID NO: 644963 - RNA, 22 nt, Human
auuucucaguaaucucagcaau

SEQ ID NO: 644964 - RNA, 22 nt, Human
uccaggccucuagcccucucuu

SEQ ID NO: 644965 - RNA, 22 nt, Human
agcagcagauccaaaaaaugug

SEQ ID NO: 644966 - RNA, 22 nt, Human
agucuguggggucccuggggca

SEQ ID NO: 644967 - RNA, 22 nt, Human
ucuucauguugcuuauucuggg

SEQ ID NO: 644968 - RNA, 22 nt, Human
aagugauacguguuuauuucca

SEQ ID NO: 644969 - RNA, 22 nt, Human
uauuuaaaauagugcuccagca

SEQ ID NO: 644970 - RNA, 22 nt, Human
acucagaguagaaaauagguuc

SEQ ID NO: 644971 - RNA, 20 nt, Human
ggugcugauaagaaagaagu

SEQ ID NO: 644972 - RNA, 22 nt, Human
aucgagggugaguacagcggac

SEQ ID NO: 644973 - RNA, 22 nt, Human
aguuuaacuuuguaaacgugag

SEQ ID NO: 644974 - RNA, 21 nt, Human
ggaaagaaggcaaggcucagg

SEQ ID NO: 644975 - RNA, 22 nt, Human
gagagguguguuucagauaaga

SEQ ID NO: 644976 - RNA, 22 nt, Human
gcauccagucuuggcuccugga

SEQ ID NO: 644977 - RNA, 23 nt, Human
gggaccagcuagggcugugaccu

SEQ ID NO: 644978 - RNA, 22 nt, Human
uguaaucauuacaguacaugga

SEQ ID NO: 644979 - RNA, 22 nt, Human
cuagagaacaacauucauaugg

SEQ ID NO: 644980 - RNA, 22 nt, Human
agugcauucuggcagaacaggu

SEQ ID NO: 644981 - RNA, 22 nt, Human
uggcuucagucucaucuuggaa

SEQ ID NO: 644982 - RNA, 22 nt, Human
gagcacagauugauuuaaaaua

SEQ ID NO: 644983 - RNA, 22 nt, Human
uggagauggccucaggcccuca

SEQ ID NO: 644984 - RNA, 22 nt, Human
gcucagguagaugggguugucc

SEQ ID NO: 644985 - RNA, 22 nt, Human
aagauucucagagugaaagaau

SEQ ID NO: 644986 - RNA, 22 nt, Human
agauuucccacuccauguauug

SEQ ID NO: 644987 - RNA, 22 nt, Human
uuugcauuaucucacuuauaua

SEQ ID NO: 644988 - RNA, 22 nt, Human
ucuauuuguucucaggaucauc

SEQ ID NO: 644989 - RNA, 23 nt, Human
uuucacagaaggauuguagggcc

SEQ ID NO: 644990 - RNA, 22 nt, Human
ugacugaggccugauaacaguu

SEQ ID NO: 644991 - RNA, 22 nt, Human
aagcaggugugagccagugggc

SEQ ID NO: 644992 - RNA, 22 nt, Human
ugagaugaauaacuccugcuaa

SEQ ID NO: 644993 - RNA, 22 nt, Human
aguacaaacuguuucaaaguag

SEQ ID NO: 644994 - RNA, 22 nt, Human
auccuucaauuagaaccaauug

SEQ ID NO: 644995 - RNA, 22 nt, Human
uguugguaaauagcuuagcaau

SEQ ID NO: 644996 - RNA, 20 nt, Human
uucuuuguuccuuacauuug

SEQ ID NO: 644997 - RNA, 22 nt, Human
gccuucugcgcucgugucuccg

SEQ ID NO: 644998 - RNA, 22 nt, Human
guggcugcucgggcuccggccc

SEQ ID NO: 644999 - RNA, 15 nt, Human
aucucucuagcugcu

SEQ ID NO: 645000 - RNA, 22 nt, Human
auuuauugaacacugacuaugu

SEQ ID NO: 645001 - RNA, 22 nt, Human
cccaggcugcguauccacaaua

SEQ ID NO: 645002 - RNA, 20 nt, Human
ugggaguacaaucaugagca

SEQ ID NO: 645003 - RNA, 22 nt, Human
ucucuucuuuggggugggcuca

SEQ ID NO: 645004 - RNA, 22 nt, Human
uugugucccccuuugagagcca

SEQ ID NO: 645005 - RNA, 18 nt, Human
uuuguuggguugccuuua

SEQ ID NO: 645006 - RNA, 22 nt, Human
ugccuuuuccaguuucuagggg

SEQ ID NO: 645007 - RNA, 16 nt, Human
gaggggagcaguaggc

SEQ ID NO: 645008 - RNA, 20 nt, Human
uucuggaggcuacaagucug

SEQ ID NO: 645009 - RNA, 22 nt, Human
aggcacuggucuaccccuuagu

SEQ ID NO: 645010 - RNA, 22 nt, Human
gcccagcugagaagcgcggggc

SEQ ID NO: 645011 - RNA, 22 nt, Human
ucacaugcagucacugagcagg

SEQ ID NO: 645012 - RNA, 22 nt, Human
uuaaugcagcucuaccacacag

SEQ ID NO: 645013 - RNA, 22 nt, Human
aucaagaacuuauuuuggaaau

SEQ ID NO: 645014 - RNA, 22 nt, Human
ggccacugaccuacaucugggg

SEQ ID NO: 645015 - RNA, 22 nt, Human
ccacagaguugaugcaauaaga

SEQ ID NO: 645016 - RNA, 22 nt, Human
uauuucaucuggaacaagguaa

SEQ ID NO: 645017 - RNA, 22 nt, Human
uaggauuuaauaaaagaauaga

SEQ ID NO: 645018 - RNA, 22 nt, Human
acagguguccucacagggggug

SEQ ID NO: 645019 - RNA, 22 nt, Human
cugucugcuaugcuuguuguca

SEQ ID NO: 645020 - RNA, 22 nt, Human
gaacuguuucuggugaaagagu

SEQ ID NO: 645021 - RNA, 22 nt, Human
cauuucacaguaaagugauuuc

SEQ ID NO: 645022 - RNA, 17 nt, Human
ugcuucaucccgauccu

SEQ ID NO: 645023 - RNA, 22 nt, Human
ccacccuuccauucuuccucuu

SEQ ID NO: 645024 - RNA, 22 nt, Human
uuauuuggguuugaguguggca

SEQ ID NO: 645025 - RNA, 22 nt, Human
uggagcuggaagacagugauau

SEQ ID NO: 645026 - RNA, 22 nt, Human
uaggaaauuggaaacucuucac

SEQ ID NO: 645027 - RNA, 22 nt, Human
cagggugcagugucgcugcuag

SEQ ID NO: 645028 - RNA, 22 nt, Human
ucuccuucgaggcccagcuccc

SEQ ID NO: 645029 - RNA, 22 nt, Human
acuuacaagcuagggaagcuug

SEQ ID NO: 645030 - RNA, 22 nt, Human
agcuggcugccuucuccuuagg

SEQ ID NO: 645031 - RNA, 22 nt, Human
cagggcugagucauauagccuu

SEQ ID NO: 645032 - RNA, 20 nt, Human
ugaaaggugggaauuguggg

SEQ ID NO: 645033 - RNA, 22 nt, Human
ucucuggcacucccuuauggcu

SEQ ID NO: 645034 - RNA, 22 nt, Human
gccagccagagaggcaugguua

SEQ ID NO: 645035 - RNA, 22 nt, Human
gugcccugucucuugucuccag

SEQ ID NO: 645036 - RNA, 22 nt, Human
gcucucugucguuaugcuucau

SEQ ID NO: 645037 - RNA, 22 nt, Human
auuuuugagcugugaacauagc

SEQ ID NO: 645038 - RNA, 22 nt, Human
ugggaagaggagcacuggaaug

SEQ ID NO: 645039 - RNA, 22 nt, Human
guauuaggugguggaauuguag

SEQ ID NO: 645040 - RNA, 19 nt, Human
agagaggcugugugaggga

SEQ ID NO: 645041 - RNA, 20 nt, Human
gacaucauguacacauugcc

SEQ ID NO: 645042 - RNA, 22 nt, Human
ggugaaggaggaagcugaugga

SEQ ID NO: 645043 - RNA, 22 nt, Human
ugcugcuuuuguauaucagaga

SEQ ID NO: 645044 - RNA, 22 nt, Human
ccugcuuaacauugccaugaca

SEQ ID NO: 645045 - RNA, 22 nt, Human
acaggcugggcgcuuccugcgg

SEQ ID NO: 645046 - RNA, 22 nt, Human
uaccucuggacauuguggagca

SEQ ID NO: 645047 - RNA, 22 nt, Human
cuucccuucugcagaucuuugg

SEQ ID NO: 645048 - RNA, 22 nt, Human
uauguauaaucacagaguguca

SEQ ID NO: 645049 - RNA, 22 nt, Human
gagauguacaauguguauuaau

SEQ ID NO: 645050 - RNA, 22 nt, Human
aacuuauacccagggcagaaau

SEQ ID NO: 645051 - RNA, 22 nt, Human
gaaugaaucuguaagugacaag

SEQ ID NO: 645052 - RNA, 19 nt, Human
ugcucaggccaaggagccc

SEQ ID NO: 645053 - RNA, 22 nt, Human
agcauuucuuggcccauuguag

SEQ ID NO: 645054 - RNA, 22 nt, Human
ggcagugaugucaaacagugaa

SEQ ID NO: 645055 - RNA, 22 nt, Human
uuuuggaugagcccagauuucu

SEQ ID NO: 645056 - RNA, 19 nt, Human
uucuggucuggaaucaagg

SEQ ID NO: 645057 - RNA, 22 nt, Human
agaugcuuuccugauauuuaug

SEQ ID NO: 645058 - RNA, 22 nt, Human
ggccuugggaggagggucagaa

SEQ ID NO: 645059 - RNA, 22 nt, Human
cuugaaagauuuggccucugug

SEQ ID NO: 645060 - RNA, 22 nt, Human
uucccacaggaugagagcugag

SEQ ID NO: 645061 - RNA, 22 nt, Human
aggggagccagggcugcgaguu

SEQ ID NO: 645062 - RNA, 22 nt, Human
cccaggagguggagguugcagu

SEQ ID NO: 645063 - RNA, 22 nt, Human
cccugcucuuagugccugugug

SEQ ID NO: 645064 - RNA, 20 nt, Human
aacacugagggcuacucuuc

SEQ ID NO: 645065 - RNA, 22 nt, Human
auaugaaaauguuuuagcugua

SEQ ID NO: 645066 - RNA, 19 nt, Human
agaaaaacugguacugcug

SEQ ID NO: 645067 - RNA, 22 nt, Human
cagcuguccaaacacauuaacu

SEQ ID NO: 645068 - RNA, 22 nt, Human
gucugcuuuucugaauugccug

SEQ ID NO: 645069 - RNA, 22 nt, Human
ggucucugagugaggaccuggg

SEQ ID NO: 645070 - RNA, 22 nt, Human
uuaauguuuuaaguuauagaga

SEQ ID NO: 645071 - RNA, 22 nt, Human
ggagccaguuuagaccucaguu

SEQ ID NO: 645072 - RNA, 22 nt, Human
cuccagaaauucaacagcaaau

SEQ ID NO: 645073 - RNA, 22 nt, Human
ggaucgcggucccggcccgcgc

SEQ ID NO: 645074 - RNA, 22 nt, Human
ucugggcugucuacagguuggc

SEQ ID NO: 645075 - RNA, 22 nt, Human
cagagguacaagcuaaguuggg

SEQ ID NO: 645076 - RNA, 22 nt, Human
uuuuacuuuggauacaguacuu

SEQ ID NO: 645077 - RNA, 22 nt, Human
ugacagagagguaaguuaugaa

SEQ ID NO: 645078 - RNA, 22 nt, Human
ugguccugcccacgcccaucug

SEQ ID NO: 645079 - RNA, 22 nt, Human
aggagggugauccgggcugguc

SEQ ID NO: 645080 - RNA, 22 nt, Human
cacuuaaagucuuagcuuacag

SEQ ID NO: 645081 - RNA, 22 nt, Human
cuuuccuggcuggcaguugugg

SEQ ID NO: 645082 - RNA, 22 nt, Human
guggccuugcucacauguccag

SEQ ID NO: 645083 - RNA, 18 nt, Human
aagauucugcuucucucu

SEQ ID NO: 645084 - RNA, 22 nt, Human
ccagagguccccugccaggagg

SEQ ID NO: 645085 - RNA, 21 nt, Human
uuguucuuccagaagcaaagu

SEQ ID NO: 645086 - RNA, 22 nt, Human
cuguccucuguccucagcagga

SEQ ID NO: 645087 - RNA, 23 nt, Human
cccacaugucugagucagugcca

SEQ ID NO: 645088 - RNA, 22 nt, Human
acacaucuuagacugaaauaug

SEQ ID NO: 645089 - RNA, 22 nt, Human
uucuuguacuggagauacauga

SEQ ID NO: 645090 - RNA, 17 nt, Human
acacaguacuuuuuugc

SEQ ID NO: 645091 - RNA, 22 nt, Human
acaguacauagaucucuacccu

SEQ ID NO: 645092 - RNA, 22 nt, Human
gcaaagacugcaauuacuuuug

SEQ ID NO: 645093 - RNA, 22 nt, Human
ggaaggaauuccaagacuaaag

SEQ ID NO: 645094 - RNA, 22 nt, Human
uuaaugcagaaaucaaacugac

SEQ ID NO: 645095 - RNA, 22 nt, Human
ugacacaguagaaagaugauga

SEQ ID NO: 645096 - RNA, 22 nt, Human
ucuggcucuaacuaggcaucag

SEQ ID NO: 645097 - RNA, 22 nt, Human
auuccuuggcauucuggacuug

SEQ ID NO: 645098 - RNA, 22 nt, Human
caggaggcgucuucaguuuguu

SEQ ID NO: 645099 - RNA, 22 nt, Human
agcgcgcucgaugguuuccgcg

SEQ ID NO: 645100 - RNA, 22 nt, Human
ugcauuguugaugaguugaaua

SEQ ID NO: 645101 - RNA, 19 nt, Human
uaauaagcaauauggaagu

SEQ ID NO: 645102 - RNA, 22 nt, Human
gacucagagaucccuggagguc

SEQ ID NO: 645103 - RNA, 22 nt, Human
ucugcuauuuucuaucugugug

SEQ ID NO: 645104 - RNA, 22 nt, Human
uuggcaaugucuaaacacauuu

SEQ ID NO: 645105 - RNA, 22 nt, Human
gcagagaacccagcagauuggc

SEQ ID NO: 645106 - RNA, 22 nt, Human
uucuguacuucaggggcucugu

SEQ ID NO: 645107 - RNA, 22 nt, Human
uuuuuggguccaggcuguaucu

SEQ ID NO: 645108 - RNA, 22 nt, Human
cagagccaaaccucagggcccg

SEQ ID NO: 645109 - RNA, 22 nt, Human
augaggcaggauuaagcuauca

SEQ ID NO: 645110 - RNA, 22 nt, Human
agggcgugguggugcuggagca

SEQ ID NO: 645111 - RNA, 22 nt, Human
uucaagucugaagaggacuaau

SEQ ID NO: 645112 - RNA, 22 nt, Human
ccucagagacaguaacuggaau

SEQ ID NO: 645113 - RNA, 22 nt, Human
acuggcugcguuccugugagac

SEQ ID NO: 645114 - RNA, 22 nt, Human
acacuauacuuccauugcuggu

SEQ ID NO: 645115 - RNA, 22 nt, Human
ggagagcugacaucaugauguu

SEQ ID NO: 645116 - RNA, 20 nt, Human
cccuaggaacgcagcaggag

SEQ ID NO: 645117 - RNA, 21 nt, Human
ugauuuccaucuuaaaauaaa

SEQ ID NO: 645118 - RNA, 22 nt, Human
aggaaacugaagcccagagagg

SEQ ID NO: 645119 - RNA, 22 nt, Human
uuagacauguuugcuaaaauga

SEQ ID NO: 645120 - RNA, 22 nt, Human
gcuccaagguauccaccagggu

SEQ ID NO: 645121 - RNA, 22 nt, Human
gcagaggacucaaucaagguau

SEQ ID NO: 645122 - RNA, 22 nt, Human
auuauggacaucaaauaacucu

SEQ ID NO: 645123 - RNA, 22 nt, Human
caggauauuaccuaauauuuga

SEQ ID NO: 645124 - RNA, 22 nt, Human
gcugccagcuuuccuuggcuga

SEQ ID NO: 645125 - RNA, 22 nt, Human
gaggcuuugguuauaaaagauc

SEQ ID NO: 645126 - RNA, 22 nt, Human
gaaaccugguucugcgugaggg

SEQ ID NO: 645127 - RNA, 22 nt, Human
aagccacugcagcaggagcugc

SEQ ID NO: 645128 - RNA, 22 nt, Human
cuagccugggauuugaacuuau

SEQ ID NO: 645129 - RNA, 22 nt, Human
agacacaguuugggauggguug

SEQ ID NO: 645130 - RNA, 23 nt, Human
uaaagcaaagucaagugcacucc

SEQ ID NO: 645131 - RNA, 22 nt, Human
gugcauauuuugcacacagaug

SEQ ID NO: 645132 - RNA, 22 nt, Human
uggugcugccucagaugccuua

SEQ ID NO: 645133 - RNA, 23 nt, Human
uuggagagggugaguagugucag

SEQ ID NO: 645134 - RNA, 22 nt, Human
acagcauugcuccaucucaaga

SEQ ID NO: 645135 - RNA, 22 nt, Human
ccuguacauggccaucuuuacc

SEQ ID NO: 645136 - RNA, 22 nt, Human
gagcccugcgugucugggggca

SEQ ID NO: 645137 - RNA, 22 nt, Human
aaguggcccuaggccaagggga

SEQ ID NO: 645138 - RNA, 22 nt, Human
ucauuuaugucuuugccaucca

SEQ ID NO: 645139 - RNA, 22 nt, Human
cuguggaaucaucaggucuuac

SEQ ID NO: 645140 - RNA, 17 nt, Human
gcauccaguaacaugcc

SEQ ID NO: 645141 - RNA, 22 nt, Human
ggugggaguggaacguggaaga

SEQ ID NO: 645142 - RNA, 22 nt, Human
ccugugugccuggccgcgggag

SEQ ID NO: 645143 - RNA, 22 nt, Human
uuggaaaagugaaacuagaugc

SEQ ID NO: 645144 - RNA, 23 nt, Human
uccuuccuuugagaggcuccauc

SEQ ID NO: 645145 - RNA, 21 nt, Human
uccacaaguuagaaggaaauu

SEQ ID NO: 645146 - RNA, 22 nt, Human
ugacauaaaucuaaaggaaagg

SEQ ID NO: 645147 - RNA, 22 nt, Human
aucaguuuggugcuuucaguga

SEQ ID NO: 645148 - RNA, 22 nt, Human
gagacacaggcacagaagaggc

SEQ ID NO: 645149 - RNA, 22 nt, Human
gcuccucucccagagcugcagg

SEQ ID NO: 645150 - RNA, 22 nt, Human
ugccaggcuuagagcaggggcu

SEQ ID NO: 645151 - RNA, 22 nt, Human
agaagccagaauauucauggau

SEQ ID NO: 645152 - RNA, 22 nt, Human
ggucacugagcuguaauucugu

SEQ ID NO: 645153 - RNA, 22 nt, Human
aaggcugccucugccagaggag

SEQ ID NO: 645154 - RNA, 22 nt, Human
cacagugcucaaacacaagugc

SEQ ID NO: 645155 - RNA, 22 nt, Human
cuacaggucaguaagaccuaga

SEQ ID NO: 645156 - RNA, 22 nt, Human
ucucaggcuaguaaaagauggg

SEQ ID NO: 645157 - RNA, 22 nt, Human
aguauguagugcaaucagucag

SEQ ID NO: 645158 - RNA, 22 nt, Human
ggccacagcaaugcugugaugu

SEQ ID NO: 645159 - RNA, 22 nt, Human
ugaaaucuuuaguuucuguccc

SEQ ID NO: 645160 - RNA, 22 nt, Human
agcuggguacagccugugccua

SEQ ID NO: 645161 - RNA, 22 nt, Human
gcuauugugacagcuuuucgcc

SEQ ID NO: 645162 - RNA, 22 nt, Human
agcaguccaacugagguggcau

SEQ ID NO: 645163 - RNA, 22 nt, Human
aggaagaguguuaccuaugggu

SEQ ID NO: 645164 - RNA, 22 nt, Human
gcugccucuccugaguugacag

SEQ ID NO: 645165 - RNA, 22 nt, Human
auuuccuauagauauggugagu

SEQ ID NO: 645166 - RNA, 22 nt, Human
ucccaaagaacugaauaguaau

SEQ ID NO: 645167 - RNA, 22 nt, Human
acuuggcuuuuccaucucugca

SEQ ID NO: 645168 - RNA, 22 nt, Human
acagggccucagccagggcaga

SEQ ID NO: 645169 - RNA, 19 nt, Human
uaucacugggcacugagga

SEQ ID NO: 645170 - RNA, 22 nt, Human
uucucagauauuuguauggaac

SEQ ID NO: 645171 - RNA, 22 nt, Human
agccagcaggaacgucuagguu

SEQ ID NO: 645172 - RNA, 22 nt, Human
ucauggaagauguagggucagg

SEQ ID NO: 645173 - RNA, 22 nt, Human
uagcagcuuccagagagggcag

SEQ ID NO: 645174 - RNA, 22 nt, Human
cgguccuggcacuugcggcucc

SEQ ID NO: 645175 - RNA, 22 nt, Human
guccugguauaauuguuuaaaa

SEQ ID NO: 645176 - RNA, 22 nt, Human
ucuggcagagugauaggauaag

SEQ ID NO: 645177 - RNA, 22 nt, Human
uguuuauucauggcuaaugaaa

SEQ ID NO: 645178 - RNA, 22 nt, Human
cccugacccuaucagagggcca

SEQ ID NO: 645179 - RNA, 22 nt, Human
aaggcagcaacuaauggaucuc

SEQ ID NO: 645180 - RNA, 22 nt, Human
uguccuugugacauucuggcuu

SEQ ID NO: 645181 - RNA, 22 nt, Human
gcucugcccaaagcuguggcug

SEQ ID NO: 645182 - RNA, 20 nt, Human
gcuguggcaaagcuuugugu

SEQ ID NO: 645183 - RNA, 22 nt, Human
gcagccucugaugauggccgua

SEQ ID NO: 645184 - RNA, 22 nt, Human
uauuuguugaguuguuaugucu

SEQ ID NO: 645185 - RNA, 22 nt, Human
aacagcuauuagaacuucaugg

SEQ ID NO: 645186 - RNA, 22 nt, Human
ugagcccucggcuggggcagag

SEQ ID NO: 645187 - RNA, 22 nt, Human
cguguaugauaaauguuaauaa

SEQ ID NO: 645188 - RNA, 22 nt, Human
agccacagugcaagagagaaaa

SEQ ID NO: 645189 - RNA, 22 nt, Human
agaggaauuucuggaaggaggc

SEQ ID NO: 645190 - RNA, 22 nt, Human
ugaauaaucuuggguauuaaua

SEQ ID NO: 645191 - RNA, 22 nt, Human
ggcugcucuccaucccaggccu

SEQ ID NO: 645192 - RNA, 22 nt, Human
uucucuaagaguuauaugaauu

SEQ ID NO: 645193 - RNA, 22 nt, Human
gcagcaccaaccagggccuguu

SEQ ID NO: 645194 - RNA, 22 nt, Human
ccuggucagagcagucaggauc

SEQ ID NO: 645195 - RNA, 22 nt, Human
gccucagcucccagcccaggcu

SEQ ID NO: 645196 - RNA, 22 nt, Human
gccagagguucaacaacugucu

SEQ ID NO: 645197 - RNA, 22 nt, Human
cccagagaaucuuucagaaagg

SEQ ID NO: 645198 - RNA, 22 nt, Human
uuagaacuuaagaauacugucu

SEQ ID NO: 645199 - RNA, 22 nt, Human
agaaauagcagagucaggcggg

SEQ ID NO: 645200 - RNA, 22 nt, Human
agcaacagguuuauuaucuuau

SEQ ID NO: 645201 - RNA, 22 nt, Human
agaaggcaccguggccaauauu

SEQ ID NO: 645202 - RNA, 22 nt, Human
gacucucaagcacaaguccacc

SEQ ID NO: 645203 - RNA, 17 nt, Human
uaaguuauagcagaaga

SEQ ID NO: 645204 - RNA, 22 nt, Human
aacagcagguccuggcaugggu

SEQ ID NO: 645205 - RNA, 22 nt, Human
aaggcaagguucaccgugcuau

SEQ ID NO: 645206 - RNA, 22 nt, Human
cauuuuaccuagaagcugaaag

SEQ ID NO: 645207 - RNA, 22 nt, Human
gggugggacugaagucugaggg

SEQ ID NO: 645208 - RNA, 22 nt, Human
ucuggacuaacagcagccucag

SEQ ID NO: 645209 - RNA, 22 nt, Human
ucagcaguguaguuuaucauuc

SEQ ID NO: 645210 - RNA, 20 nt, Human
ggcuccuucuuucauggccc

SEQ ID NO: 645211 - RNA, 22 nt, Human
uaacuucaagucuguggaucag

SEQ ID NO: 645212 - RNA, 22 nt, Human
acagaauuugcuugggcaaugg

SEQ ID NO: 645213 - RNA, 17 nt, Human
ccauacugacauauuga

SEQ ID NO: 645214 - RNA, 22 nt, Human
uugugagcaggcugcacaaacc

SEQ ID NO: 645215 - RNA, 22 nt, Human
uucugcuuucaguucuucuggg

SEQ ID NO: 645216 - RNA, 22 nt, Human
ugaguauucugaauuucaaacu

SEQ ID NO: 645217 - RNA, 22 nt, Human
augcccugcugccaucuggccg

SEQ ID NO: 645218 - RNA, 22 nt, Human
uacauucuauaucuguuacauc

SEQ ID NO: 645219 - RNA, 22 nt, Human
auguguguaugugccuauaucu

SEQ ID NO: 645220 - RNA, 22 nt, Human
cuccugggcugggaacucagcc

SEQ ID NO: 645221 - RNA, 22 nt, Human
cagauguaaucugacagcugga

SEQ ID NO: 645222 - RNA, 22 nt, Human
agggaagcaauauuagauauca

SEQ ID NO: 645223 - RNA, 22 nt, Human
uccuucagcuacucaguuucca

SEQ ID NO: 645224 - RNA, 19 nt, Human
gccuaugucuucaaaucau

SEQ ID NO: 645225 - RNA, 22 nt, Human
cccugguucagguuucucugaa

SEQ ID NO: 645226 - RNA, 22 nt, Human
gcagggggucauucacgcuggc

SEQ ID NO: 645227 - RNA, 22 nt, Human
agaaaccugugugcugugauga

SEQ ID NO: 645228 - RNA, 22 nt, Human
auuaguugaacaaguuaaguaa

SEQ ID NO: 645229 - RNA, 22 nt, Human
cccaguggcuuuugcccagguu

SEQ ID NO: 645230 - RNA, 22 nt, Human
ccucuggccaucccccauuaag

SEQ ID NO: 645231 - RNA, 22 nt, Human
agccaggcagggcucucgcucu

SEQ ID NO: 645232 - RNA, 22 nt, Human
guguccugccacccugggcuuu

SEQ ID NO: 645233 - RNA, 22 nt, Human
ucauccuuuugcaugggaaggc

SEQ ID NO: 645234 - RNA, 22 nt, Human
uggcugggagcuggaacugggc

SEQ ID NO: 645235 - RNA, 22 nt, Human
ccuuggggaacuggacgugcug

SEQ ID NO: 645236 - RNA, 22 nt, Human
ugaggcucuaugugguagauua

SEQ ID NO: 645237 - RNA, 22 nt, Human
agaggcuccuucacucuggcac

SEQ ID NO: 645238 - RNA, 22 nt, Human
cuggucugaaaaggaggcaugc

SEQ ID NO: 645239 - RNA, 22 nt, Human
cagcagcuccaaagaauagcca

SEQ ID NO: 645240 - RNA, 22 nt, Human
uagaaaggauauugagaugaau

SEQ ID NO: 645241 - RNA, 22 nt, Human
caugccuguaaucccagcucuu

SEQ ID NO: 645242 - RNA, 22 nt, Human
uguauuuugugaggaucacucu

SEQ ID NO: 645243 - RNA, 22 nt, Human
aaaguaugauuggggauuauuu

SEQ ID NO: 645244 - RNA, 22 nt, Human
acuucucugcuaccugcaaaga

SEQ ID NO: 645245 - RNA, 22 nt, Human
uugcuuuauguguaugacuuga

SEQ ID NO: 645246 - RNA, 22 nt, Human
cuuauuagaguuguguucuguu

SEQ ID NO: 645247 - RNA, 22 nt, Human
cuagggacagaaagaggguaga

SEQ ID NO: 645248 - RNA, 22 nt, Human
ugcaguuagccuaggauugagc

SEQ ID NO: 645249 - RNA, 22 nt, Human
aggauauaaaaagacuauuugg

SEQ ID NO: 645250 - RNA, 17 nt, Human
ggccuugggcugcucuu

SEQ ID NO: 645251 - RNA, 22 nt, Human
auucucucucuaugaaaacuga

SEQ ID NO: 645252 - RNA, 22 nt, Human
gaucauagcgucuucuugcagc

SEQ ID NO: 645253 - RNA, 22 nt, Human
cugggagguggagguugcauug

SEQ ID NO: 645254 - RNA, 22 nt, Human
uaaagccacgcuggaaaucagg

SEQ ID NO: 645255 - RNA, 17 nt, Human
gcaaggccuguuuguuc

SEQ ID NO: 645256 - RNA, 22 nt, Human
cuccaggacccaguggcuccag

SEQ ID NO: 645257 - RNA, 19 nt, Human
ucaguuuuagucaucaguu

SEQ ID NO: 645258 - RNA, 22 nt, Human
ucucacugcaaauauuauguau

SEQ ID NO: 645259 - RNA, 22 nt, Human
ugcuggguuaccuaagccuaaa

SEQ ID NO: 645260 - RNA, 22 nt, Human
uggccccuggcacacggaggau

SEQ ID NO: 645261 - RNA, 19 nt, Human
cuuccuugcuccccaugug

SEQ ID NO: 645262 - RNA, 22 nt, Human
gaauuaguguugaaaucagggc

SEQ ID NO: 645263 - RNA, 22 nt, Human
ucccaaagucaagcugugucuu

SEQ ID NO: 645264 - RNA, 22 nt, Human
uguuuauagggucugucacuug

SEQ ID NO: 645265 - RNA, 22 nt, Human
uaaguuuucuggaauaacuugg

SEQ ID NO: 645266 - RNA, 22 nt, Human
caaggccaaagggccacuguca

SEQ ID NO: 645267 - RNA, 22 nt, Human
uggggccagggaggaccagaca

SEQ ID NO: 645268 - RNA, 21 nt, Human
ugccagcauguaggcuaguug

SEQ ID NO: 645269 - RNA, 22 nt, Human
cugagggagcugcuggccuugg

SEQ ID NO: 645270 - RNA, 22 nt, Human
uucuggaauucuugcagccacu

SEQ ID NO: 645271 - RNA, 22 nt, Human
gagcucagacucgggccugggg

SEQ ID NO: 645272 - RNA, 22 nt, Human
auuuccuaauuuagggauagac

SEQ ID NO: 645273 - RNA, 22 nt, Human
aaugucuucaguucuguauugu

SEQ ID NO: 645274 - RNA, 22 nt, Human
ucaaaugcacguagagaaaaua

SEQ ID NO: 645275 - RNA, 23 nt, Human
ucaaacauauugugagacacagg

SEQ ID NO: 645276 - RNA, 18 nt, Human
gccagugcccuggcucac

SEQ ID NO: 645277 - RNA, 22 nt, Human
cccuugcacauuugucuuuaau

SEQ ID NO: 645278 - RNA, 22 nt, Human
ugccugggaaccaauccuggcu

SEQ ID NO: 645279 - RNA, 22 nt, Human
ucaguguuuuaacugucuuuua

SEQ ID NO: 645280 - RNA, 22 nt, Human
gaggucucacuauguugcccag

SEQ ID NO: 645281 - RNA, 22 nt, Human
ugguuccacuaaccugagagcc

SEQ ID NO: 645282 - RNA, 22 nt, Human
cccuguggcaggaggaggagca

SEQ ID NO: 645283 - RNA, 22 nt, Human
cccuguggaggcagcauccugc

SEQ ID NO: 645284 - RNA, 22 nt, Human
agcagauguucccuggucccuu

SEQ ID NO: 645285 - RNA, 22 nt, Human
aauaggaaaauauuuaacaaga

SEQ ID NO: 645286 - RNA, 22 nt, Human
gaacagcagcucguucucgaug

SEQ ID NO: 645287 - RNA, 22 nt, Human
ugggugaggagaggcugucuaa

SEQ ID NO: 645288 - RNA, 22 nt, Human
gaaugcaugugaagcaaagaau

SEQ ID NO: 645289 - RNA, 22 nt, Human
cuaacuacaagcggggcauccu

SEQ ID NO: 645290 - RNA, 22 nt, Human
gaugacaaaagaguaaguaaug

SEQ ID NO: 645291 - RNA, 22 nt, Human
ucacaguauagaguuauuuugg

SEQ ID NO: 645292 - RNA, 22 nt, Human
aaguuguaugucuuagaaagua

SEQ ID NO: 645293 - RNA, 22 nt, Human
ugucucugccagcuagcagaau

SEQ ID NO: 645294 - RNA, 22 nt, Human
aaaugcaugagaaaguauucug

SEQ ID NO: 645295 - RNA, 22 nt, Human
ugggccugcuggggcauuuuca

SEQ ID NO: 645296 - RNA, 22 nt, Human
ugaaguacccguuuuuauugca

SEQ ID NO: 645297 - RNA, 22 nt, Human
auugucuuagucagcucggacu

SEQ ID NO: 645298 - RNA, 22 nt, Human
acuggcagagacccugauggcc

SEQ ID NO: 645299 - RNA, 22 nt, Human
aacuuuggcaagucagacuucu

SEQ ID NO: 645300 - RNA, 22 nt, Human
gagcgauugcgggggucagagg

SEQ ID NO: 645301 - RNA, 22 nt, Human
ccaggcacugcucgaggugcua

SEQ ID NO: 645302 - RNA, 22 nt, Human
cccuggcaaaacacucucuuga

SEQ ID NO: 645303 - RNA, 22 nt, Human
uccuuuggcaagcucugcucuu

SEQ ID NO: 645304 - RNA, 22 nt, Human
ggguggagccugagaauuugca

SEQ ID NO: 645305 - RNA, 22 nt, Human
uauaaauuaaugugcccaugag

SEQ ID NO: 645306 - RNA, 22 nt, Human
agacaggacacaagcugcauaa

SEQ ID NO: 645307 - RNA, 22 nt, Human
aaacagucuugugggcuuggag

SEQ ID NO: 645308 - RNA, 22 nt, Human
cugccuggcccagggaugggcc

SEQ ID NO: 645309 - RNA, 22 nt, Human
ugcgccucuaaucucgggcguc

SEQ ID NO: 645310 - RNA, 22 nt, Human
gcacagaacagagaaauagcca

SEQ ID NO: 645311 - RNA, 22 nt, Human
aaccuguuuugguugcauuuca

SEQ ID NO: 645312 - RNA, 22 nt, Human
aagggcuccacuugaaucacac

SEQ ID NO: 645313 - RNA, 22 nt, Human
ucauccaugaagagugacagaa

SEQ ID NO: 645314 - RNA, 22 nt, Human
ugcaaaauaaugaacgauuuuu

SEQ ID NO: 645315 - RNA, 22 nt, Human
gugcucugggcugccugacaug

SEQ ID NO: 645316 - RNA, 22 nt, Human
cuggggucucaauucuagcggg

SEQ ID NO: 645317 - RNA, 22 nt, Human
ccucugugucagggaagagacu

SEQ ID NO: 645318 - RNA, 22 nt, Human
ugacaacaucauuuuugugugg

SEQ ID NO: 645319 - RNA, 22 nt, Human
ccugcugucucugggcaggcag

SEQ ID NO: 645320 - RNA, 20 nt, Human
uugaggcaugucuagaagua

SEQ ID NO: 645321 - RNA, 22 nt, Human
cugcagggauugcuucuguaua

SEQ ID NO: 645322 - RNA, 22 nt, Human
agcaaagcaguggcuaagcuga

SEQ ID NO: 645323 - RNA, 22 nt, Human
agggcucaagggcaugcuacgu

SEQ ID NO: 645324 - RNA, 22 nt, Human
aauuaugguggaucccaguggg

SEQ ID NO: 645325 - RNA, 23 nt, Human
uugcaaaaugagucuugagugaa

SEQ ID NO: 645326 - RNA, 22 nt, Human
auacagaugggucagauuucau

SEQ ID NO: 645327 - RNA, 22 nt, Human
uagauuucaggcuggcuugcgg

SEQ ID NO: 645328 - RNA, 22 nt, Human
aggcccuggggucuguuaaauu

SEQ ID NO: 645329 - RNA, 22 nt, Human
ucgauaauaucuuacaugugcu

SEQ ID NO: 645330 - RNA, 22 nt, Human
auguggccuuagguucuagugg

SEQ ID NO: 645331 - RNA, 22 nt, Human
ccacacugaaccucagugucuu

SEQ ID NO: 645332 - RNA, 22 nt, Human
auggaaauccaagucaccguag

SEQ ID NO: 645333 - RNA, 23 nt, Human
ucugucacuuucugcuguggagu

SEQ ID NO: 645334 - RNA, 22 nt, Human
cucugagacucaagugaguggg

SEQ ID NO: 645335 - RNA, 22 nt, Human
caugugugugagggaaacaugu

SEQ ID NO: 645336 - RNA, 22 nt, Human
uauauuaaaugaccaguuuuaa

SEQ ID NO: 645337 - RNA, 22 nt, Human
ccuuagcauggcugugcugugu

SEQ ID NO: 645338 - RNA, 22 nt, Human
cuccagaauuguccauuggaaa

SEQ ID NO: 645339 - RNA, 22 nt, Human
ccagagccugcugagccccauu

SEQ ID NO: 645340 - RNA, 22 nt, Human
cugcucuaacugcauuaguuuu

SEQ ID NO: 645341 - RNA, 22 nt, Human
uucuguuacuguuggucauaac

SEQ ID NO: 645342 - RNA, 22 nt, Human
ucugaaagcuagaaaaugcucu

SEQ ID NO: 645343 - RNA, 22 nt, Human
agcacaggcuuuggugugaggg

SEQ ID NO: 645344 - RNA, 22 nt, Human
aggguggcuggaggaaucagaa

SEQ ID NO: 645345 - RNA, 22 nt, Human
gucacacacauuucuuuggugc

SEQ ID NO: 645346 - RNA, 19 nt, Human
uagucucugaugaggcuuu

SEQ ID NO: 645347 - RNA, 22 nt, Human
aacucugguuucagacucacuu

SEQ ID NO: 645348 - RNA, 22 nt, Human
uucagucuccucauuuuacaaa

SEQ ID NO: 645349 - RNA, 22 nt, Human
gcacugcaucuacuggcaagua

SEQ ID NO: 645350 - RNA, 22 nt, Human
accaggaguuuugaccaggggc

SEQ ID NO: 645351 - RNA, 22 nt, Human
gauaucaugggaagguguacuu

SEQ ID NO: 645352 - RNA, 22 nt, Human
caccagguggaaaugucacagc

SEQ ID NO: 645353 - RNA, 22 nt, Human
agaaggguaguuguaagaguga

SEQ ID NO: 645354 - RNA, 22 nt, Human
gauuucuucucucccaagagga

SEQ ID NO: 645355 - RNA, 22 nt, Human
uucagcagcuuuuaguacauug

SEQ ID NO: 645356 - RNA, 22 nt, Human
aagcaacuccuaggaggaaagg

SEQ ID NO: 645357 - RNA, 22 nt, Human
ucugccuggauuccauucucca

SEQ ID NO: 645358 - RNA, 22 nt, Human
uaugugcauuaucuaguucauu

SEQ ID NO: 645359 - RNA, 22 nt, Human
uggcugggcccccaccugccuc

SEQ ID NO: 645360 - RNA, 22 nt, Human
ucuuuccuguaacugcuguuca

SEQ ID NO: 645361 - RNA, 19 nt, Human
ggugaccaccuggucagug

SEQ ID NO: 645362 - RNA, 22 nt, Human
aacaaugcacuaucguaagugg

SEQ ID NO: 645363 - RNA, 22 nt, Human
cuguguaguauuuguacacaua

SEQ ID NO: 645364 - RNA, 22 nt, Human
uguaugcuuguguauaauauaa

SEQ ID NO: 645365 - RNA, 22 nt, Human
ccauucauagcaagcuacaucu

SEQ ID NO: 645366 - RNA, 22 nt, Human
ccaggcugaauauguuccaggg

SEQ ID NO: 645367 - RNA, 22 nt, Human
uuuguguuuaauacaaggaccu

SEQ ID NO: 645368 - RNA, 22 nt, Human
guggccagccagggugcugaug

SEQ ID NO: 645369 - RNA, 22 nt, Human
ugcugagguaaccauauccugc

SEQ ID NO: 645370 - RNA, 22 nt, Human
aaagccaucaguaaaaugauuu

SEQ ID NO: 645371 - RNA, 22 nt, Human
gcuucuguuaacuuauguuccc

SEQ ID NO: 645372 - RNA, 22 nt, Human
cccauuuagauaacaguucaaa

SEQ ID NO: 645373 - RNA, 22 nt, Human
cuggagggacaagguaugcauu

SEQ ID NO: 645374 - RNA, 22 nt, Human
aaaugucaaagacguguuuuug

SEQ ID NO: 645375 - RNA, 22 nt, Human
uaagugggugaagaggaaauau

SEQ ID NO: 645376 - RNA, 22 nt, Human
ucagagugaggcgucaacauga

SEQ ID NO: 645377 - RNA, 22 nt, Human
caauuuuacucuuccucuucca

SEQ ID NO: 645378 - RNA, 22 nt, Human
ccaugagccaggcugaggaagc

SEQ ID NO: 645379 - RNA, 22 nt, Human
ugcuuuuagcuaguaacuagua

SEQ ID NO: 645380 - RNA, 22 nt, Human
uucauacuaaaguguaagaugu

SEQ ID NO: 645381 - RNA, 22 nt, Human
gacaugauggaaaaaaaugcuc

SEQ ID NO: 645382 - RNA, 22 nt, Human
cagagcugguguuacaagucca

SEQ ID NO: 645383 - RNA, 22 nt, Human
gaacagaagaggcuggugccac

SEQ ID NO: 645384 - RNA, 22 nt, Human
acagguguacaaugcaugacag

SEQ ID NO: 645385 - RNA, 22 nt, Human
cagaggguggaggccaggcucu

SEQ ID NO: 645386 - RNA, 22 nt, Human
uagggcuggcgugcucagggaa

SEQ ID NO: 645387 - RNA, 16 nt, Human
aggcagcauguuagug

SEQ ID NO: 645388 - RNA, 22 nt, Human
aguuaucagguguuuucaugga

SEQ ID NO: 645389 - RNA, 22 nt, Human
cucucugcuguauccuuaggcu

SEQ ID NO: 645390 - RNA, 20 nt, Human
ggccauggguugccugaggu

SEQ ID NO: 645391 - RNA, 22 nt, Human
acacagagcuggaacugcuuca

SEQ ID NO: 645392 - RNA, 22 nt, Human
uccauuaaugauuauuucugug

SEQ ID NO: 645393 - RNA, 22 nt, Human
uuuaucuguuguaccugcauug

SEQ ID NO: 645394 - RNA, 22 nt, Human
uagcugccuagacagcuauagc

SEQ ID NO: 645395 - RNA, 22 nt, Human
acugggaagacaagaaagauag

SEQ ID NO: 645396 - RNA, 22 nt, Human
augauggugagguugagcacag

SEQ ID NO: 645397 - RNA, 22 nt, Human
caaggcaggcaguucacuugag

SEQ ID NO: 645398 - RNA, 22 nt, Human
gugcagcugccgaucagauagg

SEQ ID NO: 645399 - RNA, 22 nt, Human
cugccacucugggugggccugg

SEQ ID NO: 645400 - RNA, 22 nt, Human
uuugcauuuauaaguuggugga

SEQ ID NO: 645401 - RNA, 22 nt, Human
uccuuggagguguucaucugcc

SEQ ID NO: 645402 - RNA, 22 nt, Human
uuacaaguacugaauaugauuu

SEQ ID NO: 645403 - RNA, 22 nt, Human
gucugucucccugugacugaga

SEQ ID NO: 645404 - RNA, 22 nt, Human
aacacuuuguugccuaugaacg

SEQ ID NO: 645405 - RNA, 22 nt, Human
cuguggcuucuagguccccgau

SEQ ID NO: 645406 - RNA, 22 nt, Human
uaugcgugccucugucugucug

SEQ ID NO: 645407 - RNA, 22 nt, Human
acccuggagcuuuucuggcccu

SEQ ID NO: 645408 - RNA, 18 nt, Human
uucaguuucuaguuccuu

SEQ ID NO: 645409 - RNA, 22 nt, Human
aagagcugauuaagucaugagg

SEQ ID NO: 645410 - RNA, 22 nt, Human
uggcugcagaucugugggacac

SEQ ID NO: 645411 - RNA, 22 nt, Human
cucccuucaggagaggcucaca

SEQ ID NO: 645412 - RNA, 19 nt, Human
gggcuuggggcugaagccu

SEQ ID NO: 645413 - RNA, 22 nt, Human
ccucaggauccgcaggugcagu

SEQ ID NO: 645414 - RNA, 22 nt, Human
uuuugaagaagaugggaauuua

SEQ ID NO: 645415 - RNA, 22 nt, Human
cauucuuauauuuacucauuca

SEQ ID NO: 645416 - RNA, 16 nt, Human
agggguacaguucauc

SEQ ID NO: 645417 - RNA, 23 nt, Human
uucugucuugcugucagcuuucu

SEQ ID NO: 645418 - RNA, 22 nt, Human
acuucuggugucauacugcauu

SEQ ID NO: 645419 - RNA, 22 nt, Human
auuuucagugaucauagcacac

SEQ ID NO: 645420 - RNA, 22 nt, Human
gcaccccucagcuuguuuacua

SEQ ID NO: 645421 - RNA, 22 nt, Human
ccuuucuguguugcccuauuug

SEQ ID NO: 645422 - RNA, 22 nt, Human
cuggggacucauucagagcaua

SEQ ID NO: 645423 - RNA, 19 nt, Human
cacagggcaggucucaugu

SEQ ID NO: 645424 - RNA, 22 nt, Human
cagaccagcucuaugaacccaa

SEQ ID NO: 645425 - RNA, 22 nt, Human
uuauuacacugaaagaauugcg

SEQ ID NO: 645426 - RNA, 22 nt, Human
ccucacucugcacccugcagca

SEQ ID NO: 645427 - RNA, 22 nt, Human
cuggcugguuacuauuucuggu

SEQ ID NO: 645428 - RNA, 22 nt, Human
cuugaaagcacuccuuugacug

SEQ ID NO: 645429 - RNA, 23 nt, Human
uggcucugagagguucagaugcu

SEQ ID NO: 645430 - RNA, 22 nt, Human
aaugaauaacaauccucuggag

SEQ ID NO: 645431 - RNA, 22 nt, Human
gggcacugacagggucccaacu

SEQ ID NO: 645432 - RNA, 20 nt, Human
uauuuguauuugggaaaguu

SEQ ID NO: 645433 - RNA, 22 nt, Human
gagucuccuacuggcuguccuu

SEQ ID NO: 645434 - RNA, 22 nt, Human
uggagaugaauauguguaccug

SEQ ID NO: 645435 - RNA, 22 nt, Human
aauuaucagauauaaaacugca

SEQ ID NO: 645436 - RNA, 22 nt, Human
guaggcagaauaauuccuccuu

SEQ ID NO: 645437 - RNA, 22 nt, Human
cucacaccagcuuacaagacuu

SEQ ID NO: 645438 - RNA, 22 nt, Human
uugaaagaagaagcugcgaugu

SEQ ID NO: 645439 - RNA, 22 nt, Human
cugccuugaaaaugaagcuuua

SEQ ID NO: 645440 - RNA, 22 nt, Human
agagcacaaauuaguuggucuu

SEQ ID NO: 645441 - RNA, 22 nt, Human
uuuugguacaugcaauagcaau

SEQ ID NO: 645442 - RNA, 22 nt, Human
uaaucacugugagucuguuuuc

SEQ ID NO: 645443 - RNA, 22 nt, Human
guuugucaggagguugaaguca

SEQ ID NO: 645444 - RNA, 22 nt, Human
gccuggcuucccuuggagcauu

SEQ ID NO: 645445 - RNA, 22 nt, Human
agcaguuugaaucaauggccag

SEQ ID NO: 645446 - RNA, 22 nt, Human
ucuuagcaaauacuacuuagaa

SEQ ID NO: 645447 - RNA, 22 nt, Human
ucaggagagaguuggguaggcu

SEQ ID NO: 645448 - RNA, 23 nt, Human
ccguguguauacucuguaauaga

SEQ ID NO: 645449 - RNA, 18 nt, Human
aaagcuguuauuccagaa

SEQ ID NO: 645450 - RNA, 22 nt, Human
aggucugaaagccucagucaca

SEQ ID NO: 645451 - RNA, 22 nt, Human
uggaugccugggccuccuucca

SEQ ID NO: 645452 - RNA, 18 nt, Human
aaaggcagauuacuggga

SEQ ID NO: 645453 - RNA, 22 nt, Human
cccucccuuugcagcagugcau

SEQ ID NO: 645454 - RNA, 22 nt, Human
agcgggucugcaagccuucccu

SEQ ID NO: 645455 - RNA, 22 nt, Human
uucucaguuucacugauaacag

SEQ ID NO: 645456 - RNA, 22 nt, Human
uauguucuuuacaucugugcaa

SEQ ID NO: 645457 - RNA, 23 nt, Human
uucauacagaaacaucacuucau

SEQ ID NO: 645458 - RNA, 22 nt, Human
ccaaugauggugcccacgauga

SEQ ID NO: 645459 - RNA, 22 nt, Human
ccuggcaccuucacagacuacu

SEQ ID NO: 645460 - RNA, 22 nt, Human
uggucugauauuuuuucuuacc

SEQ ID NO: 645461 - RNA, 23 nt, Human
ucagcugcuuccuccugccugcc

SEQ ID NO: 645462 - RNA, 22 nt, Human
auucuaggcuugaaacaugaag

SEQ ID NO: 645463 - RNA, 22 nt, Human
agugaggcaaagugagaggcag

SEQ ID NO: 645464 - RNA, 22 nt, Human
gagauaacucuaggucuucgag

SEQ ID NO: 645465 - RNA, 22 nt, Human
aagcugcuuugucaggaauaug

SEQ ID NO: 645466 - RNA, 22 nt, Human
ugaggcccaucugagauuuuga

SEQ ID NO: 645467 - RNA, 22 nt, Human
uauugaaauucuucauguccuc

SEQ ID NO: 645468 - RNA, 22 nt, Human
gacugaggagguaagguuugaa

SEQ ID NO: 645469 - RNA, 22 nt, Human
agaggggaggcgaaccagaguc

SEQ ID NO: 645470 - RNA, 22 nt, Human
accaguccgcggagcuccgggg

SEQ ID NO: 645471 - RNA, 22 nt, Human
ccucuuugugccugcaggcugc

SEQ ID NO: 645472 - RNA, 22 nt, Human
cuuuaguuaguagauaauggca

SEQ ID NO: 645473 - RNA, 22 nt, Human
cacccaggcuggaaugcaaugg

SEQ ID NO: 645474 - RNA, 22 nt, Human
uuucauaauagugcaguuuguu

SEQ ID NO: 645475 - RNA, 22 nt, Human
uuccacaggacuaaaugucauc

SEQ ID NO: 645476 - RNA, 22 nt, Human
uucuaccucaguuucccacuua

SEQ ID NO: 645477 - RNA, 23 nt, Human
aagcugccagucugaagccuggg

SEQ ID NO: 645478 - RNA, 22 nt, Human
agguggugaugacagaagacag

SEQ ID NO: 645479 - RNA, 22 nt, Human
gaucuggaaucugaaggcugag

SEQ ID NO: 645480 - RNA, 22 nt, Human
gcauguggaaucucuccauggu

SEQ ID NO: 645481 - RNA, 22 nt, Human
cuggagccccaggcugugcaga

SEQ ID NO: 645482 - RNA, 22 nt, Human
ccagugauggugaucagauguu

SEQ ID NO: 645483 - RNA, 22 nt, Human
aaaaccugugaauaguuaacuc

SEQ ID NO: 645484 - RNA, 22 nt, Human
ugaaaauuaagcagaugaauga

SEQ ID NO: 645485 - RNA, 22 nt, Human
aaaguugcacaacuuuguauac

SEQ ID NO: 645486 - RNA, 22 nt, Human
uuccuucuuccagaggcugccc

SEQ ID NO: 645487 - RNA, 22 nt, Human
aggcugaggcagguggaucauu

SEQ ID NO: 645488 - RNA, 22 nt, Human
cacuguacuggguugaaggacg

SEQ ID NO: 645489 - RNA, 22 nt, Human
uuauauuaguuagacuugcugu

SEQ ID NO: 645490 - RNA, 22 nt, Human
uucagagccacuucaagucuaa

SEQ ID NO: 645491 - RNA, 22 nt, Human
aucagagucagaggcuagagcu

SEQ ID NO: 645492 - RNA, 22 nt, Human
caaagaugucauugguaagaca

SEQ ID NO: 645493 - RNA, 22 nt, Human
ucuggccccggucuucacagcu

SEQ ID NO: 645494 - RNA, 22 nt, Human
uguuuuaagggucaacugucac

SEQ ID NO: 645495 - RNA, 21 nt, Human
uuucaauuugccuugagucau

SEQ ID NO: 645496 - RNA, 22 nt, Human
agggcucaucugagacugacau

SEQ ID NO: 645497 - RNA, 22 nt, Human
ggcucugcugguaagaugccuc

SEQ ID NO: 645498 - RNA, 22 nt, Human
ugcaggccggcccuaggccuca

SEQ ID NO: 645499 - RNA, 21 nt, Human
ccagcagcucaaggaucucuu

SEQ ID NO: 645500 - RNA, 22 nt, Human
gagcuuuacuucugacuggugc

SEQ ID NO: 645501 - RNA, 22 nt, Human
aguggcuggagccccaggcugg

SEQ ID NO: 645502 - RNA, 23 nt, Human
ugcagaggcaugaucacugcuca

SEQ ID NO: 645503 - RNA, 22 nt, Human
acuucacauuugcaagucuugg

SEQ ID NO: 645504 - RNA, 22 nt, Human
augcaaauaaacagucuaguug

SEQ ID NO: 645505 - RNA, 22 nt, Human
gggcucugaaucccaggucugc

SEQ ID NO: 645506 - RNA, 22 nt, Human
cugccugcuuuucugggagccg

SEQ ID NO: 645507 - RNA, 22 nt, Human
gacccuggagccgucugaggca

SEQ ID NO: 645508 - RNA, 22 nt, Human
gcugugcuugggaagaaucucu

SEQ ID NO: 645509 - RNA, 22 nt, Human
acagcuggaggggcugcagagg

SEQ ID NO: 645510 - RNA, 22 nt, Human
agucccagaucuccauucgguc

SEQ ID NO: 645511 - RNA, 22 nt, Human
aggugccagcucucaggcagga

SEQ ID NO: 645512 - RNA, 22 nt, Human
ccccaaggugcucacugucugg

SEQ ID NO: 645513 - RNA, 22 nt, Human
aaaucagaggucagcuguacca

SEQ ID NO: 645514 - RNA, 22 nt, Human
aacaaaugaccugauuucuucc

SEQ ID NO: 645515 - RNA, 22 nt, Human
cccagguagugagaaauggagg

SEQ ID NO: 645516 - RNA, 22 nt, Human
cugagcugguguuucaggguca

SEQ ID NO: 645517 - RNA, 18 nt, Human
agcagguggcgucugcag

SEQ ID NO: 645518 - RNA, 19 nt, Human
cagugauuaauucaucuua

SEQ ID NO: 645519 - RNA, 22 nt, Human
ucacaaauagcuauauuaagga

SEQ ID NO: 645520 - RNA, 22 nt, Human
gggccacacagaaccuccuggu

SEQ ID NO: 645521 - RNA, 22 nt, Human
cagagucagagcaccugggauu

SEQ ID NO: 645522 - RNA, 22 nt, Human
gaacacaguacuuuuccugaug

SEQ ID NO: 645523 - RNA, 22 nt, Human
uugaaaggugcugugugcugau

SEQ ID NO: 645524 - RNA, 20 nt, Human
ucucuguaaaucuucuuuua

SEQ ID NO: 645525 - RNA, 22 nt, Human
ugacauuuaucuucuacaauga

SEQ ID NO: 645526 - RNA, 22 nt, Human
agguuccaucaccugcagugga

SEQ ID NO: 645527 - RNA, 22 nt, Human
ugaaugauacagaauuauguag

SEQ ID NO: 645528 - RNA, 22 nt, Human
gugaggcagaaguucccuuuua

SEQ ID NO: 645529 - RNA, 22 nt, Human
ugguuauaaauugcuaugcaga

SEQ ID NO: 645530 - RNA, 22 nt, Human
cacucugggcucuuguuucaga

SEQ ID NO: 645531 - RNA, 22 nt, Human
uggacacacauguaugucagag

SEQ ID NO: 645532 - RNA, 22 nt, Human
agagggcccauguugggcugcu

SEQ ID NO: 645533 - RNA, 22 nt, Human
gacacugaagucacuaagcagg

SEQ ID NO: 645534 - RNA, 22 nt, Human
gccuccugaagugcugggauua

SEQ ID NO: 645535 - RNA, 22 nt, Human
ugggcuucuggaguggggcaga

SEQ ID NO: 645536 - RNA, 22 nt, Human
uagggcuguuuaaaagugaggu

SEQ ID NO: 645537 - RNA, 22 nt, Human
uucaugaaacuuaacuguuggg

SEQ ID NO: 645538 - RNA, 22 nt, Human
gcacugggugugaggcagcguc

SEQ ID NO: 645539 - RNA, 22 nt, Human
gcugggcagcaggcucuccggg

SEQ ID NO: 645540 - RNA, 22 nt, Human
acugucuuccaggucuggaggu

SEQ ID NO: 645541 - RNA, 22 nt, Human
ucugaaauguucucuuguuuug

SEQ ID NO: 645542 - RNA, 22 nt, Human
ucccucagacagauguguuccu

SEQ ID NO: 645543 - RNA, 22 nt, Human
agacucuggaggggcugguccu

SEQ ID NO: 645544 - RNA, 22 nt, Human
agaaaauauucauugagaggcu

SEQ ID NO: 645545 - RNA, 22 nt, Human
uaucuuuaaugcuuggagguua

SEQ ID NO: 645546 - RNA, 20 nt, Human
agccuggcaaacacccccag

SEQ ID NO: 645547 - RNA, 22 nt, Human
uuguguguuuguagaaaaucca

SEQ ID NO: 645548 - RNA, 22 nt, Human
gcacuuaugcucaccuuguucu

SEQ ID NO: 645549 - RNA, 22 nt, Human
gcucagggccuggcugcggacu

SEQ ID NO: 645550 - RNA, 21 nt, Human
uggagagcccuugccugaguc

SEQ ID NO: 645551 - RNA, 22 nt, Human
acacauuaugagcaguugucuu

SEQ ID NO: 645552 - RNA, 22 nt, Human
ccugugcaugccaggguacacc

SEQ ID NO: 645553 - RNA, 22 nt, Human
ucagccucauuuucugcucugu

SEQ ID NO: 645554 - RNA, 22 nt, Human
gaggcugaugcugccucacaga

SEQ ID NO: 645555 - RNA, 20 nt, Human
cugcccacuagaacuaccug

SEQ ID NO: 645556 - RNA, 22 nt, Human
gucagaggaauggaugagugau

SEQ ID NO: 645557 - RNA, 22 nt, Human
cucuggguguuaaugucagugu

SEQ ID NO: 645558 - RNA, 22 nt, Human
acugaaaaaguaugauucacug

SEQ ID NO: 645559 - RNA, 22 nt, Human
accuuuauagcugauuaugaca

SEQ ID NO: 645560 - RNA, 22 nt, Human
uaguuuuuaaguguacaauuuc

SEQ ID NO: 645561 - RNA, 22 nt, Human
uucuaacaaguggcuuguuagu

SEQ ID NO: 645562 - RNA, 22 nt, Human
acugccucuuggugcugagaga

SEQ ID NO: 645563 - RNA, 22 nt, Human
gguuuuauuaacuuuaacauca

SEQ ID NO: 645564 - RNA, 22 nt, Human
ccuguguguaggccaggggagu

SEQ ID NO: 645565 - RNA, 22 nt, Human
auuaggauuuuguccaaguagc

SEQ ID NO: 645566 - RNA, 22 nt, Human
uuauguuuuauggcuauaucau

SEQ ID NO: 645567 - RNA, 22 nt, Human
gggugacauuaggaagauagac

SEQ ID NO: 645568 - RNA, 22 nt, Human
uuugaaagcuacuuucggguca

SEQ ID NO: 645569 - RNA, 21 nt, Human
accaggccaggaggcuggcac

SEQ ID NO: 645570 - RNA, 23 nt, Human
acuaaauggggcuuugcuuaaag

SEQ ID NO: 645571 - RNA, 22 nt, Human
ucaggcugcaucuguaagggug

SEQ ID NO: 645572 - RNA, 23 nt, Human
augaaaguucuuaaaaugucaug

SEQ ID NO: 645573 - RNA, 22 nt, Human
gccucugcaacuccgccuuggu

SEQ ID NO: 645574 - RNA, 23 nt, Human
agggaacaagcaagcugcuaguc

SEQ ID NO: 645575 - RNA, 22 nt, Human
uagaacagaggguugcccagau

SEQ ID NO: 645576 - RNA, 20 nt, Human
ugcuggggacauacagggug

SEQ ID NO: 645577 - RNA, 22 nt, Human
agggcugaagggaggugcucau

SEQ ID NO: 645578 - RNA, 22 nt, Human
aagaaaucauaucauuucuugg

SEQ ID NO: 645579 - RNA, 22 nt, Human
agcugcccagauaggaggaggc

SEQ ID NO: 645580 - RNA, 23 nt, Human
uaguuacauuauugucagagcug

SEQ ID NO: 645581 - RNA, 15 nt, Human
auacacaugagggag

SEQ ID NO: 645582 - RNA, 22 nt, Human
ugacauaaaccagugagcaaaa

SEQ ID NO: 645583 - RNA, 22 nt, Human
gcuucgggguccaagcgcgugu

SEQ ID NO: 645584 - RNA, 22 nt, Human
agucacagggggccccugcaac

SEQ ID NO: 645585 - RNA, 22 nt, Human
ggucagaggaggaauaggacau

SEQ ID NO: 645586 - RNA, 19 nt, Human
gauaaguuuccagguaacu

SEQ ID NO: 645587 - RNA, 19 nt, Human
aggcagcacccaguccuug

SEQ ID NO: 645588 - RNA, 22 nt, Human
agagauucauguuuacuguagg

SEQ ID NO: 645589 - RNA, 22 nt, Human
ucugggcuuuugcacuggccau

SEQ ID NO: 645590 - RNA, 22 nt, Human
acacuucagcuccacaaacauu

SEQ ID NO: 645591 - RNA, 22 nt, Human
agggcugagcccaggcauguag

SEQ ID NO: 645592 - RNA, 22 nt, Human
cagagcuggcggugagaagaca

SEQ ID NO: 645593 - RNA, 22 nt, Human
gcaguaaauaauuuuguguaua

SEQ ID NO: 645594 - RNA, 22 nt, Human
aguaacaguaacaucuuccuag

SEQ ID NO: 645595 - RNA, 22 nt, Human
ccaggcagaugggccggcuuca

SEQ ID NO: 645596 - RNA, 22 nt, Human
acaggcugacuuccugccaugu

SEQ ID NO: 645597 - RNA, 22 nt, Human
aaaaugaacagaacaaugggga

SEQ ID NO: 645598 - RNA, 22 nt, Human
accauagacuggaggaucuccu

SEQ ID NO: 645599 - RNA, 22 nt, Human
cuugcacacauguacaugugua

SEQ ID NO: 645600 - RNA, 22 nt, Human
ucuaagaaaucagaugaugagg

SEQ ID NO: 645601 - RNA, 23 nt, Human
ccagccucugggucuucauccag

SEQ ID NO: 645602 - RNA, 22 nt, Human
acuagcagggauguuauuacuu

SEQ ID NO: 645603 - RNA, 20 nt, Human
uggagcugugguaaggagca

SEQ ID NO: 645604 - RNA, 22 nt, Human
agcugggcagugcuuggauuca

SEQ ID NO: 645605 - RNA, 22 nt, Human
aagcaauucacaguucacuuaa

SEQ ID NO: 645606 - RNA, 22 nt, Human
caggacagagcccagacugugu

SEQ ID NO: 645607 - RNA, 22 nt, Human
gcagcugggccccagccucucc

SEQ ID NO: 645608 - RNA, 22 nt, Human
acuggacagaggaaauauggag

SEQ ID NO: 645609 - RNA, 22 nt, Human
uucugcucugacuugcaaggaa

SEQ ID NO: 645610 - RNA, 22 nt, Human
ugcaaucucggcacuuugggag

SEQ ID NO: 645611 - RNA, 22 nt, Human
ugucucuuggauugcuugcucu

SEQ ID NO: 645612 - RNA, 22 nt, Human
ugcugaaagucccaaaucucau

SEQ ID NO: 645613 - RNA, 22 nt, Human
gugcuuggcuuggugugaccug

SEQ ID NO: 645614 - RNA, 22 nt, Human
cugagcagucugacucaagcua

SEQ ID NO: 645615 - RNA, 22 nt, Human
cuccucccucuuugccacacau

SEQ ID NO: 645616 - RNA, 22 nt, Human
uacagaaauacugggggguucu

SEQ ID NO: 645617 - RNA, 22 nt, Human
acauggaucaaccuauuuucuu

SEQ ID NO: 645618 - RNA, 21 nt, Human
gauugaaaccauggcagugag

SEQ ID NO: 645619 - RNA, 22 nt, Human
gcaagauguuaacauagggaga

SEQ ID NO: 645620 - RNA, 22 nt, Human
uaaauguuaugcccaucaucca

SEQ ID NO: 645621 - RNA, 22 nt, Human
ccagcacugcucucagacugag

SEQ ID NO: 645622 - RNA, 22 nt, Human
uuuaccacaauuuuaaacaaug

SEQ ID NO: 645623 - RNA, 22 nt, Human
gcucagaguuaauuggaugggu

SEQ ID NO: 645624 - RNA, 20 nt, Human
aguuuucagcagaacaccca

SEQ ID NO: 645625 - RNA, 22 nt, Human
uuccuggcaccaccacuucuag

SEQ ID NO: 645626 - RNA, 22 nt, Human
uguguacauauacacaaauaca

SEQ ID NO: 645627 - RNA, 22 nt, Human
cuguagaacgauccaggcauuu

SEQ ID NO: 645628 - RNA, 22 nt, Human
gaaaucuuuuccaauuguuuag

SEQ ID NO: 645629 - RNA, 22 nt, Human
aaacauuagacaccauaugcuc

SEQ ID NO: 645630 - RNA, 22 nt, Human
uuugacucuugucucuuguuag

SEQ ID NO: 645631 - RNA, 22 nt, Human
aaugcuuauggguuccauaaua

SEQ ID NO: 645632 - RNA, 22 nt, Human
uucucagacuuccagcaccagc

SEQ ID NO: 645633 - RNA, 21 nt, Human
uggaucugugaucuggggcac

SEQ ID NO: 645634 - RNA, 22 nt, Human
cucgggcuugaggcuguuuacc

SEQ ID NO: 645635 - RNA, 22 nt, Human
cacugggcaauucugagccuaa

SEQ ID NO: 645636 - RNA, 22 nt, Human
cagauuaguugugcuauggccu

SEQ ID NO: 645637 - RNA, 19 nt, Human
acaggcagaauugggugug

SEQ ID NO: 645638 - RNA, 22 nt, Human
uggucccugaucuaaugucuca

SEQ ID NO: 645639 - RNA, 22 nt, Human
gaacacuguuucuucgugaaca

SEQ ID NO: 645640 - RNA, 22 nt, Human
ugagcugggaguggugaugagg

SEQ ID NO: 645641 - RNA, 22 nt, Human
uggaaaacauugagauaccaag

SEQ ID NO: 645642 - RNA, 22 nt, Human
auuauagaggguuacaguuaau

SEQ ID NO: 645643 - RNA, 20 nt, Human
cuucuucauuaacccuacug

SEQ ID NO: 645644 - RNA, 22 nt, Human
cugaggucaggaguucaagcug

SEQ ID NO: 645645 - RNA, 19 nt, Human
gcaggugagccguggcucc

SEQ ID NO: 645646 - RNA, 22 nt, Human
ggccugugcaagacagcacccc

SEQ ID NO: 645647 - RNA, 22 nt, Human
agcucuggaacucccggcugcu

SEQ ID NO: 645648 - RNA, 22 nt, Human
ccuggcuccugcacagaucuuu

SEQ ID NO: 645649 - RNA, 22 nt, Human
aagaacauugacuaagaggggc

SEQ ID NO: 645650 - RNA, 22 nt, Human
uuuucuguauuauugugcuuca

SEQ ID NO: 645651 - RNA, 22 nt, Human
gaaagagaaccugggccuagau

SEQ ID NO: 645652 - RNA, 22 nt, Human
uuacaagacacagugcugaagg

SEQ ID NO: 645653 - RNA, 22 nt, Human
ugccagggcugcuacuggcuga

SEQ ID NO: 645654 - RNA, 22 nt, Human
uggauuuaguucuucacaggcc

SEQ ID NO: 645655 - RNA, 22 nt, Human
cagggucaggcugcuagaagcu

SEQ ID NO: 645656 - RNA, 22 nt, Human
guucuuuugguagagugugcau

SEQ ID NO: 645657 - RNA, 22 nt, Human
uguauauugccugagucuuucc

SEQ ID NO: 645658 - RNA, 22 nt, Human
acauguucaugcaugcacaggu

SEQ ID NO: 645659 - RNA, 22 nt, Human
gcugccugccuaguuccacagu

SEQ ID NO: 645660 - RNA, 22 nt, Human
uagcacaguucacuaugauaca

SEQ ID NO: 645661 - RNA, 22 nt, Human
gagaggccaccugacgagcagu

SEQ ID NO: 645662 - RNA, 22 nt, Human
cacuggggaaaacaggcuucuu

SEQ ID NO: 645663 - RNA, 22 nt, Human
uuagaaaggagcuuauuucuuu

SEQ ID NO: 645664 - RNA, 22 nt, Human
uuguggcugucgagaauugagg

SEQ ID NO: 645665 - RNA, 22 nt, Human
gcagagcacccugcagugguau

SEQ ID NO: 645666 - RNA, 22 nt, Human
ggcccaaacggguccagugaaa

SEQ ID NO: 645667 - RNA, 22 nt, Human
auaauuaauuucaguaaucucc

SEQ ID NO: 645668 - RNA, 21 nt, Human
gugcucugggcagcagagggc

SEQ ID NO: 645669 - RNA, 23 nt, Human
ggcacugaagcuacaauggugag

SEQ ID NO: 645670 - RNA, 22 nt, Human
agagccuucagagauuauuuua

SEQ ID NO: 645671 - RNA, 22 nt, Human
gcuuccuguccaggccccacau

SEQ ID NO: 645672 - RNA, 22 nt, Human
agaggagugggaagcagugcaa

SEQ ID NO: 645673 - RNA, 22 nt, Human
acccaggauagagugcugcagu

SEQ ID NO: 645674 - RNA, 22 nt, Human
uuggaucaaauuucaugcuguc

SEQ ID NO: 645675 - RNA, 22 nt, Human
uuccagccuuuauccauccaga

SEQ ID NO: 645676 - RNA, 22 nt, Human
ugcuuuuaggagauuaaaauua

SEQ ID NO: 645677 - RNA, 22 nt, Human
aaguagugugcuccagcgguga

SEQ ID NO: 645678 - RNA, 19 nt, Human
gucagcaccauggacaggg

SEQ ID NO: 645679 - RNA, 18 nt, Human
uugcagguaccucuaucu

SEQ ID NO: 645680 - RNA, 22 nt, Human
acggcuucuugacuguggguug

SEQ ID NO: 645681 - RNA, 22 nt, Human
ucugcuguauuagguugaacug

SEQ ID NO: 645682 - RNA, 22 nt, Human
gaggcacagucccgaggcaagg

SEQ ID NO: 645683 - RNA, 19 nt, Human
ucagacugaaaguuuagau

SEQ ID NO: 645684 - RNA, 19 nt, Human
uggcaguguggcuuccaga

SEQ ID NO: 645685 - RNA, 22 nt, Human
uucuccagaccuugugacuaug

SEQ ID NO: 645686 - RNA, 22 nt, Human
agcagggcuucugugccugugc

SEQ ID NO: 645687 - RNA, 22 nt, Human
caagugaucagacacugaaguc

SEQ ID NO: 645688 - RNA, 22 nt, Human
agagugcagaggucaaagaaca

SEQ ID NO: 645689 - RNA, 22 nt, Human
gucuggagccacccuaagcauu

SEQ ID NO: 645690 - RNA, 22 nt, Human
cagagcugguaagugguagagg

SEQ ID NO: 645691 - RNA, 22 nt, Human
cuuugaagagauuacugugcuc

SEQ ID NO: 645692 - RNA, 22 nt, Human
uuugacagcagauaaaauaaaa

SEQ ID NO: 645693 - RNA, 22 nt, Human
cugccugcaugcugccauagcu

SEQ ID NO: 645694 - RNA, 22 nt, Human
gacaucugaauuuagcaguuuu

SEQ ID NO: 645695 - RNA, 22 nt, Human
ccaaaaaguacauuuaggugug

SEQ ID NO: 645696 - RNA, 22 nt, Human
ugaggccaaaaugacucaaaug

SEQ ID NO: 645697 - RNA, 22 nt, Human
acuggcucagaguuccuagaga

SEQ ID NO: 645698 - RNA, 22 nt, Human
aaacauugcuaaauaaugcugc

SEQ ID NO: 645699 - RNA, 18 nt, Human
ucucuucuuggcagucaa

SEQ ID NO: 645700 - RNA, 22 nt, Human
ugugucccuuggaaccucagcu

SEQ ID NO: 645701 - RNA, 22 nt, Human
ccaugagcuucaacugacacag

SEQ ID NO: 645702 - RNA, 22 nt, Human
aggccuguuggcgugggcucua

SEQ ID NO: 645703 - RNA, 22 nt, Human
cccagagaaccuucugugccac

SEQ ID NO: 645704 - RNA, 22 nt, Human
aaguuugaugaguuucuggagg

SEQ ID NO: 645705 - RNA, 22 nt, Human
gaggcacagaguaggugcacac

SEQ ID NO: 645706 - RNA, 22 nt, Human
ccucccauggagcucuguccau

SEQ ID NO: 645707 - RNA, 23 nt, Human
ugcuuaauuccucugcuucaccu

SEQ ID NO: 645708 - RNA, 22 nt, Human
caggcagcucuaauggaaagug

SEQ ID NO: 645709 - RNA, 22 nt, Human
ugagaaaugggucugcugaaga

SEQ ID NO: 645710 - RNA, 22 nt, Human
agugaaaugauucugagcaaga

SEQ ID NO: 645711 - RNA, 22 nt, Human
accuucaggugagcacacagau

SEQ ID NO: 645712 - RNA, 19 nt, Human
gaacaauuuguuagcucuc

SEQ ID NO: 645713 - RNA, 18 nt, Human
ccagagggugcgucagcu

SEQ ID NO: 645714 - RNA, 22 nt, Human
gccagggggucagcaggcacuu

SEQ ID NO: 645715 - RNA, 20 nt, Human
uagggagauaugcucuuuuc

SEQ ID NO: 645716 - RNA, 22 nt, Human
uucauuaauucauucagugacu

SEQ ID NO: 645717 - RNA, 22 nt, Human
ugggccaguuucucauugaaau

SEQ ID NO: 645718 - RNA, 23 nt, Human
cuuguauucacucauuugggaac

SEQ ID NO: 645719 - RNA, 19 nt, Human
uggagaggaaaugcugcuc

SEQ ID NO: 645720 - RNA, 22 nt, Human
agcuccugucucaagggagccu

SEQ ID NO: 645721 - RNA, 22 nt, Human
agagcccaucaguggcagugga

SEQ ID NO: 645722 - RNA, 20 nt, Human
gcagcugaaaguaugacacc

SEQ ID NO: 645723 - RNA, 22 nt, Human
cugcuccaggauuucaggccag

SEQ ID NO: 645724 - RNA, 22 nt, Human
gggcagcaguugcccuaaucaa

SEQ ID NO: 645725 - RNA, 22 nt, Human
gacaggcuucaugauggcagga

SEQ ID NO: 645726 - RNA, 22 nt, Human
cagcugaagaaagagugguuag

SEQ ID NO: 645727 - RNA, 22 nt, Human
ucccuucaucagugagcaagcc

SEQ ID NO: 645728 - RNA, 22 nt, Human
aaggacagaaacagauugcugg

SEQ ID NO: 645729 - RNA, 22 nt, Human
auggauaagaacaaauaucuga

SEQ ID NO: 645730 - RNA, 22 nt, Human
agaaagggaacuggcaaagcca

SEQ ID NO: 645731 - RNA, 22 nt, Human
gcccugagugguaccugugggu

SEQ ID NO: 645732 - RNA, 22 nt, Human
uaagauaaguggguugagaugg

SEQ ID NO: 645733 - RNA, 22 nt, Human
cuggcucaauuuguacugcugu

SEQ ID NO: 645734 - RNA, 22 nt, Human
uucaacacaggaacaugauaua

SEQ ID NO: 645735 - RNA, 22 nt, Human
aacuuucuuggaugucucaaca

SEQ ID NO: 645736 - RNA, 22 nt, Human
caaggacagcgucaggugcaac

SEQ ID NO: 645737 - RNA, 17 nt, Human
gacaagacagaauucau

SEQ ID NO: 645738 - RNA, 22 nt, Human
acacacuucacccuugagcuaa

SEQ ID NO: 645739 - RNA, 20 nt, Human
caccagucaugagucaauac

SEQ ID NO: 645740 - RNA, 22 nt, Human
cagauugagucugggaaaaggc

SEQ ID NO: 645741 - RNA, 22 nt, Human
gggcaccuugggucucaggcaa

SEQ ID NO: 645742 - RNA, 22 nt, Human
cuguccagaaagggggcaacaa

SEQ ID NO: 645743 - RNA, 22 nt, Human
auugaaagagaauguagcucuu

SEQ ID NO: 645744 - RNA, 22 nt, Human
agaggagcuuuuggaaaaggcc

SEQ ID NO: 645745 - RNA, 22 nt, Human
acaacugggggcauuacuggca

SEQ ID NO: 645746 - RNA, 23 nt, Human
ugggccucuccacccuuuucugu

SEQ ID NO: 645747 - RNA, 19 nt, Human
ggcagcaagcucugaaggc

SEQ ID NO: 645748 - RNA, 22 nt, Human
gauuuucaugauaaacuuguga

SEQ ID NO: 645749 - RNA, 22 nt, Human
cagaacaugauauaaacagaag

SEQ ID NO: 645750 - RNA, 22 nt, Human
gguaggaguauuuugcagcagu

SEQ ID NO: 645751 - RNA, 22 nt, Human
ucugaggcugcaucuaugugac

SEQ ID NO: 645752 - RNA, 22 nt, Human
agccaugggcucccaguccuuu

SEQ ID NO: 645753 - RNA, 22 nt, Human
acagacaguaugguggggcuga

SEQ ID NO: 645754 - RNA, 22 nt, Human
cuguugcugggaacgcauguca

SEQ ID NO: 645755 - RNA, 22 nt, Human
ccacagucuagcuagaaggcau

SEQ ID NO: 645756 - RNA, 22 nt, Human
ggaagauuucccguagcugugc

SEQ ID NO: 645757 - RNA, 19 nt, Human
agcuccaggccuggaugcu

SEQ ID NO: 645758 - RNA, 22 nt, Human
ugccugcuuguuuaccuacucc

SEQ ID NO: 645759 - RNA, 22 nt, Human
gcccuguccuccugacugagug

SEQ ID NO: 645760 - RNA, 22 nt, Human
ucuugaaacauaugaguaagug

SEQ ID NO: 645761 - RNA, 22 nt, Human
cauaggaaaagcauucuucuug

SEQ ID NO: 645762 - RNA, 22 nt, Human
acuguauuccuacuagaaucua

SEQ ID NO: 645763 - RNA, 20 nt, Human
uggggaguugagcacgagca

SEQ ID NO: 645764 - RNA, 22 nt, Human
aaagcuuuguaaauaaacaggu

SEQ ID NO: 645765 - RNA, 22 nt, Human
uucaggauccccaccgcguuua

SEQ ID NO: 645766 - RNA, 22 nt, Human
ucuuagcauuuguuaauaccca

SEQ ID NO: 645767 - RNA, 22 nt, Human
acagaguaggugcucaguaaau

SEQ ID NO: 645768 - RNA, 22 nt, Human
uccaggcucagucaagcacuuc

SEQ ID NO: 645769 - RNA, 22 nt, Human
uuuaucugaaaaaacucuugga

SEQ ID NO: 645770 - RNA, 22 nt, Human
aauuccaaauguuuucaaucca

SEQ ID NO: 645771 - RNA, 22 nt, Human
caugcuaauuaauuccaccugc

SEQ ID NO: 645772 - RNA, 22 nt, Human
cuggcuuugguccccugugccu

SEQ ID NO: 645773 - RNA, 22 nt, Human
gggagcugccuuagaccggagg

SEQ ID NO: 645774 - RNA, 22 nt, Human
guuccucaugaguaccccuuaa

SEQ ID NO: 645775 - RNA, 22 nt, Human
ucucaggacuccucuggccaua

SEQ ID NO: 645776 - RNA, 20 nt, Human
auggaggaagggcaagagaa

SEQ ID NO: 645777 - RNA, 18 nt, Human
cugccauguccuacuguc

SEQ ID NO: 645778 - RNA, 22 nt, Human
uauucacaaaaugagguccuca

SEQ ID NO: 645779 - RNA, 22 nt, Human
aaggaagacacagaugaaguga

SEQ ID NO: 645780 - RNA, 22 nt, Human
gaggaagugcguuaugccuuuu

SEQ ID NO: 645781 - RNA, 22 nt, Human
agcuucucuggucuucugccaa

SEQ ID NO: 645782 - RNA, 22 nt, Human
ucaacagaagugauagcuauua

SEQ ID NO: 645783 - RNA, 22 nt, Human
aguuucagaauuuaugcagaca

SEQ ID NO: 645784 - RNA, 22 nt, Human
augugugguuuaagaauugaau

SEQ ID NO: 645785 - RNA, 22 nt, Human
ucccucucuugggcguggcuca

SEQ ID NO: 645786 - RNA, 19 nt, Human
uuuggacagaguguccagg

SEQ ID NO: 645787 - RNA, 19 nt, Human
cagcaauaaugccagaugg

SEQ ID NO: 645788 - RNA, 22 nt, Human
ucucaaauuuguuagauaaaau

SEQ ID NO: 645789 - RNA, 22 nt, Human
gaauugcuaggcugcauguguc

SEQ ID NO: 645790 - RNA, 22 nt, Human
uggaagggguuacgcagcagga

SEQ ID NO: 645791 - RNA, 22 nt, Human
aaucacaugugggucuuguagc

SEQ ID NO: 645792 - RNA, 22 nt, Human
agagaccuuucuccugccuuuc

SEQ ID NO: 645793 - RNA, 22 nt, Human
gcagggagggccuuucaugaca

SEQ ID NO: 645794 - RNA, 22 nt, Human
gauuaauucaggaucaggaaau

SEQ ID NO: 645795 - RNA, 22 nt, Human
gcagccagguuugaggaccacu

SEQ ID NO: 645796 - RNA, 22 nt, Human
gaggggcgcugucgggucaccu

SEQ ID NO: 645797 - RNA, 22 nt, Human
uuugagaagcaucugguccacu

SEQ ID NO: 645798 - RNA, 22 nt, Human
cagaauuuuucgaauguacugu

SEQ ID NO: 645799 - RNA, 22 nt, Human
augcuuccucuacggccucuga

SEQ ID NO: 645800 - RNA, 22 nt, Human
gcaggaagggaaagguugacuc

SEQ ID NO: 645801 - RNA, 22 nt, Human
agcccugggcagccaaggaagc

SEQ ID NO: 645802 - RNA, 22 nt, Human
gacagguugaaguaucaaaggu

SEQ ID NO: 645803 - RNA, 22 nt, Human
uccuggcuuuucuuggcucauc

SEQ ID NO: 645804 - RNA, 22 nt, Human
ucugggaugaagccagaaacuu

SEQ ID NO: 645805 - RNA, 18 nt, Human
acaaucugaaaccuguca

SEQ ID NO: 645806 - RNA, 22 nt, Human
cugccccauggucccugguggg

SEQ ID NO: 645807 - RNA, 22 nt, Human
cuuuuuauagcuauguccuaug

SEQ ID NO: 645808 - RNA, 22 nt, Human
uaauuucuagggacuaaggugc

SEQ ID NO: 645809 - RNA, 22 nt, Human
cagccaucaguaaagacagcuu

SEQ ID NO: 645810 - RNA, 22 nt, Human
aucaguaggccaagcagcuggc

SEQ ID NO: 645811 - RNA, 22 nt, Human
agugucuuugacacauucaaag

SEQ ID NO: 645812 - RNA, 22 nt, Human
ucaggaagaaauucuguaucuu

SEQ ID NO: 645813 - RNA, 21 nt, Human
uagcagagaguuaacuucucc

SEQ ID NO: 645814 - RNA, 22 nt, Human
ugcagcaguuuaaugcaggguu

SEQ ID NO: 645815 - RNA, 22 nt, Human
cucagugcuucuagcuugauga

SEQ ID NO: 645816 - RNA, 22 nt, Human
aucccagauagugacccucagg

SEQ ID NO: 645817 - RNA, 22 nt, Human
agcccagcccgggcugcgcuuu

SEQ ID NO: 645818 - RNA, 19 nt, Human
ugcucacucucagucccuc

SEQ ID NO: 645819 - RNA, 22 nt, Human
ccuuucccgcuuugagggcaag

SEQ ID NO: 645820 - RNA, 22 nt, Human
uaacugaauguauuacaacaga

SEQ ID NO: 645821 - RNA, 22 nt, Human
cacagcagggaugaauggagug

SEQ ID NO: 645822 - RNA, 22 nt, Human
aguguccuuaguuagcuuuggg

SEQ ID NO: 645823 - RNA, 21 nt, Human
agcaggugcuguuggaggaaa

SEQ ID NO: 645824 - RNA, 20 nt, Human
agcauucuacuagacuuuuc

SEQ ID NO: 645825 - RNA, 22 nt, Human
ugcuccagcaccaagagcucca

SEQ ID NO: 645826 - RNA, 22 nt, Human
gugcaugcaguaaguguuuuaa

SEQ ID NO: 645827 - RNA, 21 nt, Human
acauucacaggauauuaucau

SEQ ID NO: 645828 - RNA, 22 nt, Human
gcacacagaauugauucacugu

SEQ ID NO: 645829 - RNA, 22 nt, Human
uuauuacaaugcagaaaauaga

SEQ ID NO: 645830 - RNA, 23 nt, Human
aaugugcuguauucauuucugga

SEQ ID NO: 645831 - RNA, 22 nt, Human
uucagcaaacacgaugcuuguu

SEQ ID NO: 645832 - RNA, 22 nt, Human
agugaaaaccuaaucaugcagu

SEQ ID NO: 645833 - RNA, 22 nt, Human
cuauuuugccugccuagaaauc

SEQ ID NO: 645834 - RNA, 22 nt, Human
aaacucuggauuggaguccagc

SEQ ID NO: 645835 - RNA, 22 nt, Human
cuucuuccaguuauaagagcuu

SEQ ID NO: 645836 - RNA, 22 nt, Human
cucaggcucuguacucccuuug

SEQ ID NO: 645837 - RNA, 21 nt, Human
uguguuuuaaugauauucugu

SEQ ID NO: 645838 - RNA, 22 nt, Human
ccagugugguagguccacaggu

SEQ ID NO: 645839 - RNA, 22 nt, Human
ugcauuuaguuuuaauaaagga

SEQ ID NO: 645840 - RNA, 22 nt, Human
agcaaauaaagacaauuauguc

SEQ ID NO: 645841 - RNA, 22 nt, Human
ugcagcucugggguaaggggug

SEQ ID NO: 645842 - RNA, 23 nt, Human
agcaauaagaagggauacaugug

SEQ ID NO: 645843 - RNA, 22 nt, Human
cagcagaaaaugugggugauuu

SEQ ID NO: 645844 - RNA, 22 nt, Human
gucaaagaaacgcaccuuacau

SEQ ID NO: 645845 - RNA, 22 nt, Human
gcacugugcuagguaucaggga

SEQ ID NO: 645846 - RNA, 22 nt, Human
gguccucaaucccaacaaggca

SEQ ID NO: 645847 - RNA, 22 nt, Human
uuucucuucacugugugccuca

SEQ ID NO: 645848 - RNA, 22 nt, Human
uaugcuauuuuaaugaagaugu

SEQ ID NO: 645849 - RNA, 22 nt, Human
gggugagggaugagccuucuuc

SEQ ID NO: 645850 - RNA, 22 nt, Human
cugucugcuagaacaucuauac

SEQ ID NO: 645851 - RNA, 22 nt, Human
uucaacauuuuugaguuuaggu

SEQ ID NO: 645852 - RNA, 22 nt, Human
ucucugugcccaguaguucucu

SEQ ID NO: 645853 - RNA, 22 nt, Human
caggauggugugagugugagga

SEQ ID NO: 645854 - RNA, 22 nt, Human
cucacauuccacuugugccaac

SEQ ID NO: 645855 - RNA, 22 nt, Human
aauugcuaguuuguagcauuug

SEQ ID NO: 645856 - RNA, 23 nt, Human
cuucucugagcuaggaaugcucu

SEQ ID NO: 645857 - RNA, 22 nt, Human
uaaggaaugcuugaauguuccu

SEQ ID NO: 645858 - RNA, 22 nt, Human
aaagugcauagaguagugccua

SEQ ID NO: 645859 - RNA, 22 nt, Human
ccagagagaaauggauuugagu

SEQ ID NO: 645860 - RNA, 22 nt, Human
uagaguauauaggccuuugugu

SEQ ID NO: 645861 - RNA, 22 nt, Human
uauuuggagaugggaucuucaa

SEQ ID NO: 645862 - RNA, 22 nt, Human
caggcgggacgugggaggauca

SEQ ID NO: 645863 - RNA, 22 nt, Human
ugccagcacaaguuaagagauc

SEQ ID NO: 645864 - RNA, 22 nt, Human
agggcaaggguugaagauaaga

SEQ ID NO: 645865 - RNA, 22 nt, Human
agacacugaaucagagggacau

SEQ ID NO: 645866 - RNA, 22 nt, Human
acaggaaauuggcauaucaguu

SEQ ID NO: 645867 - RNA, 22 nt, Human
acauccagaggcguggaaggcu

SEQ ID NO: 645868 - RNA, 22 nt, Human
uuggcucagugugagggagaug

SEQ ID NO: 645869 - RNA, 22 nt, Human
cacauucacuucucuguccacc

SEQ ID NO: 645870 - RNA, 21 nt, Human
ugagugccaccugcuggccaa

SEQ ID NO: 645871 - RNA, 22 nt, Human
gcucucagaagagccaggcuac

SEQ ID NO: 645872 - RNA, 22 nt, Human
auuggcuauugagugugugcug

SEQ ID NO: 645873 - RNA, 22 nt, Human
ucucacagccauuucucccucu

SEQ ID NO: 645874 - RNA, 17 nt, Human
uucucuuccuggauagu

SEQ ID NO: 645875 - RNA, 22 nt, Human
auuucacagcugcuguucaggu

SEQ ID NO: 645876 - RNA, 22 nt, Human
agcucccagaagccagagucgg

SEQ ID NO: 645877 - RNA, 22 nt, Human
ugauguucuguauaucauauag

SEQ ID NO: 645878 - RNA, 22 nt, Human
ugguuucacacugcauggugua

SEQ ID NO: 645879 - RNA, 22 nt, Human
aaaugccucugcuguacacaau

SEQ ID NO: 645880 - RNA, 22 nt, Human
gcucuugggggacagauggagu

SEQ ID NO: 645881 - RNA, 22 nt, Human
acaaaguuaacaguuggauagu

SEQ ID NO: 645882 - RNA, 22 nt, Human
uauauuaacuugugauccugga

SEQ ID NO: 645883 - RNA, 22 nt, Human
uuacaaagcgcuuuaccucuga

SEQ ID NO: 645884 - RNA, 22 nt, Human
acccuguauacgcuacauuuuu

SEQ ID NO: 645885 - RNA, 22 nt, Human
agugucucagccccaacuagag

SEQ ID NO: 645886 - RNA, 22 nt, Human
agccacagggggugagggacaa

SEQ ID NO: 645887 - RNA, 22 nt, Human
uaagcauggugguaaaagaggu

SEQ ID NO: 645888 - RNA, 22 nt, Human
uccagcagagucucugaggggg

SEQ ID NO: 645889 - RNA, 22 nt, Human
guacaauagcaguuuucccuuu

SEQ ID NO: 645890 - RNA, 22 nt, Human
cugugucucauccgccucuggc

SEQ ID NO: 645891 - RNA, 22 nt, Human
aagcagccucauuugugguaag

SEQ ID NO: 645892 - RNA, 22 nt, Human
gagggcaccuucaguaauagcu

SEQ ID NO: 645893 - RNA, 21 nt, Human
gccacguuucagucuucucag

SEQ ID NO: 645894 - RNA, 22 nt, Human
aaauccaguggguccucaugag

SEQ ID NO: 645895 - RNA, 22 nt, Human
ccugcccagggucaccacagag

SEQ ID NO: 645896 - RNA, 22 nt, Human
uaccucaugcuguacagcacgu

SEQ ID NO: 645897 - RNA, 22 nt, Human
uaauaccuggccuugauacagu

SEQ ID NO: 645898 - RNA, 22 nt, Human
auguacauucuucucaccgaag

SEQ ID NO: 645899 - RNA, 22 nt, Human
caguuuaaguguguugaaggua

SEQ ID NO: 645900 - RNA, 22 nt, Human
gucauugcaguggcaaaucaca

SEQ ID NO: 645901 - RNA, 22 nt, Human
agcagcugucccuuaacaucag

SEQ ID NO: 645902 - RNA, 18 nt, Human
augcagcaaucagaaaua

SEQ ID NO: 645903 - RNA, 22 nt, Human
cccaggcuggccuccgcagugc

SEQ ID NO: 645904 - RNA, 22 nt, Human
auaaggcagugacuucaucuau

SEQ ID NO: 645905 - RNA, 22 nt, Human
acagucaaucagaacagcaugu

SEQ ID NO: 645906 - RNA, 22 nt, Human
ucugccagcccugugagucuug

SEQ ID NO: 645907 - RNA, 22 nt, Human
aaagacaugacacauuggagag

SEQ ID NO: 645908 - RNA, 22 nt, Human
accucccuccaucuggacacua

SEQ ID NO: 645909 - RNA, 22 nt, Human
uuuagcagaucuauguauguga

SEQ ID NO: 645910 - RNA, 22 nt, Human
acacauguacagauuaguauuu

SEQ ID NO: 645911 - RNA, 22 nt, Human
agcuucaggaacaggcagccug

SEQ ID NO: 645912 - RNA, 22 nt, Human
gccaagaagguggggacaugca

SEQ ID NO: 645913 - RNA, 22 nt, Human
ugcucuggaccaugacuaugug

SEQ ID NO: 645914 - RNA, 22 nt, Human
cacauuuacuuuuaucccuugg

SEQ ID NO: 645915 - RNA, 22 nt, Human
agggcugcuccuccuucaggcc

SEQ ID NO: 645916 - RNA, 19 nt, Human
uauguguauauguaucugu

SEQ ID NO: 645917 - RNA, 22 nt, Human
gaaagaaucaacuaugucucug

SEQ ID NO: 645918 - RNA, 22 nt, Human
uggcucaggaucuaagcagaau

SEQ ID NO: 645919 - RNA, 22 nt, Human
uuccuagcuauaaagcucuucc

SEQ ID NO: 645920 - RNA, 22 nt, Human
agcugcuguccuaggcacugua

SEQ ID NO: 645921 - RNA, 23 nt, Human
aguggcugagaguguuucauaug

SEQ ID NO: 645922 - RNA, 22 nt, Human
ugggcugcuuccucagcugaga

SEQ ID NO: 645923 - RNA, 22 nt, Human
uccugaggucugaaaaaggagc

SEQ ID NO: 645924 - RNA, 22 nt, Human
gcuguauuccugcacuguauag

SEQ ID NO: 645925 - RNA, 22 nt, Human
cagaggucccuguucuuaagga

SEQ ID NO: 645926 - RNA, 22 nt, Human
ugauaauguucgagaaugaaga

SEQ ID NO: 645927 - RNA, 22 nt, Human
aagaugcuaauuguggaaguug

SEQ ID NO: 645928 - RNA, 22 nt, Human
cugggaagaauccaagggcccu

SEQ ID NO: 645929 - RNA, 22 nt, Human
aauccauuaaaaacaagcgcau

SEQ ID NO: 645930 - RNA, 22 nt, Human
ugggaaauauucuaaaagucuu

SEQ ID NO: 645931 - RNA, 22 nt, Human
ucagggacaggaugggcauuuc

SEQ ID NO: 645932 - RNA, 22 nt, Human
gaacuuuauuccagaagaaagc

SEQ ID NO: 645933 - RNA, 22 nt, Human
uagaaucuggaaggggcuauuc

SEQ ID NO: 645934 - RNA, 22 nt, Human
ccaaggccaucagguagguccu

SEQ ID NO: 645935 - RNA, 21 nt, Human
uguccuuaaugcaauguccuu

SEQ ID NO: 645936 - RNA, 19 nt, Human
ugaggauugagguccagua

SEQ ID NO: 645937 - RNA, 22 nt, Human
gcuuuuggccagauggggaaac

SEQ ID NO: 645938 - RNA, 19 nt, Human
ggaccagguccugggcagc

SEQ ID NO: 645939 - RNA, 22 nt, Human
ggucccaguugcccaggucagg

SEQ ID NO: 645940 - RNA, 22 nt, Human
ucagcuauugaggguggugagu

SEQ ID NO: 645941 - RNA, 22 nt, Human
uuuguacaauuagcagaggcua

SEQ ID NO: 645942 - RNA, 22 nt, Human
augaggcaaggcuggccguguu

SEQ ID NO: 645943 - RNA, 23 nt, Human
ugggccuggaaagccuuagagag

SEQ ID NO: 645944 - RNA, 23 nt, Human
agcaaauaaucugcuugcuuuuu

SEQ ID NO: 645945 - RNA, 22 nt, Human
uuucugaagucuucuaacagau

SEQ ID NO: 645946 - RNA, 20 nt, Human
aauagcugagggcaagagua

SEQ ID NO: 645947 - RNA, 22 nt, Human
uucagugugugauaccugcugu

SEQ ID NO: 645948 - RNA, 22 nt, Human
auuauguagcuaaaaauugugu

SEQ ID NO: 645949 - RNA, 22 nt, Human
uaaacaagcuggacugauaagu

SEQ ID NO: 645950 - RNA, 22 nt, Human
acauccacauuuauucagucau

SEQ ID NO: 645951 - RNA, 22 nt, Human
uacagauaacugaaugcagacu

SEQ ID NO: 645952 - RNA, 22 nt, Human
aaggcagccgugugacugcaug

SEQ ID NO: 645953 - RNA, 22 nt, Human
aacuuagucuuucaauuugaua

SEQ ID NO: 645954 - RNA, 22 nt, Human
agcuggccagcaccuccagguc

SEQ ID NO: 645955 - RNA, 22 nt, Human
acacagguuaaaauaauuggga

SEQ ID NO: 645956 - RNA, 23 nt, Human
ugccacccuucucuucccagcuu

SEQ ID NO: 645957 - RNA, 22 nt, Human
gcugagugauucauacgcugcu

SEQ ID NO: 645958 - RNA, 22 nt, Human
ccaggcagucaggguugugugu

SEQ ID NO: 645959 - RNA, 22 nt, Human
gauuuuauauggcauacugugg

SEQ ID NO: 645960 - RNA, 22 nt, Human
cuucucuugguaguucuuguug

SEQ ID NO: 645961 - RNA, 22 nt, Human
aaagccacguggccuggggagc

SEQ ID NO: 645962 - RNA, 22 nt, Human
auuuucagagacaucuggacuu

SEQ ID NO: 645963 - RNA, 22 nt, Human
ugugaugcuggagugcgaauau

SEQ ID NO: 645964 - RNA, 22 nt, Human
ccaguguuacggcuugaacuau

SEQ ID NO: 645965 - RNA, 22 nt, Human
gccaggcuggcaaaaggaaacc

SEQ ID NO: 645966 - RNA, 22 nt, Human
caguuuuucaaaauuacaugau

SEQ ID NO: 645967 - RNA, 22 nt, Human
cucuccugguguggaggacagg

SEQ ID NO: 645968 - RNA, 19 nt, Human
agacaguggcuaggacuua

SEQ ID NO: 645969 - RNA, 22 nt, Human
uuaucuguuuucugugcguuuc

SEQ ID NO: 645970 - RNA, 22 nt, Human
accagggcuuacagcaguagcu

SEQ ID NO: 645971 - RNA, 22 nt, Human
ggcugugguggcaucccugagc

SEQ ID NO: 645972 - RNA, 22 nt, Human
ucugcagcuugcacaggcaggc

SEQ ID NO: 645973 - RNA, 22 nt, Human
guggucagcagcagugggagug

SEQ ID NO: 645974 - RNA, 22 nt, Human
gaaacauuguguucuacagauu

SEQ ID NO: 645975 - RNA, 22 nt, Human
gucauuuaucaucagaagucau

SEQ ID NO: 645976 - RNA, 22 nt, Human
agacccaggauuggggcugccg

SEQ ID NO: 645977 - RNA, 23 nt, Human
acuucauggcacugucuuagagg

SEQ ID NO: 645978 - RNA, 22 nt, Human
uccagugcuggaccagagcacc

SEQ ID NO: 645979 - RNA, 19 nt, Human
cccugaggcaaaagccuuu

SEQ ID NO: 645980 - RNA, 22 nt, Human
gaaccccaacuuauaagacaga

SEQ ID NO: 645981 - RNA, 22 nt, Human
gucugcuuucugggaacucuuu

SEQ ID NO: 645982 - RNA, 22 nt, Human
ugcugggcacugucuagguacu

SEQ ID NO: 645983 - RNA, 22 nt, Human
gcagggacaccuuugugaagcu

SEQ ID NO: 645984 - RNA, 22 nt, Human
acaggauggccagcugauauug

SEQ ID NO: 645985 - RNA, 22 nt, Human
cucagaguccauaguuuacagu

SEQ ID NO: 645986 - RNA, 22 nt, Human
cagguggccuugccaucuccug

SEQ ID NO: 645987 - RNA, 22 nt, Human
uaagacacauugagaaacacaa

SEQ ID NO: 645988 - RNA, 22 nt, Human
gccugucaauuuuguguacaau

SEQ ID NO: 645989 - RNA, 22 nt, Human
aacuauacauauuuacauagac

SEQ ID NO: 645990 - RNA, 22 nt, Human
gcuggagaugcuaugcagaggg

SEQ ID NO: 645991 - RNA, 22 nt, Human
acaguucugagcuauaauugcu

SEQ ID NO: 645992 - RNA, 22 nt, Human
uuagaaaacauaagugguaaag

SEQ ID NO: 645993 - RNA, 22 nt, Human
cagcugaguuacucugaggucu

SEQ ID NO: 645994 - RNA, 22 nt, Human
ggagacacccacauugcugggu

SEQ ID NO: 645995 - RNA, 22 nt, Human
ccucaggcuucgucuuccaccc

SEQ ID NO: 645996 - RNA, 22 nt, Human
guccuggcuuaguucgcuguaa

SEQ ID NO: 645997 - RNA, 22 nt, Human
aacugagccccugcacuuguga

SEQ ID NO: 645998 - RNA, 22 nt, Human
acauguguacauauauaugugc

SEQ ID NO: 645999 - RNA, 22 nt, Human
cagagcuguauuuaucuuucca

SEQ ID NO: 646000 - RNA, 22 nt, Human
ucccacagcuucgugcuucccc

SEQ ID NO: 646001 - RNA, 22 nt, Human
uaaaagauaucuuagggauuug

SEQ ID NO: 646002 - RNA, 22 nt, Human
gguguagaaaagggaaggguuu

SEQ ID NO: 646003 - RNA, 22 nt, Human
aauuaguaaccuaauuccaucu

SEQ ID NO: 646004 - RNA, 22 nt, Human
ucaaaugcaggucuggucuugg

SEQ ID NO: 646005 - RNA, 19 nt, Human
uucugggcauucauauuua

SEQ ID NO: 646006 - RNA, 22 nt, Human
ucagcagggaggcucugugccc

SEQ ID NO: 646007 - RNA, 22 nt, Human
gcucuggcuacuguggcuaccg

SEQ ID NO: 646008 - RNA, 22 nt, Human
caugcugugcaucuugaugacc

SEQ ID NO: 646009 - RNA, 22 nt, Human
aacagucuacugaauaucugcg

SEQ ID NO: 646010 - RNA, 22 nt, Human
aucuuucagggccauuuguauu

SEQ ID NO: 646011 - RNA, 22 nt, Human
gacaagcucuuguuucaugguu

SEQ ID NO: 646012 - RNA, 22 nt, Human
ccagggcuugguggcuuguauc

SEQ ID NO: 646013 - RNA, 22 nt, Human
cucaacauuuaacagugaaaaa

SEQ ID NO: 646014 - RNA, 22 nt, Human
uuuuauugucucccaguucugg

SEQ ID NO: 646015 - RNA, 19 nt, Human
gggagacagcucugggcug

SEQ ID NO: 646016 - RNA, 21 nt, Human
agcuuuucuguuuuauaucua

SEQ ID NO: 646017 - RNA, 22 nt, Human
uucuuauugggagaccuuuucu

SEQ ID NO: 646018 - RNA, 22 nt, Human
acagguccucaagucagcuggg

SEQ ID NO: 646019 - RNA, 22 nt, Human
cuuuggcagccucugcuauuga

SEQ ID NO: 646020 - RNA, 22 nt, Human
ccagaaggcggagauugcagug

SEQ ID NO: 646021 - RNA, 22 nt, Human
ucagcacugauagaagucaaua

SEQ ID NO: 646022 - RNA, 18 nt, Human
uucucagacuuuggaagu

SEQ ID NO: 646023 - RNA, 22 nt, Human
cauggccagggagagagaaugu

SEQ ID NO: 646024 - RNA, 22 nt, Human
cuguggcuggaauaauaaaugu

SEQ ID NO: 646025 - RNA, 22 nt, Human
gacacuguuauggugagguaag

SEQ ID NO: 646026 - RNA, 22 nt, Human
cuccacucaggugcuuaaguug

SEQ ID NO: 646027 - RNA, 22 nt, Human
gggagauggcucagaggccgcg

SEQ ID NO: 646028 - RNA, 22 nt, Human
agucugcauucacagcaauuau

SEQ ID NO: 646029 - RNA, 22 nt, Human
uugguuuucaggggcaggauaa

SEQ ID NO: 646030 - RNA, 19 nt, Human
ugagaggcuuaaggcagcu

SEQ ID NO: 646031 - RNA, 22 nt, Human
gugaauggggcaggaaggaugg

SEQ ID NO: 646032 - RNA, 22 nt, Human
uuuagcauauccuauaaaacua

SEQ ID NO: 646033 - RNA, 22 nt, Human
auuugcuucugcuaaacaacuu

SEQ ID NO: 646034 - RNA, 22 nt, Human
gcccugagcacugcugcugggg

SEQ ID NO: 646035 - RNA, 22 nt, Human
agcuggaagugcauuucucacu

SEQ ID NO: 646036 - RNA, 22 nt, Human
accacugguuuugcagaggcgc

SEQ ID NO: 646037 - RNA, 22 nt, Human
uuccucuccucacaugagucac

SEQ ID NO: 646038 - RNA, 22 nt, Human
accaggcuugauaccaagaaau

SEQ ID NO: 646039 - RNA, 22 nt, Human
gccugucugcgucacgcuuauu

SEQ ID NO: 646040 - RNA, 22 nt, Human
uuacacaguugguaggggcaga

SEQ ID NO: 646041 - RNA, 22 nt, Human
acaaugucugcuauuuggcucu

SEQ ID NO: 646042 - RNA, 22 nt, Human
gccccucccagucaggagcacu

SEQ ID NO: 646043 - RNA, 22 nt, Human
cauuucugcagaauugcucuuc

SEQ ID NO: 646044 - RNA, 22 nt, Human
guccagcugcagcugggcagaa

SEQ ID NO: 646045 - RNA, 22 nt, Human
caggguuucaccauguuagcag

SEQ ID NO: 646046 - RNA, 22 nt, Human
gaacaucagucauaauuuaacg

SEQ ID NO: 646047 - RNA, 22 nt, Human
ccagagcccagcacacggugcu

SEQ ID NO: 646048 - RNA, 22 nt, Human
uuucaggaaacauuuaauggca

SEQ ID NO: 646049 - RNA, 22 nt, Human
agcuuauuaauuuuucugcaug

SEQ ID NO: 646050 - RNA, 22 nt, Human
ccuacacaucucaccucacagg

SEQ ID NO: 646051 - RNA, 22 nt, Human
uacacauccauguuuugacuuu

SEQ ID NO: 646052 - RNA, 22 nt, Human
ccagcuggagccaagguggacu

SEQ ID NO: 646053 - RNA, 22 nt, Human
gauuuuaauuauaggagguccu

SEQ ID NO: 646054 - RNA, 20 nt, Human
ccugccuguguuugugauga

SEQ ID NO: 646055 - RNA, 22 nt, Human
aggcuguggcaucacaucagga

SEQ ID NO: 646056 - RNA, 22 nt, Human
ugggcagcauccuccacaguca

SEQ ID NO: 646057 - RNA, 22 nt, Human
gacacuugugcuguuucugagc

SEQ ID NO: 646058 - RNA, 22 nt, Human
ugcagcucuuacggagggcggg

SEQ ID NO: 646059 - RNA, 22 nt, Human
uacauacaugguggaaugguua

SEQ ID NO: 646060 - RNA, 22 nt, Human
caaaugcaggucauaaccugag

SEQ ID NO: 646061 - RNA, 22 nt, Human
ucuccuggaagaauaccacacu

SEQ ID NO: 646062 - RNA, 21 nt, Human
ugcagcugacacccuuuggga

SEQ ID NO: 646063 - RNA, 22 nt, Human
ccugggcagggcuggacucuca

SEQ ID NO: 646064 - RNA, 21 nt, Human
aaguuuuauguugccauuugu

SEQ ID NO: 646065 - RNA, 22 nt, Human
uugaagacuaauuuagauaaug

SEQ ID NO: 646066 - RNA, 22 nt, Human
acuuggagagcauugcugggga

SEQ ID NO: 646067 - RNA, 22 nt, Human
gugcuuccucaguguuuaagga

SEQ ID NO: 646068 - RNA, 22 nt, Human
aagcaggcaggguggagaguuu

SEQ ID NO: 646069 - RNA, 22 nt, Human
ggagggugcauuuuacccugug

SEQ ID NO: 646070 - RNA, 22 nt, Human
cagugggauaugggggcagcau

SEQ ID NO: 646071 - RNA, 19 nt, Human
ucccucccuguaaucucac

SEQ ID NO: 646072 - RNA, 22 nt, Human
cuggggccacaacggcgcacgc

SEQ ID NO: 646073 - RNA, 20 nt, Human
ugaggcaggagaauggcaug

SEQ ID NO: 646074 - RNA, 22 nt, Human
ugcugcugaggcuaaaguauag

SEQ ID NO: 646075 - RNA, 22 nt, Human
uucugggggccaggacaguggu

SEQ ID NO: 646076 - RNA, 22 nt, Human
aggucucaaacuggcacccugu

SEQ ID NO: 646077 - RNA, 22 nt, Human
acuuagaaagggauucuagauu

SEQ ID NO: 646078 - RNA, 22 nt, Human
ugaguguauaugaagguuguaa

SEQ ID NO: 646079 - RNA, 21 nt, Human
gaggccacuaauaggggcaga

SEQ ID NO: 646080 - RNA, 22 nt, Human
gagcaaaauaaauucugacaaa

SEQ ID NO: 646081 - RNA, 18 nt, Human
cuccccuguuuucccugc

SEQ ID NO: 646082 - RNA, 22 nt, Human
uacccagggcuuuucugaugca

SEQ ID NO: 646083 - RNA, 22 nt, Human
cauagaaacuugcagcaagcac

SEQ ID NO: 646084 - RNA, 22 nt, Human
ggagagucugccgagccagccc

SEQ ID NO: 646085 - RNA, 22 nt, Human
auucauaaguaaaugauuaccu

SEQ ID NO: 646086 - RNA, 22 nt, Human
guuuccuauaacucaggcacca

SEQ ID NO: 646087 - RNA, 22 nt, Human
ugucccagcagcuggguucucu

SEQ ID NO: 646088 - RNA, 22 nt, Human
aggccagcugccacccgguccg

SEQ ID NO: 646089 - RNA, 18 nt, Human
uauuccugauucaucuuu

SEQ ID NO: 646090 - RNA, 22 nt, Human
aaucaucacgaacacaacagcg

SEQ ID NO: 646091 - RNA, 22 nt, Human
aucugggagacccuugcgggaa

SEQ ID NO: 646092 - RNA, 22 nt, Human
uuacagaggcuuccagggccca

SEQ ID NO: 646093 - RNA, 22 nt, Human
gcuggccauagaagccaaagag

SEQ ID NO: 646094 - RNA, 22 nt, Human
cuguuuccuaccguuuuucauu

SEQ ID NO: 646095 - RNA, 22 nt, Human
aagcccaguaccuucagugagg

SEQ ID NO: 646096 - RNA, 22 nt, Human
ucuucucuccugcuuggcagaa

SEQ ID NO: 646097 - RNA, 22 nt, Human
cuuuauuguccuucuuaggugg

SEQ ID NO: 646098 - RNA, 22 nt, Human
gagggaagauuccccauauggg

SEQ ID NO: 646099 - RNA, 22 nt, Human
ugcagggaaugcuugcagcaug

SEQ ID NO: 646100 - RNA, 20 nt, Human
ccagaagagaugaucaucca

SEQ ID NO: 646101 - RNA, 22 nt, Human
ucuagauuuggggcaugaaguu

SEQ ID NO: 646102 - RNA, 22 nt, Human
gccaccugguggcaucuucugg

SEQ ID NO: 646103 - RNA, 22 nt, Human
agaauucuggaguugggaggaa

SEQ ID NO: 646104 - RNA, 22 nt, Human
uucccacaacagaucuguauua

SEQ ID NO: 646105 - RNA, 22 nt, Human
agcugggcugggcugagcugag

SEQ ID NO: 646106 - RNA, 22 nt, Human
uaggguccaagccuuauaauua

SEQ ID NO: 646107 - RNA, 22 nt, Human
gaggcagugucgguggcaggau

SEQ ID NO: 646108 - RNA, 22 nt, Human
augaggccagaccacucugcau

SEQ ID NO: 646109 - RNA, 22 nt, Human
aauaacuggcacauaucacaua

SEQ ID NO: 646110 - RNA, 22 nt, Human
aggaagcaaaaggcagggucua

SEQ ID NO: 646111 - RNA, 22 nt, Human
ucaaaggauaacugagggcagu

SEQ ID NO: 646112 - RNA, 22 nt, Human
uagcagcucugauucugggccc

SEQ ID NO: 646113 - RNA, 22 nt, Human
aaagugcugagauuacaagcgu

SEQ ID NO: 646114 - RNA, 17 nt, Human
agugaggagauuggaag

SEQ ID NO: 646115 - RNA, 22 nt, Human
gcaaaugcuaaaguguagagac

SEQ ID NO: 646116 - RNA, 22 nt, Human
guuagugcuuauuaaauaguau

SEQ ID NO: 646117 - RNA, 22 nt, Human
ugauuccuaggcacucuucucc

SEQ ID NO: 646118 - RNA, 22 nt, Human
agagauaauuagguuaaaugag

SEQ ID NO: 646119 - RNA, 22 nt, Human
acuggaaaaccacugaaaugag

SEQ ID NO: 646120 - RNA, 22 nt, Human
uuucuacauucaaaaacuacca

SEQ ID NO: 646121 - RNA, 22 nt, Human
uguggcagcuggagguggagaa

SEQ ID NO: 646122 - RNA, 22 nt, Human
cugccacaagcuggcccugugu

SEQ ID NO: 646123 - RNA, 22 nt, Human
uuauuauugauucgcucucaaa

SEQ ID NO: 646124 - RNA, 22 nt, Human
ugcuggaggagaagguugcuca

SEQ ID NO: 646125 - RNA, 22 nt, Human
uauucacauucucaggccuggu

SEQ ID NO: 646126 - RNA, 22 nt, Human
ugugacagaucuuuaaauaaug

SEQ ID NO: 646127 - RNA, 22 nt, Human
cugggagucccuggaauagcuc

SEQ ID NO: 646128 - RNA, 22 nt, Human
ugggggagagugcaagcaugaa

SEQ ID NO: 646129 - RNA, 22 nt, Human
acugggcucccaggcuugucau

SEQ ID NO: 646130 - RNA, 22 nt, Human
cccagaggucugaaaagguuga

SEQ ID NO: 646131 - RNA, 22 nt, Human
ugaagccauuacuguguuaggg

SEQ ID NO: 646132 - RNA, 22 nt, Human
caggaaacaaagccuugcucau

SEQ ID NO: 646133 - RNA, 22 nt, Human
agagagggcauagaaaaaggga

SEQ ID NO: 646134 - RNA, 22 nt, Human
auguuacaguugaguaaauuaa

SEQ ID NO: 646135 - RNA, 22 nt, Human
agucauaauuauaaacaucagu

SEQ ID NO: 646136 - RNA, 22 nt, Human
guaagggauuugaacauagguu

SEQ ID NO: 646137 - RNA, 22 nt, Human
uaagucaucacauugcagagau

SEQ ID NO: 646138 - RNA, 22 nt, Human
ugcucuggacgcugagugguuu

SEQ ID NO: 646139 - RNA, 22 nt, Human
aggcugcugccuuggagagugu

SEQ ID NO: 646140 - RNA, 22 nt, Human
ugucugcugaugucacauagcc

SEQ ID NO: 646141 - RNA, 22 nt, Human
aacuguacgauaauaaauuugu

SEQ ID NO: 646142 - RNA, 22 nt, Human
gcagagaggauauuauugucca

SEQ ID NO: 646143 - RNA, 22 nt, Human
ccaggacaggaguuggcuucgc

SEQ ID NO: 646144 - RNA, 22 nt, Human
aguuuaauuggaggcguggcuc

SEQ ID NO: 646145 - RNA, 22 nt, Human
cccagcugauuuuugcagagau

SEQ ID NO: 646146 - RNA, 22 nt, Human
guuuguuuauacaaaagauccu

SEQ ID NO: 646147 - RNA, 22 nt, Human
ucaggaguacuggugucuacag

SEQ ID NO: 646148 - RNA, 22 nt, Human
agaugguuuugucuuuaugauu

SEQ ID NO: 646149 - RNA, 22 nt, Human
uuucuguuguacuuaaacuagg

SEQ ID NO: 646150 - RNA, 22 nt, Human
gggcgcugggugucgagacuca

SEQ ID NO: 646151 - RNA, 22 nt, Human
cauguggcuuuggcaugugccc

SEQ ID NO: 646152 - RNA, 22 nt, Human
uuaaaugaugcauaucauuuag

SEQ ID NO: 646153 - RNA, 22 nt, Human
cugccucuugacagaucguggc

SEQ ID NO: 646154 - RNA, 22 nt, Human
cugucuggauauaccuuggcca

SEQ ID NO: 646155 - RNA, 22 nt, Human
uugcaaaagcaauugcaguuuu

SEQ ID NO: 646156 - RNA, 21 nt, Human
gacucuggggucagcucaacc

SEQ ID NO: 646157 - RNA, 23 nt, Human
ggcagagagcauggcuggggccc

SEQ ID NO: 646158 - RNA, 22 nt, Human
ucagcaggugccucagauucuu

SEQ ID NO: 646159 - RNA, 22 nt, Human
cuuaaauuggaugaguuaaguu

SEQ ID NO: 646160 - RNA, 22 nt, Human
gagcugagacacacuuuggcaa

SEQ ID NO: 646161 - RNA, 22 nt, Human
cagggacagcacuaaacucuug

SEQ ID NO: 646162 - RNA, 22 nt, Human
acaggccucaaauagggugccu

SEQ ID NO: 646163 - RNA, 22 nt, Human
gaaguuauugccugugaugaaa

SEQ ID NO: 646164 - RNA, 22 nt, Human
gaauucuaggguaaauauccua

SEQ ID NO: 646165 - RNA, 22 nt, Human
aagagccuggcugcuaggcuca

SEQ ID NO: 646166 - RNA, 19 nt, Human
ugacugccucaggggugga

SEQ ID NO: 646167 - RNA, 22 nt, Human
aggaaauugggacacagagaaa

SEQ ID NO: 646168 - RNA, 22 nt, Human
agcagaaacagccagucuggac

SEQ ID NO: 646169 - RNA, 22 nt, Human
auggauggccugagcacagcug

SEQ ID NO: 646170 - RNA, 22 nt, Human
aggcaccucagcugagccuggg

SEQ ID NO: 646171 - RNA, 22 nt, Human
aaaguuacuaucacaaugaaau

SEQ ID NO: 646172 - RNA, 22 nt, Human
gccugucugcagggcugucauu

SEQ ID NO: 646173 - RNA, 22 nt, Human
aggcacuuguaauugcagucau

SEQ ID NO: 646174 - RNA, 21 nt, Human
caggaugaugggaagguggug

SEQ ID NO: 646175 - RNA, 22 nt, Human
aggaauuuuacaagcugguugc

SEQ ID NO: 646176 - RNA, 22 nt, Human
ucuucugaugccaguaaccaug

SEQ ID NO: 646177 - RNA, 22 nt, Human
uucacagcuaagagcuaaguaa

SEQ ID NO: 646178 - RNA, 22 nt, Human
gagggccuggcacagggaggcu

SEQ ID NO: 646179 - RNA, 22 nt, Human
agacauuuggagccaacuuucc

SEQ ID NO: 646180 - RNA, 22 nt, Human
aaaugucaaggugauagaugca

SEQ ID NO: 646181 - RNA, 22 nt, Human
uaaugucuguguuucagugcag

SEQ ID NO: 646182 - RNA, 22 nt, Human
aggccuccagcugaguuuugcu

SEQ ID NO: 646183 - RNA, 22 nt, Human
ugaaucauggauaaauagcuua

SEQ ID NO: 646184 - RNA, 22 nt, Human
uuaaggaacuugucuuucucuu

SEQ ID NO: 646185 - RNA, 22 nt, Human
aagugaauguagcaaacuugaa

SEQ ID NO: 646186 - RNA, 22 nt, Human
ggcuuggcccaggccucacucc

SEQ ID NO: 646187 - RNA, 22 nt, Human
caugugugguuaccuacuugac

SEQ ID NO: 646188 - RNA, 22 nt, Human
cugagggcaccgacagagugga

SEQ ID NO: 646189 - RNA, 17 nt, Human
aauguccuuggaccaca

SEQ ID NO: 646190 - RNA, 22 nt, Human
agagucaaaauuuaccagaaug

SEQ ID NO: 646191 - RNA, 22 nt, Human
agacauuuccuagacaucaaug

SEQ ID NO: 646192 - RNA, 16 nt, Human
ccucugggauguuugc

SEQ ID NO: 646193 - RNA, 22 nt, Human
uuuuuccaggguuagauguuua

SEQ ID NO: 646194 - RNA, 22 nt, Human
agacaggcugcugucugcuagg

SEQ ID NO: 646195 - RNA, 22 nt, Human
ucagcaguggcucucaugcagu

SEQ ID NO: 646196 - RNA, 22 nt, Human
cucucagugccugcccuaggcu

SEQ ID NO: 646197 - RNA, 22 nt, Human
ucuacaaagaagaauuaauguc

SEQ ID NO: 646198 - RNA, 22 nt, Human
auacacauguguaugugcaugc

SEQ ID NO: 646199 - RNA, 22 nt, Human
ugaucuuugguaaucuggcaca

SEQ ID NO: 646200 - RNA, 22 nt, Human
uuacagcuagccaauuauuuag

SEQ ID NO: 646201 - RNA, 22 nt, Human
caggaagagguggggcuaaagu

SEQ ID NO: 646202 - RNA, 22 nt, Human
cagagccaugguaugggcuugu

SEQ ID NO: 646203 - RNA, 22 nt, Human
ucaguccuacacgcucagggac

SEQ ID NO: 646204 - RNA, 22 nt, Human
cugcacagaggucggucugcca

SEQ ID NO: 646205 - RNA, 22 nt, Human
aaggauugucuggcuauuuaug

SEQ ID NO: 646206 - RNA, 22 nt, Human
ccagggcuccauugcucauccu

SEQ ID NO: 646207 - RNA, 22 nt, Human
gagucucugaccagggugccaa

SEQ ID NO: 646208 - RNA, 17 nt, Human
ucugaggccucuaggag

SEQ ID NO: 646209 - RNA, 22 nt, Human
uugucaucauccucuuuggggu

SEQ ID NO: 646210 - RNA, 22 nt, Human
ugcagauacaguauguggaagc

SEQ ID NO: 646211 - RNA, 22 nt, Human
uggagagcccgagacauccugu

SEQ ID NO: 646212 - RNA, 19 nt, Human
cacugugguccuucacugc

SEQ ID NO: 646213 - RNA, 22 nt, Human
aggaggcugcaacccugaggcc

SEQ ID NO: 646214 - RNA, 22 nt, Human
caugggggcugaggcugcugua

SEQ ID NO: 646215 - RNA, 22 nt, Human
ucaggcugaccagguuuugcuc

SEQ ID NO: 646216 - RNA, 22 nt, Human
gcuuuacauuuuggaaagguga

SEQ ID NO: 646217 - RNA, 20 nt, Human
ucuccuggucugguccgugc

SEQ ID NO: 646218 - RNA, 22 nt, Human
ucacuuauugcucaucucaugc

SEQ ID NO: 646219 - RNA, 22 nt, Human
auugcuuuuccuuaacacaugc

SEQ ID NO: 646220 - RNA, 20 nt, Human
uugauaggcagcuugucagg

SEQ ID NO: 646221 - RNA, 22 nt, Human
gacaguggauucaucuagucaa

SEQ ID NO: 646222 - RNA, 22 nt, Human
augcuuccuaaccauggccgug

SEQ ID NO: 646223 - RNA, 19 nt, Human
acaaacugaguacacuugu

SEQ ID NO: 646224 - RNA, 22 nt, Human
acagaaaugauguuuggcaaua

SEQ ID NO: 646225 - RNA, 23 nt, Human
aucuuagcauagacuugaguccc

SEQ ID NO: 646226 - RNA, 22 nt, Human
cauguuauuuauccauuaaaca

SEQ ID NO: 646227 - RNA, 22 nt, Human
guugcuuuucuccaucacaugg

SEQ ID NO: 646228 - RNA, 22 nt, Human
uuugccuucucugaaccuauuu

SEQ ID NO: 646229 - RNA, 22 nt, Human
agcaacuuuucuagacaugguc

SEQ ID NO: 646230 - RNA, 22 nt, Human
cuuuccagcauuuccuugugaa

SEQ ID NO: 646231 - RNA, 22 nt, Human
aggcagaucaguacaggguuaa

SEQ ID NO: 646232 - RNA, 18 nt, Human
cuucucccaucuuggcca

SEQ ID NO: 646233 - RNA, 22 nt, Human
gacagacaggagcucacaggca

SEQ ID NO: 646234 - RNA, 22 nt, Human
aggucauuaaaguuaaaugagg

SEQ ID NO: 646235 - RNA, 22 nt, Human
ggggcccagggcagcagugcag

SEQ ID NO: 646236 - RNA, 19 nt, Human
cuuuagacacaccuggaca

SEQ ID NO: 646237 - RNA, 22 nt, Human
cagagccugcugccuucugaag

SEQ ID NO: 646238 - RNA, 22 nt, Human
cagccagcugucccaagugccu

SEQ ID NO: 646239 - RNA, 21 nt, Human
auacuacauuucucugacuuu

SEQ ID NO: 646240 - RNA, 22 nt, Human
ggguuccaaacauagucuuccu

SEQ ID NO: 646241 - RNA, 22 nt, Human
cccagcuccagagccagaaaca

SEQ ID NO: 646242 - RNA, 22 nt, Human
cucuccagggguagaugccuuc

SEQ ID NO: 646243 - RNA, 22 nt, Human
ugcuggaguaacaagacacuca

SEQ ID NO: 646244 - RNA, 22 nt, Human
uuacauuuggcuauguccucua

SEQ ID NO: 646245 - RNA, 22 nt, Human
aauggcugccagggcaggaggu

SEQ ID NO: 646246 - RNA, 22 nt, Human
uauaugcuugugcaugucuuug

SEQ ID NO: 646247 - RNA, 22 nt, Human
agccccaggaugggccgcagga

SEQ ID NO: 646248 - RNA, 22 nt, Human
auaaucaaaguccuaugacauc

SEQ ID NO: 646249 - RNA, 22 nt, Human
ggacaaaggguggagccucuga

SEQ ID NO: 646250 - RNA, 22 nt, Human
ucccagcagucagagcuaugug

SEQ ID NO: 646251 - RNA, 22 nt, Human
uccuuucuccgggggacuguug

SEQ ID NO: 646252 - RNA, 22 nt, Human
cuuucacacacauacauuugga

SEQ ID NO: 646253 - RNA, 21 nt, Human
uggcucugaaagagugcugca

SEQ ID NO: 646254 - RNA, 22 nt, Human
aaaagggcaaaaccaucaugga

SEQ ID NO: 646255 - RNA, 22 nt, Human
gagaacacgaggaggcccagcg

SEQ ID NO: 646256 - RNA, 21 nt, Human
aggcucagcagguguauaaag

SEQ ID NO: 646257 - RNA, 22 nt, Human
augugcaugcacuuacaugugu

SEQ ID NO: 646258 - RNA, 22 nt, Human
uggcuucuagcaguguugauuu

SEQ ID NO: 646259 - RNA, 22 nt, Human
ggagcugagguaacagugagug

SEQ ID NO: 646260 - RNA, 22 nt, Human
auuauauaggacuugcccuucc

SEQ ID NO: 646261 - RNA, 22 nt, Human
uccugguggcuuucccugccuu

SEQ ID NO: 646262 - RNA, 22 nt, Human
uugaggucugagacugugcagg

SEQ ID NO: 646263 - RNA, 22 nt, Human
uguuuucugauucucguguggu

SEQ ID NO: 646264 - RNA, 22 nt, Human
ugagaggcuagaucagcucugu

SEQ ID NO: 646265 - RNA, 22 nt, Human
guauuuccauuagugugugcac

SEQ ID NO: 646266 - RNA, 22 nt, Human
cuaggcugugcauugcaugaca

SEQ ID NO: 646267 - RNA, 22 nt, Human
ugggaaggaacugccuuuagcu

SEQ ID NO: 646268 - RNA, 22 nt, Human
aggaaacaacuuggcaugagcc

SEQ ID NO: 646269 - RNA, 22 nt, Human
uggggagagaccggaauguuuc

SEQ ID NO: 646270 - RNA, 22 nt, Human
ugauuuccuaggucuggagaag

SEQ ID NO: 646271 - RNA, 22 nt, Human
gggcccuggggauguggacgcg

SEQ ID NO: 646272 - RNA, 22 nt, Human
gaacauucacagacucaccauu

SEQ ID NO: 646273 - RNA, 22 nt, Human
guuuauaugaacuucauaccca

SEQ ID NO: 646274 - RNA, 22 nt, Human
gcugggcuccaggccaggguga

SEQ ID NO: 646275 - RNA, 22 nt, Human
ggucucuggccuuggagauuga

SEQ ID NO: 646276 - RNA, 18 nt, Human
ugucugaagccacuuuuu

SEQ ID NO: 646277 - RNA, 22 nt, Human
gcaccagcugcuggguucuaga

SEQ ID NO: 646278 - RNA, 22 nt, Human
aagccagauagaagaacucauu

SEQ ID NO: 646279 - RNA, 22 nt, Human
aauucaguugacagcuaaugcc

SEQ ID NO: 646280 - RNA, 22 nt, Human
acucacucuuaaucagacuccc

SEQ ID NO: 646281 - RNA, 22 nt, Human
auauacaguauguacugugguu

SEQ ID NO: 646282 - RNA, 22 nt, Human
acucucccacguucgacucuaa

SEQ ID NO: 646283 - RNA, 22 nt, Human
ccgggcgggggcucucgucacc

SEQ ID NO: 646284 - RNA, 22 nt, Human
aaugauaugcaaauuaucauca

SEQ ID NO: 646285 - RNA, 22 nt, Human
gacaccagaagacauaagcaga

SEQ ID NO: 646286 - RNA, 22 nt, Human
auuccuaaaguaauacacuaga

SEQ ID NO: 646287 - RNA, 22 nt, Human
cagggcucccuugcaaggaggg

SEQ ID NO: 646288 - RNA, 22 nt, Human
ugguugugguccuccacaucgc

SEQ ID NO: 646289 - RNA, 22 nt, Human
uacuggaaggcuggaagucagg

SEQ ID NO: 646290 - RNA, 20 nt, Human
acuguguaaacaugauucau

SEQ ID NO: 646291 - RNA, 22 nt, Human
uacuguguggugagcugucucc

SEQ ID NO: 646292 - RNA, 22 nt, Human
uaaagacauaggaucagggaga

SEQ ID NO: 646293 - RNA, 22 nt, Human
auggcuguuggcaggaggccuc

SEQ ID NO: 646294 - RNA, 22 nt, Human
uuagcauucucugugugcauaa

SEQ ID NO: 646295 - RNA, 22 nt, Human
cugagaguguggcuuccaggcc

SEQ ID NO: 646296 - RNA, 21 nt, Human
gcagccagacgggauucaguu

SEQ ID NO: 646297 - RNA, 22 nt, Human
ugccugcccuuuccacacagcc

SEQ ID NO: 646298 - RNA, 22 nt, Human
aguguccugugucccagacugu

SEQ ID NO: 646299 - RNA, 22 nt, Human
aggagagcuggugucuggaauc

SEQ ID NO: 646300 - RNA, 22 nt, Human
uauuauggcagcauucaguaug

SEQ ID NO: 646301 - RNA, 22 nt, Human
cacccuuugcugcucuuccucc

SEQ ID NO: 646302 - RNA, 22 nt, Human
gguggcugguuuuauaagaggu

SEQ ID NO: 646303 - RNA, 22 nt, Human
cagcuauuggcaagaaguggug

SEQ ID NO: 646304 - RNA, 22 nt, Human
uggguggaauaaaucaguucug

SEQ ID NO: 646305 - RNA, 22 nt, Human
ucagccuggcaggauggccugg

SEQ ID NO: 646306 - RNA, 22 nt, Human
gccuggaguugaaacuauuauu

SEQ ID NO: 646307 - RNA, 19 nt, Human
ccugccugaccccggcuac

SEQ ID NO: 646308 - RNA, 22 nt, Human
gguccucucccaagagcgcauc

SEQ ID NO: 646309 - RNA, 22 nt, Human
acagucuggaggcugcuucauu

SEQ ID NO: 646310 - RNA, 22 nt, Human
auauacuuggagacuaucauug

SEQ ID NO: 646311 - RNA, 22 nt, Human
auaauacaugguuaaccucuuu

SEQ ID NO: 646312 - RNA, 21 nt, Human
gagugggacaugggagugguu

SEQ ID NO: 646313 - RNA, 22 nt, Human
ccagcaggaaagugacguuuga

SEQ ID NO: 646314 - RNA, 22 nt, Human
accccaggcccagggaagaggc

SEQ ID NO: 646315 - RNA, 22 nt, Human
aaacacagguacugcagaagug

SEQ ID NO: 646316 - RNA, 22 nt, Human
cagcaucuuauuuucuauggaa

SEQ ID NO: 646317 - RNA, 22 nt, Human
aucuuucacuuuuuguggauga

SEQ ID NO: 646318 - RNA, 22 nt, Human
ccagccaggcuggcuguggagg

SEQ ID NO: 646319 - RNA, 22 nt, Human
ggcuuucagccaaaggacaacc

SEQ ID NO: 646320 - RNA, 23 nt, Human
cuuuaaugaaauucucugugaag

SEQ ID NO: 646321 - RNA, 22 nt, Human
ccagcucugccaagcgucagcu

SEQ ID NO: 646322 - RNA, 22 nt, Human
aagccaguguccagaaugggca

SEQ ID NO: 646323 - RNA, 22 nt, Human
cuaacuuuuacagucauguugc

SEQ ID NO: 646324 - RNA, 22 nt, Human
agugucugaguaaauuucucau

SEQ ID NO: 646325 - RNA, 19 nt, Human
uguuuuguuaaagcagucc

SEQ ID NO: 646326 - RNA, 22 nt, Human
ggagugagcaaauagagauuug

SEQ ID NO: 646327 - RNA, 22 nt, Human
aaagguucuacuuuuaaagaau

SEQ ID NO: 646328 - RNA, 22 nt, Human
gucauugacuagaauuccaaag

SEQ ID NO: 646329 - RNA, 22 nt, Human
uugugaucuguguugauggccu

SEQ ID NO: 646330 - RNA, 19 nt, Human
gcugggagcagacccuccc

SEQ ID NO: 646331 - RNA, 21 nt, Human
gcugucucuggcuccugggaa

SEQ ID NO: 646332 - RNA, 22 nt, Human
agcagcagaucaaacaggcuug

SEQ ID NO: 646333 - RNA, 22 nt, Human
ggggaccugggcuucaaggguu

SEQ ID NO: 646334 - RNA, 22 nt, Human
acccacagaaccugugacaaca

SEQ ID NO: 646335 - RNA, 22 nt, Human
agggcugcaccggggcuucgcg

SEQ ID NO: 646336 - RNA, 22 nt, Human
gucuggcuguuccugccuguga

SEQ ID NO: 646337 - RNA, 22 nt, Human
ucugcuguucucaugcugauuu

SEQ ID NO: 646338 - RNA, 22 nt, Human
acgcccggucuccauaguuuuu

SEQ ID NO: 646339 - RNA, 22 nt, Human
augaggucuggcaaucagaaac

SEQ ID NO: 646340 - RNA, 22 nt, Human
gcugcuggggccuucccucggg

SEQ ID NO: 646341 - RNA, 20 nt, Human
uuaaaaagagucacaggaga

SEQ ID NO: 646342 - RNA, 22 nt, Human
ccagggcucuaugaggguggag

SEQ ID NO: 646343 - RNA, 22 nt, Human
uuggcauuuuuccucagcugga

SEQ ID NO: 646344 - RNA, 22 nt, Human
aaaggcuggaaacugaagauaa

SEQ ID NO: 646345 - RNA, 22 nt, Human
gcuggcuuccuucugcagcuag

SEQ ID NO: 646346 - RNA, 22 nt, Human
ugucuauuaauuccacauaaaa

SEQ ID NO: 646347 - RNA, 22 nt, Human
uuucucugggcuguuggcagcc

SEQ ID NO: 646348 - RNA, 21 nt, Human
cugguguagcacucaggugcu

SEQ ID NO: 646349 - RNA, 22 nt, Human
ggcaguggguuccccaaggcac

SEQ ID NO: 646350 - RNA, 22 nt, Human
aggaaggacuccaugguccguc

SEQ ID NO: 646351 - RNA, 22 nt, Human
cccagagccucauucuguuggg

SEQ ID NO: 646352 - RNA, 22 nt, Human
guggcaguucugugucucuugu

SEQ ID NO: 646353 - RNA, 22 nt, Human
gcaguggggcgcugggaguugg

SEQ ID NO: 646354 - RNA, 22 nt, Human
guggccuggaugagcuucgaca

SEQ ID NO: 646355 - RNA, 22 nt, Human
cagaggaguucaguacacagcc

SEQ ID NO: 646356 - RNA, 22 nt, Human
ucccaggcgccugguggggagc

SEQ ID NO: 646357 - RNA, 22 nt, Human
gugggggcagugggcuucgagc

SEQ ID NO: 646358 - RNA, 20 nt, Human
augugaaagaucaguugucu

SEQ ID NO: 646359 - RNA, 22 nt, Human
uccauccauguaggaagauggu

SEQ ID NO: 646360 - RNA, 22 nt, Human
auccuucaggaaaccauccuca

SEQ ID NO: 646361 - RNA, 22 nt, Human
uggucugaggaacaccagcacu

SEQ ID NO: 646362 - RNA, 22 nt, Human
agugucuuuagcaaguuuaguc

SEQ ID NO: 646363 - RNA, 22 nt, Human
auucaguuaguagauuugguca

SEQ ID NO: 646364 - RNA, 22 nt, Human
uaaaguguguggguucuaaauu

SEQ ID NO: 646365 - RNA, 22 nt, Human
ggcaggccugagaggcagggcu

SEQ ID NO: 646366 - RNA, 22 nt, Human
uacaguagaaugcggugccagu

SEQ ID NO: 646367 - RNA, 22 nt, Human
cuucacauugggcuugauauga

SEQ ID NO: 646368 - RNA, 22 nt, Human
gcacacagagaggugguauguc

SEQ ID NO: 646369 - RNA, 22 nt, Human
acauacacaagcguacaugaac

SEQ ID NO: 646370 - RNA, 22 nt, Human
ugugcccaucucccagcuugac

SEQ ID NO: 646371 - RNA, 19 nt, Human
cccagcuguucuuccacca

SEQ ID NO: 646372 - RNA, 22 nt, Human
cugcagcuccccugagaucaag

SEQ ID NO: 646373 - RNA, 22 nt, Human
uucauucauguauugucuaugg

SEQ ID NO: 646374 - RNA, 22 nt, Human
ccugggcaggccggacgcuggg

SEQ ID NO: 646375 - RNA, 22 nt, Human
cacuuuaacucacauuucagcu

SEQ ID NO: 646376 - RNA, 22 nt, Human
cuccucuggguccugguggcca

SEQ ID NO: 646377 - RNA, 21 nt, Human
auuuacaaaacagucccuucc

SEQ ID NO: 646378 - RNA, 22 nt, Human
uuccaggaauucagcucucagu

SEQ ID NO: 646379 - RNA, 20 nt, Human
uggcugcacaccaggacagg

SEQ ID NO: 646380 - RNA, 22 nt, Human
agaacagggacuggaggcuuca

SEQ ID NO: 646381 - RNA, 22 nt, Human
gccacaggaaagcacccuggag

SEQ ID NO: 646382 - RNA, 23 nt, Human
aggugccaacugagagcugagag

SEQ ID NO: 646383 - RNA, 21 nt, Human
acagacagggccagugucccc

SEQ ID NO: 646384 - RNA, 22 nt, Human
aauugcuuuacaagccguuuaa

SEQ ID NO: 646385 - RNA, 22 nt, Human
cccagcucucugcucuuagccu

SEQ ID NO: 646386 - RNA, 22 nt, Human
aggaaggagggcagauauuaag

SEQ ID NO: 646387 - RNA, 19 nt, Human
aggaaagguggccuuagca

SEQ ID NO: 646388 - RNA, 22 nt, Human
aguuauaaucugcuacugauau

SEQ ID NO: 646389 - RNA, 17 nt, Human
agcugccagggagugug

SEQ ID NO: 646390 - RNA, 22 nt, Human
auuuuccaaaauaauuguuacu

SEQ ID NO: 646391 - RNA, 22 nt, Human
auucaaaugucaaauccaccag

SEQ ID NO: 646392 - RNA, 22 nt, Human
ugcuugauuaagccuuguuugc

SEQ ID NO: 646393 - RNA, 22 nt, Human
aucuauaucaugggguaaggua

SEQ ID NO: 646394 - RNA, 22 nt, Human
uuccucuccucccaccagguga

SEQ ID NO: 646395 - RNA, 20 nt, Human
ucuggcacacugagaagcuc

SEQ ID NO: 646396 - RNA, 22 nt, Human
ugcugggcuguuccuguccaug

SEQ ID NO: 646397 - RNA, 22 nt, Human
auggcuggucucccauggaaaa

SEQ ID NO: 646398 - RNA, 22 nt, Human
cccaggaggacauuccauaccc

SEQ ID NO: 646399 - RNA, 22 nt, Human
agcccacuguuuucauuucucu

SEQ ID NO: 646400 - RNA, 22 nt, Human
agggcuuucggcacucugaggg

SEQ ID NO: 646401 - RNA, 19 nt, Human
guguccauggagcauggag

SEQ ID NO: 646402 - RNA, 22 nt, Human
caccugcucccucaguuccagc

SEQ ID NO: 646403 - RNA, 22 nt, Human
ggccuggaguuuggggaauaga

SEQ ID NO: 646404 - RNA, 22 nt, Human
agagcagcuggcugcaucuaga

SEQ ID NO: 646405 - RNA, 22 nt, Human
ucucuguggguuucaccagcgc

SEQ ID NO: 646406 - RNA, 22 nt, Human
cugggcaggagggcucuaugga

SEQ ID NO: 646407 - RNA, 22 nt, Human
aagccaggguuuguggaucuau

SEQ ID NO: 646408 - RNA, 22 nt, Human
gugugaaaguuccuaagacuau

SEQ ID NO: 646409 - RNA, 22 nt, Human
cauuugaaaccuggaaucuacc

SEQ ID NO: 646410 - RNA, 22 nt, Human
ugcagggauccuagcugaagag

SEQ ID NO: 646411 - RNA, 22 nt, Human
acugccauuggucaaaugagug

SEQ ID NO: 646412 - RNA, 22 nt, Human
acagaacuuccugcuggagugg

SEQ ID NO: 646413 - RNA, 22 nt, Human
augaguaagaccauaauuuuug

SEQ ID NO: 646414 - RNA, 22 nt, Human
cagagcugcaaaugccccuccg

SEQ ID NO: 646415 - RNA, 22 nt, Human
uuggaacucaauaauucuucuu

SEQ ID NO: 646416 - RNA, 22 nt, Human
uugugggaucucccuguugcuc

SEQ ID NO: 646417 - RNA, 22 nt, Human
ugaggcuuagagaagaugggau

SEQ ID NO: 646418 - RNA, 22 nt, Human
cagaggcugagcagucaguuug

SEQ ID NO: 646419 - RNA, 19 nt, Human
cccaaggcccugggcaggc

SEQ ID NO: 646420 - RNA, 22 nt, Human
uggccuggcccugaggcccugu

SEQ ID NO: 646421 - RNA, 22 nt, Human
uggcuucuuagaccaguggccu

SEQ ID NO: 646422 - RNA, 22 nt, Human
uuuccuaaggcucauuuuaaaa

SEQ ID NO: 646423 - RNA, 22 nt, Human
ugaaggcaaccucugugguccu

SEQ ID NO: 646424 - RNA, 19 nt, Human
uugaauaugcaaacugaag

SEQ ID NO: 646425 - RNA, 22 nt, Human
aguaacaaauagcugccuuuaa

SEQ ID NO: 646426 - RNA, 22 nt, Human
gcccauccauggggucauggcc

SEQ ID NO: 646427 - RNA, 22 nt, Human
aucuuccuuugccaugggauag

SEQ ID NO: 646428 - RNA, 22 nt, Human
uggcccaggaggccagagggca

SEQ ID NO: 646429 - RNA, 22 nt, Human
ugguggcuguugcagaacugag

SEQ ID NO: 646430 - RNA, 22 nt, Human
aggggcuggaguucgagguuac

SEQ ID NO: 646431 - RNA, 22 nt, Human
uucuacauugugaaguucuuua

SEQ ID NO: 646432 - RNA, 22 nt, Human
gggcccuggcuuuccuguucuu

SEQ ID NO: 646433 - RNA, 22 nt, Human
aagcugugaaauagauuacaca

SEQ ID NO: 646434 - RNA, 22 nt, Human
ugggggcugaguaagaugagau

SEQ ID NO: 646435 - RNA, 22 nt, Human
acuguucuucccauuuauauug

SEQ ID NO: 646436 - RNA, 22 nt, Human
gcccugugcgcugaguucaggg

SEQ ID NO: 646437 - RNA, 22 nt, Human
acuccagggaggugagugugcg

SEQ ID NO: 646438 - RNA, 22 nt, Human
agagauugugcuacucacccaa

SEQ ID NO: 646439 - RNA, 22 nt, Human
cucccucugaggcuuugagccu

SEQ ID NO: 646440 - RNA, 22 nt, Human
cagcuucuuugggauucuuuau

SEQ ID NO: 646441 - RNA, 22 nt, Human
aucugccuggucuuugaugcag

SEQ ID NO: 646442 - RNA, 22 nt, Human
ucaggccacggcucacugagac

SEQ ID NO: 646443 - RNA, 22 nt, Human
uuucuuguaagauguuuauuaa

SEQ ID NO: 646444 - RNA, 22 nt, Human
caaggcagcuuaauagaauuug

SEQ ID NO: 646445 - RNA, 22 nt, Human
uccauggguagcccugguugag

SEQ ID NO: 646446 - RNA, 22 nt, Human
acuugaauaggaaagccacaaa

SEQ ID NO: 646447 - RNA, 22 nt, Human
auucucuguuuccaagaugaaa

SEQ ID NO: 646448 - RNA, 22 nt, Human
gcuguucagaugcgauucagga

SEQ ID NO: 646449 - RNA, 22 nt, Human
agguucuggagaacuuggaggu

SEQ ID NO: 646450 - RNA, 22 nt, Human
aagcaucuaggugacugacaua

SEQ ID NO: 646451 - RNA, 22 nt, Human
agaaguuugguccuauaaacuc

SEQ ID NO: 646452 - RNA, 22 nt, Human
caugcaugucagggauccugga

SEQ ID NO: 646453 - RNA, 22 nt, Human
aaagcagcaaguauuuguuacu

SEQ ID NO: 646454 - RNA, 22 nt, Human
aacagucagcuucucgggacau

SEQ ID NO: 646455 - RNA, 22 nt, Human
gucaggcugccagucuuuauug

SEQ ID NO: 646456 - RNA, 22 nt, Human
acacugugcagauucccuguga

SEQ ID NO: 646457 - RNA, 22 nt, Human
uucugcauucaaauuaugugag

SEQ ID NO: 646458 - RNA, 22 nt, Human
aucuuaugagacccauaaagau

SEQ ID NO: 646459 - RNA, 22 nt, Human
cacuguggauacagaaauuagu

SEQ ID NO: 646460 - RNA, 22 nt, Human
uucuguggguaauaccucauac

SEQ ID NO: 646461 - RNA, 22 nt, Human
augucacuuuugagacuagguu

SEQ ID NO: 646462 - RNA, 22 nt, Human
caggggccuguccuggcuucug

SEQ ID NO: 646463 - RNA, 22 nt, Human
ugcucugggggaagccagcugu

SEQ ID NO: 646464 - RNA, 22 nt, Human
aguaaacuguggguacagaugu

SEQ ID NO: 646465 - RNA, 20 nt, Human
aaauuuaggaaauuuuacgc

SEQ ID NO: 646466 - RNA, 22 nt, Human
aucugaaagcuaggaguucuca

SEQ ID NO: 646467 - RNA, 22 nt, Human
ugccuggauucgguuguuguca

SEQ ID NO: 646468 - RNA, 20 nt, Human
gaagauggguagaggcacag

SEQ ID NO: 646469 - RNA, 19 nt, Human
ccuggaggugaagguucuc

SEQ ID NO: 646470 - RNA, 19 nt, Human
cagagcugcuggccucguc

SEQ ID NO: 646471 - RNA, 22 nt, Human
cucgccugccugugucucuccc

SEQ ID NO: 646472 - RNA, 22 nt, Human
aacaggaaaacagcacaauagc

SEQ ID NO: 646473 - RNA, 22 nt, Human
uugcucugauuagguggaaaca

SEQ ID NO: 646474 - RNA, 22 nt, Human
uaguuucuagucaaucuucuuu

SEQ ID NO: 646475 - RNA, 22 nt, Human
uagguucagagaacugaaaaua

SEQ ID NO: 646476 - RNA, 19 nt, Human
ucaggacugacuugaaguc

SEQ ID NO: 646477 - RNA, 22 nt, Human
cuauuucaaggcccagauauga

SEQ ID NO: 646478 - RNA, 22 nt, Human
cuugaaguugcaaaacauuaau

SEQ ID NO: 646479 - RNA, 22 nt, Human
ucugugcuggacugauuucaua

SEQ ID NO: 646480 - RNA, 19 nt, Human
agacacacuugauaugugu

SEQ ID NO: 646481 - RNA, 23 nt, Human
uaggaggagaccgcaguguuacc

SEQ ID NO: 646482 - RNA, 18 nt, Human
ugcuuuaugcuuauauaa

SEQ ID NO: 646483 - RNA, 22 nt, Human
uuucaaacuuuacucuugaauc

SEQ ID NO: 646484 - RNA, 22 nt, Human
gagcugaauuacggugagucau

SEQ ID NO: 646485 - RNA, 22 nt, Human
guguggaaagaguggccucuca

SEQ ID NO: 646486 - RNA, 22 nt, Human
gcacugugacagcaagagugag

SEQ ID NO: 646487 - RNA, 22 nt, Human
uucuuauuaugugcucugugaa

SEQ ID NO: 646488 - RNA, 22 nt, Human
uucuuuuaauugugggggagug

SEQ ID NO: 646489 - RNA, 22 nt, Human
gcagagcagggauuuugccaua

SEQ ID NO: 646490 - RNA, 22 nt, Human
auucgcgggccuggaggguggg

SEQ ID NO: 646491 - RNA, 22 nt, Human
ugaaacuugcuaauugcacgua

SEQ ID NO: 646492 - RNA, 22 nt, Human
uucuuaaaacuuauggacaggu

SEQ ID NO: 646493 - RNA, 22 nt, Human
agcacacaggccaccuccacuu

SEQ ID NO: 646494 - RNA, 22 nt, Human
aggcaacaaggguagucaguga

SEQ ID NO: 646495 - RNA, 22 nt, Human
ugugaaauucuugaaaugcaca

SEQ ID NO: 646496 - RNA, 22 nt, Human
ggcuuugguagacacagauuga

SEQ ID NO: 646497 - RNA, 22 nt, Human
ucaggggcagccggggaagcca

SEQ ID NO: 646498 - RNA, 22 nt, Human
acuauaacccauggaauauaag

SEQ ID NO: 646499 - RNA, 22 nt, Human
agcugccaucugaagaacugca

SEQ ID NO: 646500 - RNA, 22 nt, Human
cuggcuuuccuugucugcaucc

SEQ ID NO: 646501 - RNA, 22 nt, Human
ugagccugggagauggaggcug

SEQ ID NO: 646502 - RNA, 23 nt, Human
gaauucuuaaggucacuaaaguc

SEQ ID NO: 646503 - RNA, 22 nt, Human
guaaaugagucaaaugggggaa

SEQ ID NO: 646504 - RNA, 22 nt, Human
ucaaaugcuguauuguaguaau

SEQ ID NO: 646505 - RNA, 22 nt, Human
aagcagauauugugggaguggg

SEQ ID NO: 646506 - RNA, 22 nt, Human
cacaggcuccggccuugcagcc

SEQ ID NO: 646507 - RNA, 22 nt, Human
augaggccaccuucuacauuuc

SEQ ID NO: 646508 - RNA, 22 nt, Human
uaggggcucagaacauguccuu

SEQ ID NO: 646509 - RNA, 22 nt, Human
gggaccuggacaugugugugcu

SEQ ID NO: 646510 - RNA, 21 nt, Human
ucuugaaaauuguagcaguuu

SEQ ID NO: 646511 - RNA, 22 nt, Human
acugucugcuggccccugguua

SEQ ID NO: 646512 - RNA, 22 nt, Human
uaaaauugcggugaauauuucc

SEQ ID NO: 646513 - RNA, 17 nt, Human
uggacccuugggccucc

SEQ ID NO: 646514 - RNA, 22 nt, Human
cucucaggcuugggucguggca

SEQ ID NO: 646515 - RNA, 22 nt, Human
uuacaauaguuccuucuuuugu

SEQ ID NO: 646516 - RNA, 22 nt, Human
cagaguguauucugcaguugca

SEQ ID NO: 646517 - RNA, 21 nt, Human
ucucuggcgguguuuggcucc

SEQ ID NO: 646518 - RNA, 22 nt, Human
uagaaauccccagucucauagu

SEQ ID NO: 646519 - RNA, 22 nt, Human
ccugagcaucagcgccuccuua

SEQ ID NO: 646520 - RNA, 21 nt, Human
gccuuugguuucuuguccugc

SEQ ID NO: 646521 - RNA, 22 nt, Human
gaggggggcgcccugcagugca

SEQ ID NO: 646522 - RNA, 22 nt, Human
accuuuggaggacuagggucau

SEQ ID NO: 646523 - RNA, 22 nt, Human
uuucaaacauaucuucauuacu

SEQ ID NO: 646524 - RNA, 22 nt, Human
gcagccacccucaaggcugaau

SEQ ID NO: 646525 - RNA, 22 nt, Human
cagugcacacaauccucugccg

SEQ ID NO: 646526 - RNA, 22 nt, Human
agagucuuccaggcagccugag

SEQ ID NO: 646527 - RNA, 22 nt, Human
agcagcacacgggagaaagaca

SEQ ID NO: 646528 - RNA, 22 nt, Human
ucugaggaaaagaggagguagc

SEQ ID NO: 646529 - RNA, 22 nt, Human
gaggcccaguccugcaagcacg

SEQ ID NO: 646530 - RNA, 22 nt, Human
auuuagaagcuaauuuuucaga

SEQ ID NO: 646531 - RNA, 22 nt, Human
cugcauaucaaauuacuccugg

SEQ ID NO: 646532 - RNA, 20 nt, Human
ucccacugggccucaguuuc

SEQ ID NO: 646533 - RNA, 21 nt, Human
agcuguuugaagcuauauugg

SEQ ID NO: 646534 - RNA, 22 nt, Human
cucucugugcucacaagggcag

SEQ ID NO: 646535 - RNA, 22 nt, Human
gggcagcagcaggaggucucug

SEQ ID NO: 646536 - RNA, 22 nt, Human
uggccucugaggcaccuuugcc

SEQ ID NO: 646537 - RNA, 22 nt, Human
cagagcuuugugucagggcugu

SEQ ID NO: 646538 - RNA, 22 nt, Human
uuacacagugguuaagucuggg

SEQ ID NO: 646539 - RNA, 22 nt, Human
aagcagaaguugaucuaccaua

SEQ ID NO: 646540 - RNA, 22 nt, Human
uguggcaguaaaauugggcaac

SEQ ID NO: 646541 - RNA, 22 nt, Human
uggcucauauugagugauuucu

SEQ ID NO: 646542 - RNA, 22 nt, Human
ugggcagacuaaggucaaagcu

SEQ ID NO: 646543 - RNA, 22 nt, Human
gugcuguaacaacagagugucu

SEQ ID NO: 646544 - RNA, 18 nt, Human
aggaaagacgaagagggc

SEQ ID NO: 646545 - RNA, 22 nt, Human
ugugggaagagcaguggcagca

SEQ ID NO: 646546 - RNA, 22 nt, Human
cucugcucaccagccaugugau

SEQ ID NO: 646547 - RNA, 20 nt, Human
ugcugggcaugcaguggaaa

SEQ ID NO: 646548 - RNA, 20 nt, Human
auuguugcugcugcuguuga

SEQ ID NO: 646549 - RNA, 22 nt, Human
caggaaaucagaacucaagugg

SEQ ID NO: 646550 - RNA, 19 nt, Human
cucugaggauuagcugugg

SEQ ID NO: 646551 - RNA, 22 nt, Human
ccuuuaugucacucuggagagc

SEQ ID NO: 646552 - RNA, 22 nt, Human
ggcacugggagaggugagacgg

SEQ ID NO: 646553 - RNA, 18 nt, Human
uguuuauucuccugacag

SEQ ID NO: 646554 - RNA, 22 nt, Human
caagucauuacugaaaugucac

SEQ ID NO: 646555 - RNA, 22 nt, Human
uuugaaugcaggacauacagaa

SEQ ID NO: 646556 - RNA, 22 nt, Human
aauagcaccugagguaguuugu

SEQ ID NO: 646557 - RNA, 22 nt, Human
aggaagaaccuaagaaagucuc

SEQ ID NO: 646558 - RNA, 21 nt, Human
guuauuuuaagugagcuuugc

SEQ ID NO: 646559 - RNA, 22 nt, Human
uuugacucagcaaauucacagg

SEQ ID NO: 646560 - RNA, 22 nt, Human
cccagcccccgagugucuggaa

SEQ ID NO: 646561 - RNA, 22 nt, Human
ugcccuggcuggagugcagugg

SEQ ID NO: 646562 - RNA, 22 nt, Human
auauagaucaaaugaugcuaau

SEQ ID NO: 646563 - RNA, 22 nt, Human
gcucucucuuggggauucagca

SEQ ID NO: 646564 - RNA, 22 nt, Human
cagcagagcuuauuaacuaaaa

SEQ ID NO: 646565 - RNA, 22 nt, Human
cgaggugggcagaucacagagu

SEQ ID NO: 646566 - RNA, 22 nt, Human
ccagagguggugggugcuacag

SEQ ID NO: 646567 - RNA, 17 nt, Human
ugcauuguaggcuagcc

SEQ ID NO: 646568 - RNA, 22 nt, Human
cuacaggaaggaucuugcucaa

SEQ ID NO: 646569 - RNA, 22 nt, Human
cagaguccuggacacagagaca

SEQ ID NO: 646570 - RNA, 22 nt, Human
auuguacaaugccuggaacauu

SEQ ID NO: 646571 - RNA, 20 nt, Human
gucuuuauguuuuaugaccu

SEQ ID NO: 646572 - RNA, 22 nt, Human
ucuggcuuggcuggcaucucug

SEQ ID NO: 646573 - RNA, 22 nt, Human
uggaggagaccauuccacucag

SEQ ID NO: 646574 - RNA, 22 nt, Human
ccaaagucagugcucagucguc

SEQ ID NO: 646575 - RNA, 22 nt, Human
auugaguacuuagugucauaua

SEQ ID NO: 646576 - RNA, 16 nt, Human
acccucagaaacugcu

SEQ ID NO: 646577 - RNA, 22 nt, Human
ugccucagcugaggccgcucca

SEQ ID NO: 646578 - RNA, 16 nt, Human
uaaacagcagacaguu

SEQ ID NO: 646579 - RNA, 22 nt, Human
acccaggguuccugggucccag

SEQ ID NO: 646580 - RNA, 22 nt, Human
aagagauuucuguaaaauguaa

SEQ ID NO: 646581 - RNA, 20 nt, Human
augccucuaauuuugcaaac

SEQ ID NO: 646582 - RNA, 22 nt, Human
caguguuucugaguuccagcuc

SEQ ID NO: 646583 - RNA, 22 nt, Human
uuccuggggacuuaccgucauu

SEQ ID NO: 646584 - RNA, 20 nt, Human
cuuccacacaagaagcacag

SEQ ID NO: 646585 - RNA, 22 nt, Human
aaugcaaagcucuuuaauccuu

SEQ ID NO: 646586 - RNA, 22 nt, Human
ccaggaaaauaccaagcuuuaa

SEQ ID NO: 646587 - RNA, 22 nt, Human
aaugucuacauucugaauucgu

SEQ ID NO: 646588 - RNA, 22 nt, Human
agucccaggcagccgagccggu

SEQ ID NO: 646589 - RNA, 22 nt, Human
uguauuugugauaacgaccuga

SEQ ID NO: 646590 - RNA, 22 nt, Human
auguuuuauuaccaacuuguac

SEQ ID NO: 646591 - RNA, 22 nt, Human
aguguguccaggaagcagaugg

SEQ ID NO: 646592 - RNA, 22 nt, Human
uggcagagucaucacaucugga

SEQ ID NO: 646593 - RNA, 22 nt, Human
gcagggcuguucaggagggugg

SEQ ID NO: 646594 - RNA, 22 nt, Human
uagccaggcgaggucagugucg

SEQ ID NO: 646595 - RNA, 22 nt, Human
ucagaucuaauuggauuauuau

SEQ ID NO: 646596 - RNA, 22 nt, Human
ggcucagauuccgaguggcccu

SEQ ID NO: 646597 - RNA, 22 nt, Human
gcacagaauaacacucugggcu

SEQ ID NO: 646598 - RNA, 22 nt, Human
ggcugcagcggauuggggauug

SEQ ID NO: 646599 - RNA, 22 nt, Human
aaguauaagcuauucuucauga

SEQ ID NO: 646600 - RNA, 22 nt, Human
gcaaacauuccacagaaggaag

SEQ ID NO: 646601 - RNA, 19 nt, Human
cugaaacacagagagggcu

SEQ ID NO: 646602 - RNA, 22 nt, Human
aaagcagcacauggauaucagu

SEQ ID NO: 646603 - RNA, 22 nt, Human
guguaauguugucagcaucauc

SEQ ID NO: 646604 - RNA, 22 nt, Human
ugccacaggguccucaggccag

SEQ ID NO: 646605 - RNA, 22 nt, Human
agguucuggcauugcucaguaa

SEQ ID NO: 646606 - RNA, 22 nt, Human
ucccacaugugaauccucaggu

SEQ ID NO: 646607 - RNA, 22 nt, Human
cagagguuugaucgaguagguc

SEQ ID NO: 646608 - RNA, 22 nt, Human
cacccugcccacuagcaaucug

SEQ ID NO: 646609 - RNA, 20 nt, Human
aucagcaacugccacucagu

SEQ ID NO: 646610 - RNA, 22 nt, Human
ugaaguuuuacauccucuccaa

SEQ ID NO: 646611 - RNA, 19 nt, Human
gggaccugacuaauuggca

SEQ ID NO: 646612 - RNA, 22 nt, Human
gggcuucuggcuacuguaugag

SEQ ID NO: 646613 - RNA, 20 nt, Human
ucuuggaaaaaguucagaau

SEQ ID NO: 646614 - RNA, 22 nt, Human
acauuguacucuuagcguuguu

SEQ ID NO: 646615 - RNA, 23 nt, Human
uggaccugaaccagugccucugu

SEQ ID NO: 646616 - RNA, 22 nt, Human
auggcagggcacagcucuaguu

SEQ ID NO: 646617 - RNA, 22 nt, Human
ucugccagugguuuggcccuga

SEQ ID NO: 646618 - RNA, 19 nt, Human
gugcuuuuuaagagcucag

SEQ ID NO: 646619 - RNA, 23 nt, Human
auggaagucacuguuuucuuguc

SEQ ID NO: 646620 - RNA, 22 nt, Human
gagcucagcacuaaaaucaugu

SEQ ID NO: 646621 - RNA, 22 nt, Human
acucucccuuggagccucaggc

SEQ ID NO: 646622 - RNA, 22 nt, Human
acagcccaagucaccugcagga

SEQ ID NO: 646623 - RNA, 20 nt, Human
aauacaugagcacacuuuca

SEQ ID NO: 646624 - RNA, 22 nt, Human
cccuggagggacagcugcucua

SEQ ID NO: 646625 - RNA, 22 nt, Human
ugguggcaacauugcuggagug

SEQ ID NO: 646626 - RNA, 17 nt, Human
gcagaaaagucaaggga

SEQ ID NO: 646627 - RNA, 21 nt, Human
gggcucuccugaggccaugaa

SEQ ID NO: 646628 - RNA, 20 nt, Human
gggaggcauuggucccucac

SEQ ID NO: 646629 - RNA, 22 nt, Human
gucagaagcauuuguggcugaa

SEQ ID NO: 646630 - RNA, 22 nt, Human
agucugaagacucaugucugaa

SEQ ID NO: 646631 - RNA, 22 nt, Human
agcagcagaagggagacccagg

SEQ ID NO: 646632 - RNA, 22 nt, Human
uuuguaaauagcaguacucaug

SEQ ID NO: 646633 - RNA, 22 nt, Human
ugagcugugaucuaugauaaau

SEQ ID NO: 646634 - RNA, 22 nt, Human
agagaagcauucuucucagggc

SEQ ID NO: 646635 - RNA, 22 nt, Human
uuaauuguaaaguuugccuguu

SEQ ID NO: 646636 - RNA, 22 nt, Human
gcuuuuaauuaguugcuuccau

SEQ ID NO: 646637 - RNA, 17 nt, Human
ugucuacucugacuaaa

SEQ ID NO: 646638 - RNA, 22 nt, Human
gugggcaggaggcccugcccug

SEQ ID NO: 646639 - RNA, 22 nt, Human
cauuacaucuuugaugcaguau

SEQ ID NO: 646640 - RNA, 18 nt, Human
cuccaaggucucuggcuu

SEQ ID NO: 646641 - RNA, 22 nt, Human
aaggcacaugaccuaggccugg

SEQ ID NO: 646642 - RNA, 22 nt, Human
auaugaagaaucuaggauaggc

SEQ ID NO: 646643 - RNA, 22 nt, Human
aaggcacaacacaagaggguga

SEQ ID NO: 646644 - RNA, 22 nt, Human
ugagaggugaggcaugaggcau

SEQ ID NO: 646645 - RNA, 21 nt, Human
gaauugugccccuugguguug

SEQ ID NO: 646646 - RNA, 20 nt, Human
acuaaggugguagcagcagg

SEQ ID NO: 646647 - RNA, 22 nt, Human
guguggccucaacgggaugcaa

SEQ ID NO: 646648 - RNA, 20 nt, Human
uuucugugcccaggucuguu

SEQ ID NO: 646649 - RNA, 22 nt, Human
aauaugcauguauacaugugua

SEQ ID NO: 646650 - RNA, 22 nt, Human
ugugugcuuauagucuaguagu

SEQ ID NO: 646651 - RNA, 22 nt, Human
cccagcucucgcacuuacuagc

SEQ ID NO: 646652 - RNA, 20 nt, Human
ccucaggccaguuuuaaagu

SEQ ID NO: 646653 - RNA, 22 nt, Human
uuggccuucugguguucauuuu

SEQ ID NO: 646654 - RNA, 22 nt, Human
ggaggaaggguagcauaaugua

SEQ ID NO: 646655 - RNA, 22 nt, Human
aaaugugaguuauagcaauaga

SEQ ID NO: 646656 - RNA, 22 nt, Human
gagaaggcuucuuuuccucuga

SEQ ID NO: 646657 - RNA, 22 nt, Human
uggcuuuagguugcauguuucu

SEQ ID NO: 646658 - RNA, 22 nt, Human
cagcccucaucccgccugcguu

SEQ ID NO: 646659 - RNA, 22 nt, Human
uauggcauuuagaaaugucaga

SEQ ID NO: 646660 - RNA, 22 nt, Human
acaacacauguguauaugugug

SEQ ID NO: 646661 - RNA, 22 nt, Human
agcaugaaaggcgugccaacuu

SEQ ID NO: 646662 - RNA, 22 nt, Human
gugguuuugccauuacaaguaa

SEQ ID NO: 646663 - RNA, 17 nt, Human
aguuaguguagcagugc

SEQ ID NO: 646664 - RNA, 22 nt, Human
augggaugaacuugaucugcuu

SEQ ID NO: 646665 - RNA, 22 nt, Human
auccaaaccuggacaugagugg

SEQ ID NO: 646666 - RNA, 22 nt, Human
ccugggaggcagagguugcagu

SEQ ID NO: 646667 - RNA, 22 nt, Human
agcuccagguagugccuuaucg

SEQ ID NO: 646668 - RNA, 22 nt, Human
ucuggcagugauuucugugauc

SEQ ID NO: 646669 - RNA, 22 nt, Human
ucuggcagggucagggcccagg

SEQ ID NO: 646670 - RNA, 22 nt, Human
gagaggcuggguuggagaucga

SEQ ID NO: 646671 - RNA, 22 nt, Human
ccugggauuugcgccagaccuu

SEQ ID NO: 646672 - RNA, 19 nt, Human
augaagauugguaaauuca

SEQ ID NO: 646673 - RNA, 22 nt, Human
agauugauagauguuucuaaaa

SEQ ID NO: 646674 - RNA, 22 nt, Human
aggucugagagccgcuuucccc

SEQ ID NO: 646675 - RNA, 22 nt, Human
aagaacuaucucuggcuguagg

SEQ ID NO: 646676 - RNA, 22 nt, Human
gaggcaccagacauggccucau

SEQ ID NO: 646677 - RNA, 22 nt, Human
uccuucucuacaaauccaggca

SEQ ID NO: 646678 - RNA, 22 nt, Human
cuugagaaaggaacaggaagcu

SEQ ID NO: 646679 - RNA, 22 nt, Human
cugucuuuucauacuuucccuc

SEQ ID NO: 646680 - RNA, 22 nt, Human
auauuuagcucauuuccagugc

SEQ ID NO: 646681 - RNA, 22 nt, Human
ccaaggcugagguuuccaguug

SEQ ID NO: 646682 - RNA, 22 nt, Human
guggcacagagauggggcauga

SEQ ID NO: 646683 - RNA, 22 nt, Human
cuggggagugaaauucuuaaau

SEQ ID NO: 646684 - RNA, 22 nt, Human
aucuacacuauaacagaaugcu

SEQ ID NO: 646685 - RNA, 22 nt, Human
aaugcaaagaguugcuuaucaa

SEQ ID NO: 646686 - RNA, 22 nt, Human
ucucuggccgagagucccuggg

SEQ ID NO: 646687 - RNA, 22 nt, Human
cagagccagcccacuguucccg

SEQ ID NO: 646688 - RNA, 22 nt, Human
caguuaaaggcccaauaucugg

SEQ ID NO: 646689 - RNA, 22 nt, Human
aguccauaacuucagaguguca

SEQ ID NO: 646690 - RNA, 22 nt, Human
cagagccagucagucagaaacu

SEQ ID NO: 646691 - RNA, 22 nt, Human
uuguauuuccuauaaccuuucu

SEQ ID NO: 646692 - RNA, 22 nt, Human
caugagcauuuuggucuaguuu

SEQ ID NO: 646693 - RNA, 22 nt, Human
ccaggcccuugcaagucccacc

SEQ ID NO: 646694 - RNA, 22 nt, Human
gacagacaggaggccaccugcu

SEQ ID NO: 646695 - RNA, 22 nt, Human
ucauuuuuuuccgguaggaaua

SEQ ID NO: 646696 - RNA, 22 nt, Human
acccuguuaugguguaacauuu

SEQ ID NO: 646697 - RNA, 22 nt, Human
uuauuugguuauuguaauuggg

SEQ ID NO: 646698 - RNA, 22 nt, Human
ucuuagaaaugaaguucuuucu

SEQ ID NO: 646699 - RNA, 22 nt, Human
aaagacauuagcuuagauguca

SEQ ID NO: 646700 - RNA, 22 nt, Human
acagcucugguccuuuagagag

SEQ ID NO: 646701 - RNA, 22 nt, Human
cagcuggccugaucccuguggc

SEQ ID NO: 646702 - RNA, 22 nt, Human
agucaccagguuuuagagaccu

SEQ ID NO: 646703 - RNA, 22 nt, Human
gggagguguucugccaacgcgg

SEQ ID NO: 646704 - RNA, 22 nt, Human
uauaugcaugcccauguauaca

SEQ ID NO: 646705 - RNA, 22 nt, Human
uauaaaauucucaguuuggggu

SEQ ID NO: 646706 - RNA, 22 nt, Human
caacagagagaccagaaacagg

SEQ ID NO: 646707 - RNA, 22 nt, Human
acaggacauguaccaggugguc

SEQ ID NO: 646708 - RNA, 22 nt, Human
cuucuucuuuuaauaaaugucu

SEQ ID NO: 646709 - RNA, 22 nt, Human
aggcaccuugagagcaggagcu

SEQ ID NO: 646710 - RNA, 22 nt, Human
guggcugcuacagagcuggagg

SEQ ID NO: 646711 - RNA, 22 nt, Human
guaguuuucugaaaauuacuuu

SEQ ID NO: 646712 - RNA, 22 nt, Human
ugaguuuaauuggagccugaau

SEQ ID NO: 646713 - RNA, 22 nt, Human
uucauauucaaauacucugcuu

SEQ ID NO: 646714 - RNA, 19 nt, Human
ucccuggcgccucucgggc

SEQ ID NO: 646715 - RNA, 22 nt, Human
cugguucauccccuuccaggaa

SEQ ID NO: 646716 - RNA, 22 nt, Human
caggaaauucuuuuguuugugc

SEQ ID NO: 646717 - RNA, 21 nt, Human
guccuucagcaaguuaguggc

SEQ ID NO: 646718 - RNA, 22 nt, Human
acucugcuggcugcagggcagc

SEQ ID NO: 646719 - RNA, 22 nt, Human
gggcuggaccgcucgccucccu

SEQ ID NO: 646720 - RNA, 22 nt, Human
acuccugguuuguguccuggcu

SEQ ID NO: 646721 - RNA, 23 nt, Human
gccaauuuuugacugucaguagg

SEQ ID NO: 646722 - RNA, 22 nt, Human
aaccaggauuuaagauucuaga

SEQ ID NO: 646723 - RNA, 22 nt, Human
gcugccuccaaucugugccccg

SEQ ID NO: 646724 - RNA, 22 nt, Human
ugcuuuauagacaaggaaguag

SEQ ID NO: 646725 - RNA, 22 nt, Human
agugcuuuccuucuugugacau

SEQ ID NO: 646726 - RNA, 22 nt, Human
aaacuuuaagacaguccucaag

SEQ ID NO: 646727 - RNA, 22 nt, Human
aaguuuauguugguaagauauc

SEQ ID NO: 646728 - RNA, 22 nt, Human
ccucagcauccuccugcucagu

SEQ ID NO: 646729 - RNA, 22 nt, Human
gaugucuuacuaacuagccuuu

SEQ ID NO: 646730 - RNA, 22 nt, Human
caaagccaggcuuucuaaugua

SEQ ID NO: 646731 - RNA, 22 nt, Human
aaaucugguucaguaaguccuc

SEQ ID NO: 646732 - RNA, 20 nt, Human
gcuuccaccugaagcgcacc

SEQ ID NO: 646733 - RNA, 22 nt, Human
acacacaauuaguuuuaugcuu

SEQ ID NO: 646734 - RNA, 22 nt, Human
aggccacagucagugggugcug

SEQ ID NO: 646735 - RNA, 22 nt, Human
uaguguguaugguaaugaugaa

SEQ ID NO: 646736 - RNA, 22 nt, Human
agucagugggcuuggcacagaa

SEQ ID NO: 646737 - RNA, 22 nt, Human
ccuuaaauucuccauuugaaag

SEQ ID NO: 646738 - RNA, 22 nt, Human
aacagcaggcauuucuuagcuc

SEQ ID NO: 646739 - RNA, 22 nt, Human
ugggaacucucugggaggcauc

SEQ ID NO: 646740 - RNA, 17 nt, Human
accagccucuccugggg

SEQ ID NO: 646741 - RNA, 22 nt, Human
auuuggggcucaccagggcuga

SEQ ID NO: 646742 - RNA, 21 nt, Human
uauugauucaauuucuugagu

SEQ ID NO: 646743 - RNA, 22 nt, Human
ccaccuccucggccaugugacg

SEQ ID NO: 646744 - RNA, 21 nt, Human
aucucgggcuucucgcccagc

SEQ ID NO: 646745 - RNA, 23 nt, Human
augcccuguagaggcugcugacc

SEQ ID NO: 646746 - RNA, 22 nt, Human
uuuacugaccuccaaucccacu

SEQ ID NO: 646747 - RNA, 22 nt, Human
aaagaggaaccaagagcacgug

SEQ ID NO: 646748 - RNA, 22 nt, Human
gcaggaugaacuaacaccugca

SEQ ID NO: 646749 - RNA, 22 nt, Human
cuccagugcccuccuugggggc

SEQ ID NO: 646750 - RNA, 22 nt, Human
ucugccucuuucaggccuggca

SEQ ID NO: 646751 - RNA, 22 nt, Human
gccuuuauauuuuucugguguu

SEQ ID NO: 646752 - RNA, 22 nt, Human
gcuucugcaggguccucgcugu

SEQ ID NO: 646753 - RNA, 22 nt, Human
guggcacucaccuguaguuuca

SEQ ID NO: 646754 - RNA, 20 nt, Human
agcacagcgcgguguuccuu

SEQ ID NO: 646755 - RNA, 22 nt, Human
aggcagucuaguccccaggcaa

SEQ ID NO: 646756 - RNA, 22 nt, Human
uacaaccauagacauauacuag

SEQ ID NO: 646757 - RNA, 22 nt, Human
uccagggccugagguugaagug

SEQ ID NO: 646758 - RNA, 22 nt, Human
cugccccagccuggggccuucu

SEQ ID NO: 646759 - RNA, 22 nt, Human
uccagggccacagaggaugcua

SEQ ID NO: 646760 - RNA, 22 nt, Human
ucugggaagacggauggacccu

SEQ ID NO: 646761 - RNA, 22 nt, Human
agcccugggauacaguaaaagc

SEQ ID NO: 646762 - RNA, 21 nt, Human
aaaguucaugcuuuaauauuc

SEQ ID NO: 646763 - RNA, 22 nt, Human
gaaaguugcaaucauggcuuuu

SEQ ID NO: 646764 - RNA, 22 nt, Human
uuuuccuggggcuucuggacuc

SEQ ID NO: 646765 - RNA, 20 nt, Human
uccugagaggcucuuggaga

SEQ ID NO: 646766 - RNA, 21 nt, Human
gaguccuuccaauguccucag

SEQ ID NO: 646767 - RNA, 22 nt, Human
uucugcugaaaacagccaugua

SEQ ID NO: 646768 - RNA, 19 nt, Human
gccagcagaaugaugaggc

SEQ ID NO: 646769 - RNA, 18 nt, Human
uaguuucuaauggccuuu

SEQ ID NO: 646770 - RNA, 22 nt, Human
ucccagggugcgccugcccucg

SEQ ID NO: 646771 - RNA, 22 nt, Human
gggugggagucuggcccucaaa

SEQ ID NO: 646772 - RNA, 22 nt, Human
uaaugcuuaacagcuggcuuuu

SEQ ID NO: 646773 - RNA, 22 nt, Human
ggaagggcggauaguauaaguu

SEQ ID NO: 646774 - RNA, 22 nt, Human
uggcagaggaggcucagauuga

SEQ ID NO: 646775 - RNA, 22 nt, Human
uuucuucuccauggcagguccu

SEQ ID NO: 646776 - RNA, 17 nt, Human
auggcuuccauugacca

SEQ ID NO: 646777 - RNA, 22 nt, Human
ugggccuggggcagcccaaauc

SEQ ID NO: 646778 - RNA, 22 nt, Human
guuuacaacaucuuguccuuca

SEQ ID NO: 646779 - RNA, 22 nt, Human
ggcugcuguacugaugucaguu

SEQ ID NO: 646780 - RNA, 22 nt, Human
gcuguauuuauaugaaggcaug

SEQ ID NO: 646781 - RNA, 22 nt, Human
uggugacugggacuggauauga

SEQ ID NO: 646782 - RNA, 22 nt, Human
ugugaaaggagccauagacagu

SEQ ID NO: 646783 - RNA, 22 nt, Human
ucugggcucugucagcaccucu

SEQ ID NO: 646784 - RNA, 22 nt, Human
ugaaauguuuggguccagaagu

SEQ ID NO: 646785 - RNA, 20 nt, Human
aauccugggacagaggcagg

SEQ ID NO: 646786 - RNA, 22 nt, Human
gggagcugaaguagggguaaau

SEQ ID NO: 646787 - RNA, 22 nt, Human
ucuucacaguccuggucagugg

SEQ ID NO: 646788 - RNA, 22 nt, Human
uggcagaaugaagacuggggcc

SEQ ID NO: 646789 - RNA, 22 nt, Human
guacagaaauggggccccaggu

SEQ ID NO: 646790 - RNA, 22 nt, Human
gcaguguguagaguuuaggaaa

SEQ ID NO: 646791 - RNA, 22 nt, Human
ccagagcagauguggccuuggu

SEQ ID NO: 646792 - RNA, 22 nt, Human
guagaggggugauucugugaga

SEQ ID NO: 646793 - RNA, 22 nt, Human
cauggcuuucccucaagagcaa

SEQ ID NO: 646794 - RNA, 22 nt, Human
ccuuccaguauguuaagauggu

SEQ ID NO: 646795 - RNA, 22 nt, Human
cugcuuuaaaacccucagcugg

SEQ ID NO: 646796 - RNA, 22 nt, Human
uccuguccacagcccugaccuc

SEQ ID NO: 646797 - RNA, 22 nt, Human
accagcacuuccagaggucagg

SEQ ID NO: 646798 - RNA, 22 nt, Human
uguauguggcuacuuuucuugc

SEQ ID NO: 646799 - RNA, 22 nt, Human
aaaaugagacacaugugacucc

SEQ ID NO: 646800 - RNA, 22 nt, Human
ucuuccuugcuccuugucacuu

SEQ ID NO: 646801 - RNA, 22 nt, Human
aaaguccuguuugaaggaccug

SEQ ID NO: 646802 - RNA, 22 nt, Human
cuuaacaagcccaacuuucauu

SEQ ID NO: 646803 - RNA, 22 nt, Human
uguuuauuacaguucuuggaau

SEQ ID NO: 646804 - RNA, 19 nt, Human
ggauucugcaguuuucaca

SEQ ID NO: 646805 - RNA, 21 nt, Human
agagacagagaaaguaacauu

SEQ ID NO: 646806 - RNA, 22 nt, Human
agugugagauuaaaccgaauca

SEQ ID NO: 646807 - RNA, 22 nt, Human
agagccugcuaccucauuccag

SEQ ID NO: 646808 - RNA, 22 nt, Human
agacugugccacacaugggagu

SEQ ID NO: 646809 - RNA, 17 nt, Human
uuucugcaugauuggac

SEQ ID NO: 646810 - RNA, 22 nt, Human
caggaagaggacaggcuucccc

SEQ ID NO: 646811 - RNA, 22 nt, Human
aggcggcuucugaggaggcugc

SEQ ID NO: 646812 - RNA, 22 nt, Human
uacuccaggacuccauuugaaa

SEQ ID NO: 646813 - RNA, 22 nt, Human
uacagcauugugucuucacuca

SEQ ID NO: 646814 - RNA, 22 nt, Human
ggagucuguuuuacaugcagga

SEQ ID NO: 646815 - RNA, 22 nt, Human
gcuauacaaguguagaauagag

SEQ ID NO: 646816 - RNA, 22 nt, Human
accagcuguguccuggcugcag

SEQ ID NO: 646817 - RNA, 22 nt, Human
acugggcuccagaugugauacg

SEQ ID NO: 646818 - RNA, 18 nt, Human
cucugggagaggcauaca

SEQ ID NO: 646819 - RNA, 22 nt, Human
ugcaggaagcaaccagguccaa

SEQ ID NO: 646820 - RNA, 21 nt, Human
acucaaguggagaugccaggu

SEQ ID NO: 646821 - RNA, 22 nt, Human
auuuguugaauaaauuaguauu

SEQ ID NO: 646822 - RNA, 22 nt, Human
uuguagaaaauuagaugcaugg

SEQ ID NO: 646823 - RNA, 22 nt, Human
gacauuuaauaguauuguggga

SEQ ID NO: 646824 - RNA, 18 nt, Human
gccaggaagaggaaugug

SEQ ID NO: 646825 - RNA, 22 nt, Human
cgugucugggauagcagaagua

SEQ ID NO: 646826 - RNA, 22 nt, Human
cagaaauguucuaaugauucag

SEQ ID NO: 646827 - RNA, 22 nt, Human
auuuccucaugaucauaaugca

SEQ ID NO: 646828 - RNA, 22 nt, Human
aagauuucuuacuuauugaugc

SEQ ID NO: 646829 - RNA, 22 nt, Human
aaauugcugugaggugguagua

SEQ ID NO: 646830 - RNA, 22 nt, Human
cuggagaggccccaagauauuu

SEQ ID NO: 646831 - RNA, 22 nt, Human
gcugagacuggcagcaggaagu

SEQ ID NO: 646832 - RNA, 22 nt, Human
gccuggaggggccaggguggua

SEQ ID NO: 646833 - RNA, 19 nt, Human
uccuggugcuugacacuga

SEQ ID NO: 646834 - RNA, 22 nt, Human
gagcugccugugugccaugaug

SEQ ID NO: 646835 - RNA, 22 nt, Human
augaaauuugaccaauuauuua

SEQ ID NO: 646836 - RNA, 23 nt, Human
guacacauaguguaguuauauuu

SEQ ID NO: 646837 - RNA, 22 nt, Human
uuaauugagccagaaaguaucu

SEQ ID NO: 646838 - RNA, 22 nt, Human
aaugaauucgagugaaggaaag

SEQ ID NO: 646839 - RNA, 22 nt, Human
gugcagugagcagugcagcacc

SEQ ID NO: 646840 - RNA, 22 nt, Human
uaugaaauuucuaguucugcuu

SEQ ID NO: 646841 - RNA, 22 nt, Human
ccugagcuagggaaggaagacc

SEQ ID NO: 646842 - RNA, 22 nt, Human
uguccucaaggagcuucagucu

SEQ ID NO: 646843 - RNA, 22 nt, Human
cucugaaaaugugguggggaaa

SEQ ID NO: 646844 - RNA, 22 nt, Human
aaguuugacagaaguuucuaau

SEQ ID NO: 646845 - RNA, 22 nt, Human
agcccagggcuaauaggaacca

SEQ ID NO: 646846 - RNA, 22 nt, Human
uacaguagcuacucaauaacua

SEQ ID NO: 646847 - RNA, 22 nt, Human
gcugccugucccaggaugagga

SEQ ID NO: 646848 - RNA, 22 nt, Human
uugugcccucaaagggugcguc

SEQ ID NO: 646849 - RNA, 22 nt, Human
cagcugggagcuccauuagaua

SEQ ID NO: 646850 - RNA, 22 nt, Human
guuagacaugcagaaucucagg

SEQ ID NO: 646851 - RNA, 22 nt, Human
cuucuucauaggcaguccuguu

SEQ ID NO: 646852 - RNA, 19 nt, Human
ggcagcucuugucuucugc

SEQ ID NO: 646853 - RNA, 22 nt, Human
ugcacacacgcggcacaucugu

SEQ ID NO: 646854 - RNA, 22 nt, Human
aaggcagagauuagcagaauga

SEQ ID NO: 646855 - RNA, 17 nt, Human
ugucugucaucaguucc

SEQ ID NO: 646856 - RNA, 22 nt, Human
acauacuaugaauacauguguc

SEQ ID NO: 646857 - RNA, 19 nt, Human
cacuucacauggugaaagc

SEQ ID NO: 646858 - RNA, 22 nt, Human
ugggaaauuguauuucuauuuc

SEQ ID NO: 646859 - RNA, 22 nt, Human
cagagggguguagagaucacug

SEQ ID NO: 646860 - RNA, 22 nt, Human
acuuuucuaagcaauggucuug

SEQ ID NO: 646861 - RNA, 22 nt, Human
acagaggcagugugagauacug

SEQ ID NO: 646862 - RNA, 22 nt, Human
uacuuagagcgauaauuuauac

SEQ ID NO: 646863 - RNA, 17 nt, Human
uuaguguaucuguuuug

SEQ ID NO: 646864 - RNA, 22 nt, Human
aaugcuuauuauuaauagaaug

SEQ ID NO: 646865 - RNA, 22 nt, Human
ucuucagcagagaauuaugaug

SEQ ID NO: 646866 - RNA, 22 nt, Human
aauggcuuugacauuuucaaau

SEQ ID NO: 646867 - RNA, 20 nt, Human
uggcaggaggcagcagugga

SEQ ID NO: 646868 - RNA, 22 nt, Human
cugagguggaacagaggugaag

SEQ ID NO: 646869 - RNA, 22 nt, Human
gauagagacuauaaugcucuuu

SEQ ID NO: 646870 - RNA, 22 nt, Human
gggguggccaaggacucugacc

SEQ ID NO: 646871 - RNA, 22 nt, Human
ugcacuuguguuuucagaaucu

SEQ ID NO: 646872 - RNA, 22 nt, Human
ucacagcuuugagcagagacca

SEQ ID NO: 646873 - RNA, 22 nt, Human
uccuuucccuuuccauccuggc

SEQ ID NO: 646874 - RNA, 22 nt, Human
aaggggugcuguuggaaaccca

SEQ ID NO: 646875 - RNA, 22 nt, Human
agggaagcaaugauuauuauuc

SEQ ID NO: 646876 - RNA, 22 nt, Human
auuugcuuccuaauacucauau

SEQ ID NO: 646877 - RNA, 22 nt, Human
gaguuacagagaggauuauggu

SEQ ID NO: 646878 - RNA, 22 nt, Human
ccugugcccugccaggcuggug

SEQ ID NO: 646879 - RNA, 22 nt, Human
uuucuccuaacucaaauuuaag

SEQ ID NO: 646880 - RNA, 20 nt, Human
uggagcuccagcguccaugu

SEQ ID NO: 646881 - RNA, 21 nt, Human
ccacaggggcuccccugucag

SEQ ID NO: 646882 - RNA, 22 nt, Human
acccagaguaacagauggauuc

SEQ ID NO: 646883 - RNA, 22 nt, Human
uggcucagccuggcccuuucau

SEQ ID NO: 646884 - RNA, 22 nt, Human
uuuguguuuguacaaugcacua

SEQ ID NO: 646885 - RNA, 22 nt, Human
uggagcugggaguccugggcug

SEQ ID NO: 646886 - RNA, 22 nt, Human
ggugggcaggucacucugccuc

SEQ ID NO: 646887 - RNA, 22 nt, Human
auguguuuugguaauuucugcu

SEQ ID NO: 646888 - RNA, 22 nt, Human
cuggugcacguggcugcagucg

SEQ ID NO: 646889 - RNA, 22 nt, Human
gcugaggacauacacauugugc

SEQ ID NO: 646890 - RNA, 22 nt, Human
agcugaagaaaugggaagcauu

SEQ ID NO: 646891 - RNA, 22 nt, Human
ugcaggagcccuugggcucugg

SEQ ID NO: 646892 - RNA, 22 nt, Human
gaggaggucuccuccgcagggg

SEQ ID NO: 646893 - RNA, 18 nt, Human
gggugcaggcacugacug

SEQ ID NO: 646894 - RNA, 22 nt, Human
aggagcugaugauucuuugauc

SEQ ID NO: 646895 - RNA, 22 nt, Human
ggcagcaguggcugcuauuguc

SEQ ID NO: 646896 - RNA, 22 nt, Human
ccugccugucccucaguccaca

SEQ ID NO: 646897 - RNA, 20 nt, Human
uggcuuguuucuaugggcag

SEQ ID NO: 646898 - RNA, 22 nt, Human
caggagauguaccuguuuuuga

SEQ ID NO: 646899 - RNA, 22 nt, Human
ggucagagcuggagagauaggg

SEQ ID NO: 646900 - RNA, 22 nt, Human
acagcagaguaguuuuccaacu

SEQ ID NO: 646901 - RNA, 22 nt, Human
gcagccacagaggagggaugca

SEQ ID NO: 646902 - RNA, 16 nt, Human
cuuuuucuccccucuu

SEQ ID NO: 646903 - RNA, 21 nt, Human
uucaagauauuuaaaaggugg

SEQ ID NO: 646904 - RNA, 22 nt, Human
uccuucuccuccuugagugaca

SEQ ID NO: 646905 - RNA, 22 nt, Human
gauggcagucaaccaggugagg

SEQ ID NO: 646906 - RNA, 22 nt, Human
uaagaaacuauugucucugaac

SEQ ID NO: 646907 - RNA, 22 nt, Human
aauuaugguauguucaacaacu

SEQ ID NO: 646908 - RNA, 22 nt, Human
uuccuggccccaccccuggaga

SEQ ID NO: 646909 - RNA, 22 nt, Human
uggaggcaugacagugucugga

SEQ ID NO: 646910 - RNA, 22 nt, Human
cauugcacuucugcuuuuccuc

SEQ ID NO: 646911 - RNA, 22 nt, Human
uuacaguguuacuugaugucca

SEQ ID NO: 646912 - RNA, 22 nt, Human
ugguccuggggugcaggcugac

SEQ ID NO: 646913 - RNA, 22 nt, Human
cuacugaugauguugguugugg

SEQ ID NO: 646914 - RNA, 22 nt, Human
agcucugggccaggaacccuaa

SEQ ID NO: 646915 - RNA, 23 nt, Human
cauggcugauuucaagcuaccac

SEQ ID NO: 646916 - RNA, 22 nt, Human
gcugagguccagcauucgccua

SEQ ID NO: 646917 - RNA, 22 nt, Human
auuggcacugcacaugauugcu

SEQ ID NO: 646918 - RNA, 22 nt, Human
aaggcccuuccaccaguccucg

SEQ ID NO: 646919 - RNA, 22 nt, Human
aucucuuagcagucuagugacc

SEQ ID NO: 646920 - RNA, 22 nt, Human
ucugagcagagcaucauuucag

SEQ ID NO: 646921 - RNA, 22 nt, Human
agccccuguacccugagugcuu

SEQ ID NO: 646922 - RNA, 22 nt, Human
aaguuuggggagaauuucauuu

SEQ ID NO: 646923 - RNA, 22 nt, Human
acaguguucugcuuuuuaaucc

SEQ ID NO: 646924 - RNA, 21 nt, Human
aggacacagagacaccuauug

SEQ ID NO: 646925 - RNA, 22 nt, Human
gugauuccuauuaguacaugca

SEQ ID NO: 646926 - RNA, 22 nt, Human
cccuggcagcaaucacuggugu

SEQ ID NO: 646927 - RNA, 22 nt, Human
aaaagcagaucuccaaagucua

SEQ ID NO: 646928 - RNA, 22 nt, Human
caucucaggucugugguucacu

SEQ ID NO: 646929 - RNA, 22 nt, Human
cguagguggcucagcaccuggg

SEQ ID NO: 646930 - RNA, 22 nt, Human
auuuagaaguuggagggcaaga

SEQ ID NO: 646931 - RNA, 22 nt, Human
aauguguucaguuaaaugaacu

SEQ ID NO: 646932 - RNA, 22 nt, Human
agauccacucgaauccaggaau

SEQ ID NO: 646933 - RNA, 22 nt, Human
ccccagcucagugcagggacau

SEQ ID NO: 646934 - RNA, 22 nt, Human
gcucugggaacugacugccuuc

SEQ ID NO: 646935 - RNA, 22 nt, Human
acugccuugaaagauuguugag

SEQ ID NO: 646936 - RNA, 20 nt, Human
aguguuuagaauacuauuau

SEQ ID NO: 646937 - RNA, 22 nt, Human
ucuggagauaagacagacagau

SEQ ID NO: 646938 - RNA, 22 nt, Human
augcuuuaaacuauaaauccac

SEQ ID NO: 646939 - RNA, 22 nt, Human
cuggcuuuaaugucaucuuucu

SEQ ID NO: 646940 - RNA, 22 nt, Human
aggacuuagaacauuauguacu

SEQ ID NO: 646941 - RNA, 22 nt, Human
uacuguuauauauagcagcagu

SEQ ID NO: 646942 - RNA, 23 nt, Human
gcaugaagugcuacgucuacagc

SEQ ID NO: 646943 - RNA, 22 nt, Human
uccuuagguauuuagcaugaau

SEQ ID NO: 646944 - RNA, 22 nt, Human
gaacagcuucuugggagcuggg

SEQ ID NO: 646945 - RNA, 22 nt, Human
uccaagcuuuccaugcccucac

SEQ ID NO: 646946 - RNA, 22 nt, Human
uaauacagacaacuugccaaau

SEQ ID NO: 646947 - RNA, 22 nt, Human
ggcugcaguugugugaaggccg

SEQ ID NO: 646948 - RNA, 22 nt, Human
auuugcaagcaugcacaaaagc

SEQ ID NO: 646949 - RNA, 22 nt, Human
aagcaauguuagaggccuuagg

SEQ ID NO: 646950 - RNA, 22 nt, Human
aucacugucgucaucugagauu

SEQ ID NO: 646951 - RNA, 22 nt, Human
gggucuggagauccgggugaag

SEQ ID NO: 646952 - RNA, 17 nt, Human
ggagacagggucuuuaa

SEQ ID NO: 646953 - RNA, 22 nt, Human
cguccugggucugggaaggcau

SEQ ID NO: 646954 - RNA, 22 nt, Human
ccagcuccagguagaugggcag

SEQ ID NO: 646955 - RNA, 22 nt, Human
cugggagagccuuuccugaguc

SEQ ID NO: 646956 - RNA, 22 nt, Human
gagcugaauugaagcaaggagc

SEQ ID NO: 646957 - RNA, 22 nt, Human
ucacugcaaggaggcuucucaa

SEQ ID NO: 646958 - RNA, 22 nt, Human
gggcuccagggcccgagucguc

SEQ ID NO: 646959 - RNA, 22 nt, Human
uagauucuacugucacuuaguu

SEQ ID NO: 646960 - RNA, 16 nt, Human
ggcuuuaauuuauccc

SEQ ID NO: 646961 - RNA, 22 nt, Human
aguucuagaagacuuuuccauu

SEQ ID NO: 646962 - RNA, 22 nt, Human
ccagcccuccuccaucagagga

SEQ ID NO: 646963 - RNA, 21 nt, Human
uggggaggggaccugauuaug

SEQ ID NO: 646964 - RNA, 22 nt, Human
uacacuaugggcuuuguguaau

SEQ ID NO: 646965 - RNA, 22 nt, Human
cuggguugcaaagcgcuggcug

SEQ ID NO: 646966 - RNA, 22 nt, Human
aaauagcuuuucauaauucuca

SEQ ID NO: 646967 - RNA, 22 nt, Human
gguuuauugaaggccaccccac

SEQ ID NO: 646968 - RNA, 22 nt, Human
ugggaaggggagcuggaaagga

SEQ ID NO: 646969 - RNA, 22 nt, Human
acaauauacacauccuaauggg

SEQ ID NO: 646970 - RNA, 22 nt, Human
uccugaacauuaugcaagcuuc

SEQ ID NO: 646971 - RNA, 22 nt, Human
gggcagcugccaagugcaucgc

SEQ ID NO: 646972 - RNA, 22 nt, Human
aauugcauguuaaugacuaagu

SEQ ID NO: 646973 - RNA, 22 nt, Human
uccuccuguuucucaggccugg

SEQ ID NO: 646974 - RNA, 22 nt, Human
uugucucuguguggcuucccua

SEQ ID NO: 646975 - RNA, 22 nt, Human
agucugggcugucugcaggagu

SEQ ID NO: 646976 - RNA, 22 nt, Human
cuggccagacuacacaugugug

SEQ ID NO: 646977 - RNA, 22 nt, Human
cugugugcaggugcuggguacc

SEQ ID NO: 646978 - RNA, 22 nt, Human
aaagaaggggucuacauccaau

SEQ ID NO: 646979 - RNA, 17 nt, Human
uucaagauauugaaaug

SEQ ID NO: 646980 - RNA, 22 nt, Human
ucucagugguggcauuccagac

SEQ ID NO: 646981 - RNA, 22 nt, Human
cuggggucagggaucagagagc

SEQ ID NO: 646982 - RNA, 22 nt, Human
augugcuugagggaaaucaguu

SEQ ID NO: 646983 - RNA, 22 nt, Human
aggaguuucaaagcuuccaugu

SEQ ID NO: 646984 - RNA, 22 nt, Human
uagguucaggagauauugcaca

SEQ ID NO: 646985 - RNA, 20 nt, Human
accuggagacagcacucugg

SEQ ID NO: 646986 - RNA, 21 nt, Human
aggcaggauucaaacacagag

SEQ ID NO: 646987 - RNA, 22 nt, Human
auuaaauguuggcauauuuugu

SEQ ID NO: 646988 - RNA, 22 nt, Human
ccacugccgugggccuugggga

SEQ ID NO: 646989 - RNA, 20 nt, Human
aagaggugauaacaggugag

SEQ ID NO: 646990 - RNA, 19 nt, Human
uaaagcacauagcaaaagu

SEQ ID NO: 646991 - RNA, 22 nt, Human
gacauugacaguccuccuuaua

SEQ ID NO: 646992 - RNA, 22 nt, Human
ugugucuguuuugcucaccauu

SEQ ID NO: 646993 - RNA, 20 nt, Human
acaggggcagcacaauaaug

SEQ ID NO: 646994 - RNA, 22 nt, Human
ucccaauuaacagguaucaggc

SEQ ID NO: 646995 - RNA, 22 nt, Human
ucaauaacuuuguuuagcauug

SEQ ID NO: 646996 - RNA, 22 nt, Human
aguuuucugccucuggaugcgu

SEQ ID NO: 646997 - RNA, 22 nt, Human
agccucugcuggcccuggcacu

SEQ ID NO: 646998 - RNA, 22 nt, Human
gcugggcagccccuacagagag

SEQ ID NO: 646999 - RNA, 22 nt, Human
uagagggccagcuggacagcga

SEQ ID NO: 647000 - RNA, 21 nt, Human
cuaacuuugaguccuggcccc

SEQ ID NO: 647001 - RNA, 22 nt, Human
ucuggcuggcagugauggugug

SEQ ID NO: 647002 - RNA, 22 nt, Human
gucuccagggacacacuagccg

SEQ ID NO: 647003 - RNA, 22 nt, Human
auuguacuacaccauaguacug

SEQ ID NO: 647004 - RNA, 22 nt, Human
ccugucugcaugaucccugcca

SEQ ID NO: 647005 - RNA, 22 nt, Human
caucuguucuauccacguugcu

SEQ ID NO: 647006 - RNA, 22 nt, Human
gcacagagguggaggacaaaua

SEQ ID NO: 647007 - RNA, 22 nt, Human
cugcccucccaguugguccgug

SEQ ID NO: 647008 - RNA, 19 nt, Human
cuccacagggauugugauu

SEQ ID NO: 647009 - RNA, 22 nt, Human
gagagcuggauucuggauaggu

SEQ ID NO: 647010 - RNA, 17 nt, Human
cguuagugauuccugcc

SEQ ID NO: 647011 - RNA, 22 nt, Human
gggcuagcagauucuaccuaau

SEQ ID NO: 647012 - RNA, 18 nt, Human
gaggaaacaggcucugug

SEQ ID NO: 647013 - RNA, 22 nt, Human
uuacagcauuuaaugagaucug

SEQ ID NO: 647014 - RNA, 22 nt, Human
agcacaugacuuuuagucgagu

SEQ ID NO: 647015 - RNA, 22 nt, Human
ugcucccaggcucuguggucug

SEQ ID NO: 647016 - RNA, 22 nt, Human
uuaaaugaggcugauguagauu

SEQ ID NO: 647017 - RNA, 22 nt, Human
gcagagguggcaucugggcucu

SEQ ID NO: 647018 - RNA, 22 nt, Human
ugcucugggcaacagccucccu

SEQ ID NO: 647019 - RNA, 22 nt, Human
agcugagcuaguaguuccagug

SEQ ID NO: 647020 - RNA, 22 nt, Human
cauuaauauuguucuucuuuag

SEQ ID NO: 647021 - RNA, 18 nt, Human
ugagagcauucgaggcaa

SEQ ID NO: 647022 - RNA, 23 nt, Human
ggacacagagauaagugagacaa

SEQ ID NO: 647023 - RNA, 22 nt, Human
acuuugauaguuuaaucuagga

SEQ ID NO: 647024 - RNA, 22 nt, Human
cuguuuaaugcaaugaaaugag

SEQ ID NO: 647025 - RNA, 21 nt, Human
agcagguaggcauucauacug

SEQ ID NO: 647026 - RNA, 22 nt, Human
cuggcacaggauccgagaccuu

SEQ ID NO: 647027 - RNA, 22 nt, Human
cuuuauguuggggugucuuagu

SEQ ID NO: 647028 - RNA, 22 nt, Human
ucucuuggugauagucuuucuu

SEQ ID NO: 647029 - RNA, 22 nt, Human
gacugagguauuaagauggcuu

SEQ ID NO: 647030 - RNA, 22 nt, Human
uaaguuuaaauguacaugaagc

SEQ ID NO: 647031 - RNA, 22 nt, Human
ucuuucaaugagcauucuuucc

SEQ ID NO: 647032 - RNA, 20 nt, Human
ugcacagacaaugagcccag

SEQ ID NO: 647033 - RNA, 22 nt, Human
cugugacaguuucucagaauuu

SEQ ID NO: 647034 - RNA, 22 nt, Human
aggcuggagugugcaguggcgc

SEQ ID NO: 647035 - RNA, 22 nt, Human
cuguuaagcaacaugaguaagu

SEQ ID NO: 647036 - RNA, 22 nt, Human
uuugagaaggugacaaauucua

SEQ ID NO: 647037 - RNA, 22 nt, Human
ugaguucaaagacagguauagg

SEQ ID NO: 647038 - RNA, 22 nt, Human
uaaaauagcaugugcagugaaa

SEQ ID NO: 647039 - RNA, 20 nt, Human
ggccucugaggacaaggaga

SEQ ID NO: 647040 - RNA, 22 nt, Human
cagcucugcugggaggaugcag

SEQ ID NO: 647041 - RNA, 22 nt, Human
guggccaaggcagagaaagagc

SEQ ID NO: 647042 - RNA, 22 nt, Human
ucacaucacaugagugcaagga

SEQ ID NO: 647043 - RNA, 22 nt, Human
aucauuagcaauuuucaauaag

SEQ ID NO: 647044 - RNA, 19 nt, Human
gaguacaggugcagaaaug

SEQ ID NO: 647045 - RNA, 22 nt, Human
cugucucugucuuaacucccag

SEQ ID NO: 647046 - RNA, 22 nt, Human
uccuggagaauccugccaccug

SEQ ID NO: 647047 - RNA, 22 nt, Human
ggccaccuaggagccacaguga

SEQ ID NO: 647048 - RNA, 22 nt, Human
agaaggcagguuuuaaaauguc

SEQ ID NO: 647049 - RNA, 22 nt, Human
uuggcucugugucuccacucaa

SEQ ID NO: 647050 - RNA, 22 nt, Human
agagggagaagcuaaaauaacu

SEQ ID NO: 647051 - RNA, 22 nt, Human
uuucuaaguaucuugcaguuuu

SEQ ID NO: 647052 - RNA, 22 nt, Human
aguguugucaaacggcucagca

SEQ ID NO: 647053 - RNA, 22 nt, Human
acuccagguguguuggacucua

SEQ ID NO: 647054 - RNA, 22 nt, Human
ugauuuccacgugcacccaggu

SEQ ID NO: 647055 - RNA, 22 nt, Human
agcuucagcuugcagcugugau

SEQ ID NO: 647056 - RNA, 22 nt, Human
uacacuuuuuacuacagauucu

SEQ ID NO: 647057 - RNA, 22 nt, Human
ucaggcgaggcuuaauccaagg

SEQ ID NO: 647058 - RNA, 22 nt, Human
cagugcccaaaggaacagaaag

SEQ ID NO: 647059 - RNA, 22 nt, Human
cugaaugagggauucugagggc

SEQ ID NO: 647060 - RNA, 22 nt, Human
uuccuggugagauuucguucug

SEQ ID NO: 647061 - RNA, 22 nt, Human
cuagcuuuuuaugacaaucuug

SEQ ID NO: 647062 - RNA, 22 nt, Human
uuccaguucaaauuggccaaua

SEQ ID NO: 647063 - RNA, 22 nt, Human
uccagagaacgaugaaagcugg

SEQ ID NO: 647064 - RNA, 22 nt, Human
gccaccagguucuggguuaagc

SEQ ID NO: 647065 - RNA, 22 nt, Human
cuggcuccauccuugagcucug

SEQ ID NO: 647066 - RNA, 22 nt, Human
gggcccugaucugugagcgcag

SEQ ID NO: 647067 - RNA, 22 nt, Human
cacagguguaugaauaugucca

SEQ ID NO: 647068 - RNA, 22 nt, Human
gcucaggcaaauuucuggugaa

SEQ ID NO: 647069 - RNA, 22 nt, Human
uggaacaacucccucggagccu

SEQ ID NO: 647070 - RNA, 22 nt, Human
uguccagguggccucugcugcu

SEQ ID NO: 647071 - RNA, 18 nt, Human
ucugcugcugcguccugc

SEQ ID NO: 647072 - RNA, 22 nt, Human
ccagcuccauugcuuaguguaa

SEQ ID NO: 647073 - RNA, 22 nt, Human
uaguucaggguuauuucaaggu

SEQ ID NO: 647074 - RNA, 22 nt, Human
aaggcacucagccuugggacag

SEQ ID NO: 647075 - RNA, 22 nt, Human
gggcuggacaucuaagguagcu

SEQ ID NO: 647076 - RNA, 22 nt, Human
cagcuuucuuccuucugucugu

SEQ ID NO: 647077 - RNA, 22 nt, Human
cuggccagccucccagguaccc

SEQ ID NO: 647078 - RNA, 22 nt, Human
aauguuauuucugcauaguagu

SEQ ID NO: 647079 - RNA, 21 nt, Human
gcucucugcaugguggcucag

SEQ ID NO: 647080 - RNA, 22 nt, Human
agguuccaagaaaucaucagug

SEQ ID NO: 647081 - RNA, 22 nt, Human
uuaccaguuuugccauuugcua

SEQ ID NO: 647082 - RNA, 22 nt, Human
gagacagagagguacucaacau

SEQ ID NO: 647083 - RNA, 22 nt, Human
agggccugagcuggcugaccuc

SEQ ID NO: 647084 - RNA, 22 nt, Human
aagguacaaaguuauacagcgu

SEQ ID NO: 647085 - RNA, 22 nt, Human
ucucaaauaggccuugguccug

SEQ ID NO: 647086 - RNA, 16 nt, Human
ugugcauguucugugu

SEQ ID NO: 647087 - RNA, 22 nt, Human
cccacucccugcacgccugccg

SEQ ID NO: 647088 - RNA, 22 nt, Human
uggccucaaccguccuaagcac

SEQ ID NO: 647089 - RNA, 22 nt, Human
acagcuaugacagauggauaau

SEQ ID NO: 647090 - RNA, 22 nt, Human
gcagggguuuucugacuugagu

SEQ ID NO: 647091 - RNA, 23 nt, Human
ugacacauuuccuuuccacugca

SEQ ID NO: 647092 - RNA, 22 nt, Human
ucaggcagaguuaauuugcucc

SEQ ID NO: 647093 - RNA, 22 nt, Human
uucucugcagcuuaggcccagu

SEQ ID NO: 647094 - RNA, 22 nt, Human
ggcuguauauacuguauacagu

SEQ ID NO: 647095 - RNA, 22 nt, Human
ucacauguguuuucucaccaac

SEQ ID NO: 647096 - RNA, 22 nt, Human
cacgugagaccuugcagaggug

SEQ ID NO: 647097 - RNA, 22 nt, Human
uagcccagaugauugaaccaug

SEQ ID NO: 647098 - RNA, 22 nt, Human
aaguguauuaagcaacguuauu

SEQ ID NO: 647099 - RNA, 17 nt, Human
ugaaguuaggcugcaga

SEQ ID NO: 647100 - RNA, 19 nt, Human
uuuugaaguaugagacagg

SEQ ID NO: 647101 - RNA, 22 nt, Human
gugcugagcacaaggcccagag

SEQ ID NO: 647102 - RNA, 20 nt, Human
uuggaaucaccuggagaggu

SEQ ID NO: 647103 - RNA, 22 nt, Human
agcacagagaagauuucaauua

SEQ ID NO: 647104 - RNA, 22 nt, Human
caagagcuagacuuugucagga

SEQ ID NO: 647105 - RNA, 22 nt, Human
gcagagguguagcccccuccau

SEQ ID NO: 647106 - RNA, 22 nt, Human
gccaggcuguggggaacuugaa

SEQ ID NO: 647107 - RNA, 22 nt, Human
auguucauuagucaacauuucu

SEQ ID NO: 647108 - RNA, 22 nt, Human
ugcuggagaccugcuugcacca

SEQ ID NO: 647109 - RNA, 22 nt, Human
augugaacucuguacucucuga

SEQ ID NO: 647110 - RNA, 22 nt, Human
guccucugacucagccuuggga

SEQ ID NO: 647111 - RNA, 22 nt, Human
cccaagggugcccagcagagga

SEQ ID NO: 647112 - RNA, 22 nt, Human
ggugagggacaucacucagcca

SEQ ID NO: 647113 - RNA, 22 nt, Human
aggauggauucuguauguggga

SEQ ID NO: 647114 - RNA, 22 nt, Human
aagcagaugggacuccaaggca

SEQ ID NO: 647115 - RNA, 22 nt, Human
ugagcuugcuacauagaucaga

SEQ ID NO: 647116 - RNA, 22 nt, Human
gugagagggcugggcucaugau

SEQ ID NO: 647117 - RNA, 20 nt, Human
gcugaccauaaaucacacug

SEQ ID NO: 647118 - RNA, 22 nt, Human
ccacuacuuuguuuuuggugcu

SEQ ID NO: 647119 - RNA, 22 nt, Human
cacagguguucuugcagugaaa

SEQ ID NO: 647120 - RNA, 22 nt, Human
ucugcugugauuugcuaccugu

SEQ ID NO: 647121 - RNA, 22 nt, Human
uggaagcacugaagagacaacc

SEQ ID NO: 647122 - RNA, 22 nt, Human
auucugcugguaacucuauaaa

SEQ ID NO: 647123 - RNA, 22 nt, Human
uuguaugaggauagcaagaagc

SEQ ID NO: 647124 - RNA, 22 nt, Human
caggaagugccuggugagagga

SEQ ID NO: 647125 - RNA, 22 nt, Human
aggucugaguauggccugagaa

SEQ ID NO: 647126 - RNA, 22 nt, Human
uauuucuuguucccuccaaguu

SEQ ID NO: 647127 - RNA, 22 nt, Human
ugagaaugaggggguagaaggu

SEQ ID NO: 647128 - RNA, 22 nt, Human
gaauguuuaaggaaggcguggc

SEQ ID NO: 647129 - RNA, 22 nt, Human
ugaggccaaugacccugggcag

SEQ ID NO: 647130 - RNA, 22 nt, Human
aguacauauaguaauuuagcca

SEQ ID NO: 647131 - RNA, 22 nt, Human
cucugggugucuuaggagcuca

SEQ ID NO: 647132 - RNA, 22 nt, Human
caaauacuuacugaaccugugc

SEQ ID NO: 647133 - RNA, 22 nt, Human
augugaaacgcaaugggaucau

SEQ ID NO: 647134 - RNA, 22 nt, Human
uggcugugucaucauagcugug

SEQ ID NO: 647135 - RNA, 22 nt, Human
auuccaguuggguucuaauaca

SEQ ID NO: 647136 - RNA, 22 nt, Human
ugagcagcuuguuccgaguguu

SEQ ID NO: 647137 - RNA, 22 nt, Human
uauucuuacucucgacugcauu

SEQ ID NO: 647138 - RNA, 22 nt, Human
uccaggagauacacugcaccag

SEQ ID NO: 647139 - RNA, 22 nt, Human
cagcugccuguauuguccucau

SEQ ID NO: 647140 - RNA, 22 nt, Human
uuugaagggcacgacaauaguu

SEQ ID NO: 647141 - RNA, 22 nt, Human
aauggcuucaugucuguggaaa

SEQ ID NO: 647142 - RNA, 23 nt, Human
cgugcuuccaggcccagcugagc

SEQ ID NO: 647143 - RNA, 22 nt, Human
uguguaaauuauuuuuaaugau

SEQ ID NO: 647144 - RNA, 22 nt, Human
uuauugccauccuggaaccuag

SEQ ID NO: 647145 - RNA, 22 nt, Human
agcucagagaauagggcuugag

SEQ ID NO: 647146 - RNA, 22 nt, Human
aguuuacacuaugaaaagacua

SEQ ID NO: 647147 - RNA, 22 nt, Human
uguuuuaaucucccauugcucu

SEQ ID NO: 647148 - RNA, 22 nt, Human
gcucagggaacuuuuugcaggc

SEQ ID NO: 647149 - RNA, 22 nt, Human
agcuaacauggaggaaaaaguu

SEQ ID NO: 647150 - RNA, 22 nt, Human
uauggcuggaauacugaaaggc

SEQ ID NO: 647151 - RNA, 22 nt, Human
uccagggccaguccuugucugu

SEQ ID NO: 647152 - RNA, 17 nt, Human
gcuugccuugucuuccu

SEQ ID NO: 647153 - RNA, 22 nt, Human
aacaaugugauugaagcuagaa

SEQ ID NO: 647154 - RNA, 22 nt, Human
gcuguccauccacuucccagcg

SEQ ID NO: 647155 - RNA, 22 nt, Human
uggucaacaggcagggaugaaa

SEQ ID NO: 647156 - RNA, 16 nt, Human
aaggcugauuuucccu

SEQ ID NO: 647157 - RNA, 22 nt, Human
uccaggcuagguuuacaggaca

SEQ ID NO: 647158 - RNA, 21 nt, Human
ugaaagaggauguggucauuc

SEQ ID NO: 647159 - RNA, 22 nt, Human
uugaccacugaaugguucugaa

SEQ ID NO: 647160 - RNA, 22 nt, Human
agcaagauuuuccuugaauguu

SEQ ID NO: 647161 - RNA, 22 nt, Human
cugcaggauuucaugggcugac

SEQ ID NO: 647162 - RNA, 22 nt, Human
guuuucugccgguggugggcuc

SEQ ID NO: 647163 - RNA, 22 nt, Human
aguuauugaguaucuauaaugu

SEQ ID NO: 647164 - RNA, 23 nt, Human
aucaaacuggugagaaugucagu

SEQ ID NO: 647165 - RNA, 21 nt, Human
agcucuaugacuuggccaggu

SEQ ID NO: 647166 - RNA, 22 nt, Human
cucuggagguggagguugcagu

SEQ ID NO: 647167 - RNA, 17 nt, Human
agaugcuggccacaugu

SEQ ID NO: 647168 - RNA, 22 nt, Human
agcagcagucaugccuaugcuc

SEQ ID NO: 647169 - RNA, 22 nt, Human
caggagcucucaucgucagggc

SEQ ID NO: 647170 - RNA, 22 nt, Human
caucacagauguuguguggagu

SEQ ID NO: 647171 - RNA, 22 nt, Human
auuuagaaauuccaaaaguauu

SEQ ID NO: 647172 - RNA, 22 nt, Human
ugggcaguggcugggccucucu

SEQ ID NO: 647173 - RNA, 22 nt, Human
ggaucauuaacacauccaucac

SEQ ID NO: 647174 - RNA, 22 nt, Human
aggcugaggcuuuccuuggaga

SEQ ID NO: 647175 - RNA, 22 nt, Human
ggcugugcgggcagccguggga

SEQ ID NO: 647176 - RNA, 17 nt, Human
gggaaguggagaaagcu

SEQ ID NO: 647177 - RNA, 22 nt, Human
aagcagccuggcaugaugcuuu

SEQ ID NO: 647178 - RNA, 22 nt, Human
uauucacauguacauaugcuca

SEQ ID NO: 647179 - RNA, 22 nt, Human
cgaggcagacaaaaguuggaag

SEQ ID NO: 647180 - RNA, 22 nt, Human
cugcacagagcggcaguucuua

SEQ ID NO: 647181 - RNA, 22 nt, Human
cuccagcuuuuucccaguuggc

SEQ ID NO: 647182 - RNA, 22 nt, Human
acuggggaguugaagcacuuuc

SEQ ID NO: 647183 - RNA, 22 nt, Human
cagagcaggaauaggguguuga

SEQ ID NO: 647184 - RNA, 22 nt, Human
acauugaacuacuuguaaugag

SEQ ID NO: 647185 - RNA, 22 nt, Human
cagaugcuauagugcugccaua

SEQ ID NO: 647186 - RNA, 22 nt, Human
uccaaaguaauuucacuucugu

SEQ ID NO: 647187 - RNA, 22 nt, Human
ggcacagagaggcccuggaagg

SEQ ID NO: 647188 - RNA, 21 nt, Human
caagccagaccaauagcagcc

SEQ ID NO: 647189 - RNA, 22 nt, Human
cugggugcuuacuuugugcuag

SEQ ID NO: 647190 - RNA, 22 nt, Human
acaugcaagccccugaacacau

SEQ ID NO: 647191 - RNA, 22 nt, Human
cagaauguauaugaucuaaggu

SEQ ID NO: 647192 - RNA, 22 nt, Human
aggauacaagucucagaaugcu

SEQ ID NO: 647193 - RNA, 22 nt, Human
agcacauuuuauuuaagaaaau

SEQ ID NO: 647194 - RNA, 22 nt, Human
uuggagagauuaucagaccagc

SEQ ID NO: 647195 - RNA, 22 nt, Human
caaguuugcugauccuuguuuu

SEQ ID NO: 647196 - RNA, 22 nt, Human
uguuaaaccaguuuugcaucau

SEQ ID NO: 647197 - RNA, 22 nt, Human
gcuucuggcagugcagccacca

SEQ ID NO: 647198 - RNA, 22 nt, Human
cucucugagugagggacaagcu

SEQ ID NO: 647199 - RNA, 22 nt, Human
ucucugagcaugccauauugcu

SEQ ID NO: 647200 - RNA, 22 nt, Human
acaucugaaagggauugcagaa

SEQ ID NO: 647201 - RNA, 22 nt, Human
acauuucugcaucucagagcua

SEQ ID NO: 647202 - RNA, 22 nt, Human
ucacaguuauagucuguagaau

SEQ ID NO: 647203 - RNA, 22 nt, Human
uugaaacugaguguguuugggg

SEQ ID NO: 647204 - RNA, 22 nt, Human
uuagaagugaaauagcuguaca

SEQ ID NO: 647205 - RNA, 22 nt, Human
aauugaacuugaucuuuagcua

SEQ ID NO: 647206 - RNA, 22 nt, Human
ucagucuccuuuccucuagaca

SEQ ID NO: 647207 - RNA, 22 nt, Human
gagguagcaugcuggaagggac

SEQ ID NO: 647208 - RNA, 22 nt, Human
cucucuagaggcccaccuugag

SEQ ID NO: 647209 - RNA, 22 nt, Human
ccagucacucugugagagcuac

SEQ ID NO: 647210 - RNA, 22 nt, Human
cccaaccagaaauugacagaca

SEQ ID NO: 647211 - RNA, 22 nt, Human
cagagagcacauaggauacuuu

SEQ ID NO: 647212 - RNA, 23 nt, Human
uucugaaaauagauaguggcucc

SEQ ID NO: 647213 - RNA, 22 nt, Human
uaucauuuaacagaaucauugc

SEQ ID NO: 647214 - RNA, 22 nt, Human
acacauguucaagaauguucag

SEQ ID NO: 647215 - RNA, 22 nt, Human
gaggucaauaauaugugcuuua

SEQ ID NO: 647216 - RNA, 22 nt, Human
ucugagaguccaucuccaagcc

SEQ ID NO: 647217 - RNA, 20 nt, Human
uggacacagcccuguugagu

SEQ ID NO: 647218 - RNA, 22 nt, Human
ugcugacuccuggcugugacac

SEQ ID NO: 647219 - RNA, 22 nt, Human
aaacaaauuucaagcugugaca

SEQ ID NO: 647220 - RNA, 22 nt, Human
gucucagugcccaaugccauaa

SEQ ID NO: 647221 - RNA, 22 nt, Human
ccuggcccuggaauagggcagg

SEQ ID NO: 647222 - RNA, 22 nt, Human
acccaggccugagagacaggag

SEQ ID NO: 647223 - RNA, 22 nt, Human
acagggccauuggaggauuaua

SEQ ID NO: 647224 - RNA, 22 nt, Human
ugcaggcugggaagagggacaa

SEQ ID NO: 647225 - RNA, 22 nt, Human
gcuggaaaaggaggcaaaauau

SEQ ID NO: 647226 - RNA, 19 nt, Human
uguuggugcggauguggag

SEQ ID NO: 647227 - RNA, 22 nt, Human
uuauucagugccuuugaaagaa

SEQ ID NO: 647228 - RNA, 22 nt, Human
gugcaaaaguaauugugguuuu

SEQ ID NO: 647229 - RNA, 23 nt, Human
ucccagggaaggugagcgaggcu

SEQ ID NO: 647230 - RNA, 18 nt, Human
gcugagcaaauuccuccc

SEQ ID NO: 647231 - RNA, 22 nt, Human
ccagggccaagagaccucgagg

SEQ ID NO: 647232 - RNA, 22 nt, Human
aaauguaagucuuuguuucuua

SEQ ID NO: 647233 - RNA, 22 nt, Human
augcaagucuuaauaguuuagg

SEQ ID NO: 647234 - RNA, 22 nt, Human
uaugaaaugauggggaaaauag

SEQ ID NO: 647235 - RNA, 22 nt, Human
uauuugagcgaagcaguguuuu

SEQ ID NO: 647236 - RNA, 22 nt, Human
ggucugaaauuaugucacugcu

SEQ ID NO: 647237 - RNA, 22 nt, Human
uugcuucacuacuucuaggcuc

SEQ ID NO: 647238 - RNA, 22 nt, Human
uuugaaaauuuaagugcuacac

SEQ ID NO: 647239 - RNA, 22 nt, Human
caucaucaacuggcagguaagu

SEQ ID NO: 647240 - RNA, 22 nt, Human
acagaagaaguucaaggugaag

SEQ ID NO: 647241 - RNA, 22 nt, Human
agagugaucagauaucaggugu

SEQ ID NO: 647242 - RNA, 22 nt, Human
uagggcucugcucaucaguugu

SEQ ID NO: 647243 - RNA, 22 nt, Human
gagcugaggcucaggcuggcgu

SEQ ID NO: 647244 - RNA, 22 nt, Human
uuaccaaaugaaauagagauuu

SEQ ID NO: 647245 - RNA, 22 nt, Human
cugcagggcagggccuccuggc

SEQ ID NO: 647246 - RNA, 22 nt, Human
uagaaacauucaguugcagucc

SEQ ID NO: 647247 - RNA, 22 nt, Human
ugggaacaccugcugcccagug

SEQ ID NO: 647248 - RNA, 22 nt, Human
uucucuaauacauuuugacaaa

SEQ ID NO: 647249 - RNA, 22 nt, Human
ugggaagaguuagagacagcug

SEQ ID NO: 647250 - RNA, 22 nt, Human
uugagacucgagucucucagac

SEQ ID NO: 647251 - RNA, 22 nt, Human
uugcugauuuguuucuauucca

SEQ ID NO: 647252 - RNA, 22 nt, Human
aauagcauagaguuaaaaugca

SEQ ID NO: 647253 - RNA, 22 nt, Human
cucagcaacagcgacuuaaggg

SEQ ID NO: 647254 - RNA, 22 nt, Human
guuuagaagccaagauuugggu

SEQ ID NO: 647255 - RNA, 22 nt, Human
uuccugaauauaaagacacuag

SEQ ID NO: 647256 - RNA, 22 nt, Human
augacaguacuggugacaauac

SEQ ID NO: 647257 - RNA, 22 nt, Human
ugcagagagaccccugggccag

SEQ ID NO: 647258 - RNA, 22 nt, Human
cugggcagguauacaaaaaaug

SEQ ID NO: 647259 - RNA, 22 nt, Human
aggagaggguggcauuaaguuu

SEQ ID NO: 647260 - RNA, 22 nt, Human
caacauauaauauuugaguucu

SEQ ID NO: 647261 - RNA, 22 nt, Human
cgaggccaauguguuuuaugaa

SEQ ID NO: 647262 - RNA, 22 nt, Human
gaaugcacuuccaacaucuauu

SEQ ID NO: 647263 - RNA, 19 nt, Human
ccucucccaugcuuaccuc

SEQ ID NO: 647264 - RNA, 19 nt, Human
cccagguguuugaggcugc

SEQ ID NO: 647265 - RNA, 22 nt, Human
gcaauaaauaacauggaagaca

SEQ ID NO: 647266 - RNA, 22 nt, Human
uacaacauuguguugcuucaua

SEQ ID NO: 647267 - RNA, 19 nt, Human
aggccugggguuuugcacu

SEQ ID NO: 647268 - RNA, 22 nt, Human
uaaaacugcuugguauggucua

SEQ ID NO: 647269 - RNA, 22 nt, Human
auaaggcagaaauagggaaagu

SEQ ID NO: 647270 - RNA, 22 nt, Human
ccagcugguuuauauuccccac

SEQ ID NO: 647271 - RNA, 22 nt, Human
uaagacagggucuauucuuagu

SEQ ID NO: 647272 - RNA, 22 nt, Human
ugcccagguuugagugcccaag

SEQ ID NO: 647273 - RNA, 22 nt, Human
ugcaaauauugggacagucuag

SEQ ID NO: 647274 - RNA, 22 nt, Human
caaggccacguucugcaugcgg

SEQ ID NO: 647275 - RNA, 22 nt, Human
agcucucccaccuucuucuuac

SEQ ID NO: 647276 - RNA, 22 nt, Human
cugggacuuuacccuguggccc

SEQ ID NO: 647277 - RNA, 22 nt, Human
ucagaaagcuuagugucuugca

SEQ ID NO: 647278 - RNA, 22 nt, Human
gaacuuuaucaaaaguuguuua

SEQ ID NO: 647279 - RNA, 22 nt, Human
cauacauuaccuaacuuaaugc

SEQ ID NO: 647280 - RNA, 22 nt, Human
cugcagcuggcucaugggauau

SEQ ID NO: 647281 - RNA, 22 nt, Human
uuuuuuguuggguagaacggaa

SEQ ID NO: 647282 - RNA, 22 nt, Human
auuacaacuggaauggugcugg

SEQ ID NO: 647283 - RNA, 22 nt, Human
gacuuucugauguaaacauuua

SEQ ID NO: 647284 - RNA, 22 nt, Human
aaaugggccuggaaagaggaug

SEQ ID NO: 647285 - RNA, 22 nt, Human
cgcuggucaccauggcguccug

SEQ ID NO: 647286 - RNA, 16 nt, Human
uccuaacuggcaguuc

SEQ ID NO: 647287 - RNA, 19 nt, Human
cacuuuauuucuguuuugu

SEQ ID NO: 647288 - RNA, 21 nt, Human
uucugagacucauuugaacuc

SEQ ID NO: 647289 - RNA, 17 nt, Human
ugugcgcuugugugagg

SEQ ID NO: 647290 - RNA, 22 nt, Human
acuguaauaugguucuuuugau

SEQ ID NO: 647291 - RNA, 22 nt, Human
uccucccugaguggggacagcu

SEQ ID NO: 647292 - RNA, 22 nt, Human
aagggagacccaccguccugga

SEQ ID NO: 647293 - RNA, 22 nt, Human
aaggcaaguuuuaguuuucugg

SEQ ID NO: 647294 - RNA, 22 nt, Human
aacaucucuguauuuuauagac

SEQ ID NO: 647295 - RNA, 22 nt, Human
uggugcugacaguucugagugc

SEQ ID NO: 647296 - RNA, 22 nt, Human
guaggcagaccaguggaugggu

SEQ ID NO: 647297 - RNA, 22 nt, Human
ccagccaguauauuccaaagcc

SEQ ID NO: 647298 - RNA, 22 nt, Human
uaugcuuugaaaaugugcugaa

SEQ ID NO: 647299 - RNA, 22 nt, Human
aaugacuguagucauauuaagg

SEQ ID NO: 647300 - RNA, 17 nt, Human
cugaggcccagggccca

SEQ ID NO: 647301 - RNA, 22 nt, Human
augaugugugcugaucaagcuu

SEQ ID NO: 647302 - RNA, 22 nt, Human
gagccugcgagggaguaaggca

SEQ ID NO: 647303 - RNA, 22 nt, Human
acuguuaaaguaauuaauuguc

SEQ ID NO: 647304 - RNA, 22 nt, Human
acagaagccuuuggccauuuga

SEQ ID NO: 647305 - RNA, 22 nt, Human
aucacaggcuauguggguuuug

SEQ ID NO: 647306 - RNA, 22 nt, Human
agaagccagauuguagugggac

SEQ ID NO: 647307 - RNA, 22 nt, Human
caguccuuccuugccccuuggg

SEQ ID NO: 647308 - RNA, 22 nt, Human
uccagaccuagggcaccccagu

SEQ ID NO: 647309 - RNA, 22 nt, Human
gccagccacaagggaggcuugu

SEQ ID NO: 647310 - RNA, 22 nt, Human
gaccuggaagaugguccucacc

SEQ ID NO: 647311 - RNA, 22 nt, Human
uggccaggaggcugcuucugac

SEQ ID NO: 647312 - RNA, 22 nt, Human
ucugcagacuugccuaagugug

SEQ ID NO: 647313 - RNA, 22 nt, Human
ucugcaucauuuuucagagccg

SEQ ID NO: 647314 - RNA, 23 nt, Human
cuguggcugaguccuguuggagu

SEQ ID NO: 647315 - RNA, 22 nt, Human
uuaucuugguguuuuaguaauu

SEQ ID NO: 647316 - RNA, 22 nt, Human
cacauuauucuaaagagguacu

SEQ ID NO: 647317 - RNA, 22 nt, Human
cugugagacugauagggaagag

SEQ ID NO: 647318 - RNA, 22 nt, Human
uuaaauucauuccaacuuuuga

SEQ ID NO: 647319 - RNA, 22 nt, Human
aaggcugaggcagugaggcaga

SEQ ID NO: 647320 - RNA, 22 nt, Human
uauuagguagauuuuacugauu

SEQ ID NO: 647321 - RNA, 22 nt, Human
uaacacuauccagauaugauaa

SEQ ID NO: 647322 - RNA, 20 nt, Human
guuuuaaggcacaggccuuu

SEQ ID NO: 647323 - RNA, 22 nt, Human
augauccaaagccacaggggca

SEQ ID NO: 647324 - RNA, 23 nt, Human
uggcccugugcaugcugcuuccc

SEQ ID NO: 647325 - RNA, 22 nt, Human
gcugagcaggguggggaaaggc

SEQ ID NO: 647326 - RNA, 22 nt, Human
acuaggaauucaaguagacaga

SEQ ID NO: 647327 - RNA, 22 nt, Human
caugcaguuucucuaugcguag

SEQ ID NO: 647328 - RNA, 22 nt, Human
gucaaauauacuaagagguaaa

SEQ ID NO: 647329 - RNA, 22 nt, Human
agaccacuuggauaagaaacag

SEQ ID NO: 647330 - RNA, 22 nt, Human
cugacuucagggauaaaaagua

SEQ ID NO: 647331 - RNA, 23 nt, Human
aauguauguuaguaucuuagaga

SEQ ID NO: 647332 - RNA, 22 nt, Human
uuuuugauacucaagaggggua

SEQ ID NO: 647333 - RNA, 22 nt, Human
ucuggggugcagccuggacaua

SEQ ID NO: 647334 - RNA, 22 nt, Human
ucacaagauauuucaguccuuu

SEQ ID NO: 647335 - RNA, 21 nt, Human
ucagcagcuuuugcagucccu

SEQ ID NO: 647336 - RNA, 22 nt, Human
gacacauaugcguauaguuuag

SEQ ID NO: 647337 - RNA, 22 nt, Human
gaaggggguugcagucuagggu

SEQ ID NO: 647338 - RNA, 22 nt, Human
cuuccugcaggacagccaucug

SEQ ID NO: 647339 - RNA, 20 nt, Human
aggcugggguguuuugccca

SEQ ID NO: 647340 - RNA, 22 nt, Human
gccuggcacauugcaguggauu

SEQ ID NO: 647341 - RNA, 22 nt, Human
uucuucagcccauaucuuccag

SEQ ID NO: 647342 - RNA, 22 nt, Human
gaggccagacugccuuuuauga

SEQ ID NO: 647343 - RNA, 22 nt, Human
auaaauguuuguugaaugaaua

SEQ ID NO: 647344 - RNA, 22 nt, Human
agucucuuauucccuauugcug

SEQ ID NO: 647345 - RNA, 22 nt, Human
ugaaaguuacaggaaaacagau

SEQ ID NO: 647346 - RNA, 22 nt, Human
gagcaacaggugauggggcugu

SEQ ID NO: 647347 - RNA, 22 nt, Human
agggcugcaggcaagauauggc

SEQ ID NO: 647348 - RNA, 22 nt, Human
ucaaccagaguuuuucuuaaua

SEQ ID NO: 647349 - RNA, 22 nt, Human
uagauucucagaauuuuagaaa

SEQ ID NO: 647350 - RNA, 22 nt, Human
ucagcaucuacagcuuugcuau

SEQ ID NO: 647351 - RNA, 22 nt, Human
uucuguguugugacauucuaga

SEQ ID NO: 647352 - RNA, 20 nt, Human
auguuucucugucgugauuu

SEQ ID NO: 647353 - RNA, 22 nt, Human
ugucccugguggaggcuggcag

SEQ ID NO: 647354 - RNA, 22 nt, Human
ggcucuggagacauguggagag

SEQ ID NO: 647355 - RNA, 22 nt, Human
ucaguuuagaguuauuuaaucu

SEQ ID NO: 647356 - RNA, 22 nt, Human
uggaagaaaauucaaucgaguu

SEQ ID NO: 647357 - RNA, 22 nt, Human
cuccaggauaccuguuccuaua

SEQ ID NO: 647358 - RNA, 20 nt, Human
aauuuacucacagaaugaau

SEQ ID NO: 647359 - RNA, 22 nt, Human
gagguucacuuccuggauccuu

SEQ ID NO: 647360 - RNA, 22 nt, Human
agagcagauggccagggggccu

SEQ ID NO: 647361 - RNA, 23 nt, Human
caaaccuguuucucucaccuguc

SEQ ID NO: 647362 - RNA, 22 nt, Human
acaaggcaguacaaugaugaca

SEQ ID NO: 647363 - RNA, 22 nt, Human
aauuccaaaucaacuagucuag

SEQ ID NO: 647364 - RNA, 22 nt, Human
uccuaguucucugccagucgcu

SEQ ID NO: 647365 - RNA, 22 nt, Human
augcaggagcccucuugagggc

SEQ ID NO: 647366 - RNA, 22 nt, Human
aguaaagcauugucuucagagu

SEQ ID NO: 647367 - RNA, 22 nt, Human
aauuggaaaaagacuuaauugc

SEQ ID NO: 647368 - RNA, 22 nt, Human
gccuuccugcagcucugagcgu

SEQ ID NO: 647369 - RNA, 22 nt, Human
gguuugacagcuuggggcuguc

SEQ ID NO: 647370 - RNA, 22 nt, Human
agagauuugucaaugauuucca

SEQ ID NO: 647371 - RNA, 22 nt, Human
gcaggccugguuuacaugguag

SEQ ID NO: 647372 - RNA, 22 nt, Human
acagacugugaguaugcauagu

SEQ ID NO: 647373 - RNA, 22 nt, Human
caggccaggugcucuagaauca

SEQ ID NO: 647374 - RNA, 22 nt, Human
auuaaagugaaguucucagaug

SEQ ID NO: 647375 - RNA, 22 nt, Human
cuucagaaugggacuguguuug

SEQ ID NO: 647376 - RNA, 22 nt, Human
acaguauuugcgauacugauga

SEQ ID NO: 647377 - RNA, 18 nt, Human
gugagcagagagcaucac

SEQ ID NO: 647378 - RNA, 22 nt, Human
uggugagaugcagcaacagaca

SEQ ID NO: 647379 - RNA, 23 nt, Human
ugugccauugaggcugaggcuca

SEQ ID NO: 647380 - RNA, 18 nt, Human
ggugggaagccagggccu

SEQ ID NO: 647381 - RNA, 17 nt, Human
gacaucaguacuuacag

SEQ ID NO: 647382 - RNA, 22 nt, Human
ugucuuuggggcuguaccuguu

SEQ ID NO: 647383 - RNA, 22 nt, Human
uuacaugacucaauagaagggc

SEQ ID NO: 647384 - RNA, 22 nt, Human
uuuucuguggucagagcuugag

SEQ ID NO: 647385 - RNA, 22 nt, Human
uuucagagcucagcagcuagag

SEQ ID NO: 647386 - RNA, 20 nt, Human
aggaagccaaaggcugucuu

SEQ ID NO: 647387 - RNA, 22 nt, Human
caggcacccucugaggggaagc

SEQ ID NO: 647388 - RNA, 22 nt, Human
ugagguggguggcuucuguuau

SEQ ID NO: 647389 - RNA, 22 nt, Human
ggaguggcuauuugugcugguu

SEQ ID NO: 647390 - RNA, 22 nt, Human
aguucacaagcguaggugcuga

SEQ ID NO: 647391 - RNA, 22 nt, Human
ccuguggcacaugcagggauuc

SEQ ID NO: 647392 - RNA, 22 nt, Human
ugacuuuggauaagaaaaugag

SEQ ID NO: 647393 - RNA, 19 nt, Human
agcacagacaagaccagca

SEQ ID NO: 647394 - RNA, 22 nt, Human
uaaagguuauugcacuggaguu

SEQ ID NO: 647395 - RNA, 22 nt, Human
gucagaaaccagucaaacaaga

SEQ ID NO: 647396 - RNA, 22 nt, Human
ggcagggguccugguguugacu

SEQ ID NO: 647397 - RNA, 22 nt, Human
auucucauaggagcgugaaccu

SEQ ID NO: 647398 - RNA, 22 nt, Human
uucuauaaaugaauguguauau

SEQ ID NO: 647399 - RNA, 22 nt, Human
agccuccuguagcccucaccca

SEQ ID NO: 647400 - RNA, 22 nt, Human
uagaagaacaugucaaacuaua

SEQ ID NO: 647401 - RNA, 22 nt, Human
gcccaggagguugggcugugca

SEQ ID NO: 647402 - RNA, 22 nt, Human
augaucugauaaucauccacua

SEQ ID NO: 647403 - RNA, 22 nt, Human
acauucaaccaauguuugcuau

SEQ ID NO: 647404 - RNA, 22 nt, Human
aagauauagauaaaacuaugca

SEQ ID NO: 647405 - RNA, 22 nt, Human
ggugaagcguauuuguggagcu

SEQ ID NO: 647406 - RNA, 22 nt, Human
ccaggccagggcugcagcgagc

SEQ ID NO: 647407 - RNA, 22 nt, Human
guugaauaucccguaucuuaaa

SEQ ID NO: 647408 - RNA, 20 nt, Human
acagagacugagacacuugc

SEQ ID NO: 647409 - RNA, 22 nt, Human
acaguacaggacgaguuuuccu

SEQ ID NO: 647410 - RNA, 22 nt, Human
acaggcucaguucacuggauuu

SEQ ID NO: 647411 - RNA, 22 nt, Human
gugcaggagguaacauagcaaa

SEQ ID NO: 647412 - RNA, 20 nt, Human
auuugcuuaccuuguuucua

SEQ ID NO: 647413 - RNA, 22 nt, Human
gcagaagcugggcagcgaggug

SEQ ID NO: 647414 - RNA, 22 nt, Human
ugaggcaguucuuacuuguauu

SEQ ID NO: 647415 - RNA, 19 nt, Human
gggagcaggaaagcugugg

SEQ ID NO: 647416 - RNA, 20 nt, Human
uguuugugccagcuuuguca

SEQ ID NO: 647417 - RNA, 22 nt, Human
augggaugaucaccugagcuca

SEQ ID NO: 647418 - RNA, 22 nt, Human
caucaucucucccccaggccug

SEQ ID NO: 647419 - RNA, 22 nt, Human
cuccccacgccuggacuaagag

SEQ ID NO: 647420 - RNA, 22 nt, Human
uggcucugguaacauuggguag

SEQ ID NO: 647421 - RNA, 22 nt, Human
auuccaguucuccucucuaaag

SEQ ID NO: 647422 - RNA, 22 nt, Human
aguggcagaguugaauaauuga

SEQ ID NO: 647423 - RNA, 22 nt, Human
agcugcccuuuaugaugcugaa

SEQ ID NO: 647424 - RNA, 22 nt, Human
cuuggccucuucucaggguggg

SEQ ID NO: 647425 - RNA, 22 nt, Human
agcaggaaggucugugugaguc

SEQ ID NO: 647426 - RNA, 22 nt, Human
ggcuccaguuuccccuuggggc

SEQ ID NO: 647427 - RNA, 22 nt, Human
ugugcauguauugauuuguacc

SEQ ID NO: 647428 - RNA, 22 nt, Human
gcaugggcaagaggacuggggg

SEQ ID NO: 647429 - RNA, 22 nt, Human
aucuugaaauacuuucuagaau

SEQ ID NO: 647430 - RNA, 22 nt, Human
aggucugggaguucauucccug

SEQ ID NO: 647431 - RNA, 21 nt, Human
ugcaugcuauguuuuuauuuc

SEQ ID NO: 647432 - RNA, 19 nt, Human
agugagcauccagagaggu

SEQ ID NO: 647433 - RNA, 22 nt, Human
ccucugcaaagaauuugucucc

SEQ ID NO: 647434 - RNA, 22 nt, Human
ucccucuggucuggacgccaua

SEQ ID NO: 647435 - RNA, 22 nt, Human
cugugaacaauagcagcaucuu

SEQ ID NO: 647436 - RNA, 22 nt, Human
gaggccacagcuaucagggaca

SEQ ID NO: 647437 - RNA, 22 nt, Human
gcaccuugggaagcgccaguug

SEQ ID NO: 647438 - RNA, 22 nt, Human
uggaaaaucaggggacauugau

SEQ ID NO: 647439 - RNA, 22 nt, Human
agggaaaguaagcauuucauua

SEQ ID NO: 647440 - RNA, 22 nt, Human
cuguuaaaugagaaagcagacu

SEQ ID NO: 647441 - RNA, 18 nt, Human
gcccaugguaaaugcugu

SEQ ID NO: 647442 - RNA, 22 nt, Human
cuugcuguugugggagacuggg

SEQ ID NO: 647443 - RNA, 19 nt, Human
agggcuuugugugcugcuc

SEQ ID NO: 647444 - RNA, 22 nt, Human
uugggggcagagggagcaucug

SEQ ID NO: 647445 - RNA, 22 nt, Human
cccaggaaaguggaggcggcug

SEQ ID NO: 647446 - RNA, 22 nt, Human
caaaguuaucaacugcaacauu

SEQ ID NO: 647447 - RNA, 22 nt, Human
uugacaaaaaccucauuucacc

SEQ ID NO: 647448 - RNA, 21 nt, Human
cuuuagugaaaaggggcuaac

SEQ ID NO: 647449 - RNA, 22 nt, Human
uacacuaauagccacacuaaug

SEQ ID NO: 647450 - RNA, 22 nt, Human
acugaacauccauaagauuuuu

SEQ ID NO: 647451 - RNA, 22 nt, Human
ucagagaauucucagaugacuc

SEQ ID NO: 647452 - RNA, 22 nt, Human
uucuacacucacccagcuguaa

SEQ ID NO: 647453 - RNA, 22 nt, Human
cugagggcuggagcugaggccu

SEQ ID NO: 647454 - RNA, 23 nt, Human
ugggaagauauguauguucaagg

SEQ ID NO: 647455 - RNA, 22 nt, Human
cuggggcccugggucugcccuc

SEQ ID NO: 647456 - RNA, 22 nt, Human
ccucaaaggccuggcaccagaa

SEQ ID NO: 647457 - RNA, 22 nt, Human
accagcucagaagccagaaaga

SEQ ID NO: 647458 - RNA, 18 nt, Human
uagcaaagauguggauug

SEQ ID NO: 647459 - RNA, 22 nt, Human
ucaucaaagucaaagaaugacu

SEQ ID NO: 647460 - RNA, 22 nt, Human
ugaauacaggaaaauauacuga

SEQ ID NO: 647461 - RNA, 22 nt, Human
cugagcuguuuaaucccagaua

SEQ ID NO: 647462 - RNA, 22 nt, Human
uauucaugagauaggcaguuuu

SEQ ID NO: 647463 - RNA, 22 nt, Human
uggguaggugcuggggauucag

SEQ ID NO: 647464 - RNA, 22 nt, Human
ggguaugagauauaggugaaua

SEQ ID NO: 647465 - RNA, 22 nt, Human
caccagcuugcagucuuaaccc

SEQ ID NO: 647466 - RNA, 23 nt, Human
ugcuccagccucuuugauagugu

SEQ ID NO: 647467 - RNA, 22 nt, Human
acauguaacauauauguagcau

SEQ ID NO: 647468 - RNA, 22 nt, Human
auguggcuagugcaacugagaa

SEQ ID NO: 647469 - RNA, 22 nt, Human
agcagcaggcuuaaggaaaagu

SEQ ID NO: 647470 - RNA, 22 nt, Human
gagggaaacagauggguugugg

SEQ ID NO: 647471 - RNA, 22 nt, Human
ccuucaaaguacacaucuuuau

SEQ ID NO: 647472 - RNA, 22 nt, Human
uagagcuauuuagagcauuuua

SEQ ID NO: 647473 - RNA, 22 nt, Human
cuuuaguguuguugugaggauu

SEQ ID NO: 647474 - RNA, 22 nt, Human
uggcagccaucugagggugggg

SEQ ID NO: 647475 - RNA, 22 nt, Human
gagguaucuuagagaguguaga

SEQ ID NO: 647476 - RNA, 22 nt, Human
ggagccuugggcgcucucccau

SEQ ID NO: 647477 - RNA, 23 nt, Human
ucccaggaaucugcauuuuuaac

SEQ ID NO: 647478 - RNA, 22 nt, Human
auuuguaagcuagagccaugau

SEQ ID NO: 647479 - RNA, 22 nt, Human
aaacaucucaaagagguauuug

SEQ ID NO: 647480 - RNA, 22 nt, Human
ggggaugguagaccggugacgu

SEQ ID NO: 647481 - RNA, 22 nt, Human
ucugcugcagagcugcgggugc

SEQ ID NO: 647482 - RNA, 22 nt, Human
uuauucaggucauggacuguca

SEQ ID NO: 647483 - RNA, 22 nt, Human
cgagcaugaugacggcuguggc

SEQ ID NO: 647484 - RNA, 19 nt, Human
ggccucugcaggccgcccc

SEQ ID NO: 647485 - RNA, 22 nt, Human
ggaggccaaggaggagcuugcc

SEQ ID NO: 647486 - RNA, 22 nt, Human
acagucuugcuguauggucagg

SEQ ID NO: 647487 - RNA, 22 nt, Human
ccaggcaggcuagaauguaaau

SEQ ID NO: 647488 - RNA, 22 nt, Human
caggggcggguaaaaggccucc

SEQ ID NO: 647489 - RNA, 22 nt, Human
caguucacacugugcuaucugc

SEQ ID NO: 647490 - RNA, 22 nt, Human
gccacagguggaauuaagaaau

SEQ ID NO: 647491 - RNA, 22 nt, Human
uuugcaaaugcucugcagagcu

SEQ ID NO: 647492 - RNA, 22 nt, Human
cagcucugggagucccaccccu

SEQ ID NO: 647493 - RNA, 22 nt, Human
auccagagagguuaggugacau

SEQ ID NO: 647494 - RNA, 22 nt, Human
uggcugccuuucaccucaucuc

SEQ ID NO: 647495 - RNA, 22 nt, Human
uggccuuggagaggcacggccc

SEQ ID NO: 647496 - RNA, 22 nt, Human
gcuguggcaauguuuauaauua

SEQ ID NO: 647497 - RNA, 22 nt, Human
uggguagagacacagucugggg

SEQ ID NO: 647498 - RNA, 22 nt, Human
uagagauggggucuugcuauga

SEQ ID NO: 647499 - RNA, 22 nt, Human
aggacaguauaggcuuuaggag

SEQ ID NO: 647500 - RNA, 22 nt, Human
uccagcugacaguucaaaauga

SEQ ID NO: 647501 - RNA, 22 nt, Human
agggaugauuucagugucugcc

SEQ ID NO: 647502 - RNA, 22 nt, Human
ggcugucuugggagcucccccg

SEQ ID NO: 647503 - RNA, 22 nt, Human
agggccugggucuguacuccuc

SEQ ID NO: 647504 - RNA, 22 nt, Human
cugaacauucuugaacaucugu

SEQ ID NO: 647505 - RNA, 22 nt, Human
ggcuuuacuauaugguacauuu

SEQ ID NO: 647506 - RNA, 22 nt, Human
gagcuggucgaaaugggcugac

SEQ ID NO: 647507 - RNA, 22 nt, Human
auaccuuuaggcauuuugcauc

SEQ ID NO: 647508 - RNA, 22 nt, Human
uguggggaccuggcugccaccc

SEQ ID NO: 647509 - RNA, 22 nt, Human
agagcuguguuaagaacaggcc

SEQ ID NO: 647510 - RNA, 22 nt, Human
ggaggccagccugaggcugagg

SEQ ID NO: 647511 - RNA, 22 nt, Human
ucucagggccccaaaggcuagu

SEQ ID NO: 647512 - RNA, 22 nt, Human
uccugcuuccuugucuuuagac

SEQ ID NO: 647513 - RNA, 22 nt, Human
agcuccuguucugagagcagga

SEQ ID NO: 647514 - RNA, 22 nt, Human
ccuccuuccugggacagagcug

SEQ ID NO: 647515 - RNA, 22 nt, Human
aaaagccaugcauaccuaagag

SEQ ID NO: 647516 - RNA, 22 nt, Human
guauuuaauuccauuaaguuag

SEQ ID NO: 647517 - RNA, 22 nt, Human
aauaaaguguauucuuugucau

SEQ ID NO: 647518 - RNA, 22 nt, Human
ugcagcugcugguggcugaaag

SEQ ID NO: 647519 - RNA, 22 nt, Human
uacaguagucgucuuauuuuga

SEQ ID NO: 647520 - RNA, 17 nt, Human
guguaacuaugagccau

SEQ ID NO: 647521 - RNA, 22 nt, Human
uccuugaacagagggccugggu

SEQ ID NO: 647522 - RNA, 22 nt, Human
uacacagaaccugguguacagu

SEQ ID NO: 647523 - RNA, 22 nt, Human
aggagcucugggcagggccucc

SEQ ID NO: 647524 - RNA, 22 nt, Human
agguccagguuccguuucugcg

SEQ ID NO: 647525 - RNA, 22 nt, Human
gacauguuaucucuggcuucaa

SEQ ID NO: 647526 - RNA, 22 nt, Human
ugcugccuuagaaauggcuaua

SEQ ID NO: 647527 - RNA, 22 nt, Human
agcuuuccacuaucuuaggggu

SEQ ID NO: 647528 - RNA, 22 nt, Human
ugccaggagagugcaugcaggg

SEQ ID NO: 647529 - RNA, 22 nt, Human
gcucugguaccagcuacuccua

SEQ ID NO: 647530 - RNA, 22 nt, Human
agcagagucugugugcacuuua

SEQ ID NO: 647531 - RNA, 22 nt, Human
agguaggaguugauggauguuc

SEQ ID NO: 647532 - RNA, 22 nt, Human
gaugaagcuuugaagucuaauc

SEQ ID NO: 647533 - RNA, 19 nt, Human
aguguuucaugugcuuuua

SEQ ID NO: 647534 - RNA, 22 nt, Human
aaauuagaaauacuuucaaagc

SEQ ID NO: 647535 - RNA, 22 nt, Human
aaugccuugccugcuacaacuu

SEQ ID NO: 647536 - RNA, 22 nt, Human
ugaauuuaccuugccuauauuu

SEQ ID NO: 647537 - RNA, 22 nt, Human
cugcugugcagacagacucucu

SEQ ID NO: 647538 - RNA, 22 nt, Human
auuuggaugcacuaaauaaaau

SEQ ID NO: 647539 - RNA, 21 nt, Human
uguguguaugcacacacaugc

SEQ ID NO: 647540 - RNA, 22 nt, Human
gcugagccaugaggccucuugc

SEQ ID NO: 647541 - RNA, 22 nt, Human
agugcauuugggguaguggaag

SEQ ID NO: 647542 - RNA, 22 nt, Human
gaagaaguauuuuuguccuguu

SEQ ID NO: 647543 - RNA, 22 nt, Human
caaggauucucacuagacuaga

SEQ ID NO: 647544 - RNA, 22 nt, Human
acauccauuuuguucaaaagca

SEQ ID NO: 647545 - RNA, 22 nt, Human
acagcagcuugcgugucugguc

SEQ ID NO: 647546 - RNA, 22 nt, Human
ggaagugaggaaauauuuuguu

SEQ ID NO: 647547 - RNA, 22 nt, Human
acacaugaggaaggccucaccc

SEQ ID NO: 647548 - RNA, 22 nt, Human
agagcacagaaguuauauguua

SEQ ID NO: 647549 - RNA, 22 nt, Human
aacacuuuggaauagagauagg

SEQ ID NO: 647550 - RNA, 22 nt, Human
cuuaaucucaccugcaaagucc

SEQ ID NO: 647551 - RNA, 22 nt, Human
uugugggauggcucuucccaaa

SEQ ID NO: 647552 - RNA, 22 nt, Human
cugugcugucuugggagccuua

SEQ ID NO: 647553 - RNA, 22 nt, Human
gagucagauugcagacagggcu

SEQ ID NO: 647554 - RNA, 22 nt, Human
uuucaucuuccuuggcauaggu

SEQ ID NO: 647555 - RNA, 22 nt, Human
aggcucuccagagagcugcuuu

SEQ ID NO: 647556 - RNA, 22 nt, Human
uguuuuuacugugauccagaaa

SEQ ID NO: 647557 - RNA, 22 nt, Human
ugcugaagggaaggucuugaau

SEQ ID NO: 647558 - RNA, 22 nt, Human
ucugaaauaacugaugccagau

SEQ ID NO: 647559 - RNA, 22 nt, Human
agggagaggagcguuucacauc

SEQ ID NO: 647560 - RNA, 22 nt, Human
ggagauaauccagggagggacu

SEQ ID NO: 647561 - RNA, 22 nt, Human
ggcuggacucugggccucucca

SEQ ID NO: 647562 - RNA, 22 nt, Human
ucuuuagaaacuuuucuucaug

SEQ ID NO: 647563 - RNA, 22 nt, Human
gguguggaucaucugaggucag

SEQ ID NO: 647564 - RNA, 22 nt, Human
gcccugcagugcggagguggca

SEQ ID NO: 647565 - RNA, 22 nt, Human
gaaggaagcugucuggaugugu

SEQ ID NO: 647566 - RNA, 22 nt, Human
uccuggccaggaugaccuaaca

SEQ ID NO: 647567 - RNA, 22 nt, Human
ggugugccacuucacugagcag

SEQ ID NO: 647568 - RNA, 22 nt, Human
uggcagguagaguucugagaug

SEQ ID NO: 647569 - RNA, 22 nt, Human
acauuucuugaugccucuguga

SEQ ID NO: 647570 - RNA, 22 nt, Human
auacacuugaccuggagugaag

SEQ ID NO: 647571 - RNA, 22 nt, Human
aagauuuagggccaguuuacau

SEQ ID NO: 647572 - RNA, 22 nt, Human
gacaaggcaaccagggaggcuu

SEQ ID NO: 647573 - RNA, 22 nt, Human
ccugccagacgcaccagggggc

SEQ ID NO: 647574 - RNA, 22 nt, Human
ggcucuggcgagcuuuaguaca

SEQ ID NO: 647575 - RNA, 22 nt, Human
acaggagacccugcugguucug

SEQ ID NO: 647576 - RNA, 22 nt, Human
acaguuagggacuauaaucauu

SEQ ID NO: 647577 - RNA, 20 nt, Human
ucugggcuucccccagcucc

SEQ ID NO: 647578 - RNA, 22 nt, Human
cuucaagauccauagauauugc

SEQ ID NO: 647579 - RNA, 22 nt, Human
gccuggcacucacugaagaggc

SEQ ID NO: 647580 - RNA, 22 nt, Human
uuggcugaccagaaccugcccc

SEQ ID NO: 647581 - RNA, 22 nt, Human
ggcuuuaugcagggauagaaau

SEQ ID NO: 647582 - RNA, 22 nt, Human
gucaggcauuuaggaugaguuc

SEQ ID NO: 647583 - RNA, 22 nt, Human
gcugccuguccugaggaguccg

SEQ ID NO: 647584 - RNA, 22 nt, Human
cuuuuaaugagcauugcugucu

SEQ ID NO: 647585 - RNA, 22 nt, Human
ccccagaaguuugcacaagaga

SEQ ID NO: 647586 - RNA, 22 nt, Human
augcuuccaaggcuaagacaag

SEQ ID NO: 647587 - RNA, 22 nt, Human
uuugucagucaugucugcuuuu

SEQ ID NO: 647588 - RNA, 16 nt, Human
uguaugaacgucucca

SEQ ID NO: 647589 - RNA, 22 nt, Human
acauuaucccuggcacaacugc

SEQ ID NO: 647590 - RNA, 22 nt, Human
cacuggaaccauccacauagug

SEQ ID NO: 647591 - RNA, 22 nt, Human
gcagggccagguacaagaagca

SEQ ID NO: 647592 - RNA, 22 nt, Human
acagacaucaucaacaucuucc

SEQ ID NO: 647593 - RNA, 22 nt, Human
gggagggaagguaccuguguga

SEQ ID NO: 647594 - RNA, 22 nt, Human
agauaacauguugcagauucug

SEQ ID NO: 647595 - RNA, 22 nt, Human
aacacuggaagggacaucaagu

SEQ ID NO: 647596 - RNA, 22 nt, Human
uuauuucuugucuauguagcca

SEQ ID NO: 647597 - RNA, 22 nt, Human
aggcuaagugggugucagggcc

SEQ ID NO: 647598 - RNA, 22 nt, Human
ucauugagcgguucuuaaccca

SEQ ID NO: 647599 - RNA, 22 nt, Human
ggcucccaggagggccuggagg

SEQ ID NO: 647600 - RNA, 22 nt, Human
gaaggaggcguuagcccuagga

SEQ ID NO: 647601 - RNA, 20 nt, Human
uaacagaaguagaagugggu

SEQ ID NO: 647602 - RNA, 22 nt, Human
acucugggcuuugauuuguuac

SEQ ID NO: 647603 - RNA, 22 nt, Human
agguuaguaugacacgguuaua

SEQ ID NO: 647604 - RNA, 19 nt, Human
ugcugacugggccucaccg

SEQ ID NO: 647605 - RNA, 22 nt, Human
aauucacaauguguagucaugc

SEQ ID NO: 647606 - RNA, 22 nt, Human
guguaugcuuagccagagauuu

SEQ ID NO: 647607 - RNA, 20 nt, Human
gacuucaauuucuaucuuuu

SEQ ID NO: 647608 - RNA, 22 nt, Human
uccacccaguguuucuacaggu

SEQ ID NO: 647609 - RNA, 22 nt, Human
guugggaaggcaagaaguagaa

SEQ ID NO: 647610 - RNA, 22 nt, Human
uauuauugacuauucagaaugu

SEQ ID NO: 647611 - RNA, 22 nt, Human
auuugcaaagguuaacagcagu

SEQ ID NO: 647612 - RNA, 22 nt, Human
ucugaaauacugcagguucucu

SEQ ID NO: 647613 - RNA, 22 nt, Human
cuggcuuuguauaguucccuga

SEQ ID NO: 647614 - RNA, 22 nt, Human
uuauuccauucaguucaacaag

SEQ ID NO: 647615 - RNA, 22 nt, Human
uacaucucaucugugcucuccg

SEQ ID NO: 647616 - RNA, 22 nt, Human
cuuaacagauacaucugugguu

SEQ ID NO: 647617 - RNA, 22 nt, Human
aucuucucaagcagcauccugu

SEQ ID NO: 647618 - RNA, 22 nt, Human
acccuuccaaaugagcuuauua

SEQ ID NO: 647619 - RNA, 23 nt, Human
agcagcaggagguauugauaagg

SEQ ID NO: 647620 - RNA, 17 nt, Human
acagagcuacauauucu

SEQ ID NO: 647621 - RNA, 22 nt, Human
aguaugaauugcuuugccugua

SEQ ID NO: 647622 - RNA, 22 nt, Human
ugcugggcacacaguaggugcu

SEQ ID NO: 647623 - RNA, 21 nt, Human
cucuuuguggcaauguauuuu

SEQ ID NO: 647624 - RNA, 18 nt, Human
ggugagggagcuggaagc

SEQ ID NO: 647625 - RNA, 22 nt, Human
uucagaacugucuguccuuuuc

SEQ ID NO: 647626 - RNA, 22 nt, Human
gcugcugcaagagccagcucuu

SEQ ID NO: 647627 - RNA, 22 nt, Human
caugcaggaggaaaaagcagcu

SEQ ID NO: 647628 - RNA, 22 nt, Human
uggagcaggucggcaccauuug

SEQ ID NO: 647629 - RNA, 22 nt, Human
uacagagagauaaguguaaaag

SEQ ID NO: 647630 - RNA, 23 nt, Human
uagaacaucggugucuuggagca

SEQ ID NO: 647631 - RNA, 22 nt, Human
gacaguaagucagagacuuggu

SEQ ID NO: 647632 - RNA, 22 nt, Human
aagugagguuucugcuuucaga

SEQ ID NO: 647633 - RNA, 22 nt, Human
uuucuagaugcggggcuugugc

SEQ ID NO: 647634 - RNA, 22 nt, Human
guguggggaggagagagcccuu

SEQ ID NO: 647635 - RNA, 22 nt, Human
caaagucagccagcuaguaggu

SEQ ID NO: 647636 - RNA, 22 nt, Human
cuguuguagcugcgcugcuuca

SEQ ID NO: 647637 - RNA, 22 nt, Human
acaaaguagucaaaguagauga

SEQ ID NO: 647638 - RNA, 22 nt, Human
aguuuucucacaucaaaaauga

SEQ ID NO: 647639 - RNA, 22 nt, Human
cugcaugagcugucaguggagg

SEQ ID NO: 647640 - RNA, 22 nt, Human
aaaguuguuguucacagguuau

SEQ ID NO: 647641 - RNA, 22 nt, Human
agaaacuaaagccaagggcucu

SEQ ID NO: 647642 - RNA, 22 nt, Human
aggcuguagaucuagacaugua

SEQ ID NO: 647643 - RNA, 22 nt, Human
accacuuugguauuucaauuuu

SEQ ID NO: 647644 - RNA, 22 nt, Human
agacacagaacacaaaagcaua

SEQ ID NO: 647645 - RNA, 22 nt, Human
cuucagccagcuggggaugcgg

SEQ ID NO: 647646 - RNA, 22 nt, Human
cuggagcucuucugagugugcu

SEQ ID NO: 647647 - RNA, 22 nt, Human
ucacaauggcauaguauaaaau

SEQ ID NO: 647648 - RNA, 22 nt, Human
aagauacagacagagccaaaau

SEQ ID NO: 647649 - RNA, 19 nt, Human
ugcagaggguaggaaggcc

SEQ ID NO: 647650 - RNA, 22 nt, Human
agaggacagguuuuccaugggc

SEQ ID NO: 647651 - RNA, 22 nt, Human
uucuuugcccuuaaugaaauaa

SEQ ID NO: 647652 - RNA, 22 nt, Human
uggaaugaauauguuuuaagga

SEQ ID NO: 647653 - RNA, 22 nt, Human
cuagaauuuuaauuggguauau

SEQ ID NO: 647654 - RNA, 22 nt, Human
caaaagucuuccuauucucuua

SEQ ID NO: 647655 - RNA, 22 nt, Human
caggcaccugugugucucaggg

SEQ ID NO: 647656 - RNA, 22 nt, Human
acaagauagcuuagaagauuca

SEQ ID NO: 647657 - RNA, 22 nt, Human
aaaugguagguuuucuuaagaa

SEQ ID NO: 647658 - RNA, 22 nt, Human
cuuucuuucgaagacgugauua

SEQ ID NO: 647659 - RNA, 22 nt, Human
gagguccauuuucacauaugau

SEQ ID NO: 647660 - RNA, 22 nt, Human
aauggcuuuuaaaaauagcauu

SEQ ID NO: 647661 - RNA, 22 nt, Human
uaacucucacagugcaacauga

SEQ ID NO: 647662 - RNA, 22 nt, Human
gaagcugagcugaggcauguug

SEQ ID NO: 647663 - RNA, 22 nt, Human
acauucaagaugcauucacuua

SEQ ID NO: 647664 - RNA, 22 nt, Human
gagauuuagcugcuuaacuccu

SEQ ID NO: 647665 - RNA, 22 nt, Human
ucugcucacauggcuccaugca

SEQ ID NO: 647666 - RNA, 22 nt, Human
agaggcugggcaggacccacag

SEQ ID NO: 647667 - RNA, 22 nt, Human
aucauucucugcuugagcacuc

SEQ ID NO: 647668 - RNA, 22 nt, Human
ccagcagggcagugcccuggac

SEQ ID NO: 647669 - RNA, 19 nt, Human
cugaagucuuuucagcugg

SEQ ID NO: 647670 - RNA, 22 nt, Human
ggauguucugggguucucuugu

SEQ ID NO: 647671 - RNA, 22 nt, Human
uacaauaugugaacuuuggugu

SEQ ID NO: 647672 - RNA, 22 nt, Human
cuggaauguauguaucuuaaga

SEQ ID NO: 647673 - RNA, 22 nt, Human
gagcugugccaaucugucuggg

SEQ ID NO: 647674 - RNA, 22 nt, Human
gacuugggggcuuuggauaggc

SEQ ID NO: 647675 - RNA, 22 nt, Human
uuggcuuccaggggcuuuuaca

SEQ ID NO: 647676 - RNA, 22 nt, Human
gcguggugcugcccugcacaca

SEQ ID NO: 647677 - RNA, 22 nt, Human
cuuuaugagccuugugaaggag

SEQ ID NO: 647678 - RNA, 22 nt, Human
uacuuucuuucugauccuuaug

SEQ ID NO: 647679 - RNA, 22 nt, Human
cgccuggagaggaggcgacgcg

SEQ ID NO: 647680 - RNA, 22 nt, Human
uccuucuggaggcucuaagggg

SEQ ID NO: 647681 - RNA, 19 nt, Human
uagcagcugccaaaggaga

SEQ ID NO: 647682 - RNA, 22 nt, Human
gggcagagaaauggacaguugg

SEQ ID NO: 647683 - RNA, 23 nt, Human
gucucccauagcgcucccaggcu

SEQ ID NO: 647684 - RNA, 22 nt, Human
auuccaaagccugaauaaugga

SEQ ID NO: 647685 - RNA, 22 nt, Human
uuucagacugcccauguuugcc

SEQ ID NO: 647686 - RNA, 22 nt, Human
uauuagaaaggcuauugcauag

SEQ ID NO: 647687 - RNA, 22 nt, Human
ugaggaguuuuucuagagcuaa

SEQ ID NO: 647688 - RNA, 22 nt, Human
acugagaagcucgcagugaugc

SEQ ID NO: 647689 - RNA, 22 nt, Human
accuggcugagaacgugcagcu

SEQ ID NO: 647690 - RNA, 21 nt, Human
cuuuucucuccgcaggacauu

SEQ ID NO: 647691 - RNA, 22 nt, Human
uggcagcagccauggaaggccc

SEQ ID NO: 647692 - RNA, 22 nt, Human
acaauguguuuuuauacauuug

SEQ ID NO: 647693 - RNA, 22 nt, Human
aggcucuguuauucuagagggc

SEQ ID NO: 647694 - RNA, 22 nt, Human
uggaggagaacucccuggcuac

SEQ ID NO: 647695 - RNA, 22 nt, Human
agucaccaacaugguucccagg

SEQ ID NO: 647696 - RNA, 22 nt, Human
cacuguccaauagauacauaau

SEQ ID NO: 647697 - RNA, 22 nt, Human
ccuccccacgggcagccggcgc

SEQ ID NO: 647698 - RNA, 21 nt, Human
aggcugcaugcaugagugugg

SEQ ID NO: 647699 - RNA, 22 nt, Human
cagaccuggaaaacaggcuugc

SEQ ID NO: 647700 - RNA, 22 nt, Human
aaguuuggaggucacuggucuu

SEQ ID NO: 647701 - RNA, 22 nt, Human
acuugggaugguggccagagcg

SEQ ID NO: 647702 - RNA, 22 nt, Human
cuaaauuaucaugagaauuaug

SEQ ID NO: 647703 - RNA, 22 nt, Human
uccuguggagaggacuggaggu

SEQ ID NO: 647704 - RNA, 22 nt, Human
auuaaggugucaauguauuugg

SEQ ID NO: 647705 - RNA, 22 nt, Human
caauuauucagugacuuaagag

SEQ ID NO: 647706 - RNA, 22 nt, Human
uggcagcuuccugcucauagga

SEQ ID NO: 647707 - RNA, 20 nt, Human
caccuucaaauuuccuggca

SEQ ID NO: 647708 - RNA, 21 nt, Human
uuuauuaacaacuguggacgu

SEQ ID NO: 647709 - RNA, 22 nt, Human
gaccacaguccagucaucaugg

SEQ ID NO: 647710 - RNA, 22 nt, Human
accaggcuggagugcaguggcg

SEQ ID NO: 647711 - RNA, 22 nt, Human
aaggccaacuaggaugagcuag

SEQ ID NO: 647712 - RNA, 22 nt, Human
augcaguuuaaggcacaauuag

SEQ ID NO: 647713 - RNA, 22 nt, Human
gcauucuuugaaugcuucuaau

SEQ ID NO: 647714 - RNA, 22 nt, Human
aaugccuucccauuuauacuuu

SEQ ID NO: 647715 - RNA, 22 nt, Human
cagaucuuguacucauuauuga

SEQ ID NO: 647716 - RNA, 22 nt, Human
aaugccuuauaggcugaaaauu

SEQ ID NO: 647717 - RNA, 22 nt, Human
uacauguaauuuucauaguaag

SEQ ID NO: 647718 - RNA, 22 nt, Human
acuggaaaacacuacuacaugc

SEQ ID NO: 647719 - RNA, 22 nt, Human
gcugcugggaaugaacaguguu

SEQ ID NO: 647720 - RNA, 22 nt, Human
aacaugcugccuuucuacgagu

SEQ ID NO: 647721 - RNA, 20 nt, Human
aacagucaaauguugauugc

SEQ ID NO: 647722 - RNA, 22 nt, Human
aggcugugggacaguuaggaga

SEQ ID NO: 647723 - RNA, 22 nt, Human
ucaacacucuuuggcacaguua

SEQ ID NO: 647724 - RNA, 22 nt, Human
aaucagaauuuauugaaucuuu

SEQ ID NO: 647725 - RNA, 22 nt, Human
uguaggacauguacuuguaaca

SEQ ID NO: 647726 - RNA, 20 nt, Human
gggcagcuccccucauucug

SEQ ID NO: 647727 - RNA, 23 nt, Human
cccuggaguaaauucuuggaagg

SEQ ID NO: 647728 - RNA, 22 nt, Human
gcugcucucauagauggcuuca

SEQ ID NO: 647729 - RNA, 22 nt, Human
ccaggccuagccccugagggua

SEQ ID NO: 647730 - RNA, 22 nt, Human
cagcuccuauuagacacugaau

SEQ ID NO: 647731 - RNA, 23 nt, Human
cccagcagagaugaggagggguc

SEQ ID NO: 647732 - RNA, 22 nt, Human
gcugggaguuugauuugacugg

SEQ ID NO: 647733 - RNA, 22 nt, Human
cugggagcuuuuagaaaugcag

SEQ ID NO: 647734 - RNA, 22 nt, Human
uggagagcuauuuggaccucca

SEQ ID NO: 647735 - RNA, 22 nt, Human
cuucuucucaaggggcaggugg

SEQ ID NO: 647736 - RNA, 22 nt, Human
acuuugcaaugggcagaaccca

SEQ ID NO: 647737 - RNA, 22 nt, Human
cucacagguaccagcacccucc

SEQ ID NO: 647738 - RNA, 22 nt, Human
ccagagaguaggaggcauuauu

SEQ ID NO: 647739 - RNA, 22 nt, Human
cacauuuaucucucuccgguga

SEQ ID NO: 647740 - RNA, 22 nt, Human
cugggaguggugacagcucucg

SEQ ID NO: 647741 - RNA, 22 nt, Human
gcacugagucugucaugcugca

SEQ ID NO: 647742 - RNA, 22 nt, Human
uagugcauaacauuuaaagguc

SEQ ID NO: 647743 - RNA, 22 nt, Human
caagaagcaaggucagggccca

SEQ ID NO: 647744 - RNA, 22 nt, Human
uaaaaaguagugagaauggcgc

SEQ ID NO: 647745 - RNA, 21 nt, Human
acaguucaugauaacuccauc

SEQ ID NO: 647746 - RNA, 22 nt, Human
uucaguguggugcacaguuuug

SEQ ID NO: 647747 - RNA, 22 nt, Human
ucuuuauuucugaaucccccau

SEQ ID NO: 647748 - RNA, 22 nt, Human
agcuggcaucugaagucagggc

SEQ ID NO: 647749 - RNA, 21 nt, Human
cugcaaauaccuaguuaucug

SEQ ID NO: 647750 - RNA, 22 nt, Human
gggugagacagaaagagcaaaa

SEQ ID NO: 647751 - RNA, 23 nt, Human
cagaaaacccagagcucaguccc

SEQ ID NO: 647752 - RNA, 22 nt, Human
gauucaagaccuagcucagcca

SEQ ID NO: 647753 - RNA, 22 nt, Human
cugcugcccagugugcauuggg

SEQ ID NO: 647754 - RNA, 22 nt, Human
ugcuuuacaagccugcuuccuc

SEQ ID NO: 647755 - RNA, 17 nt, Human
ugcccugugccuggugu

SEQ ID NO: 647756 - RNA, 22 nt, Human
auuugacaacuucugguggcau

SEQ ID NO: 647757 - RNA, 22 nt, Human
gaggaagaagggauuagaacuc

SEQ ID NO: 647758 - RNA, 22 nt, Human
uagauucuguaaauaaucaagg

SEQ ID NO: 647759 - RNA, 22 nt, Human
ggaggugguggcagugacaauu

SEQ ID NO: 647760 - RNA, 22 nt, Human
ucacaucuauacccaauaauuu

SEQ ID NO: 647761 - RNA, 22 nt, Human
aguuuauucugcuuggcccucc

SEQ ID NO: 647762 - RNA, 22 nt, Human
cagcuguugucaccucacaucc

SEQ ID NO: 647763 - RNA, 22 nt, Human
gcuaaucaauguuaaggcugug

SEQ ID NO: 647764 - RNA, 22 nt, Human
cuuauucagaccuuggauucuu

SEQ ID NO: 647765 - RNA, 22 nt, Human
cugucauggucagauugucauc

SEQ ID NO: 647766 - RNA, 22 nt, Human
ggcagguggccaagugucuaag

SEQ ID NO: 647767 - RNA, 22 nt, Human
gcaauagauuaugaucuacagu

SEQ ID NO: 647768 - RNA, 22 nt, Human
aucauccaagcguaguucuucu

SEQ ID NO: 647769 - RNA, 22 nt, Human
caggagcugggucuggaagcag

SEQ ID NO: 647770 - RNA, 22 nt, Human
gccaggaggcuuaacuggacag

SEQ ID NO: 647771 - RNA, 22 nt, Human
uggcagagcccagaacugagca

SEQ ID NO: 647772 - RNA, 22 nt, Human
agagggugagcagguacacaug

SEQ ID NO: 647773 - RNA, 22 nt, Human
aacaguuuaugagauaugcuau

SEQ ID NO: 647774 - RNA, 22 nt, Human
acuaaauggaaugauuacuaua

SEQ ID NO: 647775 - RNA, 22 nt, Human
aacuggaaagaucaguaggaag

SEQ ID NO: 647776 - RNA, 22 nt, Human
gggagggaaggaggcgccgugu

SEQ ID NO: 647777 - RNA, 22 nt, Human
cccccauccaugucaggagagg

SEQ ID NO: 647778 - RNA, 19 nt, Human
ugcugaggaugcaagaucc

SEQ ID NO: 647779 - RNA, 22 nt, Human
aacuguggcauguugaauuugu

SEQ ID NO: 647780 - RNA, 22 nt, Human
uuccuucuagcccaaguauugg

SEQ ID NO: 647781 - RNA, 22 nt, Human
auacaagaucacuccagaaaau

SEQ ID NO: 647782 - RNA, 22 nt, Human
agcaggcuuguuaugucugaga

SEQ ID NO: 647783 - RNA, 22 nt, Human
ccugagcagcucugaggggcga

SEQ ID NO: 647784 - RNA, 22 nt, Human
augcuuggccccuuuauagccu

SEQ ID NO: 647785 - RNA, 22 nt, Human
gaguuauauccugagucauauu

SEQ ID NO: 647786 - RNA, 22 nt, Human
gauugcuugauacccagucaau

SEQ ID NO: 647787 - RNA, 22 nt, Human
cacuguggagcaaauuuauuua

SEQ ID NO: 647788 - RNA, 22 nt, Human
auucucugccauugcgguggau

SEQ ID NO: 647789 - RNA, 22 nt, Human
uuccaaagaaauugaccaagac

SEQ ID NO: 647790 - RNA, 22 nt, Human
gcuaggagauugagcucugaag

SEQ ID NO: 647791 - RNA, 22 nt, Human
acacaguugguggcucagucug

SEQ ID NO: 647792 - RNA, 22 nt, Human
ugcccuggggagcccagccagg

SEQ ID NO: 647793 - RNA, 21 nt, Human
agcgucaauaucgucaacagg

SEQ ID NO: 647794 - RNA, 22 nt, Human
gcuggugauugccucaggaggc

SEQ ID NO: 647795 - RNA, 22 nt, Human
gggagcaggacauaauagcaau

SEQ ID NO: 647796 - RNA, 22 nt, Human
ugaguccaagagccagugggaa

SEQ ID NO: 647797 - RNA, 22 nt, Human
ugggagaggcugccaucuugca

SEQ ID NO: 647798 - RNA, 22 nt, Human
uaaagcuguucagugcagaaag

SEQ ID NO: 647799 - RNA, 22 nt, Human
cacaugaagaccuaauuggauu

SEQ ID NO: 647800 - RNA, 22 nt, Human
gcagcauccugggccacagucc

SEQ ID NO: 647801 - RNA, 22 nt, Human
auugaaagguuuugagcagaua

SEQ ID NO: 647802 - RNA, 19 nt, Human
uggcugggugccaauggcc

SEQ ID NO: 647803 - RNA, 22 nt, Human
gaugcugagagguggagggaac

SEQ ID NO: 647804 - RNA, 22 nt, Human
cagguggaucucuaaggacuga

SEQ ID NO: 647805 - RNA, 22 nt, Human
aguuuuauuccaaugugcagca

SEQ ID NO: 647806 - RNA, 22 nt, Human
cacugcuugguugcaacauugc

SEQ ID NO: 647807 - RNA, 23 nt, Human
uucaagauacgguuuccaggcug

SEQ ID NO: 647808 - RNA, 22 nt, Human
cggcccuggcggaggcgggaga

SEQ ID NO: 647809 - RNA, 22 nt, Human
acaggcuuggggcucagacaga

SEQ ID NO: 647810 - RNA, 22 nt, Human
cccuccaggcacugcccucuuc

SEQ ID NO: 647811 - RNA, 22 nt, Human
ucauaaaguuguuuuaauggga

SEQ ID NO: 647812 - RNA, 22 nt, Human
aauuggcuauauuauuuagccu

SEQ ID NO: 647813 - RNA, 22 nt, Human
ugucugccugucucugugcaaa

SEQ ID NO: 647814 - RNA, 22 nt, Human
uggagcagcucuagcgggcgcc

SEQ ID NO: 647815 - RNA, 22 nt, Human
gcugccaguuccuucuuacucc

SEQ ID NO: 647816 - RNA, 22 nt, Human
gcugucuuggguagaaagaggu

SEQ ID NO: 647817 - RNA, 22 nt, Human
aggaaggcugaucacugcuugu

SEQ ID NO: 647818 - RNA, 19 nt, Human
ugugagaggcuagcugccc

SEQ ID NO: 647819 - RNA, 22 nt, Human
uccuuccuggggucucugcugc

SEQ ID NO: 647820 - RNA, 22 nt, Human
agcaaggcucuuaaugcccaaa

SEQ ID NO: 647821 - RNA, 22 nt, Human
uccuucuuugacaaguggcaga

SEQ ID NO: 647822 - RNA, 22 nt, Human
gucucagagagcuacucucuua

SEQ ID NO: 647823 - RNA, 22 nt, Human
uguuuacagggugauuuuaccu

SEQ ID NO: 647824 - RNA, 22 nt, Human
gaaguauuucugaguugcccag

SEQ ID NO: 647825 - RNA, 22 nt, Human
ucauuguugcguuaaugucuuc

SEQ ID NO: 647826 - RNA, 22 nt, Human
cuggagcucuguguguuccuga

SEQ ID NO: 647827 - RNA, 22 nt, Human
caggaaggcgcggcugugccug

SEQ ID NO: 647828 - RNA, 22 nt, Human
uauaagucuggcauauguaugc

SEQ ID NO: 647829 - RNA, 22 nt, Human
ggccuggagcagagacuaggga

SEQ ID NO: 647830 - RNA, 19 nt, Human
aucagcaagguaggaugug

SEQ ID NO: 647831 - RNA, 22 nt, Human
augcugguugcuaagcagcgau

SEQ ID NO: 647832 - RNA, 22 nt, Human
ugcuguauauauuuugaaguga

SEQ ID NO: 647833 - RNA, 22 nt, Human
cucugcugggauguaaagucuu

SEQ ID NO: 647834 - RNA, 22 nt, Human
aucuggcuugacuuugcgacuu

SEQ ID NO: 647835 - RNA, 17 nt, Human
uucugcuguuuccccuu

SEQ ID NO: 647836 - RNA, 22 nt, Human
ggcagcagggucuagauugaug

SEQ ID NO: 647837 - RNA, 22 nt, Human
cagcagguggacacacucaccu

SEQ ID NO: 647838 - RNA, 22 nt, Human
gcugccuccacuggcucccagu

SEQ ID NO: 647839 - RNA, 22 nt, Human
ucagucacacucacugagguag

SEQ ID NO: 647840 - RNA, 19 nt, Human
gggcuggagggauagagcc

SEQ ID NO: 647841 - RNA, 22 nt, Human
aaauucagauggcuuucuuuuc

SEQ ID NO: 647842 - RNA, 22 nt, Human
uccacagaccaguaucugcagc

SEQ ID NO: 647843 - RNA, 22 nt, Human
ggagauccaggcugagucuuuc

SEQ ID NO: 647844 - RNA, 22 nt, Human
uuugagugcccauguuucccag

SEQ ID NO: 647845 - RNA, 22 nt, Human
agacccucuccaugcccacugc

SEQ ID NO: 647846 - RNA, 22 nt, Human
gagagguagcaguaagaacagg

SEQ ID NO: 647847 - RNA, 22 nt, Human
uggcauuuggcuuacuuauguu

SEQ ID NO: 647848 - RNA, 22 nt, Human
gugagguccauguuaauggguu

SEQ ID NO: 647849 - RNA, 22 nt, Human
cuuaaauuuucaucuacaagaa

SEQ ID NO: 647850 - RNA, 22 nt, Human
uaggacaggaucaugaugcugg

SEQ ID NO: 647851 - RNA, 23 nt, Human
uugaaaaauauagucccauuguc

SEQ ID NO: 647852 - RNA, 22 nt, Human
ggcugaggcggcgaugcccuug

SEQ ID NO: 647853 - RNA, 22 nt, Human
uggcucugaccagguagaggag

SEQ ID NO: 647854 - RNA, 22 nt, Human
aggacaauuagacucuuuguuu

SEQ ID NO: 647855 - RNA, 22 nt, Human
guacaauuaagugcacaaauag

SEQ ID NO: 647856 - RNA, 22 nt, Human
ucuuuucauugagaacacacug

SEQ ID NO: 647857 - RNA, 22 nt, Human
cugaaguucuacaagccucagg

SEQ ID NO: 647858 - RNA, 22 nt, Human
gggcuguguaaugugcucuuuu

SEQ ID NO: 647859 - RNA, 22 nt, Human
aaucaguuaaauauugaguaca

SEQ ID NO: 647860 - RNA, 22 nt, Human
ucucaugcuguagugcacuaac

SEQ ID NO: 647861 - RNA, 19 nt, Human
gagcaggccacacaugugu

SEQ ID NO: 647862 - RNA, 22 nt, Human
ccugucauacuaacguaguggg

SEQ ID NO: 647863 - RNA, 17 nt, Human
cagacaggcugucaccc

SEQ ID NO: 647864 - RNA, 22 nt, Human
gagagaacccuaaaugagauau

SEQ ID NO: 647865 - RNA, 22 nt, Human
auuauuagugauguuguuacug

SEQ ID NO: 647866 - RNA, 22 nt, Human
gauacuuuccauccaaaugcau

SEQ ID NO: 647867 - RNA, 22 nt, Human
ucuuaucuuauaccuaacagcc

SEQ ID NO: 647868 - RNA, 22 nt, Human
auuacaacuaugugcucugcaa

SEQ ID NO: 647869 - RNA, 21 nt, Human
gacaggggaagaagcaaggag

SEQ ID NO: 647870 - RNA, 17 nt, Human
aggcaggcagagcggga

SEQ ID NO: 647871 - RNA, 22 nt, Human
gugggcagacaugauagaagga

SEQ ID NO: 647872 - RNA, 22 nt, Human
gacuuucugagucaaagaaagg

SEQ ID NO: 647873 - RNA, 19 nt, Human
acugugcucgggaaccacu

SEQ ID NO: 647874 - RNA, 22 nt, Human
cccugcagagagugcuuuugug

SEQ ID NO: 647875 - RNA, 22 nt, Human
agaacugugaaguaugugaaau

SEQ ID NO: 647876 - RNA, 22 nt, Human
ugcagcuucuccaucuccuugu

SEQ ID NO: 647877 - RNA, 22 nt, Human
ucaucaaaagccuucuggguua

SEQ ID NO: 647878 - RNA, 18 nt, Human
ucugaggaauggaagagc

SEQ ID NO: 647879 - RNA, 22 nt, Human
uuggagagggcuuggaucacac

SEQ ID NO: 647880 - RNA, 22 nt, Human
caaaugcuaugauuuugaguuu

SEQ ID NO: 647881 - RNA, 22 nt, Human
ggcacugaauuucuuggcaucu

SEQ ID NO: 647882 - RNA, 22 nt, Human
agcuuccacaucugucuucagu

SEQ ID NO: 647883 - RNA, 22 nt, Human
aauaauguaggaugauaaauga

SEQ ID NO: 647884 - RNA, 22 nt, Human
cuccugggaauuuaguugugag

SEQ ID NO: 647885 - RNA, 22 nt, Human
aagagacuggaaacuaggguca

SEQ ID NO: 647886 - RNA, 22 nt, Human
gcucugggaaguccuuuaccau

SEQ ID NO: 647887 - RNA, 22 nt, Human
acucagcucaggagcuggcugg

SEQ ID NO: 647888 - RNA, 22 nt, Human
uccauauuaacuaaaacuagaa

SEQ ID NO: 647889 - RNA, 22 nt, Human
ugggccagaaguaugcauguuu

SEQ ID NO: 647890 - RNA, 22 nt, Human
agcugguggagaagcagaccuc

SEQ ID NO: 647891 - RNA, 22 nt, Human
ccaaaaauuagauacacauaua

SEQ ID NO: 647892 - RNA, 22 nt, Human
gcugccucccagagcccugcag

SEQ ID NO: 647893 - RNA, 22 nt, Human
accugagagcuauaagguuuua

SEQ ID NO: 647894 - RNA, 22 nt, Human
cuggggcuggugaggcaggcuc

SEQ ID NO: 647895 - RNA, 22 nt, Human
guacacauagguuacugauuaa

SEQ ID NO: 647896 - RNA, 22 nt, Human
agguagcuauccagacgcugaa

SEQ ID NO: 647897 - RNA, 22 nt, Human
cugcccaccacaccugcuccug

SEQ ID NO: 647898 - RNA, 22 nt, Human
gcugauguaagacuuuugguuu

SEQ ID NO: 647899 - RNA, 22 nt, Human
uucuggaaagaaggcuaagguc

SEQ ID NO: 647900 - RNA, 22 nt, Human
cugagcuuggccaggaaugaau

SEQ ID NO: 647901 - RNA, 22 nt, Human
uuagagagaaccaucaggaucu

SEQ ID NO: 647902 - RNA, 22 nt, Human
cuggaugcuuccucucugcuag

SEQ ID NO: 647903 - RNA, 22 nt, Human
ucucccaggcuggagugcagug

SEQ ID NO: 647904 - RNA, 22 nt, Human
augcaugucagcugugcccaug

SEQ ID NO: 647905 - RNA, 22 nt, Human
cuucucaaaguugugaaucagg

SEQ ID NO: 647906 - RNA, 22 nt, Human
auccuguguugcuacuggagga

SEQ ID NO: 647907 - RNA, 22 nt, Human
aguuugauuugucuaucuucau

SEQ ID NO: 647908 - RNA, 22 nt, Human
gaggaguguauuccacaccacu

SEQ ID NO: 647909 - RNA, 22 nt, Human
acagaugaggaaacagggucag

SEQ ID NO: 647910 - RNA, 22 nt, Human
acacacagaguuuauacaggca

SEQ ID NO: 647911 - RNA, 19 nt, Human
cagaguccuugaccagucc

SEQ ID NO: 647912 - RNA, 22 nt, Human
augcuuuauuguuaggucaugu

SEQ ID NO: 647913 - RNA, 22 nt, Human
ucagauuuuccagccuuucucu

SEQ ID NO: 647914 - RNA, 22 nt, Human
caugcacaugcaauagugcuuu

SEQ ID NO: 647915 - RNA, 22 nt, Human
gaggcagcaaaauauaucauaa

SEQ ID NO: 647916 - RNA, 22 nt, Human
uccaggagcucauccacgucaa

SEQ ID NO: 647917 - RNA, 22 nt, Human
auguuuccauuuucuuguauca

SEQ ID NO: 647918 - RNA, 22 nt, Human
uaauccugugcuguguaaguac

SEQ ID NO: 647919 - RNA, 22 nt, Human
ccccauccuauucauguuucug

SEQ ID NO: 647920 - RNA, 22 nt, Human
ucuggguuggguuccuggaauu

SEQ ID NO: 647921 - RNA, 22 nt, Human
auuagagguuguuuuguaaaga

SEQ ID NO: 647922 - RNA, 22 nt, Human
ugcaagagcccagggccaggaa

SEQ ID NO: 647923 - RNA, 22 nt, Human
ugggcucauguuucuuugagga

SEQ ID NO: 647924 - RNA, 22 nt, Human
agcagcagggucauugcucuuu

SEQ ID NO: 647925 - RNA, 22 nt, Human
acaaugaauaucaugaaguacu

SEQ ID NO: 647926 - RNA, 22 nt, Human
ucuccuugcuacccaguauguc

SEQ ID NO: 647927 - RNA, 22 nt, Human
acuggacagguucaugguuuua

SEQ ID NO: 647928 - RNA, 21 nt, Human
agaagggauugugguaaagau

SEQ ID NO: 647929 - RNA, 22 nt, Human
aaugauacauauguaucguuag

SEQ ID NO: 647930 - RNA, 22 nt, Human
gcagggcugggacuuacuggua

SEQ ID NO: 647931 - RNA, 22 nt, Human
ucuccaggaaagacacuggacu

SEQ ID NO: 647932 - RNA, 22 nt, Human
gagucagaauguccuccugcgg

SEQ ID NO: 647933 - RNA, 22 nt, Human
caagcaugucuucuuaagcaau

SEQ ID NO: 647934 - RNA, 22 nt, Human
agaggcucuggugcagcaugca

SEQ ID NO: 647935 - RNA, 22 nt, Human
uaaaggcucguauuguugugug

SEQ ID NO: 647936 - RNA, 22 nt, Human
aaugcauauguaggcaagcagu

SEQ ID NO: 647937 - RNA, 22 nt, Human
uggaacacuggcuuuccacugu

SEQ ID NO: 647938 - RNA, 22 nt, Human
ugcaggugcagcgauacuguga

SEQ ID NO: 647939 - RNA, 22 nt, Human
uuucauuggcucccugaugaau

SEQ ID NO: 647940 - RNA, 22 nt, Human
gcccagcuuuucacuuccacac

SEQ ID NO: 647941 - RNA, 22 nt, Human
aauauagcauuguaugacugug

SEQ ID NO: 647942 - RNA, 19 nt, Human
cugguccugacugaggggu

SEQ ID NO: 647943 - RNA, 22 nt, Human
uggcacagaaaaaugcuccauu

SEQ ID NO: 647944 - RNA, 22 nt, Human
gcacccucugagcuccgcuccg

SEQ ID NO: 647945 - RNA, 22 nt, Human
uguuuccuaagugucucugaag

SEQ ID NO: 647946 - RNA, 22 nt, Human
agaggcaagggaccuuucuggg

SEQ ID NO: 647947 - RNA, 22 nt, Human
auucuggaagcaagcuuuuaaa

SEQ ID NO: 647948 - RNA, 22 nt, Human
auuucuguaguccacauucuuu

SEQ ID NO: 647949 - RNA, 22 nt, Human
augcccuucaacgugaggauuu

SEQ ID NO: 647950 - RNA, 22 nt, Human
gggcugacgaaggccaugugug

SEQ ID NO: 647951 - RNA, 22 nt, Human
cuggagccauguauagccuaug

SEQ ID NO: 647952 - RNA, 22 nt, Human
aagcugaagccggaucaaaaag

SEQ ID NO: 647953 - RNA, 22 nt, Human
aagaaauuaaugugccauuacu

SEQ ID NO: 647954 - RNA, 22 nt, Human
ucuggucccuuuuccugcaguc

SEQ ID NO: 647955 - RNA, 22 nt, Human
aucaagaauguucauucuucua

SEQ ID NO: 647956 - RNA, 22 nt, Human
cuggcuugcagcucaucauaaa

SEQ ID NO: 647957 - RNA, 22 nt, Human
uugauuucuuacucuuccaagg

SEQ ID NO: 647958 - RNA, 22 nt, Human
uuugaaagggacaaagucacug

SEQ ID NO: 647959 - RNA, 22 nt, Human
uuugucugccuugcuggacugu

SEQ ID NO: 647960 - RNA, 22 nt, Human
uggcacagggcuuggucgcuca

SEQ ID NO: 647961 - RNA, 22 nt, Human
acugggccgcgcugcagagggc

SEQ ID NO: 647962 - RNA, 22 nt, Human
ccuagaggcugcaaggagaggc

SEQ ID NO: 647963 - RNA, 22 nt, Human
augcauguuuauagggugcuuc

SEQ ID NO: 647964 - RNA, 22 nt, Human
aucaagcauauauaaaacugca

SEQ ID NO: 647965 - RNA, 17 nt, Human
ggcaguggaggaagaga

SEQ ID NO: 647966 - RNA, 20 nt, Human
gcaauuaauuuuugguuaca

SEQ ID NO: 647967 - RNA, 22 nt, Human
aaacuugggugacccugagcaa

SEQ ID NO: 647968 - RNA, 22 nt, Human
acagggcaaccucugggagacu

SEQ ID NO: 647969 - RNA, 22 nt, Human
ggcuggguacagggcagugugc

SEQ ID NO: 647970 - RNA, 22 nt, Human
cagaugugccuccagggcuuug

SEQ ID NO: 647971 - RNA, 22 nt, Human
ccagcuuuauagcuucaaagga

SEQ ID NO: 647972 - RNA, 21 nt, Human
agcuggugucagagcucuggg

SEQ ID NO: 647973 - RNA, 22 nt, Human
cacaucuacugauauuccagga

SEQ ID NO: 647974 - RNA, 20 nt, Human
guuaaaagaguaauuugagg

SEQ ID NO: 647975 - RNA, 22 nt, Human
auggccaguguuucccucaguu

SEQ ID NO: 647976 - RNA, 22 nt, Human
ggugacuggagggacccaggcc

SEQ ID NO: 647977 - RNA, 19 nt, Human
cugugggugugcaagggug

SEQ ID NO: 647978 - RNA, 22 nt, Human
acugugugacuguuauuacugu

SEQ ID NO: 647979 - RNA, 22 nt, Human
agcuaucaccuuaauaaacuga

SEQ ID NO: 647980 - RNA, 22 nt, Human
gagugaaaaaggaagggccaua

SEQ ID NO: 647981 - RNA, 22 nt, Human
auuauauuugaaagguuggaag

SEQ ID NO: 647982 - RNA, 22 nt, Human
caaacauuuguuggaaccccug

SEQ ID NO: 647983 - RNA, 22 nt, Human
accaguuaaagggaaauugaaa

SEQ ID NO: 647984 - RNA, 20 nt, Human
ugugggccuucggcgugcuc

SEQ ID NO: 647985 - RNA, 20 nt, Human
uggguccugcuucuuccuga

SEQ ID NO: 647986 - RNA, 22 nt, Human
ucugcucuccauacuuccgcac

SEQ ID NO: 647987 - RNA, 21 nt, Human
ucuguacuuugcuuccaugcu

SEQ ID NO: 647988 - RNA, 23 nt, Human
ucagggcucacacguuuucuggc

SEQ ID NO: 647989 - RNA, 22 nt, Human
acagagcaauucuuggguguuu

SEQ ID NO: 647990 - RNA, 22 nt, Human
gcuccaggcagagccucuuucg

SEQ ID NO: 647991 - RNA, 22 nt, Human
ucucagaaucaggaccuacuuc

SEQ ID NO: 647992 - RNA, 22 nt, Human
aggaauguguuucuaggcuguu

SEQ ID NO: 647993 - RNA, 18 nt, Human
gagcucugccucccaguc

SEQ ID NO: 647994 - RNA, 22 nt, Human
acugggcagggaaggagaccga

SEQ ID NO: 647995 - RNA, 22 nt, Human
uugccaggagacaucuggagcc

SEQ ID NO: 647996 - RNA, 22 nt, Human
ccuggcaggccccuccuggauu

SEQ ID NO: 647997 - RNA, 22 nt, Human
ugaguuaagcagguagcaagcu

SEQ ID NO: 647998 - RNA, 22 nt, Human
ugcuccagaaaaacuugagacu

SEQ ID NO: 647999 - RNA, 22 nt, Human
aauuucacuggaaaagauaauu

SEQ ID NO: 648000 - RNA, 22 nt, Human
agaguuugaaguuaucuuugac

SEQ ID NO: 648001 - RNA, 22 nt, Human
aaauagauugcugaggcauuac

SEQ ID NO: 648002 - RNA, 22 nt, Human
gaauuacaugacccugaguaga

SEQ ID NO: 648003 - RNA, 20 nt, Human
uccagcugucuuucagagac

SEQ ID NO: 648004 - RNA, 22 nt, Human
aaucuguuuccauguuuuauug

SEQ ID NO: 648005 - RNA, 22 nt, Human
uauuaggguuuugaagguuugu

SEQ ID NO: 648006 - RNA, 22 nt, Human
guggguguggaacugugagacc

SEQ ID NO: 648007 - RNA, 22 nt, Human
uauuauggggggaacaucacuc

SEQ ID NO: 648008 - RNA, 22 nt, Human
aaagguuaagguguucaagaaa

SEQ ID NO: 648009 - RNA, 22 nt, Human
agguucaggcugcacaccugag

SEQ ID NO: 648010 - RNA, 19 nt, Human
aggcuggaugcccaucuua

SEQ ID NO: 648011 - RNA, 22 nt, Human
ucuguauuuuaagaugcuguuu

SEQ ID NO: 648012 - RNA, 22 nt, Human
auauaaagagcuuaguauagug

SEQ ID NO: 648013 - RNA, 18 nt, Human
acccaguuugaaggaaag

SEQ ID NO: 648014 - RNA, 22 nt, Human
caagauuuggcaacuuugucau

SEQ ID NO: 648015 - RNA, 22 nt, Human
agucagugaaggcauugcucaa

SEQ ID NO: 648016 - RNA, 22 nt, Human
aauaauacaugagauuaauguu

SEQ ID NO: 648017 - RNA, 22 nt, Human
cuaauuguaagcuccuugaggg

SEQ ID NO: 648018 - RNA, 22 nt, Human
ucagcuggcaguucagaggcug

SEQ ID NO: 648019 - RNA, 22 nt, Human
ugaagcuugagugucaguuccu

SEQ ID NO: 648020 - RNA, 22 nt, Human
ugucacuuuuuauagguguuga

SEQ ID NO: 648021 - RNA, 22 nt, Human
agugcauguaucuacagucaca

SEQ ID NO: 648022 - RNA, 22 nt, Human
cuggaagaccccccaggacuca

SEQ ID NO: 648023 - RNA, 23 nt, Human
ucaguccuguaggggcuccaggu

SEQ ID NO: 648024 - RNA, 22 nt, Human
acuguuaaguaugaaguaaggc

SEQ ID NO: 648025 - RNA, 22 nt, Human
uccauccaggccagcaguaauc

SEQ ID NO: 648026 - RNA, 21 nt, Human
ggggucaagugaaugguguug

SEQ ID NO: 648027 - RNA, 22 nt, Human
agccagcugugggcucaggcgg

SEQ ID NO: 648028 - RNA, 22 nt, Human
auuccacagcucagccucucuu

SEQ ID NO: 648029 - RNA, 22 nt, Human
cagauucugcagucaacuugcu

SEQ ID NO: 648030 - RNA, 22 nt, Human
caaagauaaucacagaauaccc

SEQ ID NO: 648031 - RNA, 22 nt, Human
uuugacaguccccugauguuug

SEQ ID NO: 648032 - RNA, 22 nt, Human
uuugugcagauguauauuugug

SEQ ID NO: 648033 - RNA, 22 nt, Human
gaggcugcugagagcccuguuu

SEQ ID NO: 648034 - RNA, 22 nt, Human
agcuggcaaguugaagguggcu

SEQ ID NO: 648035 - RNA, 22 nt, Human
aaugaaguguuauuuaguuuca

SEQ ID NO: 648036 - RNA, 22 nt, Human
aaauaacuugguuucaucagag

SEQ ID NO: 648037 - RNA, 22 nt, Human
gcagccagcccuagucccacuu

SEQ ID NO: 648038 - RNA, 22 nt, Human
gcccugcugcuggcagaggcgc

SEQ ID NO: 648039 - RNA, 22 nt, Human
uguuuauaccuugguauaacca

SEQ ID NO: 648040 - RNA, 22 nt, Human
cauuggaagacauaucaugcua

SEQ ID NO: 648041 - RNA, 22 nt, Human
acaagauuuuaugacucuuuuu

SEQ ID NO: 648042 - RNA, 22 nt, Human
ccucugggcagguagcagcagc

SEQ ID NO: 648043 - RNA, 22 nt, Human
acauagcuuaaaugagaagaua

SEQ ID NO: 648044 - RNA, 22 nt, Human
aaaugcagaucccugaaucuca

SEQ ID NO: 648045 - RNA, 19 nt, Human
ggacagucucagccucaug

SEQ ID NO: 648046 - RNA, 22 nt, Human
gagcacauucccaggagcugcu

SEQ ID NO: 648047 - RNA, 22 nt, Human
acuuguuaguuuuaucugcaug

SEQ ID NO: 648048 - RNA, 22 nt, Human
ucuggacuauaggcugccaagu

SEQ ID NO: 648049 - RNA, 22 nt, Human
ggcguggggccuucugcccgcu

SEQ ID NO: 648050 - RNA, 22 nt, Human
gcagcaggcauggccgcccugg

SEQ ID NO: 648051 - RNA, 22 nt, Human
acaaaugaacauauaagcuuga

SEQ ID NO: 648052 - RNA, 23 nt, Human
gccaggcuccggucuguggccac

SEQ ID NO: 648053 - RNA, 22 nt, Human
acaugagaggcuguggaguaca

SEQ ID NO: 648054 - RNA, 22 nt, Human
acauuucaguaaguguuaauuu

SEQ ID NO: 648055 - RNA, 22 nt, Human
cccgagccucgguuucuuuucu

SEQ ID NO: 648056 - RNA, 22 nt, Human
gaggcucuggaguagguacaca

SEQ ID NO: 648057 - RNA, 22 nt, Human
cucucuggcccauccuguugcc

SEQ ID NO: 648058 - RNA, 22 nt, Human
uaccugagcccagugcagcaua

SEQ ID NO: 648059 - RNA, 22 nt, Human
aggcacagagaaugcccuccau

SEQ ID NO: 648060 - RNA, 21 nt, Human
auauuucucauaagguuaugg

SEQ ID NO: 648061 - RNA, 22 nt, Human
uguacaugaauaaaagaucuug

SEQ ID NO: 648062 - RNA, 22 nt, Human
gcugcucuuuucagagaugaga

SEQ ID NO: 648063 - RNA, 22 nt, Human
ggaggagcccacucaaagggga

SEQ ID NO: 648064 - RNA, 22 nt, Human
auacacuacuaagcacagauug

SEQ ID NO: 648065 - RNA, 22 nt, Human
caccagcuucccaucgcggguc

SEQ ID NO: 648066 - RNA, 22 nt, Human
uuaucagaguccccaaaagaaa

SEQ ID NO: 648067 - RNA, 22 nt, Human
ugaaagggguugaguuacagcu

SEQ ID NO: 648068 - RNA, 22 nt, Human
agugcuccacauugcacuauuc

SEQ ID NO: 648069 - RNA, 22 nt, Human
uuccaaagucauguugcugaua

SEQ ID NO: 648070 - RNA, 18 nt, Human
aaggcuucaaagaguaga

SEQ ID NO: 648071 - RNA, 21 nt, Human
cgcagagcgaacuugcggcgc

SEQ ID NO: 648072 - RNA, 22 nt, Human
accccagcgcauauggucugcg

SEQ ID NO: 648073 - RNA, 22 nt, Human
aggaaacuaaagcccagagagg

SEQ ID NO: 648074 - RNA, 22 nt, Human
aacuguggagauucggaaggua

SEQ ID NO: 648075 - RNA, 22 nt, Human
uauuuaaccaguuaaauuucca

SEQ ID NO: 648076 - RNA, 22 nt, Human
ugccaaggagcuggaucagggc

SEQ ID NO: 648077 - RNA, 22 nt, Human
ucaguacaaaggugcucucaag

SEQ ID NO: 648078 - RNA, 22 nt, Human
uacagaggcuggguuuucaggg

SEQ ID NO: 648079 - RNA, 22 nt, Human
ucaggggcuugaggugcauguc

SEQ ID NO: 648080 - RNA, 22 nt, Human
uggaccagggucccagaguaug

SEQ ID NO: 648081 - RNA, 22 nt, Human
ucaggcugggcuccucucccca

SEQ ID NO: 648082 - RNA, 22 nt, Human
cagggcuccccagagagccucu

SEQ ID NO: 648083 - RNA, 22 nt, Human
agaacagcagcacgucaagcug

SEQ ID NO: 648084 - RNA, 17 nt, Human
aucuggcugcuucuaga

SEQ ID NO: 648085 - RNA, 22 nt, Human
ccuaggcccauuaauuccccuu

SEQ ID NO: 648086 - RNA, 22 nt, Human
gagggaggugauacugaacgua

SEQ ID NO: 648087 - RNA, 22 nt, Human
gagaagaacuugggcaaaguca

SEQ ID NO: 648088 - RNA, 22 nt, Human
ggcauggccuguaagacggaga

SEQ ID NO: 648089 - RNA, 22 nt, Human
ccacagagacagagcccagggu

SEQ ID NO: 648090 - RNA, 22 nt, Human
ccuccuggcccugggccuggaa

SEQ ID NO: 648091 - RNA, 22 nt, Human
cacauccuucagcugagcccag

SEQ ID NO: 648092 - RNA, 22 nt, Human
cagaggucccuauuucuuuguu

SEQ ID NO: 648093 - RNA, 22 nt, Human
ccagcagaggggcggagugcag

SEQ ID NO: 648094 - RNA, 22 nt, Human
augcuacaggaagacgucaggc

SEQ ID NO: 648095 - RNA, 22 nt, Human
uaucagcaacucagagcagucu

SEQ ID NO: 648096 - RNA, 22 nt, Human
cagcugaaagaaggaaguguca

SEQ ID NO: 648097 - RNA, 22 nt, Human
augaaaugcugagaggugcuuc

SEQ ID NO: 648098 - RNA, 22 nt, Human
cauggcuugcaagcauaggaga

SEQ ID NO: 648099 - RNA, 22 nt, Human
gugugccugacaugaugguuaa

SEQ ID NO: 648100 - RNA, 22 nt, Human
agauacaaaagauaagauuuag

SEQ ID NO: 648101 - RNA, 22 nt, Human
uuacacaauuuuauugaccuaa

SEQ ID NO: 648102 - RNA, 22 nt, Human
uauucugcuaagugauuucuac

SEQ ID NO: 648103 - RNA, 22 nt, Human
uuuccauguuaucuugcagacu

SEQ ID NO: 648104 - RNA, 22 nt, Human
gaagcagcagcuggggacaguu

SEQ ID NO: 648105 - RNA, 22 nt, Human
ucugugcuaauuuauccuuccu

SEQ ID NO: 648106 - RNA, 22 nt, Human
agaaaguacagaugagacacuu

SEQ ID NO: 648107 - RNA, 22 nt, Human
uaagaauuguguugaauagagu

SEQ ID NO: 648108 - RNA, 22 nt, Human
agcaggagauggggcgugaugu

SEQ ID NO: 648109 - RNA, 22 nt, Human
cuacauguagguuuccuuaauu

SEQ ID NO: 648110 - RNA, 22 nt, Human
agcaggugggaucaagcuggca

SEQ ID NO: 648111 - RNA, 22 nt, Human
acagaguaucuaucaggaguau

SEQ ID NO: 648112 - RNA, 22 nt, Human
cagcaaggucugucaauagugg

SEQ ID NO: 648113 - RNA, 22 nt, Human
cccaggacuaaugagcucuacg

SEQ ID NO: 648114 - RNA, 22 nt, Human
agaggccaagccagacugugca

SEQ ID NO: 648115 - RNA, 18 nt, Human
ugaacuuuuccugcugcu

SEQ ID NO: 648116 - RNA, 22 nt, Human
uuaacacauauuuaucaauugc

SEQ ID NO: 648117 - RNA, 21 nt, Human
auuugcauuaaaauauuacgc

SEQ ID NO: 648118 - RNA, 21 nt, Human
gaugguagccucauagaagua

SEQ ID NO: 648119 - RNA, 22 nt, Human
acagcagcgugaaguguguuau

SEQ ID NO: 648120 - RNA, 22 nt, Human
acacagaguaucuuuugccuag

SEQ ID NO: 648121 - RNA, 21 nt, Human
aaagagcccgcugagagguuc

SEQ ID NO: 648122 - RNA, 22 nt, Human
ucuggccuauuucugucagauc

SEQ ID NO: 648123 - RNA, 22 nt, Human
uucucccacuccgugcuucagu

SEQ ID NO: 648124 - RNA, 22 nt, Human
auucugggagguagaacugaaa

SEQ ID NO: 648125 - RNA, 22 nt, Human
cugggcagaauuuuaggauggc

SEQ ID NO: 648126 - RNA, 22 nt, Human
ugaacacagcauauuuuguuac

SEQ ID NO: 648127 - RNA, 22 nt, Human
ggguggaagccagagaggucau

SEQ ID NO: 648128 - RNA, 22 nt, Human
ugacugccccuuccauuccugc

SEQ ID NO: 648129 - RNA, 22 nt, Human
agacuucuuugugagcauuuuc

SEQ ID NO: 648130 - RNA, 23 nt, Human
acuuaaaugguucuuuaucucag

SEQ ID NO: 648131 - RNA, 22 nt, Human
augguuuuauuucucuauagcu

SEQ ID NO: 648132 - RNA, 18 nt, Human
ggcagcaagaagggaggg

SEQ ID NO: 648133 - RNA, 22 nt, Human
auguauuuugccagacugucuc

SEQ ID NO: 648134 - RNA, 22 nt, Human
gggcggggcuuccguccuccac

SEQ ID NO: 648135 - RNA, 22 nt, Human
uguuuaagauccgucagucacu

SEQ ID NO: 648136 - RNA, 23 nt, Human
gagcucugcacuaggcccuggga

SEQ ID NO: 648137 - RNA, 22 nt, Human
ugacuuaagcuguucuuuagau

SEQ ID NO: 648138 - RNA, 22 nt, Human
uuccuggugaccucacugguag

SEQ ID NO: 648139 - RNA, 22 nt, Human
augccaaagcccaaguucauca

SEQ ID NO: 648140 - RNA, 22 nt, Human
aggagcugauaaaaggggguca

SEQ ID NO: 648141 - RNA, 23 nt, Human
aggguccagggaucaccaggugu

SEQ ID NO: 648142 - RNA, 21 nt, Human
uuaauuuauucaugauagcua

SEQ ID NO: 648143 - RNA, 22 nt, Human
guucauguggaaauuuaaaaca

SEQ ID NO: 648144 - RNA, 22 nt, Human
aaacuguaaugcaggaucaaga

SEQ ID NO: 648145 - RNA, 22 nt, Human
cugagguauugaaguaucuucu

SEQ ID NO: 648146 - RNA, 22 nt, Human
ucacaaaugucuccuguccugu

SEQ ID NO: 648147 - RNA, 22 nt, Human
aggcccaguagucgacggcgcu

SEQ ID NO: 648148 - RNA, 20 nt, Human
aaucucaguauccuaugcaa

SEQ ID NO: 648149 - RNA, 22 nt, Human
auacccuuuacaggaacagcaa

SEQ ID NO: 648150 - RNA, 22 nt, Human
auugaucaugcagaugcuucac

SEQ ID NO: 648151 - RNA, 22 nt, Human
aaaucaguuaagaugaggccau

SEQ ID NO: 648152 - RNA, 22 nt, Human
auacagagaagggaggcaaaau

SEQ ID NO: 648153 - RNA, 22 nt, Human
caggaaaugcguaguugaacuu

SEQ ID NO: 648154 - RNA, 22 nt, Human
aauuuguguuauaccugcuccu

SEQ ID NO: 648155 - RNA, 22 nt, Human
gcuuccucccugcugcucacua

SEQ ID NO: 648156 - RNA, 22 nt, Human
cacuugaacccgggaggcugag

SEQ ID NO: 648157 - RNA, 20 nt, Human
cuguggaauuuuaccaugcg

SEQ ID NO: 648158 - RNA, 21 nt, Human
gcagagccugagguucuugag

SEQ ID NO: 648159 - RNA, 22 nt, Human
uuccaggguuaauuuauauggu

SEQ ID NO: 648160 - RNA, 22 nt, Human
auggccaccaucucuaaaacac

SEQ ID NO: 648161 - RNA, 22 nt, Human
aagggcucuucuauuuauggcc

SEQ ID NO: 648162 - RNA, 22 nt, Human
accugucaucccggcugcaccg

SEQ ID NO: 648163 - RNA, 22 nt, Human
ggcagcgcccgaguccgcagcu

SEQ ID NO: 648164 - RNA, 19 nt, Human
gcaggacucccagcuccuc

SEQ ID NO: 648165 - RNA, 22 nt, Human
gggcuucuagaauuucugauau

SEQ ID NO: 648166 - RNA, 19 nt, Human
cacaaaugaugaggaccug

SEQ ID NO: 648167 - RNA, 22 nt, Human
ucuccuggcucuaaaaggcugu

SEQ ID NO: 648168 - RNA, 21 nt, Human
agaagucaauugaacugaaau

SEQ ID NO: 648169 - RNA, 22 nt, Human
cagcuggccccacaguagaggc

SEQ ID NO: 648170 - RNA, 22 nt, Human
cgaggaaauauuuacaacugau

SEQ ID NO: 648171 - RNA, 22 nt, Human
ggcuggauguacuuuggggcug

SEQ ID NO: 648172 - RNA, 22 nt, Human
aaggggaauagaguggguugug

SEQ ID NO: 648173 - RNA, 22 nt, Human
gacauuaaaugucuuaguugcc

SEQ ID NO: 648174 - RNA, 22 nt, Human
uucauuugccaucaguguaaug

SEQ ID NO: 648175 - RNA, 22 nt, Human
ugguggcaugauagugugaaug

SEQ ID NO: 648176 - RNA, 22 nt, Human
acacagauggguagaaaacaga

SEQ ID NO: 648177 - RNA, 22 nt, Human
gaagcugugcugggggaucugu

SEQ ID NO: 648178 - RNA, 22 nt, Human
ggaagaaaaugggcaacaggug

SEQ ID NO: 648179 - RNA, 22 nt, Human
aaguuucuuuauuagcuugucc

SEQ ID NO: 648180 - RNA, 22 nt, Human
uaacagaaaggggacagaaaua

SEQ ID NO: 648181 - RNA, 22 nt, Human
uugucugcuugaugccaagcau

SEQ ID NO: 648182 - RNA, 18 nt, Human
cugucaccgccaccacac

SEQ ID NO: 648183 - RNA, 22 nt, Human
guucugaguggcccaagcccug

SEQ ID NO: 648184 - RNA, 22 nt, Human
uauucagaguauuccaugaggu

SEQ ID NO: 648185 - RNA, 22 nt, Human
caggcagcugaggacuuugcua

SEQ ID NO: 648186 - RNA, 22 nt, Human
ucuuuggcugccugaagcccaa

SEQ ID NO: 648187 - RNA, 18 nt, Human
cccagccucuccuuucua

SEQ ID NO: 648188 - RNA, 22 nt, Human
aaugagaagccuagguguacug

SEQ ID NO: 648189 - RNA, 22 nt, Human
ggggagcaauaguugaggugug

SEQ ID NO: 648190 - RNA, 22 nt, Human
agugucugcagugaugucucuu

SEQ ID NO: 648191 - RNA, 22 nt, Human
cugugccuccagucucgcuucu

SEQ ID NO: 648192 - RNA, 22 nt, Human
cugaggagagguggccuguguu

SEQ ID NO: 648193 - RNA, 22 nt, Human
guguggguguacuguucuagau

SEQ ID NO: 648194 - RNA, 23 nt, Human
cauaugaaaguagacacuuucca

SEQ ID NO: 648195 - RNA, 22 nt, Human
agcuucuuuaauucagcaugau

SEQ ID NO: 648196 - RNA, 22 nt, Human
ccagagagucgaugggggacac

SEQ ID NO: 648197 - RNA, 22 nt, Human
uuuuccuuaacagagggagaaa

SEQ ID NO: 648198 - RNA, 22 nt, Human
guccaguguguuuaucuuggau

SEQ ID NO: 648199 - RNA, 22 nt, Human
caggcagaaggaaguaccaggc

SEQ ID NO: 648200 - RNA, 22 nt, Human
aggcagccauccaggaggcuca

SEQ ID NO: 648201 - RNA, 22 nt, Human
cuucacagagucccugauuguu

SEQ ID NO: 648202 - RNA, 21 nt, Human
uaggaacuguucugagugguc

SEQ ID NO: 648203 - RNA, 22 nt, Human
caggccuggggcuggcuuccag

SEQ ID NO: 648204 - RNA, 19 nt, Human
aggcagcauucuggggcuu

SEQ ID NO: 648205 - RNA, 22 nt, Human
aaagcuggcuuuuacaggggcu

SEQ ID NO: 648206 - RNA, 22 nt, Human
cugaaggcugaggcuguguugu

SEQ ID NO: 648207 - RNA, 20 nt, Human
ggaagcagagaacuguuuuc

SEQ ID NO: 648208 - RNA, 22 nt, Human
ccuguacaucugcucucauugc

SEQ ID NO: 648209 - RNA, 22 nt, Human
gugggacagcggggugggacag

SEQ ID NO: 648210 - RNA, 22 nt, Human
gcucugugaguauuggcccugg

SEQ ID NO: 648211 - RNA, 21 nt, Human
agcaggugaaccuccaguaca

SEQ ID NO: 648212 - RNA, 22 nt, Human
ugcauauugugaaaauguagau

SEQ ID NO: 648213 - RNA, 22 nt, Human
ucaaguauaucuagucauuagg

SEQ ID NO: 648214 - RNA, 22 nt, Human
gucugaaaguagggcugaucua

SEQ ID NO: 648215 - RNA, 22 nt, Human
gguacaauggaccauaaaagcu

SEQ ID NO: 648216 - RNA, 22 nt, Human
caagcagaaaucuagaacucca

SEQ ID NO: 648217 - RNA, 18 nt, Human
cccucuccugcuaguggg

SEQ ID NO: 648218 - RNA, 22 nt, Human
ucucuaaauacagaugucaugg

SEQ ID NO: 648219 - RNA, 22 nt, Human
uuuacaagucagggacuguucu

SEQ ID NO: 648220 - RNA, 22 nt, Human
cagggcacaguuauggaggugg

SEQ ID NO: 648221 - RNA, 22 nt, Human
ugaggcagaaaauagcaguuca

SEQ ID NO: 648222 - RNA, 22 nt, Human
uauugucuguccgggucaaagc

SEQ ID NO: 648223 - RNA, 22 nt, Human
ugugccauugagagguuucaga

SEQ ID NO: 648224 - RNA, 22 nt, Human
gagcuuccauccuuacugugug

SEQ ID NO: 648225 - RNA, 22 nt, Human
ugauggcuaucccuggaagggc

SEQ ID NO: 648226 - RNA, 22 nt, Human
ggcuuaagaaaugucuaguuuu

SEQ ID NO: 648227 - RNA, 22 nt, Human
cuggaaagacagagggcauggg

SEQ ID NO: 648228 - RNA, 22 nt, Human
augacuucguuuucucucugca

SEQ ID NO: 648229 - RNA, 22 nt, Human
ggcucugucaccuaugagcuga

SEQ ID NO: 648230 - RNA, 22 nt, Human
ggcuucacagccccauuagugc

SEQ ID NO: 648231 - RNA, 22 nt, Human
gaggcccaggguacaggccgcu

SEQ ID NO: 648232 - RNA, 22 nt, Human
aauaucuguggccauacaauuu

SEQ ID NO: 648233 - RNA, 22 nt, Human
cagcuccucuggccagcccugc

SEQ ID NO: 648234 - RNA, 22 nt, Human
cuuuaugacugaguugucaauu

SEQ ID NO: 648235 - RNA, 22 nt, Human
aucuuucaguuucauaccaauu

SEQ ID NO: 648236 - RNA, 22 nt, Human
guggcucagcggagcucugcac

SEQ ID NO: 648237 - RNA, 22 nt, Human
cagaagcacauguuuacaugua

SEQ ID NO: 648238 - RNA, 22 nt, Human
agugaccauuuucagcuagagg

SEQ ID NO: 648239 - RNA, 22 nt, Human
cacaggagcuguggggcagugu

SEQ ID NO: 648240 - RNA, 19 nt, Human
ugaucuggaaggaaccagg

SEQ ID NO: 648241 - RNA, 22 nt, Human
cccagggaaugacucuggccuu

SEQ ID NO: 648242 - RNA, 22 nt, Human
acuuuaucaggaaucacacagc

SEQ ID NO: 648243 - RNA, 22 nt, Human
acaagcagagauuaaauguuuu

SEQ ID NO: 648244 - RNA, 22 nt, Human
cuucuuccugaaagcuggcucu

SEQ ID NO: 648245 - RNA, 19 nt, Human
cacagcuggcgcugaccgc

SEQ ID NO: 648246 - RNA, 19 nt, Human
gauauaaagagauggugaa

SEQ ID NO: 648247 - RNA, 22 nt, Human
uccacagaauguaagauccaca

SEQ ID NO: 648248 - RNA, 20 nt, Human
aagcuggaagaccagcauug

SEQ ID NO: 648249 - RNA, 21 nt, Human
uccaaaucccauucuguaguc

SEQ ID NO: 648250 - RNA, 22 nt, Human
uaacagaauccuguuauugcca

SEQ ID NO: 648251 - RNA, 22 nt, Human
ucacuauguucggagaacucug

SEQ ID NO: 648252 - RNA, 17 nt, Human
ccuggcugggaaucuga

SEQ ID NO: 648253 - RNA, 22 nt, Human
cacugggcuuuguaguuagcau

SEQ ID NO: 648254 - RNA, 22 nt, Human
aaugaagccagguagaagagaa

SEQ ID NO: 648255 - RNA, 22 nt, Human
cucugagguuuccucacaagcu

SEQ ID NO: 648256 - RNA, 23 nt, Human
acucagugagggccuugggcugc

SEQ ID NO: 648257 - RNA, 22 nt, Human
ucuauucauucaauuuagcucu

SEQ ID NO: 648258 - RNA, 22 nt, Human
aaaagucuugucaagguuccca

SEQ ID NO: 648259 - RNA, 22 nt, Human
agggcacaggcuccggguccag

SEQ ID NO: 648260 - RNA, 18 nt, Human
gguggccuugacuucucu

SEQ ID NO: 648261 - RNA, 22 nt, Human
uuuuaaagagaugcugugcaua

SEQ ID NO: 648262 - RNA, 22 nt, Human
uuucagagccuuuaucucucua

SEQ ID NO: 648263 - RNA, 22 nt, Human
aggauugugccuccagucagaa

SEQ ID NO: 648264 - RNA, 22 nt, Human
uucccagaggagauuugcuuau

SEQ ID NO: 648265 - RNA, 22 nt, Human
ccuggagaggagaaagggccca

SEQ ID NO: 648266 - RNA, 22 nt, Human
aguaaucaauuuuucgguggau

SEQ ID NO: 648267 - RNA, 22 nt, Human
gggcuucucuuuagugagcuga

SEQ ID NO: 648268 - RNA, 20 nt, Human
uggaauaaguuaaguuguuu

SEQ ID NO: 648269 - RNA, 18 nt, Human
cacuggaccucaugagag

SEQ ID NO: 648270 - RNA, 22 nt, Human
acaaugcaauaggagcuagaaa

SEQ ID NO: 648271 - RNA, 23 nt, Human
uaugagaacccauacgcugucuu

SEQ ID NO: 648272 - RNA, 23 nt, Human
agauccaugugggcuggaaacug

SEQ ID NO: 648273 - RNA, 22 nt, Human
guguccuuuccgggccuggagg

SEQ ID NO: 648274 - RNA, 22 nt, Human
auccacagaaggaacuugaaag

SEQ ID NO: 648275 - RNA, 22 nt, Human
uaagcauaguaccguagcagcu

SEQ ID NO: 648276 - RNA, 22 nt, Human
caucuuuguuuuggauauaauc

SEQ ID NO: 648277 - RNA, 22 nt, Human
aggaaacaugaaucugccuuga

SEQ ID NO: 648278 - RNA, 22 nt, Human
cacaagucuguggucuccaaca

SEQ ID NO: 648279 - RNA, 22 nt, Human
uccaggguguguuuacuggggu

SEQ ID NO: 648280 - RNA, 22 nt, Human
gaaagagaggggcugagaugca

SEQ ID NO: 648281 - RNA, 18 nt, Human
auguacauuugcuaaagc

SEQ ID NO: 648282 - RNA, 22 nt, Human
acagagguaggacaugagauau

SEQ ID NO: 648283 - RNA, 22 nt, Human
acacucuugcauuaccugaaua

SEQ ID NO: 648284 - RNA, 22 nt, Human
agcgagguuuugcagauacagc

SEQ ID NO: 648285 - RNA, 20 nt, Human
agucuggcaccuauuccugu

SEQ ID NO: 648286 - RNA, 22 nt, Human
agcacaguaaagcagugucaca

SEQ ID NO: 648287 - RNA, 23 nt, Human
agaggccagccuuuggagacacc

SEQ ID NO: 648288 - RNA, 22 nt, Human
ggagagguguauucaguggguc

SEQ ID NO: 648289 - RNA, 22 nt, Human
auauucauugaacaccuacuac

SEQ ID NO: 648290 - RNA, 22 nt, Human
cagacacuauuguguauaaauc

SEQ ID NO: 648291 - RNA, 22 nt, Human
aggacaguguggaagagggugc

SEQ ID NO: 648292 - RNA, 22 nt, Human
agcagggaggcggugugcuggc

SEQ ID NO: 648293 - RNA, 22 nt, Human
gcugaaaaauagugucguguuu

SEQ ID NO: 648294 - RNA, 22 nt, Human
gccugggugucgaucacuagug

SEQ ID NO: 648295 - RNA, 22 nt, Human
ucagugucaucacuuaauauaa

SEQ ID NO: 648296 - RNA, 22 nt, Human
ucagagugcagggaguagcagc

SEQ ID NO: 648297 - RNA, 22 nt, Human
aagagggcugcaaucuuauugc

SEQ ID NO: 648298 - RNA, 22 nt, Human
ccacuugacaauaaacugagcu

SEQ ID NO: 648299 - RNA, 22 nt, Human
uagggaggcuacuucuuguagg

SEQ ID NO: 648300 - RNA, 22 nt, Human
ggccuugguaaagggaugcaug

SEQ ID NO: 648301 - RNA, 22 nt, Human
uauugaagauuuugugguugcu

SEQ ID NO: 648302 - RNA, 22 nt, Human
uucugaggcauagaggaugaga

SEQ ID NO: 648303 - RNA, 23 nt, Human
acugggaaguuuggagagacgca

SEQ ID NO: 648304 - RNA, 22 nt, Human
gcugacaguuacugcuguaaca

SEQ ID NO: 648305 - RNA, 22 nt, Human
uuuucuauuaacucauuuugca

SEQ ID NO: 648306 - RNA, 22 nt, Human
ccuggagagcucgggccaggca

SEQ ID NO: 648307 - RNA, 22 nt, Human
gacaauacagaaagggacaugc

SEQ ID NO: 648308 - RNA, 22 nt, Human
cuacuucuaaguacauggugau

SEQ ID NO: 648309 - RNA, 20 nt, Human
gggcuggcgcauggggaaag

SEQ ID NO: 648310 - RNA, 22 nt, Human
agcugugauuauccacuggaau

SEQ ID NO: 648311 - RNA, 22 nt, Human
uugccagggaacagggagaggc

SEQ ID NO: 648312 - RNA, 22 nt, Human
uauccaaagagauucauguucu

SEQ ID NO: 648313 - RNA, 22 nt, Human
cugugggagcacuggggaccga

SEQ ID NO: 648314 - RNA, 22 nt, Human
ucagugugcacucugugaccca

SEQ ID NO: 648315 - RNA, 22 nt, Human
auggaguucuuuaaauucacag

SEQ ID NO: 648316 - RNA, 22 nt, Human
uugcagagccaugaggcuggcu

SEQ ID NO: 648317 - RNA, 22 nt, Human
auguucuuugugauucugagcu

SEQ ID NO: 648318 - RNA, 22 nt, Human
aggcugugaagguuaaagacga

SEQ ID NO: 648319 - RNA, 21 nt, Human
uugaauuguaugauuaaacug

SEQ ID NO: 648320 - RNA, 23 nt, Human
cagugggaggacugagauaaaac

SEQ ID NO: 648321 - RNA, 22 nt, Human
cuccugcuccugcuugcaagga

SEQ ID NO: 648322 - RNA, 22 nt, Human
ccucacuuuccuuucuccuggg

SEQ ID NO: 648323 - RNA, 22 nt, Human
acucaagucauaggcuucuuuc

SEQ ID NO: 648324 - RNA, 22 nt, Human
gcugcucuacccaugcaucugu

SEQ ID NO: 648325 - RNA, 22 nt, Human
uacaaguauguuuuaaaauguu

SEQ ID NO: 648326 - RNA, 22 nt, Human
acauucaggccacaguggaguc

SEQ ID NO: 648327 - RNA, 22 nt, Human
uuugacucaagccuuucuuuag

SEQ ID NO: 648328 - RNA, 22 nt, Human
uaauugaaaucauuucaauuca

SEQ ID NO: 648329 - RNA, 22 nt, Human
gagcagaugugugccaggaugc

SEQ ID NO: 648330 - RNA, 22 nt, Human
ggcucuggugcccuggcuccca

SEQ ID NO: 648331 - RNA, 22 nt, Human
auuuuuuguuaacucaggauag

SEQ ID NO: 648332 - RNA, 23 nt, Human
acugagccagggccugggucagc

SEQ ID NO: 648333 - RNA, 22 nt, Human
ggcaugcaaaacaacucagaga

SEQ ID NO: 648334 - RNA, 22 nt, Human
cacaggaaaaauggguccuuua

SEQ ID NO: 648335 - RNA, 22 nt, Human
uauuggaccacagacuuuaagg

SEQ ID NO: 648336 - RNA, 22 nt, Human
ggccucugcaacuggcuguggc

SEQ ID NO: 648337 - RNA, 20 nt, Human
gagauggacagaugaagggg

SEQ ID NO: 648338 - RNA, 22 nt, Human
aaagcacuugaaaucuggcagu

SEQ ID NO: 648339 - RNA, 22 nt, Human
gaggaugcugcagugcaggaca

SEQ ID NO: 648340 - RNA, 22 nt, Human
aaauugcagguaggugggugau

SEQ ID NO: 648341 - RNA, 22 nt, Human
auuuaugacuggugaauagaac

SEQ ID NO: 648342 - RNA, 22 nt, Human
auuguagcaauuucucuuaauu

SEQ ID NO: 648343 - RNA, 22 nt, Human
ggcagcugagcauggcuaccuu

SEQ ID NO: 648344 - RNA, 20 nt, Human
cuggggagcugcucccacga

SEQ ID NO: 648345 - RNA, 22 nt, Human
uaugaacuguaacccucaccgc

SEQ ID NO: 648346 - RNA, 22 nt, Human
uucaaguaacacaaaugcaccc

SEQ ID NO: 648347 - RNA, 22 nt, Human
uagagcuagcuucaaaaugcga

SEQ ID NO: 648348 - RNA, 22 nt, Human
ggacagaaaccauaugagugua

SEQ ID NO: 648349 - RNA, 22 nt, Human
gaguccagcagaaugagccaag

SEQ ID NO: 648350 - RNA, 22 nt, Human
aguggcuggcauaggaacagac

SEQ ID NO: 648351 - RNA, 17 nt, Human
gcuuccugugcugggga

SEQ ID NO: 648352 - RNA, 22 nt, Human
uggcacauagcagguacucagu

SEQ ID NO: 648353 - RNA, 22 nt, Human
gggcuuuaggggccagugacca

SEQ ID NO: 648354 - RNA, 22 nt, Human
ugaaauguguccauguuauuuc

SEQ ID NO: 648355 - RNA, 22 nt, Human
gaggcugagaguuuguucuacu

SEQ ID NO: 648356 - RNA, 22 nt, Human
aguuccaccauuuaggaucugu

SEQ ID NO: 648357 - RNA, 22 nt, Human
gccugccccuuccugggcaggg

SEQ ID NO: 648358 - RNA, 21 nt, Human
ugagaaguaugucuucagcca

SEQ ID NO: 648359 - RNA, 22 nt, Human
cugggcacaguggcucacgccu

SEQ ID NO: 648360 - RNA, 22 nt, Human
ugcuuuggccacuagaauucag

SEQ ID NO: 648361 - RNA, 22 nt, Human
uauucuccccggaucagggcaa

SEQ ID NO: 648362 - RNA, 22 nt, Human
cuguauaugugcauacacacac

SEQ ID NO: 648363 - RNA, 22 nt, Human
cccugaggcccuccuggggucu

SEQ ID NO: 648364 - RNA, 22 nt, Human
acagagucaugguagucaaagg

SEQ ID NO: 648365 - RNA, 21 nt, Human
ggccaacauggucucaucucu

SEQ ID NO: 648366 - RNA, 22 nt, Human
uucacaguauagguuuccagcg

SEQ ID NO: 648367 - RNA, 22 nt, Human
ggggcagagagaaggaagcuug

SEQ ID NO: 648368 - RNA, 22 nt, Human
uuacagaaaagggcuuuaagag

SEQ ID NO: 648369 - RNA, 22 nt, Human
aguagcagaaggucuugaaggg

SEQ ID NO: 648370 - RNA, 22 nt, Human
uccacuguggucccuugcugcc

SEQ ID NO: 648371 - RNA, 22 nt, Human
ggcagggucuggacugaaagcu

SEQ ID NO: 648372 - RNA, 18 nt, Human
ggcugagguugacuagaa

SEQ ID NO: 648373 - RNA, 22 nt, Human
uggcaguggugucugcacaggc

SEQ ID NO: 648374 - RNA, 22 nt, Human
gaucauugaacaggcacuggag

SEQ ID NO: 648375 - RNA, 22 nt, Human
ugagcccugaggaucuguucgg

SEQ ID NO: 648376 - RNA, 22 nt, Human
uacacauauguccauuaaucag

SEQ ID NO: 648377 - RNA, 22 nt, Human
gcuuuuauuucuucacaaaagu

SEQ ID NO: 648378 - RNA, 22 nt, Human
uuuagcaauuucuaaaaguguu

SEQ ID NO: 648379 - RNA, 22 nt, Human
agacugggauucucccugauca

SEQ ID NO: 648380 - RNA, 22 nt, Human
uagauguuuugauauuugcuga

SEQ ID NO: 648381 - RNA, 21 nt, Human
ugcugggcugcaggggaugca

SEQ ID NO: 648382 - RNA, 22 nt, Human
ucuaaugagggugaaggcccag

SEQ ID NO: 648383 - RNA, 22 nt, Human
cauuauggaagugaagagcucu

SEQ ID NO: 648384 - RNA, 20 nt, Human
uggacagaauuagacacuuu

SEQ ID NO: 648385 - RNA, 22 nt, Human
augggaagcugaccugcaugga

SEQ ID NO: 648386 - RNA, 22 nt, Human
ugaaacaaauuuggaaaaucua

SEQ ID NO: 648387 - RNA, 22 nt, Human
uucuucuccuaaggagaguccu

SEQ ID NO: 648388 - RNA, 22 nt, Human
ggcuguggggaccaacaggacu

SEQ ID NO: 648389 - RNA, 22 nt, Human
auucuacacaaagcaagaagac

SEQ ID NO: 648390 - RNA, 22 nt, Human
gagccugccccuccaccaggau

SEQ ID NO: 648391 - RNA, 22 nt, Human
aaagcauagaauuagaguuagg

SEQ ID NO: 648392 - RNA, 22 nt, Human
agcagcugaucaaagcacuuau

SEQ ID NO: 648393 - RNA, 22 nt, Human
auauacaaagggcaaccucgcu

SEQ ID NO: 648394 - RNA, 22 nt, Human
gcauguguuagagugugcaugc

SEQ ID NO: 648395 - RNA, 22 nt, Human
gccucagggggagaggccagcu

SEQ ID NO: 648396 - RNA, 22 nt, Human
auagcauggccugugacacuuu

SEQ ID NO: 648397 - RNA, 22 nt, Human
uucgacucugugccugaagagc

SEQ ID NO: 648398 - RNA, 22 nt, Human
gggguggcuggcaccuccuggu

SEQ ID NO: 648399 - RNA, 18 nt, Human
aguggaaaacaaauacac

SEQ ID NO: 648400 - RNA, 22 nt, Human
cagggccaugaggcacaggguc

SEQ ID NO: 648401 - RNA, 22 nt, Human
uuaaaugugauccugguaugca

SEQ ID NO: 648402 - RNA, 22 nt, Human
aagaguaugcaugcauguuugu

SEQ ID NO: 648403 - RNA, 22 nt, Human
gggucuggacggcugcaggaag

SEQ ID NO: 648404 - RNA, 21 nt, Human
ggggcagagcuaggcccugca

SEQ ID NO: 648405 - RNA, 22 nt, Human
aaauugcacaauauagacauga

SEQ ID NO: 648406 - RNA, 22 nt, Human
cccugaggaaaggguggagggc

SEQ ID NO: 648407 - RNA, 22 nt, Human
gcuguggucugugagcuccaaa

SEQ ID NO: 648408 - RNA, 17 nt, Human
aguggcaggcagauggg

SEQ ID NO: 648409 - RNA, 22 nt, Human
ucaagauguccagugccuauaa

SEQ ID NO: 648410 - RNA, 22 nt, Human
cagacaggagacuggaucaugg

SEQ ID NO: 648411 - RNA, 22 nt, Human
uagaaagcaugcaaguuugaug

SEQ ID NO: 648412 - RNA, 22 nt, Human
aaagcauuauucuguggaaaaa

SEQ ID NO: 648413 - RNA, 22 nt, Human
cugggcuggguuuacccucuuc

SEQ ID NO: 648414 - RNA, 22 nt, Human
gugaggucuuugggaggugauu

SEQ ID NO: 648415 - RNA, 21 nt, Human
uucuguuuuuuguaccagggc

SEQ ID NO: 648416 - RNA, 22 nt, Human
ugucuauuaacacaagaaagga

SEQ ID NO: 648417 - RNA, 19 nt, Human
uugaggggccaggggagau

SEQ ID NO: 648418 - RNA, 22 nt, Human
augcuuuuaugucacaugguca

SEQ ID NO: 648419 - RNA, 22 nt, Human
gcuuugcaggaaaccagugcau

SEQ ID NO: 648420 - RNA, 21 nt, Human
cacugaggucagggguagggu

SEQ ID NO: 648421 - RNA, 22 nt, Human
ucacuugacuuuccagucuugg

SEQ ID NO: 648422 - RNA, 22 nt, Human
gcagggugccgacuucagggau

SEQ ID NO: 648423 - RNA, 22 nt, Human
ucccagagucuucuccuguaau

SEQ ID NO: 648424 - RNA, 22 nt, Human
ggccaggccaagaggguuggaa

SEQ ID NO: 648425 - RNA, 22 nt, Human
auucucugugucugcuuuccca

SEQ ID NO: 648426 - RNA, 22 nt, Human
ugucuuuuuaccugugaugagu

SEQ ID NO: 648427 - RNA, 22 nt, Human
agcgcugugggcgugcgaggag

SEQ ID NO: 648428 - RNA, 20 nt, Human
uucagaguuuacucaaacug

SEQ ID NO: 648429 - RNA, 22 nt, Human
uccccucugguugacccaggag

SEQ ID NO: 648430 - RNA, 22 nt, Human
acugaaggcuuucccaagguca

SEQ ID NO: 648431 - RNA, 21 nt, Human
ugcacagggcccaggagagcc

SEQ ID NO: 648432 - RNA, 22 nt, Human
uaaguucaguuggucgaaguag

SEQ ID NO: 648433 - RNA, 22 nt, Human
uauuuauguggaccauaagccu

SEQ ID NO: 648434 - RNA, 22 nt, Human
guuuagaccaaucauaauuuau

SEQ ID NO: 648435 - RNA, 22 nt, Human
cagauaacugaaauaucauacc

SEQ ID NO: 648436 - RNA, 22 nt, Human
uuacgaauguuagauugcaucu

SEQ ID NO: 648437 - RNA, 22 nt, Human
aaggcaaauguguucuuuuagu

SEQ ID NO: 648438 - RNA, 22 nt, Human
gagugucuauguuuagucuuuc

SEQ ID NO: 648439 - RNA, 22 nt, Human
gggcgccgugggaaacagccgg

SEQ ID NO: 648440 - RNA, 22 nt, Human
auguauguuuucaguuguauua

SEQ ID NO: 648441 - RNA, 22 nt, Human
auuugucauauauaauacucuu

SEQ ID NO: 648442 - RNA, 22 nt, Human
cacaaaugguuguagacauuaa

SEQ ID NO: 648443 - RNA, 22 nt, Human
augaaauugaucuugaacuuuu

SEQ ID NO: 648444 - RNA, 19 nt, Human
aaacucugaaggccacugg

SEQ ID NO: 648445 - RNA, 22 nt, Human
cucugggucaggacacaaaagu

SEQ ID NO: 648446 - RNA, 22 nt, Human
cauuucugauuacagaauacua

SEQ ID NO: 648447 - RNA, 23 nt, Human
aggugcccagggcagguuuacug

SEQ ID NO: 648448 - RNA, 20 nt, Human
uuuuccagaaaguaucauug

SEQ ID NO: 648449 - RNA, 19 nt, Human
cgcaggcuucgggucgcuc

SEQ ID NO: 648450 - RNA, 22 nt, Human
ggucugcccuggguggaggcgc

SEQ ID NO: 648451 - RNA, 22 nt, Human
aguguggcaggaaugacuagaa

SEQ ID NO: 648452 - RNA, 22 nt, Human
aauaauuacccaucuuuuugua

SEQ ID NO: 648453 - RNA, 22 nt, Human
caaaguaugaaccaguuucucu

SEQ ID NO: 648454 - RNA, 22 nt, Human
aaauuuuccugguaaagaugga

SEQ ID NO: 648455 - RNA, 22 nt, Human
caugcuccaaaaacaagagaau

SEQ ID NO: 648456 - RNA, 22 nt, Human
guuuacacuccaggcuggggug

SEQ ID NO: 648457 - RNA, 22 nt, Human
ucugaagaacugaguaaacaug

SEQ ID NO: 648458 - RNA, 22 nt, Human
gacacagggggauguguggacg

SEQ ID NO: 648459 - RNA, 22 nt, Human
agacaugcuuggaggagaagga

SEQ ID NO: 648460 - RNA, 22 nt, Human
ccaaggcuucccagagaugcuc

SEQ ID NO: 648461 - RNA, 22 nt, Human
gguuaaacacuuuggaaguggc

SEQ ID NO: 648462 - RNA, 22 nt, Human
uuacaguauuggucacguuugu

SEQ ID NO: 648463 - RNA, 22 nt, Human
gccuguggggcugaggcugccu

SEQ ID NO: 648464 - RNA, 22 nt, Human
gggcauggcgugugcuggauuc

SEQ ID NO: 648465 - RNA, 22 nt, Human
aagcagaaggggaauaauauuu

SEQ ID NO: 648466 - RNA, 22 nt, Human
aggaaaagugugaaguauggag

SEQ ID NO: 648467 - RNA, 22 nt, Human
aaaaacuguaauuacuuuugca

SEQ ID NO: 648468 - RNA, 22 nt, Human
guucacaaaguacuguaugcau

SEQ ID NO: 648469 - RNA, 22 nt, Human
aguccccuggcaggagggacgu

SEQ ID NO: 648470 - RNA, 22 nt, Human
cagccacugacaggaauggucc

SEQ ID NO: 648471 - RNA, 22 nt, Human
uacuuucuaagacauacaacuu

SEQ ID NO: 648472 - RNA, 22 nt, Human
uagugucuguccaucaguaacu

SEQ ID NO: 648473 - RNA, 22 nt, Human
agaauauaguuaccaaauucug

SEQ ID NO: 648474 - RNA, 22 nt, Human
gcugcucugugacagccuccgg

SEQ ID NO: 648475 - RNA, 22 nt, Human
uuguuuuggagaugagcuaaaa

SEQ ID NO: 648476 - RNA, 22 nt, Human
gaugaagucauuauccuuuugg

SEQ ID NO: 648477 - RNA, 22 nt, Human
gaauugaauucauuuacucaaa

SEQ ID NO: 648478 - RNA, 22 nt, Human
uucuaacucuguuauguguuuc

SEQ ID NO: 648479 - RNA, 22 nt, Human
aagcuggaacaucuugaggaag

SEQ ID NO: 648480 - RNA, 22 nt, Human
aaaugcacaauaaaguaaaggc

SEQ ID NO: 648481 - RNA, 22 nt, Human
gccauggggagggcagcgccug

SEQ ID NO: 648482 - RNA, 20 nt, Human
auuagugcaucuggacaugc

SEQ ID NO: 648483 - RNA, 22 nt, Human
ggccagagaagucagacccuug

SEQ ID NO: 648484 - RNA, 22 nt, Human
ucugggaagcugcgugccuguu

SEQ ID NO: 648485 - RNA, 22 nt, Human
gcaguguuuggauccauagcga

SEQ ID NO: 648486 - RNA, 22 nt, Human
gucuuuuuauuauagaguggag

SEQ ID NO: 648487 - RNA, 22 nt, Human
acaguggagaaggcaugaggcu

SEQ ID NO: 648488 - RNA, 22 nt, Human
gggaagaagacauggugaaggc

SEQ ID NO: 648489 - RNA, 22 nt, Human
agggccagaguggcaaaagccu

SEQ ID NO: 648490 - RNA, 22 nt, Human
gcaguguuaccucuucaguggg

SEQ ID NO: 648491 - RNA, 22 nt, Human
acccagggucaccccguagggu

SEQ ID NO: 648492 - RNA, 22 nt, Human
agucauuacggacuaguacuac

SEQ ID NO: 648493 - RNA, 22 nt, Human
augcaauuuacuguacauaaau

SEQ ID NO: 648494 - RNA, 21 nt, Human
ugaaagaaggugcagucugaa

SEQ ID NO: 648495 - RNA, 20 nt, Human
cuccagggaacagacuggag

SEQ ID NO: 648496 - RNA, 22 nt, Human
ugcugaggagguggcugugcuu

SEQ ID NO: 648497 - RNA, 22 nt, Human
gacuuuaugaagagaugaccaa

SEQ ID NO: 648498 - RNA, 22 nt, Human
ggcaggguccacaccugggaaa

SEQ ID NO: 648499 - RNA, 22 nt, Human
agacuuugagcucuuagagaag

SEQ ID NO: 648500 - RNA, 19 nt, Human
cacaucagcagggcugugg

SEQ ID NO: 648501 - RNA, 22 nt, Human
cucugcagaauuugagcugcuc

SEQ ID NO: 648502 - RNA, 22 nt, Human
agcuccuugcagguugccuugg

SEQ ID NO: 648503 - RNA, 22 nt, Human
gugggggcaggcagugcuagga

SEQ ID NO: 648504 - RNA, 22 nt, Human
cagggcacagaucggggcgcac

SEQ ID NO: 648505 - RNA, 22 nt, Human
ugcagccaggaaauauuugcug

SEQ ID NO: 648506 - RNA, 22 nt, Human
guuucucacaaggcugcaaucc

SEQ ID NO: 648507 - RNA, 22 nt, Human
cugugccuuaguauucucauuu

SEQ ID NO: 648508 - RNA, 22 nt, Human
agauacuauggaauuuuaugag

SEQ ID NO: 648509 - RNA, 21 nt, Human
ccuacagauggauauauauuc

SEQ ID NO: 648510 - RNA, 22 nt, Human
gcuggcaggagccuuucccuuu

SEQ ID NO: 648511 - RNA, 21 nt, Human
uccagaggaggacagacucag

SEQ ID NO: 648512 - RNA, 22 nt, Human
aaucacauuaagcccuguucag

SEQ ID NO: 648513 - RNA, 22 nt, Human
ugcuggcuuagauaucacugcc

SEQ ID NO: 648514 - RNA, 22 nt, Human
ugaggaggugggcacacagagu

SEQ ID NO: 648515 - RNA, 22 nt, Human
gauggcuucagucuccuugggu

SEQ ID NO: 648516 - RNA, 22 nt, Human
auagaaaggucuuuggcagaca

SEQ ID NO: 648517 - RNA, 19 nt, Human
ggugugugcuggggccugu

SEQ ID NO: 648518 - RNA, 22 nt, Human
ucucccacagccgugcuucaag

SEQ ID NO: 648519 - RNA, 22 nt, Human
aaagaugugccuguuucauagu

SEQ ID NO: 648520 - RNA, 22 nt, Human
acagcuuuuuacuaauagauug

SEQ ID NO: 648521 - RNA, 23 nt, Human
ccuggcagcaaacgaggagguua

SEQ ID NO: 648522 - RNA, 22 nt, Human
acaucugggccuaaggcuauau

SEQ ID NO: 648523 - RNA, 22 nt, Human
uggucucugacucugaagaccc

SEQ ID NO: 648524 - RNA, 22 nt, Human
uggcucagcauucacuggucuu

SEQ ID NO: 648525 - RNA, 22 nt, Human
cuccagauuccguuuauucagg

SEQ ID NO: 648526 - RNA, 22 nt, Human
ggcccagugucccggucguggc

SEQ ID NO: 648527 - RNA, 22 nt, Human
ugcacaugugccuguggcacau

SEQ ID NO: 648528 - RNA, 22 nt, Human
agaggcccucucucuccugaug

SEQ ID NO: 648529 - RNA, 22 nt, Human
uugcagcuucgagucuaucugu

SEQ ID NO: 648530 - RNA, 22 nt, Human
cauuggaaugaucguuuugcug

SEQ ID NO: 648531 - RNA, 22 nt, Human
ugauuacacaccacagugcucc

SEQ ID NO: 648532 - RNA, 19 nt, Human
uggggaugcugaugaccaa

SEQ ID NO: 648533 - RNA, 22 nt, Human
agaaguguuuauuucagcaaca

SEQ ID NO: 648534 - RNA, 23 nt, Human
acagaauaccauugacuaggugu

SEQ ID NO: 648535 - RNA, 23 nt, Human
ugccuauucagcagagugauagc

SEQ ID NO: 648536 - RNA, 23 nt, Human
cccagcuggaaguuagaggacca

SEQ ID NO: 648537 - RNA, 21 nt, Human
aaaucacuguccaaucuuggu

SEQ ID NO: 648538 - RNA, 22 nt, Human
gcagaugcuuggcacugacagu

SEQ ID NO: 648539 - RNA, 22 nt, Human
ggccagcagucacagggucaga

SEQ ID NO: 648540 - RNA, 22 nt, Human
uuucaaagucaagaaggauacu

SEQ ID NO: 648541 - RNA, 22 nt, Human
ucucuggagggcuccaggcggg

SEQ ID NO: 648542 - RNA, 22 nt, Human
uuagaaccauaaugaaucaaug

SEQ ID NO: 648543 - RNA, 19 nt, Human
acagaugcuuuugcugccc

SEQ ID NO: 648544 - RNA, 22 nt, Human
uuucucaucuggaaacagugcu

SEQ ID NO: 648545 - RNA, 19 nt, Human
aacaccagagucaggaguc

SEQ ID NO: 648546 - RNA, 22 nt, Human
aggaagaacagauaauggacgc

SEQ ID NO: 648547 - RNA, 22 nt, Human
aaaguguugaagaaaauguuca

SEQ ID NO: 648548 - RNA, 22 nt, Human
cucugaaauuggcccucagcag

SEQ ID NO: 648549 - RNA, 22 nt, Human
gguagcacauugcauuaggaga

SEQ ID NO: 648550 - RNA, 22 nt, Human
aggcagcagucaugaggaaaga

SEQ ID NO: 648551 - RNA, 22 nt, Human
ggacaggguuggggcauauaaa

SEQ ID NO: 648552 - RNA, 22 nt, Human
acuguacacgugucauuuacag

SEQ ID NO: 648553 - RNA, 22 nt, Human
uuuacagggaauauuuuggcuu

SEQ ID NO: 648554 - RNA, 22 nt, Human
ucuaacuugaacucaugacugu

SEQ ID NO: 648555 - RNA, 23 nt, Human
gauacacucccugcugggcacug

SEQ ID NO: 648556 - RNA, 22 nt, Human
cagcaucucugcacccuccccc

SEQ ID NO: 648557 - RNA, 22 nt, Human
uuauuagguuuacauaaagguu

SEQ ID NO: 648558 - RNA, 22 nt, Human
uacugaaagacugaauauuuag

SEQ ID NO: 648559 - RNA, 22 nt, Human
uuuacacuccuggaaaugauau

SEQ ID NO: 648560 - RNA, 22 nt, Human
agcacuuguagacuagaauuuu

SEQ ID NO: 648561 - RNA, 22 nt, Human
uugauuugauugaugaacuaag

SEQ ID NO: 648562 - RNA, 22 nt, Human
gugucugcugcacccucacacc

SEQ ID NO: 648563 - RNA, 20 nt, Human
ucaggagccuaggacaugau

SEQ ID NO: 648564 - RNA, 22 nt, Human
auggauucauuaaugacuucuc

SEQ ID NO: 648565 - RNA, 22 nt, Human
gcugcugugccuggcguccugu

SEQ ID NO: 648566 - RNA, 22 nt, Human
agcaacagcaacgacauuucuc

SEQ ID NO: 648567 - RNA, 22 nt, Human
ccucagcauccucaugcucagu

SEQ ID NO: 648568 - RNA, 22 nt, Human
agguauauauucugguccuuau

SEQ ID NO: 648569 - RNA, 22 nt, Human
caaaugaugcauggcuagugag

SEQ ID NO: 648570 - RNA, 22 nt, Human
gccuguuuacuuugccgcagga

SEQ ID NO: 648571 - RNA, 22 nt, Human
ucugggccaacccuuccauggg

SEQ ID NO: 648572 - RNA, 22 nt, Human
gacaguauuuaacuaguucauu

SEQ ID NO: 648573 - RNA, 22 nt, Human
aagagugugagguugugcuuuu

SEQ ID NO: 648574 - RNA, 22 nt, Human
uuuaugauuaauccaauucugu

SEQ ID NO: 648575 - RNA, 23 nt, Human
cucccugaacaugacacaccaga

SEQ ID NO: 648576 - RNA, 22 nt, Human
aaugauauagcagacauagccu

SEQ ID NO: 648577 - RNA, 22 nt, Human
ccaggagcuggcauguggagag

SEQ ID NO: 648578 - RNA, 19 nt, Human
acaguucuaauuucugugg

SEQ ID NO: 648579 - RNA, 22 nt, Human
uuuauucacuucagugccaaag

SEQ ID NO: 648580 - RNA, 22 nt, Human
aagggcugcauuugauguguca

SEQ ID NO: 648581 - RNA, 22 nt, Human
uaggucccuucuguccuggucu

SEQ ID NO: 648582 - RNA, 22 nt, Human
aagaauaaauuaagauacuuag

SEQ ID NO: 648583 - RNA, 22 nt, Human
uucacagacuuuccauagauug

SEQ ID NO: 648584 - RNA, 22 nt, Human
gcauucuuguuuuuccuacccu

SEQ ID NO: 648585 - RNA, 22 nt, Human
uucuucagacucccucuuuaag

SEQ ID NO: 648586 - RNA, 22 nt, Human
auagugucagaaaaucauaaga

SEQ ID NO: 648587 - RNA, 22 nt, Human
uguuucuaucuggaucaauaga

SEQ ID NO: 648588 - RNA, 22 nt, Human
acugggcuuaugcuguggagua

SEQ ID NO: 648589 - RNA, 22 nt, Human
accagcagaguugaggaggaca

SEQ ID NO: 648590 - RNA, 22 nt, Human
cccaggacucugacacccccaa

SEQ ID NO: 648591 - RNA, 22 nt, Human
aagaggccacagcugacagcac

SEQ ID NO: 648592 - RNA, 20 nt, Human
uggccucugagaugccacgg

SEQ ID NO: 648593 - RNA, 17 nt, Human
gcaccgugggcacacuc

SEQ ID NO: 648594 - RNA, 22 nt, Human
gagcauggauagaaggugggau

SEQ ID NO: 648595 - RNA, 22 nt, Human
gcucugagauugagccuuuggu

SEQ ID NO: 648596 - RNA, 22 nt, Human
gcccuggaaucucuccauggga

SEQ ID NO: 648597 - RNA, 22 nt, Human
uuuacagagguguccugcauug

SEQ ID NO: 648598 - RNA, 22 nt, Human
ugagaucauugacuuguuccug

SEQ ID NO: 648599 - RNA, 22 nt, Human
uugggaguuccuacugcgguuu

SEQ ID NO: 648600 - RNA, 22 nt, Human
gcacauggacaauggaggugca

SEQ ID NO: 648601 - RNA, 22 nt, Human
uuuccaagacuccaguucuccc

SEQ ID NO: 648602 - RNA, 22 nt, Human
uaggcugggcugagcuggacgg

SEQ ID NO: 648603 - RNA, 22 nt, Human
gcugucugcaagccaggaaaug

SEQ ID NO: 648604 - RNA, 22 nt, Human
cagguccccuccccuaccaggc

SEQ ID NO: 648605 - RNA, 20 nt, Human
aaaaagacaaaacgaguugg

SEQ ID NO: 648606 - RNA, 22 nt, Human
uccacccugcuuucuuaucucc

SEQ ID NO: 648607 - RNA, 22 nt, Human
uuugcagagugcagaagcaucu

SEQ ID NO: 648608 - RNA, 22 nt, Human
ucuuggcuguaccauugacuag

SEQ ID NO: 648609 - RNA, 22 nt, Human
gagagaaaggcuugcaggcugu

SEQ ID NO: 648610 - RNA, 22 nt, Human
uuucaaaauuuugcagugguaa

SEQ ID NO: 648611 - RNA, 22 nt, Human
agcccaggucucaaaguacagg

SEQ ID NO: 648612 - RNA, 22 nt, Human
ucugggaaaugggcagcuucgc

SEQ ID NO: 648613 - RNA, 19 nt, Human
cuggugcuugagugaguca

SEQ ID NO: 648614 - RNA, 22 nt, Human
uuugcuuugggagguugucugg

SEQ ID NO: 648615 - RNA, 22 nt, Human
aggcacagcacaccuggccccc

SEQ ID NO: 648616 - RNA, 21 nt, Human
gaggaaaugcucugguguuca

SEQ ID NO: 648617 - RNA, 22 nt, Human
gguaccaccaauucagcugcca

SEQ ID NO: 648618 - RNA, 22 nt, Human
gcagccacuuugcaaccaagag

SEQ ID NO: 648619 - RNA, 22 nt, Human
uuugcauuucuaaugagcuccg

SEQ ID NO: 648620 - RNA, 22 nt, Human
cauugacaguucuuuaaguugc

SEQ ID NO: 648621 - RNA, 22 nt, Human
cuggcagcucugagucccuucu

SEQ ID NO: 648622 - RNA, 20 nt, Human
uccaggaaugguagaggacu

SEQ ID NO: 648623 - RNA, 21 nt, Human
aguguguucuuggcauuaccu

SEQ ID NO: 648624 - RNA, 22 nt, Human
uagugucuguugcuuuuguuca

SEQ ID NO: 648625 - RNA, 22 nt, Human
guggucaucauuaguauuauua

SEQ ID NO: 648626 - RNA, 22 nt, Human
agugcucuaacagucaaaaaag

SEQ ID NO: 648627 - RNA, 22 nt, Human
acaacuagcagguauuaauuuu

SEQ ID NO: 648628 - RNA, 22 nt, Human
cucagagaaccuaagcggagga

SEQ ID NO: 648629 - RNA, 22 nt, Human
ucacuguuuccuguacuggaca

SEQ ID NO: 648630 - RNA, 20 nt, Human
cagugcccguggaaaagaug

SEQ ID NO: 648631 - RNA, 22 nt, Human
cagguggcagaggucucuggaa

SEQ ID NO: 648632 - RNA, 22 nt, Human
agcucacauucucaucagaugu

SEQ ID NO: 648633 - RNA, 22 nt, Human
ccacagaaccucagcuuugagc

SEQ ID NO: 648634 - RNA, 22 nt, Human
ccucaggguucggaugagaaca

SEQ ID NO: 648635 - RNA, 22 nt, Human
ccaggcucagcgcgcacgucug

SEQ ID NO: 648636 - RNA, 22 nt, Human
uggacagccaugcaaaugagcu

SEQ ID NO: 648637 - RNA, 22 nt, Human
aaaccuagguuuccucauucag

SEQ ID NO: 648638 - RNA, 23 nt, Human
uggagaauucuuccuuccacugu

SEQ ID NO: 648639 - RNA, 22 nt, Human
cagcugaacauguagagcaucu

SEQ ID NO: 648640 - RNA, 22 nt, Human
uucagggcugacaagccuauug

SEQ ID NO: 648641 - RNA, 22 nt, Human
auguguguaaacaaguauaauu

SEQ ID NO: 648642 - RNA, 22 nt, Human
ucaacaguugcacuggagaggu

SEQ ID NO: 648643 - RNA, 22 nt, Human
aaaauggguuucuucaaccuca

SEQ ID NO: 648644 - RNA, 23 nt, Human
caaauguaguguguccaccccug

SEQ ID NO: 648645 - RNA, 22 nt, Human
uggucuuuaagguagcugucau

SEQ ID NO: 648646 - RNA, 22 nt, Human
cacacauggucaguggcuacuc

SEQ ID NO: 648647 - RNA, 22 nt, Human
agggggugaucaaggugcggcg

SEQ ID NO: 648648 - RNA, 22 nt, Human
ggcagaggagcuggaaacaugg

SEQ ID NO: 648649 - RNA, 22 nt, Human
aaagaccugaaauauaaucuag

SEQ ID NO: 648650 - RNA, 22 nt, Human
ccuuggaguucuguuuggcuua

SEQ ID NO: 648651 - RNA, 22 nt, Human
uccagguaugacauggcuguuu

SEQ ID NO: 648652 - RNA, 22 nt, Human
ucuccuggauagauacuaucca

SEQ ID NO: 648653 - RNA, 22 nt, Human
aacugcagagaacaucuggguu

SEQ ID NO: 648654 - RNA, 22 nt, Human
uagcucaaagguuaagugugga

SEQ ID NO: 648655 - RNA, 22 nt, Human
ccuugcauuuaaaggcguaggg

SEQ ID NO: 648656 - RNA, 17 nt, Human
gccuggcccagccuggc

SEQ ID NO: 648657 - RNA, 22 nt, Human
gaggccacaguccugaggcauc

SEQ ID NO: 648658 - RNA, 22 nt, Human
gcaugcaacucccaguucugcc

SEQ ID NO: 648659 - RNA, 22 nt, Human
auggaaggcuuuaugacucaaa

SEQ ID NO: 648660 - RNA, 20 nt, Human
ccauggccacaucugugcug

SEQ ID NO: 648661 - RNA, 22 nt, Human
agugcagugguuaggagccagg

SEQ ID NO: 648662 - RNA, 22 nt, Human
uaagaauauugggaauggaugg

SEQ ID NO: 648663 - RNA, 22 nt, Human
aauccauagaauaaaauugcag

SEQ ID NO: 648664 - RNA, 22 nt, Human
agccaggguaagguacuuagua

SEQ ID NO: 648665 - RNA, 18 nt, Human
agucuuguucuguugccc

SEQ ID NO: 648666 - RNA, 22 nt, Human
uucauguaggcugcaaugcaca

SEQ ID NO: 648667 - RNA, 22 nt, Human
ucugucacaaguaauccuuuuc

SEQ ID NO: 648668 - RNA, 22 nt, Human
ugcaguccaagagucuccuggu

SEQ ID NO: 648669 - RNA, 22 nt, Human
ucccugggcaaguuuacucuuc

SEQ ID NO: 648670 - RNA, 22 nt, Human
auccacuugccacuguauaguu

SEQ ID NO: 648671 - RNA, 22 nt, Human
ccugagccuggcucaugcacuc

SEQ ID NO: 648672 - RNA, 22 nt, Human
ucagggacgugagcucagaguc

SEQ ID NO: 648673 - RNA, 22 nt, Human
guacaaguucuacucuauaaau

SEQ ID NO: 648674 - RNA, 22 nt, Human
uuagaaagggugucugaaucug

SEQ ID NO: 648675 - RNA, 22 nt, Human
gcuucagaccugaaaggaaaaa

SEQ ID NO: 648676 - RNA, 22 nt, Human
uucucugaucuugcuagacuga

SEQ ID NO: 648677 - RNA, 22 nt, Human
cugagggcaugaacauuccaua

SEQ ID NO: 648678 - RNA, 22 nt, Human
uagcugccauugcuccaggaag

SEQ ID NO: 648679 - RNA, 18 nt, Human
uucuuuaauucaguuuga

SEQ ID NO: 648680 - RNA, 22 nt, Human
cagcuuccgaccgggggcugca

SEQ ID NO: 648681 - RNA, 22 nt, Human
cccuggaggcaaagguugcagu

SEQ ID NO: 648682 - RNA, 22 nt, Human
uaagaacaguagaacaguaggu

SEQ ID NO: 648683 - RNA, 19 nt, Human
gaaagucauagagcuuguc

SEQ ID NO: 648684 - RNA, 22 nt, Human
ugggcccaagugcaaugcagug

SEQ ID NO: 648685 - RNA, 19 nt, Human
gggaaauucacuugcuucc

SEQ ID NO: 648686 - RNA, 22 nt, Human
ucucuuaaaagaguaauagaga

SEQ ID NO: 648687 - RNA, 22 nt, Human
uuuacacaaaagauagcacacc

SEQ ID NO: 648688 - RNA, 22 nt, Human
ugugccugugacagcgaccugg

SEQ ID NO: 648689 - RNA, 23 nt, Human
ggauacaaagauuaauaguagag

SEQ ID NO: 648690 - RNA, 22 nt, Human
uugaaaggugaacaugaugcac

SEQ ID NO: 648691 - RNA, 23 nt, Human
gaagcagaugucugaguaggcag

SEQ ID NO: 648692 - RNA, 22 nt, Human
aguggcagaagccaagucugca

SEQ ID NO: 648693 - RNA, 20 nt, Human
aucugcuugccuguccucgg

SEQ ID NO: 648694 - RNA, 22 nt, Human
cuccagggagcugcgggagcca

SEQ ID NO: 648695 - RNA, 22 nt, Human
ucagaaccugcaagucuaaccu

SEQ ID NO: 648696 - RNA, 22 nt, Human
gagcucagguggucaaaacaau

SEQ ID NO: 648697 - RNA, 22 nt, Human
aguuucaguguugacagauggu

SEQ ID NO: 648698 - RNA, 17 nt, Human
aaggcacagggcacugg

SEQ ID NO: 648699 - RNA, 21 nt, Human
ccuguggauuuuaaaauugga

SEQ ID NO: 648700 - RNA, 22 nt, Human
agguacuaccagggauuuucag

SEQ ID NO: 648701 - RNA, 22 nt, Human
agcagagaagacacaggcuuca

SEQ ID NO: 648702 - RNA, 22 nt, Human
cagaaacagagaaauauuggcu

SEQ ID NO: 648703 - RNA, 22 nt, Human
gauacacacccuugauaggacu

SEQ ID NO: 648704 - RNA, 20 nt, Human
cagagccaggguuuuguuuu

SEQ ID NO: 648705 - RNA, 22 nt, Human
gcuggucacucugggagcugcu

SEQ ID NO: 648706 - RNA, 22 nt, Human
cuuuguaucuaaauaucuugaa

SEQ ID NO: 648707 - RNA, 22 nt, Human
agugggcagugcgcucggaugc

SEQ ID NO: 648708 - RNA, 22 nt, Human
gugggcugcuuccuccuuccac

SEQ ID NO: 648709 - RNA, 22 nt, Human
agcuuccuuggcgcugaggccu

SEQ ID NO: 648710 - RNA, 22 nt, Human
cugcccaggcugaaggaacauc

SEQ ID NO: 648711 - RNA, 22 nt, Human
aaaauucuaacaugcagccaag

SEQ ID NO: 648712 - RNA, 22 nt, Human
ucccuagguccuagucacagua

SEQ ID NO: 648713 - RNA, 22 nt, Human
uggcucagugacauuccuccca

SEQ ID NO: 648714 - RNA, 22 nt, Human
gguaggcacuggugggaagaga

SEQ ID NO: 648715 - RNA, 22 nt, Human
uacuaucucuucuaacuucaga

SEQ ID NO: 648716 - RNA, 22 nt, Human
uauguacauggagagcaauuga

SEQ ID NO: 648717 - RNA, 21 nt, Human
cucuucaguggugagcucuuc

SEQ ID NO: 648718 - RNA, 22 nt, Human
ucauugcaguugaguuguguua

SEQ ID NO: 648719 - RNA, 22 nt, Human
cagaaaucuccaugucagacau

SEQ ID NO: 648720 - RNA, 22 nt, Human
uccagcagguccgagacaaguu

SEQ ID NO: 648721 - RNA, 22 nt, Human
uagcuuuacaaagugcugcacc

SEQ ID NO: 648722 - RNA, 22 nt, Human
aggcuuccgaguagcugggacu

SEQ ID NO: 648723 - RNA, 22 nt, Human
agagaaacugauguccuuugaa

SEQ ID NO: 648724 - RNA, 18 nt, Human
augcauauuuuaaguugu

SEQ ID NO: 648725 - RNA, 22 nt, Human
caggaggcaguuucagaaguca

SEQ ID NO: 648726 - RNA, 22 nt, Human
ucuggaauuuuauugaucaaaa

SEQ ID NO: 648727 - RNA, 19 nt, Human
ucucaggcugggcggcugc

SEQ ID NO: 648728 - RNA, 22 nt, Human
uuccuuguucuacaucccugcc

SEQ ID NO: 648729 - RNA, 22 nt, Human
ugcuuauauuuauugggcuuag

SEQ ID NO: 648730 - RNA, 22 nt, Human
uugaguuccaggaugguuguua

SEQ ID NO: 648731 - RNA, 22 nt, Human
uuccuaacacaguguaagcaag

SEQ ID NO: 648732 - RNA, 22 nt, Human
uggcuugucauguaucugaggc

SEQ ID NO: 648733 - RNA, 18 nt, Human
ugauucaaguugcccucc

SEQ ID NO: 648734 - RNA, 22 nt, Human
cugcucugugcacuuguucagg

SEQ ID NO: 648735 - RNA, 20 nt, Human
guauuacaggcuuagaacca

SEQ ID NO: 648736 - RNA, 21 nt, Human
uuguuuccucccaaaaugcca

SEQ ID NO: 648737 - RNA, 22 nt, Human
agagaggcugcuggacuauaug

SEQ ID NO: 648738 - RNA, 22 nt, Human
uaguuuaauggucaacuaauga

SEQ ID NO: 648739 - RNA, 22 nt, Human
cccaggcuggcacugcugaagu

SEQ ID NO: 648740 - RNA, 22 nt, Human
auguguauauuuauuguaguuu

SEQ ID NO: 648741 - RNA, 22 nt, Human
ggcagaaggccucccagcuccu

SEQ ID NO: 648742 - RNA, 18 nt, Human
agcuguuguugacucugu

SEQ ID NO: 648743 - RNA, 23 nt, Human
ucugagagaacaaugccuccuau

SEQ ID NO: 648744 - RNA, 22 nt, Human
auuugcuuggucuucucuccgu

SEQ ID NO: 648745 - RNA, 22 nt, Human
uagauauaagguccuuagaaca

SEQ ID NO: 648746 - RNA, 22 nt, Human
agcuguguuuccagaugguagc

SEQ ID NO: 648747 - RNA, 22 nt, Human
uggcuuccuccagagcaggagg

SEQ ID NO: 648748 - RNA, 20 nt, Human
ugcagggcucugcuucucuc

SEQ ID NO: 648749 - RNA, 22 nt, Human
uuuuagcacacuuucuuuagcg

SEQ ID NO: 648750 - RNA, 22 nt, Human
aagaggacuugugaagauguac

SEQ ID NO: 648751 - RNA, 22 nt, Human
acaggacaaaaaucuggauggc

SEQ ID NO: 648752 - RNA, 22 nt, Human
agugccagcuccacacagcagc

SEQ ID NO: 648753 - RNA, 22 nt, Human
agaaucuaaguacacagacaga

SEQ ID NO: 648754 - RNA, 22 nt, Human
cugaggcucccucgggucugcu

SEQ ID NO: 648755 - RNA, 22 nt, Human
uguuggcacuaucucauguuuu

SEQ ID NO: 648756 - RNA, 20 nt, Human
uccaggcccacucagcugaa

SEQ ID NO: 648757 - RNA, 22 nt, Human
gauuugucuauauucaaauaug

SEQ ID NO: 648758 - RNA, 22 nt, Human
uguacaguaggaacuuguuauu

SEQ ID NO: 648759 - RNA, 22 nt, Human
gggcugagccacagcuuuuguu

SEQ ID NO: 648760 - RNA, 22 nt, Human
cucuugguaagacauuagaggu

SEQ ID NO: 648761 - RNA, 20 nt, Human
aaaaucucccagaaacuuau

SEQ ID NO: 648762 - RNA, 22 nt, Human
aggcucagucuguucaugcacu

SEQ ID NO: 648763 - RNA, 22 nt, Human
aaguugaaucaguaacacaguu

SEQ ID NO: 648764 - RNA, 22 nt, Human
auggagcaaauggggcugcagg

SEQ ID NO: 648765 - RNA, 22 nt, Human
aagaauugguuuccucugucau

SEQ ID NO: 648766 - RNA, 22 nt, Human
auuagaagcgugaauccuuuca

SEQ ID NO: 648767 - RNA, 22 nt, Human
augguggauuugugauucagcu

SEQ ID NO: 648768 - RNA, 22 nt, Human
ucagaaccagcccagcagauga

SEQ ID NO: 648769 - RNA, 22 nt, Human
acacagaggcuccagagauaga

SEQ ID NO: 648770 - RNA, 22 nt, Human
gugggggaugcugaguuggaaa

SEQ ID NO: 648771 - RNA, 22 nt, Human
augauuuccaguuguugcuaag

SEQ ID NO: 648772 - RNA, 20 nt, Human
agcuccaugaaguagucacu

SEQ ID NO: 648773 - RNA, 22 nt, Human
aggggcucaagcaguguggucu

SEQ ID NO: 648774 - RNA, 18 nt, Human
ggccagccccaggccagc

SEQ ID NO: 648775 - RNA, 22 nt, Human
cuacagaguucacaggauuuua

SEQ ID NO: 648776 - RNA, 22 nt, Human
gcccaggaaguugaggcugccg

SEQ ID NO: 648777 - RNA, 22 nt, Human
agcaguuuuagggagacacauu

SEQ ID NO: 648778 - RNA, 22 nt, Human
aucuguggcuggugagaggcag

SEQ ID NO: 648779 - RNA, 22 nt, Human
gagcuaggauaucaugagggua

SEQ ID NO: 648780 - RNA, 22 nt, Human
aacacuaaugggagaacaaccc

SEQ ID NO: 648781 - RNA, 22 nt, Human
cuuaucaaacuggagcaggcuu

SEQ ID NO: 648782 - RNA, 22 nt, Human
accugcccuuaacacugugugc

SEQ ID NO: 648783 - RNA, 22 nt, Human
gucuacaaagcuucaagucucu

SEQ ID NO: 648784 - RNA, 22 nt, Human
gcccaguaguucaagguugcag

SEQ ID NO: 648785 - RNA, 22 nt, Human
ucaagacaucacugugcauuuu

SEQ ID NO: 648786 - RNA, 22 nt, Human
auuugagaugguaaauaacuuu

SEQ ID NO: 648787 - RNA, 22 nt, Human
aggagcaaaugaugagacagca

SEQ ID NO: 648788 - RNA, 22 nt, Human
gccaagcucuuuaaaggccaaa

SEQ ID NO: 648789 - RNA, 22 nt, Human
gcagucauggaaaaauguauac

SEQ ID NO: 648790 - RNA, 22 nt, Human
ugagaccauuugacauacagug

SEQ ID NO: 648791 - RNA, 22 nt, Human
aaacucuauaggcagaagcaau

SEQ ID NO: 648792 - RNA, 22 nt, Human
gggaagggacuuguuuaagguc

SEQ ID NO: 648793 - RNA, 22 nt, Human
uggccaagccacugcugggucu

SEQ ID NO: 648794 - RNA, 22 nt, Human
agcaccuggagggcugggaccu

SEQ ID NO: 648795 - RNA, 22 nt, Human
ucuggcuuuauuccuucacuga

SEQ ID NO: 648796 - RNA, 22 nt, Human
ugcauccuguucuagguuuggg

SEQ ID NO: 648797 - RNA, 22 nt, Human
aaacaauguacacaugaauguu

SEQ ID NO: 648798 - RNA, 22 nt, Human
gacagccaucagcacacgcugc

SEQ ID NO: 648799 - RNA, 23 nt, Human
agguuaugauuauagagcgagga

SEQ ID NO: 648800 - RNA, 22 nt, Human
auuuuuaugacaaaccauccuc

SEQ ID NO: 648801 - RNA, 19 nt, Human
agauggcuuggacugaaaa

SEQ ID NO: 648802 - RNA, 22 nt, Human
auuuauauuuugggagcuccug

SEQ ID NO: 648803 - RNA, 20 nt, Human
cucucccagcacagcuuccu

SEQ ID NO: 648804 - RNA, 18 nt, Human
gcugcugguggagggagc

SEQ ID NO: 648805 - RNA, 22 nt, Human
cacaggaauauaaguuugaguu

SEQ ID NO: 648806 - RNA, 21 nt, Human
cuggccuucaacugauuggau

SEQ ID NO: 648807 - RNA, 22 nt, Human
cuccccagguucaggagguggg

SEQ ID NO: 648808 - RNA, 22 nt, Human
ggccugugucugugccuguccu

SEQ ID NO: 648809 - RNA, 22 nt, Human
aggcagcuggcaaauucuagag

SEQ ID NO: 648810 - RNA, 22 nt, Human
caucacagggggcuagaagucu

SEQ ID NO: 648811 - RNA, 22 nt, Human
caggccugcaggaaaggcuccc

SEQ ID NO: 648812 - RNA, 21 nt, Human
ucauucgauuuccucuaucuc

SEQ ID NO: 648813 - RNA, 22 nt, Human
cagggaugaccagagggaugug

SEQ ID NO: 648814 - RNA, 22 nt, Human
agggccugguucuguguaggga

SEQ ID NO: 648815 - RNA, 22 nt, Human
cagagcagcagagcuuccaugg

SEQ ID NO: 648816 - RNA, 22 nt, Human
ugguggacauucuggaugugcu

SEQ ID NO: 648817 - RNA, 22 nt, Human
aguaacaugaguuuuucuaaug

SEQ ID NO: 648818 - RNA, 22 nt, Human
uccuagagaugcaauuugauuu

SEQ ID NO: 648819 - RNA, 22 nt, Human
auucaagagcccauguuuccug

SEQ ID NO: 648820 - RNA, 22 nt, Human
auacaaaggaacacaggcaugu

SEQ ID NO: 648821 - RNA, 22 nt, Human
acaugcaaaugugcaugcaugu

SEQ ID NO: 648822 - RNA, 22 nt, Human
gcggggggcaggcaguacguug

SEQ ID NO: 648823 - RNA, 22 nt, Human
cuggguggcagagccugcagug

SEQ ID NO: 648824 - RNA, 22 nt, Human
cugcugagcaucagggcugccc

SEQ ID NO: 648825 - RNA, 22 nt, Human
aagagggaaauuguuggcugcu

SEQ ID NO: 648826 - RNA, 22 nt, Human
uccugaggcuaaagugcagugg

SEQ ID NO: 648827 - RNA, 22 nt, Human
ugaggccauggucuucccaguc

SEQ ID NO: 648828 - RNA, 22 nt, Human
agcuccuggggguuccaagcag

SEQ ID NO: 648829 - RNA, 22 nt, Human
ugagcaguaacagcucacaggg

SEQ ID NO: 648830 - RNA, 22 nt, Human
gaacaaugaaagacauaaacuc

SEQ ID NO: 648831 - RNA, 22 nt, Human
ccagcuggugggucuuucucug

SEQ ID NO: 648832 - RNA, 22 nt, Human
gcaugcaugugugcagacaguc

SEQ ID NO: 648833 - RNA, 17 nt, Human
ccugucuuguuucugcc

SEQ ID NO: 648834 - RNA, 22 nt, Human
agaguuuguacuuuacccugag

SEQ ID NO: 648835 - RNA, 22 nt, Human
agguaaugcaacuacuuugcua

SEQ ID NO: 648836 - RNA, 22 nt, Human
uagcaauguguugacuugguca

SEQ ID NO: 648837 - RNA, 19 nt, Human
aaaauugcguauuuugagg

SEQ ID NO: 648838 - RNA, 22 nt, Human
cggcacagccgggcaaggcugg

SEQ ID NO: 648839 - RNA, 22 nt, Human
gugaggcagggaaagaggauaa

SEQ ID NO: 648840 - RNA, 22 nt, Human
uucagugccgugcugggucgcu

SEQ ID NO: 648841 - RNA, 22 nt, Human
acaggaagugggaagaaacagg

SEQ ID NO: 648842 - RNA, 20 nt, Human
ucugucucugagcuagacuu

SEQ ID NO: 648843 - RNA, 22 nt, Human
guggggucucucuguaccuccc

SEQ ID NO: 648844 - RNA, 22 nt, Human
gcugucccuugucccaccuugc

SEQ ID NO: 648845 - RNA, 23 nt, Human
agaaaaacaggauuguguuccua

SEQ ID NO: 648846 - RNA, 20 nt, Human
cagaggaguacauauguuca

SEQ ID NO: 648847 - RNA, 22 nt, Human
ucaggcuguuccuguccaaaau

SEQ ID NO: 648848 - RNA, 22 nt, Human
cucugggaccacgugacucugc

SEQ ID NO: 648849 - RNA, 22 nt, Human
guccaaaagagccagccgggcg

SEQ ID NO: 648850 - RNA, 22 nt, Human
cagagaagagucuggccucucu

SEQ ID NO: 648851 - RNA, 21 nt, Human
ggugcucgcugaugaggagug

SEQ ID NO: 648852 - RNA, 22 nt, Human
cuauuuggccauagugcaguua

SEQ ID NO: 648853 - RNA, 22 nt, Human
uagaacaugggauagaguuuuu

SEQ ID NO: 648854 - RNA, 22 nt, Human
ugggcaguugcuccucagaccc

SEQ ID NO: 648855 - RNA, 22 nt, Human
agcagcucccuccucagccacc

SEQ ID NO: 648856 - RNA, 22 nt, Human
aauguaaagcucaggucaggag

SEQ ID NO: 648857 - RNA, 22 nt, Human
gcgaggcugggcccugcaggcg

SEQ ID NO: 648858 - RNA, 22 nt, Human
gugugccucgccaagcugucgg

SEQ ID NO: 648859 - RNA, 22 nt, Human
gcagccagaagacucagaacaa

SEQ ID NO: 648860 - RNA, 22 nt, Human
cccaaguuaaaauucagugcuc

SEQ ID NO: 648861 - RNA, 22 nt, Human
ucuccugugcacccucccugug

SEQ ID NO: 648862 - RNA, 22 nt, Human
guuaaaugcagauucugacuca

SEQ ID NO: 648863 - RNA, 22 nt, Human
ccuaagauugcaaacucucucc

SEQ ID NO: 648864 - RNA, 22 nt, Human
acaucuuuuuggaaacggcuga

SEQ ID NO: 648865 - RNA, 22 nt, Human
uguguuuguuagacuaauguua

SEQ ID NO: 648866 - RNA, 22 nt, Human
cagggugcagagcuaggguagu

SEQ ID NO: 648867 - RNA, 22 nt, Human
agccaaggacacggagccuccu

SEQ ID NO: 648868 - RNA, 22 nt, Human
ucugcccucauugcugccugga

SEQ ID NO: 648869 - RNA, 22 nt, Human
acugggcuggggcucauucucc

SEQ ID NO: 648870 - RNA, 21 nt, Human
cagaucuguagguacuaccau

SEQ ID NO: 648871 - RNA, 22 nt, Human
caaggacacugauguucauccu

SEQ ID NO: 648872 - RNA, 22 nt, Human
ugggaagcauuaaugauagggg

SEQ ID NO: 648873 - RNA, 22 nt, Human
ucccacccauccugcaucucuu

SEQ ID NO: 648874 - RNA, 22 nt, Human
uucacauugugguucaugugaa

SEQ ID NO: 648875 - RNA, 22 nt, Human
caggaucugccaauauucaacc

SEQ ID NO: 648876 - RNA, 22 nt, Human
uccaggccgcaggggcagcccc

SEQ ID NO: 648877 - RNA, 22 nt, Human
agcugcaggccucuccugggga

SEQ ID NO: 648878 - RNA, 22 nt, Human
uuucacagcuuccacuuaagga

SEQ ID NO: 648879 - RNA, 22 nt, Human
aggugcuguuugucagcaguuu

SEQ ID NO: 648880 - RNA, 22 nt, Human
gugcugaacuauaaaaagcuuu

SEQ ID NO: 648881 - RNA, 22 nt, Human
ugggcucaagugaugcuccugu

SEQ ID NO: 648882 - RNA, 22 nt, Human
uaaagcaggcaucucucuccuc

SEQ ID NO: 648883 - RNA, 21 nt, Human
ccucuggcuugugcugugccc

SEQ ID NO: 648884 - RNA, 22 nt, Human
cagcaggccaugcugcuuuuca

SEQ ID NO: 648885 - RNA, 22 nt, Human
ucaauauucuucuuuaguagga

SEQ ID NO: 648886 - RNA, 22 nt, Human
caggcacaugggagcucaucau

SEQ ID NO: 648887 - RNA, 22 nt, Human
uggaggaugccuggggaggccu

SEQ ID NO: 648888 - RNA, 22 nt, Human
aacuuucaggcaaugaauauuu

SEQ ID NO: 648889 - RNA, 23 nt, Human
aacucuggcuagcauagaauaga

SEQ ID NO: 648890 - RNA, 22 nt, Human
cacauuuaauccuuuauaagua

SEQ ID NO: 648891 - RNA, 22 nt, Human
ucucagagaaaugugucaccau

SEQ ID NO: 648892 - RNA, 22 nt, Human
agggcuguguuugcacccucug

SEQ ID NO: 648893 - RNA, 22 nt, Human
guacacacuauguauuguacac

SEQ ID NO: 648894 - RNA, 22 nt, Human
aaaggcagugugauacuguggu

SEQ ID NO: 648895 - RNA, 22 nt, Human
ucagcagggcauacugagccua

SEQ ID NO: 648896 - RNA, 22 nt, Human
cagucaggggugggaucaaggc

SEQ ID NO: 648897 - RNA, 22 nt, Human
aauucugcuucaucagcucuuu

SEQ ID NO: 648898 - RNA, 23 nt, Human
gcccucccucccagguggguguu

SEQ ID NO: 648899 - RNA, 22 nt, Human
ggccugucucacccccgggugc

SEQ ID NO: 648900 - RNA, 22 nt, Human
ggucccaggcucccucuugucc

SEQ ID NO: 648901 - RNA, 22 nt, Human
gcuggagucuggaggugugcca

SEQ ID NO: 648902 - RNA, 22 nt, Human
ucuucacauggaacaugaagcu

SEQ ID NO: 648903 - RNA, 20 nt, Human
ugcugaggccugaggccugg

SEQ ID NO: 648904 - RNA, 22 nt, Human
ucaugcagaggaaggcuaguuu

SEQ ID NO: 648905 - RNA, 22 nt, Human
ccuaccaguaggaggccagaga

SEQ ID NO: 648906 - RNA, 22 nt, Human
gccaagaaugcgacagccguca

SEQ ID NO: 648907 - RNA, 22 nt, Human
ugccaggcuaaguggaggacuu

SEQ ID NO: 648908 - RNA, 22 nt, Human
uguuuuuuuauauaccugaagu

SEQ ID NO: 648909 - RNA, 22 nt, Human
cuggagcuggcccaggcuggcc

SEQ ID NO: 648910 - RNA, 22 nt, Human
acacugacugggcaguauaguc

SEQ ID NO: 648911 - RNA, 22 nt, Human
aggagauggagcucagugggca

SEQ ID NO: 648912 - RNA, 22 nt, Human
gcuggagccaagcugcucuugg

SEQ ID NO: 648913 - RNA, 22 nt, Human
uccaggcaugucccaagccgga

SEQ ID NO: 648914 - RNA, 19 nt, Human
cuggcugcaaugccagggu

SEQ ID NO: 648915 - RNA, 22 nt, Human
aaaugagguuaauacagugcuu

SEQ ID NO: 648916 - RNA, 22 nt, Human
ugaaacauuaggaaaucauuau

SEQ ID NO: 648917 - RNA, 22 nt, Human
uuuugugauggcauuacauuua

SEQ ID NO: 648918 - RNA, 22 nt, Human
agcccugguuugcagcauuugc

SEQ ID NO: 648919 - RNA, 22 nt, Human
agaguuuacagaaauaagcugu

SEQ ID NO: 648920 - RNA, 22 nt, Human
gggccacacagggcagcucccu

SEQ ID NO: 648921 - RNA, 22 nt, Human
uggaaggcaugggaacuguucu

SEQ ID NO: 648922 - RNA, 22 nt, Human
acagugagauccaagggcaggc

SEQ ID NO: 648923 - RNA, 22 nt, Human
agccuggagcuugaguuaugag

SEQ ID NO: 648924 - RNA, 22 nt, Human
aacagauggccaagugcauggg

SEQ ID NO: 648925 - RNA, 22 nt, Human
ucauugaaagugccuccucgga

SEQ ID NO: 648926 - RNA, 22 nt, Human
agagccaggcucuaccuggguu

SEQ ID NO: 648927 - RNA, 22 nt, Human
aaaguuacccaaucucuaugaa

SEQ ID NO: 648928 - RNA, 22 nt, Human
acuggccaggcagcaguagcuu

SEQ ID NO: 648929 - RNA, 21 nt, Human
ucugucagaaaagcugaggcu

SEQ ID NO: 648930 - RNA, 22 nt, Human
caagacuucaccgcucugugcu

SEQ ID NO: 648931 - RNA, 22 nt, Human
gagcaguggucacagggaggga

SEQ ID NO: 648932 - RNA, 22 nt, Human
augcauaucagugauuguuugc

SEQ ID NO: 648933 - RNA, 22 nt, Human
cauaacauccuugcuacuuuga

SEQ ID NO: 648934 - RNA, 22 nt, Human
gcuuucugaugagcuuaagaaa

SEQ ID NO: 648935 - RNA, 22 nt, Human
uuaaggaaacauuuuuccauag

SEQ ID NO: 648936 - RNA, 22 nt, Human
gauggcuuguuuucuggcugaa

SEQ ID NO: 648937 - RNA, 22 nt, Human
uauggcuuuucauuccuaugug

SEQ ID NO: 648938 - RNA, 22 nt, Human
cucagggucugguccuuagauu

SEQ ID NO: 648939 - RNA, 22 nt, Human
ucacccaagaccaucggaagug

SEQ ID NO: 648940 - RNA, 22 nt, Human
agacagugcaagaagagcaggc

SEQ ID NO: 648941 - RNA, 22 nt, Human
cccgggagguggagacugcagu

SEQ ID NO: 648942 - RNA, 22 nt, Human
gacagggcaagacucugucuaa

SEQ ID NO: 648943 - RNA, 22 nt, Human
aaccagugaaacaccaggcaag

SEQ ID NO: 648944 - RNA, 22 nt, Human
aacaugucuuuagagaaacauu

SEQ ID NO: 648945 - RNA, 22 nt, Human
cucugggugagacagaccuggu

SEQ ID NO: 648946 - RNA, 22 nt, Human
aggcugugcgaggucucagagu

SEQ ID NO: 648947 - RNA, 22 nt, Human
uucagagggacauucaagggaa

SEQ ID NO: 648948 - RNA, 22 nt, Human
caguggagagacuuuuacucuu

SEQ ID NO: 648949 - RNA, 17 nt, Human
ugggggcgccagggucu

SEQ ID NO: 648950 - RNA, 22 nt, Human
ugaauaugauugcaaauuuggc

SEQ ID NO: 648951 - RNA, 22 nt, Human
acagggaacaggaauauacaaa

SEQ ID NO: 648952 - RNA, 20 nt, Human
ugcagcugcaggaggguggg

SEQ ID NO: 648953 - RNA, 22 nt, Human
ccaggcucagggcagacuuuca

SEQ ID NO: 648954 - RNA, 22 nt, Human
guaagcaaacagcaaaugauuu

SEQ ID NO: 648955 - RNA, 22 nt, Human
uaagauuuuuaaaauguccuca

SEQ ID NO: 648956 - RNA, 22 nt, Human
cugcuagcccaggaugcaggga

SEQ ID NO: 648957 - RNA, 22 nt, Human
agaaggaaacagcugugcuuug

SEQ ID NO: 648958 - RNA, 22 nt, Human
agccacagguguuggccagugu

SEQ ID NO: 648959 - RNA, 22 nt, Human
ucugagcccucuuuugcagccc

SEQ ID NO: 648960 - RNA, 21 nt, Human
ugagcaggugcagggaagugg

SEQ ID NO: 648961 - RNA, 22 nt, Human
agggaagcccuggcugagaccc

SEQ ID NO: 648962 - RNA, 22 nt, Human
gcccugcuccuccgucccacga

SEQ ID NO: 648963 - RNA, 22 nt, Human
aggagggugggaagcaguuuua

SEQ ID NO: 648964 - RNA, 22 nt, Human
uggcccuggguggaauguccca

SEQ ID NO: 648965 - RNA, 22 nt, Human
caaaacugucuagagagagaag

SEQ ID NO: 648966 - RNA, 22 nt, Human
gggaggugauggcaagcagcgg

SEQ ID NO: 648967 - RNA, 23 nt, Human
cuggccuccgacacuggccaaga

SEQ ID NO: 648968 - RNA, 22 nt, Human
augcuaaauaacugguuugacu

SEQ ID NO: 648969 - RNA, 22 nt, Human
acagucuaaucuuguguucugu

SEQ ID NO: 648970 - RNA, 22 nt, Human
caaagguauaaguuaauauaca

SEQ ID NO: 648971 - RNA, 22 nt, Human
uugagguaguucuauugugagu

SEQ ID NO: 648972 - RNA, 19 nt, Human
uguguguauuucaguucuu

SEQ ID NO: 648973 - RNA, 22 nt, Human
ugaucccaaucuuuccugcucc

SEQ ID NO: 648974 - RNA, 22 nt, Human
gugcugagcugcagaugcgcuc

SEQ ID NO: 648975 - RNA, 22 nt, Human
ccugcccccgucagaggugaug

SEQ ID NO: 648976 - RNA, 22 nt, Human
ugaacaacagauguccauuguu

SEQ ID NO: 648977 - RNA, 22 nt, Human
augcugugcuggcuaaccaugg

SEQ ID NO: 648978 - RNA, 22 nt, Human
aacagcuuugugcucagauuug

SEQ ID NO: 648979 - RNA, 22 nt, Human
cagucuggcacagcacacugaa

SEQ ID NO: 648980 - RNA, 22 nt, Human
ggagaggagauuguggcauuuu

SEQ ID NO: 648981 - RNA, 22 nt, Human
cauguuucugagaaaaguagga

SEQ ID NO: 648982 - RNA, 22 nt, Human
ugugugcucuaaugccuaguac

SEQ ID NO: 648983 - RNA, 22 nt, Human
ccuuuuuucuaugccaacucug

SEQ ID NO: 648984 - RNA, 22 nt, Human
aacaugcuggguguuuuugaug

SEQ ID NO: 648985 - RNA, 23 nt, Human
gaacuguugaugaauagaauaua

SEQ ID NO: 648986 - RNA, 22 nt, Human
ugccuggcaagaggggcuggcu

SEQ ID NO: 648987 - RNA, 22 nt, Human
cugcagggccauggguucuaua

SEQ ID NO: 648988 - RNA, 22 nt, Human
uuuucauugagcaccugaguaa

SEQ ID NO: 648989 - RNA, 22 nt, Human
cauucccugucucuucaauccu

SEQ ID NO: 648990 - RNA, 22 nt, Human
aaagucauuggaauauuaauga

SEQ ID NO: 648991 - RNA, 22 nt, Human
acuucucuuuaguacuaaaugu

SEQ ID NO: 648992 - RNA, 22 nt, Human
aucuuucagagcuccaucaggg

SEQ ID NO: 648993 - RNA, 22 nt, Human
auuucacucauucauguuacuu

SEQ ID NO: 648994 - RNA, 22 nt, Human
cccaucaggaacccaggagccc

SEQ ID NO: 648995 - RNA, 22 nt, Human
cucuguacaggagacaucucua

SEQ ID NO: 648996 - RNA, 23 nt, Human
ucuuuuuaagagaucuagugacg

SEQ ID NO: 648997 - RNA, 22 nt, Human
gcaaaguauuaaccaacaggau

SEQ ID NO: 648998 - RNA, 22 nt, Human
uuacauguaaucuaaaauaauu

SEQ ID NO: 648999 - RNA, 17 nt, Human
aaacuggggucaggagc

SEQ ID NO: 649000 - RNA, 22 nt, Human
ucuguucaugaaauaucuuuuu

SEQ ID NO: 649001 - RNA, 22 nt, Human
cuuguggcccauggcuuccugc

SEQ ID NO: 649002 - RNA, 22 nt, Human
caagaaauucuguucagauagc

SEQ ID NO: 649003 - RNA, 22 nt, Human
ugacaacaaggauccugccugg

SEQ ID NO: 649004 - RNA, 22 nt, Human
guuuuguuuugagucaacucca

SEQ ID NO: 649005 - RNA, 22 nt, Human
gggcaguagcuucguaggcauc

SEQ ID NO: 649006 - RNA, 22 nt, Human
uuucaguugccaagcuaauucu

SEQ ID NO: 649007 - RNA, 23 nt, Human
ucucagugaaucucagaauucgc

SEQ ID NO: 649008 - RNA, 22 nt, Human
ucugggaaccagugcggcuggg

SEQ ID NO: 649009 - RNA, 22 nt, Human
aaacaugcuggauuuagaauau

SEQ ID NO: 649010 - RNA, 22 nt, Human
agagccagcaagugaauaguga

SEQ ID NO: 649011 - RNA, 22 nt, Human
gaacacagcagggauaaccacu

SEQ ID NO: 649012 - RNA, 22 nt, Human
auucccaccaagcaggccaugc

SEQ ID NO: 649013 - RNA, 22 nt, Human
ugagccagguuaagacaggagc

SEQ ID NO: 649014 - RNA, 23 nt, Human
acccaucucuccugucaugcaga

SEQ ID NO: 649015 - RNA, 22 nt, Human
ccugaauaauuugugaaaagau

SEQ ID NO: 649016 - RNA, 19 nt, Human
ccuccccuuggaccagcaa

SEQ ID NO: 649017 - RNA, 22 nt, Human
ggucucuuugcuucagcuacag

SEQ ID NO: 649018 - RNA, 22 nt, Human
uuaggaaauuaugguuucagau

SEQ ID NO: 649019 - RNA, 20 nt, Human
ucucuuuuagcuuacagcug

SEQ ID NO: 649020 - RNA, 22 nt, Human
gcuauguguguuuugcugcagc

SEQ ID NO: 649021 - RNA, 22 nt, Human
uaugucuggaccacugcagccc

SEQ ID NO: 649022 - RNA, 23 nt, Human
aggucaaccacaagcugacaaac

SEQ ID NO: 649023 - RNA, 20 nt, Human
cuguuuauuagaaguggauu

SEQ ID NO: 649024 - RNA, 22 nt, Human
cuaggaaagacacagagaguuu

SEQ ID NO: 649025 - RNA, 22 nt, Human
uuucucaaguucagauauuuga

SEQ ID NO: 649026 - RNA, 22 nt, Human
acuuagcacgaacauuuacuuu

SEQ ID NO: 649027 - RNA, 22 nt, Human
uuuuagaaguucaugugggauu

SEQ ID NO: 649028 - RNA, 22 nt, Human
cccugcaggggaccugcagccu

SEQ ID NO: 649029 - RNA, 22 nt, Human
aggaccaacauagcagcagugg

SEQ ID NO: 649030 - RNA, 16 nt, Human
acagugugcuaagcau

SEQ ID NO: 649031 - RNA, 20 nt, Human
ccacaugagcucuuucugac

SEQ ID NO: 649032 - RNA, 22 nt, Human
gggcuucuugcaggggcaacau

SEQ ID NO: 649033 - RNA, 22 nt, Human
cugcacaguggguggggcguca

SEQ ID NO: 649034 - RNA, 18 nt, Human
aggccaaacuuguaagca

SEQ ID NO: 649035 - RNA, 22 nt, Human
caaugucuucuauaguuacuca

SEQ ID NO: 649036 - RNA, 20 nt, Human
gccacugugcuuacacugcu

SEQ ID NO: 649037 - RNA, 22 nt, Human
auguucauuuucuuaaugugcc

SEQ ID NO: 649038 - RNA, 22 nt, Human
uuggcauuggagaugcaagaac

SEQ ID NO: 649039 - RNA, 22 nt, Human
agccagggaggauuacacccca

SEQ ID NO: 649040 - RNA, 22 nt, Human
aaaaccagacacuguuucuggg

SEQ ID NO: 649041 - RNA, 22 nt, Human
agugcccugggccuuccaggac

SEQ ID NO: 649042 - RNA, 22 nt, Human
cagggcuuuuuauuagcugccu

SEQ ID NO: 649043 - RNA, 22 nt, Human
cauuuuaagaugaccugguuuc

SEQ ID NO: 649044 - RNA, 22 nt, Human
gugauguggggaccguccuggc

SEQ ID NO: 649045 - RNA, 22 nt, Human
aggcaggccgugucccuccuca

SEQ ID NO: 649046 - RNA, 22 nt, Human
uguuuauaccugcaaccuguca

SEQ ID NO: 649047 - RNA, 21 nt, Human
uccagcacagaugaccucccc

SEQ ID NO: 649048 - RNA, 22 nt, Human
cugucccacaagcagugugcac

SEQ ID NO: 649049 - RNA, 22 nt, Human
cacaauuuuccuuuaaguguau

SEQ ID NO: 649050 - RNA, 22 nt, Human
cugaaaauguuagugauacgaa

SEQ ID NO: 649051 - RNA, 22 nt, Human
gugugugucuccgcggccguag

SEQ ID NO: 649052 - RNA, 22 nt, Human
aggcuccacccuacagagcucc

SEQ ID NO: 649053 - RNA, 22 nt, Human
uucugggcaggacuggggaccc

SEQ ID NO: 649054 - RNA, 22 nt, Human
gugcaaaaguaauuacaguuuu

SEQ ID NO: 649055 - RNA, 21 nt, Human
augcauguuccauaaaguggg

SEQ ID NO: 649056 - RNA, 22 nt, Human
cuuccugaagagguuggucagg

SEQ ID NO: 649057 - RNA, 22 nt, Human
ugaguguggggaaugucaugag

SEQ ID NO: 649058 - RNA, 22 nt, Human
acaagagacaagagguucuucu

SEQ ID NO: 649059 - RNA, 22 nt, Human
ccagggcaaaugagaucauagc

SEQ ID NO: 649060 - RNA, 18 nt, Human
uaacauguuuucauuaag

SEQ ID NO: 649061 - RNA, 22 nt, Human
uguuuguggaauauucuuuaag

SEQ ID NO: 649062 - RNA, 22 nt, Human
ccaguggcuacagggggguuga

SEQ ID NO: 649063 - RNA, 22 nt, Human
aagguauaucugauccaugagg

SEQ ID NO: 649064 - RNA, 22 nt, Human
ugccugcucugugccacaguug

SEQ ID NO: 649065 - RNA, 19 nt, Human
ugcaaauucuaaaaacuga

SEQ ID NO: 649066 - RNA, 17 nt, Human
cucuccuuccucugagg

SEQ ID NO: 649067 - RNA, 21 nt, Human
uuacuuuugcagcaaccuaau

SEQ ID NO: 649068 - RNA, 22 nt, Human
ugccucaguuucuccauaugaa

SEQ ID NO: 649069 - RNA, 22 nt, Human
gcugggagcaaguacucaucuu

SEQ ID NO: 649070 - RNA, 22 nt, Human
cauuuguuaaccaguguggauu

SEQ ID NO: 649071 - RNA, 22 nt, Human
agcaguuuuccugagcuccuca

SEQ ID NO: 649072 - RNA, 22 nt, Human
cucugggcacuguauggguucu

SEQ ID NO: 649073 - RNA, 22 nt, Human
cucaguuugaaugcugacacug

SEQ ID NO: 649074 - RNA, 22 nt, Human
cauguugaauggccuugauuuu

SEQ ID NO: 649075 - RNA, 22 nt, Human
uucggucuggcuguuauacgcu

SEQ ID NO: 649076 - RNA, 22 nt, Human
auauauaagcugaugagccaca

SEQ ID NO: 649077 - RNA, 22 nt, Human
ugcugaggucauuuccaaguga

SEQ ID NO: 649078 - RNA, 22 nt, Human
ucaguccuccucucauagagag

SEQ ID NO: 649079 - RNA, 20 nt, Human
aggcuggcacuccuggccag

SEQ ID NO: 649080 - RNA, 22 nt, Human
ggacauggaaguauggagugga

SEQ ID NO: 649081 - RNA, 19 nt, Human
gcccucaggcagcuccauc

SEQ ID NO: 649082 - RNA, 22 nt, Human
cacagcuuaugccacugauugg

SEQ ID NO: 649083 - RNA, 20 nt, Human
agcaggaaugaugcuuucau

SEQ ID NO: 649084 - RNA, 22 nt, Human
ggccuugggcagacacgucaca

SEQ ID NO: 649085 - RNA, 22 nt, Human
cucacagcacuugugucauugg

SEQ ID NO: 649086 - RNA, 22 nt, Human
uauuggcagcaugagcuccugg

SEQ ID NO: 649087 - RNA, 22 nt, Human
agggcagcaaugcagcugcugc

SEQ ID NO: 649088 - RNA, 22 nt, Human
ccugaguccccucauucacucu

SEQ ID NO: 649089 - RNA, 22 nt, Human
agcugcuuuuagggccgggcuc

SEQ ID NO: 649090 - RNA, 22 nt, Human
ggcacagcccucucuguggaca

SEQ ID NO: 649091 - RNA, 22 nt, Human
guuaacuuccccaugucugcau

SEQ ID NO: 649092 - RNA, 22 nt, Human
gcaguaggagaagaggaugcuu

SEQ ID NO: 649093 - RNA, 22 nt, Human
gauuuccuagacauggggcaga

SEQ ID NO: 649094 - RNA, 22 nt, Human
cauucauaagacuuugcucuug

SEQ ID NO: 649095 - RNA, 22 nt, Human
ugaucugguccuacugugggca

SEQ ID NO: 649096 - RNA, 22 nt, Human
gagccaaggguugccauggaga

SEQ ID NO: 649097 - RNA, 19 nt, Human
ucucucuguacauuagaua

SEQ ID NO: 649098 - RNA, 22 nt, Human
cccacuguguugcagucuagug

SEQ ID NO: 649099 - RNA, 22 nt, Human
uucaaacucugaguaguucugc

SEQ ID NO: 649100 - RNA, 21 nt, Human
aauccuuaaugaggaguuggu

SEQ ID NO: 649101 - RNA, 22 nt, Human
cuuacagugaucaacacaaaga

SEQ ID NO: 649102 - RNA, 22 nt, Human
cagcagagcuuauguuggguca

SEQ ID NO: 649103 - RNA, 22 nt, Human
acucuacuguaguaugggcacu

SEQ ID NO: 649104 - RNA, 22 nt, Human
cucagggaugggcagauguuaa

SEQ ID NO: 649105 - RNA, 22 nt, Human
aagagaauacaagcaggcagga

SEQ ID NO: 649106 - RNA, 22 nt, Human
uuggaaauggcuguaguuauga

SEQ ID NO: 649107 - RNA, 22 nt, Human
caugcuucaugcaaaauucuga

SEQ ID NO: 649108 - RNA, 22 nt, Human
gagggagugccagagggccagc

SEQ ID NO: 649109 - RNA, 22 nt, Human
gagagacccagacaccaugcau

SEQ ID NO: 649110 - RNA, 22 nt, Human
aggcauggauguagcagugacc

SEQ ID NO: 649111 - RNA, 22 nt, Human
caggguugguuucuccucaggc

SEQ ID NO: 649112 - RNA, 18 nt, Human
aaaaugcaggcgacaugg

SEQ ID NO: 649113 - RNA, 22 nt, Human
aaacucuagcuacuaggauaac

SEQ ID NO: 649114 - RNA, 22 nt, Human
gugcugcucaagggacaggaca

SEQ ID NO: 649115 - RNA, 22 nt, Human
ucucaucuuuaaaugaaaauuu

SEQ ID NO: 649116 - RNA, 20 nt, Human
ucuugagaacaauuucuggc

SEQ ID NO: 649117 - RNA, 22 nt, Human
caguaugucuacuggacaaagu

SEQ ID NO: 649118 - RNA, 22 nt, Human
gaaggcauuuuaugccuuauag

SEQ ID NO: 649119 - RNA, 22 nt, Human
agcaaggcugggucuaaugggg

SEQ ID NO: 649120 - RNA, 22 nt, Human
uguccugggaacucacagucca

SEQ ID NO: 649121 - RNA, 22 nt, Human
auccuuggcagcucagaccuac

SEQ ID NO: 649122 - RNA, 20 nt, Human
cugcacugaacaugucugag

SEQ ID NO: 649123 - RNA, 22 nt, Human
ggucugugugcuuugggaagug

SEQ ID NO: 649124 - RNA, 22 nt, Human
guggagaccuccuaggaugugu

SEQ ID NO: 649125 - RNA, 22 nt, Human
cucuguguuaaauuggguuuuu

SEQ ID NO: 649126 - RNA, 22 nt, Human
agcacagauucugaagaguccu

SEQ ID NO: 649127 - RNA, 22 nt, Human
auccuuccagaguuauucucaa

SEQ ID NO: 649128 - RNA, 22 nt, Human
uugcacagaugagggugaugcu

SEQ ID NO: 649129 - RNA, 23 nt, Human
ucucugcauguccugagcacauc

SEQ ID NO: 649130 - RNA, 22 nt, Human
ggcuucugcucagccugcacgc

SEQ ID NO: 649131 - RNA, 22 nt, Human
ucccugugucuuccucuugccc

SEQ ID NO: 649132 - RNA, 22 nt, Human
ugugugauugcacuuauaugag

SEQ ID NO: 649133 - RNA, 22 nt, Human
aggcacugcuucuaaguaggaa

SEQ ID NO: 649134 - RNA, 22 nt, Human
cagcugcccugccuugcccuua

SEQ ID NO: 649135 - RNA, 22 nt, Human
auuucucaguaggugcacagug

SEQ ID NO: 649136 - RNA, 22 nt, Human
cugaggugugaaaugguggcaa

SEQ ID NO: 649137 - RNA, 22 nt, Human
aguugugagaaacagaaugagc

SEQ ID NO: 649138 - RNA, 22 nt, Human
agacuaaaagaaggaagcuacc

SEQ ID NO: 649139 - RNA, 22 nt, Human
gugcccugaucgcuaggcuccc

SEQ ID NO: 649140 - RNA, 22 nt, Human
aaauuuuagaccaggcaaaacu

SEQ ID NO: 649141 - RNA, 22 nt, Human
gucccacaccuugaggggucuu

SEQ ID NO: 649142 - RNA, 22 nt, Human
cuggguagggcaaggaacuggc

SEQ ID NO: 649143 - RNA, 22 nt, Human
caggcuaaagcuuugagcaugu

SEQ ID NO: 649144 - RNA, 22 nt, Human
ggcugcagguugguuggcagcu

SEQ ID NO: 649145 - RNA, 22 nt, Human
ugagcagaaguuauaaauaaga

SEQ ID NO: 649146 - RNA, 22 nt, Human
gcugugcaguaguagguacagu

SEQ ID NO: 649147 - RNA, 20 nt, Human
ugucaugcauuagaugaaga

SEQ ID NO: 649148 - RNA, 22 nt, Human
auacuucuagaaauacuaugca

SEQ ID NO: 649149 - RNA, 22 nt, Human
aucucugcaucccucaagguug

SEQ ID NO: 649150 - RNA, 22 nt, Human
aagugcuuuacaaaugucuguu

SEQ ID NO: 649151 - RNA, 22 nt, Human
gcugccucugcgacucugggcg

SEQ ID NO: 649152 - RNA, 22 nt, Human
gaggaaagcugguuuaaaguau

SEQ ID NO: 649153 - RNA, 22 nt, Human
aucacauauuuaagaaacaugu

SEQ ID NO: 649154 - RNA, 22 nt, Human
gcagagauccuugcuggaugac

SEQ ID NO: 649155 - RNA, 22 nt, Human
ugguccugaucaccgcugggca

SEQ ID NO: 649156 - RNA, 20 nt, Human
ccagcacccucucagcugaa

SEQ ID NO: 649157 - RNA, 22 nt, Human
gugagccaguucgacuguuucu

SEQ ID NO: 649158 - RNA, 22 nt, Human
ugguauuuaagacuucacuccu

SEQ ID NO: 649159 - RNA, 22 nt, Human
ucuuucugaugggaagggucaa

SEQ ID NO: 649160 - RNA, 22 nt, Human
uacuuuuugucucuuugaaugu

SEQ ID NO: 649161 - RNA, 18 nt, Human
uuucacagauucaugacu

SEQ ID NO: 649162 - RNA, 22 nt, Human
cuucuccucugaguccugggag

SEQ ID NO: 649163 - RNA, 22 nt, Human
uguuuuauuucuccaagaggga

SEQ ID NO: 649164 - RNA, 22 nt, Human
ggagcccuagcugugcaucaga

SEQ ID NO: 649165 - RNA, 22 nt, Human
aucagaauggagcccacauggu

SEQ ID NO: 649166 - RNA, 22 nt, Human
aucuguguccuuauaagagaca

SEQ ID NO: 649167 - RNA, 22 nt, Human
ugggcagggagcuggaaccaca

SEQ ID NO: 649168 - RNA, 22 nt, Human
ccugaucaaguuuucuggcucc

SEQ ID NO: 649169 - RNA, 22 nt, Human
augcauucauucauucuuucua

SEQ ID NO: 649170 - RNA, 22 nt, Human
gacaggggucccucugggcugu

SEQ ID NO: 649171 - RNA, 22 nt, Human
ucccugggguaucgcugaggca

SEQ ID NO: 649172 - RNA, 20 nt, Human
agaaguggcugcagacacua

SEQ ID NO: 649173 - RNA, 22 nt, Human
cuaaauaaucccucuggucuua

SEQ ID NO: 649174 - RNA, 23 nt, Human
ucuguguccuccuggaccacaga

SEQ ID NO: 649175 - RNA, 22 nt, Human
ccagcuggcacuguggcugccc

SEQ ID NO: 649176 - RNA, 22 nt, Human
agcuguggucuucaaguugccu

SEQ ID NO: 649177 - RNA, 22 nt, Human
augcuuuauuauuuugcaggga

SEQ ID NO: 649178 - RNA, 23 nt, Human
acuacagauacuccugcuguuug

SEQ ID NO: 649179 - RNA, 22 nt, Human
caggagacaaguuagcagcuga

SEQ ID NO: 649180 - RNA, 22 nt, Human
uacaaaguagaaauucaguaaa

SEQ ID NO: 649181 - RNA, 22 nt, Human
gcuuguuugugauuucuccaga

SEQ ID NO: 649182 - RNA, 22 nt, Human
ccccaccauguagaaacugaga

SEQ ID NO: 649183 - RNA, 22 nt, Human
cugggacaugauagaaacagau

SEQ ID NO: 649184 - RNA, 22 nt, Human
gacagcagacaaaccauguuuu

SEQ ID NO: 649185 - RNA, 22 nt, Human
uguuaacauacugcuuucuaau

SEQ ID NO: 649186 - RNA, 22 nt, Human
gcauggcagccaguacauggug

SEQ ID NO: 649187 - RNA, 22 nt, Human
gaguaaaaguuggauuacaaag

SEQ ID NO: 649188 - RNA, 22 nt, Human
gcuggucagagagaaaggaggc

SEQ ID NO: 649189 - RNA, 22 nt, Human
ggaaaacuguauuugaauaacu

SEQ ID NO: 649190 - RNA, 22 nt, Human
agaaagggucacugaaagagga

SEQ ID NO: 649191 - RNA, 22 nt, Human
uguaacagcucuccaugugggg

SEQ ID NO: 649192 - RNA, 22 nt, Human
cauauuagacacuuauguccac

SEQ ID NO: 649193 - RNA, 22 nt, Human
uucauuuuauaaacccugcuga

SEQ ID NO: 649194 - RNA, 22 nt, Human
auucugaguccaugggggcagg

SEQ ID NO: 649195 - RNA, 22 nt, Human
ggggcacuuuacugccucaucu

SEQ ID NO: 649196 - RNA, 22 nt, Human
cugcagcagugugucucauuuu

SEQ ID NO: 649197 - RNA, 22 nt, Human
uuugucaaguuugcaaauacgu

SEQ ID NO: 649198 - RNA, 19 nt, Human
gacuaaauaauaauagcag

SEQ ID NO: 649199 - RNA, 22 nt, Human
ggacugucuccuugcugguagg

SEQ ID NO: 649200 - RNA, 22 nt, Human
uuacaaaguucugaguucaaac

SEQ ID NO: 649201 - RNA, 22 nt, Human
ccuuuacaucugacuucuuuca

SEQ ID NO: 649202 - RNA, 22 nt, Human
ccuggaggagcgcugaccagcu

SEQ ID NO: 649203 - RNA, 22 nt, Human
gcagcuguacuggcagcauugu

SEQ ID NO: 649204 - RNA, 22 nt, Human
cagcugucugcugaaggaagcu

SEQ ID NO: 649205 - RNA, 22 nt, Human
cuccuucagcugaaucccugcu

SEQ ID NO: 649206 - RNA, 22 nt, Human
agcuucucucaggguaucuuuc

SEQ ID NO: 649207 - RNA, 19 nt, Human
acccagcccaggaguggca

SEQ ID NO: 649208 - RNA, 22 nt, Human
gcugggagccguaccugucacg

SEQ ID NO: 649209 - RNA, 22 nt, Human
cacaggccugggguugagcggg

SEQ ID NO: 649210 - RNA, 22 nt, Human
aagugaaucuccuuucuuuauu

SEQ ID NO: 649211 - RNA, 21 nt, Human
auucugagucuuggggucuca

SEQ ID NO: 649212 - RNA, 22 nt, Human
ccugggcucaagcgaucuuguc

SEQ ID NO: 649213 - RNA, 22 nt, Human
ccacaggggcccacgagccgcu

SEQ ID NO: 649214 - RNA, 22 nt, Human
cucucuguauguguauauuuau

SEQ ID NO: 649215 - RNA, 22 nt, Human
uaaagguaugucuuaaucaaac

SEQ ID NO: 649216 - RNA, 22 nt, Human
uagcuaauggugaagauucaga

SEQ ID NO: 649217 - RNA, 22 nt, Human
ccugggagccaagccucugugu

SEQ ID NO: 649218 - RNA, 22 nt, Human
cacacugacuggaaucaaggau

SEQ ID NO: 649219 - RNA, 22 nt, Human
guauuagaagaaauuauaggua

SEQ ID NO: 649220 - RNA, 22 nt, Human
uuguuucauggggauguuuauu

SEQ ID NO: 649221 - RNA, 23 nt, Human
caguacuuaguguagcguuaauu

SEQ ID NO: 649222 - RNA, 22 nt, Human
aaacaaacauagguuugaaagu

SEQ ID NO: 649223 - RNA, 22 nt, Human
ugcaggagagugagucaguagg

SEQ ID NO: 649224 - RNA, 22 nt, Human
aacuuuucauugaaucauguca

SEQ ID NO: 649225 - RNA, 22 nt, Human
acucagcacagcacugggaacc

SEQ ID NO: 649226 - RNA, 22 nt, Human
aagcugccuugcugaggagaaa

SEQ ID NO: 649227 - RNA, 19 nt, Human
uuuuaagugcccuuucuuc

SEQ ID NO: 649228 - RNA, 22 nt, Human
augaagaaaaauccagcugucc

SEQ ID NO: 649229 - RNA, 22 nt, Human
gcaauacugagauuauuguacu

SEQ ID NO: 649230 - RNA, 22 nt, Human
ccugcagaccacacucaguccu

SEQ ID NO: 649231 - RNA, 22 nt, Human
aaggcucaauuaacuaagaagu

SEQ ID NO: 649232 - RNA, 22 nt, Human
auuuccuaggguagaugucaca

SEQ ID NO: 649233 - RNA, 22 nt, Human
uuugcaaacacuuaagaagaga

SEQ ID NO: 649234 - RNA, 22 nt, Human
ugugugauugcaggagaugugg

SEQ ID NO: 649235 - RNA, 17 nt, Human
cucagagcaggacagaa

SEQ ID NO: 649236 - RNA, 21 nt, Human
ggccuuccccugcagucuccg

SEQ ID NO: 649237 - RNA, 22 nt, Human
uauuuggaaauagggcuuugua

SEQ ID NO: 649238 - RNA, 22 nt, Human
uugcuuccuuuacagaugggca

SEQ ID NO: 649239 - RNA, 22 nt, Human
aagucuguuugagugucacacu

SEQ ID NO: 649240 - RNA, 22 nt, Human
guccagagggcugcaggaugcu

SEQ ID NO: 649241 - RNA, 22 nt, Human
gagagguggugaggacuugucu

SEQ ID NO: 649242 - RNA, 22 nt, Human
uugcaaaucuuugccagaaggc

SEQ ID NO: 649243 - RNA, 22 nt, Human
ugcuuuauucagucucugccau

SEQ ID NO: 649244 - RNA, 18 nt, Human
ucaaaauauuucugugga

SEQ ID NO: 649245 - RNA, 22 nt, Human
agccauugaauuuagugccuuu

SEQ ID NO: 649246 - RNA, 22 nt, Human
ucgaaggaaccucaauuuucgu

SEQ ID NO: 649247 - RNA, 23 nt, Human
ucaguuuuggcuguucaguguug

SEQ ID NO: 649248 - RNA, 22 nt, Human
agcugggaggugggcagugaga

SEQ ID NO: 649249 - RNA, 22 nt, Human
ucggagcuguagaugaaacccu

SEQ ID NO: 649250 - RNA, 23 nt, Human
ugagaagccgccgggcagccugg

SEQ ID NO: 649251 - RNA, 19 nt, Human
uccccagcaccucugaguc

SEQ ID NO: 649252 - RNA, 22 nt, Human
agccucucuguuagucacuggg

SEQ ID NO: 649253 - RNA, 19 nt, Human
gcugcagaggugaagaaga

SEQ ID NO: 649254 - RNA, 22 nt, Human
cugcagggcccaaggucaacgg

SEQ ID NO: 649255 - RNA, 22 nt, Human
aagccagguguugugguaagag

SEQ ID NO: 649256 - RNA, 22 nt, Human
ucagcaguggguccugagggug

SEQ ID NO: 649257 - RNA, 22 nt, Human
cacagaaguuucauagucucga

SEQ ID NO: 649258 - RNA, 22 nt, Human
guuauugcaguauagaggucua

SEQ ID NO: 649259 - RNA, 22 nt, Human
aacaucaucaugaacaacuaau

SEQ ID NO: 649260 - RNA, 22 nt, Human
gaguuuaaagcauacauauuuu

SEQ ID NO: 649261 - RNA, 22 nt, Human
gguucacuccgaucucugccuc

SEQ ID NO: 649262 - RNA, 22 nt, Human
caggugcccagcuccugcugug

SEQ ID NO: 649263 - RNA, 22 nt, Human
agaugauuaugauagcacuguu

SEQ ID NO: 649264 - RNA, 22 nt, Human
ggcuccuucaaagcaccuggcu

SEQ ID NO: 649265 - RNA, 22 nt, Human
agugaaauagcauuuaugaagc

SEQ ID NO: 649266 - RNA, 23 nt, Human
agcugaggcugugggugucagag

SEQ ID NO: 649267 - RNA, 22 nt, Human
ccugcguccacggcugggagac

SEQ ID NO: 649268 - RNA, 22 nt, Human
uuccagaggggagguggcagcc

SEQ ID NO: 649269 - RNA, 22 nt, Human
aagaacuguaucaagauguagu

SEQ ID NO: 649270 - RNA, 22 nt, Human
gagaugcuauggcuauuccccu

SEQ ID NO: 649271 - RNA, 22 nt, Human
uuuacagaugaggauacugagg

SEQ ID NO: 649272 - RNA, 22 nt, Human
gagcccugauuugcagcauuug

SEQ ID NO: 649273 - RNA, 22 nt, Human
agcacagaaaguauugacugaa

SEQ ID NO: 649274 - RNA, 22 nt, Human
gcugugcagguccccacugccu

SEQ ID NO: 649275 - RNA, 21 nt, Human
ugcuuaccgccccagggcucc

SEQ ID NO: 649276 - RNA, 22 nt, Human
agauauauuuaagguaauaagu

SEQ ID NO: 649277 - RNA, 19 nt, Human
auagcuugucagcugcucc

SEQ ID NO: 649278 - RNA, 22 nt, Human
gccagagccggcuucacaggau

SEQ ID NO: 649279 - RNA, 22 nt, Human
auacacagccauuaugaauuag

SEQ ID NO: 649280 - RNA, 22 nt, Human
cagcaggaggugaguagcaggu

SEQ ID NO: 649281 - RNA, 21 nt, Human
ggucccauugugaggcuugaa

SEQ ID NO: 649282 - RNA, 22 nt, Human
aggaauguggcaaucuucaagu

SEQ ID NO: 649283 - RNA, 22 nt, Human
agaaacugcagcucagagaagu

SEQ ID NO: 649284 - RNA, 17 nt, Human
cuuugcagcagacaugu

SEQ ID NO: 649285 - RNA, 22 nt, Human
gccuggaguagcauggcaagcc

SEQ ID NO: 649286 - RNA, 22 nt, Human
cuucacaaagcucucuuuaugu

SEQ ID NO: 649287 - RNA, 22 nt, Human
cuucuugucagugauuucuucc

SEQ ID NO: 649288 - RNA, 22 nt, Human
auaaacuugagucucagaguau

SEQ ID NO: 649289 - RNA, 22 nt, Human
agcaacaggcauaauguguuga

SEQ ID NO: 649290 - RNA, 22 nt, Human
uacagcccaagaaguuuauacg

SEQ ID NO: 649291 - RNA, 22 nt, Human
uucauucagguguauuuauggg

SEQ ID NO: 649292 - RNA, 22 nt, Human
ucagacaugggauaugaagcuc

SEQ ID NO: 649293 - RNA, 22 nt, Human
aagggaggaggauuuauuguac

SEQ ID NO: 649294 - RNA, 22 nt, Human
cuggcuguuucaaauguauaga

SEQ ID NO: 649295 - RNA, 22 nt, Human
gugaggcaggcauucuccuuuc

SEQ ID NO: 649296 - RNA, 22 nt, Human
ggagauggcuggcagguagaug

SEQ ID NO: 649297 - RNA, 22 nt, Human
caggaugugaggaggccauuug

SEQ ID NO: 649298 - RNA, 22 nt, Human
uccuugggucagugagugaggu

SEQ ID NO: 649299 - RNA, 22 nt, Human
aagauuguuuuggaugcuaacu

SEQ ID NO: 649300 - RNA, 22 nt, Human
ucugaguuacacaagcaagggu

SEQ ID NO: 649301 - RNA, 22 nt, Human
gugggcagauuauagaugaugc

SEQ ID NO: 649302 - RNA, 22 nt, Human
uucuaaaauaaguuuaucuggu

SEQ ID NO: 649303 - RNA, 22 nt, Human
uuuccaggcagaggaguuguga

SEQ ID NO: 649304 - RNA, 22 nt, Human
uucucuggguuaggggaacuau

SEQ ID NO: 649305 - RNA, 22 nt, Human
uccacgcugugugaccuugggc

SEQ ID NO: 649306 - RNA, 22 nt, Human
ucagagaaucucuccuuaguuu

SEQ ID NO: 649307 - RNA, 22 nt, Human
gcuaccugagcaagagcuucaa

SEQ ID NO: 649308 - RNA, 20 nt, Human
gauuacaaaaugaaaugcau

SEQ ID NO: 649309 - RNA, 22 nt, Human
caguacuuauuucuauuuaggg

SEQ ID NO: 649310 - RNA, 22 nt, Human
ugcuggccuguccacgggcugu

SEQ ID NO: 649311 - RNA, 22 nt, Human
aauaaacaaaucuuuccugugg

SEQ ID NO: 649312 - RNA, 22 nt, Human
cagcucuuuuucacacaacaug

SEQ ID NO: 649313 - RNA, 22 nt, Human
uggucagcguuugucagagcag

SEQ ID NO: 649314 - RNA, 22 nt, Human
caugcuuuucaaucuaucuuaa

SEQ ID NO: 649315 - RNA, 22 nt, Human
aggcugaugcuggcugaggcug

SEQ ID NO: 649316 - RNA, 22 nt, Human
guuuauuaacugucaagugauu

SEQ ID NO: 649317 - RNA, 22 nt, Human
ccaggcagaaugaaaccccugu

SEQ ID NO: 649318 - RNA, 22 nt, Human
cugggguggaggagcuccccug

SEQ ID NO: 649319 - RNA, 22 nt, Human
cauggaggccaggaaacagccu

SEQ ID NO: 649320 - RNA, 22 nt, Human
ugacauaaguugguagaaagga

SEQ ID NO: 649321 - RNA, 20 nt, Human
ggcugcugugggcagagagg

SEQ ID NO: 649322 - RNA, 22 nt, Human
ggaaaguggugguggaaagagg

SEQ ID NO: 649323 - RNA, 19 nt, Human
auuucaagagguuuauugg

SEQ ID NO: 649324 - RNA, 22 nt, Human
acagcaggcaugaagaaauguu

SEQ ID NO: 649325 - RNA, 21 nt, Human
ggaacuuucaugaaucuagca

SEQ ID NO: 649326 - RNA, 22 nt, Human
augauugcagcccuacagcugu

SEQ ID NO: 649327 - RNA, 21 nt, Human
uagagaugacgagcucuagca

SEQ ID NO: 649328 - RNA, 22 nt, Human
uccacccagcacacugugguag

SEQ ID NO: 649329 - RNA, 22 nt, Human
gagcaggaaggccagaaggguc

SEQ ID NO: 649330 - RNA, 22 nt, Human
acagaugagaagcugcauucaa

SEQ ID NO: 649331 - RNA, 22 nt, Human
uguccaggugugucuaaagaga

SEQ ID NO: 649332 - RNA, 22 nt, Human
caggaugggugucggccagcac

SEQ ID NO: 649333 - RNA, 22 nt, Human
aaguuucuguaugcucuucugu

SEQ ID NO: 649334 - RNA, 22 nt, Human
caggaaggcccaccuguccugu

SEQ ID NO: 649335 - RNA, 22 nt, Human
ggccucugcuuaugcugaugac

SEQ ID NO: 649336 - RNA, 22 nt, Human
auccuuaaaggaauucugauuu

SEQ ID NO: 649337 - RNA, 22 nt, Human
caagagcuggagaggcagucua

SEQ ID NO: 649338 - RNA, 21 nt, Human
uaaacauaaccuuguauggcu

SEQ ID NO: 649339 - RNA, 23 nt, Human
uccauacucuaaacauguuauuu

SEQ ID NO: 649340 - RNA, 22 nt, Human
ggacgcagccgagggagcaggg

SEQ ID NO: 649341 - RNA, 21 nt, Human
acauacauuaucuuuuuaaaa

SEQ ID NO: 649342 - RNA, 22 nt, Human
uggcccugaggggcugugcccc

SEQ ID NO: 649343 - RNA, 22 nt, Human
ggccucuggucaagacaagcau

SEQ ID NO: 649344 - RNA, 22 nt, Human
aaagcauuucaugucuagaaag

SEQ ID NO: 649345 - RNA, 22 nt, Human
gauggaggagauggcagggugc

SEQ ID NO: 649346 - RNA, 22 nt, Human
agcagacagguaggaggauaaa

SEQ ID NO: 649347 - RNA, 22 nt, Human
uccuauugguagacauuucugu

SEQ ID NO: 649348 - RNA, 22 nt, Human
gcacccacuuaggccagucaau

SEQ ID NO: 649349 - RNA, 22 nt, Human
aggauaaaugaucuagauuuuc

SEQ ID NO: 649350 - RNA, 22 nt, Human
uccacacuugcugucugcugag

SEQ ID NO: 649351 - RNA, 17 nt, Human
ucagagggaugagcagg

SEQ ID NO: 649352 - RNA, 22 nt, Human
cagcuggcaaguggagcagggu

SEQ ID NO: 649353 - RNA, 22 nt, Human
uuuacacggcauuaucuucaug

SEQ ID NO: 649354 - RNA, 22 nt, Human
ucuuucuggucucgccuuauuc

SEQ ID NO: 649355 - RNA, 20 nt, Human
gggcuagaccagggcagagg

SEQ ID NO: 649356 - RNA, 23 nt, Human
uucugcauguuucagagcuggga

SEQ ID NO: 649357 - RNA, 22 nt, Human
cccaggucucccugcagcccug

SEQ ID NO: 649358 - RNA, 22 nt, Human
aaacuacaucucauggaugagg

SEQ ID NO: 649359 - RNA, 22 nt, Human
aaucuuggcaaauguagcuucc

SEQ ID NO: 649360 - RNA, 22 nt, Human
uguguagugauuuucuuccaac

SEQ ID NO: 649361 - RNA, 22 nt, Human
ucacauuguucuuaguuuaccu

SEQ ID NO: 649362 - RNA, 22 nt, Human
cgggcgcacuccgggcagcugu

SEQ ID NO: 649363 - RNA, 22 nt, Human
uccagagcuguaugauuuuuuu

SEQ ID NO: 649364 - RNA, 23 nt, Human
ugagcugggccugcaggggucuc

SEQ ID NO: 649365 - RNA, 22 nt, Human
gaaauauuucucuugagccccu

SEQ ID NO: 649366 - RNA, 22 nt, Human
uucaaucauugcaaaguaaugg

SEQ ID NO: 649367 - RNA, 22 nt, Human
gggaacagagugccagacugac

SEQ ID NO: 649368 - RNA, 22 nt, Human
cuccuuugaucccaaaugaccc

SEQ ID NO: 649369 - RNA, 22 nt, Human
uucugggcaccaccacagacuu

SEQ ID NO: 649370 - RNA, 22 nt, Human
uagguucagugucuuguucugc

SEQ ID NO: 649371 - RNA, 22 nt, Human
gaagcagcaaaucugcaguauc

SEQ ID NO: 649372 - RNA, 22 nt, Human
aggaugugccaccagcuuugca

SEQ ID NO: 649373 - RNA, 22 nt, Human
aagacuugaccagguugaaggc

SEQ ID NO: 649374 - RNA, 22 nt, Human
uaucaugaucagcaacuaauca

SEQ ID NO: 649375 - RNA, 22 nt, Human
acagucucuguugcugcuguuu

SEQ ID NO: 649376 - RNA, 22 nt, Human
uggcauguugauaauggagaag

SEQ ID NO: 649377 - RNA, 22 nt, Human
aaauaugugaucagugaauaaa

SEQ ID NO: 649378 - RNA, 22 nt, Human
aggaugagaagauuggaaucuu

SEQ ID NO: 649379 - RNA, 22 nt, Human
ugugcuauuuuugcauaugugu

SEQ ID NO: 649380 - RNA, 22 nt, Human
agaaaucugacugcugugcaca

SEQ ID NO: 649381 - RNA, 22 nt, Human
guggcacauugguagggucugu

SEQ ID NO: 649382 - RNA, 22 nt, Human
ugaaaugaaacagaacauauca

SEQ ID NO: 649383 - RNA, 22 nt, Human
cagaaagcagagcugagccuuu

SEQ ID NO: 649384 - RNA, 22 nt, Human
caauguuugugaucuacugacu

SEQ ID NO: 649385 - RNA, 22 nt, Human
uguucuguaccuguccuggggc

SEQ ID NO: 649386 - RNA, 22 nt, Human
auggaauauagucuuauaucuc

SEQ ID NO: 649387 - RNA, 22 nt, Human
ucauaggaguagcagugagagg

SEQ ID NO: 649388 - RNA, 22 nt, Human
cagcuggcuuguuuguucuuga

SEQ ID NO: 649389 - RNA, 22 nt, Human
cugggucucuuuagggugccgu

SEQ ID NO: 649390 - RNA, 20 nt, Human
gcucugugguuugagucucc

SEQ ID NO: 649391 - RNA, 22 nt, Human
uccccacaucucugcaucaggc

SEQ ID NO: 649392 - RNA, 22 nt, Human
agugggugauaagaccaaggag

SEQ ID NO: 649393 - RNA, 19 nt, Human
agucaucucacugugccca

SEQ ID NO: 649394 - RNA, 22 nt, Human
cuaaggaaaggaaauacaguaa

SEQ ID NO: 649395 - RNA, 22 nt, Human
ggcugcaggcaggguauccacu

SEQ ID NO: 649396 - RNA, 22 nt, Human
gaaauguugucucugcagcaau

SEQ ID NO: 649397 - RNA, 22 nt, Human
uuggaaggggcagaguggcugc

SEQ ID NO: 649398 - RNA, 22 nt, Human
ucaacugauuuagucugugcca

SEQ ID NO: 649399 - RNA, 22 nt, Human
guauuagacugagaaauggagu

SEQ ID NO: 649400 - RNA, 19 nt, Human
gcacacccugcaccaccau

SEQ ID NO: 649401 - RNA, 22 nt, Human
ccagauaucacugccguguugu

SEQ ID NO: 649402 - RNA, 22 nt, Human
ggcugggagccccacagaguca

SEQ ID NO: 649403 - RNA, 22 nt, Human
cauggcuuuugcuuuugcccau

SEQ ID NO: 649404 - RNA, 19 nt, Human
ccuagagcaguaccuggua

SEQ ID NO: 649405 - RNA, 22 nt, Human
uggcagggucuugcuguguugc

SEQ ID NO: 649406 - RNA, 22 nt, Human
acguuuucuagagaauaugcag

SEQ ID NO: 649407 - RNA, 22 nt, Human
gcagccaggggcugugaccugu

SEQ ID NO: 649408 - RNA, 22 nt, Human
cucccucagaggagcaccuguu

SEQ ID NO: 649409 - RNA, 22 nt, Human
auguagggaacuaaauucacug

SEQ ID NO: 649410 - RNA, 22 nt, Human
uucuuuggggucuccagcauag

SEQ ID NO: 649411 - RNA, 22 nt, Human
ugcccugugccagacuuccugg

SEQ ID NO: 649412 - RNA, 22 nt, Human
gcagggcagcugaagcuaggug

SEQ ID NO: 649413 - RNA, 19 nt, Human
uuuucccacccuuuagaau

SEQ ID NO: 649414 - RNA, 22 nt, Human
gaaggaaaaauacucuguaagg

SEQ ID NO: 649415 - RNA, 21 nt, Human
aguccuugaaacucuuucuug

SEQ ID NO: 649416 - RNA, 22 nt, Human
cucccucaggccuuagcccugc

SEQ ID NO: 649417 - RNA, 22 nt, Human
caagaaggcuauaugggccagg

SEQ ID NO: 649418 - RNA, 22 nt, Human
aaaugucuguuagucauaucau

SEQ ID NO: 649419 - RNA, 22 nt, Human
aucauggaagccuaucuugaga

SEQ ID NO: 649420 - RNA, 22 nt, Human
gcugugggccauggccaaguga

SEQ ID NO: 649421 - RNA, 22 nt, Human
cugaauaauuuucuguuguaug

SEQ ID NO: 649422 - RNA, 22 nt, Human
augugugugaugggcgccgcca

SEQ ID NO: 649423 - RNA, 22 nt, Human
uggcuucucaguuucauaauga

SEQ ID NO: 649424 - RNA, 22 nt, Human
uuuuauucucagcuccagagag

SEQ ID NO: 649425 - RNA, 22 nt, Human
gcaaugucuagucugagggcuu

SEQ ID NO: 649426 - RNA, 21 nt, Human
gauuugcagaaacuagacagg

SEQ ID NO: 649427 - RNA, 17 nt, Human
cuauuuuggagauuaaa

SEQ ID NO: 649428 - RNA, 22 nt, Human
cauaaguugcagagggugcauu

SEQ ID NO: 649429 - RNA, 22 nt, Human
gacaggcccgaguagcugauga

SEQ ID NO: 649430 - RNA, 22 nt, Human
aacacugagcuauuacggugga

SEQ ID NO: 649431 - RNA, 20 nt, Human
augcccuguccucuucuguu

SEQ ID NO: 649432 - RNA, 22 nt, Human
gaggacgggcuucauggggccu

SEQ ID NO: 649433 - RNA, 22 nt, Human
guuuuuauuguguaaauguggg

SEQ ID NO: 649434 - RNA, 22 nt, Human
aggcagagcugauguucuguga

SEQ ID NO: 649435 - RNA, 22 nt, Human
aaaucucacuguagucaaagug

SEQ ID NO: 649436 - RNA, 22 nt, Human
auagcauauaaguuauaaaacu

SEQ ID NO: 649437 - RNA, 22 nt, Human
uguaucuguuuagcacccagcc

SEQ ID NO: 649438 - RNA, 22 nt, Human
ggccaccucugcccuacugagu

SEQ ID NO: 649439 - RNA, 22 nt, Human
caggcagcgcucguggccuggc

SEQ ID NO: 649440 - RNA, 22 nt, Human
uaauucuuguucagagguagua

SEQ ID NO: 649441 - RNA, 22 nt, Human
caagaccucaaaaugagagggg

SEQ ID NO: 649442 - RNA, 22 nt, Human
ucccagggauuaggacauggau

SEQ ID NO: 649443 - RNA, 18 nt, Human
ugggcugccuggccucug

SEQ ID NO: 649444 - RNA, 22 nt, Human
cccugcuuucaaccuucuagcu

SEQ ID NO: 649445 - RNA, 22 nt, Human
uauauauaugcacacacaccua

SEQ ID NO: 649446 - RNA, 22 nt, Human
auuauauugaguauaaccagag

SEQ ID NO: 649447 - RNA, 22 nt, Human
ggaaggcugugcaguguuugca

SEQ ID NO: 649448 - RNA, 22 nt, Human
ucucuuggagguucuuccuguu

SEQ ID NO: 649449 - RNA, 22 nt, Human
uaugauauucuaaauugacacc

SEQ ID NO: 649450 - RNA, 22 nt, Human
uggaaagagguagaggaucugg

SEQ ID NO: 649451 - RNA, 22 nt, Human
aggcucagagagcuguguccau

SEQ ID NO: 649452 - RNA, 22 nt, Human
gaaccugagcccagguggcauu

SEQ ID NO: 649453 - RNA, 22 nt, Human
ccugagguuauccaucuaccug

SEQ ID NO: 649454 - RNA, 22 nt, Human
auuuuguuauaggagcugaaau

SEQ ID NO: 649455 - RNA, 22 nt, Human
aacuuguaaugaaaggcaauag

SEQ ID NO: 649456 - RNA, 17 nt, Human
uaguaaaugaguagagc

SEQ ID NO: 649457 - RNA, 19 nt, Human
aggucuaaucauaagacaa

SEQ ID NO: 649458 - RNA, 22 nt, Human
gcagaggcaaucagguaugugg

SEQ ID NO: 649459 - RNA, 22 nt, Human
agacaggccacucuggucuggu

SEQ ID NO: 649460 - RNA, 22 nt, Human
caaagugcugagauuacaggua

SEQ ID NO: 649461 - RNA, 22 nt, Human
ugggaagcuacucaugcaggca

SEQ ID NO: 649462 - RNA, 17 nt, Human
gcucugccucucccacc

SEQ ID NO: 649463 - RNA, 22 nt, Human
ucucagcugccugcccugcucc

SEQ ID NO: 649464 - RNA, 22 nt, Human
cuucucuggcagaugugugucc

SEQ ID NO: 649465 - RNA, 22 nt, Human
agcuggaacuggguuuguugga

SEQ ID NO: 649466 - RNA, 22 nt, Human
ugggggagauuagagcuucuua

SEQ ID NO: 649467 - RNA, 22 nt, Human
uucuaacuggcuugacaguuuc

SEQ ID NO: 649468 - RNA, 22 nt, Human
aauuuagauugauaaacaugga

SEQ ID NO: 649469 - RNA, 22 nt, Human
uuccaaaguuauucaagcagua

SEQ ID NO: 649470 - RNA, 22 nt, Human
ugggcucugcaucagugcccau

SEQ ID NO: 649471 - RNA, 22 nt, Human
caaguccucgcuucuagcugug

SEQ ID NO: 649472 - RNA, 22 nt, Human
uaaauacuuaguuuugugucua

SEQ ID NO: 649473 - RNA, 18 nt, Human
agcagagagugaauggga

SEQ ID NO: 649474 - RNA, 22 nt, Human
cccccuggcaggcuggccucuc

SEQ ID NO: 649475 - RNA, 22 nt, Human
cccagcucucucaguucugcuu

SEQ ID NO: 649476 - RNA, 22 nt, Human
cagcucugcuuccuuguacagg

SEQ ID NO: 649477 - RNA, 22 nt, Human
augaacucuucugguuauuuuu

SEQ ID NO: 649478 - RNA, 18 nt, Human
agcccagcggagugaauc

SEQ ID NO: 649479 - RNA, 22 nt, Human
gcaggcuugggacgagcuggag

SEQ ID NO: 649480 - RNA, 22 nt, Human
acaguggaugugauguccaggu

SEQ ID NO: 649481 - RNA, 22 nt, Human
ccauuguaaagaguauacuuug

SEQ ID NO: 649482 - RNA, 22 nt, Human
gaugugggguugagggaccagc

SEQ ID NO: 649483 - RNA, 22 nt, Human
ugugaauggacaauuaaaucua

SEQ ID NO: 649484 - RNA, 22 nt, Human
gacagcugaacaggugggauaa

SEQ ID NO: 649485 - RNA, 22 nt, Human
caucauuuguuugcaugcagga

SEQ ID NO: 649486 - RNA, 22 nt, Human
gugcaaaaguaauugcaguuuu

SEQ ID NO: 649487 - RNA, 22 nt, Human
agaaacugaacacaagagucgg

SEQ ID NO: 649488 - RNA, 22 nt, Human
aucucugauuuacagcaucucu

SEQ ID NO: 649489 - RNA, 22 nt, Human
uuuuuacacuuagcauugagcg

SEQ ID NO: 649490 - RNA, 22 nt, Human
agggaggaaggaacuccuucua

SEQ ID NO: 649491 - RNA, 22 nt, Human
ugacaaagugaggucuucagua

SEQ ID NO: 649492 - RNA, 22 nt, Human
aaagagaaaaagaucccggcuc

SEQ ID NO: 649493 - RNA, 22 nt, Human
aguccagucucacucuuggcag

SEQ ID NO: 649494 - RNA, 22 nt, Human
caucacaucagugugaacaguu

SEQ ID NO: 649495 - RNA, 22 nt, Human
uguaauggaagugggauugcau

SEQ ID NO: 649496 - RNA, 22 nt, Human
agguuggcugcucuuuuccuaa

SEQ ID NO: 649497 - RNA, 23 nt, Human
cacugcagcguggucuggcagga

SEQ ID NO: 649498 - RNA, 22 nt, Human
aaggcaggaugcggacccaucu

SEQ ID NO: 649499 - RNA, 19 nt, Human
ggcuucaguuuagcaggcu

SEQ ID NO: 649500 - RNA, 21 nt, Human
agguacaggucuugugagucu

SEQ ID NO: 649501 - RNA, 22 nt, Human
gcuguggguacaaauacacaau

SEQ ID NO: 649502 - RNA, 20 nt, Human
agcacauuaaacauacuccu

SEQ ID NO: 649503 - RNA, 22 nt, Human
ucacugcuuucaaaaauuauug

SEQ ID NO: 649504 - RNA, 22 nt, Human
uugcuuuaacuaguaaaugggg

SEQ ID NO: 649505 - RNA, 22 nt, Human
aguuuuauuaaauccacagaag

SEQ ID NO: 649506 - RNA, 22 nt, Human
acagaugguuauugucauuucu

SEQ ID NO: 649507 - RNA, 22 nt, Human
ccuuggugaucugggcuggaag

SEQ ID NO: 649508 - RNA, 22 nt, Human
guuuucucaucuccucaauggu

SEQ ID NO: 649509 - RNA, 22 nt, Human
cagcaucucacuucccagaagg

SEQ ID NO: 649510 - RNA, 22 nt, Human
agaaagugaacguguucaguuu

SEQ ID NO: 649511 - RNA, 22 nt, Human
ucagaaaugaucguuauucauu

SEQ ID NO: 649512 - RNA, 22 nt, Human
aucaaagugauuuguaaacagg

SEQ ID NO: 649513 - RNA, 22 nt, Human
aggauaaaggucauuauuccca

SEQ ID NO: 649514 - RNA, 22 nt, Human
uugaggcauuacuguaaugaga

SEQ ID NO: 649515 - RNA, 22 nt, Human
uuucuuuaggcuguguugccaa

SEQ ID NO: 649516 - RNA, 22 nt, Human
ucacacauucuagguauguuga

SEQ ID NO: 649517 - RNA, 22 nt, Human
aacaggcuuuuggaaaguuaca

SEQ ID NO: 649518 - RNA, 22 nt, Human
cccagggcuugagucauccaug

SEQ ID NO: 649519 - RNA, 22 nt, Human
cuggccugaucucaugcugucc

SEQ ID NO: 649520 - RNA, 22 nt, Human
ggaugugaaucugggcugagac

SEQ ID NO: 649521 - RNA, 22 nt, Human
agggagcucuaaguagagggac

SEQ ID NO: 649522 - RNA, 22 nt, Human
ccagggcuccccagaaguaccc

SEQ ID NO: 649523 - RNA, 22 nt, Human
ccaggacuucgaggcuacagug

SEQ ID NO: 649524 - RNA, 20 nt, Human
aauaaacuacugagagaugu

SEQ ID NO: 649525 - RNA, 22 nt, Human
augaaugaugccaguugaaaug

SEQ ID NO: 649526 - RNA, 22 nt, Human
gauauuuuuaguauuucugccu

SEQ ID NO: 649527 - RNA, 22 nt, Human
gugcagggcuggcaccggaggc

SEQ ID NO: 649528 - RNA, 22 nt, Human
gcugagguaggagguugcagug

SEQ ID NO: 649529 - RNA, 22 nt, Human
ucuggcuugaacaauuagguaa

SEQ ID NO: 649530 - RNA, 22 nt, Human
ugggaggaucgcuugagcccag

SEQ ID NO: 649531 - RNA, 18 nt, Human
auguguggcuuggggucc

SEQ ID NO: 649532 - RNA, 22 nt, Human
agggaugacucuuggcugauuc

SEQ ID NO: 649533 - RNA, 20 nt, Human
ucugcaaacaaguuuuagac

SEQ ID NO: 649534 - RNA, 22 nt, Human
guguuuagugugcagacaugca

SEQ ID NO: 649535 - RNA, 22 nt, Human
caguggcugagaguggacacug

SEQ ID NO: 649536 - RNA, 22 nt, Human
aguguggauuggcuggagcuau

SEQ ID NO: 649537 - RNA, 22 nt, Human
aguuuacauaaaaaggcagagg

SEQ ID NO: 649538 - RNA, 22 nt, Human
uacauucccccaauuaccaaug

SEQ ID NO: 649539 - RNA, 22 nt, Human
cagaggaacguuuggauugauu

SEQ ID NO: 649540 - RNA, 22 nt, Human
gagguugggaugagggauacag

SEQ ID NO: 649541 - RNA, 21 nt, Human
ugaaugagcaucuggacuuuu

SEQ ID NO: 649542 - RNA, 22 nt, Human
uccuucagccaugggcucucca

SEQ ID NO: 649543 - RNA, 22 nt, Human
aggucauuacaauuaucauuuu

SEQ ID NO: 649544 - RNA, 22 nt, Human
acauguauacaauguguaauga

SEQ ID NO: 649545 - RNA, 22 nt, Human
guggggcucccaucuccuggcu

SEQ ID NO: 649546 - RNA, 22 nt, Human
gagaagcaaucaguggccaccc

SEQ ID NO: 649547 - RNA, 22 nt, Human
ucuggcagagucagugcacaca

SEQ ID NO: 649548 - RNA, 22 nt, Human
gaauacaccaaggaaucagaau

SEQ ID NO: 649549 - RNA, 22 nt, Human
aguaugcauauuucaaaguaag

SEQ ID NO: 649550 - RNA, 22 nt, Human
aaaggcacuagaaguuaccuuu

SEQ ID NO: 649551 - RNA, 22 nt, Human
acccucaagauggaagcaguuu

SEQ ID NO: 649552 - RNA, 22 nt, Human
cagagcagagugauuguucugg

SEQ ID NO: 649553 - RNA, 22 nt, Human
ugcaggagcugcuguccugcuc

SEQ ID NO: 649554 - RNA, 22 nt, Human
uucuuuugggaauuacguaugc

SEQ ID NO: 649555 - RNA, 22 nt, Human
ugcagccucucugcuucaggaa

SEQ ID NO: 649556 - RNA, 22 nt, Human
uaucuuaaaugcaugauagaca

SEQ ID NO: 649557 - RNA, 22 nt, Human
uaagaacaguguuucaucucua

SEQ ID NO: 649558 - RNA, 22 nt, Human
auugcaaucuggugaaaacagu

SEQ ID NO: 649559 - RNA, 22 nt, Human
aauuucagaacccaaauuagcg

SEQ ID NO: 649560 - RNA, 22 nt, Human
uccaggccuaggccaagugauu

SEQ ID NO: 649561 - RNA, 22 nt, Human
ccgggggacuacugggaaacug

SEQ ID NO: 649562 - RNA, 23 nt, Human
aaccagauaaauggcuccagggc

SEQ ID NO: 649563 - RNA, 22 nt, Human
acacauauauacauauuugugc

SEQ ID NO: 649564 - RNA, 23 nt, Human
ucauuucacagugagcuuccuag

SEQ ID NO: 649565 - RNA, 22 nt, Human
aaaaccaaguuuuccuuagucu

SEQ ID NO: 649566 - RNA, 22 nt, Human
acucagaagauauaaugacuca

SEQ ID NO: 649567 - RNA, 21 nt, Human
cugcuuccucucuucauggca

SEQ ID NO: 649568 - RNA, 20 nt, Human
ugcuggaggcgccggcgcuc

SEQ ID NO: 649569 - RNA, 22 nt, Human
aagagggcagcacagguggguc

SEQ ID NO: 649570 - RNA, 22 nt, Human
uaucuuuauuaugucuaucugc

SEQ ID NO: 649571 - RNA, 22 nt, Human
ucccaggaaggauucggcauuu

SEQ ID NO: 649572 - RNA, 22 nt, Human
ccaaaccauccaucuccaggcu

SEQ ID NO: 649573 - RNA, 22 nt, Human
ugccucaggcaccuggcagguu

SEQ ID NO: 649574 - RNA, 22 nt, Human
cugugaguucauugugccaccu

SEQ ID NO: 649575 - RNA, 22 nt, Human
uuacuacagagagagcuccagu

SEQ ID NO: 649576 - RNA, 22 nt, Human
uguuacagugacuaauguuuua

SEQ ID NO: 649577 - RNA, 22 nt, Human
gagcugagcuuaacuccuugaa

SEQ ID NO: 649578 - RNA, 22 nt, Human
uucacacuuuggaauuccaccu

SEQ ID NO: 649579 - RNA, 22 nt, Human
auguuauugaugccugaggcuu

SEQ ID NO: 649580 - RNA, 23 nt, Human
cugugugugccgaggguggccac

SEQ ID NO: 649581 - RNA, 22 nt, Human
acacaguucuuucacuguuggu

SEQ ID NO: 649582 - RNA, 22 nt, Human
ggguguccagggcgugucugga

SEQ ID NO: 649583 - RNA, 22 nt, Human
gcaacagcauucucauugacau

SEQ ID NO: 649584 - RNA, 22 nt, Human
uacagacaaagagcaugcggua

SEQ ID NO: 649585 - RNA, 22 nt, Human
aaccuguuuugauuaacaagua

SEQ ID NO: 649586 - RNA, 22 nt, Human
auccugugcaaugacugcaucu

SEQ ID NO: 649587 - RNA, 22 nt, Human
uuauucugucaaacuuauacau

SEQ ID NO: 649588 - RNA, 22 nt, Human
ccccagggucaguguguggagg

SEQ ID NO: 649589 - RNA, 22 nt, Human
gggcuggaggaccggccucgga

SEQ ID NO: 649590 - RNA, 22 nt, Human
uguguacuugaaagggcagguc

SEQ ID NO: 649591 - RNA, 22 nt, Human
guggccaggacauugccaggca

SEQ ID NO: 649592 - RNA, 22 nt, Human
aaccccgcucaggcugggugag

SEQ ID NO: 649593 - RNA, 22 nt, Human
uuauaguauuagguacucaaca

SEQ ID NO: 649594 - RNA, 22 nt, Human
aaacuacacuuugggaccagca

SEQ ID NO: 649595 - RNA, 22 nt, Human
ggcagcaguuacaaaugugcag

SEQ ID NO: 649596 - RNA, 22 nt, Human
cugggcaccuuugcagcaggcu

SEQ ID NO: 649597 - RNA, 22 nt, Human
agagcagcacguuguccccaca

SEQ ID NO: 649598 - RNA, 22 nt, Human
cucaggacuuucaaauagaaau

SEQ ID NO: 649599 - RNA, 21 nt, Human
uacaaugcacaggagagccuc

SEQ ID NO: 649600 - RNA, 22 nt, Human
agugaggucauacuggagaggg

SEQ ID NO: 649601 - RNA, 22 nt, Human
auaauauaauccuacuucccau

SEQ ID NO: 649602 - RNA, 22 nt, Human
uuguaugagcuccaggaacuca

SEQ ID NO: 649603 - RNA, 22 nt, Human
cagguccaacuauuuaucugug

SEQ ID NO: 649604 - RNA, 22 nt, Human
agcacagagaaacuaagacauu

SEQ ID NO: 649605 - RNA, 20 nt, Human
cagaggcauuuucagacucu

SEQ ID NO: 649606 - RNA, 22 nt, Human
uuccagcaggguacuuguaauu

SEQ ID NO: 649607 - RNA, 22 nt, Human
uguguauaagugagaaugcugu

SEQ ID NO: 649608 - RNA, 22 nt, Human
auucucauuuuuauagaugaga

SEQ ID NO: 649609 - RNA, 22 nt, Human
ggggaggaagcucucaguucca

SEQ ID NO: 649610 - RNA, 22 nt, Human
caggagugaguuggggucuaca

SEQ ID NO: 649611 - RNA, 22 nt, Human
aacugucuaaggagaauaugaa

SEQ ID NO: 649612 - RNA, 22 nt, Human
ugcagggcuuccucuuggaguu

SEQ ID NO: 649613 - RNA, 22 nt, Human
acuuauauuugcuuuaugcuuc

SEQ ID NO: 649614 - RNA, 22 nt, Human
uggcauggaccuuggaagaauu

SEQ ID NO: 649615 - RNA, 20 nt, Human
ugcuggcacggguggacucc

SEQ ID NO: 649616 - RNA, 22 nt, Human
gaggcucagagugguuaaauaa

SEQ ID NO: 649617 - RNA, 22 nt, Human
agccucccuaugcaccuucagg

SEQ ID NO: 649618 - RNA, 22 nt, Human
ccaccucugagcccaaacccug

SEQ ID NO: 649619 - RNA, 22 nt, Human
ugcauaguucuccuuccuccuc

SEQ ID NO: 649620 - RNA, 22 nt, Human
caagauaucaaugacauaguau

SEQ ID NO: 649621 - RNA, 19 nt, Human
augcauuguuugaaguuga

SEQ ID NO: 649622 - RNA, 22 nt, Human
auuaaaagcuucccaagaguua

SEQ ID NO: 649623 - RNA, 22 nt, Human
gcacugugaauauacuagcaaa

SEQ ID NO: 649624 - RNA, 22 nt, Human
aggaauuuggaauuuuuccugu

SEQ ID NO: 649625 - RNA, 20 nt, Human
caccacagaauuggggacag

SEQ ID NO: 649626 - RNA, 22 nt, Human
guuaauuugcagcuuucgagcu

SEQ ID NO: 649627 - RNA, 19 nt, Human
ucucuggcaguucagagca

SEQ ID NO: 649628 - RNA, 22 nt, Human
cauucuuacacaauauuuuaau

SEQ ID NO: 649629 - RNA, 22 nt, Human
gagaggcucugaggacuggggu

SEQ ID NO: 649630 - RNA, 22 nt, Human
aggaagaugugcaaaguuggaa

SEQ ID NO: 649631 - RNA, 22 nt, Human
gagacacaguuaucaggcauac

SEQ ID NO: 649632 - RNA, 22 nt, Human
gaucugaagagcaaugaaauau

SEQ ID NO: 649633 - RNA, 22 nt, Human
cugucacugaugggcucaccag

SEQ ID NO: 649634 - RNA, 22 nt, Human
aagucugacuagaaucucuccc

SEQ ID NO: 649635 - RNA, 22 nt, Human
cucagcaggcacugugccuuac

SEQ ID NO: 649636 - RNA, 22 nt, Human
augaacaucggaaaugagacug

SEQ ID NO: 649637 - RNA, 22 nt, Human
ugaguggagacuguguguagag

SEQ ID NO: 649638 - RNA, 22 nt, Human
ucaaacauaucugauuuuccau

SEQ ID NO: 649639 - RNA, 22 nt, Human
aagucagaccuuguugauagcu

SEQ ID NO: 649640 - RNA, 22 nt, Human
uuauguuugaguauaugacuca

SEQ ID NO: 649641 - RNA, 22 nt, Human
aucuuuuacuacaaaucaggug

SEQ ID NO: 649642 - RNA, 22 nt, Human
uaaggcaaagugauuucuuaaa

SEQ ID NO: 649643 - RNA, 22 nt, Human
auuuccagcagcauauuugucu

SEQ ID NO: 649644 - RNA, 22 nt, Human
uuaaaaucacagucacccagua

SEQ ID NO: 649645 - RNA, 22 nt, Human
ccuuggcaaaccagggcagcug

SEQ ID NO: 649646 - RNA, 22 nt, Human
gcacauaaagggcaugggaggu

SEQ ID NO: 649647 - RNA, 22 nt, Human
gccucuguaggagugagagcau

SEQ ID NO: 649648 - RNA, 22 nt, Human
ucuuagcagugcugagaagaau

SEQ ID NO: 649649 - RNA, 22 nt, Human
ugucacaauuuauuucucuuga

SEQ ID NO: 649650 - RNA, 22 nt, Human
uugcuuuugggaaaacaugccu

SEQ ID NO: 649651 - RNA, 22 nt, Human
aaacaguuuauaacaugauacu

SEQ ID NO: 649652 - RNA, 22 nt, Human
agcagauggugucaugggaugg

SEQ ID NO: 649653 - RNA, 22 nt, Human
aagaagaugguuaacuuucagu

SEQ ID NO: 649654 - RNA, 22 nt, Human
ucugugugugccuguuaauauu

SEQ ID NO: 649655 - RNA, 22 nt, Human
auauauuuugaauagccucugu

SEQ ID NO: 649656 - RNA, 22 nt, Human
uauauucaaugauuaguaucag

SEQ ID NO: 649657 - RNA, 22 nt, Human
gacaauaaagugauacauggga

SEQ ID NO: 649658 - RNA, 22 nt, Human
cuucaaggcuuauuccaguugu

SEQ ID NO: 649659 - RNA, 22 nt, Human
aguauguauuuuauacuuacag

SEQ ID NO: 649660 - RNA, 22 nt, Human
uaaacuaucuguguuugaaguu

SEQ ID NO: 649661 - RNA, 22 nt, Human
cagagcaucgcgcagagagccu

SEQ ID NO: 649662 - RNA, 22 nt, Human
gcaguggcaccgcuggcucugg

SEQ ID NO: 649663 - RNA, 23 nt, Human
guuuuacaggugagaaaauggag

SEQ ID NO: 649664 - RNA, 22 nt, Human
gugcaaaaguaacugugguuuu

SEQ ID NO: 649665 - RNA, 22 nt, Human
ggcugcccucgucuacugccca

SEQ ID NO: 649666 - RNA, 22 nt, Human
guguggcuguuuagugacuuuc

SEQ ID NO: 649667 - RNA, 22 nt, Human
gaggcugcacuggcuaaaggcu

SEQ ID NO: 649668 - RNA, 22 nt, Human
aagccagcauuuucccauuccu

SEQ ID NO: 649669 - RNA, 22 nt, Human
uuaaguacuucccuguuggaca

SEQ ID NO: 649670 - RNA, 22 nt, Human
uggcagagugcggcauccccug

SEQ ID NO: 649671 - RNA, 22 nt, Human
uauugagacuuccaguauauga

SEQ ID NO: 649672 - RNA, 19 nt, Human
ucucccagcugagaagggc

SEQ ID NO: 649673 - RNA, 22 nt, Human
ggcccugugguuuugcaaaguc

SEQ ID NO: 649674 - RNA, 22 nt, Human
ccugauggcugucugggccuga

SEQ ID NO: 649675 - RNA, 22 nt, Human
cagggcuucgauggauggaugg

SEQ ID NO: 649676 - RNA, 22 nt, Human
cagcuuccccccgggcuugaga

SEQ ID NO: 649677 - RNA, 22 nt, Human
caaaugugacuuuugggcuucu

SEQ ID NO: 649678 - RNA, 22 nt, Human
gcuuucaaauccuaauuccaac

SEQ ID NO: 649679 - RNA, 22 nt, Human
ggcgggaggcugaggaguuggu

SEQ ID NO: 649680 - RNA, 22 nt, Human
ugcuuaaacccugaucaugugu

SEQ ID NO: 649681 - RNA, 22 nt, Human
auccuugagccaaugacugauu

SEQ ID NO: 649682 - RNA, 22 nt, Human
gaaaagcuaggccaguucagcu

SEQ ID NO: 649683 - RNA, 22 nt, Human
ugcaaagccacaaugaaaucag

SEQ ID NO: 649684 - RNA, 22 nt, Human
cagcccugcuuccccgcuaguu

SEQ ID NO: 649685 - RNA, 22 nt, Human
ugaggauggggagauggugucu

SEQ ID NO: 649686 - RNA, 22 nt, Human
ucaguuucuccaucgcuccagu

SEQ ID NO: 649687 - RNA, 22 nt, Human
ucagaagaagagacuccacagc

SEQ ID NO: 649688 - RNA, 22 nt, Human
augcuguagaucuuagccucua

SEQ ID NO: 649689 - RNA, 20 nt, Human
gagugggccauggagugaga

SEQ ID NO: 649690 - RNA, 22 nt, Human
ccaagagguugaggcugcagug

SEQ ID NO: 649691 - RNA, 22 nt, Human
ugguccugcaguaauagacauc

SEQ ID NO: 649692 - RNA, 22 nt, Human
uguuugaaguucuucugugacu

SEQ ID NO: 649693 - RNA, 22 nt, Human
ucagugcuucggcgagcaccua

SEQ ID NO: 649694 - RNA, 22 nt, Human
gggugcagcagagcuccucugu

SEQ ID NO: 649695 - RNA, 22 nt, Human
auugaaaggcaaaguaggaagc

SEQ ID NO: 649696 - RNA, 22 nt, Human
gugugaaaugguucucuuuguu

SEQ ID NO: 649697 - RNA, 22 nt, Human
ccuguuuaccacugaggggcag

SEQ ID NO: 649698 - RNA, 22 nt, Human
uagacacuuuagaaguaagggu

SEQ ID NO: 649699 - RNA, 22 nt, Human
gagaggaguagacacuuugguu

SEQ ID NO: 649700 - RNA, 22 nt, Human
gagggccaauggauuucaacug

SEQ ID NO: 649701 - RNA, 22 nt, Human
ucucuucuuguguuuuccugcc

SEQ ID NO: 649702 - RNA, 22 nt, Human
ucaguaacccugcuguucagag

SEQ ID NO: 649703 - RNA, 22 nt, Human
aggguggccaugagggagagau

SEQ ID NO: 649704 - RNA, 22 nt, Human
caaggcuugaauucugaugggu

SEQ ID NO: 649705 - RNA, 22 nt, Human
ccagaggugcucuuuggaagug

SEQ ID NO: 649706 - RNA, 22 nt, Human
accuggaccugccaccuaugag

SEQ ID NO: 649707 - RNA, 22 nt, Human
auucaguuucauggcacagcua

SEQ ID NO: 649708 - RNA, 22 nt, Human
auauuauucuaguaacagugau

SEQ ID NO: 649709 - RNA, 22 nt, Human
uuuggcucugcgucuucaccca

SEQ ID NO: 649710 - RNA, 22 nt, Human
caacauuucaaggucuuuagga

SEQ ID NO: 649711 - RNA, 22 nt, Human
acuccaggauguagaaucagag

SEQ ID NO: 649712 - RNA, 22 nt, Human
cuggucagcugaagccccacac

SEQ ID NO: 649713 - RNA, 20 nt, Human
aagcauggucaaaacuuaug

SEQ ID NO: 649714 - RNA, 22 nt, Human
gaaaucugaaucuucuguuggu

SEQ ID NO: 649715 - RNA, 22 nt, Human
ugguuuaccccuguccuauauc

SEQ ID NO: 649716 - RNA, 22 nt, Human
ucugaggaaucuugacacauuu

SEQ ID NO: 649717 - RNA, 22 nt, Human
acaauguucucugaguugugug

SEQ ID NO: 649718 - RNA, 18 nt, Human
aguuucagggcaggaaac

SEQ ID NO: 649719 - RNA, 22 nt, Human
guauuuuacuuacgcaugacuu

SEQ ID NO: 649720 - RNA, 22 nt, Human
aggccuccagccacaugccagu

SEQ ID NO: 649721 - RNA, 22 nt, Human
gagcacagaaggagaaauaugg

SEQ ID NO: 649722 - RNA, 22 nt, Human
auuuuaaggcuuauuuaaaggc

SEQ ID NO: 649723 - RNA, 22 nt, Human
ucugauaagacagcugauuuga

SEQ ID NO: 649724 - RNA, 22 nt, Human
uaaugaacaugcaucgugugua

SEQ ID NO: 649725 - RNA, 22 nt, Human
uuaacacuccuaacuacagucu

SEQ ID NO: 649726 - RNA, 22 nt, Human
uggcccugcuaugauccugcaa

SEQ ID NO: 649727 - RNA, 22 nt, Human
aggaaacaguugguaaugcaua

SEQ ID NO: 649728 - RNA, 22 nt, Human
agagagcccgggccagggcaca

SEQ ID NO: 649729 - RNA, 22 nt, Human
ugugaguaauaaagucauuuuu

SEQ ID NO: 649730 - RNA, 22 nt, Human
uauuauugcaaguauauaaagu

SEQ ID NO: 649731 - RNA, 22 nt, Human
ugagccagauaagggcucacgc

SEQ ID NO: 649732 - RNA, 17 nt, Human
ggcuuacaggugccagc

SEQ ID NO: 649733 - RNA, 22 nt, Human
uagauuaagaugccaguuuuga

SEQ ID NO: 649734 - RNA, 22 nt, Human
gggcagugucugcaaaugaaca

SEQ ID NO: 649735 - RNA, 22 nt, Human
caauugcugauaugcagaagac

SEQ ID NO: 649736 - RNA, 22 nt, Human
uaacacauauuucaagaguagu

SEQ ID NO: 649737 - RNA, 22 nt, Human
ggacacaguggaagacagcuug

SEQ ID NO: 649738 - RNA, 21 nt, Human
cugagggccgcagcugggcuc

SEQ ID NO: 649739 - RNA, 22 nt, Human
uccagcagccacaccucuggac

SEQ ID NO: 649740 - RNA, 22 nt, Human
gcagcaaucuucacagugucau

SEQ ID NO: 649741 - RNA, 22 nt, Human
ggagugacucacagcugggaca

SEQ ID NO: 649742 - RNA, 22 nt, Human
gccacccuugcgucacugacau

SEQ ID NO: 649743 - RNA, 22 nt, Human
cacuuuaaaacugacagcccuu

SEQ ID NO: 649744 - RNA, 22 nt, Human
caaggccacugcucagguuucc

SEQ ID NO: 649745 - RNA, 17 nt, Human
ucauuugggccucacaa

SEQ ID NO: 649746 - RNA, 22 nt, Human
cccuggcaugcaugucccuggc

SEQ ID NO: 649747 - RNA, 22 nt, Human
caagggcauugcuugggaccuu

SEQ ID NO: 649748 - RNA, 22 nt, Human
cccugagcgugaggaggaagua

SEQ ID NO: 649749 - RNA, 22 nt, Human
ucugccugcaguguggcagggc

SEQ ID NO: 649750 - RNA, 22 nt, Human
guauuuucaagagcaguaguau

SEQ ID NO: 649751 - RNA, 21 nt, Human
aucuuuauuacgcagagaaga

SEQ ID NO: 649752 - RNA, 20 nt, Human
gcagccguggagacuaggag

SEQ ID NO: 649753 - RNA, 22 nt, Human
ggcuuucuagaucuagcucugu

SEQ ID NO: 649754 - RNA, 22 nt, Human
auaaaauuugcuacuguuaaau

SEQ ID NO: 649755 - RNA, 22 nt, Human
gcaggaauauaguauuucgagg

SEQ ID NO: 649756 - RNA, 22 nt, Human
aaaugacaauaaaaguccaugc

SEQ ID NO: 649757 - RNA, 22 nt, Human
ucauuauaaacauaugcuaaag

SEQ ID NO: 649758 - RNA, 22 nt, Human
ucagggaaauucaagggagauu

SEQ ID NO: 649759 - RNA, 22 nt, Human
caaagguauucucauuuuggaa

SEQ ID NO: 649760 - RNA, 22 nt, Human
acacagaagaucucuuaaugcu

SEQ ID NO: 649761 - RNA, 22 nt, Human
ugugagaagggugaggcuuuua

SEQ ID NO: 649762 - RNA, 22 nt, Human
agcugagaaucuuccccagugu

SEQ ID NO: 649763 - RNA, 22 nt, Human
gaagaauauauaaugauuuugu

SEQ ID NO: 649764 - RNA, 20 nt, Human
aacaaucuagaagcuauucu

SEQ ID NO: 649765 - RNA, 22 nt, Human
ucagagcuuuggagaccaggaa

SEQ ID NO: 649766 - RNA, 22 nt, Human
ugcagcugagucacccagccau

SEQ ID NO: 649767 - RNA, 22 nt, Human
aggcugagcggggucccagagc

SEQ ID NO: 649768 - RNA, 22 nt, Human
ucauuuugggguuugucaucuu

SEQ ID NO: 649769 - RNA, 22 nt, Human
auauguauagccagucuuuagg

SEQ ID NO: 649770 - RNA, 22 nt, Human
aaaauagauaaugccaggguca

SEQ ID NO: 649771 - RNA, 22 nt, Human
uacauucauggugacuuguaug

SEQ ID NO: 649772 - RNA, 19 nt, Human
acccugagaggugguccgg

SEQ ID NO: 649773 - RNA, 22 nt, Human
agcagagccugggcuaggggug

SEQ ID NO: 649774 - RNA, 22 nt, Human
ucucaggcuuccuggugcugug

SEQ ID NO: 649775 - RNA, 22 nt, Human
aaggucuguucuaggugagggu

SEQ ID NO: 649776 - RNA, 21 nt, Human
cuggagcuuggugagaagugu

SEQ ID NO: 649777 - RNA, 22 nt, Human
auccauuuuugcaaaguuguuc

SEQ ID NO: 649778 - RNA, 22 nt, Human
cugcuguguuucugcuagaaaa

SEQ ID NO: 649779 - RNA, 22 nt, Human
aaaggucuuaagguuaagcagg

SEQ ID NO: 649780 - RNA, 23 nt, Human
uaucuuaccucccuucuuuccug

SEQ ID NO: 649781 - RNA, 22 nt, Human
uaacacugugucugccauaucc

SEQ ID NO: 649782 - RNA, 22 nt, Human
ucuguauugauucuguuaggca

SEQ ID NO: 649783 - RNA, 22 nt, Human
acauguuuaaguuuguuauaug

SEQ ID NO: 649784 - RNA, 22 nt, Human
uucucugugagggugcuggauu

SEQ ID NO: 649785 - RNA, 22 nt, Human
ucaugaguuuaagguuuaggcu

SEQ ID NO: 649786 - RNA, 22 nt, Human
ucugggccagugauuuuuccag

SEQ ID NO: 649787 - RNA, 22 nt, Human
uauuuuguuuuguauccacugu

SEQ ID NO: 649788 - RNA, 22 nt, Human
aaagacagacggaaaccugagg

SEQ ID NO: 649789 - RNA, 22 nt, Human
uagauuucgcugcaucucaauc

SEQ ID NO: 649790 - RNA, 22 nt, Human
ugacacugccgaaacuguagag

SEQ ID NO: 649791 - RNA, 22 nt, Human
gagggcugaugcuuacuuauuu

SEQ ID NO: 649792 - RNA, 22 nt, Human
ugguuccuucugcauuuucagc

SEQ ID NO: 649793 - RNA, 22 nt, Human
uuuaucacagaauaagaaguca

SEQ ID NO: 649794 - RNA, 21 nt, Human
agguggagugcuuagcaucca

SEQ ID NO: 649795 - RNA, 22 nt, Human
ccauccaggcugugggugagcu

SEQ ID NO: 649796 - RNA, 22 nt, Human
ucuguuucuauaaagacaagag

SEQ ID NO: 649797 - RNA, 22 nt, Human
ucaugaaaaauuuuccauguca

SEQ ID NO: 649798 - RNA, 22 nt, Human
acagucaagaaauggcagagcc

SEQ ID NO: 649799 - RNA, 22 nt, Human
acauucuagaagagcuucacuu

SEQ ID NO: 649800 - RNA, 22 nt, Human
cacaauuuggggugcccacugu

SEQ ID NO: 649801 - RNA, 22 nt, Human
guuuugaaaugaaagaaccaag

SEQ ID NO: 649802 - RNA, 22 nt, Human
acagggccuuauauccagaagg

SEQ ID NO: 649803 - RNA, 22 nt, Human
agcccugauuaaccuuggcuuu

SEQ ID NO: 649804 - RNA, 19 nt, Human
agguaggcaguggcaugga

SEQ ID NO: 649805 - RNA, 22 nt, Human
cagcaacucuccugugcucaaa

SEQ ID NO: 649806 - RNA, 22 nt, Human
uuggcuaugcuuguguucaguu

SEQ ID NO: 649807 - RNA, 22 nt, Human
aggagccaagaugcugucuggc

SEQ ID NO: 649808 - RNA, 19 nt, Human
cugagaauccuacuuauuu

SEQ ID NO: 649809 - RNA, 22 nt, Human
agccuggcuuaauccuccuuuu

SEQ ID NO: 649810 - RNA, 22 nt, Human
cagagcuggguuugggaaaccu

SEQ ID NO: 649811 - RNA, 22 nt, Human
ucauaaagcuugccugcagugu

SEQ ID NO: 649812 - RNA, 22 nt, Human
agaucauaugcaguaaugaacu

SEQ ID NO: 649813 - RNA, 22 nt, Human
acuugguuggucucacccuguu

SEQ ID NO: 649814 - RNA, 22 nt, Human
uuauggaauuugcaaaagguua

SEQ ID NO: 649815 - RNA, 22 nt, Human
caucccugguuccuguguuuaa

SEQ ID NO: 649816 - RNA, 22 nt, Human
gcuggcuuugaucuucccaucu

SEQ ID NO: 649817 - RNA, 20 nt, Human
ggcugcaggacucauuggcu

SEQ ID NO: 649818 - RNA, 22 nt, Human
uuccugagcuuuuaaccuaguc

SEQ ID NO: 649819 - RNA, 22 nt, Human
auuauucucuggaggaaagauu

SEQ ID NO: 649820 - RNA, 19 nt, Human
ucccugaguuccagcccag

SEQ ID NO: 649821 - RNA, 22 nt, Human
uaggccaguaaaauguuucagu

SEQ ID NO: 649822 - RNA, 18 nt, Human
gggcauggaugcagcauc

SEQ ID NO: 649823 - RNA, 22 nt, Human
uaccacagucugccauuagaug

SEQ ID NO: 649824 - RNA, 22 nt, Human
aaaggaaaauaaguaguuccau

SEQ ID NO: 649825 - RNA, 22 nt, Human
uggcugcccucaugggccugau

SEQ ID NO: 649826 - RNA, 22 nt, Human
gaguggggcgaagucggcgagu

SEQ ID NO: 649827 - RNA, 22 nt, Human
cucugcaugccacaugagugac

SEQ ID NO: 649828 - RNA, 22 nt, Human
cucagccccaauucuccccauu

SEQ ID NO: 649829 - RNA, 22 nt, Human
aagagcuggagcugcuacagga

SEQ ID NO: 649830 - RNA, 22 nt, Human
gcacaggcacagagggccacug

SEQ ID NO: 649831 - RNA, 22 nt, Human
gggcagcuagcccucuagccca

SEQ ID NO: 649832 - RNA, 22 nt, Human
caugcuggguaaagguggugaa

SEQ ID NO: 649833 - RNA, 22 nt, Human
gggaaauugugugagaucuuug

SEQ ID NO: 649834 - RNA, 22 nt, Human
gggcccugccuaaggaacacac

SEQ ID NO: 649835 - RNA, 21 nt, Human
cagugagguccccagccuagg

SEQ ID NO: 649836 - RNA, 22 nt, Human
ucuuuagagccuuuccucccga

SEQ ID NO: 649837 - RNA, 22 nt, Human
agugggagccagcagcuugggg

SEQ ID NO: 649838 - RNA, 22 nt, Human
cugauuaggcuaagcaagaggg

SEQ ID NO: 649839 - RNA, 22 nt, Human
augcuuuauguucuggcauuuu

SEQ ID NO: 649840 - RNA, 23 nt, Human
auuagaaaggcuuucuggugaaa

SEQ ID NO: 649841 - RNA, 22 nt, Human
acagagcuaaauuucaauccca

SEQ ID NO: 649842 - RNA, 21 nt, Human
gaccacagggaaggucuugca

SEQ ID NO: 649843 - RNA, 19 nt, Human
ugcugcuguccuugcaggg

SEQ ID NO: 649844 - RNA, 22 nt, Human
ccugggaaggucuuagcaucua

SEQ ID NO: 649845 - RNA, 22 nt, Human
agccaaaacaugugaguuuuga

SEQ ID NO: 649846 - RNA, 22 nt, Human
auggacagugugucuguuucca

SEQ ID NO: 649847 - RNA, 22 nt, Human
augaccaguuuccccacugucc

SEQ ID NO: 649848 - RNA, 22 nt, Human
aacagaaaagguagguggcuuu

SEQ ID NO: 649849 - RNA, 22 nt, Human
aaugaaugugauuaacuucaag

SEQ ID NO: 649850 - RNA, 22 nt, Human
guaaaucccauccuuucucugg

SEQ ID NO: 649851 - RNA, 22 nt, Human
cucugagcugaaacaugagcau

SEQ ID NO: 649852 - RNA, 22 nt, Human
uagugcuuuauuguuccugaaa

SEQ ID NO: 649853 - RNA, 22 nt, Human
uagauacauuuuucuuuccugu

SEQ ID NO: 649854 - RNA, 18 nt, Human
uuggcuuugagaacuggu

SEQ ID NO: 649855 - RNA, 22 nt, Human
uacuuuacaguauuagauaauu

SEQ ID NO: 649856 - RNA, 22 nt, Human
cauuucaaaagaauugccagaa

SEQ ID NO: 649857 - RNA, 22 nt, Human
uuacagagguauguaugucucu

SEQ ID NO: 649858 - RNA, 22 nt, Human
ccaggaagcucugcuccacggg

SEQ ID NO: 649859 - RNA, 22 nt, Human
agggaggucuggcugcccugag

SEQ ID NO: 649860 - RNA, 22 nt, Human
guaacagaggguuugcagauau

SEQ ID NO: 649861 - RNA, 22 nt, Human
agguguggcuugaagucucuau

SEQ ID NO: 649862 - RNA, 19 nt, Human
ucccucagucugccaggcc

SEQ ID NO: 649863 - RNA, 20 nt, Human
aggauggcaagcaagugcau

SEQ ID NO: 649864 - RNA, 22 nt, Human
gccucacauauucaugguuacu

SEQ ID NO: 649865 - RNA, 22 nt, Human
guguguguacucuguauauaaa

SEQ ID NO: 649866 - RNA, 22 nt, Human
guucauuguguguggucuucuu

SEQ ID NO: 649867 - RNA, 22 nt, Human
ucccaggaauugaagccagugu

SEQ ID NO: 649868 - RNA, 22 nt, Human
cuagaaauauuuuacagucaag

SEQ ID NO: 649869 - RNA, 22 nt, Human
aguggcauuuuaauggauguca

SEQ ID NO: 649870 - RNA, 22 nt, Human
uuuucuuaugugcagcuauaug

SEQ ID NO: 649871 - RNA, 22 nt, Human
acagcagaggaaaagucugaua

SEQ ID NO: 649872 - RNA, 22 nt, Human
cugccaggauucugugaacccc

SEQ ID NO: 649873 - RNA, 22 nt, Human
cacaccugugagucucggcuug

SEQ ID NO: 649874 - RNA, 19 nt, Human
gcucaacagcucggguccu

SEQ ID NO: 649875 - RNA, 22 nt, Human
gugcucuggcuggucucccggu

SEQ ID NO: 649876 - RNA, 23 nt, Human
ggcucugugcugggccugcagga

SEQ ID NO: 649877 - RNA, 20 nt, Human
auggagugaagagugaaagc

SEQ ID NO: 649878 - RNA, 22 nt, Human
gcaugguggagucugagcaggg

SEQ ID NO: 649879 - RNA, 22 nt, Human
agaggaugguugaggaagaccu

SEQ ID NO: 649880 - RNA, 22 nt, Human
gaggcuaagguucugccagaag

SEQ ID NO: 649881 - RNA, 22 nt, Human
caugcuuaauuggagcauucau

SEQ ID NO: 649882 - RNA, 22 nt, Human
gcaggagagccagcaggcuucc

SEQ ID NO: 649883 - RNA, 23 nt, Human
ucaguuuguauaauccauaugca

SEQ ID NO: 649884 - RNA, 18 nt, Human
aggccacacuccagaaca

SEQ ID NO: 649885 - RNA, 22 nt, Human
aucuugggaauuuuccaggagu

SEQ ID NO: 649886 - RNA, 22 nt, Human
uuucuacaguacugauuucaua

SEQ ID NO: 649887 - RNA, 22 nt, Human
cagagccuuccuagcagacucu

SEQ ID NO: 649888 - RNA, 22 nt, Human
agggccaguucuaccucugaau

SEQ ID NO: 649889 - RNA, 22 nt, Human
ugcagcaguguuccuuggcuug

SEQ ID NO: 649890 - RNA, 22 nt, Human
auuuugcuacaguugguggaaa

SEQ ID NO: 649891 - RNA, 22 nt, Human
aucugcugucacauguuugaag

SEQ ID NO: 649892 - RNA, 22 nt, Human
augucacaugguucuggggccu

SEQ ID NO: 649893 - RNA, 22 nt, Human
gacaaugguggauacaugucau

SEQ ID NO: 649894 - RNA, 22 nt, Human
uucuggcuacccuccuaauguu

SEQ ID NO: 649895 - RNA, 22 nt, Human
ucuguguuuuaaacaguagaaa

SEQ ID NO: 649896 - RNA, 21 nt, Human
ugacccuucuagcagaacaca

SEQ ID NO: 649897 - RNA, 22 nt, Human
caguagccacuagacacaugua

SEQ ID NO: 649898 - RNA, 22 nt, Human
aaauucuucagguaauuuugau

SEQ ID NO: 649899 - RNA, 22 nt, Human
uuuaaucaggcaaagcauaaua

SEQ ID NO: 649900 - RNA, 22 nt, Human
uuguuaaauggaugcagaauaa

SEQ ID NO: 649901 - RNA, 22 nt, Human
ucagucuucuaaagggaugcaa

SEQ ID NO: 649902 - RNA, 20 nt, Human
agguggcuccugcugggggu

SEQ ID NO: 649903 - RNA, 22 nt, Human
ggcuccaugcugagcuuugaau

SEQ ID NO: 649904 - RNA, 22 nt, Human
cacuggugucugagcaggguga

SEQ ID NO: 649905 - RNA, 22 nt, Human
uccagucccuugccuccacagc

SEQ ID NO: 649906 - RNA, 22 nt, Human
aaauggcuccaguugacuuuuu

SEQ ID NO: 649907 - RNA, 22 nt, Human
cuccuggaccagggcuauuggg

SEQ ID NO: 649908 - RNA, 22 nt, Human
ugaggggcauguguuuacacau

SEQ ID NO: 649909 - RNA, 22 nt, Human
cucagaggaggcagggugugcc

SEQ ID NO: 649910 - RNA, 22 nt, Human
cacugcuuuuucuccucacugg

SEQ ID NO: 649911 - RNA, 22 nt, Human
ugcucacagcccagaacauaau

SEQ ID NO: 649912 - RNA, 22 nt, Human
ucccugcagcaggugaucaaug

SEQ ID NO: 649913 - RNA, 22 nt, Human
ugaaggccucugguacaugcca

SEQ ID NO: 649914 - RNA, 19 nt, Human
guguggcagagagugacca

SEQ ID NO: 649915 - RNA, 22 nt, Human
gaaauaacagcucuggaagagu

SEQ ID NO: 649916 - RNA, 22 nt, Human
cuuauucaaugcuggaaauguu

SEQ ID NO: 649917 - RNA, 22 nt, Human
ucagcagaaguauagaggccau

SEQ ID NO: 649918 - RNA, 22 nt, Human
auuugcuucauagaucugugga

SEQ ID NO: 649919 - RNA, 22 nt, Human
uguggggcucccuggcagccug

SEQ ID NO: 649920 - RNA, 22 nt, Human
ugucuaauggcaauuucaugug

SEQ ID NO: 649921 - RNA, 22 nt, Human
aguuuacaguucucaucgcaac

SEQ ID NO: 649922 - RNA, 22 nt, Human
cagaggacaauagaauggaaag

SEQ ID NO: 649923 - RNA, 21 nt, Human
ugagcaggagucaugggaaug

SEQ ID NO: 649924 - RNA, 22 nt, Human
uccuugaaugaagagaggugac

SEQ ID NO: 649925 - RNA, 22 nt, Human
cauuuucaugaguuucuguuca

SEQ ID NO: 649926 - RNA, 23 nt, Human
cccaagccugugcccucugacuc

SEQ ID NO: 649927 - RNA, 22 nt, Human
gaggcucagagggacuuucaag

SEQ ID NO: 649928 - RNA, 18 nt, Human
ggccagagggaggguccc

SEQ ID NO: 649929 - RNA, 22 nt, Human
ugaaauuccaggagaguuaaaa

SEQ ID NO: 649930 - RNA, 22 nt, Human
acugggcagcagcucgagccgc

SEQ ID NO: 649931 - RNA, 22 nt, Human
ucacucagguucaugucuuugu

SEQ ID NO: 649932 - RNA, 22 nt, Human
uggcaaggcugugggggcagag

SEQ ID NO: 649933 - RNA, 22 nt, Human
caaauagacucuagaauuuauu

SEQ ID NO: 649934 - RNA, 22 nt, Human
uagguaagauguuaacagcuga

SEQ ID NO: 649935 - RNA, 22 nt, Human
acagaguuaauggauaggcagg

SEQ ID NO: 649936 - RNA, 22 nt, Human
caugggagguuggcuuggcaug

SEQ ID NO: 649937 - RNA, 22 nt, Human
ccaggaagcggugagggcugcc

SEQ ID NO: 649938 - RNA, 22 nt, Human
uacuuugaccaccaucugauua

SEQ ID NO: 649939 - RNA, 22 nt, Human
ugagcccuaauuuacaacaucu

SEQ ID NO: 649940 - RNA, 22 nt, Human
agcagcugcagggagggucugc

SEQ ID NO: 649941 - RNA, 23 nt, Human
uaggcucuguagguagagauggg

SEQ ID NO: 649942 - RNA, 22 nt, Human
gcaccuggacagugacccuagc

SEQ ID NO: 649943 - RNA, 18 nt, Human
cagggcuguggggucacu

SEQ ID NO: 649944 - RNA, 20 nt, Human
uccugaauuuccuuucugcu

SEQ ID NO: 649945 - RNA, 22 nt, Human
cagcuucuauuuaucuuugugu

SEQ ID NO: 649946 - RNA, 23 nt, Human
aucuaauuucuccaaaucucuac

SEQ ID NO: 649947 - RNA, 22 nt, Human
gacuagaagggcaagagucccu

SEQ ID NO: 649948 - RNA, 22 nt, Human
acuccagacacagacacuauga

SEQ ID NO: 649949 - RNA, 22 nt, Human
aggcagcaagauuauuuaaucc

SEQ ID NO: 649950 - RNA, 21 nt, Human
uucuucuuggacuguuuuggc

SEQ ID NO: 649951 - RNA, 22 nt, Human
aaccucuuugugaaugucauga

SEQ ID NO: 649952 - RNA, 22 nt, Human
agccuccaucccaugcacaaag

SEQ ID NO: 649953 - RNA, 23 nt, Human
uggcugagguccagguaguuuca

SEQ ID NO: 649954 - RNA, 22 nt, Human
cagcagcagagauacugguuuc

SEQ ID NO: 649955 - RNA, 22 nt, Human
ucuucacauucacguaacauag

SEQ ID NO: 649956 - RNA, 19 nt, Human
ccccaggguaggcuagggg

SEQ ID NO: 649957 - RNA, 22 nt, Human
auauuacauaaacaugagugaa

SEQ ID NO: 649958 - RNA, 22 nt, Human
ugauucaagcuacuguuacugg

SEQ ID NO: 649959 - RNA, 22 nt, Human
uuacaaguuucuggcuucaucc

SEQ ID NO: 649960 - RNA, 22 nt, Human
cagguggguacaucacagagac

SEQ ID NO: 649961 - RNA, 22 nt, Human
acagcagaucuggcuacagguu

SEQ ID NO: 649962 - RNA, 22 nt, Human
uuccugggauuauugucaagca

SEQ ID NO: 649963 - RNA, 21 nt, Human
ucaggcugaugucgauguuag

SEQ ID NO: 649964 - RNA, 22 nt, Human
gcuucuguucaaggauauaagg

SEQ ID NO: 649965 - RNA, 22 nt, Human
auuggaaauacaguagaaaaau

SEQ ID NO: 649966 - RNA, 22 nt, Human
ugaucaaaacauuacuccacca

SEQ ID NO: 649967 - RNA, 22 nt, Human
cacaugaugguggaagccauag

SEQ ID NO: 649968 - RNA, 22 nt, Human
ggugugggcccugaugucagca

SEQ ID NO: 649969 - RNA, 22 nt, Human
uaaaauagcuuaugucuuuuga

SEQ ID NO: 649970 - RNA, 22 nt, Human
agcaaggccuacagagaggggc

SEQ ID NO: 649971 - RNA, 22 nt, Human
gcucccagggaccgcagggcag

SEQ ID NO: 649972 - RNA, 22 nt, Human
gccuggcuccuaaggacuggcu

SEQ ID NO: 649973 - RNA, 20 nt, Human
ucuuuagauuuaucuuaugu

SEQ ID NO: 649974 - RNA, 22 nt, Human
uccaagaaucacugacacagcu

SEQ ID NO: 649975 - RNA, 20 nt, Human
uguuuacucuagaggguaga

SEQ ID NO: 649976 - RNA, 22 nt, Human
uuaacaggaguaacucuagaaa

SEQ ID NO: 649977 - RNA, 22 nt, Human
gcagccccaggagacgcccagg

SEQ ID NO: 649978 - RNA, 22 nt, Human
cuuccagcugauuacaggcuau

SEQ ID NO: 649979 - RNA, 22 nt, Human
uccccugcagcgccugcuucua

SEQ ID NO: 649980 - RNA, 22 nt, Human
caauaugcaagcuauuaaguau

SEQ ID NO: 649981 - RNA, 22 nt, Human
gcugagcagguuugaugcuuuu

SEQ ID NO: 649982 - RNA, 22 nt, Human
acaguguucugaaaguugaggg

SEQ ID NO: 649983 - RNA, 22 nt, Human
accugggaguaugcagugguga

SEQ ID NO: 649984 - RNA, 22 nt, Human
uuagcaaaaauaucucauauua

SEQ ID NO: 649985 - RNA, 22 nt, Human
agcucagaaaugccaguaggua

SEQ ID NO: 649986 - RNA, 22 nt, Human
ucgugucagaucagagguuccu

SEQ ID NO: 649987 - RNA, 22 nt, Human
ucuuuacacaagacaagaauaa

SEQ ID NO: 649988 - RNA, 18 nt, Human
caagagcugcuccuggcc

SEQ ID NO: 649989 - RNA, 22 nt, Human
aaaguaaccuaguaauaguguc

SEQ ID NO: 649990 - RNA, 22 nt, Human
cacaauuagcagcucuuuauuu

SEQ ID NO: 649991 - RNA, 22 nt, Human
gugcuuccuguauugauuccau

SEQ ID NO: 649992 - RNA, 22 nt, Human
agcuuaggaggaugaugaacau

SEQ ID NO: 649993 - RNA, 22 nt, Human
ccuuggcuuaccuucugugugg

SEQ ID NO: 649994 - RNA, 21 nt, Human
ugaacaaaguucuuaucguga

SEQ ID NO: 649995 - RNA, 22 nt, Human
caucuuugcacccucaaaaccu

SEQ ID NO: 649996 - RNA, 22 nt, Human
aaagugcugggauuaccggcau

SEQ ID NO: 649997 - RNA, 20 nt, Human
aggcccugccagggacggag

SEQ ID NO: 649998 - RNA, 22 nt, Human
uaagugaauuguccgaggacac

SEQ ID NO: 649999 - RNA, 22 nt, Human
gauuuacagcuauacccaaugg

SEQ ID NO: 650000 - RNA, 22 nt, Human
ucagaagacuacuaggacacau

SEQ ID NO: 650001 - RNA, 22 nt, Human
ugccaggccucaggagucucca

SEQ ID NO: 650002 - RNA, 22 nt, Human
cacacaugucucuccaugcucu

SEQ ID NO: 650003 - RNA, 22 nt, Human
gcagcagggagcagggguguca

SEQ ID NO: 650004 - RNA, 22 nt, Human
gaauagcuuccuuuuuuccaaa

SEQ ID NO: 650005 - RNA, 17 nt, Human
agcugccucucccacca

SEQ ID NO: 650006 - RNA, 22 nt, Human
gcagcgacaggcacuggucagg

SEQ ID NO: 650007 - RNA, 22 nt, Human
cucccugcccugugaguuggcc

SEQ ID NO: 650008 - RNA, 22 nt, Human
uaggacaggcuaaaagggauaa

SEQ ID NO: 650009 - RNA, 22 nt, Human
cagggcucaccacugggauccu

SEQ ID NO: 650010 - RNA, 22 nt, Human
cugucagguuggucucagagcu

SEQ ID NO: 650011 - RNA, 22 nt, Human
ccuccugggagagcacggaggg

SEQ ID NO: 650012 - RNA, 22 nt, Human
uaagacuucauuaguaauaugg

SEQ ID NO: 650013 - RNA, 22 nt, Human
gaaauacaguugggaggaggua

SEQ ID NO: 650014 - RNA, 22 nt, Human
uaaugcuuccuauauagcacuc

SEQ ID NO: 650015 - RNA, 21 nt, Human
aggaaaggaaguccccagggu

SEQ ID NO: 650016 - RNA, 22 nt, Human
ucucuugacugcuaaaauuaga

SEQ ID NO: 650017 - RNA, 18 nt, Human
uggaggaaucacaauggc

SEQ ID NO: 650018 - RNA, 22 nt, Human
gaguagaaaguaaaguacgaau

SEQ ID NO: 650019 - RNA, 22 nt, Human
gcuuuuuuagguaagacccagg

SEQ ID NO: 650020 - RNA, 21 nt, Human
caauuacagauggcucagggg

SEQ ID NO: 650021 - RNA, 22 nt, Human
ccucugcccuuuuccuguauca

SEQ ID NO: 650022 - RNA, 22 nt, Human
gccaagcuuugcaggaguguug

SEQ ID NO: 650023 - RNA, 22 nt, Human
ccugcaggggagagacuucuag

SEQ ID NO: 650024 - RNA, 22 nt, Human
uuccugugaagccgguggucuc

SEQ ID NO: 650025 - RNA, 22 nt, Human
gcuggggaggcagcagagaaca

SEQ ID NO: 650026 - RNA, 22 nt, Human
gcaccccuggacgguagggcca

SEQ ID NO: 650027 - RNA, 22 nt, Human
gugaggggccaagaguagggca

SEQ ID NO: 650028 - RNA, 22 nt, Human
aaauacagaguugcuuaaaagc

SEQ ID NO: 650029 - RNA, 22 nt, Human
uuagaaaaauguucaguaguuu

SEQ ID NO: 650030 - RNA, 19 nt, Human
ccucuucucuggcagcaga

SEQ ID NO: 650031 - RNA, 22 nt, Human
uaucacacauaacuaagcugca

SEQ ID NO: 650032 - RNA, 22 nt, Human
uucugcugcgacccaggaguua

SEQ ID NO: 650033 - RNA, 22 nt, Human
gaggagcuggcagcgucuccgc

SEQ ID NO: 650034 - RNA, 22 nt, Human
ugauagaaaggaaauuaauugg

SEQ ID NO: 650035 - RNA, 22 nt, Human
gaggaaaauggaguguaauuaa

SEQ ID NO: 650036 - RNA, 22 nt, Human
acagcuccuaacaaaggcucuc

SEQ ID NO: 650037 - RNA, 19 nt, Human
cagaggcaccagguauaga

SEQ ID NO: 650038 - RNA, 22 nt, Human
cagcaggugucuagcaaggguc

SEQ ID NO: 650039 - RNA, 22 nt, Human
gcccuggagcuagacuaggaca

SEQ ID NO: 650040 - RNA, 22 nt, Human
agcagcaaagccaggggauggg

SEQ ID NO: 650041 - RNA, 21 nt, Human
aucugcuuagguuuguucaga

SEQ ID NO: 650042 - RNA, 21 nt, Human
ucauuucucuauguauuucac

SEQ ID NO: 650043 - RNA, 22 nt, Human
cccaggagcuucucucugccuc

SEQ ID NO: 650044 - RNA, 22 nt, Human
gagugcugaaugcgagaacaga

SEQ ID NO: 650045 - RNA, 22 nt, Human
gccuggcugccggccuuggcaa

SEQ ID NO: 650046 - RNA, 22 nt, Human
gaggcaagagaagccagcuuuc

SEQ ID NO: 650047 - RNA, 22 nt, Human
cugcugcucagugucaucaugu

SEQ ID NO: 650048 - RNA, 23 nt, Human
gggagccaggaccucgcgcccca

SEQ ID NO: 650049 - RNA, 22 nt, Human
guuucuuauuugcagguugcuu

SEQ ID NO: 650050 - RNA, 22 nt, Human
uccagcccgggggcaggugacc

SEQ ID NO: 650051 - RNA, 22 nt, Human
aguuacaagcuauuuuacuuaa

SEQ ID NO: 650052 - RNA, 22 nt, Human
ucccagagaagagcuggaugga

SEQ ID NO: 650053 - RNA, 22 nt, Human
ugagcugugucuuggugagagu

SEQ ID NO: 650054 - RNA, 22 nt, Human
ucuagggagcucuagcaguggu

SEQ ID NO: 650055 - RNA, 22 nt, Human
auuucuagacuuagaacucuua

SEQ ID NO: 650056 - RNA, 22 nt, Human
aggggagguguccccaaaucuc

SEQ ID NO: 650057 - RNA, 22 nt, Human
gacaauguguugaaagggaaaa

SEQ ID NO: 650058 - RNA, 22 nt, Human
acuggggagugguuuugggaag

SEQ ID NO: 650059 - RNA, 22 nt, Human
acacaggaggaggauggugguc

SEQ ID NO: 650060 - RNA, 22 nt, Human
cuuggcaguuucggaaggauga

SEQ ID NO: 650061 - RNA, 22 nt, Human
uggcucugggcaccguguccac

SEQ ID NO: 650062 - RNA, 22 nt, Human
aaaguuuuauaugcugcagcga

SEQ ID NO: 650063 - RNA, 22 nt, Human
ucuaggccguaggauacagagc

SEQ ID NO: 650064 - RNA, 22 nt, Human
acccucccauuuccauguagca

SEQ ID NO: 650065 - RNA, 22 nt, Human
uccugucugcucacagagcugg

SEQ ID NO: 650066 - RNA, 22 nt, Human
uauuccaaaauaguuaagcacu

SEQ ID NO: 650067 - RNA, 22 nt, Human
ucucugugguaugucauagcaa

SEQ ID NO: 650068 - RNA, 22 nt, Human
cagagagggagcaguagucucu

SEQ ID NO: 650069 - RNA, 22 nt, Human
aaguguagauuauggagugucu

SEQ ID NO: 650070 - RNA, 22 nt, Human
gauuucuugauaauucaaaucc

SEQ ID NO: 650071 - RNA, 22 nt, Human
auaaaggcagaguagggaggaa

SEQ ID NO: 650072 - RNA, 22 nt, Human
gcccuccaugagacacagugua

SEQ ID NO: 650073 - RNA, 22 nt, Human
agguagaggccuccaggcagca

SEQ ID NO: 650074 - RNA, 23 nt, Human
uacauucuguauuuuuauagagu

SEQ ID NO: 650075 - RNA, 22 nt, Human
cugggaguugacgaggcuugua

SEQ ID NO: 650076 - RNA, 22 nt, Human
uucuggaauauuugacacaauu

SEQ ID NO: 650077 - RNA, 22 nt, Human
auuugacauugacacaccuaug

SEQ ID NO: 650078 - RNA, 22 nt, Human
gucccuggggaaucagcuggag

SEQ ID NO: 650079 - RNA, 22 nt, Human
gcuuaugauguuuacauaaaag

SEQ ID NO: 650080 - RNA, 22 nt, Human
uuuaguaaguucacugcaaagc

SEQ ID NO: 650081 - RNA, 22 nt, Human
gggggccuuguuaguggaugga

SEQ ID NO: 650082 - RNA, 22 nt, Human
uuucuccaauguaucagcacac

SEQ ID NO: 650083 - RNA, 22 nt, Human
uauguucuagacuuuugcugug

SEQ ID NO: 650084 - RNA, 22 nt, Human
aaggccaggagacuuggaguca

SEQ ID NO: 650085 - RNA, 22 nt, Human
cagggcuucgugucucagugcu

SEQ ID NO: 650086 - RNA, 22 nt, Human
aggcuucuggggcaccgagcga

SEQ ID NO: 650087 - RNA, 22 nt, Human
caagcagauauuuuagucaaga

SEQ ID NO: 650088 - RNA, 20 nt, Human
uuugagaccagucugcccaa

SEQ ID NO: 650089 - RNA, 22 nt, Human
ugcccugcagacccugcagugu

SEQ ID NO: 650090 - RNA, 22 nt, Human
auucugaguacaacaagauguu

SEQ ID NO: 650091 - RNA, 22 nt, Human
agguagaaggaccagaauuuau

SEQ ID NO: 650092 - RNA, 22 nt, Human
gcagaggauagcauaugaaccu

SEQ ID NO: 650093 - RNA, 22 nt, Human
uugcuuuauucacaucuauauu

SEQ ID NO: 650094 - RNA, 22 nt, Human
uggcagggaguucguucacaac

SEQ ID NO: 650095 - RNA, 22 nt, Human
ggaggggaugguuugacccugg

SEQ ID NO: 650096 - RNA, 22 nt, Human
cugccagcucaaagcgcagcua

SEQ ID NO: 650097 - RNA, 22 nt, Human
ggugagcagcugucuguaugga

SEQ ID NO: 650098 - RNA, 20 nt, Human
cuaagagguccuuccacauc

SEQ ID NO: 650099 - RNA, 22 nt, Human
guauugcaauuacucuucuucu

SEQ ID NO: 650100 - RNA, 22 nt, Human
auuuuaguaccucaaguaucca

SEQ ID NO: 650101 - RNA, 23 nt, Human
ggucccugacagcgggcaaguug

SEQ ID NO: 650102 - RNA, 22 nt, Human
gcguuuguuuugcuggcgccag

SEQ ID NO: 650103 - RNA, 22 nt, Human
uuucagaaauggcacugaaauc

SEQ ID NO: 650104 - RNA, 22 nt, Human
cugugcuggugaaacccacaga

SEQ ID NO: 650105 - RNA, 22 nt, Human
uuugugaauucuuggaagauug

SEQ ID NO: 650106 - RNA, 22 nt, Human
cuggguucuuggcacagcagga

SEQ ID NO: 650107 - RNA, 22 nt, Human
cuggaaaucacuacuagucaau

SEQ ID NO: 650108 - RNA, 22 nt, Human
uuuuauuaguggcuagaugggg

SEQ ID NO: 650109 - RNA, 22 nt, Human
ugggagcucugagccugcugug

SEQ ID NO: 650110 - RNA, 22 nt, Human
gagcuuggacaagcucugaagg

SEQ ID NO: 650111 - RNA, 22 nt, Human
caggcccaggggucuggcccac

SEQ ID NO: 650112 - RNA, 22 nt, Human
agucuuagaacuacagugccua

SEQ ID NO: 650113 - RNA, 22 nt, Human
cccaggcugaguuagagguguc

SEQ ID NO: 650114 - RNA, 22 nt, Human
agcugccuggagccagaguuga

SEQ ID NO: 650115 - RNA, 22 nt, Human
auguauuugcguauggacauac

SEQ ID NO: 650116 - RNA, 22 nt, Human
aucauccauggcugaucauaaa

SEQ ID NO: 650117 - RNA, 22 nt, Human
uuauggaauacuuaugcugcag

SEQ ID NO: 650118 - RNA, 22 nt, Human
guuuuuaucuaauagcaguuau

SEQ ID NO: 650119 - RNA, 22 nt, Human
aagauguugcaagggacucuuc

SEQ ID NO: 650120 - RNA, 23 nt, Human
agcaggauaauuuuauuaugccc

SEQ ID NO: 650121 - RNA, 23 nt, Human
aguguguaagguacuuugcugcu

SEQ ID NO: 650122 - RNA, 22 nt, Human
cccuaaggacaccugcugucca

SEQ ID NO: 650123 - RNA, 22 nt, Human
cacugcuauuauuagacaaugu

SEQ ID NO: 650124 - RNA, 22 nt, Human
ucauuuuugucuccgguuugug

SEQ ID NO: 650125 - RNA, 22 nt, Human
gaggcccucuugccacaaugaa

SEQ ID NO: 650126 - RNA, 22 nt, Human
cuuucauucuuagauauuagug

SEQ ID NO: 650127 - RNA, 22 nt, Human
uuucuuuguaguagcauaauca

SEQ ID NO: 650128 - RNA, 22 nt, Human
ugugcgugggcacacacauaug

SEQ ID NO: 650129 - RNA, 17 nt, Human
agaaaagagaccagcag

SEQ ID NO: 650130 - RNA, 22 nt, Human
ucucucagcuuugagaccugcu

SEQ ID NO: 650131 - RNA, 22 nt, Human
agcaggcagccuaggaagugaa

SEQ ID NO: 650132 - RNA, 22 nt, Human
cuuaggcaagcagagcccaucc

SEQ ID NO: 650133 - RNA, 17 nt, Human
cagucacaggucuuuuc

SEQ ID NO: 650134 - RNA, 22 nt, Human
uccagccccuccugagccaagc

SEQ ID NO: 650135 - RNA, 22 nt, Human
aaauucuuucauggcuaauaag

SEQ ID NO: 650136 - RNA, 22 nt, Human
uacacaaaggcacucuguuguu

SEQ ID NO: 650137 - RNA, 23 nt, Human
gaggagggucugacaaguguagc

SEQ ID NO: 650138 - RNA, 22 nt, Human
cagcccuggugagguuggcuau

SEQ ID NO: 650139 - RNA, 22 nt, Human
agccuaggggguccugggccac

SEQ ID NO: 650140 - RNA, 20 nt, Human
acaaaauagguacuggguag

SEQ ID NO: 650141 - RNA, 22 nt, Human
gcacagacuuugauugcaguca

SEQ ID NO: 650142 - RNA, 22 nt, Human
aggcacugacucaagggagcca

SEQ ID NO: 650143 - RNA, 22 nt, Human
aggcugagagcaacgugucaga

SEQ ID NO: 650144 - RNA, 22 nt, Human
uuaaaggcugaucuuaauauua

SEQ ID NO: 650145 - RNA, 22 nt, Human
aagaaagauaagguuugcuugg

SEQ ID NO: 650146 - RNA, 22 nt, Human
gaagaaggguaaggaguguuga

SEQ ID NO: 650147 - RNA, 19 nt, Human
agcaggcagguggcccagg

SEQ ID NO: 650148 - RNA, 22 nt, Human
caacaauaugccagacucaauu

SEQ ID NO: 650149 - RNA, 22 nt, Human
cccagaguggagggugcagaau

SEQ ID NO: 650150 - RNA, 22 nt, Human
uacugaaggacuugaggguuuc

SEQ ID NO: 650151 - RNA, 22 nt, Human
gagaggugaauguggaugccac

SEQ ID NO: 650152 - RNA, 22 nt, Human
aauugaaauucuuuguggucca

SEQ ID NO: 650153 - RNA, 19 nt, Human
cugagucaaagguuguggg

SEQ ID NO: 650154 - RNA, 22 nt, Human
gaaauauacauugcaggaagag

SEQ ID NO: 650155 - RNA, 22 nt, Human
guuggaauuugcucauccauuu

SEQ ID NO: 650156 - RNA, 22 nt, Human
uucaggagaauuccaagaagua

SEQ ID NO: 650157 - RNA, 22 nt, Human
cccaugagugcugcucagaggc

SEQ ID NO: 650158 - RNA, 18 nt, Human
cacaauuuacagaugaca

SEQ ID NO: 650159 - RNA, 22 nt, Human
ugacagacagcuucucauuuua

SEQ ID NO: 650160 - RNA, 22 nt, Human
cagcuccccucuguggggcagu

SEQ ID NO: 650161 - RNA, 22 nt, Human
uccuccagcuucucuuuugggg

SEQ ID NO: 650162 - RNA, 22 nt, Human
gcugugcagagcacaggguccc

SEQ ID NO: 650163 - RNA, 22 nt, Human
cagcgccuccuggaccuccucu

SEQ ID NO: 650164 - RNA, 22 nt, Human
cuugggcacaucccugguauuu

SEQ ID NO: 650165 - RNA, 22 nt, Human
aggcucagauccuuguguccug

SEQ ID NO: 650166 - RNA, 22 nt, Human
ucacuuuggauuauguaauuuc

SEQ ID NO: 650167 - RNA, 22 nt, Human
acacaguauugugacuauaacu

SEQ ID NO: 650168 - RNA, 18 nt, Human
cuuguucuucucuuggcg

SEQ ID NO: 650169 - RNA, 22 nt, Human
ugagggucauuuggaaguggaa

SEQ ID NO: 650170 - RNA, 22 nt, Human
gggagcugaacugcugaaguug

SEQ ID NO: 650171 - RNA, 22 nt, Human
aaagucauuuagccuuaucucc

SEQ ID NO: 650172 - RNA, 19 nt, Human
uaacucuuuccuuuucccc

SEQ ID NO: 650173 - RNA, 21 nt, Human
uccaagccuucaacacauuca

SEQ ID NO: 650174 - RNA, 22 nt, Human
guuugcauggaagacagugagu

SEQ ID NO: 650175 - RNA, 22 nt, Human
cucuggaguucucaugaggaac

SEQ ID NO: 650176 - RNA, 22 nt, Human
cugcuuuaccaaacucuuggau

SEQ ID NO: 650177 - RNA, 21 nt, Human
agaagccauuuguuaggacuu

SEQ ID NO: 650178 - RNA, 22 nt, Human
uucuuccuugguuuccuggaua

SEQ ID NO: 650179 - RNA, 20 nt, Human
ggcuuucugugauccucagu

SEQ ID NO: 650180 - RNA, 22 nt, Human
augcauaucuccuaucuccuca

SEQ ID NO: 650181 - RNA, 22 nt, Human
uguauuucgcuagguacucccu

SEQ ID NO: 650182 - RNA, 22 nt, Human
auucugcucaugagcucccggg

SEQ ID NO: 650183 - RNA, 22 nt, Human
augagaaugcauucauguuuug

SEQ ID NO: 650184 - RNA, 22 nt, Human
gaagcaaucuggcucccagcca

SEQ ID NO: 650185 - RNA, 22 nt, Human
cccucugaaccugguagcagaa

SEQ ID NO: 650186 - RNA, 22 nt, Human
uauacagucuuuugcuauauuc

SEQ ID NO: 650187 - RNA, 22 nt, Human
gaaguucuuugcuccccaguac

SEQ ID NO: 650188 - RNA, 22 nt, Human
gugugcagggcugccugugccg

SEQ ID NO: 650189 - RNA, 17 nt, Human
ucaauacacugcuuuua

SEQ ID NO: 650190 - RNA, 22 nt, Human
uggggacacagagguucguugg

SEQ ID NO: 650191 - RNA, 22 nt, Human
gccugaagaacagcugugagga

SEQ ID NO: 650192 - RNA, 22 nt, Human
uccccaggaguuuuacuuugca

SEQ ID NO: 650193 - RNA, 22 nt, Human
uucaguuucagucuugcaaaaa

SEQ ID NO: 650194 - RNA, 22 nt, Human
caggggcugugggcggagccuc

SEQ ID NO: 650195 - RNA, 22 nt, Human
cuauacacuuuuugaaaauaga

SEQ ID NO: 650196 - RNA, 22 nt, Human
acagggcccuugccagcacaag

SEQ ID NO: 650197 - RNA, 22 nt, Human
uuauucugucuuuggucucaau

SEQ ID NO: 650198 - RNA, 22 nt, Human
cugugaauugaauaugacuaug

SEQ ID NO: 650199 - RNA, 22 nt, Human
uuuacccauauuagcaucaagu

SEQ ID NO: 650200 - RNA, 22 nt, Human
aggauuugcacugguguuugag

SEQ ID NO: 650201 - RNA, 21 nt, Human
cuugucuugcuuagaauagac

SEQ ID NO: 650202 - RNA, 22 nt, Human
ucauucuugaucacuaguuagu

SEQ ID NO: 650203 - RNA, 22 nt, Human
aacuuucugaaaagcuugauca

SEQ ID NO: 650204 - RNA, 20 nt, Human
ggaagccagcauccuugagg

SEQ ID NO: 650205 - RNA, 22 nt, Human
agagcccuguggacugucaagu

SEQ ID NO: 650206 - RNA, 22 nt, Human
caaagaugcugauguuggauca

SEQ ID NO: 650207 - RNA, 22 nt, Human
ugucaccuggaaaucacucuaa

SEQ ID NO: 650208 - RNA, 22 nt, Human
auguccaguacuucuaaauggu

SEQ ID NO: 650209 - RNA, 22 nt, Human
aauuaggaaauucagccauuuu

SEQ ID NO: 650210 - RNA, 22 nt, Human
cugccauccucaccagagcagc

SEQ ID NO: 650211 - RNA, 22 nt, Human
gagucauugcacacuagcucag

SEQ ID NO: 650212 - RNA, 21 nt, Human
ccacauucucauucugacugc

SEQ ID NO: 650213 - RNA, 22 nt, Human
aguagggagaccggaggccgcc

SEQ ID NO: 650214 - RNA, 22 nt, Human
aggaagagcuggaccagaggac

SEQ ID NO: 650215 - RNA, 22 nt, Human
cugggacagagcagcagugggg

SEQ ID NO: 650216 - RNA, 22 nt, Human
agacacuuauuuagugggaguu

SEQ ID NO: 650217 - RNA, 22 nt, Human
gccagccccagacauccuaucg

SEQ ID NO: 650218 - RNA, 23 nt, Human
uuacaguaggaguuggaaaacca

SEQ ID NO: 650219 - RNA, 22 nt, Human
aagaggugccagggguuuugua

SEQ ID NO: 650220 - RNA, 22 nt, Human
guccugugagauucaugcucaa

SEQ ID NO: 650221 - RNA, 22 nt, Human
cagguccugcagggagaguaaa

SEQ ID NO: 650222 - RNA, 22 nt, Human
ugggaagguguagaaagaacaa

SEQ ID NO: 650223 - RNA, 22 nt, Human
aauuggacugugcugcucaaaa

SEQ ID NO: 650224 - RNA, 22 nt, Human
auaugacagcggauucacauau

SEQ ID NO: 650225 - RNA, 22 nt, Human
augagcuugguccagcaggcuu

SEQ ID NO: 650226 - RNA, 22 nt, Human
aaagguuuauugauucugcucu

SEQ ID NO: 650227 - RNA, 22 nt, Human
gcauguggccuucaggcuggaa

SEQ ID NO: 650228 - RNA, 20 nt, Human
cugccuggaggccucuaccu

SEQ ID NO: 650229 - RNA, 22 nt, Human
agacagggagggagcgcggcug

SEQ ID NO: 650230 - RNA, 22 nt, Human
acagcuuuaucucagggaucag

SEQ ID NO: 650231 - RNA, 22 nt, Human
uuaacaaaaauaucaggcauca

SEQ ID NO: 650232 - RNA, 22 nt, Human
ggcagucacaggggagacuggg

SEQ ID NO: 650233 - RNA, 22 nt, Human
ugccaccccucugcacccucag

SEQ ID NO: 650234 - RNA, 22 nt, Human
acucaugucauguguucuuuac

SEQ ID NO: 650235 - RNA, 22 nt, Human
gggcagcuguaucugagcuuau

SEQ ID NO: 650236 - RNA, 22 nt, Human
aaguauauacuaaauguuaauc

SEQ ID NO: 650237 - RNA, 22 nt, Human
cagucucuggcagcugcuggcc

SEQ ID NO: 650238 - RNA, 22 nt, Human
ccucugcagcagagagccagag

SEQ ID NO: 650239 - RNA, 22 nt, Human
aaagccuugagauccuauaguu

SEQ ID NO: 650240 - RNA, 22 nt, Human
agaguauugugaccauuuguca

SEQ ID NO: 650241 - RNA, 22 nt, Human
agaugguucucagaaacucaac

SEQ ID NO: 650242 - RNA, 20 nt, Human
uccagcauauaaacuccucu

SEQ ID NO: 650243 - RNA, 22 nt, Human
aggacagguguagugggcucug

SEQ ID NO: 650244 - RNA, 22 nt, Human
gcagaggugucaccuuccagga

SEQ ID NO: 650245 - RNA, 22 nt, Human
gugcuucuccguucugcagcac

SEQ ID NO: 650246 - RNA, 23 nt, Human
uaugucaugagcauauugaaugu

SEQ ID NO: 650247 - RNA, 22 nt, Human
aaaaccaggcuugcugugcucg

SEQ ID NO: 650248 - RNA, 22 nt, Human
auucuaauggcagagacuccug

SEQ ID NO: 650249 - RNA, 22 nt, Human
agacuguagggauagaggucuu

SEQ ID NO: 650250 - RNA, 22 nt, Human
agggaggucuuugaggggcuua

SEQ ID NO: 650251 - RNA, 22 nt, Human
acagcugggaacucacacagca

SEQ ID NO: 650252 - RNA, 22 nt, Human
gggcugagugggccucuuacuu

SEQ ID NO: 650253 - RNA, 22 nt, Human
uguuccugaggcaugugucaau

SEQ ID NO: 650254 - RNA, 22 nt, Human
ucaggcaggacaauuauuuagg

SEQ ID NO: 650255 - RNA, 22 nt, Human
cuuuagacaucucauuguguaa

SEQ ID NO: 650256 - RNA, 22 nt, Human
ugucaccuugaugauggccuag

SEQ ID NO: 650257 - RNA, 22 nt, Human
cugaggccucuccuuggcuugu

SEQ ID NO: 650258 - RNA, 22 nt, Human
ggugcagaguccacagaaagcu

SEQ ID NO: 650259 - RNA, 22 nt, Human
uggcuccagcucaaguauggca

SEQ ID NO: 650260 - RNA, 22 nt, Human
ucucuuccaguaagagucuuua

SEQ ID NO: 650261 - RNA, 20 nt, Human
cagcucugggcaggucgagg

SEQ ID NO: 650262 - RNA, 22 nt, Human
cuggguuuuauuacagugagcu

SEQ ID NO: 650263 - RNA, 22 nt, Human
cugugugcagggcacaauggaa

SEQ ID NO: 650264 - RNA, 16 nt, Human
aacaaugccaauccag

SEQ ID NO: 650265 - RNA, 22 nt, Human
gaggaggcuaucagcaaucagg

SEQ ID NO: 650266 - RNA, 22 nt, Human
gcccugugauggagacuagagg

SEQ ID NO: 650267 - RNA, 19 nt, Human
cucucagccugucuccuug

SEQ ID NO: 650268 - RNA, 22 nt, Human
uagaaagacuguccagauuuca

SEQ ID NO: 650269 - RNA, 22 nt, Human
aaccaggacaauuuugaaagua

SEQ ID NO: 650270 - RNA, 22 nt, Human
agaguacauucagagcuaccua

SEQ ID NO: 650271 - RNA, 22 nt, Human
guuacaaauguaaauucugggg

SEQ ID NO: 650272 - RNA, 22 nt, Human
agacauauuggcuugcuuuaau

SEQ ID NO: 650273 - RNA, 22 nt, Human
ucuggggacggggcccagcaau

SEQ ID NO: 650274 - RNA, 22 nt, Human
caaagggcucuagacucagcag

SEQ ID NO: 650275 - RNA, 22 nt, Human
aggcagccauuaccaagggcau

SEQ ID NO: 650276 - RNA, 22 nt, Human
cucugcaucaggcauuauggau

SEQ ID NO: 650277 - RNA, 21 nt, Human
gaaccugagugaagacuuggg

SEQ ID NO: 650278 - RNA, 22 nt, Human
cugugccaguguauuccuguga

SEQ ID NO: 650279 - RNA, 22 nt, Human
uggccacaugcgucugugaggc

SEQ ID NO: 650280 - RNA, 22 nt, Human
aaccuguuuucuucucaucuag

SEQ ID NO: 650281 - RNA, 20 nt, Human
cagaggcaaggagacuugga

SEQ ID NO: 650282 - RNA, 22 nt, Human
aggaggguugaggaggauacuu

SEQ ID NO: 650283 - RNA, 22 nt, Human
uauagagguggaaacugagguu

SEQ ID NO: 650284 - RNA, 22 nt, Human
agagaucuagcaccugcugguc

SEQ ID NO: 650285 - RNA, 20 nt, Human
uuugucuguuaaguguuucu

SEQ ID NO: 650286 - RNA, 22 nt, Human
gguacaaugucuuacagaccca

SEQ ID NO: 650287 - RNA, 22 nt, Human
uugcuauaaauggucuaucuuu

SEQ ID NO: 650288 - RNA, 22 nt, Human
aguguauugauuggaacagccu

SEQ ID NO: 650289 - RNA, 21 nt, Human
aauggaaguuuaaagguaucc

SEQ ID NO: 650290 - RNA, 22 nt, Human
uuagacaggauguaugaaagcu

SEQ ID NO: 650291 - RNA, 20 nt, Human
gggagcuggaauugucuuag

SEQ ID NO: 650292 - RNA, 22 nt, Human
ugagccaggcucaagugauccu

SEQ ID NO: 650293 - RNA, 22 nt, Human
guggcaaggagcaugaaaaguc

SEQ ID NO: 650294 - RNA, 22 nt, Human
uccauucuaugcuuacauuuau

SEQ ID NO: 650295 - RNA, 22 nt, Human
agauguggccuuugggagauua

SEQ ID NO: 650296 - RNA, 22 nt, Human
uaaaaugaucucucauguucuu

SEQ ID NO: 650297 - RNA, 22 nt, Human
uaaacauggcuguuucaguuau

SEQ ID NO: 650298 - RNA, 22 nt, Human
cuggacacacuggagucuggca

SEQ ID NO: 650299 - RNA, 22 nt, Human
cagggcuagugacaccccaguc

SEQ ID NO: 650300 - RNA, 22 nt, Human
uugcagggcaggaccauggaca

SEQ ID NO: 650301 - RNA, 22 nt, Human
cacacucauuagucauuucucu

SEQ ID NO: 650302 - RNA, 22 nt, Human
ggucccuggaagucccucuucu

SEQ ID NO: 650303 - RNA, 22 nt, Human
gguacaauccacuguggguuag

SEQ ID NO: 650304 - RNA, 22 nt, Human
ugagagccuguguucaaaugcc

SEQ ID NO: 650305 - RNA, 22 nt, Human
uaacaauucucaaaagagggga

SEQ ID NO: 650306 - RNA, 22 nt, Human
uuuagaauguuagcguuaaagg

SEQ ID NO: 650307 - RNA, 22 nt, Human
uauuucuggcuuugagggugau

SEQ ID NO: 650308 - RNA, 22 nt, Human
ccagcagagugggguuuagagu

SEQ ID NO: 650309 - RNA, 22 nt, Human
aacuacauuguccuuucugaag

SEQ ID NO: 650310 - RNA, 22 nt, Human
ucccuccaggcagcuggguacu

SEQ ID NO: 650311 - RNA, 22 nt, Human
gguggggucacgacagagggaa

SEQ ID NO: 650312 - RNA, 22 nt, Human
agucacugguucuguaauuaau

SEQ ID NO: 650313 - RNA, 19 nt, Human
agguagcucagacucaaag

SEQ ID NO: 650314 - RNA, 22 nt, Human
cuggccugaggccgccuucaga

SEQ ID NO: 650315 - RNA, 22 nt, Human
cuccagaagacccauccucaug

SEQ ID NO: 650316 - RNA, 22 nt, Human
uccuccagagauuugaguuauu

SEQ ID NO: 650317 - RNA, 22 nt, Human
cugucucagcaggaagucauca

SEQ ID NO: 650318 - RNA, 22 nt, Human
ucugagguguagcugggcuuca

SEQ ID NO: 650319 - RNA, 22 nt, Human
aaauaguucagcuuguaaaccc

SEQ ID NO: 650320 - RNA, 22 nt, Human
ggcccuuccugcucucuuagcu

SEQ ID NO: 650321 - RNA, 22 nt, Human
uggcugcaggggugucugacau

SEQ ID NO: 650322 - RNA, 22 nt, Human
acauuugaaauucugaacagau

SEQ ID NO: 650323 - RNA, 20 nt, Human
uguagguguacaguaaggag

SEQ ID NO: 650324 - RNA, 22 nt, Human
gaggacagugugaucugccagc

SEQ ID NO: 650325 - RNA, 22 nt, Human
aagucccuuuaaucagugccuu

SEQ ID NO: 650326 - RNA, 22 nt, Human
gcauccaaauguuucauuucuu

SEQ ID NO: 650327 - RNA, 22 nt, Human
caggagcccagaguccucagcu

SEQ ID NO: 650328 - RNA, 22 nt, Human
uuucucuggccucaguuuaaca

SEQ ID NO: 650329 - RNA, 22 nt, Human
uugcgcgcggcuaggucucggu

SEQ ID NO: 650330 - RNA, 21 nt, Human
agcggcagacccugcauuuga

SEQ ID NO: 650331 - RNA, 22 nt, Human
uccagagguauguagagaguau

SEQ ID NO: 650332 - RNA, 22 nt, Human
gccaggguugccaaugggggca

SEQ ID NO: 650333 - RNA, 22 nt, Human
ggcuccagggucucuccuugug

SEQ ID NO: 650334 - RNA, 22 nt, Human
cucaguuucuuacucuguauaa

SEQ ID NO: 650335 - RNA, 22 nt, Human
gugaaauuguauuuggcauuga

SEQ ID NO: 650336 - RNA, 22 nt, Human
agcccagguugaggcugcagug

SEQ ID NO: 650337 - RNA, 22 nt, Human
agcuuagaauguguuaggaaag

SEQ ID NO: 650338 - RNA, 22 nt, Human
uucacagggcagcagcugagcc

SEQ ID NO: 650339 - RNA, 22 nt, Human
uagaggcacccuggaggagacu

SEQ ID NO: 650340 - RNA, 22 nt, Human
uauauugacuuuaaagaagcaa

SEQ ID NO: 650341 - RNA, 22 nt, Human
cccagcaggcauguugggagga

SEQ ID NO: 650342 - RNA, 22 nt, Human
agcugugguguuuucaagcccu

SEQ ID NO: 650343 - RNA, 22 nt, Human
cugggagcuggaaugggagaag

SEQ ID NO: 650344 - RNA, 22 nt, Human
guucugcuguaauaucucugcu

SEQ ID NO: 650345 - RNA, 22 nt, Human
cauaauuucuguaucagcacca

SEQ ID NO: 650346 - RNA, 22 nt, Human
cccugugggaacuccugaguug

SEQ ID NO: 650347 - RNA, 23 nt, Human
uuuaacuuuccaauaauucauug

SEQ ID NO: 650348 - RNA, 16 nt, Human
gcugggagggagaggu

SEQ ID NO: 650349 - RNA, 22 nt, Human
gcagauggacuguaugaccuga

SEQ ID NO: 650350 - RNA, 22 nt, Human
auggagagugaaagucucucua

SEQ ID NO: 650351 - RNA, 19 nt, Human
uguuucuuccuccaucuga

SEQ ID NO: 650352 - RNA, 22 nt, Human
cagggaguguacaccaugugua

SEQ ID NO: 650353 - RNA, 22 nt, Human
uagauuuaagacccugaauuug

SEQ ID NO: 650354 - RNA, 22 nt, Human
ucuuuucuguaacucagugucu

SEQ ID NO: 650355 - RNA, 22 nt, Human
aggcgcagaaggccaggggccu

SEQ ID NO: 650356 - RNA, 22 nt, Human
auuucccacucaggccgcggcg

SEQ ID NO: 650357 - RNA, 22 nt, Human
uuacagaaucuacucgugguga

SEQ ID NO: 650358 - RNA, 22 nt, Human
gcuccuggcauccugcuuuuaa

SEQ ID NO: 650359 - RNA, 22 nt, Human
aagggcuggcccugggaagagu

SEQ ID NO: 650360 - RNA, 22 nt, Human
agcugcagcuguuuucugagug

SEQ ID NO: 650361 - RNA, 22 nt, Human
uuaauccaauauccuggcuauu

SEQ ID NO: 650362 - RNA, 22 nt, Human
auugaacugucuuugaagaaau

SEQ ID NO: 650363 - RNA, 22 nt, Human
aggccacauagcuugcauguag

SEQ ID NO: 650364 - RNA, 23 nt, Human
acugagcauuaguauuuuuauaa

SEQ ID NO: 650365 - RNA, 23 nt, Human
uuucaacaaugcuuagagaaaac

SEQ ID NO: 650366 - RNA, 22 nt, Human
augcaacauacauucugaagcu

SEQ ID NO: 650367 - RNA, 22 nt, Human
guggggguggaaaggcaaguug

SEQ ID NO: 650368 - RNA, 22 nt, Human
ucagagaguuggaaagaauuaa

SEQ ID NO: 650369 - RNA, 22 nt, Human
cucagggaagcuauggugaggg

SEQ ID NO: 650370 - RNA, 18 nt, Human
agaagcacaagaugucuu

SEQ ID NO: 650371 - RNA, 22 nt, Human
auucucauuugcuggcuauaug

SEQ ID NO: 650372 - RNA, 20 nt, Human
ugcauaguugcugcaguuga

SEQ ID NO: 650373 - RNA, 22 nt, Human
cugagaguauuggcaggcuugg

SEQ ID NO: 650374 - RNA, 22 nt, Human
guaaagcaaaauguagagauug

SEQ ID NO: 650375 - RNA, 22 nt, Human
uucacaaagcuggagcauuucc

SEQ ID NO: 650376 - RNA, 22 nt, Human
acacuuuaugucuagaucuggg

SEQ ID NO: 650377 - RNA, 22 nt, Human
uacccaggggcugagcagaggu

SEQ ID NO: 650378 - RNA, 22 nt, Human
aaucaguauugguauagaauga

SEQ ID NO: 650379 - RNA, 22 nt, Human
acauuuuuggguugaugucuga

SEQ ID NO: 650380 - RNA, 22 nt, Human
aacuuuuaaaauacacagacaa

SEQ ID NO: 650381 - RNA, 21 nt, Human
gccugagcaugucuucagguc

SEQ ID NO: 650382 - RNA, 22 nt, Human
ccucagggucugaggagaccgu

SEQ ID NO: 650383 - RNA, 22 nt, Human
acucugaggcaggucagggcag

SEQ ID NO: 650384 - RNA, 22 nt, Human
ucaagagaagugcuccacagua

SEQ ID NO: 650385 - RNA, 22 nt, Human
gcuggccauucucuuugagaug

SEQ ID NO: 650386 - RNA, 22 nt, Human
auauucacuccuggugagacua

SEQ ID NO: 650387 - RNA, 22 nt, Human
uccgauaagcaauucuugugcu

SEQ ID NO: 650388 - RNA, 22 nt, Human
ccagaaaaugcagaacauagaa

SEQ ID NO: 650389 - RNA, 20 nt, Human
ccagagaguagguuagugau

SEQ ID NO: 650390 - RNA, 22 nt, Human
cccagggucccugcucucugug

SEQ ID NO: 650391 - RNA, 22 nt, Human
gcaguccuuaggagaggaagua

SEQ ID NO: 650392 - RNA, 22 nt, Human
agccaggaagaaggucacacca

SEQ ID NO: 650393 - RNA, 22 nt, Human
uaguucaccccucuuuauuuuc

SEQ ID NO: 650394 - RNA, 22 nt, Human
gacacauacagcaguaagucua

SEQ ID NO: 650395 - RNA, 22 nt, Human
aaguccagugcuuuagauucca

SEQ ID NO: 650396 - RNA, 22 nt, Human
ccugggccuauccuagaaccaa

SEQ ID NO: 650397 - RNA, 22 nt, Human
aagccaggcugcacuugcuggg

SEQ ID NO: 650398 - RNA, 22 nt, Human
aucaguuuaacugucaagagcc

SEQ ID NO: 650399 - RNA, 22 nt, Human
gaaugcuuggaaccugaaguuc

SEQ ID NO: 650400 - RNA, 22 nt, Human
ggucagcagugcagggcagagc

SEQ ID NO: 650401 - RNA, 22 nt, Human
caucagucugaaagccagggag

SEQ ID NO: 650402 - RNA, 22 nt, Human
cagcagcuguuuacggaacacc

SEQ ID NO: 650403 - RNA, 17 nt, Human
uccagccuccucugcug

SEQ ID NO: 650404 - RNA, 22 nt, Human
uuuaguguggcacugauguuca

SEQ ID NO: 650405 - RNA, 22 nt, Human
auagggccuaaaaaguauugcu

SEQ ID NO: 650406 - RNA, 22 nt, Human
uaucucuguaaaagaaaucaca

SEQ ID NO: 650407 - RNA, 22 nt, Human
gcagccaccucccauggcgggg

SEQ ID NO: 650408 - RNA, 22 nt, Human
uggcacaggaauuuagaugcag

SEQ ID NO: 650409 - RNA, 22 nt, Human
cuccugggcuucgaaggcuccc

SEQ ID NO: 650410 - RNA, 22 nt, Human
uuuaugagcaaugcugagggga

SEQ ID NO: 650411 - RNA, 22 nt, Human
uuccuaacaagucuaucuuuga

SEQ ID NO: 650412 - RNA, 22 nt, Human
ccagguguagcacugcucacag

SEQ ID NO: 650413 - RNA, 18 nt, Human
ccuaagcuccagccccag

SEQ ID NO: 650414 - RNA, 22 nt, Human
uuccugaugcacacagucauuu

SEQ ID NO: 650415 - RNA, 22 nt, Human
guccagagaggcaggaggcuac

SEQ ID NO: 650416 - RNA, 22 nt, Human
ucagcagacaguuagcuauauu

SEQ ID NO: 650417 - RNA, 22 nt, Human
uucugauaccuugcaggauccu

SEQ ID NO: 650418 - RNA, 21 nt, Human
cccuguguuccacagcagaca

SEQ ID NO: 650419 - RNA, 22 nt, Human
uguggccuccccacuucugggg

SEQ ID NO: 650420 - RNA, 23 nt, Human
agaagcagcuucuggaguaucgg

SEQ ID NO: 650421 - RNA, 22 nt, Human
ucagucuugcuucucuuggguc

SEQ ID NO: 650422 - RNA, 22 nt, Human
ccagugggagggagcuaggcca

SEQ ID NO: 650423 - RNA, 22 nt, Human
gcuguguuugacaguagcagac

SEQ ID NO: 650424 - RNA, 22 nt, Human
ucaggugaccugagccacuaug

SEQ ID NO: 650425 - RNA, 22 nt, Human
ucaguguuuuccagggucuacu

SEQ ID NO: 650426 - RNA, 22 nt, Human
ucaggcaggaucccagggaagg

SEQ ID NO: 650427 - RNA, 22 nt, Human
cccacaggcccugcugccuuga

SEQ ID NO: 650428 - RNA, 22 nt, Human
gugcugaauugugcucuuuaca

SEQ ID NO: 650429 - RNA, 22 nt, Human
auucugcauugcucacaaagau

SEQ ID NO: 650430 - RNA, 22 nt, Human
cuaacauuuggaaggcuuauga

SEQ ID NO: 650431 - RNA, 22 nt, Human
ccagccaugcacaaaccaugag

SEQ ID NO: 650432 - RNA, 22 nt, Human
auccucagaccucagcaaagcc

SEQ ID NO: 650433 - RNA, 22 nt, Human
gagagcuaggccacuggggcuu

SEQ ID NO: 650434 - RNA, 22 nt, Human
cugcuguucugaagcaacaagc

SEQ ID NO: 650435 - RNA, 19 nt, Human
aggucauugauagugcagg

SEQ ID NO: 650436 - RNA, 22 nt, Human
ucagaaacagaaacuaagaacc

SEQ ID NO: 650437 - RNA, 17 nt, Human
uccuguuuaucauugau

SEQ ID NO: 650438 - RNA, 21 nt, Human
ggcagcugaccgcgcggugca

SEQ ID NO: 650439 - RNA, 18 nt, Human
auguggcuagugcaacug

SEQ ID NO: 650440 - RNA, 22 nt, Human
accagcaguuaugaggccagga

SEQ ID NO: 650441 - RNA, 22 nt, Human
agcagagaccugguuuuguuga

SEQ ID NO: 650442 - RNA, 22 nt, Human
cugugucccccucagccaggug

SEQ ID NO: 650443 - RNA, 22 nt, Human
ucugcacauagguaggcuggaa

SEQ ID NO: 650444 - RNA, 18 nt, Human
cucucuuuccacucuuug

SEQ ID NO: 650445 - RNA, 19 nt, Human
ggccccucucacaggaguu

SEQ ID NO: 650446 - RNA, 22 nt, Human
gcuguucugcgucccaggcugg

SEQ ID NO: 650447 - RNA, 22 nt, Human
aaguucuaauuuugcauucagg

SEQ ID NO: 650448 - RNA, 22 nt, Human
gucugcuggugccuggccugcg

SEQ ID NO: 650449 - RNA, 22 nt, Human
ccccacagcuuguggagagaau

SEQ ID NO: 650450 - RNA, 22 nt, Human
uaggcagcgcuuggcugugcuu

SEQ ID NO: 650451 - RNA, 22 nt, Human
agagcacaaauuuuaaggaggc

SEQ ID NO: 650452 - RNA, 22 nt, Human
gagcagcugugggguugaccau

SEQ ID NO: 650453 - RNA, 22 nt, Human
uggcaaccgcauggccugcuuc

SEQ ID NO: 650454 - RNA, 22 nt, Human
ccaggacucaguggggaaaggg

SEQ ID NO: 650455 - RNA, 22 nt, Human
caaaauugaugaauguaugauu

SEQ ID NO: 650456 - RNA, 22 nt, Human
cugcuguggguuaagacacugu

SEQ ID NO: 650457 - RNA, 22 nt, Human
ucagggcuccggaaguggccuc

SEQ ID NO: 650458 - RNA, 22 nt, Human
cacacauggcugccagggaggu

SEQ ID NO: 650459 - RNA, 22 nt, Human
cugagguccucagagggaaagg

SEQ ID NO: 650460 - RNA, 22 nt, Human
agagccugagaggauaaugggg

SEQ ID NO: 650461 - RNA, 22 nt, Human
agucaguuaaccucacagcauc

SEQ ID NO: 650462 - RNA, 22 nt, Human
uaagacacaguccgcacucucu

SEQ ID NO: 650463 - RNA, 22 nt, Human
agccagagacuuuaccugugca

SEQ ID NO: 650464 - RNA, 22 nt, Human
cugccccuggcuggugaagcag

SEQ ID NO: 650465 - RNA, 22 nt, Human
aacccgggagguggagguuaug

SEQ ID NO: 650466 - RNA, 22 nt, Human
cauuucacaaauggccacauca

SEQ ID NO: 650467 - RNA, 22 nt, Human
caugggcccgugagaggcaggg

SEQ ID NO: 650468 - RNA, 19 nt, Human
agucccaggcccgaaagag

SEQ ID NO: 650469 - RNA, 22 nt, Human
uuguuucucuggucuugaguga

SEQ ID NO: 650470 - RNA, 22 nt, Human
aaggccaugcuugaguugaagg

SEQ ID NO: 650471 - RNA, 22 nt, Human
uaauacaaggcaggaagcagua

SEQ ID NO: 650472 - RNA, 22 nt, Human
uagcuguuaauauacaaauggu

SEQ ID NO: 650473 - RNA, 21 nt, Human
ucaccuggcuucugaccuggc

SEQ ID NO: 650474 - RNA, 22 nt, Human
aguuuagaagaggaacuuguua

SEQ ID NO: 650475 - RNA, 22 nt, Human
uaggacagaguucccugauggc

SEQ ID NO: 650476 - RNA, 22 nt, Human
acagggucauuuuaugaucugu

SEQ ID NO: 650477 - RNA, 22 nt, Human
ugugcaguuuuaaguggucuaa

SEQ ID NO: 650478 - RNA, 23 nt, Human
ccucagggucuagcagagagaag

SEQ ID NO: 650479 - RNA, 22 nt, Human
acacuagcuaaaugcugauuaa

SEQ ID NO: 650480 - RNA, 22 nt, Human
uuuaauuagcaagccagagagc

SEQ ID NO: 650481 - RNA, 22 nt, Human
gguccaggggguagauauguga

SEQ ID NO: 650482 - RNA, 22 nt, Human
gagggggcucugccaaccuguc

SEQ ID NO: 650483 - RNA, 22 nt, Human
auuaauauugguucauuagcug

SEQ ID NO: 650484 - RNA, 22 nt, Human
ucuguacaacaaagggaugaga

SEQ ID NO: 650485 - RNA, 22 nt, Human
cccucgggucgcggacugcgcu

SEQ ID NO: 650486 - RNA, 22 nt, Human
ggccaccuuccaguugccugca

SEQ ID NO: 650487 - RNA, 22 nt, Human
ugcuguccuguuuuggaguaau

SEQ ID NO: 650488 - RNA, 22 nt, Human
cuuuauuccuacaagauuuucu

SEQ ID NO: 650489 - RNA, 22 nt, Human
cagggcagagccaggauuucaa

SEQ ID NO: 650490 - RNA, 19 nt, Human
gugaggauacugcucagag

SEQ ID NO: 650491 - RNA, 22 nt, Human
agcuccuguggcagcucuucug

SEQ ID NO: 650492 - RNA, 22 nt, Human
uauuucugggaguucagaaauu

SEQ ID NO: 650493 - RNA, 22 nt, Human
acagucugcauaugaccuguag

SEQ ID NO: 650494 - RNA, 22 nt, Human
uugagcaauuaggaaauaaaga

SEQ ID NO: 650495 - RNA, 22 nt, Human
aucauucaucuuauugccaguc

SEQ ID NO: 650496 - RNA, 22 nt, Human
cugggcacugcagcaggcauca

SEQ ID NO: 650497 - RNA, 22 nt, Human
gcagagugggagcccagggcug

SEQ ID NO: 650498 - RNA, 22 nt, Human
ccucugugugugcaugcaugcg

SEQ ID NO: 650499 - RNA, 22 nt, Human
guaugugagguugguuuccagg

SEQ ID NO: 650500 - RNA, 22 nt, Human
uaguaaucagagguaaacuuua

SEQ ID NO: 650501 - RNA, 22 nt, Human
uaacacaugguuaguacacaau

SEQ ID NO: 650502 - RNA, 22 nt, Human
aagagaauucugguuuuccuau

SEQ ID NO: 650503 - RNA, 22 nt, Human
auuccaaacagugcugcagacu

SEQ ID NO: 650504 - RNA, 18 nt, Human
acugugguuuauguguag

SEQ ID NO: 650505 - RNA, 21 nt, Human
uuggauguauuuauguuuuag

SEQ ID NO: 650506 - RNA, 22 nt, Human
ccugagagcauuccacacugaa

SEQ ID NO: 650507 - RNA, 22 nt, Human
guggauggugguccaguaucau

SEQ ID NO: 650508 - RNA, 22 nt, Human
gaauuucaagcagugcaauguu

SEQ ID NO: 650509 - RNA, 22 nt, Human
gguuucaacuucaaccucucca

SEQ ID NO: 650510 - RNA, 22 nt, Human
ucuccaaggcccuacucuauuu

SEQ ID NO: 650511 - RNA, 22 nt, Human
uaucuaaaggauuuaauuuagu

SEQ ID NO: 650512 - RNA, 22 nt, Human
aagugaaugaugugaaguguaa

SEQ ID NO: 650513 - RNA, 22 nt, Human
gaggcccacagggaguaccaag

SEQ ID NO: 650514 - RNA, 22 nt, Human
uaaggcacacaguugcugcaug

SEQ ID NO: 650515 - RNA, 18 nt, Human
aagcaggguccauugugc

SEQ ID NO: 650516 - RNA, 22 nt, Human
ugcccagcgcccacauucuguc

SEQ ID NO: 650517 - RNA, 22 nt, Human
gcuuccgcgauguccuaggugg

SEQ ID NO: 650518 - RNA, 19 nt, Human
aagcuccagcagauccuuu

SEQ ID NO: 650519 - RNA, 22 nt, Human
ucagaaaucuugucaaggcauc

SEQ ID NO: 650520 - RNA, 22 nt, Human
ccagggauguggcagcaccaua

SEQ ID NO: 650521 - RNA, 22 nt, Human
agaagaugacuuuggaguugga

SEQ ID NO: 650522 - RNA, 22 nt, Human
uacugucuggguucccaagcaa

SEQ ID NO: 650523 - RNA, 22 nt, Human
ggugcaggaaucugcaauugaa

SEQ ID NO: 650524 - RNA, 22 nt, Human
acuuuguagguuucagugaaac

SEQ ID NO: 650525 - RNA, 22 nt, Human
gcucccuggcuuuuacagugua

SEQ ID NO: 650526 - RNA, 22 nt, Human
uugaacucuggacccaugccag

SEQ ID NO: 650527 - RNA, 22 nt, Human
ccaggcaccaaaguaugcuuua

SEQ ID NO: 650528 - RNA, 19 nt, Human
ugggcagugccagggcuua

SEQ ID NO: 650529 - RNA, 22 nt, Human
acuugaauucaaagcgaaagca

SEQ ID NO: 650530 - RNA, 17 nt, Human
cagucgaggaggaccug

SEQ ID NO: 650531 - RNA, 22 nt, Human
uugcuuuaccugugguauauuu

SEQ ID NO: 650532 - RNA, 22 nt, Human
uuuaugugaugcaucccagaaa

SEQ ID NO: 650533 - RNA, 22 nt, Human
ccuguacuagggucucauugcc

SEQ ID NO: 650534 - RNA, 22 nt, Human
agagacugucacauaacagagg

SEQ ID NO: 650535 - RNA, 22 nt, Human
cuucucuggcuccucagcgccc

SEQ ID NO: 650536 - RNA, 22 nt, Human
gcccugaaauauuuccacggcc

SEQ ID NO: 650537 - RNA, 22 nt, Human
ugguuuaugcuguugcagcucu

SEQ ID NO: 650538 - RNA, 22 nt, Human
ggugacugguuuaucuggcagu

SEQ ID NO: 650539 - RNA, 20 nt, Human
augugcugggcaauauguua

SEQ ID NO: 650540 - RNA, 22 nt, Human
uaggguaguaccaugcugccag

SEQ ID NO: 650541 - RNA, 22 nt, Human
ucugggaacacacgucacuuca

SEQ ID NO: 650542 - RNA, 22 nt, Human
ccucugaggucauggacuuggc

SEQ ID NO: 650543 - RNA, 22 nt, Human
gauuuuauagucaggaaaaaga

SEQ ID NO: 650544 - RNA, 22 nt, Human
ccuggcagaauauuaaagugca

SEQ ID NO: 650545 - RNA, 22 nt, Human
gcccucuggcagccuuggcugg

SEQ ID NO: 650546 - RNA, 22 nt, Human
ggcuggaggagaauggguguga

SEQ ID NO: 650547 - RNA, 22 nt, Human
gcagcucuccucugugaggaac

SEQ ID NO: 650548 - RNA, 22 nt, Human
agaaaucauucccaaacccaua

SEQ ID NO: 650549 - RNA, 22 nt, Human
aauacagaggcuuccaguaaaa

SEQ ID NO: 650550 - RNA, 20 nt, Human
ugguggccagugcugcaggc

SEQ ID NO: 650551 - RNA, 22 nt, Human
aggcauaaccuuuuaucuggau

SEQ ID NO: 650552 - RNA, 22 nt, Human
agaagcaaggucugucaguaua

SEQ ID NO: 650553 - RNA, 22 nt, Human
aucaacagguauggaugagauu

SEQ ID NO: 650554 - RNA, 22 nt, Human
ggcaggcuagcacugauguccu

SEQ ID NO: 650555 - RNA, 22 nt, Human
uauugcugccauuuuccaaugu

SEQ ID NO: 650556 - RNA, 22 nt, Human
cuccuaggacgccgcugcuccu

SEQ ID NO: 650557 - RNA, 22 nt, Human
ugcaaauuucuuuaguacauaa

SEQ ID NO: 650558 - RNA, 22 nt, Human
cuuuaguuuaagaacaugauga

SEQ ID NO: 650559 - RNA, 21 nt, Human
caaugucugcucucugccuag

SEQ ID NO: 650560 - RNA, 22 nt, Human
uuuacgaaaagugacuaauagg

SEQ ID NO: 650561 - RNA, 23 nt, Human
cagcccuggagaugugggaggca

SEQ ID NO: 650562 - RNA, 22 nt, Human
gcugagagcacauagaaggggc

SEQ ID NO: 650563 - RNA, 22 nt, Human
agugcacaccuuaguacaaagu

SEQ ID NO: 650564 - RNA, 22 nt, Human
cuggacaggcuggggacugcaa

SEQ ID NO: 650565 - RNA, 22 nt, Human
auacagaaaaugaugcagaguu

SEQ ID NO: 650566 - RNA, 22 nt, Human
augggccagcaccauguuaagc

SEQ ID NO: 650567 - RNA, 22 nt, Human
cugcuuggaggccugggugcua

SEQ ID NO: 650568 - RNA, 22 nt, Human
caggcagagugagaagcccuug

SEQ ID NO: 650569 - RNA, 22 nt, Human
ugcuucuuuaaaugauagucaa

SEQ ID NO: 650570 - RNA, 22 nt, Human
agacagggccacucauccucac

SEQ ID NO: 650571 - RNA, 22 nt, Human
uggucccugccugccaagugcu

SEQ ID NO: 650572 - RNA, 18 nt, Human
caguaacuauguuguuac

SEQ ID NO: 650573 - RNA, 22 nt, Human
uguaggauuuucaccagaccuu

SEQ ID NO: 650574 - RNA, 22 nt, Human
gggggcuguccugugcauugua

SEQ ID NO: 650575 - RNA, 22 nt, Human
aggccagccucaggcagggacc

SEQ ID NO: 650576 - RNA, 22 nt, Human
cucggaauggaacaacagcggu

SEQ ID NO: 650577 - RNA, 22 nt, Human
cugugagauuuuuaaauaacuu

SEQ ID NO: 650578 - RNA, 22 nt, Human
guuuugcagagugcaauaaauc

SEQ ID NO: 650579 - RNA, 22 nt, Human
uccaggcaagggaggagcaugg

SEQ ID NO: 650580 - RNA, 21 nt, Human
gggagcuggaaacugggugac

SEQ ID NO: 650581 - RNA, 22 nt, Human
ggaggggauuuaguagaugcua

SEQ ID NO: 650582 - RNA, 22 nt, Human
gccaggcccugggcacuucgug

SEQ ID NO: 650583 - RNA, 22 nt, Human
gcacagcagacuugguggggcu

SEQ ID NO: 650584 - RNA, 19 nt, Human
aguggcagaucuggaagua

SEQ ID NO: 650585 - RNA, 22 nt, Human
aaaaacacaacugucuuucucu

SEQ ID NO: 650586 - RNA, 21 nt, Human
uuggcagucagaaaugugagg

SEQ ID NO: 650587 - RNA, 22 nt, Human
caacaguguugcaaucugaaaa

SEQ ID NO: 650588 - RNA, 22 nt, Human
uguacauugucacucaucaagu

SEQ ID NO: 650589 - RNA, 22 nt, Human
ugucucaguucccuucucugga

SEQ ID NO: 650590 - RNA, 22 nt, Human
acagcuaucugacuuugacuca

SEQ ID NO: 650591 - RNA, 22 nt, Human
cugaguucugcccaaggucugg

SEQ ID NO: 650592 - RNA, 22 nt, Human
ccacugcccaccccgacgucua

SEQ ID NO: 650593 - RNA, 22 nt, Human
ccugcugaggucagccacccaa

SEQ ID NO: 650594 - RNA, 22 nt, Human
aagugauacaucuagucuauaa

SEQ ID NO: 650595 - RNA, 22 nt, Human
auuauacauuuuguguagagau

SEQ ID NO: 650596 - RNA, 22 nt, Human
ccuggcacauaauaguggcuca

SEQ ID NO: 650597 - RNA, 22 nt, Human
gggacucugagagccugagggu

SEQ ID NO: 650598 - RNA, 22 nt, Human
uagacuagaggaucagcaaggg

SEQ ID NO: 650599 - RNA, 22 nt, Human
agacagcaugauacaugaugcu

SEQ ID NO: 650600 - RNA, 22 nt, Human
ucugcugugggucuauauuuua

SEQ ID NO: 650601 - RNA, 22 nt, Human
auccuucagcugcccuguuacc

SEQ ID NO: 650602 - RNA, 22 nt, Human
ggcucuggggccuccucccuug

SEQ ID NO: 650603 - RNA, 22 nt, Human
ggccugcuccgggggcugagcu

SEQ ID NO: 650604 - RNA, 22 nt, Human
uccacaggcaagucucuuggca

SEQ ID NO: 650605 - RNA, 22 nt, Human
ggcagcaggguagccauuucuc

SEQ ID NO: 650606 - RNA, 22 nt, Human
uuuuaugcaaguuaugauuaaa

SEQ ID NO: 650607 - RNA, 22 nt, Human
uagcagagcugcaauauagacc

SEQ ID NO: 650608 - RNA, 22 nt, Human
gagcacugauuuauuuuugucu

SEQ ID NO: 650609 - RNA, 22 nt, Human
uccaauuuguuugaugauggaa

SEQ ID NO: 650610 - RNA, 22 nt, Human
auguaacugaaggaaaugcaug

SEQ ID NO: 650611 - RNA, 23 nt, Human
uucugggcuguggaagccucggg

SEQ ID NO: 650612 - RNA, 22 nt, Human
cucaggaggugguagaggcccu

SEQ ID NO: 650613 - RNA, 22 nt, Human
uggcugagaaguucugguggga

SEQ ID NO: 650614 - RNA, 22 nt, Human
gugccuggggguaauguaggau

SEQ ID NO: 650615 - RNA, 22 nt, Human
uuucuauuguaagucuccuaua

SEQ ID NO: 650616 - RNA, 22 nt, Human
caugagaaguggccuucaaaaa

SEQ ID NO: 650617 - RNA, 22 nt, Human
ugcacauugaaugagcaaacug

SEQ ID NO: 650618 - RNA, 22 nt, Human
gaacagaugccugauucauagg

SEQ ID NO: 650619 - RNA, 22 nt, Human
cacaaggagguccugaggaagc

SEQ ID NO: 650620 - RNA, 22 nt, Human
gcugccugugcacuuucucgua

SEQ ID NO: 650621 - RNA, 22 nt, Human
uuacauacaaaggcuggguuau

SEQ ID NO: 650622 - RNA, 22 nt, Human
cccuggggcugagggauggccg

SEQ ID NO: 650623 - RNA, 19 nt, Human
cucuuuacucccuugccuu

SEQ ID NO: 650624 - RNA, 22 nt, Human
aaaugcagguaguauuuauuuu

SEQ ID NO: 650625 - RNA, 22 nt, Human
cauugucacccaaagcucauag

SEQ ID NO: 650626 - RNA, 22 nt, Human
gaugugugcugcauaguauauu

SEQ ID NO: 650627 - RNA, 22 nt, Human
accagugcuuccugcuggagcu

SEQ ID NO: 650628 - RNA, 22 nt, Human
guauuuccuauagugagggccu

SEQ ID NO: 650629 - RNA, 22 nt, Human
ggucagccuuggauuugguagc

SEQ ID NO: 650630 - RNA, 22 nt, Human
uguggucuccccagugccagcu

SEQ ID NO: 650631 - RNA, 22 nt, Human
uaaagugcuuccuaacccagag

SEQ ID NO: 650632 - RNA, 22 nt, Human
cuucuuaacuguauauacuaug

SEQ ID NO: 650633 - RNA, 22 nt, Human
agcagguguaucggucaccuac

SEQ ID NO: 650634 - RNA, 22 nt, Human
acacagggauauuucagguggu

SEQ ID NO: 650635 - RNA, 18 nt, Human
ucagcuuccagcauguuu

SEQ ID NO: 650636 - RNA, 22 nt, Human
uauaaagaaguguaaacaggaa

SEQ ID NO: 650637 - RNA, 22 nt, Human
acaacauuauacauagaaagcu

SEQ ID NO: 650638 - RNA, 22 nt, Human
aauaggaagcaccaaauucucc

SEQ ID NO: 650639 - RNA, 22 nt, Human
gggauggacugacgguagcgcg

SEQ ID NO: 650640 - RNA, 22 nt, Human
agucucaggcagaggaaggcua

SEQ ID NO: 650641 - RNA, 17 nt, Human
cugucugcgcaugaggu

SEQ ID NO: 650642 - RNA, 19 nt, Human
uacuuuuucaggacagagu

SEQ ID NO: 650643 - RNA, 22 nt, Human
cuucugugauuugguuaggaua

SEQ ID NO: 650644 - RNA, 22 nt, Human
uaaacaagaaacauuuucuguu

SEQ ID NO: 650645 - RNA, 22 nt, Human
caccccuugucuuuggggucgu

SEQ ID NO: 650646 - RNA, 22 nt, Human
uucuggaaaucagcagagggug

SEQ ID NO: 650647 - RNA, 23 nt, Human
auccugcugauggcccuccagga

SEQ ID NO: 650648 - RNA, 22 nt, Human
cagaauaaagguacaauugagu

SEQ ID NO: 650649 - RNA, 23 nt, Human
aaucuggcugauguuuuuucucu

SEQ ID NO: 650650 - RNA, 19 nt, Human
ccugaggaaaagaugauug

SEQ ID NO: 650651 - RNA, 22 nt, Human
auugugcaaauauuaucuguag

SEQ ID NO: 650652 - RNA, 22 nt, Human
cagaagcugcagugaucuggga

SEQ ID NO: 650653 - RNA, 22 nt, Human
ggcucugcagugacuugagggg

SEQ ID NO: 650654 - RNA, 18 nt, Human
auuuaugcuaaugggaua

SEQ ID NO: 650655 - RNA, 21 nt, Human
ugacagcauagagcagggagg

SEQ ID NO: 650656 - RNA, 20 nt, Human
cuguccauauuugaaaaugc

SEQ ID NO: 650657 - RNA, 22 nt, Human
ugucuucaucuccaugcacaga

SEQ ID NO: 650658 - RNA, 22 nt, Human
aaguuuuauuggaacauagcca

SEQ ID NO: 650659 - RNA, 22 nt, Human
uucuuucucuacuagcagagcu

SEQ ID NO: 650660 - RNA, 22 nt, Human
cuauauacuuuucacagauguu

SEQ ID NO: 650661 - RNA, 22 nt, Human
uggucuggaacuccuggcuuca

SEQ ID NO: 650662 - RNA, 20 nt, Human
uuauuucaguugcuagauug

SEQ ID NO: 650663 - RNA, 22 nt, Human
uauguagcaauagcaucauacu

SEQ ID NO: 650664 - RNA, 22 nt, Human
cugucugggucuacauccucug

SEQ ID NO: 650665 - RNA, 22 nt, Human
ucuguuauucugucuauugcca

SEQ ID NO: 650666 - RNA, 19 nt, Human
guggccucggagcgcgcgg

SEQ ID NO: 650667 - RNA, 22 nt, Human
ucauacauucagcagauauuug

SEQ ID NO: 650668 - RNA, 22 nt, Human
gacaggcuagguugcuguccuc

SEQ ID NO: 650669 - RNA, 22 nt, Human
gauuucuaaguuuuaccacaaa

SEQ ID NO: 650670 - RNA, 22 nt, Human
uaguuuagaauguugcaauaca

SEQ ID NO: 650671 - RNA, 22 nt, Human
guuauguaugggggccuuauga

SEQ ID NO: 650672 - RNA, 23 nt, Human
gugcaaagauauaccacauggcu

SEQ ID NO: 650673 - RNA, 19 nt, Human
cccagcucucguggugugc

SEQ ID NO: 650674 - RNA, 19 nt, Human
ggcauccagaacuaccagu

SEQ ID NO: 650675 - RNA, 22 nt, Human
aaggugggcagaucacaagguc

SEQ ID NO: 650676 - RNA, 22 nt, Human
cccuggccagcucaugucugag

SEQ ID NO: 650677 - RNA, 22 nt, Human
uuaguugauagccaaaauuuau

SEQ ID NO: 650678 - RNA, 22 nt, Human
cacaugcccagaacuucucauu

SEQ ID NO: 650679 - RNA, 22 nt, Human
aauaacagagucuucaagauag

SEQ ID NO: 650680 - RNA, 22 nt, Human
cucucugggguuccagacgugg

SEQ ID NO: 650681 - RNA, 22 nt, Human
cuccaggagcugugucuuucuu

SEQ ID NO: 650682 - RNA, 22 nt, Human
uauaaagugugaacugugagua

SEQ ID NO: 650683 - RNA, 20 nt, Human
cugcaucugugacuugcaaa

SEQ ID NO: 650684 - RNA, 22 nt, Human
gcugaaaugggcacugaaggcc

SEQ ID NO: 650685 - RNA, 22 nt, Human
cuaccuucaaguuccucccucu

SEQ ID NO: 650686 - RNA, 22 nt, Human
ggcugccaggagggaggccagu

SEQ ID NO: 650687 - RNA, 22 nt, Human
agugcccugcuggggcaggaga

SEQ ID NO: 650688 - RNA, 22 nt, Human
cagcuccagcucugggcgccuc

SEQ ID NO: 650689 - RNA, 22 nt, Human
acugagugggagguuuguguga

SEQ ID NO: 650690 - RNA, 22 nt, Human
acaccagggauaugaggaagga

SEQ ID NO: 650691 - RNA, 22 nt, Human
accugcccuggaggaagauauu

SEQ ID NO: 650692 - RNA, 22 nt, Human
uuugguccuaagcugcucucua

SEQ ID NO: 650693 - RNA, 22 nt, Human
caguuaaacgggccaugugagu

SEQ ID NO: 650694 - RNA, 22 nt, Human
cugcccugaccugccucagagu

SEQ ID NO: 650695 - RNA, 20 nt, Human
uggauucuggagcugcccuc

SEQ ID NO: 650696 - RNA, 20 nt, Human
aucuuugucucuguaguugu

SEQ ID NO: 650697 - RNA, 22 nt, Human
ccuggcagacugugagggcagg

SEQ ID NO: 650698 - RNA, 22 nt, Human
aacaugcaugaagaaguuauau

SEQ ID NO: 650699 - RNA, 22 nt, Human
cagacagagcucacaagucuuu

SEQ ID NO: 650700 - RNA, 22 nt, Human
cugcgugcauuaauauuuccuu

SEQ ID NO: 650701 - RNA, 22 nt, Human
cuugaacucaaugugaggaaga

SEQ ID NO: 650702 - RNA, 22 nt, Human
gagaaaugagugauucacuuuu

SEQ ID NO: 650703 - RNA, 22 nt, Human
ugcagaaagucacauucccuuu

SEQ ID NO: 650704 - RNA, 22 nt, Human
caauauagagagaaaauuaugu

SEQ ID NO: 650705 - RNA, 22 nt, Human
acagaucuacauugucugaccc

SEQ ID NO: 650706 - RNA, 22 nt, Human
uguguguggggaggcagcagau

SEQ ID NO: 650707 - RNA, 20 nt, Human
caaaucacagguaauugcaa

SEQ ID NO: 650708 - RNA, 22 nt, Human
aggcccagcccguccucgugcu

SEQ ID NO: 650709 - RNA, 22 nt, Human
gcacccaguuugucucaggguu

SEQ ID NO: 650710 - RNA, 22 nt, Human
cugguaggggugacuguuaucg

SEQ ID NO: 650711 - RNA, 22 nt, Human
auaccuguguauccacaagcgu

SEQ ID NO: 650712 - RNA, 22 nt, Human
gacccuccuacuacccuggaaa

SEQ ID NO: 650713 - RNA, 23 nt, Human
ccuggcugaccugaagguguagu

SEQ ID NO: 650714 - RNA, 22 nt, Human
gagcucugcuuggguucuuagg

SEQ ID NO: 650715 - RNA, 22 nt, Human
gaguaauuuucuugauuucuua

SEQ ID NO: 650716 - RNA, 22 nt, Human
aggaacagaagagcaaugcagg

SEQ ID NO: 650717 - RNA, 22 nt, Human
cagggcggggucugccggcccu

SEQ ID NO: 650718 - RNA, 22 nt, Human
uugacaaaacaacacagauuuc

SEQ ID NO: 650719 - RNA, 22 nt, Human
ucuuccugcuuggugugucugg

SEQ ID NO: 650720 - RNA, 22 nt, Human
uacaggcauguagcauggugau

SEQ ID NO: 650721 - RNA, 22 nt, Human
aguccaggccuccucuuuuccu

SEQ ID NO: 650722 - RNA, 22 nt, Human
cagaaauguuuguuaauauugu

SEQ ID NO: 650723 - RNA, 22 nt, Human
gggacacagccaucuguguuuu

SEQ ID NO: 650724 - RNA, 22 nt, Human
ugcagggaacuuggacagcuag

SEQ ID NO: 650725 - RNA, 22 nt, Human
ugugagaauuccugaucacagg

SEQ ID NO: 650726 - RNA, 22 nt, Human
uucagacaaauuugaggaagcu

SEQ ID NO: 650727 - RNA, 22 nt, Human
ucaagaagauaaugucuagggu

SEQ ID NO: 650728 - RNA, 21 nt, Human
aggauauuaggugauuugggu

SEQ ID NO: 650729 - RNA, 22 nt, Human
gcagcuuggggacaugaaaaga

SEQ ID NO: 650730 - RNA, 22 nt, Human
agagguauuagguaauucagua

SEQ ID NO: 650731 - RNA, 22 nt, Human
cugggcucccucaugugucugc

SEQ ID NO: 650732 - RNA, 22 nt, Human
agggcacaggcuggcaggaucu

SEQ ID NO: 650733 - RNA, 22 nt, Human
aggccagggccagauuagccac

SEQ ID NO: 650734 - RNA, 22 nt, Human
ggcaaauugcugcaauuacuua

SEQ ID NO: 650735 - RNA, 22 nt, Human
ggaggugggagccuccaguggu

SEQ ID NO: 650736 - RNA, 22 nt, Human
caaggccuccugggcccagaga

SEQ ID NO: 650737 - RNA, 22 nt, Human
aagauaaacucuugauuucuga

SEQ ID NO: 650738 - RNA, 22 nt, Human
guccaggccaugguggacacag

SEQ ID NO: 650739 - RNA, 22 nt, Human
uuauuagcugggcuucagggug

SEQ ID NO: 650740 - RNA, 22 nt, Human
caaaugcuacuaauaggcaagu

SEQ ID NO: 650741 - RNA, 22 nt, Human
gggcagugguuacacagcugag

SEQ ID NO: 650742 - RNA, 22 nt, Human
ccaggcucugcgcuggacaugg

SEQ ID NO: 650743 - RNA, 22 nt, Human
aaaaagauguccugaaguuuag

SEQ ID NO: 650744 - RNA, 23 nt, Human
gccucugcagccuaguuaguguc

SEQ ID NO: 650745 - RNA, 22 nt, Human
uguguacacacagauauauaca

SEQ ID NO: 650746 - RNA, 22 nt, Human
uggcuggagcauuccuugucuu

SEQ ID NO: 650747 - RNA, 22 nt, Human
aggcuucaaggaccugagggaa

SEQ ID NO: 650748 - RNA, 22 nt, Human
ugcagguguagaguugggcucc

SEQ ID NO: 650749 - RNA, 22 nt, Human
ugaggaaacugaggcacagaug

SEQ ID NO: 650750 - RNA, 22 nt, Human
uuuggcugagaaguugugcuuu

SEQ ID NO: 650751 - RNA, 22 nt, Human
cagcuuugauucuuucugccau

SEQ ID NO: 650752 - RNA, 22 nt, Human
aaaaguguucaggaagaauaau

SEQ ID NO: 650753 - RNA, 17 nt, Human
aggagucucagaugagc

SEQ ID NO: 650754 - RNA, 22 nt, Human
gucugcccagaagacauccccu

SEQ ID NO: 650755 - RNA, 22 nt, Human
aaauagagcuggguuaaacuuu

SEQ ID NO: 650756 - RNA, 22 nt, Human
agcaggcuuuccacagaaggag

SEQ ID NO: 650757 - RNA, 22 nt, Human
ucaccacucacucaggcaaguc

SEQ ID NO: 650758 - RNA, 22 nt, Human
ucugggucaugacucagcguga

SEQ ID NO: 650759 - RNA, 22 nt, Human
ugcaaacaggcauuucacaaac

SEQ ID NO: 650760 - RNA, 22 nt, Human
auuuaagaggcugcuagaguau

SEQ ID NO: 650761 - RNA, 22 nt, Human
aucauugaaauguaguuucauc

SEQ ID NO: 650762 - RNA, 22 nt, Human
uuagcaguuuccauuuugguca

SEQ ID NO: 650763 - RNA, 22 nt, Human
aggcugccucgugagcucgcug

SEQ ID NO: 650764 - RNA, 22 nt, Human
aucuggcuuaccuagggugccu

SEQ ID NO: 650765 - RNA, 22 nt, Human
caaagguuucacaguagcccau

SEQ ID NO: 650766 - RNA, 20 nt, Human
ucuguagucuguggcaagac

SEQ ID NO: 650767 - RNA, 22 nt, Human
agaaauaugcugauuagaugaa

SEQ ID NO: 650768 - RNA, 22 nt, Human
cugcucagaggaaggaaugucu

SEQ ID NO: 650769 - RNA, 22 nt, Human
gauucagugggcuuugggacag

SEQ ID NO: 650770 - RNA, 19 nt, Human
gacaggaaggcuaccagua

SEQ ID NO: 650771 - RNA, 22 nt, Human
agcugcccuuaauaggcauuca

SEQ ID NO: 650772 - RNA, 22 nt, Human
gcaauacaguaagaguacugua

SEQ ID NO: 650773 - RNA, 21 nt, Human
acacacuacacauuccuaguu

SEQ ID NO: 650774 - RNA, 22 nt, Human
gagaauuagggcguaauucaga

SEQ ID NO: 650775 - RNA, 22 nt, Human
cacaggagguuaggaagugguc

SEQ ID NO: 650776 - RNA, 22 nt, Human
uucaacauguucuacauaaggg

SEQ ID NO: 650777 - RNA, 22 nt, Human
ucaggguauguucuagaucuga

SEQ ID NO: 650778 - RNA, 22 nt, Human
augccaggaacaaacaguggug

SEQ ID NO: 650779 - RNA, 22 nt, Human
cccugggagcugccuggcugac

SEQ ID NO: 650780 - RNA, 22 nt, Human
ggugaggaaagauggugacagu

SEQ ID NO: 650781 - RNA, 22 nt, Human
caauuucugggccucacacaag

SEQ ID NO: 650782 - RNA, 22 nt, Human
gcccugagacugagcauggguu

SEQ ID NO: 650783 - RNA, 22 nt, Human
uaaaugugggggccacgggcuu

SEQ ID NO: 650784 - RNA, 22 nt, Human
aaaaugaggucaauauccuuuu

SEQ ID NO: 650785 - RNA, 22 nt, Human
ggcugucugugguggagcguug

SEQ ID NO: 650786 - RNA, 22 nt, Human
agaugggcgcccuggacugagg

SEQ ID NO: 650787 - RNA, 22 nt, Human
uucaaaguugcaugacagcuua

SEQ ID NO: 650788 - RNA, 22 nt, Human
auugcuuuucagacaaugaggc

SEQ ID NO: 650789 - RNA, 22 nt, Human
acugaacaccauuuauaacauu

SEQ ID NO: 650790 - RNA, 22 nt, Human
cugcuguguuucacaccucugg

SEQ ID NO: 650791 - RNA, 22 nt, Human
uucacaggugagcauuaggccg

SEQ ID NO: 650792 - RNA, 22 nt, Human
cugccucuauucacugaggcag

SEQ ID NO: 650793 - RNA, 22 nt, Human
ucaggcagugguaaaugaguua

SEQ ID NO: 650794 - RNA, 22 nt, Human
cagcucuguguauuuuccccac

SEQ ID NO: 650795 - RNA, 22 nt, Human
auucugugauaguugauccuua

SEQ ID NO: 650796 - RNA, 22 nt, Human
gaguagaacugguuaucuaaua

SEQ ID NO: 650797 - RNA, 22 nt, Human
acagcaguggauuagaggaugg

SEQ ID NO: 650798 - RNA, 22 nt, Human
uauauucauauuguugucucuc

SEQ ID NO: 650799 - RNA, 22 nt, Human
uggaagacaauguacaugcagu

SEQ ID NO: 650800 - RNA, 22 nt, Human
aauuucaguugcuaauaaguuc

SEQ ID NO: 650801 - RNA, 22 nt, Human
caucccugcccucaugccuaua

SEQ ID NO: 650802 - RNA, 22 nt, Human
gaguaauuuucuuaaaacauca

SEQ ID NO: 650803 - RNA, 22 nt, Human
gagaugcugucaggcuaucugu

SEQ ID NO: 650804 - RNA, 22 nt, Human
ccuguaggaacgccuucauuug

SEQ ID NO: 650805 - RNA, 22 nt, Human
caggcaagauccagaggcugcu

SEQ ID NO: 650806 - RNA, 22 nt, Human
agcuugggcaacacagcaagac

SEQ ID NO: 650807 - RNA, 22 nt, Human
aaggcuuucagcuaacuugauu

SEQ ID NO: 650808 - RNA, 22 nt, Human
aguagacagacagaacacagcc

SEQ ID NO: 650809 - RNA, 22 nt, Human
gugcaaaagucauugugguuuu

SEQ ID NO: 650810 - RNA, 22 nt, Human
cucuggaguccuguaucacucc

SEQ ID NO: 650811 - RNA, 22 nt, Human
uuacaguuagaaucugaugaaa

SEQ ID NO: 650812 - RNA, 22 nt, Human
acaggacaggcugggcuagacu

SEQ ID NO: 650813 - RNA, 22 nt, Human
ccuccaggcugaauaucuagaa

SEQ ID NO: 650814 - RNA, 22 nt, Human
agguggcagagcuggcccagcg

SEQ ID NO: 650815 - RNA, 22 nt, Human
caguuuaaggcaggacauggga

SEQ ID NO: 650816 - RNA, 21 nt, Human
aguuuccucaacugcagaagg

SEQ ID NO: 650817 - RNA, 18 nt, Human
gccagagguacuacugau

SEQ ID NO: 650818 - RNA, 22 nt, Human
uauuguuucuggcuguggcagc

SEQ ID NO: 650819 - RNA, 22 nt, Human
ucauugauggcuucuuucuugc

SEQ ID NO: 650820 - RNA, 22 nt, Human
ccugaaauccauaguuuacacu

SEQ ID NO: 650821 - RNA, 22 nt, Human
ccuuuuauauggcucaucacag

SEQ ID NO: 650822 - RNA, 22 nt, Human
aguacaugugguccuggccaga

SEQ ID NO: 650823 - RNA, 22 nt, Human
gcauccucugagagcucuagau

SEQ ID NO: 650824 - RNA, 22 nt, Human
gcaguguuuguguucucacaug

SEQ ID NO: 650825 - RNA, 22 nt, Human
agcugcuccuuuccugcaggcg

SEQ ID NO: 650826 - RNA, 23 nt, Human
acacauuuuucccguucugaggu

SEQ ID NO: 650827 - RNA, 22 nt, Human
gucuauauauugcuugaauaau

SEQ ID NO: 650828 - RNA, 22 nt, Human
uccagggagagccgcugcucca

SEQ ID NO: 650829 - RNA, 22 nt, Human
ugaggcagcaauuguauuguau

SEQ ID NO: 650830 - RNA, 22 nt, Human
agucucaucaggcauguaguca

SEQ ID NO: 650831 - RNA, 22 nt, Human
ggcagcaugggugccuuuguga

SEQ ID NO: 650832 - RNA, 22 nt, Human
aagaaagggagaaggauggugu

SEQ ID NO: 650833 - RNA, 22 nt, Human
agcaugcaggaaccacauggca

SEQ ID NO: 650834 - RNA, 22 nt, Human
auuagggaaacugacuugucuc

SEQ ID NO: 650835 - RNA, 17 nt, Human
guccugggaggagagag

SEQ ID NO: 650836 - RNA, 22 nt, Human
uaggaagcucuuuguuuuguga

SEQ ID NO: 650837 - RNA, 22 nt, Human
ggggucggggcauagccacuua

SEQ ID NO: 650838 - RNA, 22 nt, Human
uuucuaauaucacuuccagcug

SEQ ID NO: 650839 - RNA, 22 nt, Human
aaagucaugaugaaccaccgua

SEQ ID NO: 650840 - RNA, 22 nt, Human
ucugcagagggagugcuggguc

SEQ ID NO: 650841 - RNA, 22 nt, Human
aguugucccggucuagccacuu

SEQ ID NO: 650842 - RNA, 22 nt, Human
caguauaagagugaggaagggc

SEQ ID NO: 650843 - RNA, 22 nt, Human
guggcccuauuugaggacccca

SEQ ID NO: 650844 - RNA, 22 nt, Human
ggagggcugccagguggagcgg

SEQ ID NO: 650845 - RNA, 22 nt, Human
cuguccccgcgaguccagagcu

SEQ ID NO: 650846 - RNA, 22 nt, Human
gagcagcucugugccuggagac

SEQ ID NO: 650847 - RNA, 22 nt, Human
uuccaguccagggcuguuucca

SEQ ID NO: 650848 - RNA, 22 nt, Human
ugggaaggauacguuacaagau

SEQ ID NO: 650849 - RNA, 22 nt, Human
cgcugcagaugggagcugguug

SEQ ID NO: 650850 - RNA, 22 nt, Human
cucuccaggagcucagagucua

SEQ ID NO: 650851 - RNA, 22 nt, Human
agcccuccuggggccacgcugg

SEQ ID NO: 650852 - RNA, 18 nt, Human
gcugucugaggucugagg

SEQ ID NO: 650853 - RNA, 22 nt, Human
ccagcugccuaagcaauccaua

SEQ ID NO: 650854 - RNA, 22 nt, Human
auacacaggcaugcuucugauu

SEQ ID NO: 650855 - RNA, 22 nt, Human
caggccugggcuucggggcuga

SEQ ID NO: 650856 - RNA, 22 nt, Human
auggcagcaaaugucuggcugg

SEQ ID NO: 650857 - RNA, 22 nt, Human
cuggacucagggugcuccagcg

SEQ ID NO: 650858 - RNA, 22 nt, Human
caaagaaugagugaguacauaa

SEQ ID NO: 650859 - RNA, 22 nt, Human
ugggugugccauauuccauuuc

SEQ ID NO: 650860 - RNA, 22 nt, Human
uuucugcuuucagagugagaca

SEQ ID NO: 650861 - RNA, 22 nt, Human
ugcaaauaggggacaacucuuu

SEQ ID NO: 650862 - RNA, 22 nt, Human
caggguccaucuuucaucacug

SEQ ID NO: 650863 - RNA, 23 nt, Human
uucccacaucuuccacagcuaug

SEQ ID NO: 650864 - RNA, 22 nt, Human
uacaaaguaauguauaauaucg

SEQ ID NO: 650865 - RNA, 22 nt, Human
uaggggagcucgggugcaaucg

SEQ ID NO: 650866 - RNA, 22 nt, Human
cuguacaucccgagagccagua

SEQ ID NO: 650867 - RNA, 22 nt, Human
uccuucuggaggcuguaaagga

SEQ ID NO: 650868 - RNA, 22 nt, Human
auuauccagcaccaaugucaga

SEQ ID NO: 650869 - RNA, 22 nt, Human
cuuucuuaauuuuuaaggacac

SEQ ID NO: 650870 - RNA, 22 nt, Human
cugucauuggcagggagugugu

SEQ ID NO: 650871 - RNA, 22 nt, Human
cgagcagaauggagggugccga

SEQ ID NO: 650872 - RNA, 22 nt, Human
aacacucuacgugcagcuccua

SEQ ID NO: 650873 - RNA, 22 nt, Human
augacagauagucuucauuugc

SEQ ID NO: 650874 - RNA, 22 nt, Human
ucccuuccucauaggcagaagg

SEQ ID NO: 650875 - RNA, 22 nt, Human
cucuucuuauggccguggcuga

SEQ ID NO: 650876 - RNA, 22 nt, Human
agaaguuuguuauguaaacaaa

SEQ ID NO: 650877 - RNA, 22 nt, Human
cucggcagguggagguuguagu

SEQ ID NO: 650878 - RNA, 22 nt, Human
uucugcagaucaacuugacugc

SEQ ID NO: 650879 - RNA, 22 nt, Human
ccacugugagcaugaacaggac

SEQ ID NO: 650880 - RNA, 23 nt, Human
gccuuggagaagucacucaggga

SEQ ID NO: 650881 - RNA, 22 nt, Human
cugggccuccacgggccaucac

SEQ ID NO: 650882 - RNA, 22 nt, Human
uuugcaaauacagaggucuugc

SEQ ID NO: 650883 - RNA, 22 nt, Human
cuucacauggguacugcugauc

SEQ ID NO: 650884 - RNA, 22 nt, Human
cacaggaaauauuaggagggau

SEQ ID NO: 650885 - RNA, 22 nt, Human
ugguguguuagagcucagggca

SEQ ID NO: 650886 - RNA, 22 nt, Human
cugggcuugaguuccugcucgu

SEQ ID NO: 650887 - RNA, 22 nt, Human
ugugaauguauaguuuguauau

SEQ ID NO: 650888 - RNA, 22 nt, Human
gcuguggccgggcccaggccgc

SEQ ID NO: 650889 - RNA, 23 nt, Human
ucuccagugucucuucauugagu

SEQ ID NO: 650890 - RNA, 22 nt, Human
aaucuucagugucuaaaaagca

SEQ ID NO: 650891 - RNA, 22 nt, Human
aggaauuugcuggaacacagau

SEQ ID NO: 650892 - RNA, 22 nt, Human
agagauuacagcaggguccagc

SEQ ID NO: 650893 - RNA, 22 nt, Human
auaguuuaccuuccagauggcu

SEQ ID NO: 650894 - RNA, 22 nt, Human
auacaccaccuuggaucuuuca

SEQ ID NO: 650895 - RNA, 22 nt, Human
cugcugcauuccucuuuaugag

SEQ ID NO: 650896 - RNA, 22 nt, Human
gcgggccaccuuggagagcgcu

SEQ ID NO: 650897 - RNA, 22 nt, Human
ccacacugaccagcugugagac

SEQ ID NO: 650898 - RNA, 22 nt, Human
uucuuuaaaauagugagaaaga

SEQ ID NO: 650899 - RNA, 23 nt, Human
augugcacaucuccuuguccacc

SEQ ID NO: 650900 - RNA, 22 nt, Human
agagcccuaaacccugccuugg

SEQ ID NO: 650901 - RNA, 22 nt, Human
uuaaaaaccaucuuccuuuccu

SEQ ID NO: 650902 - RNA, 22 nt, Human
ggugccauauuauauacaguuu

SEQ ID NO: 650903 - RNA, 22 nt, Human
cuguggaaauaaacaaugcuaa

SEQ ID NO: 650904 - RNA, 18 nt, Human
aggcagcagcaucuucuc

SEQ ID NO: 650905 - RNA, 22 nt, Human
caggacaggcccuguggggucu

SEQ ID NO: 650906 - RNA, 21 nt, Human
agaggcccucggacugggcgu

SEQ ID NO: 650907 - RNA, 20 nt, Human
ccaaggacacuggcuccugg

SEQ ID NO: 650908 - RNA, 22 nt, Human
guauuaggaaauaugaagaaag

SEQ ID NO: 650909 - RNA, 22 nt, Human
gagauuggauuuaauggccaaa

SEQ ID NO: 650910 - RNA, 22 nt, Human
uagcuuuccuuguugccugugc

SEQ ID NO: 650911 - RNA, 22 nt, Human
cagccagcuucagauccaagcc

SEQ ID NO: 650912 - RNA, 20 nt, Human
acaaaguauugaggacaagu

SEQ ID NO: 650913 - RNA, 22 nt, Human
gcagccagggagagaaccaggg

SEQ ID NO: 650914 - RNA, 22 nt, Human
agacggauuaccugaggucagg

SEQ ID NO: 650915 - RNA, 23 nt, Human
ccugggcauuggcugcagcuucu

SEQ ID NO: 650916 - RNA, 18 nt, Human
ucauggcuugcagauggu

SEQ ID NO: 650917 - RNA, 22 nt, Human
cagcuuucugucucaugacuga

SEQ ID NO: 650918 - RNA, 22 nt, Human
gcagggaugcugaggcucagug

SEQ ID NO: 650919 - RNA, 22 nt, Human
accagagggcaaaccccagugu

SEQ ID NO: 650920 - RNA, 22 nt, Human
uaccagcaauguaugaguguuu

SEQ ID NO: 650921 - RNA, 22 nt, Human
aaagugcugaaauuacaggugu

SEQ ID NO: 650922 - RNA, 22 nt, Human
ucuuacaagucacccgcuuucu

SEQ ID NO: 650923 - RNA, 22 nt, Human
agcaauuuucccuuagucuuug

SEQ ID NO: 650924 - RNA, 22 nt, Human
ugggcagaggacagggaagauc

SEQ ID NO: 650925 - RNA, 22 nt, Human
ucuggcuucuccuagagcaaug

SEQ ID NO: 650926 - RNA, 22 nt, Human
ucacagaauaaauugagaagac

SEQ ID NO: 650927 - RNA, 22 nt, Human
aggccucaggaagguaaagaag

SEQ ID NO: 650928 - RNA, 22 nt, Human
cugagugaggggagcuugaugg

SEQ ID NO: 650929 - RNA, 22 nt, Human
agaggaggccaggcccacaccu

SEQ ID NO: 650930 - RNA, 22 nt, Human
gcacauacccacugucaagcac

SEQ ID NO: 650931 - RNA, 22 nt, Human
gcugaauacagcaugccuuaug

SEQ ID NO: 650932 - RNA, 22 nt, Human
agucaggauuuuggauuauucg

SEQ ID NO: 650933 - RNA, 22 nt, Human
uucaguaugacagacgcauugg

SEQ ID NO: 650934 - RNA, 22 nt, Human
gccacguugccacccgggugac

SEQ ID NO: 650935 - RNA, 22 nt, Human
cugcugugggcaggguagcugg

SEQ ID NO: 650936 - RNA, 22 nt, Human
uacaguuacugcauuucuaaua

SEQ ID NO: 650937 - RNA, 22 nt, Human
aauuucuaauugaaucucucuu

SEQ ID NO: 650938 - RNA, 22 nt, Human
cacagggccuugugugacugca

SEQ ID NO: 650939 - RNA, 22 nt, Human
agguuucaugggagacaacuca

SEQ ID NO: 650940 - RNA, 22 nt, Human
aggagugcaaauaguccagaga

SEQ ID NO: 650941 - RNA, 22 nt, Human
gggcagcuccuguggaauccac

SEQ ID NO: 650942 - RNA, 22 nt, Human
acaaagcacgagugccauggac

SEQ ID NO: 650943 - RNA, 22 nt, Human
uggagccuguguuucugcccag

SEQ ID NO: 650944 - RNA, 21 nt, Human
ucugggcuuucuuauaaggca

SEQ ID NO: 650945 - RNA, 22 nt, Human
gagagcugcauucucagacaca

SEQ ID NO: 650946 - RNA, 22 nt, Human
uacaaaucagaucaugaguuua

SEQ ID NO: 650947 - RNA, 22 nt, Human
gagcugaggcugaggccucacu

SEQ ID NO: 650948 - RNA, 22 nt, Human
caaaaguaauugcaguuuuugc

SEQ ID NO: 650949 - RNA, 20 nt, Human
cuuuuucuccagcucugagc

SEQ ID NO: 650950 - RNA, 22 nt, Human
uggagucaucuuaaucuaggca

SEQ ID NO: 650951 - RNA, 23 nt, Human
caggaaaugaauccaggaggaug

SEQ ID NO: 650952 - RNA, 22 nt, Human
cucugcuggcagcccccgggcc

SEQ ID NO: 650953 - RNA, 22 nt, Human
cacaguuugcauaggaaaaaca

SEQ ID NO: 650954 - RNA, 22 nt, Human
ugccagcuccugcagcuccugu

SEQ ID NO: 650955 - RNA, 22 nt, Human
gaauacaagccaggcacaaggc

SEQ ID NO: 650956 - RNA, 20 nt, Human
ucuccuggugacaguaccca

SEQ ID NO: 650957 - RNA, 22 nt, Human
ugcagcaggagccaggccuggu

SEQ ID NO: 650958 - RNA, 22 nt, Human
uguacaaauucaguucuagggu

SEQ ID NO: 650959 - RNA, 19 nt, Human
uggcuaauuuuauagaggc

SEQ ID NO: 650960 - RNA, 22 nt, Human
agcaggugacccaagcaggcug

SEQ ID NO: 650961 - RNA, 22 nt, Human
cucaagucugaguacuggcucu

SEQ ID NO: 650962 - RNA, 20 nt, Human
cuucuucaguaguuuguucu

SEQ ID NO: 650963 - RNA, 17 nt, Human
ugcuccugggacaagga

SEQ ID NO: 650964 - RNA, 21 nt, Human
aagcuuccaaacugcuggacu

SEQ ID NO: 650965 - RNA, 22 nt, Human
uucuuuuuaaaguguguaugca

SEQ ID NO: 650966 - RNA, 22 nt, Human
uccagagcugagcagucauucu

SEQ ID NO: 650967 - RNA, 22 nt, Human
aucucuccuucagcugaggccc

SEQ ID NO: 650968 - RNA, 22 nt, Human
cacacaugugugcagcuuagaa

SEQ ID NO: 650969 - RNA, 22 nt, Human
ucaguucuaacaguuuagaaca

SEQ ID NO: 650970 - RNA, 22 nt, Human
cugaguggaacauaggaugaua

SEQ ID NO: 650971 - RNA, 22 nt, Human
ugcauuuccagauuucuggagu

SEQ ID NO: 650972 - RNA, 22 nt, Human
agggcugacagugaggagucaa

SEQ ID NO: 650973 - RNA, 22 nt, Human
ucaggcugaaucauccuagcuu

SEQ ID NO: 650974 - RNA, 22 nt, Human
uuggaaaugcauuuguuauuau

SEQ ID NO: 650975 - RNA, 22 nt, Human
uccugagauaggaguugaaggc

SEQ ID NO: 650976 - RNA, 22 nt, Human
cagagggcacaugguuuccuca

SEQ ID NO: 650977 - RNA, 22 nt, Human
agaacagaggccuuauguuuca

SEQ ID NO: 650978 - RNA, 22 nt, Human
uauugaguuacagaaaauacuu

SEQ ID NO: 650979 - RNA, 22 nt, Human
ucagcaggcaccggaaguguuu

SEQ ID NO: 650980 - RNA, 22 nt, Human
cugguggagagugggcucugga

SEQ ID NO: 650981 - RNA, 22 nt, Human
cagcugcuguuacugcuuauua

SEQ ID NO: 650982 - RNA, 22 nt, Human
gugcccacgaggccaggcuggu

SEQ ID NO: 650983 - RNA, 22 nt, Human
ugaacaaauggaaauaaccagu

SEQ ID NO: 650984 - RNA, 22 nt, Human
ucccugggccuaucuuagcucc

SEQ ID NO: 650985 - RNA, 22 nt, Human
uucuuauguucacauaauucca

SEQ ID NO: 650986 - RNA, 22 nt, Human
auacaugacacugggcuacagg

SEQ ID NO: 650987 - RNA, 22 nt, Human
ucugaaauauugguaauacuuu

SEQ ID NO: 650988 - RNA, 22 nt, Human
ucugugccaccucuccaguguc

SEQ ID NO: 650989 - RNA, 21 nt, Human
ucagacuugagcucuucuaca

SEQ ID NO: 650990 - RNA, 22 nt, Human
auuagauacacagauuuccacu

SEQ ID NO: 650991 - RNA, 22 nt, Human
aacugcuugagauauguuuguc

SEQ ID NO: 650992 - RNA, 18 nt, Human
acugugugaauuagcucc

SEQ ID NO: 650993 - RNA, 22 nt, Human
gccucccuguuuccugcuccaa

SEQ ID NO: 650994 - RNA, 22 nt, Human
gcuccgugggcauugcuaggug

SEQ ID NO: 650995 - RNA, 22 nt, Human
uuaaggaaggagucuuaaaugg

SEQ ID NO: 650996 - RNA, 18 nt, Human
uccagggcuuccuccucu

SEQ ID NO: 650997 - RNA, 22 nt, Human
cucuuuacugcuacuacaaaga

SEQ ID NO: 650998 - RNA, 22 nt, Human
agccccuccaguggcauaaaau

SEQ ID NO: 650999 - RNA, 22 nt, Human
cuccaguggugauggggaagaa

SEQ ID NO: 651000 - RNA, 22 nt, Human
agcugucuccagauacaggauu

SEQ ID NO: 651001 - RNA, 22 nt, Human
uaacagaaguuguucauugugg

SEQ ID NO: 651002 - RNA, 22 nt, Human
cuuaaacugggcauucagagaa

SEQ ID NO: 651003 - RNA, 22 nt, Human
ucuaacagaaauucugacaaaa

SEQ ID NO: 651004 - RNA, 22 nt, Human
uggcuggaauggagcugagccu

SEQ ID NO: 651005 - RNA, 22 nt, Human
auugaauagcugcuuguuguau

SEQ ID NO: 651006 - RNA, 22 nt, Human
augaguuaguuucuugucuaga

SEQ ID NO: 651007 - RNA, 22 nt, Human
uacacaucacuguaucuuucag

SEQ ID NO: 651008 - RNA, 22 nt, Human
uuucaucuuauuugucuacauc

SEQ ID NO: 651009 - RNA, 22 nt, Human
aggcugaguuucucauucucgc

SEQ ID NO: 651010 - RNA, 22 nt, Human
ugggcugcuguuacaggggcug

SEQ ID NO: 651011 - RNA, 22 nt, Human
uaguuaaagauucuguuaagag

SEQ ID NO: 651012 - RNA, 22 nt, Human
gaauugucuuggccagugagaa

SEQ ID NO: 651013 - RNA, 22 nt, Human
auucagcauaaucaguagcuug

SEQ ID NO: 651014 - RNA, 22 nt, Human
auucuuuagccagcagguauau

SEQ ID NO: 651015 - RNA, 22 nt, Human
gauggcuuacagacaguuagga

SEQ ID NO: 651016 - RNA, 22 nt, Human
cagcaaggccauuggaugcagu

SEQ ID NO: 651017 - RNA, 22 nt, Human
acaggacaaggggaagaagaua

SEQ ID NO: 651018 - RNA, 22 nt, Human
uacaucauggugagcaggaggc

SEQ ID NO: 651019 - RNA, 22 nt, Human
caggcucggaagugcuggcuuu

SEQ ID NO: 651020 - RNA, 22 nt, Human
aaagaugaguccggcagacaua

SEQ ID NO: 651021 - RNA, 22 nt, Human
aguuucauauuaccaugucacc

SEQ ID NO: 651022 - RNA, 22 nt, Human
uuuuaucaaucauuaagacauu

SEQ ID NO: 651023 - RNA, 22 nt, Human
agcuuuggcccuggagguuacu

SEQ ID NO: 651024 - RNA, 19 nt, Human
gucacauuugucucccagg

SEQ ID NO: 651025 - RNA, 22 nt, Human
aaggccaggacaccaggggacu

SEQ ID NO: 651026 - RNA, 22 nt, Human
aguguucauuuauucauucacu

SEQ ID NO: 651027 - RNA, 22 nt, Human
agggaggaucugcuccuugucu

SEQ ID NO: 651028 - RNA, 22 nt, Human
cccugaggcaguaggagcuuuu

SEQ ID NO: 651029 - RNA, 22 nt, Human
uucaagguaugguagcugguca

SEQ ID NO: 651030 - RNA, 22 nt, Human
caagaggagcaggcaggugugc

SEQ ID NO: 651031 - RNA, 22 nt, Human
gcgagccucuggaguccucugg

SEQ ID NO: 651032 - RNA, 22 nt, Human
agggcuccaggggcugggugac

SEQ ID NO: 651033 - RNA, 22 nt, Human
acagggcucgucgggcccucgg

SEQ ID NO: 651034 - RNA, 22 nt, Human
ucagaggacaagcucccuggug

SEQ ID NO: 651035 - RNA, 22 nt, Human
gccugcuggcuguccauugcag

SEQ ID NO: 651036 - RNA, 22 nt, Human
cuuagcagaagcuucagcuuca

SEQ ID NO: 651037 - RNA, 22 nt, Human
aaacagcuuguuucaggaaagu

SEQ ID NO: 651038 - RNA, 22 nt, Human
aggcuguggcccuggucuagca

SEQ ID NO: 651039 - RNA, 22 nt, Human
gcaaacaugcugagaaauaaga

SEQ ID NO: 651040 - RNA, 22 nt, Human
aauucuagcauugugaaaauau

SEQ ID NO: 651041 - RNA, 22 nt, Human
ccuggguuggagagcaauggug

SEQ ID NO: 651042 - RNA, 22 nt, Human
aacacugagaacaauacagagu

SEQ ID NO: 651043 - RNA, 20 nt, Human
cugggccauccuuuuacaau

SEQ ID NO: 651044 - RNA, 22 nt, Human
uagagaggccgcggguccccuc

SEQ ID NO: 651045 - RNA, 22 nt, Human
gcagggacagggcagggccuuu

SEQ ID NO: 651046 - RNA, 22 nt, Human
aggcaggcucuggguaugugca

SEQ ID NO: 651047 - RNA, 22 nt, Human
uguggccugggagcugaggucu

SEQ ID NO: 651048 - RNA, 22 nt, Human
uagaaacauguucuguucuguu

SEQ ID NO: 651049 - RNA, 22 nt, Human
gcaagaguuuuuucucucuuga

SEQ ID NO: 651050 - RNA, 22 nt, Human
aguguguagcauuuggcaggca

SEQ ID NO: 651051 - RNA, 17 nt, Human
gcaagggaugggagauu

SEQ ID NO: 651052 - RNA, 22 nt, Human
gccagagcaugcacugccugca

SEQ ID NO: 651053 - RNA, 22 nt, Human
auaauguugaugauugucuuug

SEQ ID NO: 651054 - RNA, 22 nt, Human
uacaugaaccuuuaugugugau

SEQ ID NO: 651055 - RNA, 22 nt, Human
caugaccccccaaggccugcag

SEQ ID NO: 651056 - RNA, 22 nt, Human
aaagacacaugucucuuagauu

SEQ ID NO: 651057 - RNA, 22 nt, Human
uccuaacuaauuuguagcaaaa

SEQ ID NO: 651058 - RNA, 22 nt, Human
uuucagaaagcaucaucaaagu

SEQ ID NO: 651059 - RNA, 22 nt, Human
agcacccuccaacuucccugua

SEQ ID NO: 651060 - RNA, 22 nt, Human
cugggcucagaaccuuguuaag

SEQ ID NO: 651061 - RNA, 22 nt, Human
uugcuggcuugaagauagagga

SEQ ID NO: 651062 - RNA, 22 nt, Human
gcagcguggggcugagucagcu

SEQ ID NO: 651063 - RNA, 22 nt, Human
ggcuacaguggcacugggcuuu

SEQ ID NO: 651064 - RNA, 22 nt, Human
acuguauuuuggguguauuuuc

SEQ ID NO: 651065 - RNA, 15 nt, Human
aacaucacuauuuug

SEQ ID NO: 651066 - RNA, 22 nt, Human
gggaccaggugggugcauuccg

SEQ ID NO: 651067 - RNA, 20 nt, Human
ucccagucagccagagugag

SEQ ID NO: 651068 - RNA, 22 nt, Human
agcugcucuugggugacuucaa

SEQ ID NO: 651069 - RNA, 22 nt, Human
gucaggaaaacccggguugacu

SEQ ID NO: 651070 - RNA, 22 nt, Human
uggcuuuauccaucaucgccaa

SEQ ID NO: 651071 - RNA, 22 nt, Human
acaauguaggcugaaaaagcuu

SEQ ID NO: 651072 - RNA, 22 nt, Human
ucaguguuuauugcggugugua

SEQ ID NO: 651073 - RNA, 22 nt, Human
ccuggcagcgccgaagcuggcc

SEQ ID NO: 651074 - RNA, 22 nt, Human
agaaauuaugcaguaguuuuau

SEQ ID NO: 651075 - RNA, 22 nt, Human
agccugggcaacuccauucacu

SEQ ID NO: 651076 - RNA, 22 nt, Human
uaguuuagacuucaacccuuug

SEQ ID NO: 651077 - RNA, 22 nt, Human
ccagcaucuguccuuucccuca

SEQ ID NO: 651078 - RNA, 22 nt, Human
ggagacacuggaaaguauuaca

SEQ ID NO: 651079 - RNA, 22 nt, Human
uguggccaggaaaaggagaugg

SEQ ID NO: 651080 - RNA, 22 nt, Human
ucuaacauuguuuuucacagau

SEQ ID NO: 651081 - RNA, 22 nt, Human
cucuguggcuacacaaaccucc

SEQ ID NO: 651082 - RNA, 22 nt, Human
uuauuuaggagaaggaacccug

SEQ ID NO: 651083 - RNA, 22 nt, Human
cuggcucugucacccuuucucc

SEQ ID NO: 651084 - RNA, 22 nt, Human
uggcagcaugucccggccucag

SEQ ID NO: 651085 - RNA, 22 nt, Human
uuugcaaauucuugucuagccu

SEQ ID NO: 651086 - RNA, 22 nt, Human
gauggcaggugauagccgaguc

SEQ ID NO: 651087 - RNA, 22 nt, Human
caugucuugcccugauuaguag

SEQ ID NO: 651088 - RNA, 22 nt, Human
aguuagaauagucagauuguag

SEQ ID NO: 651089 - RNA, 22 nt, Human
aggagccacuuaggugagauaa

SEQ ID NO: 651090 - RNA, 22 nt, Human
uucagacuggcuacauuuucau

SEQ ID NO: 651091 - RNA, 22 nt, Human
cuuagcuagugcucagcuguca

SEQ ID NO: 651092 - RNA, 22 nt, Human
auccacucuaagaucuguggug

SEQ ID NO: 651093 - RNA, 22 nt, Human
uaaauaucaccuggaauuguua

SEQ ID NO: 651094 - RNA, 19 nt, Human
auuaacaucaguguuggcc

SEQ ID NO: 651095 - RNA, 22 nt, Human
ucauccaguaccauggaaggca

SEQ ID NO: 651096 - RNA, 22 nt, Human
cugagguaaaauuucuauuuug

SEQ ID NO: 651097 - RNA, 22 nt, Human
agguccuggugaccauggaguu

SEQ ID NO: 651098 - RNA, 22 nt, Human
caguauguccuuccucguuggc

SEQ ID NO: 651099 - RNA, 22 nt, Human
ucagaauuaagcucuuggucag

SEQ ID NO: 651100 - RNA, 21 nt, Human
uuuuaugcauaggaaauauau

SEQ ID NO: 651101 - RNA, 22 nt, Human
agguaauuacuagaguuauuua

SEQ ID NO: 651102 - RNA, 22 nt, Human
uaagcaaaagucgagugugagc

SEQ ID NO: 651103 - RNA, 22 nt, Human
ggcugugacccccacaggggug

SEQ ID NO: 651104 - RNA, 22 nt, Human
ucccagugcuacagacagggca

SEQ ID NO: 651105 - RNA, 22 nt, Human
acccaggguagaaccucagagc

SEQ ID NO: 651106 - RNA, 22 nt, Human
cuucuagagcuggagcaaaugu

SEQ ID NO: 651107 - RNA, 22 nt, Human
ccagcagcgauagggugagugc

SEQ ID NO: 651108 - RNA, 22 nt, Human
uucauaugcagauuaacaaaua

SEQ ID NO: 651109 - RNA, 22 nt, Human
ggcuggccuguguggccgccac

SEQ ID NO: 651110 - RNA, 22 nt, Human
acagcugggugucccacuucug

SEQ ID NO: 651111 - RNA, 22 nt, Human
aucaucuucgaaaaaagucaga

SEQ ID NO: 651112 - RNA, 21 nt, Human
guucaauagcucuuugaaugc

SEQ ID NO: 651113 - RNA, 22 nt, Human
augaggagaccaaggccugaug

SEQ ID NO: 651114 - RNA, 22 nt, Human
acagccaggacuuggcccucuu

SEQ ID NO: 651115 - RNA, 22 nt, Human
auggaugaaggcgaggaugagg

SEQ ID NO: 651116 - RNA, 22 nt, Human
agcuuuaaaaauccaauaucca

SEQ ID NO: 651117 - RNA, 22 nt, Human
aauuagaaccagaagccauauu

SEQ ID NO: 651118 - RNA, 22 nt, Human
aaguccaaggcugggugcagug

SEQ ID NO: 651119 - RNA, 22 nt, Human
ggagaagggaacugaguuuuug

SEQ ID NO: 651120 - RNA, 22 nt, Human
guaggcagugcuugauuuucca

SEQ ID NO: 651121 - RNA, 22 nt, Human
aaauguacaacauccauauaua

SEQ ID NO: 651122 - RNA, 22 nt, Human
uuucaugauuaacuuagugaau

SEQ ID NO: 651123 - RNA, 22 nt, Human
guccagagauggacgagcagau

SEQ ID NO: 651124 - RNA, 22 nt, Human
ccagggugaccagcuggccuag

SEQ ID NO: 651125 - RNA, 22 nt, Human
uaaaggcuucugcagggacuga

SEQ ID NO: 651126 - RNA, 22 nt, Human
aaucaguuguucacucugaaaa

SEQ ID NO: 651127 - RNA, 22 nt, Human
augaggucauucuuggauuaca

SEQ ID NO: 651128 - RNA, 22 nt, Human
gagaacacuuauggauuauucu

SEQ ID NO: 651129 - RNA, 22 nt, Human
ugucagugaguuggguccugag

SEQ ID NO: 651130 - RNA, 22 nt, Human
uugaauaguguuuucaguauac

SEQ ID NO: 651131 - RNA, 22 nt, Human
uggggaugaaacccaggcaucu

SEQ ID NO: 651132 - RNA, 22 nt, Human
cagaacaggucaugcuugcugu

SEQ ID NO: 651133 - RNA, 22 nt, Human
cucugcugccaccagaaccacu

SEQ ID NO: 651134 - RNA, 22 nt, Human
aaugugagccaaugcccguggg

SEQ ID NO: 651135 - RNA, 22 nt, Human
ucaauuucuugguuugauaaua

SEQ ID NO: 651136 - RNA, 22 nt, Human
cucucccagucaggcucaggau

SEQ ID NO: 651137 - RNA, 22 nt, Human
uugaaucuauaauuucaguauu

SEQ ID NO: 651138 - RNA, 22 nt, Human
uaauugaacuaacaugcaaaca

SEQ ID NO: 651139 - RNA, 20 nt, Human
agaaauacaugcaugcauga

SEQ ID NO: 651140 - RNA, 22 nt, Human
uugaagcacaaugucuuuuauc

SEQ ID NO: 651141 - RNA, 20 nt, Human
uccuuuccuccuucuaaaug

SEQ ID NO: 651142 - RNA, 22 nt, Human
acacagccccacggugagcaaa

SEQ ID NO: 651143 - RNA, 22 nt, Human
acuguauacuucuguauacaau

SEQ ID NO: 651144 - RNA, 22 nt, Human
ugaggcagaguaagauacauga

SEQ ID NO: 651145 - RNA, 22 nt, Human
guccagcugaucuugacccagc

SEQ ID NO: 651146 - RNA, 22 nt, Human
uugaggucuucauucuugggca

SEQ ID NO: 651147 - RNA, 22 nt, Human
cauuuaauagaugcuguuucag

SEQ ID NO: 651148 - RNA, 22 nt, Human
gaaucauuuagcucugcaugga

SEQ ID NO: 651149 - RNA, 22 nt, Human
caggcuggagugcaauggcaca

SEQ ID NO: 651150 - RNA, 22 nt, Human
gaaaguuuucauauauaccaaa

SEQ ID NO: 651151 - RNA, 22 nt, Human
ugcagaggcgccgugggugggg

SEQ ID NO: 651152 - RNA, 22 nt, Human
gaaggcugcgaggggagugccg

SEQ ID NO: 651153 - RNA, 22 nt, Human
gcugaggcugggagcagccugu

SEQ ID NO: 651154 - RNA, 22 nt, Human
gggcuccagaguccauguucuu

SEQ ID NO: 651155 - RNA, 22 nt, Human
ucugaaauaaaugcacuguuag

SEQ ID NO: 651156 - RNA, 22 nt, Human
ggcggggccucgcgaacggccu

SEQ ID NO: 651157 - RNA, 22 nt, Human
cagggagcuggcuggcugugcc

SEQ ID NO: 651158 - RNA, 22 nt, Human
guugcagauguggaacucgugc

SEQ ID NO: 651159 - RNA, 22 nt, Human
gauucuggguccugugucuugc

SEQ ID NO: 651160 - RNA, 22 nt, Human
uucacaguuuaauggcaaggau

SEQ ID NO: 651161 - RNA, 21 nt, Human
cagagcuguccaaacccugac

SEQ ID NO: 651162 - RNA, 22 nt, Human
uguggggcagcuagccggccug

SEQ ID NO: 651163 - RNA, 23 nt, Human
agcuggaggcugucuacucccaa

SEQ ID NO: 651164 - RNA, 22 nt, Human
uccccagcucugugcuuccacu

SEQ ID NO: 651165 - RNA, 22 nt, Human
auuucacagcgugguugacugc

SEQ ID NO: 651166 - RNA, 20 nt, Human
ccagcuuucccugcagcauc

SEQ ID NO: 651167 - RNA, 22 nt, Human
agucuggaauuuggccugagca

SEQ ID NO: 651168 - RNA, 22 nt, Human
gcacagagaggcugugagcgcc

SEQ ID NO: 651169 - RNA, 22 nt, Human
cuauuugucacaacugguguuu

SEQ ID NO: 651170 - RNA, 22 nt, Human
ccauuaaaauugugacauagga

SEQ ID NO: 651171 - RNA, 22 nt, Human
acuuuaaaacugaucaucagag

SEQ ID NO: 651172 - RNA, 18 nt, Human
gcucagguauagacaggg

SEQ ID NO: 651173 - RNA, 22 nt, Human
uuguguuugaugcugacacgca

SEQ ID NO: 651174 - RNA, 22 nt, Human
acaugucucuucugaaagacaa

SEQ ID NO: 651175 - RNA, 22 nt, Human
gugauuuucuccuccuagaagu

SEQ ID NO: 651176 - RNA, 22 nt, Human
ugugugcacguacauacuguau

SEQ ID NO: 651177 - RNA, 21 nt, Human
aaagcaucacgaacauuuggg

SEQ ID NO: 651178 - RNA, 22 nt, Human
cuccagggagcuuggaaagacc

SEQ ID NO: 651179 - RNA, 22 nt, Human
aggucaaaagcaaggccagguu

SEQ ID NO: 651180 - RNA, 21 nt, Human
caggaaagaaaacguacauau

SEQ ID NO: 651181 - RNA, 22 nt, Human
ccuuuuucccuggagggacagc

SEQ ID NO: 651182 - RNA, 21 nt, Human
ccaguauuauuucucuaugua

SEQ ID NO: 651183 - RNA, 22 nt, Human
uuaauauguugaaauuuauuag

SEQ ID NO: 651184 - RNA, 22 nt, Human
cugugcaguggcagcguguggg

SEQ ID NO: 651185 - RNA, 18 nt, Human
ccucacagacuuccaugu

SEQ ID NO: 651186 - RNA, 22 nt, Human
ucccauggucuauauagaggca

SEQ ID NO: 651187 - RNA, 20 nt, Human
augcuuucuugugugcugcu

SEQ ID NO: 651188 - RNA, 22 nt, Human
acaggcagguugagaaacauuu

SEQ ID NO: 651189 - RNA, 22 nt, Human
agucagagucgccgacagucaa

SEQ ID NO: 651190 - RNA, 22 nt, Human
ucuccaggaagcccucccugac

SEQ ID NO: 651191 - RNA, 21 nt, Human
ucaaauccugcuguuaccacu

SEQ ID NO: 651192 - RNA, 22 nt, Human
aaagcacaugaguaguguagua

SEQ ID NO: 651193 - RNA, 22 nt, Human
agacacugaaauguauugaaga

SEQ ID NO: 651194 - RNA, 22 nt, Human
aaucauggcguguuuagcuuaa

SEQ ID NO: 651195 - RNA, 22 nt, Human
ugccugcugccuuucaucccaa

SEQ ID NO: 651196 - RNA, 22 nt, Human
aaguuauuuccucgugacugaa

SEQ ID NO: 651197 - RNA, 22 nt, Human
auguuuaaauuuauagacagug

SEQ ID NO: 651198 - RNA, 22 nt, Human
uuccucaguuagugccugaggc

SEQ ID NO: 651199 - RNA, 22 nt, Human
cagugugaggaauuagugucca

SEQ ID NO: 651200 - RNA, 22 nt, Human
uaaggcuuauauacuuagacau

SEQ ID NO: 651201 - RNA, 22 nt, Human
uagugcacacgcauguagcagu

SEQ ID NO: 651202 - RNA, 22 nt, Human
gcagagauggcugccucugagu

SEQ ID NO: 651203 - RNA, 22 nt, Human
gaaucagaaucucuaagguggg

SEQ ID NO: 651204 - RNA, 22 nt, Human
gcucuagguuccuagccaaguc

SEQ ID NO: 651205 - RNA, 22 nt, Human
uggccagccuugucaucgcuuu

SEQ ID NO: 651206 - RNA, 22 nt, Human
guaagaagaugaauccaggcug

SEQ ID NO: 651207 - RNA, 22 nt, Human
ucugcccugccauucacuggaa

SEQ ID NO: 651208 - RNA, 22 nt, Human
aaagaguuuccauugacauuuc

SEQ ID NO: 651209 - RNA, 22 nt, Human
cagaaagcccuauguacagugg

SEQ ID NO: 651210 - RNA, 22 nt, Human
cuggaaagugcauguaaugagg

SEQ ID NO: 651211 - RNA, 22 nt, Human
ugcagucuuccagcugcacaaa

SEQ ID NO: 651212 - RNA, 23 nt, Human
uuuguucacuccugggaaagaca

SEQ ID NO: 651213 - RNA, 21 nt, Human
cagaggccucaugcucugugc

SEQ ID NO: 651214 - RNA, 22 nt, Human
gcuuaguguaggaccuggaaua

SEQ ID NO: 651215 - RNA, 22 nt, Human
cccaggaagggaugccaaggaa

SEQ ID NO: 651216 - RNA, 22 nt, Human
ggggcuggcucacuaagagacu

SEQ ID NO: 651217 - RNA, 22 nt, Human
cacauucacauuuuucccucua

SEQ ID NO: 651218 - RNA, 19 nt, Human
auggcuguguuccaguaaa

SEQ ID NO: 651219 - RNA, 22 nt, Human
ucaguuuucucaucuguaauuu

SEQ ID NO: 651220 - RNA, 22 nt, Human
gggaaauuaaugacugguugga

SEQ ID NO: 651221 - RNA, 22 nt, Human
auaauacaugguugaucuuuuc

SEQ ID NO: 651222 - RNA, 22 nt, Human
uauuugcucaauaauaguuuua

SEQ ID NO: 651223 - RNA, 19 nt, Human
agacaaugggguuggcagu

SEQ ID NO: 651224 - RNA, 22 nt, Human
aagcuggggacucagaccccau

SEQ ID NO: 651225 - RNA, 22 nt, Human
auuagugcccaggcugccucuu

SEQ ID NO: 651226 - RNA, 22 nt, Human
uccucccuugacuccugcuuuu

SEQ ID NO: 651227 - RNA, 22 nt, Human
cagagugaacagugggaugugc

SEQ ID NO: 651228 - RNA, 22 nt, Human
ucucugucugcacccaaucaau

SEQ ID NO: 651229 - RNA, 22 nt, Human
cccaggcuagaaaggccaacaa

SEQ ID NO: 651230 - RNA, 22 nt, Human
gccacagcuuagaucacagccu

SEQ ID NO: 651231 - RNA, 22 nt, Human
gccuggagaggaagccggugga

SEQ ID NO: 651232 - RNA, 20 nt, Human
uggaaggucccagaggaauu

SEQ ID NO: 651233 - RNA, 22 nt, Human
cuuauguacacacauauauugu

SEQ ID NO: 651234 - RNA, 22 nt, Human
acuugggagggugugggcagcu

SEQ ID NO: 651235 - RNA, 22 nt, Human
uggcacaggcgguaagggugug

SEQ ID NO: 651236 - RNA, 22 nt, Human
ucacacauuucucaaguguagg

SEQ ID NO: 651237 - RNA, 22 nt, Human
aggcccugcccagugccacaag

SEQ ID NO: 651238 - RNA, 22 nt, Human
ugugacguuccugcuggcgacc

SEQ ID NO: 651239 - RNA, 23 nt, Human
caacuuuuggcuacaugcuuagc

SEQ ID NO: 651240 - RNA, 22 nt, Human
uccucucagugugguuguggga

SEQ ID NO: 651241 - RNA, 22 nt, Human
ugcagcugccuagggcuggcuu

SEQ ID NO: 651242 - RNA, 22 nt, Human
ugcuggcuguauaugugagagu

SEQ ID NO: 651243 - RNA, 22 nt, Human
aggugggcaccaggcuuguggu

SEQ ID NO: 651244 - RNA, 22 nt, Human
ugcugaggaaagaggauaaaag

SEQ ID NO: 651245 - RNA, 17 nt, Human
augugucugaguguccu

SEQ ID NO: 651246 - RNA, 22 nt, Human
uggaaugugaacauacaaggua

SEQ ID NO: 651247 - RNA, 22 nt, Human
ucuccaggacugagcuccagcc

SEQ ID NO: 651248 - RNA, 22 nt, Human
cagugcugggcagaggagagcg

SEQ ID NO: 651249 - RNA, 22 nt, Human
cauaagaagguaacauccuuaa

SEQ ID NO: 651250 - RNA, 22 nt, Human
ucugagguuuucauguuuucug

SEQ ID NO: 651251 - RNA, 22 nt, Human
cagaagcauuccagcaaauagu

SEQ ID NO: 651252 - RNA, 22 nt, Human
cauuugaaccuggauguucuua

SEQ ID NO: 651253 - RNA, 22 nt, Human
ucaggaagcucuugcugauucu

SEQ ID NO: 651254 - RNA, 22 nt, Human
guucauccugacuuggauuagu

SEQ ID NO: 651255 - RNA, 22 nt, Human
ccuucagccaguuuucuuuguu

SEQ ID NO: 651256 - RNA, 22 nt, Human
cucuccagccuuuagcccacgc

SEQ ID NO: 651257 - RNA, 18 nt, Human
cuggucucccuucgcuuu

SEQ ID NO: 651258 - RNA, 22 nt, Human
ucacagcaaaugcugcuucuca

SEQ ID NO: 651259 - RNA, 21 nt, Human
uccucugcucucauaccacaa

SEQ ID NO: 651260 - RNA, 22 nt, Human
cagacuugacggcagcugcuuu

SEQ ID NO: 651261 - RNA, 22 nt, Human
ugcccacaccugggggaggcug

SEQ ID NO: 651262 - RNA, 22 nt, Human
uuccacucuguccccuguggga

SEQ ID NO: 651263 - RNA, 22 nt, Human
augcugugguagacagcauucc

SEQ ID NO: 651264 - RNA, 22 nt, Human
acaggcuuagggcuugggcccg

SEQ ID NO: 651265 - RNA, 22 nt, Human
ugucagagcaaggccaggccag

SEQ ID NO: 651266 - RNA, 22 nt, Human
agcaacagggggauggccacug

SEQ ID NO: 651267 - RNA, 22 nt, Human
gaggcuguuggcugaucugagu

SEQ ID NO: 651268 - RNA, 22 nt, Human
ggcuccuuaucucuccuaugcc

SEQ ID NO: 651269 - RNA, 22 nt, Human
caggggcuguggcacauggugu

SEQ ID NO: 651270 - RNA, 22 nt, Human
gagugugucggucagcguggcg

SEQ ID NO: 651271 - RNA, 22 nt, Human
ugaaggaagaauaggcaguguu

SEQ ID NO: 651272 - RNA, 22 nt, Human
uguaugaagguuuaccugcugu

SEQ ID NO: 651273 - RNA, 22 nt, Human
ugaguucaaguccaaguugcug

SEQ ID NO: 651274 - RNA, 22 nt, Human
auagacaacacuuauuauuccu

SEQ ID NO: 651275 - RNA, 22 nt, Human
uuucugcuuaggacucugugga

SEQ ID NO: 651276 - RNA, 22 nt, Human
cagucccaggguugguucagcu

SEQ ID NO: 651277 - RNA, 22 nt, Human
uuggguaggagaaagaacagau

SEQ ID NO: 651278 - RNA, 22 nt, Human
uaagauguuuugguuugauaag

SEQ ID NO: 651279 - RNA, 22 nt, Human
cuucuggaggcuccagggaggu

SEQ ID NO: 651280 - RNA, 22 nt, Human
gggcugugggacccggcacuuu

SEQ ID NO: 651281 - RNA, 22 nt, Human
accagcugccuuuucuuaguag

SEQ ID NO: 651282 - RNA, 22 nt, Human
uuccauauuguacucuuuggag

SEQ ID NO: 651283 - RNA, 22 nt, Human
uccugaaggcagauggggauca

SEQ ID NO: 651284 - RNA, 22 nt, Human
ggccaggcgaugaccccuccac

SEQ ID NO: 651285 - RNA, 22 nt, Human
gaagaugugcaauacaaagaaa

SEQ ID NO: 651286 - RNA, 22 nt, Human
cacccucccgucagccccuggg

SEQ ID NO: 651287 - RNA, 22 nt, Human
gagcaggacagcagcuuccugg

SEQ ID NO: 651288 - RNA, 22 nt, Human
cauucacaaaaccacaugccau

SEQ ID NO: 651289 - RNA, 22 nt, Human
gaaaggugccccauaggcagga

SEQ ID NO: 651290 - RNA, 22 nt, Human
uuuguguuguuuuaagccacua

SEQ ID NO: 651291 - RNA, 22 nt, Human
uugcaccaaaugaguuaaaauu

SEQ ID NO: 651292 - RNA, 22 nt, Human
uauggaauggcuauuuucuagg

SEQ ID NO: 651293 - RNA, 22 nt, Human
ugcccuggugaagugcucuccu

SEQ ID NO: 651294 - RNA, 22 nt, Human
uuucaguguguaaauugaaaua

SEQ ID NO: 651295 - RNA, 22 nt, Human
ccaggcugggcuacaaguugag

SEQ ID NO: 651296 - RNA, 22 nt, Human
cuuucucuucacugucaugauc

SEQ ID NO: 651297 - RNA, 22 nt, Human
gcccugaggcaaaagaacaguc

SEQ ID NO: 651298 - RNA, 22 nt, Human
ucugucacuauuggccagaaca

SEQ ID NO: 651299 - RNA, 22 nt, Human
uuagaacaaagccaccagguga

SEQ ID NO: 651300 - RNA, 22 nt, Human
cuguuaaguguagauaaugugg

SEQ ID NO: 651301 - RNA, 22 nt, Human
gucaugugaauaaguguggggu

SEQ ID NO: 651302 - RNA, 22 nt, Human
ugcucuguccagugcaccauca

SEQ ID NO: 651303 - RNA, 22 nt, Human
gcaggagucccagaagguuuug

SEQ ID NO: 651304 - RNA, 22 nt, Human
ggaggguggcagcguccugggc

SEQ ID NO: 651305 - RNA, 20 nt, Human
ugcuguaagauuagagagcu

SEQ ID NO: 651306 - RNA, 22 nt, Human
agauguggccggcuagggagag

SEQ ID NO: 651307 - RNA, 22 nt, Human
agguaaauauaaaucuuacucu

SEQ ID NO: 651308 - RNA, 22 nt, Human
ggcugcagaaguacuuccggau

SEQ ID NO: 651309 - RNA, 22 nt, Human
ccuccaucuccagcuucugccu

SEQ ID NO: 651310 - RNA, 22 nt, Human
aauucacagcauuugcccaucu

SEQ ID NO: 651311 - RNA, 22 nt, Human
ugaaugauuaaaacccggacua

SEQ ID NO: 651312 - RNA, 22 nt, Human
gcagaugaggaagcuaaugcug

SEQ ID NO: 651313 - RNA, 22 nt, Human
agggcagagauuaauuaagaca

SEQ ID NO: 651314 - RNA, 22 nt, Human
ggcuccagaaacuucaguccau

SEQ ID NO: 651315 - RNA, 22 nt, Human
ucagagagguuaaauaucuugu

SEQ ID NO: 651316 - RNA, 22 nt, Human
ugucugugugagcaaaugacuu

SEQ ID NO: 651317 - RNA, 17 nt, Human
aggagcuggggguggug

SEQ ID NO: 651318 - RNA, 22 nt, Human
uggcccugaaggccuugagcau

SEQ ID NO: 651319 - RNA, 22 nt, Human
caggugggaccaugauagggca

SEQ ID NO: 651320 - RNA, 22 nt, Human
cuguuuuucagaagguaaggga

SEQ ID NO: 651321 - RNA, 22 nt, Human
uuguaacaggcacucugugcca

SEQ ID NO: 651322 - RNA, 22 nt, Human
uucugggcaguuggaaauuuca

SEQ ID NO: 651323 - RNA, 22 nt, Human
acacuucuuugucaccugcuuc

SEQ ID NO: 651324 - RNA, 22 nt, Human
uagcacagagcuuuuaaacuuc

SEQ ID NO: 651325 - RNA, 22 nt, Human
agcugccugugcugggagccca

SEQ ID NO: 651326 - RNA, 22 nt, Human
aagcacaauuuaggacugaaau

SEQ ID NO: 651327 - RNA, 21 nt, Human
gugcugcuagcgggacgggag

SEQ ID NO: 651328 - RNA, 22 nt, Human
acaaacugggauaggauccugu

SEQ ID NO: 651329 - RNA, 22 nt, Human
acaaaugagaauguagacagag

SEQ ID NO: 651330 - RNA, 22 nt, Human
uccacaucucucgccaaccaau

SEQ ID NO: 651331 - RNA, 22 nt, Human
caggaguccugaaaucugauga

SEQ ID NO: 651332 - RNA, 22 nt, Human
ugagccaugggacuccaaggga

SEQ ID NO: 651333 - RNA, 22 nt, Human
aggucacacuuggaucauagaa

SEQ ID NO: 651334 - RNA, 22 nt, Human
cugccuucuuucaaggguaagc

SEQ ID NO: 651335 - RNA, 22 nt, Human
uuuagcuugaaucuuguuuaaa

SEQ ID NO: 651336 - RNA, 22 nt, Human
aaauagcagcuuugacagcaca

SEQ ID NO: 651337 - RNA, 22 nt, Human
uguacacaugguguacacuccc

SEQ ID NO: 651338 - RNA, 22 nt, Human
aaagaucuccccuucaaagagu

SEQ ID NO: 651339 - RNA, 18 nt, Human
caggaugagugaugggga

SEQ ID NO: 651340 - RNA, 22 nt, Human
uccugaaggccugaguuccacc

SEQ ID NO: 651341 - RNA, 21 nt, Human
ugaaacuaccuacaagcuacc

SEQ ID NO: 651342 - RNA, 22 nt, Human
agagagcugacuuuggagucag

SEQ ID NO: 651343 - RNA, 21 nt, Human
ugcaauuuagacuugaacauu

SEQ ID NO: 651344 - RNA, 22 nt, Human
uaaaucagggagucaucugcga

SEQ ID NO: 651345 - RNA, 20 nt, Human
agucccuuuggucagguauu

SEQ ID NO: 651346 - RNA, 22 nt, Human
cccaggcagggacgugcucugg

SEQ ID NO: 651347 - RNA, 22 nt, Human
ugaggucccagggguagugugc

SEQ ID NO: 651348 - RNA, 22 nt, Human
cacuuagauacuagaucacaaa

SEQ ID NO: 651349 - RNA, 22 nt, Human
caguucuuuguggggaguucuc

SEQ ID NO: 651350 - RNA, 22 nt, Human
aggcuggcgucaggggcuguac

SEQ ID NO: 651351 - RNA, 19 nt, Human
ucugcagaggaauucuuca

SEQ ID NO: 651352 - RNA, 22 nt, Human
cugugcccaccuggcucugagg

SEQ ID NO: 651353 - RNA, 22 nt, Human
agacaguugauauacuauaaaa

SEQ ID NO: 651354 - RNA, 22 nt, Human
ccagccaggcauugcaaacuga

SEQ ID NO: 651355 - RNA, 22 nt, Human
uucugucuucccacugaggagc

SEQ ID NO: 651356 - RNA, 22 nt, Human
gccagguacauuuaagaagccu

SEQ ID NO: 651357 - RNA, 22 nt, Human
agucuuagauaagugaccaaug

SEQ ID NO: 651358 - RNA, 22 nt, Human
ugugaauaaugccgcaauaaac

SEQ ID NO: 651359 - RNA, 22 nt, Human
uuucuucuuaauacuggcugcu

SEQ ID NO: 651360 - RNA, 22 nt, Human
ugucuccacaggugucagcuca

SEQ ID NO: 651361 - RNA, 22 nt, Human
acacuguucuuugcacugagaa

SEQ ID NO: 651362 - RNA, 22 nt, Human
ugaggccaacuagggagaugga

SEQ ID NO: 651363 - RNA, 22 nt, Human
gaagcaugcuaaggauucucag

SEQ ID NO: 651364 - RNA, 22 nt, Human
ucagugcauuaauaauaucagu

SEQ ID NO: 651365 - RNA, 20 nt, Human
uguauauuuucugguguaaa

SEQ ID NO: 651366 - RNA, 22 nt, Human
accauccugaaaccuucaugcu

SEQ ID NO: 651367 - RNA, 22 nt, Human
ugugauuauauuguaguacauu

SEQ ID NO: 651368 - RNA, 22 nt, Human
gauccguuugugugggaguauu

SEQ ID NO: 651369 - RNA, 20 nt, Human
gaggaaaagcugccaggccu

SEQ ID NO: 651370 - RNA, 22 nt, Human
cacacaugaaguugcugagcua

SEQ ID NO: 651371 - RNA, 22 nt, Human
ggaacugaggaacgaacuggga

SEQ ID NO: 651372 - RNA, 22 nt, Human
ugaugugugauucauucucaaa

SEQ ID NO: 651373 - RNA, 22 nt, Human
ucaaggaggugcuuggcuucac

SEQ ID NO: 651374 - RNA, 22 nt, Human
ccagacccugcucuggggcucu

SEQ ID NO: 651375 - RNA, 22 nt, Human
gcagaacauggaaagagaacua

SEQ ID NO: 651376 - RNA, 22 nt, Human
agcauagaaaagauucccagag

SEQ ID NO: 651377 - RNA, 22 nt, Human
gaaugcuaagcaugugggaguu

SEQ ID NO: 651378 - RNA, 20 nt, Human
uauuuacaacuuagagccuc

SEQ ID NO: 651379 - RNA, 22 nt, Human
ccagaggcuggggaaggauaca

SEQ ID NO: 651380 - RNA, 19 nt, Human
cucuggcuuccaaagcauc

SEQ ID NO: 651381 - RNA, 22 nt, Human
ugggaagaggaugaggcauaug

SEQ ID NO: 651382 - RNA, 20 nt, Human
gcuuggaccuucugcucugu

SEQ ID NO: 651383 - RNA, 22 nt, Human
aucuuuaggcaaguuacuuaac

SEQ ID NO: 651384 - RNA, 23 nt, Human
auggggcucaacacuuaguagcu

SEQ ID NO: 651385 - RNA, 22 nt, Human
agcugcugcggaaagaugccac

SEQ ID NO: 651386 - RNA, 22 nt, Human
acaguuauucuuuaugcaacca

SEQ ID NO: 651387 - RNA, 22 nt, Human
ucuggagcuuccucauuuacag

SEQ ID NO: 651388 - RNA, 22 nt, Human
ucuggcucuccagugcucuuag

SEQ ID NO: 651389 - RNA, 22 nt, Human
agugucuguugaguuucaaaag

SEQ ID NO: 651390 - RNA, 22 nt, Human
agugaaauuuguuuagauaggu

SEQ ID NO: 651391 - RNA, 22 nt, Human
gacagcugcucccguuucugcu

SEQ ID NO: 651392 - RNA, 19 nt, Human
uggcagugugggguaugaa

SEQ ID NO: 651393 - RNA, 22 nt, Human
aaggcaauguaaauuacagcuu

SEQ ID NO: 651394 - RNA, 22 nt, Human
gucuccugagacugcagucacc

SEQ ID NO: 651395 - RNA, 22 nt, Human
ucuuggcuucuguauuuccugu

SEQ ID NO: 651396 - RNA, 22 nt, Human
acaauuguggcaauuuguaugu

SEQ ID NO: 651397 - RNA, 22 nt, Human
ccaaagcaagucacaugaucaa

SEQ ID NO: 651398 - RNA, 22 nt, Human
ucacccagccuuggcggguuug

SEQ ID NO: 651399 - RNA, 22 nt, Human
caauaacuuugauauuuugcgg

SEQ ID NO: 651400 - RNA, 22 nt, Human
gcauuuguuugggcuaaucuua

SEQ ID NO: 651401 - RNA, 22 nt, Human
augaggcaaagguggagguggg

SEQ ID NO: 651402 - RNA, 22 nt, Human
ccagcauggcaccugagaugag

SEQ ID NO: 651403 - RNA, 22 nt, Human
caggcauggaaaagcccagagg

SEQ ID NO: 651404 - RNA, 21 nt, Human
ucccucagacagggugccuau

SEQ ID NO: 651405 - RNA, 22 nt, Human
uuuacuguguccaucugugacu

SEQ ID NO: 651406 - RNA, 22 nt, Human
agagggcauaaaauagagcacg

SEQ ID NO: 651407 - RNA, 22 nt, Human
auugaaaauaaggccagaaaca

SEQ ID NO: 651408 - RNA, 22 nt, Human
ucucugguuauuaacuaacucc

SEQ ID NO: 651409 - RNA, 22 nt, Human
uggcugagaaugggaugaugcc

SEQ ID NO: 651410 - RNA, 22 nt, Human
guaaaauugcaauuacuuuugc

SEQ ID NO: 651411 - RNA, 22 nt, Human
uggggauggaugaaucuuugcu

SEQ ID NO: 651412 - RNA, 22 nt, Human
aacuguggccagggacuggagu

SEQ ID NO: 651413 - RNA, 18 nt, Human
ucuuccaacacugacacc

SEQ ID NO: 651414 - RNA, 22 nt, Human
uccagaguuugagucuccuucc

SEQ ID NO: 651415 - RNA, 22 nt, Human
gccacccugacgccgcagaccc

SEQ ID NO: 651416 - RNA, 22 nt, Human
agaaagggagcguggaucaauu

SEQ ID NO: 651417 - RNA, 22 nt, Human
gcagugugcauggcuuuuggcc

SEQ ID NO: 651418 - RNA, 22 nt, Human
cuauaaaucuacccagcauugg

SEQ ID NO: 651419 - RNA, 22 nt, Human
agucugaagauauucuugcagg

SEQ ID NO: 651420 - RNA, 22 nt, Human
agcuccagggaaagaguggauc

SEQ ID NO: 651421 - RNA, 22 nt, Human
cuaggaauagcaaaguaggaca

SEQ ID NO: 651422 - RNA, 22 nt, Human
ugcugcuuccugguagauagga

SEQ ID NO: 651423 - RNA, 22 nt, Human
auuuccauguccaaaaauuagu

SEQ ID NO: 651424 - RNA, 22 nt, Human
ucagggcauguauguuucuuua

SEQ ID NO: 651425 - RNA, 22 nt, Human
ggcagagccuucuggagcucgc

SEQ ID NO: 651426 - RNA, 22 nt, Human
acuugaaacccugagaugauaa

SEQ ID NO: 651427 - RNA, 22 nt, Human
ugaggugguccaaagacuguuu

SEQ ID NO: 651428 - RNA, 22 nt, Human
auuauuacuccugauuguacug

SEQ ID NO: 651429 - RNA, 22 nt, Human
guagaaauauuuaucucugaga

SEQ ID NO: 651430 - RNA, 22 nt, Human
ucacuguuaauaaauagcaaag

SEQ ID NO: 651431 - RNA, 22 nt, Human
uggcagcagcaaauggcauauc

SEQ ID NO: 651432 - RNA, 22 nt, Human
aguagcagugacagcugaggua

SEQ ID NO: 651433 - RNA, 22 nt, Human
ugucaucuguguuuugcuggag

SEQ ID NO: 651434 - RNA, 22 nt, Human
gacauaauccuccucaccuacu

SEQ ID NO: 651435 - RNA, 21 nt, Human
uuggccugauaucuuggagca

SEQ ID NO: 651436 - RNA, 22 nt, Human
auucacacacauuuagagcaga

SEQ ID NO: 651437 - RNA, 22 nt, Human
uucccaguuagucauuuuuaca

SEQ ID NO: 651438 - RNA, 22 nt, Human
gaggcagcugaaggagugacag

SEQ ID NO: 651439 - RNA, 22 nt, Human
cccagugucauucuaagggagg

SEQ ID NO: 651440 - RNA, 22 nt, Human
uucagaaggauuuuaacacaug

SEQ ID NO: 651441 - RNA, 22 nt, Human
uccaugagaacccuuggagaua

SEQ ID NO: 651442 - RNA, 22 nt, Human
ucugcaacgcacugcaaaaccu

SEQ ID NO: 651443 - RNA, 22 nt, Human
agagaauucuggugcuaacaag

SEQ ID NO: 651444 - RNA, 22 nt, Human
aguaacaucuuugacauuuguu

SEQ ID NO: 651445 - RNA, 22 nt, Human
aauauguuccacuuaaagcugg

SEQ ID NO: 651446 - RNA, 22 nt, Human
cuuccuucaauauaauuuuuac

SEQ ID NO: 651447 - RNA, 22 nt, Human
cagugucuuucagacucagaaa

SEQ ID NO: 651448 - RNA, 22 nt, Human
ccugaagaugcuguggccuggu

SEQ ID NO: 651449 - RNA, 22 nt, Human
aguuauaccuuauacacauaug

SEQ ID NO: 651450 - RNA, 22 nt, Human
cacaccagagguuaccugcaaa

SEQ ID NO: 651451 - RNA, 22 nt, Human
guccugagagaggcuccuugcc

SEQ ID NO: 651452 - RNA, 22 nt, Human
gccagcugcaaaguauguugaa

SEQ ID NO: 651453 - RNA, 22 nt, Human
uucaaacacugcuuugagaggg

SEQ ID NO: 651454 - RNA, 22 nt, Human
cagacccuuuucugagaggacc

SEQ ID NO: 651455 - RNA, 22 nt, Human
gccuagggguaagaguacuggc

SEQ ID NO: 651456 - RNA, 22 nt, Human
caagagcugcaaauagcgugac

SEQ ID NO: 651457 - RNA, 22 nt, Human
aaguaacacauguuacuucugc

SEQ ID NO: 651458 - RNA, 22 nt, Human
ugccacauggugcauuuccuag

SEQ ID NO: 651459 - RNA, 22 nt, Human
gcacagaacuucucuuaguagg

SEQ ID NO: 651460 - RNA, 22 nt, Human
gagaggggcccaagccacauag

SEQ ID NO: 651461 - RNA, 22 nt, Human
acccagauaaaugacagggcuu

SEQ ID NO: 651462 - RNA, 22 nt, Human
ccaggccuccugugaguggacc

SEQ ID NO: 651463 - RNA, 22 nt, Human
aggccaagauuuuggaucagcu

SEQ ID NO: 651464 - RNA, 22 nt, Human
cuacagcagagaccagccacau

SEQ ID NO: 651465 - RNA, 22 nt, Human
acagucuugagcaucagccaga

SEQ ID NO: 651466 - RNA, 22 nt, Human
uguccugggccggcgacugguc

SEQ ID NO: 651467 - RNA, 22 nt, Human
uagaaaagauaacauucugugc

SEQ ID NO: 651468 - RNA, 22 nt, Human
aagcccagcaucccugcaccag

SEQ ID NO: 651469 - RNA, 22 nt, Human
acccaggcuggagugcaguggu

SEQ ID NO: 651470 - RNA, 22 nt, Human
augcggagccccaagcuugaag

SEQ ID NO: 651471 - RNA, 22 nt, Human
ucugcucuguggcuucagcuaa

SEQ ID NO: 651472 - RNA, 22 nt, Human
uugugagcauuuuggugagcuu

SEQ ID NO: 651473 - RNA, 22 nt, Human
uucuauuuccaguccuucagag

SEQ ID NO: 651474 - RNA, 22 nt, Human
gcaaacagaaaugcaggacgcu

SEQ ID NO: 651475 - RNA, 22 nt, Human
acucagugaauuuucaucaaau

SEQ ID NO: 651476 - RNA, 19 nt, Human
uacauccucuuccucuuug

SEQ ID NO: 651477 - RNA, 22 nt, Human
acugcacaaggccuggacacac

SEQ ID NO: 651478 - RNA, 22 nt, Human
gcugaauaagagucuacuuugc

SEQ ID NO: 651479 - RNA, 22 nt, Human
aauuggaaaaugcuacauauca

SEQ ID NO: 651480 - RNA, 18 nt, Human
ugaccugcgcuucacggu

SEQ ID NO: 651481 - RNA, 22 nt, Human
agcuaaugaugagauacagaua

SEQ ID NO: 651482 - RNA, 22 nt, Human
agugcucauaaaaaugugaaac

SEQ ID NO: 651483 - RNA, 22 nt, Human
uucuuugaguuaguacagucca

SEQ ID NO: 651484 - RNA, 17 nt, Human
ucaugcccaacuauuac

SEQ ID NO: 651485 - RNA, 22 nt, Human
aguuuucugaccccugcucuau

SEQ ID NO: 651486 - RNA, 20 nt, Human
ggcugccuccuuccuuuccu

SEQ ID NO: 651487 - RNA, 22 nt, Human
ucacaugucagucuuaaacaga

SEQ ID NO: 651488 - RNA, 22 nt, Human
uuugcauugcagugguuuacag

SEQ ID NO: 651489 - RNA, 22 nt, Human
ggcugagggccagggcuagucu

SEQ ID NO: 651490 - RNA, 22 nt, Human
agcucugguauuucuuuaaucc

SEQ ID NO: 651491 - RNA, 22 nt, Human
cucugggucucccugaggcuaa

SEQ ID NO: 651492 - RNA, 22 nt, Human
ggcuuccuaucccaucugagug

SEQ ID NO: 651493 - RNA, 22 nt, Human
aacagcagcugaggagcugggc

SEQ ID NO: 651494 - RNA, 22 nt, Human
cauuaaacaaccuugaaucaau

SEQ ID NO: 651495 - RNA, 22 nt, Human
cucacugcaaguuccaccuacc

SEQ ID NO: 651496 - RNA, 22 nt, Human
uggccuuggacagagcgcuccu

SEQ ID NO: 651497 - RNA, 22 nt, Human
uacagugucugcaacugcacac

SEQ ID NO: 651498 - RNA, 22 nt, Human
aaacuucaguaggagccaaccu

SEQ ID NO: 651499 - RNA, 22 nt, Human
ugaguccaauaggggccuggaa

SEQ ID NO: 651500 - RNA, 22 nt, Human
uuuacaguauaguaggacucau

SEQ ID NO: 651501 - RNA, 22 nt, Human
augauucagcaauuuuauaucu

SEQ ID NO: 651502 - RNA, 22 nt, Human
gcaaaggcuucuuuuauucucc

SEQ ID NO: 651503 - RNA, 17 nt, Human
ucacugggccugcuccc

SEQ ID NO: 651504 - RNA, 22 nt, Human
uguacaaagccagaacucccaa

SEQ ID NO: 651505 - RNA, 22 nt, Human
agacccuguuaguuccagucuu

SEQ ID NO: 651506 - RNA, 19 nt, Human
aguuaaugagcuuuugauc

SEQ ID NO: 651507 - RNA, 21 nt, Human
gcccucaggggaggauggccu

SEQ ID NO: 651508 - RNA, 22 nt, Human
aggcagugcugugcccugaacc

SEQ ID NO: 651509 - RNA, 20 nt, Human
ucccucaggucauugggcug

SEQ ID NO: 651510 - RNA, 22 nt, Human
uugagauagaucucaucuuccc

SEQ ID NO: 651511 - RNA, 19 nt, Human
uucugggaggggcugacug

SEQ ID NO: 651512 - RNA, 22 nt, Human
ccuccuagaggaaccccagggc

SEQ ID NO: 651513 - RNA, 23 nt, Human
auguuuuaugucucuagcugcca

SEQ ID NO: 651514 - RNA, 22 nt, Human
ucuccugccacugcuucccauu

SEQ ID NO: 651515 - RNA, 21 nt, Human
uuacaaagcuacagauguugc

SEQ ID NO: 651516 - RNA, 23 nt, Human
cuguccuuggucuuggcugagug

SEQ ID NO: 651517 - RNA, 22 nt, Human
gcauaugaucacgugugucggu

SEQ ID NO: 651518 - RNA, 22 nt, Human
ucugaccacagacaaccugcua

SEQ ID NO: 651519 - RNA, 21 nt, Human
ucugagcugaguccucuaggu

SEQ ID NO: 651520 - RNA, 22 nt, Human
ugccauggugacugcaggaggu

SEQ ID NO: 651521 - RNA, 22 nt, Human
ugggcagaggcagcagaaaccu

SEQ ID NO: 651522 - RNA, 23 nt, Human
augcccugugcagaaauguggaa

SEQ ID NO: 651523 - RNA, 22 nt, Human
ucagaauugauuuucaaaacag

SEQ ID NO: 651524 - RNA, 22 nt, Human
uacagucuuuggaaagagauag

SEQ ID NO: 651525 - RNA, 19 nt, Human
ggcuggagaaaggaaucag

SEQ ID NO: 651526 - RNA, 18 nt, Human
cucugucauaagugucau

SEQ ID NO: 651527 - RNA, 22 nt, Human
acucucccugcuauccacuucc

SEQ ID NO: 651528 - RNA, 22 nt, Human
cugagagcagggacuugagcca

SEQ ID NO: 651529 - RNA, 22 nt, Human
augauucuggcaaauuuauuau

SEQ ID NO: 651530 - RNA, 22 nt, Human
aacaaaguagcugcuguucuua

SEQ ID NO: 651531 - RNA, 22 nt, Human
agaacaaugcguauuuuacucc

SEQ ID NO: 651532 - RNA, 20 nt, Human
guguggccaggagcugcgcu

SEQ ID NO: 651533 - RNA, 23 nt, Human
ucucaggcaaaccaggacaaguu

SEQ ID NO: 651534 - RNA, 22 nt, Human
agagucuggugcaugauaagca

SEQ ID NO: 651535 - RNA, 21 nt, Human
ggaguuuuucuggaagggacu

SEQ ID NO: 651536 - RNA, 22 nt, Human
gagaggccaaaaucccugcccc

SEQ ID NO: 651537 - RNA, 22 nt, Human
uccuucagauuccugcuucugg

SEQ ID NO: 651538 - RNA, 22 nt, Human
gagggauggugugagaggcuca

SEQ ID NO: 651539 - RNA, 22 nt, Human
ccagacuguggaguuccuggug

SEQ ID NO: 651540 - RNA, 22 nt, Human
auuguauaagucuauuuacaau

SEQ ID NO: 651541 - RNA, 22 nt, Human
cuguguuugacaggcggucucc

SEQ ID NO: 651542 - RNA, 22 nt, Human
cugcaugguucaaaugagcuaa

SEQ ID NO: 651543 - RNA, 21 nt, Human
cacaccaggcaugucuugagc

SEQ ID NO: 651544 - RNA, 22 nt, Human
gaugauuugaggauuucaugag

SEQ ID NO: 651545 - RNA, 22 nt, Human
agaacauuugucaaaaagccaa

SEQ ID NO: 651546 - RNA, 22 nt, Human
agcagcucgggcuacagagggg

SEQ ID NO: 651547 - RNA, 22 nt, Human
cucacaugauggccuuuuucau

SEQ ID NO: 651548 - RNA, 22 nt, Human
aaucuuagguuuggcuucaucu

SEQ ID NO: 651549 - RNA, 22 nt, Human
cuguuacugcuggagccauuga

SEQ ID NO: 651550 - RNA, 20 nt, Human
ugauauuucuggaaguggag

SEQ ID NO: 651551 - RNA, 22 nt, Human
gggaucugaugcacugcugaaa

SEQ ID NO: 651552 - RNA, 22 nt, Human
gcuucccacagcuggacugggg

SEQ ID NO: 651553 - RNA, 22 nt, Human
uaauaccacugugcucauuaua

SEQ ID NO: 651554 - RNA, 22 nt, Human
aaggacagguuggggcuucagg

SEQ ID NO: 651555 - RNA, 22 nt, Human
aucaggaucugggagccugaaa

SEQ ID NO: 651556 - RNA, 22 nt, Human
uugaaucucaucccaauguugu

SEQ ID NO: 651557 - RNA, 22 nt, Human
gcagggcugggugggagacaga

SEQ ID NO: 651558 - RNA, 22 nt, Human
aaccugagauaauaggagagua

SEQ ID NO: 651559 - RNA, 22 nt, Human
ccugugggagcccaggcagaua

SEQ ID NO: 651560 - RNA, 22 nt, Human
agauacauuaguaguuacuugu

SEQ ID NO: 651561 - RNA, 22 nt, Human
gagaggaguaggcugauggugc

SEQ ID NO: 651562 - RNA, 22 nt, Human
cauacuuucuuuuucacgcaua

SEQ ID NO: 651563 - RNA, 18 nt, Human
aagugggaaaagcaagca

SEQ ID NO: 651564 - RNA, 22 nt, Human
agguggcaggaggucagagaaa

SEQ ID NO: 651565 - RNA, 19 nt, Human
aaacuaaggggaaauguuu

SEQ ID NO: 651566 - RNA, 22 nt, Human
uauguuuacgcugguagaauua

SEQ ID NO: 651567 - RNA, 22 nt, Human
gggcuccagccacuggcugagg

SEQ ID NO: 651568 - RNA, 22 nt, Human
aguuucacacaacauuugcaug

SEQ ID NO: 651569 - RNA, 22 nt, Human
ugccuggcacagagcagguggc

SEQ ID NO: 651570 - RNA, 17 nt, Human
ucuccuggcucuaucag

SEQ ID NO: 651571 - RNA, 22 nt, Human
acagaccugggcacagaaagga

SEQ ID NO: 651572 - RNA, 22 nt, Human
cucugcuuguaucacauuugcu

SEQ ID NO: 651573 - RNA, 22 nt, Human
gcugagggauagcugcucacug

SEQ ID NO: 651574 - RNA, 22 nt, Human
auaaugaaugcagaguuauuuu

SEQ ID NO: 651575 - RNA, 22 nt, Human
ggccucucagggcagagacccu

SEQ ID NO: 651576 - RNA, 22 nt, Human
gaagcauauagguacugaacua

SEQ ID NO: 651577 - RNA, 22 nt, Human
uucuuugaauagauguucccag

SEQ ID NO: 651578 - RNA, 22 nt, Human
cuggugauuacaaugaugacaa

SEQ ID NO: 651579 - RNA, 22 nt, Human
aggcagcauccagaggagaaug

SEQ ID NO: 651580 - RNA, 22 nt, Human
ccuacauucucugaguuuuccu

SEQ ID NO: 651581 - RNA, 22 nt, Human
ugcuggcaggcaccuccugggg

SEQ ID NO: 651582 - RNA, 22 nt, Human
gaaauacaaaugccuagauccu

SEQ ID NO: 651583 - RNA, 22 nt, Human
acauuucucuuagaguuggacu

SEQ ID NO: 651584 - RNA, 22 nt, Human
guggcaggaucacggcucacug

SEQ ID NO: 651585 - RNA, 22 nt, Human
uuacauuguccagaaauuauug

SEQ ID NO: 651586 - RNA, 22 nt, Human
augugucuuauuugauuccaca

SEQ ID NO: 651587 - RNA, 22 nt, Human
augcuggucucauuggguuagg

SEQ ID NO: 651588 - RNA, 22 nt, Human
guguaaguaucuuuguaucuuu

SEQ ID NO: 651589 - RNA, 22 nt, Human
ugaggcagcuuuuucugugugu

SEQ ID NO: 651590 - RNA, 22 nt, Human
aaggcaccauugucaacgguaa

SEQ ID NO: 651591 - RNA, 22 nt, Human
cugggcaguucgcuuucguuuu

SEQ ID NO: 651592 - RNA, 20 nt, Human
aucaaaggcugauucagucc

SEQ ID NO: 651593 - RNA, 22 nt, Human
gaccaaggcccucagugggagg

SEQ ID NO: 651594 - RNA, 22 nt, Human
gcaguggcaugaugugggcuca

SEQ ID NO: 651595 - RNA, 22 nt, Human
ccagcucagggucacauggcac

SEQ ID NO: 651596 - RNA, 22 nt, Human
gaugggcugucugagcgcugug

SEQ ID NO: 651597 - RNA, 22 nt, Human
cagugcaguugguggcaggggu

SEQ ID NO: 651598 - RNA, 22 nt, Human
cucaguguuaaauauaagguau

SEQ ID NO: 651599 - RNA, 22 nt, Human
uaugacaaaugauauauuuggc

SEQ ID NO: 651600 - RNA, 22 nt, Human
aguccaugguuguaguucucuc

SEQ ID NO: 651601 - RNA, 22 nt, Human
gcucccaacucaggccuccucc

SEQ ID NO: 651602 - RNA, 22 nt, Human
ucccuggacagccuugccuggg

SEQ ID NO: 651603 - RNA, 22 nt, Human
gaauguuugacuaaagguagcu

SEQ ID NO: 651604 - RNA, 19 nt, Human
ggcucucuuaaagcuguuu

SEQ ID NO: 651605 - RNA, 22 nt, Human
caccuggcccagcuccagugcu

SEQ ID NO: 651606 - RNA, 22 nt, Human
ucacaguguuggaaucagagcu

SEQ ID NO: 651607 - RNA, 22 nt, Human
uagguucaugaaauuuucagga

SEQ ID NO: 651608 - RNA, 22 nt, Human
auuuuauccccacuggauuaca

SEQ ID NO: 651609 - RNA, 22 nt, Human
ugucuggacauugacaaucaug

SEQ ID NO: 651610 - RNA, 22 nt, Human
ugcuccaggccgccuggggcug

SEQ ID NO: 651611 - RNA, 22 nt, Human
ugaaucugauuucccuggaggc

SEQ ID NO: 651612 - RNA, 22 nt, Human
gaaucuuaaaucggaaucuuaa

SEQ ID NO: 651613 - RNA, 22 nt, Human
gccagagccacuuuugggugau

SEQ ID NO: 651614 - RNA, 22 nt, Human
cccugccagaugugcuucaguu

SEQ ID NO: 651615 - RNA, 22 nt, Human
ugcagcauucuuggccacuacu

SEQ ID NO: 651616 - RNA, 22 nt, Human
cugggcucaagaagucuucccu

SEQ ID NO: 651617 - RNA, 22 nt, Human
agagaacagacagaugcaauga

SEQ ID NO: 651618 - RNA, 22 nt, Human
uggcacaggaucucagcggcca

SEQ ID NO: 651619 - RNA, 22 nt, Human
uuggcccuuuaugggaugggca

SEQ ID NO: 651620 - RNA, 22 nt, Human
ugggagaagcagcagccaagug

SEQ ID NO: 651621 - RNA, 22 nt, Human
auuccucagcaggccuuuuguu

SEQ ID NO: 651622 - RNA, 22 nt, Human
ugaaagcagugccaugauuaug

SEQ ID NO: 651623 - RNA, 22 nt, Human
uaauuuuguauugccauuguag

SEQ ID NO: 651624 - RNA, 20 nt, Human
gcagggcaagggauaugaaa

SEQ ID NO: 651625 - RNA, 22 nt, Human
gcacaggccaugggaggacagc

SEQ ID NO: 651626 - RNA, 22 nt, Human
cauuucuguacauguuuuggug

SEQ ID NO: 651627 - RNA, 19 nt, Human
uuucaauggcuuagagaaa

SEQ ID NO: 651628 - RNA, 23 nt, Human
aaauaccugaauuagauauuauc

SEQ ID NO: 651629 - RNA, 22 nt, Human
gaugucuuaagcccagaaguuc

SEQ ID NO: 651630 - RNA, 22 nt, Human
aucccgaaccucuacuucuuuc

SEQ ID NO: 651631 - RNA, 17 nt, Human
agugagaaugucaugua

SEQ ID NO: 651632 - RNA, 22 nt, Human
gaacugaguuuucugccuggac

SEQ ID NO: 651633 - RNA, 22 nt, Human
uugagaaugaugagauucuucc

SEQ ID NO: 651634 - RNA, 22 nt, Human
gccuggcuugccagcccuggcg

SEQ ID NO: 651635 - RNA, 22 nt, Human
ugcuuucugcucuuguccacac

SEQ ID NO: 651636 - RNA, 22 nt, Human
gucuggaggagggcucugcggc

SEQ ID NO: 651637 - RNA, 22 nt, Human
agagggagugaaauggaauaga

SEQ ID NO: 651638 - RNA, 22 nt, Human
aggaagccaugguggacgucua

SEQ ID NO: 651639 - RNA, 22 nt, Human
cuggcccuguaggaugugaguu

SEQ ID NO: 651640 - RNA, 22 nt, Human
uuucacuagaacguucuuguuu

SEQ ID NO: 651641 - RNA, 22 nt, Human
aaaguccuagcgauccacagaa

SEQ ID NO: 651642 - RNA, 22 nt, Human
agcugaccaaaugccuacaguu

SEQ ID NO: 651643 - RNA, 22 nt, Human
aguaggcauuuaauaaacauga

SEQ ID NO: 651644 - RNA, 22 nt, Human
uucacauuacaaggccauauuu

SEQ ID NO: 651645 - RNA, 22 nt, Human
ugugggaggaauuagaauggga

SEQ ID NO: 651646 - RNA, 22 nt, Human
aaaggccucuguccuagugccu

SEQ ID NO: 651647 - RNA, 20 nt, Human
ccagggcuggcuccugggau

SEQ ID NO: 651648 - RNA, 22 nt, Human
gucauuuuugacuuugaaguga

SEQ ID NO: 651649 - RNA, 21 nt, Human
gagaaucaggaaggauugaug

SEQ ID NO: 651650 - RNA, 22 nt, Human
acagaggguguggaggaagacg

SEQ ID NO: 651651 - RNA, 21 nt, Human
ugagucucucagcuucaggua

SEQ ID NO: 651652 - RNA, 22 nt, Human
caugggguggugggcaaccuca

SEQ ID NO: 651653 - RNA, 22 nt, Human
cuucugagauguuguuuuacag

SEQ ID NO: 651654 - RNA, 22 nt, Human
ggccugcugacccaaguccugu

SEQ ID NO: 651655 - RNA, 22 nt, Human
guguaaaaacauacuauuucua

SEQ ID NO: 651656 - RNA, 22 nt, Human
cagagcuggacuuaaauauauu

SEQ ID NO: 651657 - RNA, 22 nt, Human
gggucaagccguugcccaaggc

SEQ ID NO: 651658 - RNA, 22 nt, Human
uuagagauacauuuguagcuug

SEQ ID NO: 651659 - RNA, 22 nt, Human
uuugugaauaagagaaugacag

SEQ ID NO: 651660 - RNA, 22 nt, Human
ggcagcucgucaggcugcggcg

SEQ ID NO: 651661 - RNA, 22 nt, Human
ccugcucuagacucugggaagg

SEQ ID NO: 651662 - RNA, 22 nt, Human
cuucagcccugagugccagcag

SEQ ID NO: 651663 - RNA, 19 nt, Human
ggcuucgaggcuggggaag

SEQ ID NO: 651664 - RNA, 22 nt, Human
auucuguaauugaacuguguug

SEQ ID NO: 651665 - RNA, 22 nt, Human
uuuugcuuuaagauggagagga

SEQ ID NO: 651666 - RNA, 22 nt, Human
agagcuggauggucaagauggc

SEQ ID NO: 651667 - RNA, 22 nt, Human
uuagacauuaaaugccauuuaa

SEQ ID NO: 651668 - RNA, 22 nt, Human
cccugcagaucagugagaacuu

SEQ ID NO: 651669 - RNA, 18 nt, Human
acaguaaagaaaggaauu

SEQ ID NO: 651670 - RNA, 22 nt, Human
ucagaaugaaauuucuuucaga

SEQ ID NO: 651671 - RNA, 19 nt, Human
augauacaggugaaaauug

SEQ ID NO: 651672 - RNA, 22 nt, Human
aaaagcuuuguuaauagguuug

SEQ ID NO: 651673 - RNA, 22 nt, Human
cagaaugagauaacccagauug

SEQ ID NO: 651674 - RNA, 22 nt, Human
ggcuuugcaggcagcaucaagg

SEQ ID NO: 651675 - RNA, 22 nt, Human
cuucagaacuauaaaaaguacu

SEQ ID NO: 651676 - RNA, 22 nt, Human
ugcuucugcucagcuuccuacu

SEQ ID NO: 651677 - RNA, 22 nt, Human
acugggccagaucagagcaacu

SEQ ID NO: 651678 - RNA, 22 nt, Human
aaggcaaugcuaagagguuugg

SEQ ID NO: 651679 - RNA, 22 nt, Human
ugcuugucacccugccugagug

SEQ ID NO: 651680 - RNA, 22 nt, Human
ggagacucaccccgcauucuag

SEQ ID NO: 651681 - RNA, 22 nt, Human
agucacauaguguuuuggaauc

SEQ ID NO: 651682 - RNA, 19 nt, Human
cucagucuggcucugccug

SEQ ID NO: 651683 - RNA, 21 nt, Human
agcuggaaucuggcugugcuu

SEQ ID NO: 651684 - RNA, 22 nt, Human
uggcugaggucuggggcuucug

SEQ ID NO: 651685 - RNA, 21 nt, Human
uagaaaucagcuggugccucu

SEQ ID NO: 651686 - RNA, 22 nt, Human
aauucauacucuauauugcuuu

SEQ ID NO: 651687 - RNA, 22 nt, Human
gccucugcgccucagccgaccu

SEQ ID NO: 651688 - RNA, 22 nt, Human
uacugaauggggcaguaagaaa

SEQ ID NO: 651689 - RNA, 22 nt, Human
uaggaaacaaaccugccucuuc

SEQ ID NO: 651690 - RNA, 22 nt, Human
ucagaggaacuggacuaaagcc

SEQ ID NO: 651691 - RNA, 22 nt, Human
agcugccaaguuucucaguuua

SEQ ID NO: 651692 - RNA, 22 nt, Human
uucuccucagcaaggcagcuuu

SEQ ID NO: 651693 - RNA, 22 nt, Human
cuccacucaccgaggcagagca

SEQ ID NO: 651694 - RNA, 17 nt, Human
agagagagcaugccacc

SEQ ID NO: 651695 - RNA, 22 nt, Human
uagugaaacaguuaucaaucug

SEQ ID NO: 651696 - RNA, 22 nt, Human
aggagcuggccuagaaaggaga

SEQ ID NO: 651697 - RNA, 22 nt, Human
auuagggcuggaugcaaggaaa

SEQ ID NO: 651698 - RNA, 21 nt, Human
ugcuugucaugaaugggccag

SEQ ID NO: 651699 - RNA, 22 nt, Human
uuuggaagggaaagaaaguacu

SEQ ID NO: 651700 - RNA, 22 nt, Human
uccugggagcacaugguccugc

SEQ ID NO: 651701 - RNA, 23 nt, Human
uugcuucugugcaauucaguacu

SEQ ID NO: 651702 - RNA, 22 nt, Human
ucucaggccccugaguuucucu

SEQ ID NO: 651703 - RNA, 22 nt, Human
uaucuucucaguauaugggaug

SEQ ID NO: 651704 - RNA, 22 nt, Human
ggagggcucaauugacuccuga

SEQ ID NO: 651705 - RNA, 20 nt, Human
cacagaacaaauugcaggac

SEQ ID NO: 651706 - RNA, 22 nt, Human
cuuaguuucucuguauguuuac

SEQ ID NO: 651707 - RNA, 22 nt, Human
gucugggucuccacagucagca

SEQ ID NO: 651708 - RNA, 22 nt, Human
ccacagcugacaauggauagac

SEQ ID NO: 651709 - RNA, 22 nt, Human
auucagcagccauggcuucuga

SEQ ID NO: 651710 - RNA, 22 nt, Human
cgcaggcugcagccaagaagag

SEQ ID NO: 651711 - RNA, 19 nt, Human
uuaacagucaccaaggaga

SEQ ID NO: 651712 - RNA, 20 nt, Human
guuuuucucucuugccacua

SEQ ID NO: 651713 - RNA, 22 nt, Human
auguuuccagcucagcugcagg

SEQ ID NO: 651714 - RNA, 22 nt, Human
uccuuccucggggacccagauc

SEQ ID NO: 651715 - RNA, 22 nt, Human
aauuaaauugguuuagagagga

SEQ ID NO: 651716 - RNA, 20 nt, Human
uuccuggcucuaggaccuug

SEQ ID NO: 651717 - RNA, 22 nt, Human
auucagcacaucuuuguacagc

SEQ ID NO: 651718 - RNA, 20 nt, Human
gcuguggcaagugcucacug

SEQ ID NO: 651719 - RNA, 22 nt, Human
aacacuguacuggaagauggac

SEQ ID NO: 651720 - RNA, 22 nt, Human
uuuuucucuucuguaaaguggu

SEQ ID NO: 651721 - RNA, 22 nt, Human
acagcugugagggucacuugua

SEQ ID NO: 651722 - RNA, 22 nt, Human
aguggcuguucauuuuacacaa

SEQ ID NO: 651723 - RNA, 22 nt, Human
aaguuuuacugaggacacaugu

SEQ ID NO: 651724 - RNA, 22 nt, Human
guggcagugccguuugguucag

SEQ ID NO: 651725 - RNA, 22 nt, Human
auucuggccuuggcucugucac

SEQ ID NO: 651726 - RNA, 22 nt, Human
cagugucugaaauaacaccgga

SEQ ID NO: 651727 - RNA, 22 nt, Human
uuccaguugguagaauguaagg

SEQ ID NO: 651728 - RNA, 22 nt, Human
auguuuaaaggagucagagacu

SEQ ID NO: 651729 - RNA, 22 nt, Human
augucuguccaacccugcaggg

SEQ ID NO: 651730 - RNA, 22 nt, Human
ggggaagaaaucuggguucuuc

SEQ ID NO: 651731 - RNA, 22 nt, Human
gcgagggcacgcgguugaaggc

SEQ ID NO: 651732 - RNA, 22 nt, Human
uugaagcaugguacuuguucaa

SEQ ID NO: 651733 - RNA, 20 nt, Human
ugcagggcugccucccagcu

SEQ ID NO: 651734 - RNA, 22 nt, Human
ucucccaggcugcccuguggac

SEQ ID NO: 651735 - RNA, 22 nt, Human
auauaaguguguggcuguuagu

SEQ ID NO: 651736 - RNA, 22 nt, Human
ugggggcuccaggcuccaggga

SEQ ID NO: 651737 - RNA, 22 nt, Human
gcuguccagguuguggagcaac

SEQ ID NO: 651738 - RNA, 22 nt, Human
cagcucagucuugaagcacugg

SEQ ID NO: 651739 - RNA, 22 nt, Human
ccaggagucuggaugagguguc

SEQ ID NO: 651740 - RNA, 22 nt, Human
gcucuuugcacagcucugcccu

SEQ ID NO: 651741 - RNA, 21 nt, Human
uggagcugaauuuuuggcauc

SEQ ID NO: 651742 - RNA, 22 nt, Human
ucauuuaauaauuuuugaguag

SEQ ID NO: 651743 - RNA, 20 nt, Human
agucccagaucaaauuucug

SEQ ID NO: 651744 - RNA, 22 nt, Human
cucaguuuccccggccugggcg

SEQ ID NO: 651745 - RNA, 22 nt, Human
gccugugccucagccugcagcc

SEQ ID NO: 651746 - RNA, 22 nt, Human
gacagcagccacagggagaggg

SEQ ID NO: 651747 - RNA, 22 nt, Human
cacagcuggugacagagcccag

SEQ ID NO: 651748 - RNA, 22 nt, Human
gugucaauaaauagcggugugg

SEQ ID NO: 651749 - RNA, 22 nt, Human
guggagcuggacccaggccucu

SEQ ID NO: 651750 - RNA, 21 nt, Human
ggguggucugcugaagaggga

SEQ ID NO: 651751 - RNA, 22 nt, Human
cugauaauguccugcaguaaau

SEQ ID NO: 651752 - RNA, 22 nt, Human
ucuaugaaugacacagauaaua

SEQ ID NO: 651753 - RNA, 22 nt, Human
gcucagagcccgaggcuugcau

SEQ ID NO: 651754 - RNA, 22 nt, Human
acagcaggaauuaacauauaag

SEQ ID NO: 651755 - RNA, 22 nt, Human
cagacuguggcuucuuggaggg

SEQ ID NO: 651756 - RNA, 22 nt, Human
ggcacagagcccagcuuccuag

SEQ ID NO: 651757 - RNA, 22 nt, Human
ggcagugaacagaaaugcagaa

SEQ ID NO: 651758 - RNA, 22 nt, Human
gccagagcacaggcugguagua

SEQ ID NO: 651759 - RNA, 22 nt, Human
gcaauguuuuuccuuccauauu

SEQ ID NO: 651760 - RNA, 22 nt, Human
gcagcauggaguuguggaauga

SEQ ID NO: 651761 - RNA, 22 nt, Human
aacauucagcuggguggagcag

SEQ ID NO: 651762 - RNA, 22 nt, Human
ucaccccuacauuucccuugcu

SEQ ID NO: 651763 - RNA, 22 nt, Human
ucuguaaucaagauauuugaga

SEQ ID NO: 651764 - RNA, 22 nt, Human
auuuagucucccuuaucaagga

SEQ ID NO: 651765 - RNA, 22 nt, Human
guuuggaaguuaagugcagcag

SEQ ID NO: 651766 - RNA, 22 nt, Human
cuuccuguugucacagucugcg

SEQ ID NO: 651767 - RNA, 22 nt, Human
gggaggacgguccagggcaaag

SEQ ID NO: 651768 - RNA, 22 nt, Human
cggagaggaccugcaacucgcu

SEQ ID NO: 651769 - RNA, 22 nt, Human
ucaguucuuauuuucaugaaua

SEQ ID NO: 651770 - RNA, 22 nt, Human
aagguacaccaaaguucaaguu

SEQ ID NO: 651771 - RNA, 22 nt, Human
caaccugagacuccaggcaccu

SEQ ID NO: 651772 - RNA, 22 nt, Human
gcccaggagaggccagggcuga

SEQ ID NO: 651773 - RNA, 22 nt, Human
acaauuccacauggcaugcagg

SEQ ID NO: 651774 - RNA, 22 nt, Human
uauuuucuggggagagugaacc

SEQ ID NO: 651775 - RNA, 22 nt, Human
cuuucugaaagacauuuuaacu

SEQ ID NO: 651776 - RNA, 22 nt, Human
uggaacaaauuacaauuaacuu

SEQ ID NO: 651777 - RNA, 22 nt, Human
augugagcuccggcagguggaa

SEQ ID NO: 651778 - RNA, 22 nt, Human
cuggaaaguacagugugucaca

SEQ ID NO: 651779 - RNA, 22 nt, Human
cauaauuuuccaugguuugcua

SEQ ID NO: 651780 - RNA, 22 nt, Human
gugaacuuccagaugauaaaca

SEQ ID NO: 651781 - RNA, 22 nt, Human
agcccagcaaagggagguucag

SEQ ID NO: 651782 - RNA, 22 nt, Human
cucugcaaucugagcacuugua

SEQ ID NO: 651783 - RNA, 22 nt, Human
gucacuguauccagguuccagc

SEQ ID NO: 651784 - RNA, 22 nt, Human
gcuaguccacagccauccaggc

SEQ ID NO: 651785 - RNA, 22 nt, Human
uucuccuggggccgugauguga

SEQ ID NO: 651786 - RNA, 23 nt, Human
uucauuugucuacuucacuuguu

SEQ ID NO: 651787 - RNA, 22 nt, Human
ggucccaggaaucuguguucua

SEQ ID NO: 651788 - RNA, 22 nt, Human
uggaggagggcuggugucugua

SEQ ID NO: 651789 - RNA, 22 nt, Human
aggaaaacacaguauugaugga

SEQ ID NO: 651790 - RNA, 17 nt, Human
acaaugcagucucuagu

SEQ ID NO: 651791 - RNA, 22 nt, Human
uuagaggaaagugacuccgaug

SEQ ID NO: 651792 - RNA, 22 nt, Human
agguucaggcacuugcccaaca

SEQ ID NO: 651793 - RNA, 22 nt, Human
uagauucuguaugucugcucuc

SEQ ID NO: 651794 - RNA, 22 nt, Human
agugccuggaccccaugacaua

SEQ ID NO: 651795 - RNA, 22 nt, Human
cacccagcuuuugcauccuccg

SEQ ID NO: 651796 - RNA, 22 nt, Human
ucucuuggaacacuugcucuua

SEQ ID NO: 651797 - RNA, 22 nt, Human
agaggcuggguacgggccaccu

SEQ ID NO: 651798 - RNA, 22 nt, Human
cuuuggaauauuuuauugagaa

SEQ ID NO: 651799 - RNA, 22 nt, Human
gcccagcagaucucagugucuc

SEQ ID NO: 651800 - RNA, 22 nt, Human
caucaaauggcaagugaaagcu

SEQ ID NO: 651801 - RNA, 22 nt, Human
ucuuuaaucauaaccaagaugg

SEQ ID NO: 651802 - RNA, 22 nt, Human
gggacuguccuacauggagagg

SEQ ID NO: 651803 - RNA, 22 nt, Human
cagaaagccgacuuacaaugga

SEQ ID NO: 651804 - RNA, 22 nt, Human
caguuuuauugguugaaaucug

SEQ ID NO: 651805 - RNA, 22 nt, Human
uaauugcugaacuacuaucccu

SEQ ID NO: 651806 - RNA, 22 nt, Human
cuuucacaagauuugagaugcu

SEQ ID NO: 651807 - RNA, 22 nt, Human
guccuucaagaguccccuacug

SEQ ID NO: 651808 - RNA, 22 nt, Human
agggcagccucucagccuaggu

SEQ ID NO: 651809 - RNA, 22 nt, Human
auacaucuagagucauaaaaac

SEQ ID NO: 651810 - RNA, 22 nt, Human
cagcccagcgcaaacaacuggc

SEQ ID NO: 651811 - RNA, 22 nt, Human
cuaaacaugcaagagcuucugg

SEQ ID NO: 651812 - RNA, 22 nt, Human
agcagcaguccuuuguguaauu

SEQ ID NO: 651813 - RNA, 22 nt, Human
ugaauacacuaaaaaucacuuu

SEQ ID NO: 651814 - RNA, 22 nt, Human
caggagaugacagggaagaacc

SEQ ID NO: 651815 - RNA, 22 nt, Human
ugcaggugcguuuucaagccuc

SEQ ID NO: 651816 - RNA, 22 nt, Human
agcugggguugcacacauuuug

SEQ ID NO: 651817 - RNA, 21 nt, Human
uauaggcuuccauaugaaggg

SEQ ID NO: 651818 - RNA, 22 nt, Human
aagccaagugcuggccaugggc

SEQ ID NO: 651819 - RNA, 20 nt, Human
uggagagccucuggacugug

SEQ ID NO: 651820 - RNA, 22 nt, Human
gccccacuguggaaccuaaguc

SEQ ID NO: 651821 - RNA, 19 nt, Human
uuuuccugccucauuguuu

SEQ ID NO: 651822 - RNA, 22 nt, Human
uagauuuuacuucugucauuac

SEQ ID NO: 651823 - RNA, 19 nt, Human
guuucauuaagauaggaaa

SEQ ID NO: 651824 - RNA, 22 nt, Human
cagggggugcaggcccugugac

SEQ ID NO: 651825 - RNA, 22 nt, Human
ccagcuggcaggagagucaggg

SEQ ID NO: 651826 - RNA, 22 nt, Human
ggcugagcccccucugcguagg

SEQ ID NO: 651827 - RNA, 22 nt, Human
uuuuacaccuguuaacucuaag

SEQ ID NO: 651828 - RNA, 22 nt, Human
ucauaaauugauuaugugcuuu

SEQ ID NO: 651829 - RNA, 22 nt, Human
gaaggcauuucagagaucucug

SEQ ID NO: 651830 - RNA, 22 nt, Human
uuucacacuagucagaauacca

SEQ ID NO: 651831 - RNA, 22 nt, Human
uugcccugccucccugagguga

SEQ ID NO: 651832 - RNA, 22 nt, Human
uccagggaaggugugaggcugg

SEQ ID NO: 651833 - RNA, 22 nt, Human
uaugcaugugguauaugcuuau

SEQ ID NO: 651834 - RNA, 18 nt, Human
ugagaauguaagaaaugg

SEQ ID NO: 651835 - RNA, 22 nt, Human
guuuuccugagcccagagaugc

SEQ ID NO: 651836 - RNA, 18 nt, Human
ugagccgguagauggggu

SEQ ID NO: 651837 - RNA, 22 nt, Human
auaugguaagaguauauuuacu

SEQ ID NO: 651838 - RNA, 22 nt, Human
gcccaaggucacacacaggaag

SEQ ID NO: 651839 - RNA, 22 nt, Human
uggcagcauuuuuuccagaaca

SEQ ID NO: 651840 - RNA, 22 nt, Human
gagaagggcuugggagucaaca

SEQ ID NO: 651841 - RNA, 22 nt, Human
ggcgggagcagcagcucugagc

SEQ ID NO: 651842 - RNA, 22 nt, Human
uuccaucugcuagguaaaugaa

SEQ ID NO: 651843 - RNA, 22 nt, Human
cccagccuuugcuuccugguuc

SEQ ID NO: 651844 - RNA, 22 nt, Human
cuagggugugcagauuuugccu

SEQ ID NO: 651845 - RNA, 22 nt, Human
uccaguaugacugauguccuuc

SEQ ID NO: 651846 - RNA, 22 nt, Human
gggaguggauuauguggaccca

SEQ ID NO: 651847 - RNA, 19 nt, Human
agcaggcuaggcugccucu

SEQ ID NO: 651848 - RNA, 22 nt, Human
cuggugcaggaaggagcuggca

SEQ ID NO: 651849 - RNA, 22 nt, Human
caguuucuuagugacacaaauc

SEQ ID NO: 651850 - RNA, 19 nt, Human
uuucuuuuccccucagcac

SEQ ID NO: 651851 - RNA, 22 nt, Human
caccagcagaagacugagggug

SEQ ID NO: 651852 - RNA, 22 nt, Human
cuguggaaggacuuagcgauac

SEQ ID NO: 651853 - RNA, 22 nt, Human
aaaggcaugccuccauuucuau

SEQ ID NO: 651854 - RNA, 22 nt, Human
gacaggcaggccagggcugugg

SEQ ID NO: 651855 - RNA, 22 nt, Human
acacuacagggccgggauggaa

SEQ ID NO: 651856 - RNA, 22 nt, Human
ucccagacaaucauuggccacc

SEQ ID NO: 651857 - RNA, 22 nt, Human
ucagcagauggguuguguuggc

SEQ ID NO: 651858 - RNA, 22 nt, Human
aauuagaaucuuauuuggggaa

SEQ ID NO: 651859 - RNA, 22 nt, Human
ucauuauccuaguaucuugaau

SEQ ID NO: 651860 - RNA, 22 nt, Human
agcugguucaguuucugggccu

SEQ ID NO: 651861 - RNA, 22 nt, Human
gugagucugccuagcacaucac

SEQ ID NO: 651862 - RNA, 22 nt, Human
aauuacagucggagcagcacug

SEQ ID NO: 651863 - RNA, 23 nt, Human
uccugcagauaagcugguugaca

SEQ ID NO: 651864 - RNA, 22 nt, Human
uagaggugagauuguggugcug

SEQ ID NO: 651865 - RNA, 22 nt, Human
agcuggcaguaugacuggugac

SEQ ID NO: 651866 - RNA, 22 nt, Human
aguaaacauuucagauuuauuu

SEQ ID NO: 651867 - RNA, 22 nt, Human
uacuguacucaacaugugaguu

SEQ ID NO: 651868 - RNA, 22 nt, Human
ugcuccacuaagccaucccauu

SEQ ID NO: 651869 - RNA, 22 nt, Human
guauaaaguauaagcuuguuuu

SEQ ID NO: 651870 - RNA, 22 nt, Human
ugcuuucauauugccuaugacu

SEQ ID NO: 651871 - RNA, 22 nt, Human
cagggagggaggaaaauuugcu

SEQ ID NO: 651872 - RNA, 22 nt, Human
ccauuacugaaauaaagagaau

SEQ ID NO: 651873 - RNA, 22 nt, Human
ggaguggccucuccugugcagg

SEQ ID NO: 651874 - RNA, 22 nt, Human
uucugguguguucucucuaggc

SEQ ID NO: 651875 - RNA, 22 nt, Human
ucugaguucauaccaggcuacc

SEQ ID NO: 651876 - RNA, 22 nt, Human
gaaauaauucugugucugaaca

SEQ ID NO: 651877 - RNA, 22 nt, Human
ugcagcaauuugcaguaauuua

SEQ ID NO: 651878 - RNA, 21 nt, Human
ugggcucagccccagcccugc

SEQ ID NO: 651879 - RNA, 22 nt, Human
cuccaggagggggauggcugua

SEQ ID NO: 651880 - RNA, 22 nt, Human
cuccagauaggagggggucccc

SEQ ID NO: 651881 - RNA, 22 nt, Human
gugcagccauuugcaugcuucc

SEQ ID NO: 651882 - RNA, 22 nt, Human
gggcugaaaggccgccucagau

SEQ ID NO: 651883 - RNA, 22 nt, Human
ggugcugagugagcuagaggcu

SEQ ID NO: 651884 - RNA, 22 nt, Human
caugugucuuuauggagccaca

SEQ ID NO: 651885 - RNA, 22 nt, Human
aagaaauguagagccuaguaaa

SEQ ID NO: 651886 - RNA, 22 nt, Human
gcucuggacccuggaguggcug

SEQ ID NO: 651887 - RNA, 22 nt, Human
caaggcagucccuacucccugc

SEQ ID NO: 651888 - RNA, 22 nt, Human
gggagguccuaaaggggaccag

SEQ ID NO: 651889 - RNA, 22 nt, Human
aagggugggcaccgccagguca

SEQ ID NO: 651890 - RNA, 22 nt, Human
agggcucaguugccuggagccc

SEQ ID NO: 651891 - RNA, 22 nt, Human
ugugccaucugauauaagagcc

SEQ ID NO: 651892 - RNA, 22 nt, Human
gggucaggcuagcccagacuuc

SEQ ID NO: 651893 - RNA, 22 nt, Human
guggugaagccccaucucugcu

SEQ ID NO: 651894 - RNA, 18 nt, Human
gaaaggagagacaguagg

SEQ ID NO: 651895 - RNA, 22 nt, Human
uccaggcucuaggcugcucucc

SEQ ID NO: 651896 - RNA, 22 nt, Human
ggucaucugccuccaaagcacu

SEQ ID NO: 651897 - RNA, 22 nt, Human
aacuuucuauagguugggauuu

SEQ ID NO: 651898 - RNA, 22 nt, Human
cuggccacaugugugcugagca

SEQ ID NO: 651899 - RNA, 22 nt, Human
caggacagaaauaaggaauaua

SEQ ID NO: 651900 - RNA, 22 nt, Human
ccaggcuuuucucauggaguca

SEQ ID NO: 651901 - RNA, 22 nt, Human
gccuguggccacugcgucugca

SEQ ID NO: 651902 - RNA, 22 nt, Human
caagggugguauugggagcaua

SEQ ID NO: 651903 - RNA, 22 nt, Human
ugcagagauccuggacugagcg

SEQ ID NO: 651904 - RNA, 22 nt, Human
uucauguaccguguaccaggca

SEQ ID NO: 651905 - RNA, 22 nt, Human
uacauagaggguaauagcauca

SEQ ID NO: 651906 - RNA, 22 nt, Human
ccuucccuaaagcgucgcuuag

SEQ ID NO: 651907 - RNA, 22 nt, Human
uuccaggacaagauguuucagg

SEQ ID NO: 651908 - RNA, 20 nt, Human
ucaugcaagauucauaaagg

SEQ ID NO: 651909 - RNA, 22 nt, Human
gcuguuucuuuggcaaacugau

SEQ ID NO: 651910 - RNA, 22 nt, Human
ggcguugcucuccccaggcuca

SEQ ID NO: 651911 - RNA, 22 nt, Human
ucaggaggcggugcugccuuug

SEQ ID NO: 651912 - RNA, 22 nt, Human
gagggcucuaccaaguaacucu

SEQ ID NO: 651913 - RNA, 22 nt, Human
ugucaguguauacauacaguau

SEQ ID NO: 651914 - RNA, 22 nt, Human
ccccaggacacauggaccaagu

SEQ ID NO: 651915 - RNA, 22 nt, Human
agacaacaucuaguuuggugga

SEQ ID NO: 651916 - RNA, 22 nt, Human
accuuuuuccaaagcuucuuac

SEQ ID NO: 651917 - RNA, 22 nt, Human
accagcugugugaccugaggca

SEQ ID NO: 651918 - RNA, 17 nt, Human
uagcccauggcugccag

SEQ ID NO: 651919 - RNA, 22 nt, Human
cgggcucaggaggaaacaggag

SEQ ID NO: 651920 - RNA, 22 nt, Human
aagaggucauaccagauaaggg

SEQ ID NO: 651921 - RNA, 22 nt, Human
agcgggugcugugucagcccuc

SEQ ID NO: 651922 - RNA, 22 nt, Human
gacagaggguuccaaaauugau

SEQ ID NO: 651923 - RNA, 22 nt, Human
uccuggaggaauaaguuuucca

SEQ ID NO: 651924 - RNA, 22 nt, Human
ucuuuguuauugcuuuaucuau

SEQ ID NO: 651925 - RNA, 22 nt, Human
ccaugcccuaaaggacuggcag

SEQ ID NO: 651926 - RNA, 22 nt, Human
gacagcugugcaggagaagggg

SEQ ID NO: 651927 - RNA, 22 nt, Human
gcaguguuucagugcuuuuucu

SEQ ID NO: 651928 - RNA, 22 nt, Human
ggcuuuauaggguagaggauca

SEQ ID NO: 651929 - RNA, 21 nt, Human
uggcacagaaaggaaaguuca

SEQ ID NO: 651930 - RNA, 22 nt, Human
cagcaacuuggacagcagucuu

SEQ ID NO: 651931 - RNA, 22 nt, Human
agaaugcagcuugccaguaucu

SEQ ID NO: 651932 - RNA, 20 nt, Human
cagaccugcacccacuucga

SEQ ID NO: 651933 - RNA, 22 nt, Human
uccaauuugaaaugguauaugu

SEQ ID NO: 651934 - RNA, 23 nt, Human
ugccaaaguuuaccuaacacugg

SEQ ID NO: 651935 - RNA, 22 nt, Human
ggguacaaagauuucauaagau

SEQ ID NO: 651936 - RNA, 22 nt, Human
ggcucuguuuacuuucagaggc

SEQ ID NO: 651937 - RNA, 22 nt, Human
ugagugaaauucugguaaagga

SEQ ID NO: 651938 - RNA, 22 nt, Human
auggguaggauuuacucagaug

SEQ ID NO: 651939 - RNA, 22 nt, Human
uucugggcccacuguagcaucc

SEQ ID NO: 651940 - RNA, 22 nt, Human
ucucaggcaucuguguggcaca

SEQ ID NO: 651941 - RNA, 22 nt, Human
uggccucuuacgacauagccuu

SEQ ID NO: 651942 - RNA, 22 nt, Human
cuccuucacgcaggcugccaug

SEQ ID NO: 651943 - RNA, 22 nt, Human
ccagacaguuccuugagguuca

SEQ ID NO: 651944 - RNA, 22 nt, Human
uggcugagguaacuaugaauaa

SEQ ID NO: 651945 - RNA, 22 nt, Human
aaguauuucuggccugugaaag

SEQ ID NO: 651946 - RNA, 20 nt, Human
gauggcuuuagaagcuggua

SEQ ID NO: 651947 - RNA, 22 nt, Human
gcccacaguacgaggcucaggc

SEQ ID NO: 651948 - RNA, 22 nt, Human
uccauaggaucugcuucauacu

SEQ ID NO: 651949 - RNA, 21 nt, Human
ccugugugucugacugggcua

SEQ ID NO: 651950 - RNA, 22 nt, Human
ggaaccuguacguuguccuuga

SEQ ID NO: 651951 - RNA, 22 nt, Human
cagugcuggaggggugcuugca

SEQ ID NO: 651952 - RNA, 22 nt, Human
gucaggauuugaacucaggucu

SEQ ID NO: 651953 - RNA, 22 nt, Human
ucugaggucucaugacuugcau

SEQ ID NO: 651954 - RNA, 22 nt, Human
cuggagcuguuuuuucaggaaa

SEQ ID NO: 651955 - RNA, 22 nt, Human
aagauguuauugucuuccuugc

SEQ ID NO: 651956 - RNA, 22 nt, Human
ucuauuuuauacucaaaucuuc

SEQ ID NO: 651957 - RNA, 22 nt, Human
cagaucaaacaaaauggguuag

SEQ ID NO: 651958 - RNA, 19 nt, Human
cugagccucaguuuccuag

SEQ ID NO: 651959 - RNA, 19 nt, Human
agaugucuauuugacuauc

SEQ ID NO: 651960 - RNA, 22 nt, Human
uagaaagucaugaauuacacca

SEQ ID NO: 651961 - RNA, 22 nt, Human
acaaagucucuaauaaucuucu

SEQ ID NO: 651962 - RNA, 22 nt, Human
gguggccucgguggugcacagg

SEQ ID NO: 651963 - RNA, 22 nt, Human
uggucauuuuuauuucaguugc

SEQ ID NO: 651964 - RNA, 22 nt, Human
ggcagagaaucuggcuguuuac

SEQ ID NO: 651965 - RNA, 22 nt, Human
uuagaguagagccauuucuguu

SEQ ID NO: 651966 - RNA, 22 nt, Human
ucaguguuuccugugguacagc

SEQ ID NO: 651967 - RNA, 22 nt, Human
ccauccagaccaguccaugggu

SEQ ID NO: 651968 - RNA, 21 nt, Human
gcagugcagcuuggaggguag

SEQ ID NO: 651969 - RNA, 22 nt, Human
uguaaauaaugcauguaaauca

SEQ ID NO: 651970 - RNA, 22 nt, Human
uaaagguuauaaagguuagggg

SEQ ID NO: 651971 - RNA, 22 nt, Human
agaaaucuuugaaguguaaugu

SEQ ID NO: 651972 - RNA, 22 nt, Human
uugccagggcuuugguggcauc

SEQ ID NO: 651973 - RNA, 22 nt, Human
caaaggcuucaucucagagcag

SEQ ID NO: 651974 - RNA, 22 nt, Human
ggcauccucuagaagcuggaaa

SEQ ID NO: 651975 - RNA, 22 nt, Human
auggaaauguuccauauauuga

SEQ ID NO: 651976 - RNA, 22 nt, Human
uaauacagggcacuuugaguga

SEQ ID NO: 651977 - RNA, 22 nt, Human
guguguaaaccuccaaucuggg

SEQ ID NO: 651978 - RNA, 22 nt, Human
auacagccuauucuuaccauug

SEQ ID NO: 651979 - RNA, 22 nt, Human
gcagaggcugggugucccaguc

SEQ ID NO: 651980 - RNA, 22 nt, Human
agcaccugcuaugugucaggga

SEQ ID NO: 651981 - RNA, 22 nt, Human
gcuuugcuggcuugaaaugcug

SEQ ID NO: 651982 - RNA, 22 nt, Human
ucagggcaaaagggaaaccauu

SEQ ID NO: 651983 - RNA, 22 nt, Human
uugaaaaaauugguagaggaug

SEQ ID NO: 651984 - RNA, 22 nt, Human
cuggagggaguuaggacccgga

SEQ ID NO: 651985 - RNA, 21 nt, Human
uccuucagucuagaugauugu

SEQ ID NO: 651986 - RNA, 22 nt, Human
ccacagaguuacaaaacaguca

SEQ ID NO: 651987 - RNA, 23 nt, Human
auuagacacuuuggguugucuuc

SEQ ID NO: 651988 - RNA, 22 nt, Human
ucugugaacaucacauugacag

SEQ ID NO: 651989 - RNA, 22 nt, Human
ugagugaggaagcgguggagga

SEQ ID NO: 651990 - RNA, 22 nt, Human
ucuccuggguaaaaggguugau

SEQ ID NO: 651991 - RNA, 22 nt, Human
gcucuggggaugcuucugccgu

SEQ ID NO: 651992 - RNA, 22 nt, Human
gggacagaaggaagugagcaca

SEQ ID NO: 651993 - RNA, 22 nt, Human
gaagagagaacauuacauaaac

SEQ ID NO: 651994 - RNA, 22 nt, Human
uaaauaagucacugaccauuua

SEQ ID NO: 651995 - RNA, 22 nt, Human
ugccaaauugcccuauaaauga

SEQ ID NO: 651996 - RNA, 19 nt, Human
uggaggccucaggaaaaga

SEQ ID NO: 651997 - RNA, 22 nt, Human
cuauuuguaagagccccacacc

SEQ ID NO: 651998 - RNA, 22 nt, Human
ggggaucuaggcuuaugagggc

SEQ ID NO: 651999 - RNA, 22 nt, Human
aggagcugcauggauaccuggu

SEQ ID NO: 652000 - RNA, 22 nt, Human
gcacagcaugaagagaggaagc

SEQ ID NO: 652001 - RNA, 22 nt, Human
uugcugaucugaaacguuacug

SEQ ID NO: 652002 - RNA, 22 nt, Human
gauuucaggcuaucuaugcaga

SEQ ID NO: 652003 - RNA, 22 nt, Human
aaugaagccagcugggaugcga

SEQ ID NO: 652004 - RNA, 22 nt, Human
gacccauauaggacccuccaaa

SEQ ID NO: 652005 - RNA, 22 nt, Human
ucagggcugugguuccuuuucu

SEQ ID NO: 652006 - RNA, 22 nt, Human
uggagaguucuguagauaucua

SEQ ID NO: 652007 - RNA, 22 nt, Human
auucucuggucauugagcauau

SEQ ID NO: 652008 - RNA, 22 nt, Human
cugagaggaugcugcaguggag

SEQ ID NO: 652009 - RNA, 22 nt, Human
cacauggggcgcugcauuggcc

SEQ ID NO: 652010 - RNA, 22 nt, Human
uuugaagacauuugaauacuuu

SEQ ID NO: 652011 - RNA, 21 nt, Human
guccucagcugaugggagcug

SEQ ID NO: 652012 - RNA, 17 nt, Human
ugaaacaccaagacugu

SEQ ID NO: 652013 - RNA, 22 nt, Human
gaaccuggaauguggcgcccaa

SEQ ID NO: 652014 - RNA, 22 nt, Human
ggacauuuagaacagaguauuu

SEQ ID NO: 652015 - RNA, 22 nt, Human
caccaucuagcauuuauuugga

SEQ ID NO: 652016 - RNA, 22 nt, Human
cugccuggggcaucagucaagg

SEQ ID NO: 652017 - RNA, 22 nt, Human
uggagucagaaugcgacaggcc

SEQ ID NO: 652018 - RNA, 22 nt, Human
auguuuacugguuuauagaaua

SEQ ID NO: 652019 - RNA, 22 nt, Human
uucuuuccccauggaguucgga

SEQ ID NO: 652020 - RNA, 22 nt, Human
gcagcugugggccucggagagc

SEQ ID NO: 652021 - RNA, 22 nt, Human
cugagagaugguguguuuauaa

SEQ ID NO: 652022 - RNA, 22 nt, Human
acugugggccuuuccuuugacc

SEQ ID NO: 652023 - RNA, 22 nt, Human
ugcugccuucuaggcgugcccu

SEQ ID NO: 652024 - RNA, 18 nt, Human
cugcugugucgucugggc

SEQ ID NO: 652025 - RNA, 22 nt, Human
ucuaaagccuuccauauaacgc

SEQ ID NO: 652026 - RNA, 22 nt, Human
uuuccagagggugcucagggcg

SEQ ID NO: 652027 - RNA, 22 nt, Human
uauuaauuuaaucuccauggua

SEQ ID NO: 652028 - RNA, 22 nt, Human
auggcugcuuucccuuagcacc

SEQ ID NO: 652029 - RNA, 22 nt, Human
ccauaaucuggcuuugagagag

SEQ ID NO: 652030 - RNA, 22 nt, Human
ucaggguaaaccuucacuguga

SEQ ID NO: 652031 - RNA, 22 nt, Human
caaccaguagcugaguucaaaa

SEQ ID NO: 652032 - RNA, 23 nt, Human
cagcucagcacauaggagguacu

SEQ ID NO: 652033 - RNA, 22 nt, Human
acaugcauggcugcuuaaauua

SEQ ID NO: 652034 - RNA, 23 nt, Human
gcuguccccaugcuccaucccug

SEQ ID NO: 652035 - RNA, 22 nt, Human
uuuggaauuggcauucuauucu

SEQ ID NO: 652036 - RNA, 22 nt, Human
gcuguggccuccagcacucccc

SEQ ID NO: 652037 - RNA, 22 nt, Human
ugaagccuuguguggccucucu

SEQ ID NO: 652038 - RNA, 22 nt, Human
ugucugcugguugggagcuuaa

SEQ ID NO: 652039 - RNA, 22 nt, Human
aagcccagaugggagcauuuca

SEQ ID NO: 652040 - RNA, 22 nt, Human
aaccugaaaguaguaaaagcug

SEQ ID NO: 652041 - RNA, 22 nt, Human
cugugucuucugcuuacagucu

SEQ ID NO: 652042 - RNA, 22 nt, Human
uuggcagagaguaugcugaaga

SEQ ID NO: 652043 - RNA, 22 nt, Human
aggcuguggugggcuuugagcc

SEQ ID NO: 652044 - RNA, 22 nt, Human
gcugaaaugucuuuagcagugu

SEQ ID NO: 652045 - RNA, 22 nt, Human
uccugccucuccaugcuaacua

SEQ ID NO: 652046 - RNA, 22 nt, Human
gggcaucugguggagccucagg

SEQ ID NO: 652047 - RNA, 19 nt, Human
uucacaagugaugucucuc

SEQ ID NO: 652048 - RNA, 22 nt, Human
uuugacaacguuguugugagga

SEQ ID NO: 652049 - RNA, 22 nt, Human
aggcagguuggugagaagacug

SEQ ID NO: 652050 - RNA, 22 nt, Human
uuccuggagaguuuucccaaag

SEQ ID NO: 652051 - RNA, 22 nt, Human
ucuuucccaguagcucucccag

SEQ ID NO: 652052 - RNA, 22 nt, Human
aucuacuccugaauauaucuag

SEQ ID NO: 652053 - RNA, 22 nt, Human
ccccaggagaaaucuuaaacua

SEQ ID NO: 652054 - RNA, 22 nt, Human
caaguaugagaaagcuauuacc

SEQ ID NO: 652055 - RNA, 22 nt, Human
ucccugaaacauaauagaugcc

SEQ ID NO: 652056 - RNA, 22 nt, Human
cuucuauucacuggucacaguu

SEQ ID NO: 652057 - RNA, 22 nt, Human
ggccagagguguccucaguucu

SEQ ID NO: 652058 - RNA, 22 nt, Human
uuuuucagccaugaauuacacu

SEQ ID NO: 652059 - RNA, 22 nt, Human
ccaggggcugcagauccauggu

SEQ ID NO: 652060 - RNA, 22 nt, Human
uagugaaauuuaugcacagcua

SEQ ID NO: 652061 - RNA, 22 nt, Human
uggcaccaucaaggcugagaac

SEQ ID NO: 652062 - RNA, 22 nt, Human
uguggcagggcgugacauuugg

SEQ ID NO: 652063 - RNA, 22 nt, Human
acaaagucacaauaauuaaccu

SEQ ID NO: 652064 - RNA, 21 nt, Human
uccccucacuugucuucugag

SEQ ID NO: 652065 - RNA, 22 nt, Human
gcacccaggcacuuuccuuucu

SEQ ID NO: 652066 - RNA, 22 nt, Human
ucauuucaguccucugugugag

SEQ ID NO: 652067 - RNA, 22 nt, Human
cuggggcucacuuuggucaggc

SEQ ID NO: 652068 - RNA, 22 nt, Human
ugggcuggcugaacuucaaccu

SEQ ID NO: 652069 - RNA, 22 nt, Human
uuucacaggauucugauguagu

SEQ ID NO: 652070 - RNA, 20 nt, Human
agggucugcuggguaggaca

SEQ ID NO: 652071 - RNA, 22 nt, Human
guacauuuuacuuuguuugaau

SEQ ID NO: 652072 - RNA, 22 nt, Human
uacagccucgaacuccugcauu

SEQ ID NO: 652073 - RNA, 22 nt, Human
agagaggauuuguuuuucuccu

SEQ ID NO: 652074 - RNA, 22 nt, Human
agcagcaguguucuggaauucu

SEQ ID NO: 652075 - RNA, 22 nt, Human
auagcaaauucuuuaggugcuu

SEQ ID NO: 652076 - RNA, 22 nt, Human
cuguggagugcuuggcucagug

SEQ ID NO: 652077 - RNA, 22 nt, Human
ucaaagccuguggauaguuugg

SEQ ID NO: 652078 - RNA, 22 nt, Human
cccucagcuccacccucagcag

SEQ ID NO: 652079 - RNA, 22 nt, Human
acaggcaggcuucggccagagc

SEQ ID NO: 652080 - RNA, 22 nt, Human
cuggucacuggucucauccagc

SEQ ID NO: 652081 - RNA, 22 nt, Human
aggcacuggguaauuaguagcu

SEQ ID NO: 652082 - RNA, 19 nt, Human
uuaucuguguugcaguggu

SEQ ID NO: 652083 - RNA, 22 nt, Human
aaacuguuucccuccauaaccu

SEQ ID NO: 652084 - RNA, 22 nt, Human
cacuucucugauaaucucaguu

SEQ ID NO: 652085 - RNA, 22 nt, Human
uaggagggggaacaaggcauac

SEQ ID NO: 652086 - RNA, 22 nt, Human
uacugaaaaagaauccagaccu

SEQ ID NO: 652087 - RNA, 22 nt, Human
acagugugguuguuucugguua

SEQ ID NO: 652088 - RNA, 22 nt, Human
aguguguccagaaaucuguauu

SEQ ID NO: 652089 - RNA, 22 nt, Human
uguuacagaaauauugcuucuu

SEQ ID NO: 652090 - RNA, 22 nt, Human
uuucuauuuacagugcuaggua

SEQ ID NO: 652091 - RNA, 22 nt, Human
gcugcugucucaugcgaugcgg

SEQ ID NO: 652092 - RNA, 22 nt, Human
gcuuuauagcccuauuacauga

SEQ ID NO: 652093 - RNA, 22 nt, Human
cagcugagcucccaggccauca

SEQ ID NO: 652094 - RNA, 22 nt, Human
ccaggagcagauauggacauaa

SEQ ID NO: 652095 - RNA, 22 nt, Human
ugcauucaaaucuccaggcuca

SEQ ID NO: 652096 - RNA, 22 nt, Human
uggcagugucuuaucaggagug

SEQ ID NO: 652097 - RNA, 22 nt, Human
aagccacuuggggaaagaugga

SEQ ID NO: 652098 - RNA, 22 nt, Human
ugaagggguucagcaugggggu

SEQ ID NO: 652099 - RNA, 18 nt, Human
ugagacagcuaccacuug

SEQ ID NO: 652100 - RNA, 22 nt, Human
ggcugaugggcaugagcuguca

SEQ ID NO: 652101 - RNA, 22 nt, Human
uaugagaacugacagagugcca

SEQ ID NO: 652102 - RNA, 21 nt, Human
uauugucaaucugcuuucaga

SEQ ID NO: 652103 - RNA, 22 nt, Human
cacauuuaagcagauguggacc

SEQ ID NO: 652104 - RNA, 19 nt, Human
uacaggcaguuucuacaau

SEQ ID NO: 652105 - RNA, 22 nt, Human
ccagaccacccuggccaugcac

SEQ ID NO: 652106 - RNA, 22 nt, Human
cuggcgugaagguggccaugag

SEQ ID NO: 652107 - RNA, 22 nt, Human
aggaggugcuagagaagauguu

SEQ ID NO: 652108 - RNA, 22 nt, Human
uaccaaaagcuuguuucauaca

SEQ ID NO: 652109 - RNA, 22 nt, Human
agcuccugaaaagcgcuugcuu

SEQ ID NO: 652110 - RNA, 22 nt, Human
agaggccaggcugcagagggau

SEQ ID NO: 652111 - RNA, 22 nt, Human
ggaggccaaggagggcggauca

SEQ ID NO: 652112 - RNA, 22 nt, Human
cauguccuucucauugccucau

SEQ ID NO: 652113 - RNA, 22 nt, Human
aguucuucauaaccuuacugug

SEQ ID NO: 652114 - RNA, 22 nt, Human
acuucaugcagaagagagcugu

SEQ ID NO: 652115 - RNA, 22 nt, Human
cccugcagagaccacugaccuu

SEQ ID NO: 652116 - RNA, 22 nt, Human
gugcuuccaucuagagggucac

SEQ ID NO: 652117 - RNA, 22 nt, Human
gugcugucguggaacugggcug

SEQ ID NO: 652118 - RNA, 22 nt, Human
uggcugagccuuuggggcuuuc

SEQ ID NO: 652119 - RNA, 22 nt, Human
ucucuacagauccuauauagaa

SEQ ID NO: 652120 - RNA, 22 nt, Human
ccccaugcugggaucugacacc

SEQ ID NO: 652121 - RNA, 22 nt, Human
aggccuguuccaggccccuuuu

SEQ ID NO: 652122 - RNA, 22 nt, Human
guggcccucugauagggucagg

SEQ ID NO: 652123 - RNA, 22 nt, Human
aagggcuuaggauuuugcugug

SEQ ID NO: 652124 - RNA, 22 nt, Human
agcugcagugaacuguuuuguc

SEQ ID NO: 652125 - RNA, 22 nt, Human
auauuaaaacuaugguuuucag

SEQ ID NO: 652126 - RNA, 22 nt, Human
aacuaacagucauuaaaagaac

SEQ ID NO: 652127 - RNA, 22 nt, Human
agaauccgcuugacuuugaagu

SEQ ID NO: 652128 - RNA, 22 nt, Human
ugcuccagaaccugaccaugcu

SEQ ID NO: 652129 - RNA, 22 nt, Human
uuaaaugcucacauaaagguag

SEQ ID NO: 652130 - RNA, 18 nt, Human
ucuugccugcacccucuc

SEQ ID NO: 652131 - RNA, 22 nt, Human
ucuuaacugacaguuuaauggg

SEQ ID NO: 652132 - RNA, 18 nt, Human
ucuuuguuuccuucuugc

SEQ ID NO: 652133 - RNA, 22 nt, Human
ugcauucaauacaguaagaaua

SEQ ID NO: 652134 - RNA, 22 nt, Human
aaacagcagcuguuuaauuugc

SEQ ID NO: 652135 - RNA, 22 nt, Human
augagaugugucuaauggaacc

SEQ ID NO: 652136 - RNA, 18 nt, Human
acccuuuccaaacugcag

SEQ ID NO: 652137 - RNA, 22 nt, Human
ucucugggauaaacugggccag

SEQ ID NO: 652138 - RNA, 22 nt, Human
ucaaaugcuucuacuccuaaga

SEQ ID NO: 652139 - RNA, 22 nt, Human
cuugcuucauuagugucuuagu

SEQ ID NO: 652140 - RNA, 21 nt, Human
uggccagcugcucgucuccuc

SEQ ID NO: 652141 - RNA, 22 nt, Human
ggcuugggagcaggcaugugac

SEQ ID NO: 652142 - RNA, 22 nt, Human
agucccagaucuacaggaggga

SEQ ID NO: 652143 - RNA, 22 nt, Human
aauacagcagauggagacaaau

SEQ ID NO: 652144 - RNA, 22 nt, Human
cugcccgcugcuagagaggccg

SEQ ID NO: 652145 - RNA, 22 nt, Human
aucauuggaggcacugugcagu

SEQ ID NO: 652146 - RNA, 22 nt, Human
cugguucugauguucuuggcuu

SEQ ID NO: 652147 - RNA, 22 nt, Human
auaaacugguaggaaaacagua

SEQ ID NO: 652148 - RNA, 22 nt, Human
aguuucaguucugucauuuaua

SEQ ID NO: 652149 - RNA, 22 nt, Human
cccauucccuuuacuguugcau

SEQ ID NO: 652150 - RNA, 22 nt, Human
ugcugggccaaagcaggguuuu

SEQ ID NO: 652151 - RNA, 22 nt, Human
uggcauccagauacccugaggg

SEQ ID NO: 652152 - RNA, 21 nt, Human
gcucaaagggcuugccaugcu

SEQ ID NO: 652153 - RNA, 22 nt, Human
uacugucugcuucuuauagcuu

SEQ ID NO: 652154 - RNA, 22 nt, Human
uaaagguaacaugaacugcuuu

SEQ ID NO: 652155 - RNA, 22 nt, Human
cccucagcucaagccccugugc

SEQ ID NO: 652156 - RNA, 22 nt, Human
accagcuggucaccugggcacu

SEQ ID NO: 652157 - RNA, 22 nt, Human
guuuuucuagacugggaguuug

SEQ ID NO: 652158 - RNA, 17 nt, Human
uuccaaggagcauuuga

SEQ ID NO: 652159 - RNA, 22 nt, Human
uuaacacuaucugucauaauua

SEQ ID NO: 652160 - RNA, 22 nt, Human
uggagaaaagguugaauccauc

SEQ ID NO: 652161 - RNA, 22 nt, Human
agggcgacaauggagagcguuu

SEQ ID NO: 652162 - RNA, 22 nt, Human
uggagcaggugggaugucguga

SEQ ID NO: 652163 - RNA, 22 nt, Human
ucucaggcacugggugccaacu

SEQ ID NO: 652164 - RNA, 22 nt, Human
augggagaaacaucaugaggca

SEQ ID NO: 652165 - RNA, 21 nt, Human
ugcagcagauuugggggaaga

SEQ ID NO: 652166 - RNA, 22 nt, Human
caagagcuggguggcaagcuag

SEQ ID NO: 652167 - RNA, 22 nt, Human
acugugcuugccaaaccauuga

SEQ ID NO: 652168 - RNA, 22 nt, Human
uccauaguagaaaaugggacag

SEQ ID NO: 652169 - RNA, 22 nt, Human
aagugcugagacuacaggcaug

SEQ ID NO: 652170 - RNA, 22 nt, Human
aguuucucuuugacaccaaaau

SEQ ID NO: 652171 - RNA, 22 nt, Human
ccuucaaaacacuaguuuuuga

SEQ ID NO: 652172 - RNA, 22 nt, Human
ugcagggaaaacccaggaugcu

SEQ ID NO: 652173 - RNA, 22 nt, Human
augggcuggggaagcucacucc

SEQ ID NO: 652174 - RNA, 20 nt, Human
uccuggagcugcuugaauuc

SEQ ID NO: 652175 - RNA, 20 nt, Human
uguccuaauagacaagcaga

SEQ ID NO: 652176 - RNA, 22 nt, Human
uucaugauaguauuuuuuguga

SEQ ID NO: 652177 - RNA, 22 nt, Human
caggacacuuguucuucucugc

SEQ ID NO: 652178 - RNA, 22 nt, Human
uuccaugccucuauuuagaauu

SEQ ID NO: 652179 - RNA, 22 nt, Human
ccuuuucuaaucuuaagaaugu

SEQ ID NO: 652180 - RNA, 22 nt, Human
uucugagaaggcuguggacaca

SEQ ID NO: 652181 - RNA, 22 nt, Human
ugcuuccaggaauccaucuggc

SEQ ID NO: 652182 - RNA, 22 nt, Human
aagaacaugaagucacaaaugc

SEQ ID NO: 652183 - RNA, 22 nt, Human
ccacaugagcuggcaaugcccu

SEQ ID NO: 652184 - RNA, 22 nt, Human
agagaagggaagggauucaccc

SEQ ID NO: 652185 - RNA, 22 nt, Human
gcucagugagauauugacucca

SEQ ID NO: 652186 - RNA, 22 nt, Human
caguaggaaggaugcagaaaaa

SEQ ID NO: 652187 - RNA, 22 nt, Human
cuauuucugccuaaugaccugu

SEQ ID NO: 652188 - RNA, 22 nt, Human
cuucaugagacuccacugccau

SEQ ID NO: 652189 - RNA, 23 nt, Human
cagcuucuuugggauucuuuaua

SEQ ID NO: 652190 - RNA, 22 nt, Human
uuuuucaagacaaccugcaugu

SEQ ID NO: 652191 - RNA, 23 nt, Human
gugcagcagugucugcagucaug

SEQ ID NO: 652192 - RNA, 20 nt, Human
cacaguauucuuccuuaaaa

SEQ ID NO: 652193 - RNA, 22 nt, Human
aaagccaguucuuagagaaagc

SEQ ID NO: 652194 - RNA, 22 nt, Human
acaguguacuagguacauguuc

SEQ ID NO: 652195 - RNA, 22 nt, Human
gagucauuguuggucccucccc

SEQ ID NO: 652196 - RNA, 20 nt, Human
uuucugugagaaacacuguu

SEQ ID NO: 652197 - RNA, 22 nt, Human
cuuuguucaugacaucugcuuc

SEQ ID NO: 652198 - RNA, 22 nt, Human
uuucaugauccauuuacaaaau

SEQ ID NO: 652199 - RNA, 22 nt, Human
uuaucaguuguguguauacacg

SEQ ID NO: 652200 - RNA, 22 nt, Human
uuuaucaucuuguuuuuaaagc

SEQ ID NO: 652201 - RNA, 22 nt, Human
ugacaacuuuacaaaauucuuc

SEQ ID NO: 652202 - RNA, 22 nt, Human
gucuggguuucaugggcacugg

SEQ ID NO: 652203 - RNA, 22 nt, Human
auuucuuaugaauauugacugu

SEQ ID NO: 652204 - RNA, 22 nt, Human
aauguauucugggaaaauguua

SEQ ID NO: 652205 - RNA, 22 nt, Human
ucauuucucccggccaaaaacu

SEQ ID NO: 652206 - RNA, 22 nt, Human
ugcauucaguuggucagcuuuu

SEQ ID NO: 652207 - RNA, 22 nt, Human
agacugaauaacaagcaaauaa

SEQ ID NO: 652208 - RNA, 22 nt, Human
aaagugggaacaauggagagug

SEQ ID NO: 652209 - RNA, 21 nt, Human
agaaacugacuccuagaggca

SEQ ID NO: 652210 - RNA, 22 nt, Human
ugugugaauucugagcaguuua

SEQ ID NO: 652211 - RNA, 22 nt, Human
gccucuccuggagaaggcaggg

SEQ ID NO: 652212 - RNA, 22 nt, Human
cagcucccagagugaccagcag

SEQ ID NO: 652213 - RNA, 22 nt, Human
ugaggaagccaaacagcuacac

SEQ ID NO: 652214 - RNA, 18 nt, Human
cuuucaguaauuucagcc

SEQ ID NO: 652215 - RNA, 20 nt, Human
ugaauaugaccuuauuugga

SEQ ID NO: 652216 - RNA, 17 nt, Human
caggucccagggucucu

SEQ ID NO: 652217 - RNA, 22 nt, Human
cuguaucugucagcuggucucg

SEQ ID NO: 652218 - RNA, 22 nt, Human
uugcugaaaucuaugacauccu

SEQ ID NO: 652219 - RNA, 22 nt, Human
aaauuucaguuggaaugagcuc

SEQ ID NO: 652220 - RNA, 22 nt, Human
ggccuugguucugucacagccg

SEQ ID NO: 652221 - RNA, 22 nt, Human
uauuagguaaaggacuugcagg

SEQ ID NO: 652222 - RNA, 22 nt, Human
uaggaauuuuuguaaugguacu

SEQ ID NO: 652223 - RNA, 22 nt, Human
caaucuuagagagauucuuuua

SEQ ID NO: 652224 - RNA, 22 nt, Human
ugggccucccaugucuuaggga

SEQ ID NO: 652225 - RNA, 22 nt, Human
cccaguggaaggaguagaagac

SEQ ID NO: 652226 - RNA, 22 nt, Human
cugcuagcccgccggccagcga

SEQ ID NO: 652227 - RNA, 22 nt, Human
gcugcccugacuccagcagccu

SEQ ID NO: 652228 - RNA, 22 nt, Human
cuguaucuguguuggaugaguu

SEQ ID NO: 652229 - RNA, 22 nt, Human
auucuucaguauguguggauug

SEQ ID NO: 652230 - RNA, 22 nt, Human
cacugugggucccagacuggag

SEQ ID NO: 652231 - RNA, 22 nt, Human
cccugucuguaccgugaugagc

SEQ ID NO: 652232 - RNA, 22 nt, Human
augcuucccuuugcuccacaug

SEQ ID NO: 652233 - RNA, 20 nt, Human
uggcaggaauagggccagag

SEQ ID NO: 652234 - RNA, 22 nt, Human
aauaugugggugcuaaucaaaa

SEQ ID NO: 652235 - RNA, 22 nt, Human
ugucuguaauagucacuaugug

SEQ ID NO: 652236 - RNA, 17 nt, Human
aagauuucauuagcuga

SEQ ID NO: 652237 - RNA, 22 nt, Human
cuucaguguugccagggccuag

SEQ ID NO: 652238 - RNA, 19 nt, Human
ucuauguggcagugauggc

SEQ ID NO: 652239 - RNA, 18 nt, Human
acuggagcauuagcagcu

SEQ ID NO: 652240 - RNA, 22 nt, Human
uucucacaggcuggaaugauga

SEQ ID NO: 652241 - RNA, 23 nt, Human
ccucugacaaugaugucaccugc

SEQ ID NO: 652242 - RNA, 22 nt, Human
gagcccucucuguaggcaagua

SEQ ID NO: 652243 - RNA, 22 nt, Human
gggcaagcuuugaacaucagca

SEQ ID NO: 652244 - RNA, 22 nt, Human
gccacccugagcugggccaggg

SEQ ID NO: 652245 - RNA, 22 nt, Human
ucaucuguucauacacaugcgu

SEQ ID NO: 652246 - RNA, 22 nt, Human
cauggccagauucuuucuucuc

SEQ ID NO: 652247 - RNA, 22 nt, Human
augcccuggggcuaccucugag

SEQ ID NO: 652248 - RNA, 22 nt, Human
acucaggaaaugaagacugguu

SEQ ID NO: 652249 - RNA, 20 nt, Human
auaaaacucuaaucuggccu

SEQ ID NO: 652250 - RNA, 22 nt, Human
ugucuuuacuuagaaguucagg

SEQ ID NO: 652251 - RNA, 21 nt, Human
aaauuagcuucaaguucugca

SEQ ID NO: 652252 - RNA, 22 nt, Human
gagagugucuggaggaagcuaa

SEQ ID NO: 652253 - RNA, 20 nt, Human
gggugugggcccggccaggc

SEQ ID NO: 652254 - RNA, 22 nt, Human
ugucugccauuagcccagucca

SEQ ID NO: 652255 - RNA, 22 nt, Human
aagccagugggcauagcaguug

SEQ ID NO: 652256 - RNA, 22 nt, Human
agguccugaggguucgucugca

SEQ ID NO: 652257 - RNA, 22 nt, Human
ucacugcugcugccaugaugga

SEQ ID NO: 652258 - RNA, 22 nt, Human
acucacagacugcagguuuauu

SEQ ID NO: 652259 - RNA, 20 nt, Human
agaaaaaguguggaaauuuc

SEQ ID NO: 652260 - RNA, 22 nt, Human
caugucugccaauuuggaagga

SEQ ID NO: 652261 - RNA, 22 nt, Human
cacaaggcuuucaucuggcaua

SEQ ID NO: 652262 - RNA, 22 nt, Human
uggagaguuuagccuacuggaa

SEQ ID NO: 652263 - RNA, 22 nt, Human
uuugaucuaugcgugguuuccc

SEQ ID NO: 652264 - RNA, 22 nt, Human
agagguggagcucuuggcauca

SEQ ID NO: 652265 - RNA, 22 nt, Human
cacagcagccagaacauuuuug

SEQ ID NO: 652266 - RNA, 22 nt, Human
cucagggcuggaaagccaggaa

SEQ ID NO: 652267 - RNA, 22 nt, Human
agugaauaugcagcaagaaguu

SEQ ID NO: 652268 - RNA, 22 nt, Human
acaguaccugcucucaagcaaa

SEQ ID NO: 652269 - RNA, 22 nt, Human
auugacaauuagcccuuaggug

SEQ ID NO: 652270 - RNA, 18 nt, Human
uaaaccugagaagcgugu

SEQ ID NO: 652271 - RNA, 17 nt, Human
ccaggagcgugggucuc

SEQ ID NO: 652272 - RNA, 22 nt, Human
uggggaagaauaauguauguac

SEQ ID NO: 652273 - RNA, 22 nt, Human
aaugaagaaauggacaucuuua

SEQ ID NO: 652274 - RNA, 22 nt, Human
ucuucacaucauguuuuuuaau

SEQ ID NO: 652275 - RNA, 22 nt, Human
ggcucaccauuuucacucucug

SEQ ID NO: 652276 - RNA, 22 nt, Human
caaugcuaggcagauccugcgu

SEQ ID NO: 652277 - RNA, 22 nt, Human
uuauuuguaaagguccauagua

SEQ ID NO: 652278 - RNA, 23 nt, Human
agccacagccagagcuaucucca

SEQ ID NO: 652279 - RNA, 22 nt, Human
uuuucauuuuuguagaugcaag

SEQ ID NO: 652280 - RNA, 19 nt, Human
agugucaucagcuacucag

SEQ ID NO: 652281 - RNA, 22 nt, Human
ggccucucauguccugggcuuc

SEQ ID NO: 652282 - RNA, 22 nt, Human
agcuagagcugagaagcacuug

SEQ ID NO: 652283 - RNA, 22 nt, Human
ggccuggagucagggaaagcaa

SEQ ID NO: 652284 - RNA, 22 nt, Human
aagcauaacuugcugcacauag

SEQ ID NO: 652285 - RNA, 22 nt, Human
acugaaggaaagccuuugcaug

SEQ ID NO: 652286 - RNA, 22 nt, Human
uaguuuuaugaauugguauaau

SEQ ID NO: 652287 - RNA, 22 nt, Human
caaauccagaucccagucguag

SEQ ID NO: 652288 - RNA, 18 nt, Human
ggcugugcguggaggcug

SEQ ID NO: 652289 - RNA, 20 nt, Human
cugggcugggcuacaggguc

SEQ ID NO: 652290 - RNA, 22 nt, Human
aguggagaagaggauggucucc

SEQ ID NO: 652291 - RNA, 18 nt, Human
augugucuuucuuguuug

SEQ ID NO: 652292 - RNA, 22 nt, Human
cugggggcagcaagaagccaug

SEQ ID NO: 652293 - RNA, 22 nt, Human
uaccugucaaaagacauggaga

SEQ ID NO: 652294 - RNA, 22 nt, Human
uaaagcauaaugaauaucuaga

SEQ ID NO: 652295 - RNA, 22 nt, Human
ucacacagcuaguaagggccga

SEQ ID NO: 652296 - RNA, 22 nt, Human
uuggcccacucucagaaugugg

SEQ ID NO: 652297 - RNA, 22 nt, Human
acaugcuacagugaaggaggaa

SEQ ID NO: 652298 - RNA, 23 nt, Human
ucuauuacuuauuguacucugga

SEQ ID NO: 652299 - RNA, 22 nt, Human
guggcacagccaagccucacuc

SEQ ID NO: 652300 - RNA, 22 nt, Human
cuggcucaggaaaguugcugcu

SEQ ID NO: 652301 - RNA, 22 nt, Human
cugaggcaggagaauugcugga

SEQ ID NO: 652302 - RNA, 22 nt, Human
uacagaaaaacaucuggagccg

SEQ ID NO: 652303 - RNA, 22 nt, Human
ccaucagcaugggagcaugggc

SEQ ID NO: 652304 - RNA, 22 nt, Human
uugaaugaaauugcuguguuau

SEQ ID NO: 652305 - RNA, 22 nt, Human
ucucagugagcuuuucuauguu

SEQ ID NO: 652306 - RNA, 22 nt, Human
gacaguauccagguggugaaga

SEQ ID NO: 652307 - RNA, 22 nt, Human
ugggaggcagguaggugaugau

SEQ ID NO: 652308 - RNA, 22 nt, Human
uccagcccgacugggccugccg

SEQ ID NO: 652309 - RNA, 22 nt, Human
augucuuuggcuuugacauggc

SEQ ID NO: 652310 - RNA, 22 nt, Human
aaaguccagagggcacacugaa

SEQ ID NO: 652311 - RNA, 22 nt, Human
ggaacauuuaaauucuuauuug

SEQ ID NO: 652312 - RNA, 22 nt, Human
cuugccuacuugucaaccagca

SEQ ID NO: 652313 - RNA, 22 nt, Human
cucuccuauugugugguaagga

SEQ ID NO: 652314 - RNA, 22 nt, Human
aagggcuuuuaagauuuauccu

SEQ ID NO: 652315 - RNA, 22 nt, Human
uuguguuucccuugcauauucc

SEQ ID NO: 652316 - RNA, 22 nt, Human
cuuccucaugugcaaugcaagc

SEQ ID NO: 652317 - RNA, 17 nt, Human
uagcacagugccuggua

SEQ ID NO: 652318 - RNA, 22 nt, Human
auacuacauuauuagagccugg

SEQ ID NO: 652319 - RNA, 22 nt, Human
uagguacagcuaaaaauuaucu

SEQ ID NO: 652320 - RNA, 22 nt, Human
cagcacaucugauuauaugacu

SEQ ID NO: 652321 - RNA, 22 nt, Human
acagauaaaaguuguuuaaaau

SEQ ID NO: 652322 - RNA, 22 nt, Human
uuucugucauaguuaucuuugu

SEQ ID NO: 652323 - RNA, 22 nt, Human
ugggcagaguagcucagaagaa

SEQ ID NO: 652324 - RNA, 18 nt, Human
aacuucaacuacaaugga

SEQ ID NO: 652325 - RNA, 20 nt, Human
ucuguguuucagcugcuuga

SEQ ID NO: 652326 - RNA, 22 nt, Human
caggcccucguggugagcuggg

SEQ ID NO: 652327 - RNA, 22 nt, Human
cuagaggaacaguuucagguuu

SEQ ID NO: 652328 - RNA, 22 nt, Human
gcuucugcagagccguccugag

SEQ ID NO: 652329 - RNA, 22 nt, Human
cugcagugccugccacugagcc

SEQ ID NO: 652330 - RNA, 22 nt, Human
ugcugcuggguuugacagucac

SEQ ID NO: 652331 - RNA, 22 nt, Human
acagauauguuggguucuuguu

SEQ ID NO: 652332 - RNA, 22 nt, Human
ccugugggcgcagcuggaguca

SEQ ID NO: 652333 - RNA, 22 nt, Human
uccuccagcaggacugaggccc

SEQ ID NO: 652334 - RNA, 22 nt, Human
cuaaaugucagaguagcuugca

SEQ ID NO: 652335 - RNA, 22 nt, Human
ugaauggucacugagcaucugu

SEQ ID NO: 652336 - RNA, 17 nt, Human
uggcuucaggcugagca

SEQ ID NO: 652337 - RNA, 22 nt, Human
caagcaacgacuuucaagcugu

SEQ ID NO: 652338 - RNA, 22 nt, Human
gaggggccuggcgaggacaugu

SEQ ID NO: 652339 - RNA, 22 nt, Human
uucauaaggguggccauauaaa

SEQ ID NO: 652340 - RNA, 22 nt, Human
uggaaugcauggcucugugacg

SEQ ID NO: 652341 - RNA, 22 nt, Human
auggcagaagucaagaugaguu

SEQ ID NO: 652342 - RNA, 22 nt, Human
gcuuggcuccuggcucacaggu

SEQ ID NO: 652343 - RNA, 22 nt, Human
auagauauuugaguuguuucca

SEQ ID NO: 652344 - RNA, 22 nt, Human
caaccugacaagacuaugagua

SEQ ID NO: 652345 - RNA, 22 nt, Human
uccaccugaguuucaguuauuu

SEQ ID NO: 652346 - RNA, 22 nt, Human
uuccagcaggcagacaggagau

SEQ ID NO: 652347 - RNA, 22 nt, Human
acaauuuuucaaagaagcuuau

SEQ ID NO: 652348 - RNA, 22 nt, Human
acuaaaguauggaagugaauaa

SEQ ID NO: 652349 - RNA, 22 nt, Human
caggcagcagaggaguguggga

SEQ ID NO: 652350 - RNA, 17 nt, Human
aggagggaaauagcuug

SEQ ID NO: 652351 - RNA, 22 nt, Human
aaaggcaucuagccaaguugag

SEQ ID NO: 652352 - RNA, 22 nt, Human
gaugaggucauguuuuacauau

SEQ ID NO: 652353 - RNA, 21 nt, Human
uucucagaucgaguagugaga

SEQ ID NO: 652354 - RNA, 18 nt, Human
ugaauuaguuugugguuu

SEQ ID NO: 652355 - RNA, 22 nt, Human
acugcucaaggaucugguaggg

SEQ ID NO: 652356 - RNA, 22 nt, Human
uaugaaauugccauuuuuaugg

SEQ ID NO: 652357 - RNA, 18 nt, Human
uggcuggcagugggcagc

SEQ ID NO: 652358 - RNA, 22 nt, Human
uggcucugugcuucuaguaucu

SEQ ID NO: 652359 - RNA, 22 nt, Human
auucacagggcuuuccgcaugg

SEQ ID NO: 652360 - RNA, 22 nt, Human
uucagacuagacacauuucaag

SEQ ID NO: 652361 - RNA, 18 nt, Human
auauggaaugccuggcua

SEQ ID NO: 652362 - RNA, 22 nt, Human
cuacucuuuugagucuucagau

SEQ ID NO: 652363 - RNA, 22 nt, Human
auuggcuugcacuguauuuuaa

SEQ ID NO: 652364 - RNA, 22 nt, Human
gugcagaccuuaguucaagcca

SEQ ID NO: 652365 - RNA, 22 nt, Human
uccagcagugcucuagagcgug

SEQ ID NO: 652366 - RNA, 22 nt, Human
aaccuaagugcuguugaacguu

SEQ ID NO: 652367 - RNA, 22 nt, Human
cuauuuucauucuuacauuguc

SEQ ID NO: 652368 - RNA, 22 nt, Human
gccaggcauuuguuaggugcug

SEQ ID NO: 652369 - RNA, 22 nt, Human
gggugggaucuguggagccuca

SEQ ID NO: 652370 - RNA, 19 nt, Human
aaugacugaguacauuguc

SEQ ID NO: 652371 - RNA, 22 nt, Human
aaugaaauaguuggcuguagag

SEQ ID NO: 652372 - RNA, 22 nt, Human
cgggcagaucacacagggcuug

SEQ ID NO: 652373 - RNA, 22 nt, Human
augucuguacgaguuacaaugg

SEQ ID NO: 652374 - RNA, 22 nt, Human
ucacagcuuucagauuguuccc

SEQ ID NO: 652375 - RNA, 22 nt, Human
uuguguguagacucagccauug

SEQ ID NO: 652376 - RNA, 22 nt, Human
gaccaaggaagaggggagccag

SEQ ID NO: 652377 - RNA, 22 nt, Human
uuacaugggccauuuagacaug

SEQ ID NO: 652378 - RNA, 22 nt, Human
ccaguguucaguaugcauuaag

SEQ ID NO: 652379 - RNA, 22 nt, Human
cuagaaaugcucaagagaaagu

SEQ ID NO: 652380 - RNA, 22 nt, Human
aucauuucccuuuagaucacaa

SEQ ID NO: 652381 - RNA, 22 nt, Human
acaagugcauggaaucagcugu

SEQ ID NO: 652382 - RNA, 20 nt, Human
ccuggagccuggaaggaguc

SEQ ID NO: 652383 - RNA, 22 nt, Human
uuaugauuuagaaagauucacu

SEQ ID NO: 652384 - RNA, 22 nt, Human
uagcaacaagugacuaucuaua

SEQ ID NO: 652385 - RNA, 22 nt, Human
aguccauacauugagaauaaca

SEQ ID NO: 652386 - RNA, 22 nt, Human
caaggccauaagagauacaaaa

SEQ ID NO: 652387 - RNA, 22 nt, Human
agaagaauuucucucaugauuu

SEQ ID NO: 652388 - RNA, 22 nt, Human
cauacugugaagcuuacuauuu

SEQ ID NO: 652389 - RNA, 22 nt, Human
acaaagguggaccauguggcuu

SEQ ID NO: 652390 - RNA, 22 nt, Human
ucagugucuucucuuuccuacc

SEQ ID NO: 652391 - RNA, 22 nt, Human
cagaguggagauguguguggaa

SEQ ID NO: 652392 - RNA, 22 nt, Human
auucugggcgccuauggcugca

SEQ ID NO: 652393 - RNA, 22 nt, Human
cauuaugaagcaucaucuuauu

SEQ ID NO: 652394 - RNA, 22 nt, Human
uacuguauaugcuuguaucuga

SEQ ID NO: 652395 - RNA, 22 nt, Human
gacuuugguuugagcaagucag

SEQ ID NO: 652396 - RNA, 22 nt, Human
agcugcucugagcccugauucu

SEQ ID NO: 652397 - RNA, 22 nt, Human
uucauguauuuaucauguaaau

SEQ ID NO: 652398 - RNA, 22 nt, Human
ggaggagucaguugggcugcuu

SEQ ID NO: 652399 - RNA, 22 nt, Human
aggcucagaggugagcaucugc

SEQ ID NO: 652400 - RNA, 22 nt, Human
cagcuccucacgagucuugaaa

SEQ ID NO: 652401 - RNA, 22 nt, Human
ccugcucagagcgucuugugug

SEQ ID NO: 652402 - RNA, 22 nt, Human
gucugcccugcugaucucaccc

SEQ ID NO: 652403 - RNA, 22 nt, Human
augucuuucuugugucccaaga

SEQ ID NO: 652404 - RNA, 22 nt, Human
cuagggaguggcagagcuggga

SEQ ID NO: 652405 - RNA, 22 nt, Human
ccuuuucuugccacugacucgg

SEQ ID NO: 652406 - RNA, 22 nt, Human
gcucugagcacugugcggcugg

SEQ ID NO: 652407 - RNA, 18 nt, Human
uccagucccaaggccagc

SEQ ID NO: 652408 - RNA, 17 nt, Human
guggcugcacacacaug

SEQ ID NO: 652409 - RNA, 22 nt, Human
agggcuccuaugaugcucugcc

SEQ ID NO: 652410 - RNA, 22 nt, Human
ggcucaagcagucugccugccu

SEQ ID NO: 652411 - RNA, 22 nt, Human
uagcagagcagggaucagagcc

SEQ ID NO: 652412 - RNA, 22 nt, Human
auaggucugaaaguguauccug

SEQ ID NO: 652413 - RNA, 22 nt, Human
ccacuguuuuucaguuaacuuu

SEQ ID NO: 652414 - RNA, 22 nt, Human
agcaaagucaguggaaccaucc

SEQ ID NO: 652415 - RNA, 22 nt, Human
cuggcugucuuggaggaaggag

SEQ ID NO: 652416 - RNA, 22 nt, Human
gggaaagaagaucuagauacug

SEQ ID NO: 652417 - RNA, 22 nt, Human
uccucagggggccaacccagcc

SEQ ID NO: 652418 - RNA, 22 nt, Human
uaagugucucucgaauuaugcu

SEQ ID NO: 652419 - RNA, 22 nt, Human
ugcgagaguggaaaggaagccu

SEQ ID NO: 652420 - RNA, 22 nt, Human
uuacagaauguucuuccaacag

SEQ ID NO: 652421 - RNA, 22 nt, Human
uuguuaaaaugcauauucuggu

SEQ ID NO: 652422 - RNA, 22 nt, Human
guaaauaacugguaauuggggu

SEQ ID NO: 652423 - RNA, 22 nt, Human
ggucagagccauggagcaacug

SEQ ID NO: 652424 - RNA, 20 nt, Human
gagguagggcuuaaggcaag

SEQ ID NO: 652425 - RNA, 22 nt, Human
ggggaugguggcauuuguaaaa

SEQ ID NO: 652426 - RNA, 22 nt, Human
gcuguguucauuuugcauaugu

SEQ ID NO: 652427 - RNA, 22 nt, Human
aaaugauaguauggaacuagga

SEQ ID NO: 652428 - RNA, 22 nt, Human
uggcugagggggcucugcucag

SEQ ID NO: 652429 - RNA, 22 nt, Human
ugggcacaaacaucugccuguu

SEQ ID NO: 652430 - RNA, 22 nt, Human
uggccccugaggagcaucagcc

SEQ ID NO: 652431 - RNA, 22 nt, Human
aaucagaacuccuaccacagag

SEQ ID NO: 652432 - RNA, 21 nt, Human
aaugcauuaacauaaagcuga

SEQ ID NO: 652433 - RNA, 22 nt, Human
uacagcuuugggaaggccccau

SEQ ID NO: 652434 - RNA, 22 nt, Human
ugggggugcccuaugaggaagc

SEQ ID NO: 652435 - RNA, 22 nt, Human
gagcugaggauacaucagugaa

SEQ ID NO: 652436 - RNA, 22 nt, Human
ggaggcacaccucagacuggga

SEQ ID NO: 652437 - RNA, 22 nt, Human
guccagagccggaagagugaca

SEQ ID NO: 652438 - RNA, 22 nt, Human
gcuuucugguucucaaagcacu

SEQ ID NO: 652439 - RNA, 22 nt, Human
ggcacaauugcagcaauaaaca

SEQ ID NO: 652440 - RNA, 22 nt, Human
aaagucauugcuguuaucaaug

SEQ ID NO: 652441 - RNA, 22 nt, Human
ggcuggagguagaagaacacuu

SEQ ID NO: 652442 - RNA, 17 nt, Human
uuucaagguuacguucc

SEQ ID NO: 652443 - RNA, 17 nt, Human
cucuggggacaguucua

SEQ ID NO: 652444 - RNA, 22 nt, Human
gagggcuguggggcaugaccag

SEQ ID NO: 652445 - RNA, 22 nt, Human
uuucaacagcucucaaaugauc

SEQ ID NO: 652446 - RNA, 22 nt, Human
uggcuccagaagggagggcgcc

SEQ ID NO: 652447 - RNA, 22 nt, Human
cccuugggugccagccacaagu

SEQ ID NO: 652448 - RNA, 22 nt, Human
guggguggacggugcuuuuguu

SEQ ID NO: 652449 - RNA, 22 nt, Human
ccaggggccugugaaggugccc

SEQ ID NO: 652450 - RNA, 22 nt, Human
auguagaauuccuucuacuuug

SEQ ID NO: 652451 - RNA, 22 nt, Human
auuuaacaagacagagaacugg

SEQ ID NO: 652452 - RNA, 22 nt, Human
cuggccccaggcagccugcugg

SEQ ID NO: 652453 - RNA, 22 nt, Human
ugauucugcuuauggguggauu

SEQ ID NO: 652454 - RNA, 22 nt, Human
agaauaaaugcuaccuaucaca

SEQ ID NO: 652455 - RNA, 22 nt, Human
aacuguagcaaagaacagcucu

SEQ ID NO: 652456 - RNA, 22 nt, Human
aacaggaaauacuuaugaggua

SEQ ID NO: 652457 - RNA, 22 nt, Human
uacacaucccagacucccagga

SEQ ID NO: 652458 - RNA, 22 nt, Human
ucucauucauccaaggauuuau

SEQ ID NO: 652459 - RNA, 22 nt, Human
cagcuuugagaguugcauuuua

SEQ ID NO: 652460 - RNA, 22 nt, Human
ccccaaagcugaguucccgccu

SEQ ID NO: 652461 - RNA, 22 nt, Human
gugcacagaaauugguaagacu

SEQ ID NO: 652462 - RNA, 22 nt, Human
ucugaaggucugagaaccagga

SEQ ID NO: 652463 - RNA, 22 nt, Human
aaggcuggaguacagugcagug

SEQ ID NO: 652464 - RNA, 22 nt, Human
gcagcaggacugccguuaaagu

SEQ ID NO: 652465 - RNA, 22 nt, Human
cagccaagaaccacagacccag

SEQ ID NO: 652466 - RNA, 22 nt, Human
guguagagugacaaggugggaa

SEQ ID NO: 652467 - RNA, 22 nt, Human
uuugacauuggcuuauucuguu

SEQ ID NO: 652468 - RNA, 22 nt, Human
cacccuguacaaauggacaucu

SEQ ID NO: 652469 - RNA, 22 nt, Human
acaucacagagcccagauaaag

SEQ ID NO: 652470 - RNA, 22 nt, Human
guaaacaauagcauugccugau

SEQ ID NO: 652471 - RNA, 22 nt, Human
aggagcugcacugggaguuuuu

SEQ ID NO: 652472 - RNA, 22 nt, Human
cagagcccagggccuacguccc

SEQ ID NO: 652473 - RNA, 22 nt, Human
cuggagccggaccagggacggu

SEQ ID NO: 652474 - RNA, 22 nt, Human
uggacucagaguugguggcagu

SEQ ID NO: 652475 - RNA, 22 nt, Human
ucagagaaaugcugagcucaug

SEQ ID NO: 652476 - RNA, 22 nt, Human
gagcuaagagucuagaaaggcu

SEQ ID NO: 652477 - RNA, 22 nt, Human
acaggcagcacuaaucucuggu

SEQ ID NO: 652478 - RNA, 22 nt, Human
cuccuggaccaccuuguggcca

SEQ ID NO: 652479 - RNA, 22 nt, Human
cuggagggauguaggguguauu

SEQ ID NO: 652480 - RNA, 22 nt, Human
uccugaggcacaauccuagaau

SEQ ID NO: 652481 - RNA, 22 nt, Human
aagcagagccaccagcuuugga

SEQ ID NO: 652482 - RNA, 21 nt, Human
uuguaugcauacauacacaca

SEQ ID NO: 652483 - RNA, 22 nt, Human
cucucuggucccagauuccaga

SEQ ID NO: 652484 - RNA, 22 nt, Human
ucuguccaggcuuacuauauau

SEQ ID NO: 652485 - RNA, 23 nt, Human
ccugucugugcuggguggacaca

SEQ ID NO: 652486 - RNA, 22 nt, Human
ugcccuggaaaugagaggugug

SEQ ID NO: 652487 - RNA, 22 nt, Human
acacugacgcuugacagucacc

SEQ ID NO: 652488 - RNA, 22 nt, Human
ggagauagacuuggugagccac

SEQ ID NO: 652489 - RNA, 22 nt, Human
uuauuuguuuucugagaaguau

SEQ ID NO: 652490 - RNA, 22 nt, Human
acacaugaaagacauuaaggug

SEQ ID NO: 652491 - RNA, 22 nt, Human
uuuguaacaucccaacaaauuu

SEQ ID NO: 652492 - RNA, 22 nt, Human
gggcagccugcuuucugaucca

SEQ ID NO: 652493 - RNA, 22 nt, Human
caaguccuuagaugguucuuug

SEQ ID NO: 652494 - RNA, 20 nt, Human
aaaaauugauaucgcuuccu

SEQ ID NO: 652495 - RNA, 22 nt, Human
aaggaugugacucagucagcua

SEQ ID NO: 652496 - RNA, 21 nt, Human
ggaagggguccucccaacagu

SEQ ID NO: 652497 - RNA, 22 nt, Human
cccuccccagggucauauugaa

SEQ ID NO: 652498 - RNA, 22 nt, Human
uuauucaggaggugcucgaagg

SEQ ID NO: 652499 - RNA, 22 nt, Human
gacagucuggccuaaaggguua

SEQ ID NO: 652500 - RNA, 22 nt, Human
auuagagguacaaaccuucacu

SEQ ID NO: 652501 - RNA, 21 nt, Human
ugguuugcggccaaaguuaaa

SEQ ID NO: 652502 - RNA, 22 nt, Human
uugugugacuccuagaguagag

SEQ ID NO: 652503 - RNA, 22 nt, Human
ggaggccaagucacugaccugg

SEQ ID NO: 652504 - RNA, 22 nt, Human
gccaggugggagacagacagca

SEQ ID NO: 652505 - RNA, 22 nt, Human
ugauggaaauaaaagcauagcu

SEQ ID NO: 652506 - RNA, 22 nt, Human
acagaacugggaaaugcacaua

SEQ ID NO: 652507 - RNA, 22 nt, Human
aagugcaaaucuguggcugaaa

SEQ ID NO: 652508 - RNA, 22 nt, Human
ugcuguguuacugagauccggc

SEQ ID NO: 652509 - RNA, 22 nt, Human
uggaggccggacugagaggcau

SEQ ID NO: 652510 - RNA, 22 nt, Human
gcaggaggaucacuugagccca

SEQ ID NO: 652511 - RNA, 22 nt, Human
uucagcuugcuuagucuccuuc

SEQ ID NO: 652512 - RNA, 22 nt, Human
cuggcacaacuccaccucagcg

SEQ ID NO: 652513 - RNA, 22 nt, Human
agccuguggaucccugcacugg

SEQ ID NO: 652514 - RNA, 22 nt, Human
ggauauaugcauguuaucauuu

SEQ ID NO: 652515 - RNA, 22 nt, Human
cucucuuugauguauaaauaau

SEQ ID NO: 652516 - RNA, 22 nt, Human
ugaaaugagcauuuauucuuua

SEQ ID NO: 652517 - RNA, 22 nt, Human
ccagaagaggacacagugugga

SEQ ID NO: 652518 - RNA, 22 nt, Human
cagaccugggucccuggccugu

SEQ ID NO: 652519 - RNA, 22 nt, Human
uccaggcccacucgguggggcu

SEQ ID NO: 652520 - RNA, 22 nt, Human
uagaaagucaaaacacuguguu

SEQ ID NO: 652521 - RNA, 20 nt, Human
gcugucugacaguucccaga

SEQ ID NO: 652522 - RNA, 22 nt, Human
uggcccucagucuugcuccugc

SEQ ID NO: 652523 - RNA, 22 nt, Human
cagucagaaggaagaugcuuaa

SEQ ID NO: 652524 - RNA, 22 nt, Human
auuuacaccuucuucgauucuc

SEQ ID NO: 652525 - RNA, 22 nt, Human
ugcuuaaagcugcucaguugua

SEQ ID NO: 652526 - RNA, 22 nt, Human
cagcagcuaccugcucuugugg

SEQ ID NO: 652527 - RNA, 22 nt, Human
aaucuucauaaaaaucuaguag

SEQ ID NO: 652528 - RNA, 22 nt, Human
uauacagauaaugaagaccaag

SEQ ID NO: 652529 - RNA, 22 nt, Human
cugcuucacccaacuuugggau

SEQ ID NO: 652530 - RNA, 22 nt, Human
ugcaacucuggaucuucuggua

SEQ ID NO: 652531 - RNA, 22 nt, Human
gcacuagagcagcucucagaga

SEQ ID NO: 652532 - RNA, 22 nt, Human
acucagaagauguggguagaua

SEQ ID NO: 652533 - RNA, 20 nt, Human
uuauguguaccugugcuccc

SEQ ID NO: 652534 - RNA, 22 nt, Human
ugcccuguuaucuuggaagagu

SEQ ID NO: 652535 - RNA, 22 nt, Human
uggcuucaggcagaauuuagac

SEQ ID NO: 652536 - RNA, 22 nt, Human
ugaguaaauacaaaaucaccuc

SEQ ID NO: 652537 - RNA, 23 nt, Human
uccuggagaaaagaaacauuucu

SEQ ID NO: 652538 - RNA, 22 nt, Human
ggcagauguugcagugagcaga

SEQ ID NO: 652539 - RNA, 22 nt, Human
ggugggugcagggggcuucuua

SEQ ID NO: 652540 - RNA, 22 nt, Human
gcugggcaggccucgugagggc

SEQ ID NO: 652541 - RNA, 22 nt, Human
uuuauugagcacccguugugcg

SEQ ID NO: 652542 - RNA, 22 nt, Human
aauuaggaauaaaugaguacuu

SEQ ID NO: 652543 - RNA, 22 nt, Human
uucugagccucauucaugaggc

SEQ ID NO: 652544 - RNA, 22 nt, Human
gucauauugaagaagacuggca

SEQ ID NO: 652545 - RNA, 22 nt, Human
agacaauguuuggucuacacuu

SEQ ID NO: 652546 - RNA, 22 nt, Human
guucacagauccuugaagccag

SEQ ID NO: 652547 - RNA, 22 nt, Human
gugcaggagccagggguaggaa

SEQ ID NO: 652548 - RNA, 19 nt, Human
acaaaugauguugcacuga

SEQ ID NO: 652549 - RNA, 22 nt, Human
ucucuaauucaaccagacacuu

SEQ ID NO: 652550 - RNA, 22 nt, Human
uaggcuccucucacauucuauu

SEQ ID NO: 652551 - RNA, 22 nt, Human
uguguucuccaacuguagauuu

SEQ ID NO: 652552 - RNA, 22 nt, Human
cagucccaccaggaucgcucuu

SEQ ID NO: 652553 - RNA, 22 nt, Human
uggauaccugguuuuuauuuac

SEQ ID NO: 652554 - RNA, 22 nt, Human
uuccaacuuugucauauauuau

SEQ ID NO: 652555 - RNA, 22 nt, Human
auggacuuaagagucagaagcu

SEQ ID NO: 652556 - RNA, 21 nt, Human
auucacagguauccucucccu

SEQ ID NO: 652557 - RNA, 22 nt, Human
ucuucauuccguagauauuuau

SEQ ID NO: 652558 - RNA, 22 nt, Human
cuugcugucuugcauuuagagc

SEQ ID NO: 652559 - RNA, 22 nt, Human
gccugagcaggcguggaccaug

SEQ ID NO: 652560 - RNA, 22 nt, Human
gugggcaaggucccugccagcu

SEQ ID NO: 652561 - RNA, 22 nt, Human
auggcacuaagagggagcugga

SEQ ID NO: 652562 - RNA, 22 nt, Human
gcugccuggagaggcagggaug

SEQ ID NO: 652563 - RNA, 21 nt, Human
ccuggcuucagggugcacugg

SEQ ID NO: 652564 - RNA, 22 nt, Human
ugcuucugacuaagcugcauga

SEQ ID NO: 652565 - RNA, 23 nt, Human
cucucucuaccaugugaggacac

SEQ ID NO: 652566 - RNA, 22 nt, Human
auaugcuuacagcuuaaaaucc

SEQ ID NO: 652567 - RNA, 23 nt, Human
cacaugaccugaccuaggcuagg

SEQ ID NO: 652568 - RNA, 18 nt, Human
gagguccugcucuagccc

SEQ ID NO: 652569 - RNA, 22 nt, Human
guuuagaauggcaaaauuaagu

SEQ ID NO: 652570 - RNA, 22 nt, Human
auucacaacugauccuugcuca

SEQ ID NO: 652571 - RNA, 22 nt, Human
agccuccacagaugcaaagggc

SEQ ID NO: 652572 - RNA, 22 nt, Human
aauuagacuaauuuuacaaggg

SEQ ID NO: 652573 - RNA, 22 nt, Human
uauucuugacugcuuacuaugu

SEQ ID NO: 652574 - RNA, 22 nt, Human
uauucauggggguccagguacc

SEQ ID NO: 652575 - RNA, 22 nt, Human
agguaaaugaauguuuagucuu

SEQ ID NO: 652576 - RNA, 22 nt, Human
augcgugcagggguccuccugg

SEQ ID NO: 652577 - RNA, 22 nt, Human
caggaggaaaugugacccugcu

SEQ ID NO: 652578 - RNA, 22 nt, Human
ccagggaagauuagaagccacu

SEQ ID NO: 652579 - RNA, 22 nt, Human
accuagaaacugacagaauauu

SEQ ID NO: 652580 - RNA, 22 nt, Human
ccuggcugguugucugauucua

SEQ ID NO: 652581 - RNA, 22 nt, Human
ugaauaaauugagagcgaaugu

SEQ ID NO: 652582 - RNA, 22 nt, Human
uauugaaauccauuacguucuu

SEQ ID NO: 652583 - RNA, 22 nt, Human
gaggcacauauauacagagccc

SEQ ID NO: 652584 - RNA, 22 nt, Human
ucagcaggugaacaucaugcca

SEQ ID NO: 652585 - RNA, 22 nt, Human
agacucugguccucuugaauuu

SEQ ID NO: 652586 - RNA, 22 nt, Human
aaguucaaggcucuagaguucc

SEQ ID NO: 652587 - RNA, 22 nt, Human
ucagaacagugccuggcacuaa

SEQ ID NO: 652588 - RNA, 23 nt, Human
caggacaugggaggaaguauggc

SEQ ID NO: 652589 - RNA, 22 nt, Human
gcacacacuguuuuccucacau

SEQ ID NO: 652590 - RNA, 22 nt, Human
aggaugaggcuggcaggucuug

SEQ ID NO: 652591 - RNA, 22 nt, Human
uuuacaacguuccuggugcuaa

SEQ ID NO: 652592 - RNA, 22 nt, Human
uccagggucagaagucacauac

SEQ ID NO: 652593 - RNA, 22 nt, Human
ucuucccccgugcuccagugca

SEQ ID NO: 652594 - RNA, 22 nt, Human
aucaguuugagugcugugucaa

SEQ ID NO: 652595 - RNA, 22 nt, Human
cagcuucagggacagcuucuuu

SEQ ID NO: 652596 - RNA, 22 nt, Human
ccaagagguugugaggcaggca

SEQ ID NO: 652597 - RNA, 19 nt, Human
cuuucaugugguucuucuu

SEQ ID NO: 652598 - RNA, 19 nt, Human
ccuuuuuuaacuucagcaa

SEQ ID NO: 652599 - RNA, 22 nt, Human
ccggucccaggugccccgguga

SEQ ID NO: 652600 - RNA, 22 nt, Human
agcuguucccucacugcaguca

SEQ ID NO: 652601 - RNA, 22 nt, Human
cagcagaucaauguagaauauu

SEQ ID NO: 652602 - RNA, 22 nt, Human
augaacaugugacucagaccug

SEQ ID NO: 652603 - RNA, 22 nt, Human
ugcuggaaaaaucauuugcuuu

SEQ ID NO: 652604 - RNA, 22 nt, Human
cucaggucgcuauuucucuuac

SEQ ID NO: 652605 - RNA, 22 nt, Human
ucuucuuuggaugaaagaauau

SEQ ID NO: 652606 - RNA, 22 nt, Human
uacaacuuccagcuuucagccc

SEQ ID NO: 652607 - RNA, 22 nt, Human
ggcucuggcguccaauggagcg

SEQ ID NO: 652608 - RNA, 22 nt, Human
auaauccugcuuuuucacuauu

SEQ ID NO: 652609 - RNA, 22 nt, Human
aaaugguauaaugucauguauu

SEQ ID NO: 652610 - RNA, 22 nt, Human
uuugagauggagucuugcucug

SEQ ID NO: 652611 - RNA, 22 nt, Human
aaacagcaauggagaagccagg

SEQ ID NO: 652612 - RNA, 22 nt, Human
cuccugagaggaucucuguugu

SEQ ID NO: 652613 - RNA, 22 nt, Human
uacaggagagauuuaguaauca

SEQ ID NO: 652614 - RNA, 22 nt, Human
gugggccacaucccagggcucu

SEQ ID NO: 652615 - RNA, 22 nt, Human
auggcucucuccuuacugcugc

SEQ ID NO: 652616 - RNA, 22 nt, Human
gcucaugggcccagagcagccc

SEQ ID NO: 652617 - RNA, 22 nt, Human
gugagcaggauaggggcucccu

SEQ ID NO: 652618 - RNA, 22 nt, Human
uguuaacuuccuccuccucugc

SEQ ID NO: 652619 - RNA, 22 nt, Human
uuugcuuucuguugaacagagu

SEQ ID NO: 652620 - RNA, 19 nt, Human
gcuuccagcacugcaggag

SEQ ID NO: 652621 - RNA, 23 nt, Human
agcuaaugggacagauuccaugg

SEQ ID NO: 652622 - RNA, 22 nt, Human
gugcauuaggcuggaauguuga

SEQ ID NO: 652623 - RNA, 22 nt, Human
uagaucaucagugggcucuuau

SEQ ID NO: 652624 - RNA, 22 nt, Human
cuaguggaaacuaacuggaauu

SEQ ID NO: 652625 - RNA, 22 nt, Human
uaugcacacaggcuuaauucau

SEQ ID NO: 652626 - RNA, 22 nt, Human
gagaggccaagggauccgugag

SEQ ID NO: 652627 - RNA, 22 nt, Human
aacauuucugagaauaucaguu

SEQ ID NO: 652628 - RNA, 22 nt, Human
agagcagcguuuguggaacacu

SEQ ID NO: 652629 - RNA, 22 nt, Human
cacagggcuucucauggggugc

SEQ ID NO: 652630 - RNA, 22 nt, Human
uuaaagucccugccuuaauucc

SEQ ID NO: 652631 - RNA, 22 nt, Human
gguaggggaagacaagugaaaa

SEQ ID NO: 652632 - RNA, 21 nt, Human
ucagcagcaucugccuagagu

SEQ ID NO: 652633 - RNA, 22 nt, Human
auaaagaggauguauuuacagc

SEQ ID NO: 652634 - RNA, 22 nt, Human
caggcccuccugugaucugccu

SEQ ID NO: 652635 - RNA, 22 nt, Human
acauagaagugaugcuuaucca

SEQ ID NO: 652636 - RNA, 22 nt, Human
gcagagcuguuaauggagcuga

SEQ ID NO: 652637 - RNA, 22 nt, Human
aguggcagccuuguucauuaug

SEQ ID NO: 652638 - RNA, 21 nt, Human
uuucuaaggaggaagaaaaga

SEQ ID NO: 652639 - RNA, 22 nt, Human
guguaugaggggagaauguuuu

SEQ ID NO: 652640 - RNA, 22 nt, Human
aagcugaauuuucuaaaagaau

SEQ ID NO: 652641 - RNA, 22 nt, Human
gggucaggcucagcagggcagc

SEQ ID NO: 652642 - RNA, 22 nt, Human
uccugcacaccuugagcuugga

SEQ ID NO: 652643 - RNA, 23 nt, Human
ugucaaguauagcaggcccuccc

SEQ ID NO: 652644 - RNA, 22 nt, Human
ugccaggcccagcagggcggcc

SEQ ID NO: 652645 - RNA, 22 nt, Human
ucagaagucaugcucagucugu

SEQ ID NO: 652646 - RNA, 20 nt, Human
ggggcugcaugcagagaaga

SEQ ID NO: 652647 - RNA, 22 nt, Human
caggaggugcccucuaguggca

SEQ ID NO: 652648 - RNA, 22 nt, Human
gugcuuuaaaaauaggagauga

SEQ ID NO: 652649 - RNA, 22 nt, Human
gggagcuguaagggacagguag

SEQ ID NO: 652650 - RNA, 22 nt, Human
ucugggccagaucuagggaucu

SEQ ID NO: 652651 - RNA, 22 nt, Human
gcccacuccagcuucucccaca

SEQ ID NO: 652652 - RNA, 22 nt, Human
aaagaggcaaucaauguagcaa

SEQ ID NO: 652653 - RNA, 22 nt, Human
ugaaugauuucuuaggcaauug

SEQ ID NO: 652654 - RNA, 22 nt, Human
cagacugggcugguggaaagcu

SEQ ID NO: 652655 - RNA, 22 nt, Human
uucuaacuaaagucuuuguuuu

SEQ ID NO: 652656 - RNA, 22 nt, Human
gaagauaacuuuaaaaaguggc

SEQ ID NO: 652657 - RNA, 22 nt, Human
agguccaguuuucugacaaggg

SEQ ID NO: 652658 - RNA, 22 nt, Human
uaagauguacaaccacuucucu

SEQ ID NO: 652659 - RNA, 17 nt, Human
ggucuggggccauuggc

SEQ ID NO: 652660 - RNA, 22 nt, Human
guggcuucaugaacacugauga

SEQ ID NO: 652661 - RNA, 18 nt, Human
gcuccugguuggaaagaa

SEQ ID NO: 652662 - RNA, 22 nt, Human
ggaggagagagguugcaaacac

SEQ ID NO: 652663 - RNA, 22 nt, Human
agcugugugccaggggagaugu

SEQ ID NO: 652664 - RNA, 22 nt, Human
ucacuguuucaucccuagcacu

SEQ ID NO: 652665 - RNA, 22 nt, Human
guuguauagagggcaugaaucu

SEQ ID NO: 652666 - RNA, 22 nt, Human
aguggcaguuugggagcuacag

SEQ ID NO: 652667 - RNA, 22 nt, Human
uccagggguaccggccaggcag

SEQ ID NO: 652668 - RNA, 22 nt, Human
uucuguaugccaauggguuuuu

SEQ ID NO: 652669 - RNA, 20 nt, Human
uucauucacguagcuguuga

SEQ ID NO: 652670 - RNA, 22 nt, Human
uguuuacauauuuggucucaga

SEQ ID NO: 652671 - RNA, 22 nt, Human
ugucauuuucagcuuaugcuuc

SEQ ID NO: 652672 - RNA, 22 nt, Human
gcccugagcuagugugggcagg

SEQ ID NO: 652673 - RNA, 22 nt, Human
cacucugacuggcccugcagga

SEQ ID NO: 652674 - RNA, 22 nt, Human
acuuguuucaacuguacucucc

SEQ ID NO: 652675 - RNA, 22 nt, Human
uguggcugucuguucuccuagg

SEQ ID NO: 652676 - RNA, 22 nt, Human
agaacagcaacaucagacaaag

SEQ ID NO: 652677 - RNA, 22 nt, Human
uuggugugacuaaggcagugug

SEQ ID NO: 652678 - RNA, 22 nt, Human
ggcugcagcagagggacucacg

SEQ ID NO: 652679 - RNA, 22 nt, Human
gcugguccagggccucuguggg

SEQ ID NO: 652680 - RNA, 22 nt, Human
ucagugcaaaaaaugggcuaga

SEQ ID NO: 652681 - RNA, 22 nt, Human
cuuuacagccccacuuccgggc

SEQ ID NO: 652682 - RNA, 22 nt, Human
ccagagccccugagcuucccug

SEQ ID NO: 652683 - RNA, 22 nt, Human
uaaggcagguagaugacuacgg

SEQ ID NO: 652684 - RNA, 22 nt, Human
uacaugaagaugaauguauggc

SEQ ID NO: 652685 - RNA, 22 nt, Human
acucauuugacacuuuaaacug

SEQ ID NO: 652686 - RNA, 22 nt, Human
uugauucuacuuaaaacauaug

SEQ ID NO: 652687 - RNA, 22 nt, Human
aagugucuuuuagccacuuuua

SEQ ID NO: 652688 - RNA, 22 nt, Human
aguauauaguggcgcuguaugc

SEQ ID NO: 652689 - RNA, 22 nt, Human
cacaugggugugccuggaggaa

SEQ ID NO: 652690 - RNA, 22 nt, Human
ugaggccccgaagcugagguuu

SEQ ID NO: 652691 - RNA, 22 nt, Human
aggagcagcuucugaaccaugu

SEQ ID NO: 652692 - RNA, 22 nt, Human
ugugugaaucuauugaauauau

SEQ ID NO: 652693 - RNA, 22 nt, Human
gcaaggccugaggugggugcuc

SEQ ID NO: 652694 - RNA, 22 nt, Human
cuuauucuugucuuauugugcu

SEQ ID NO: 652695 - RNA, 22 nt, Human
aaacaauguuccuauauuagag

SEQ ID NO: 652696 - RNA, 22 nt, Human
aguccuuugggaaaaaugacua

SEQ ID NO: 652697 - RNA, 22 nt, Human
ucugcccuaauucagugcuuag

SEQ ID NO: 652698 - RNA, 22 nt, Human
cuccagccucagaugacgguac

SEQ ID NO: 652699 - RNA, 22 nt, Human
acauauuuugaaagcuuucuaa

SEQ ID NO: 652700 - RNA, 22 nt, Human
aaucuggaguuaauguuuucgc

SEQ ID NO: 652701 - RNA, 22 nt, Human
agcaaggcuaaauuucaguuau

SEQ ID NO: 652702 - RNA, 22 nt, Human
uugcauuugagaaaguucuccu

SEQ ID NO: 652703 - RNA, 22 nt, Human
gcuuccugagaaacaaucugau

SEQ ID NO: 652704 - RNA, 22 nt, Human
ugugaucugccuuggaucugca

SEQ ID NO: 652705 - RNA, 22 nt, Human
acacaguugauugucacucagg

SEQ ID NO: 652706 - RNA, 22 nt, Human
uacagcuuaaaagaugcauuua

SEQ ID NO: 652707 - RNA, 19 nt, Human
aggaggccaugccacuaga

SEQ ID NO: 652708 - RNA, 22 nt, Human
gucccuuccucauuccacuuua

SEQ ID NO: 652709 - RNA, 22 nt, Human
aggugccuaucuggucucugca

SEQ ID NO: 652710 - RNA, 22 nt, Human
uggugacaccccaucucuaaag

SEQ ID NO: 652711 - RNA, 22 nt, Human
acaggcaguugagguuugugug

SEQ ID NO: 652712 - RNA, 22 nt, Human
agaaaugggccuugggacacaa

SEQ ID NO: 652713 - RNA, 22 nt, Human
cagucagggacaccagcuagga

SEQ ID NO: 652714 - RNA, 22 nt, Human
augcacuacuuggcuuuacuga

SEQ ID NO: 652715 - RNA, 22 nt, Human
gccucaguugaucugugugagc

SEQ ID NO: 652716 - RNA, 22 nt, Human
gucaggauuaaugggaguaugc

SEQ ID NO: 652717 - RNA, 22 nt, Human
cagauguggaaugcagcaggcu

SEQ ID NO: 652718 - RNA, 22 nt, Human
uguccugggucaaccaggucga

SEQ ID NO: 652719 - RNA, 23 nt, Human
agguggucuuguggaugcugcaa

SEQ ID NO: 652720 - RNA, 22 nt, Human
ucuaaacuucacuuuaagugcu

SEQ ID NO: 652721 - RNA, 22 nt, Human
guuguacaauuguuucacaugc

SEQ ID NO: 652722 - RNA, 22 nt, Human
ucauguuuguuggaaauguggc

SEQ ID NO: 652723 - RNA, 22 nt, Human
ggcucuggugugaagcagccuc

SEQ ID NO: 652724 - RNA, 22 nt, Human
uucuuuccacagaggggaugau

SEQ ID NO: 652725 - RNA, 22 nt, Human
ugcacagagggaggcauaaaau

SEQ ID NO: 652726 - RNA, 22 nt, Human
cauagcaaggugcuuuccacau

SEQ ID NO: 652727 - RNA, 22 nt, Human
aucaguaaauauucauugugca

SEQ ID NO: 652728 - RNA, 22 nt, Human
agcaugaaagcauaggacaguc

SEQ ID NO: 652729 - RNA, 23 nt, Human
gagggcucugagugcuugggcca

SEQ ID NO: 652730 - RNA, 17 nt, Human
cugaggggagugcugug

SEQ ID NO: 652731 - RNA, 22 nt, Human
aggccuugugagaagcagagaa

SEQ ID NO: 652732 - RNA, 22 nt, Human
gacccugauaggaguagaagaa

SEQ ID NO: 652733 - RNA, 22 nt, Human
ucaucuugcugccauugcuuua

SEQ ID NO: 652734 - RNA, 22 nt, Human
gaggaacagagacgggaucgcu

SEQ ID NO: 652735 - RNA, 22 nt, Human
agucugugacucauuggaucuc

SEQ ID NO: 652736 - RNA, 22 nt, Human
aacagccugagagaacaaugau

SEQ ID NO: 652737 - RNA, 22 nt, Human
uagcagcaccuacacgucagag

SEQ ID NO: 652738 - RNA, 23 nt, Human
gcucuggcagcuugugucagcac

SEQ ID NO: 652739 - RNA, 22 nt, Human
augucuuggguuucaguuuacu

SEQ ID NO: 652740 - RNA, 22 nt, Human
aaugcauguauucauuguggaa

SEQ ID NO: 652741 - RNA, 23 nt, Human
cuuuuaacuugaucugagaccag

SEQ ID NO: 652742 - RNA, 22 nt, Human
cuucuggguguggagugaggac

SEQ ID NO: 652743 - RNA, 22 nt, Human
auucaauaagucacuguggaau

SEQ ID NO: 652744 - RNA, 22 nt, Human
ugucaguuaccuagcacaagaa

SEQ ID NO: 652745 - RNA, 22 nt, Human
uuccuucuuuuacaccauaaau

SEQ ID NO: 652746 - RNA, 22 nt, Human
gcagagugguuucagaguugag

SEQ ID NO: 652747 - RNA, 22 nt, Human
gcugagggaggcugaacugagu

SEQ ID NO: 652748 - RNA, 22 nt, Human
uagggcugcagaacaauggccu

SEQ ID NO: 652749 - RNA, 22 nt, Human
uguagcuucagucugaucucau

SEQ ID NO: 652750 - RNA, 22 nt, Human
gcuccuggccagcacagggccc

SEQ ID NO: 652751 - RNA, 22 nt, Human
ccagccagcugguuggacgccu

SEQ ID NO: 652752 - RNA, 22 nt, Human
ucugcccacagccuccugucca

SEQ ID NO: 652753 - RNA, 22 nt, Human
cucugcccacgucuugcccaga

SEQ ID NO: 652754 - RNA, 22 nt, Human
agugcuggauuacaggcgugag

SEQ ID NO: 652755 - RNA, 22 nt, Human
aaauugugcucacacugauauu

SEQ ID NO: 652756 - RNA, 22 nt, Human
gcagagguuggauuggugacuu

SEQ ID NO: 652757 - RNA, 22 nt, Human
aacacaaucuuccaguuugcug

SEQ ID NO: 652758 - RNA, 22 nt, Human
gaaaacacuuugaucugaaagu

SEQ ID NO: 652759 - RNA, 22 nt, Human
gggugagagucaggcagagauu

SEQ ID NO: 652760 - RNA, 22 nt, Human
uucuucaaaguaauagagacua

SEQ ID NO: 652761 - RNA, 22 nt, Human
aacuuaaacccacucauguaga

SEQ ID NO: 652762 - RNA, 22 nt, Human
aggccuagaggaauggccaggg

SEQ ID NO: 652763 - RNA, 22 nt, Human
cucucagauggagugugaaugg

SEQ ID NO: 652764 - RNA, 22 nt, Human
ccaggcugugcuuuucauaaau

SEQ ID NO: 652765 - RNA, 22 nt, Human
cagcucuuauuuucucuccuaa

SEQ ID NO: 652766 - RNA, 22 nt, Human
uuuacacugacagcacauaagg

SEQ ID NO: 652767 - RNA, 22 nt, Human
cuuccuggcucggugccucacc

SEQ ID NO: 652768 - RNA, 22 nt, Human
aauugcuuuugggggcaguuac

SEQ ID NO: 652769 - RNA, 22 nt, Human
uccagggagcaagucaggccgg

SEQ ID NO: 652770 - RNA, 22 nt, Human
guuuccagccuagagaugguga

SEQ ID NO: 652771 - RNA, 22 nt, Human
ccuuagagaguacugggcugcc

SEQ ID NO: 652772 - RNA, 22 nt, Human
cauuuagaagucuuagaacuau

SEQ ID NO: 652773 - RNA, 23 nt, Human
ucacuugaagcuagaaucugccc

SEQ ID NO: 652774 - RNA, 22 nt, Human
cagccuggauugcagaaugcua

SEQ ID NO: 652775 - RNA, 22 nt, Human
aggucuggagugggaucugaga

SEQ ID NO: 652776 - RNA, 22 nt, Human
cuucaauaccugcguugcuagu

SEQ ID NO: 652777 - RNA, 22 nt, Human
aagaccugccagccucauccug

SEQ ID NO: 652778 - RNA, 22 nt, Human
gagcuaaggucacaagaagcag

SEQ ID NO: 652779 - RNA, 22 nt, Human
ugcaggguagaugcaggcugug

SEQ ID NO: 652780 - RNA, 22 nt, Human
uuuauugacccaaagcgagagu

SEQ ID NO: 652781 - RNA, 22 nt, Human
gcugucugggaugucacugcug

SEQ ID NO: 652782 - RNA, 22 nt, Human
aagaucaugguuuaucugggag

SEQ ID NO: 652783 - RNA, 22 nt, Human
uccuuagacaaagagugggcuu

SEQ ID NO: 652784 - RNA, 22 nt, Human
agcugccaggccccugagaacc

SEQ ID NO: 652785 - RNA, 22 nt, Human
ucugucaucucuaaaauagaaa

SEQ ID NO: 652786 - RNA, 22 nt, Human
acugcagcaaagcccgugucuu

SEQ ID NO: 652787 - RNA, 22 nt, Human
cacucuccagcacaccccauuu

SEQ ID NO: 652788 - RNA, 22 nt, Human
cucugcuuucucaaacccugug

SEQ ID NO: 652789 - RNA, 22 nt, Human
ucaaagcuuagauaauuucuuu

SEQ ID NO: 652790 - RNA, 22 nt, Human
cuguuuucaaagagagagaaug

SEQ ID NO: 652791 - RNA, 22 nt, Human
augucacagcaggaguauucuu

SEQ ID NO: 652792 - RNA, 22 nt, Human
cagcuguggcugccacugcucc

SEQ ID NO: 652793 - RNA, 22 nt, Human
uaacuucugcacagaaaauuug

SEQ ID NO: 652794 - RNA, 22 nt, Human
uucuggaguugugaccucaggg

SEQ ID NO: 652795 - RNA, 22 nt, Human
gcaaacauaauaugaagacacu

SEQ ID NO: 652796 - RNA, 22 nt, Human
ugagccaaguucacaccauugc

SEQ ID NO: 652797 - RNA, 22 nt, Human
aaauagacaggcuuaaauagga

SEQ ID NO: 652798 - RNA, 22 nt, Human
ccaggaggaugguuguuaggug

SEQ ID NO: 652799 - RNA, 22 nt, Human
gcugccagcccucggggucuga

SEQ ID NO: 652800 - RNA, 22 nt, Human
gcuucugugguugucacgacua

SEQ ID NO: 652801 - RNA, 22 nt, Human
aguuaagagugugaaaauguua

SEQ ID NO: 652802 - RNA, 22 nt, Human
ucauucuccucuggaaaaggca

SEQ ID NO: 652803 - RNA, 22 nt, Human
caaugugucaggaaaagggcca

SEQ ID NO: 652804 - RNA, 22 nt, Human
ugagcugggaagagcagccaga

SEQ ID NO: 652805 - RNA, 20 nt, Human
ugcucugucuaaaacuuccc

SEQ ID NO: 652806 - RNA, 22 nt, Human
acgcaguuuguggacauuuuuu

SEQ ID NO: 652807 - RNA, 20 nt, Human
cauauauaccuagaagugga

SEQ ID NO: 652808 - RNA, 22 nt, Human
ugcaguuuugccaggcaaugga

SEQ ID NO: 652809 - RNA, 22 nt, Human
uuacacuuguaauuauauaacg

SEQ ID NO: 652810 - RNA, 19 nt, Human
gccagugugugguacagug

SEQ ID NO: 652811 - RNA, 22 nt, Human
gcagugaacauaacacagaagg

SEQ ID NO: 652812 - RNA, 22 nt, Human
uuguaacagcugcuuaauagag

SEQ ID NO: 652813 - RNA, 22 nt, Human
aaaaacagaaugugucuaacuc

SEQ ID NO: 652814 - RNA, 22 nt, Human
ccuggucagguaacugggcuga

SEQ ID NO: 652815 - RNA, 22 nt, Human
ucacauuucaagugcucaaaag

SEQ ID NO: 652816 - RNA, 22 nt, Human
uuacaugagguuaauuaagcau

SEQ ID NO: 652817 - RNA, 22 nt, Human
auaucacagguguuuaccugau

SEQ ID NO: 652818 - RNA, 22 nt, Human
caaguaauucugcaagaaacca

SEQ ID NO: 652819 - RNA, 22 nt, Human
acuuccugacuucuggguugga

SEQ ID NO: 652820 - RNA, 22 nt, Human
cagcaggguauacagggaauuu

SEQ ID NO: 652821 - RNA, 18 nt, Human
uccccugcucuggugcuc

SEQ ID NO: 652822 - RNA, 21 nt, Human
acaggcucuggggaugcuggg

SEQ ID NO: 652823 - RNA, 22 nt, Human
cuggacuuggggaggcuagauu

SEQ ID NO: 652824 - RNA, 22 nt, Human
uguguguguuuacaguuucuca

SEQ ID NO: 652825 - RNA, 22 nt, Human
cuugccugccacuacagcugaa

SEQ ID NO: 652826 - RNA, 22 nt, Human
cuggauuuaauuaacuguugcu

SEQ ID NO: 652827 - RNA, 22 nt, Human
cacagccuuacugagauccacu

SEQ ID NO: 652828 - RNA, 22 nt, Human
uguaaagguaggugcaaaauga

SEQ ID NO: 652829 - RNA, 22 nt, Human
ucuucaaauacagucauauuga

SEQ ID NO: 652830 - RNA, 22 nt, Human
accuuucauuaaagucuguagu

SEQ ID NO: 652831 - RNA, 22 nt, Human
agccuggugauaucagugguuu

SEQ ID NO: 652832 - RNA, 22 nt, Human
ggcagagcuaguggcuucucuu

SEQ ID NO: 652833 - RNA, 22 nt, Human
gcugaggucaggagcugugggg

SEQ ID NO: 652834 - RNA, 22 nt, Human
ggcucagaaaccucuggugucu

SEQ ID NO: 652835 - RNA, 22 nt, Human
cuucacauuugcgaaggccaaa

SEQ ID NO: 652836 - RNA, 21 nt, Human
caaauacuuagaaacuuaaga

SEQ ID NO: 652837 - RNA, 22 nt, Human
ugagaacaguuggaagcaguca

SEQ ID NO: 652838 - RNA, 22 nt, Human
ugagcaccuacuguauuccagg

SEQ ID NO: 652839 - RNA, 22 nt, Human
acauagauuuaagagcaauuag

SEQ ID NO: 652840 - RNA, 22 nt, Human
uggcagggugggcuucagcccc

SEQ ID NO: 652841 - RNA, 18 nt, Human
uucacaggaaaugucuuu

SEQ ID NO: 652842 - RNA, 22 nt, Human
acaggccuuggcaggcauguga

SEQ ID NO: 652843 - RNA, 22 nt, Human
gaaaugcaaauucucucucgcu

SEQ ID NO: 652844 - RNA, 22 nt, Human
cagccaucccagccugugguuc

SEQ ID NO: 652845 - RNA, 17 nt, Human
ugcuugacucucuuguu

SEQ ID NO: 652846 - RNA, 22 nt, Human
gaacagaguugaaacaaggcug

SEQ ID NO: 652847 - RNA, 22 nt, Human
ggcguggcagucaggaaaaggu

SEQ ID NO: 652848 - RNA, 22 nt, Human
ugugugaauuacgcguguccug

SEQ ID NO: 652849 - RNA, 22 nt, Human
cacuggcaaauggagagaaugu

SEQ ID NO: 652850 - RNA, 22 nt, Human
aggcuggagugcuggagugcug

SEQ ID NO: 652851 - RNA, 22 nt, Human
aaucaguuaggguguuaaugag

SEQ ID NO: 652852 - RNA, 22 nt, Human
auuccacaggacuaccaaugug

SEQ ID NO: 652853 - RNA, 23 nt, Human
aagaggaggcccugcucccgucc

SEQ ID NO: 652854 - RNA, 22 nt, Human
gcagcccacagcuggaggccua

SEQ ID NO: 652855 - RNA, 22 nt, Human
uggccaguuugcucaggcaguc

SEQ ID NO: 652856 - RNA, 22 nt, Human
ggcaggguaaaccgagguaagu

SEQ ID NO: 652857 - RNA, 22 nt, Human
uacaugaaguugucuaaacugg

SEQ ID NO: 652858 - RNA, 22 nt, Human
aaagaucauucucugguccaga

SEQ ID NO: 652859 - RNA, 22 nt, Human
cucccaggguagggagagacua

SEQ ID NO: 652860 - RNA, 22 nt, Human
ccagcagagucuaggaaggagg

SEQ ID NO: 652861 - RNA, 22 nt, Human
gaggaaugggugucucgugauu

SEQ ID NO: 652862 - RNA, 22 nt, Human
uauuucaccuuacuaagcugug

SEQ ID NO: 652863 - RNA, 22 nt, Human
uggagccaaaaagggaaggaga

SEQ ID NO: 652864 - RNA, 21 nt, Human
aggaggggucuuucccacuga

SEQ ID NO: 652865 - RNA, 22 nt, Human
acuuccaguuuuaauuaaauug

SEQ ID NO: 652866 - RNA, 22 nt, Human
aguguguacucauauacuucca

SEQ ID NO: 652867 - RNA, 22 nt, Human
gccaggagugucccacucauuu

SEQ ID NO: 652868 - RNA, 22 nt, Human
uggcacugggacagaugcucuc

SEQ ID NO: 652869 - RNA, 22 nt, Human
acccacaccuccguauaucacu

SEQ ID NO: 652870 - RNA, 17 nt, Human
ucugagaaugcuggagg

SEQ ID NO: 652871 - RNA, 17 nt, Human
ugucuuaucuguccugu

SEQ ID NO: 652872 - RNA, 22 nt, Human
gggcaggaggcuaauucugcau

SEQ ID NO: 652873 - RNA, 22 nt, Human
ucugagguuacugcuuuguaga

SEQ ID NO: 652874 - RNA, 22 nt, Human
uucauugaaggagggacuugcu

SEQ ID NO: 652875 - RNA, 22 nt, Human
gcagaggugagaagggccuccc

SEQ ID NO: 652876 - RNA, 22 nt, Human
augcauuggucagggucuuagg

SEQ ID NO: 652877 - RNA, 22 nt, Human
uggaguuccuuugaaaggcucu

SEQ ID NO: 652878 - RNA, 22 nt, Human
uccugccuugccugggacauca

SEQ ID NO: 652879 - RNA, 22 nt, Human
gcauugaauccuaucaggcaaa

SEQ ID NO: 652880 - RNA, 22 nt, Human
guggcagagagcaagugucuga

SEQ ID NO: 652881 - RNA, 22 nt, Human
ccgcaaggcagagguugcagug

SEQ ID NO: 652882 - RNA, 22 nt, Human
ucacgugagggaccugugucug

SEQ ID NO: 652883 - RNA, 22 nt, Human
agcaccaggcaccaaagggccu

SEQ ID NO: 652884 - RNA, 22 nt, Human
uguguguccuugaccucagugg

SEQ ID NO: 652885 - RNA, 22 nt, Human
aaaugccucccauucuacugac

SEQ ID NO: 652886 - RNA, 22 nt, Human
gcaggcauggucgcugccaggu

SEQ ID NO: 652887 - RNA, 22 nt, Human
aggaagcucaaagccaugaugu

SEQ ID NO: 652888 - RNA, 21 nt, Human
ucuggagcugcaggcugggca

SEQ ID NO: 652889 - RNA, 22 nt, Human
ccacaguaagagauaguuuaug

SEQ ID NO: 652890 - RNA, 22 nt, Human
uuuguguuuuagcuggugaggc

SEQ ID NO: 652891 - RNA, 22 nt, Human
uuccucaggcuucccuuugucc

SEQ ID NO: 652892 - RNA, 22 nt, Human
cuccagggcuaccagguuuuag

SEQ ID NO: 652893 - RNA, 22 nt, Human
aguaugaacggaaggccuggga

SEQ ID NO: 652894 - RNA, 22 nt, Human
cacccccaccugugggcuccug

SEQ ID NO: 652895 - RNA, 22 nt, Human
ucucaggcauucccacauagaa

SEQ ID NO: 652896 - RNA, 22 nt, Human
ucagucccuuaaagguggcagc

SEQ ID NO: 652897 - RNA, 19 nt, Human
ucugcuggcagaauucccu

SEQ ID NO: 652898 - RNA, 23 nt, Human
ugugggaauguuggagaggaaac

SEQ ID NO: 652899 - RNA, 17 nt, Human
aggcauggucuggggug

SEQ ID NO: 652900 - RNA, 22 nt, Human
accagcacggauuagaaugcuu

SEQ ID NO: 652901 - RNA, 18 nt, Human
ugggagugggaguggaua

SEQ ID NO: 652902 - RNA, 22 nt, Human
auagauacauuguuauauuugu

SEQ ID NO: 652903 - RNA, 22 nt, Human
auggaauugagcaucaguuguu

SEQ ID NO: 652904 - RNA, 22 nt, Human
cagggccuggagcugggccugc

SEQ ID NO: 652905 - RNA, 22 nt, Human
acaguagauugguaugauguca

SEQ ID NO: 652906 - RNA, 22 nt, Human
cauucauucagcaacuguuauu

SEQ ID NO: 652907 - RNA, 22 nt, Human
gggacauggaggcgcgcaggca

SEQ ID NO: 652908 - RNA, 17 nt, Human
ggacaccuggagucucc

SEQ ID NO: 652909 - RNA, 22 nt, Human
uccuggagccacggagcuuuca

SEQ ID NO: 652910 - RNA, 22 nt, Human
ugugggcacuaaugacaugcag

SEQ ID NO: 652911 - RNA, 20 nt, Human
cucaguguauucugggugcu

SEQ ID NO: 652912 - RNA, 22 nt, Human
aauuucaagucuugaagaagua

SEQ ID NO: 652913 - RNA, 22 nt, Human
ucaaagucauggcuaguaauga

SEQ ID NO: 652914 - RNA, 22 nt, Human
caacuucacugugccucuaguu

SEQ ID NO: 652915 - RNA, 22 nt, Human
gcagaugguggggcaggaaaau

SEQ ID NO: 652916 - RNA, 22 nt, Human
ugcaauuuuuuagcacaaggag

SEQ ID NO: 652917 - RNA, 22 nt, Human
uggcaguguugugccacauucc

SEQ ID NO: 652918 - RNA, 22 nt, Human
guaggcagggcuguggggagaa

SEQ ID NO: 652919 - RNA, 22 nt, Human
cgugucaucugagccuugggcg

SEQ ID NO: 652920 - RNA, 22 nt, Human
uccugaagagcccugcucugug

SEQ ID NO: 652921 - RNA, 22 nt, Human
aguguccaacucagcuugucaa

SEQ ID NO: 652922 - RNA, 22 nt, Human
uuucacauaaauauuaugccua

SEQ ID NO: 652923 - RNA, 22 nt, Human
cggcuucagucucaucaucgcc

SEQ ID NO: 652924 - RNA, 22 nt, Human
ugagguguguccccagggaggu

SEQ ID NO: 652925 - RNA, 17 nt, Human
uuucaucugggaccacc

SEQ ID NO: 652926 - RNA, 22 nt, Human
uugaggucugugauaaaaguca

SEQ ID NO: 652927 - RNA, 22 nt, Human
ggccuagggcuuggucauggca

SEQ ID NO: 652928 - RNA, 22 nt, Human
agugauguaacaaacagaguua

SEQ ID NO: 652929 - RNA, 20 nt, Human
agugucuggauuuuguaacc

SEQ ID NO: 652930 - RNA, 22 nt, Human
cccagagcauaacguaucuuga

SEQ ID NO: 652931 - RNA, 22 nt, Human
agggauggaagcucgucugcaa

SEQ ID NO: 652932 - RNA, 22 nt, Human
uacaguagcugagguucucagg

SEQ ID NO: 652933 - RNA, 22 nt, Human
cuuuuuccagcuucaggguggg

SEQ ID NO: 652934 - RNA, 22 nt, Human
uuguucaucguccuugcucugu

SEQ ID NO: 652935 - RNA, 22 nt, Human
agguaauaggguucagaauuau

SEQ ID NO: 652936 - RNA, 22 nt, Human
ugccucuguggaaauggugguc

SEQ ID NO: 652937 - RNA, 23 nt, Human
agucugugcuuggugggagggcc

SEQ ID NO: 652938 - RNA, 22 nt, Human
uacacauucuagggcacaguua

SEQ ID NO: 652939 - RNA, 22 nt, Human
uuguugguggaauugaugcuag

SEQ ID NO: 652940 - RNA, 22 nt, Human
gaaggccacggaauggagcugg

SEQ ID NO: 652941 - RNA, 22 nt, Human
ucagaagcagauauuucaaaau

SEQ ID NO: 652942 - RNA, 22 nt, Human
agcugagcacauucaaacaggu

SEQ ID NO: 652943 - RNA, 22 nt, Human
uggccacucagggaugcaggaa

SEQ ID NO: 652944 - RNA, 22 nt, Human
gaaguuuagaguguuguaauuu

SEQ ID NO: 652945 - RNA, 22 nt, Human
guacagcauuugaaauuacugg

SEQ ID NO: 652946 - RNA, 22 nt, Human
cuuguuauuggaaaugucaugc

SEQ ID NO: 652947 - RNA, 22 nt, Human
aaucagaccguucuggcugucc

SEQ ID NO: 652948 - RNA, 22 nt, Human
uauaauccauucauugauuucu

SEQ ID NO: 652949 - RNA, 22 nt, Human
auguccagggcacacagcagug

SEQ ID NO: 652950 - RNA, 22 nt, Human
gauuuuacaugucauaucuauu

SEQ ID NO: 652951 - RNA, 22 nt, Human
ccugggaccucgcgggaagcgg

SEQ ID NO: 652952 - RNA, 22 nt, Human
uccuuugacuucuugcagucca

SEQ ID NO: 652953 - RNA, 22 nt, Human
uccucagggguuucagguguac

SEQ ID NO: 652954 - RNA, 22 nt, Human
uuacaaaguguuaugauaaaca

SEQ ID NO: 652955 - RNA, 22 nt, Human
aggccccaucaggaaggaggcc

SEQ ID NO: 652956 - RNA, 22 nt, Human
auguggagaggaagugcaaacu

SEQ ID NO: 652957 - RNA, 22 nt, Human
cucuacuccaaaaggcuacaau

SEQ ID NO: 652958 - RNA, 22 nt, Human
ucuucucccaucuccaggcagg

SEQ ID NO: 652959 - RNA, 23 nt, Human
ugcccauugcaucuugguacugg

SEQ ID NO: 652960 - RNA, 22 nt, Human
gaaacguuguggaaaauccucu

SEQ ID NO: 652961 - RNA, 22 nt, Human
uugcauuuauagacugccauuu

SEQ ID NO: 652962 - RNA, 22 nt, Human
ggcaggugcuaagagagguaaa

SEQ ID NO: 652963 - RNA, 19 nt, Human
ggcugucucggcccagcca

SEQ ID NO: 652964 - RNA, 22 nt, Human
acugguggcuuucagacagaaa

SEQ ID NO: 652965 - RNA, 22 nt, Human
cguguacacgcacacguguccu

SEQ ID NO: 652966 - RNA, 22 nt, Human
aaauaguuguuuggaucaauaa

SEQ ID NO: 652967 - RNA, 22 nt, Human
acccugcuuggccccacuucua

SEQ ID NO: 652968 - RNA, 22 nt, Human
aguaugucagagugaaaauggu

SEQ ID NO: 652969 - RNA, 22 nt, Human
ggcuauggaaauggcaggacau

SEQ ID NO: 652970 - RNA, 20 nt, Human
gcuuccagaggaggccccgu

SEQ ID NO: 652971 - RNA, 22 nt, Human
uuugcauuuguuuagaaccuga

SEQ ID NO: 652972 - RNA, 22 nt, Human
aggcuggaguacaguggcuauu

SEQ ID NO: 652973 - RNA, 22 nt, Human
uauuugaugguucuaaaacagc

SEQ ID NO: 652974 - RNA, 22 nt, Human
ccagaggugccacagaaagagc

SEQ ID NO: 652975 - RNA, 22 nt, Human
aagcauuuuugaaaugguagga

SEQ ID NO: 652976 - RNA, 22 nt, Human
auuggcuuccuucuuauuguca

SEQ ID NO: 652977 - RNA, 22 nt, Human
acaguacaaaacccaccagagg

SEQ ID NO: 652978 - RNA, 22 nt, Human
auuccacaguguguggugagga

SEQ ID NO: 652979 - RNA, 22 nt, Human
cccagcaggucggugcugccug

SEQ ID NO: 652980 - RNA, 22 nt, Human
acucuggcaagcuuccacuucc

SEQ ID NO: 652981 - RNA, 22 nt, Human
uucuggaagccccagagucaga

SEQ ID NO: 652982 - RNA, 22 nt, Human
cagggugacugcccuggccacu

SEQ ID NO: 652983 - RNA, 22 nt, Human
acugcugauuauugaaguagag

SEQ ID NO: 652984 - RNA, 22 nt, Human
aggaaugacagauguccgcacc

SEQ ID NO: 652985 - RNA, 22 nt, Human
ccaggauaguaugaguagggau

SEQ ID NO: 652986 - RNA, 23 nt, Human
acagaaaguucugcuggacagag

SEQ ID NO: 652987 - RNA, 19 nt, Human
ggugugccaaaugggaaug

SEQ ID NO: 652988 - RNA, 22 nt, Human
gcugccugcccugggucaucug

SEQ ID NO: 652989 - RNA, 22 nt, Human
uugcuuccuccuagccacuugc

SEQ ID NO: 652990 - RNA, 22 nt, Human
uauacaguuugaguucuugcau

SEQ ID NO: 652991 - RNA, 22 nt, Human
gcacagagagcagugggggaca

SEQ ID NO: 652992 - RNA, 22 nt, Human
ccuggccucagccuagggcuga

SEQ ID NO: 652993 - RNA, 22 nt, Human
uguauuagaucugagaacuucu

SEQ ID NO: 652994 - RNA, 22 nt, Human
augaaacugggauaacuauagc

SEQ ID NO: 652995 - RNA, 22 nt, Human
ugggacagagugagcuuuggcc

SEQ ID NO: 652996 - RNA, 22 nt, Human
gggagagaauuauugccagacc

SEQ ID NO: 652997 - RNA, 22 nt, Human
agagcuggaagcugcucuuaga

SEQ ID NO: 652998 - RNA, 22 nt, Human
ugauaacucucaguuucucaug

SEQ ID NO: 652999 - RNA, 22 nt, Human
ccaugggagaugauggggagug

SEQ ID NO: 653000 - RNA, 20 nt, Human
agcaggccuuggggagagga

SEQ ID NO: 653001 - RNA, 22 nt, Human
uaauugucuuaggugugaugau

SEQ ID NO: 653002 - RNA, 22 nt, Human
uggagcugguucuggggaagcu

SEQ ID NO: 653003 - RNA, 22 nt, Human
uacaguuacgcugagaaacgaa

SEQ ID NO: 653004 - RNA, 22 nt, Human
gcccagcacuaaaagcuuugcu

SEQ ID NO: 653005 - RNA, 22 nt, Human
ucuuuggaucccaacuggcugg

SEQ ID NO: 653006 - RNA, 22 nt, Human
caucagcuaaacuuagugaaau

SEQ ID NO: 653007 - RNA, 22 nt, Human
gugccugggacuugcuccggau

SEQ ID NO: 653008 - RNA, 22 nt, Human
ggagagagagcucauuagcugc

SEQ ID NO: 653009 - RNA, 22 nt, Human
gggcugauucgauggggguaga

SEQ ID NO: 653010 - RNA, 22 nt, Human
gcacccagcccagggcgugaug

SEQ ID NO: 653011 - RNA, 22 nt, Human
gcaccugguuuauauaaucaua

SEQ ID NO: 653012 - RNA, 22 nt, Human
aaagccagaauucguccagccu

SEQ ID NO: 653013 - RNA, 22 nt, Human
uggcccagagcacugcugggca

SEQ ID NO: 653014 - RNA, 19 nt, Human
ucucuggggacacuuucac

SEQ ID NO: 653015 - RNA, 19 nt, Human
cuccaagugccaaggacag

SEQ ID NO: 653016 - RNA, 22 nt, Human
cucacagguuaguuguguggau

SEQ ID NO: 653017 - RNA, 22 nt, Human
aguggcagagugcacucaggca

SEQ ID NO: 653018 - RNA, 22 nt, Human
uccuggugucgccuggucaguu

SEQ ID NO: 653019 - RNA, 22 nt, Human
cacuuucucaugaauuuggccc

SEQ ID NO: 653020 - RNA, 22 nt, Human
cuuugccuccuagagcacguuc

SEQ ID NO: 653021 - RNA, 22 nt, Human
accuuuggaaauaaacacucug

SEQ ID NO: 653022 - RNA, 22 nt, Human
ggcaaggguugaagauaaggua

SEQ ID NO: 653023 - RNA, 22 nt, Human
gucucauugguucugccagagu

SEQ ID NO: 653024 - RNA, 22 nt, Human
aaacauuguuaugauaaauuac

SEQ ID NO: 653025 - RNA, 22 nt, Human
ucaggcugaaggaggccuaucu

SEQ ID NO: 653026 - RNA, 21 nt, Human
cugugcuucuuccuaagccag

SEQ ID NO: 653027 - RNA, 18 nt, Human
gucuggaggucaggagcu

SEQ ID NO: 653028 - RNA, 22 nt, Human
aaguucuuggaggaugaagagu

SEQ ID NO: 653029 - RNA, 22 nt, Human
aggugucuggacuugugaagca

SEQ ID NO: 653030 - RNA, 20 nt, Human
caguccugcaggcgggagaa

SEQ ID NO: 653031 - RNA, 22 nt, Human
aagcccugggauguucagcagu

SEQ ID NO: 653032 - RNA, 22 nt, Human
cacauuccuuacauucauagag

SEQ ID NO: 653033 - RNA, 17 nt, Human
aaggauauuauaguucu

SEQ ID NO: 653034 - RNA, 20 nt, Human
agcagcagauguuggaggug

SEQ ID NO: 653035 - RNA, 22 nt, Human
ccugggucuggucacuaaguca

SEQ ID NO: 653036 - RNA, 22 nt, Human
gcuucuccagaccuucaucccc

SEQ ID NO: 653037 - RNA, 22 nt, Human
uggugaauaguagcuucagacu

SEQ ID NO: 653038 - RNA, 22 nt, Human
ccaggaagguguuuaacuagag

SEQ ID NO: 653039 - RNA, 22 nt, Human
augcuuuaaaugucuuuugcuu

SEQ ID NO: 653040 - RNA, 22 nt, Human
aaaugcuacacaggaauucuca

SEQ ID NO: 653041 - RNA, 22 nt, Human
uuccaugaaauguguuaugcuu

SEQ ID NO: 653042 - RNA, 22 nt, Human
cauuagguauuuaagcacacag

SEQ ID NO: 653043 - RNA, 22 nt, Human
cuagagaagagguuaagcauga

SEQ ID NO: 653044 - RNA, 22 nt, Human
ucucuguaguugggcagcugcu

SEQ ID NO: 653045 - RNA, 23 nt, Human
caucaaguacuuuugacaagugu

SEQ ID NO: 653046 - RNA, 22 nt, Human
cagagccagcuguccuuggcau

SEQ ID NO: 653047 - RNA, 22 nt, Human
ggaagcuggcauauguaauccu

SEQ ID NO: 653048 - RNA, 22 nt, Human
gcucagcugagcgaaggacaug

SEQ ID NO: 653049 - RNA, 22 nt, Human
accagguaauguaaagcagggu

SEQ ID NO: 653050 - RNA, 22 nt, Human
cccagcacucagcaggcucaua

SEQ ID NO: 653051 - RNA, 22 nt, Human
agcuuuggagacugacuccauc

SEQ ID NO: 653052 - RNA, 22 nt, Human
ucucugggacacugggucaguu

SEQ ID NO: 653053 - RNA, 22 nt, Human
uggggacccggacuccuggguc

SEQ ID NO: 653054 - RNA, 22 nt, Human
uuucuagggcucuugucuucug

SEQ ID NO: 653055 - RNA, 22 nt, Human
auuuucauuuugcagggugaga

SEQ ID NO: 653056 - RNA, 22 nt, Human
uagcaacaugguuaucacauua

SEQ ID NO: 653057 - RNA, 22 nt, Human
ucauguguccuaguucauauaa

SEQ ID NO: 653058 - RNA, 17 nt, Human
cagugcagagcccuuuc

SEQ ID NO: 653059 - RNA, 22 nt, Human
gcuucucuuucuccccuggcgg

SEQ ID NO: 653060 - RNA, 22 nt, Human
ggcagggugccuggcuccuguu

SEQ ID NO: 653061 - RNA, 22 nt, Human
auuuuaauaagauucccaagua

SEQ ID NO: 653062 - RNA, 22 nt, Human
ggggcuccagucuucacauuuu

SEQ ID NO: 653063 - RNA, 18 nt, Human
aggcacuggaauuaaggg

SEQ ID NO: 653064 - RNA, 19 nt, Human
gccaggucuuggguccagg

SEQ ID NO: 653065 - RNA, 22 nt, Human
cugcccgucccuuugcucucgc

SEQ ID NO: 653066 - RNA, 22 nt, Human
ucugagaggcagaccuuccuaa

SEQ ID NO: 653067 - RNA, 22 nt, Human
auuguacagaugagguaaguga

SEQ ID NO: 653068 - RNA, 22 nt, Human
acaucucuuauaaacucucuga

SEQ ID NO: 653069 - RNA, 22 nt, Human
cucuccugggcugaccguccga

SEQ ID NO: 653070 - RNA, 22 nt, Human
guuuaaccaagagcauugugca

SEQ ID NO: 653071 - RNA, 22 nt, Human
aggcuuagaaauucagcugagu

SEQ ID NO: 653072 - RNA, 22 nt, Human
aaaguccugacugcaggggaug

SEQ ID NO: 653073 - RNA, 22 nt, Human
ggcagaagauaggacagggaau

SEQ ID NO: 653074 - RNA, 22 nt, Human
aaggcacuugcccagagcugca

SEQ ID NO: 653075 - RNA, 22 nt, Human
aauauuaucaaaagcuuuuuca

SEQ ID NO: 653076 - RNA, 22 nt, Human
auucacaacaaaaggauaugag

SEQ ID NO: 653077 - RNA, 23 nt, Human
cauuucaacgaauuuuccuucug

SEQ ID NO: 653078 - RNA, 22 nt, Human
agagccuggacuuuucugagcc

SEQ ID NO: 653079 - RNA, 22 nt, Human
ugugaagguuuuuaugggauau

SEQ ID NO: 653080 - RNA, 22 nt, Human
gggcugcaaugcuucaguuguu

SEQ ID NO: 653081 - RNA, 22 nt, Human
ugguccucagguucucugugcg

SEQ ID NO: 653082 - RNA, 22 nt, Human
uucuuacaaguaugacguagca

SEQ ID NO: 653083 - RNA, 22 nt, Human
aggaaggggagaaguuaaagcu

SEQ ID NO: 653084 - RNA, 22 nt, Human
ggagcagccgcgucucagggca

SEQ ID NO: 653085 - RNA, 22 nt, Human
uuauuauugugaccugagaaug

SEQ ID NO: 653086 - RNA, 22 nt, Human
uuugaugaaagcuacuauuuac

SEQ ID NO: 653087 - RNA, 22 nt, Human
ggaagagagaucccauagaugu

SEQ ID NO: 653088 - RNA, 22 nt, Human
aagagcuucccuguuguagagg

SEQ ID NO: 653089 - RNA, 22 nt, Human
gaagucuuuuagcaaaacgaac

SEQ ID NO: 653090 - RNA, 22 nt, Human
cucaggccaauaagcuccagcc

SEQ ID NO: 653091 - RNA, 22 nt, Human
gccagggugagggcugagaggu

SEQ ID NO: 653092 - RNA, 22 nt, Human
uuuccugguuggggacgugguu

SEQ ID NO: 653093 - RNA, 22 nt, Human
gcaggacauucagugaaugggc

SEQ ID NO: 653094 - RNA, 22 nt, Human
ugaaacuuauaagaauaugaau

SEQ ID NO: 653095 - RNA, 22 nt, Human
auaguaacuggcauguuuauga

SEQ ID NO: 653096 - RNA, 22 nt, Human
ggguguguuccuaaggaaacca

SEQ ID NO: 653097 - RNA, 22 nt, Human
cgcuguguuuacaucauugcug

SEQ ID NO: 653098 - RNA, 22 nt, Human
cugggcccugaagacagucagg

SEQ ID NO: 653099 - RNA, 22 nt, Human
ugaaauacacaaauuuaguaag

SEQ ID NO: 653100 - RNA, 22 nt, Human
gagucagaaacucacucuauag

SEQ ID NO: 653101 - RNA, 23 nt, Human
ucagggacaugaugugucauauc

SEQ ID NO: 653102 - RNA, 20 nt, Human
ccucaagcagacugacagcu

SEQ ID NO: 653103 - RNA, 22 nt, Human
agcugcagguucagcauuccac

SEQ ID NO: 653104 - RNA, 22 nt, Human
cucugacagccuucauuaugca

SEQ ID NO: 653105 - RNA, 21 nt, Human
gagcauggcuuacaucagcag

SEQ ID NO: 653106 - RNA, 22 nt, Human
gaauugcuugugaagugugucu

SEQ ID NO: 653107 - RNA, 22 nt, Human
uucacagugguagugcauuuag

SEQ ID NO: 653108 - RNA, 22 nt, Human
caggacagcugggccaccacca

SEQ ID NO: 653109 - RNA, 22 nt, Human
gcaccagcugcaggguggcuga

SEQ ID NO: 653110 - RNA, 22 nt, Human
guuauaaaggugauaaugguca

SEQ ID NO: 653111 - RNA, 22 nt, Human
uccucuucagagggaccucggg

SEQ ID NO: 653112 - RNA, 20 nt, Human
uacugcaggaaucagcuagc

SEQ ID NO: 653113 - RNA, 22 nt, Human
uagagcuuggggauuuaguagu

SEQ ID NO: 653114 - RNA, 22 nt, Human
uucacagaugccugaugugugg

SEQ ID NO: 653115 - RNA, 22 nt, Human
ugcagcugguuuagaacuagau

SEQ ID NO: 653116 - RNA, 22 nt, Human
cugccucuccccagaguggccc

SEQ ID NO: 653117 - RNA, 23 nt, Human
uuucucauccagagagucagucc

SEQ ID NO: 653118 - RNA, 19 nt, Human
acacagggcuagaguuaca

SEQ ID NO: 653119 - RNA, 22 nt, Human
gcuacugauugaccuuggagag

SEQ ID NO: 653120 - RNA, 22 nt, Human
uugcacagugguuuagagccug

SEQ ID NO: 653121 - RNA, 22 nt, Human
auguagaguagaauaguacaac

SEQ ID NO: 653122 - RNA, 22 nt, Human
agagugggcaggagccucgacu

SEQ ID NO: 653123 - RNA, 22 nt, Human
acugauaaguugcuugcucuca

SEQ ID NO: 653124 - RNA, 22 nt, Human
acuuccugaauggggcuaauua

SEQ ID NO: 653125 - RNA, 22 nt, Human
agagcacugcugauuuacaguc

SEQ ID NO: 653126 - RNA, 22 nt, Human
aacaguuugcuuuaagaggcac

SEQ ID NO: 653127 - RNA, 22 nt, Human
uuuuggggagaacgguugcuau

SEQ ID NO: 653128 - RNA, 22 nt, Human
gagaggccauggcugugcagug

SEQ ID NO: 653129 - RNA, 23 nt, Human
cucuggagauccucugccugggu

SEQ ID NO: 653130 - RNA, 20 nt, Human
cucugcugcccgccggcugc

SEQ ID NO: 653131 - RNA, 22 nt, Human
gcaggaugguggaaggccugcu

SEQ ID NO: 653132 - RNA, 18 nt, Human
agaggcuggacaggggau

SEQ ID NO: 653133 - RNA, 22 nt, Human
uuauacagcauugcuagugaug

SEQ ID NO: 653134 - RNA, 22 nt, Human
acuuucauguuggugaaggguu

SEQ ID NO: 653135 - RNA, 22 nt, Human
gcucagaaauggcagauggaga

SEQ ID NO: 653136 - RNA, 22 nt, Human
ugcuggcuccucgaggcuucgu

SEQ ID NO: 653137 - RNA, 22 nt, Human
agagcaagugacagaaacaggg

SEQ ID NO: 653138 - RNA, 22 nt, Human
cuguauuaaaggcagugaucuu

SEQ ID NO: 653139 - RNA, 22 nt, Human
ccacaagaugcaaacucuaaca

SEQ ID NO: 653140 - RNA, 22 nt, Human
uaacagucaugugcuacugcua

SEQ ID NO: 653141 - RNA, 22 nt, Human
uugacaaaggaauugaaucucu

SEQ ID NO: 653142 - RNA, 22 nt, Human
ucagagaacuggcauguuuaga

SEQ ID NO: 653143 - RNA, 22 nt, Human
cacuguaagaugagcuuuuuua

SEQ ID NO: 653144 - RNA, 22 nt, Human
aggcuggcugacuucugaagca

SEQ ID NO: 653145 - RNA, 22 nt, Human
ggggaggagccauguaacuagu

SEQ ID NO: 653146 - RNA, 22 nt, Human
gaccucaguauuguucaggaug

SEQ ID NO: 653147 - RNA, 22 nt, Human
uauauuaucauaaaaccauuca

SEQ ID NO: 653148 - RNA, 22 nt, Human
cuuaacagcaagaucuguguca

SEQ ID NO: 653149 - RNA, 22 nt, Human
ucauuccauuuccagcucugaa

SEQ ID NO: 653150 - RNA, 22 nt, Human
ggugggcaacauuuggccugag

SEQ ID NO: 653151 - RNA, 22 nt, Human
cuucugccccuguagccugagu

SEQ ID NO: 653152 - RNA, 22 nt, Human
cuguugcaucauggcucuuaau

SEQ ID NO: 653153 - RNA, 22 nt, Human
aguggcaguggcugggcagagc

SEQ ID NO: 653154 - RNA, 22 nt, Human
gagauugggucuugcucuguca

SEQ ID NO: 653155 - RNA, 22 nt, Human
gccugggagcacaucggggucc

SEQ ID NO: 653156 - RNA, 22 nt, Human
cccugagaugccucacccuagu

SEQ ID NO: 653157 - RNA, 18 nt, Human
uggcagugccaccuucuc

SEQ ID NO: 653158 - RNA, 22 nt, Human
uauaggaaauaggucuucugug

SEQ ID NO: 653159 - RNA, 22 nt, Human
ggcucuggggggaagucuguug

SEQ ID NO: 653160 - RNA, 22 nt, Human
uuuaaagugguccauuucagaa

SEQ ID NO: 653161 - RNA, 21 nt, Human
ggucagcucuauccacgccuu

SEQ ID NO: 653162 - RNA, 22 nt, Human
cuugaaagcacuuaguaaauua

SEQ ID NO: 653163 - RNA, 22 nt, Human
gcacauccaaugauuguuuuga

SEQ ID NO: 653164 - RNA, 19 nt, Human
uccaggcuccauuggcaga

SEQ ID NO: 653165 - RNA, 22 nt, Human
uacacaguaaaugguaaauaca

SEQ ID NO: 653166 - RNA, 22 nt, Human
ugggcaugaguggacagagaag

SEQ ID NO: 653167 - RNA, 20 nt, Human
gugcauuucaccuguacugu

SEQ ID NO: 653168 - RNA, 22 nt, Human
ggaggcucugccaucugucaca

SEQ ID NO: 653169 - RNA, 22 nt, Human
cgugaaaugaguugaauuauug

SEQ ID NO: 653170 - RNA, 18 nt, Human
ccuggcuuccaucuuggu

SEQ ID NO: 653171 - RNA, 22 nt, Human
augcucaguagcuggcugaccc

SEQ ID NO: 653172 - RNA, 22 nt, Human
aaccugagcgcguugcuuucua

SEQ ID NO: 653173 - RNA, 22 nt, Human
ugugucuuacauaauuacaugu

SEQ ID NO: 653174 - RNA, 22 nt, Human
agaucaguaagaggaagaaugg

SEQ ID NO: 653175 - RNA, 22 nt, Human
aauaaaggcaccauaaggcaaa

SEQ ID NO: 653176 - RNA, 22 nt, Human
ggacacaaaagugaauaaaaua

SEQ ID NO: 653177 - RNA, 22 nt, Human
ggagaggacauggcucccacag

SEQ ID NO: 653178 - RNA, 22 nt, Human
gcagggaagggaaacagagacc

SEQ ID NO: 653179 - RNA, 22 nt, Human
ggcagcaggcgacuucccuauu

SEQ ID NO: 653180 - RNA, 22 nt, Human
gcuuaauucuggcucaguuucc

SEQ ID NO: 653181 - RNA, 22 nt, Human
caaaauguucuggcaccuuuaa

SEQ ID NO: 653182 - RNA, 22 nt, Human
ucccuugguuaaauauguagga

SEQ ID NO: 653183 - RNA, 22 nt, Human
agaauuagaggccauguacuug

SEQ ID NO: 653184 - RNA, 19 nt, Human
ucaaugucuggccaauggu

SEQ ID NO: 653185 - RNA, 22 nt, Human
ucaggcucccugcugggcucug

SEQ ID NO: 653186 - RNA, 22 nt, Human
agaggcugauggaguagugucu

SEQ ID NO: 653187 - RNA, 22 nt, Human
aaugcacacauuugguacugaa

SEQ ID NO: 653188 - RNA, 22 nt, Human
aaaccucuuuuaaggaguuguu

SEQ ID NO: 653189 - RNA, 22 nt, Human
uucuacaucacuuaacaugcua

SEQ ID NO: 653190 - RNA, 22 nt, Human
uaagaggcaaaagauacucaga

SEQ ID NO: 653191 - RNA, 23 nt, Human
ccugacacaaaaggauucuugcu

SEQ ID NO: 653192 - RNA, 22 nt, Human
gggcugaccccaccccucacuc

SEQ ID NO: 653193 - RNA, 22 nt, Human
gaccuucaagcaccauauuuau

SEQ ID NO: 653194 - RNA, 22 nt, Human
augucccaagauacagcuagag

SEQ ID NO: 653195 - RNA, 22 nt, Human
gugucuuagaaagacugaaugc

SEQ ID NO: 653196 - RNA, 22 nt, Human
caaaucauggaauaacuagaga

SEQ ID NO: 653197 - RNA, 22 nt, Human
ccagggugaggaggcucccacg

SEQ ID NO: 653198 - RNA, 22 nt, Human
uucuauugggcagcauugcuuc

SEQ ID NO: 653199 - RNA, 22 nt, Human
gaggccaggacaugaaagcuga

SEQ ID NO: 653200 - RNA, 22 nt, Human
uuggcuguuuuauaggucaguu

SEQ ID NO: 653201 - RNA, 22 nt, Human
gccacagugggcuggggccaga

SEQ ID NO: 653202 - RNA, 22 nt, Human
caucccugcugguggaaggggu

SEQ ID NO: 653203 - RNA, 16 nt, Human
agaggcuguaauggaa

SEQ ID NO: 653204 - RNA, 22 nt, Human
agcuguggcaaccuugucagac

SEQ ID NO: 653205 - RNA, 22 nt, Human
ggcuucuuccuggcuccuauua

SEQ ID NO: 653206 - RNA, 20 nt, Human
ucagaggcugccagcugggg

SEQ ID NO: 653207 - RNA, 21 nt, Human
cuggucuggccaauaaggucc

SEQ ID NO: 653208 - RNA, 22 nt, Human
cugcagucuuccuuccuuaggc

SEQ ID NO: 653209 - RNA, 22 nt, Human
ugccucugugggcagagcugcc

SEQ ID NO: 653210 - RNA, 22 nt, Human
ucucugccaccaugagaugggc

SEQ ID NO: 653211 - RNA, 22 nt, Human
caggccacacggcggcucccug

SEQ ID NO: 653212 - RNA, 22 nt, Human
ccccagggaagcuuugcuuacu

SEQ ID NO: 653213 - RNA, 22 nt, Human
uagaugauuuucagucaaagca

SEQ ID NO: 653214 - RNA, 22 nt, Human
ccaggguaccccaagggcaggu

SEQ ID NO: 653215 - RNA, 22 nt, Human
uagagguagauggucagccaau

SEQ ID NO: 653216 - RNA, 22 nt, Human
gagacuuuuuaaucacuaggaa

SEQ ID NO: 653217 - RNA, 22 nt, Human
gaaagugccucaguccucuuau

SEQ ID NO: 653218 - RNA, 22 nt, Human
auucacagagugguuaguggua

SEQ ID NO: 653219 - RNA, 22 nt, Human
ucagcagaggggaaggcaucug

SEQ ID NO: 653220 - RNA, 22 nt, Human
gagcucugcggaaaacgugccg

SEQ ID NO: 653221 - RNA, 22 nt, Human
guacaguacuucagaaccagcc

SEQ ID NO: 653222 - RNA, 22 nt, Human
uccucacagaugggugcauagc

SEQ ID NO: 653223 - RNA, 22 nt, Human
ugcuuucauugccugcgguuuu

SEQ ID NO: 653224 - RNA, 22 nt, Human
uccauagugaauggguaaugca

SEQ ID NO: 653225 - RNA, 22 nt, Human
aaguacauauauuuaugauucu

SEQ ID NO: 653226 - RNA, 22 nt, Human
ugggaccucucuugagagagca

SEQ ID NO: 653227 - RNA, 22 nt, Human
uccagcuccacagccucccugu

SEQ ID NO: 653228 - RNA, 22 nt, Human
gcuggugugugaaccuagggac

SEQ ID NO: 653229 - RNA, 22 nt, Human
accaggaggcuacacuguccca

SEQ ID NO: 653230 - RNA, 22 nt, Human
cuauugaauuaacuauuaaagu

SEQ ID NO: 653231 - RNA, 22 nt, Human
aaaugguaaugucuuucuguuu

SEQ ID NO: 653232 - RNA, 22 nt, Human
ggggcagagcauagcuccaauu

SEQ ID NO: 653233 - RNA, 22 nt, Human
agguucaaaugcaagagaugcu

SEQ ID NO: 653234 - RNA, 23 nt, Human
uggcucucucagugcugcagagg

SEQ ID NO: 653235 - RNA, 22 nt, Human
gugugcagaagacacaagacau

SEQ ID NO: 653236 - RNA, 22 nt, Human
ucugggagagcacguggcugac

SEQ ID NO: 653237 - RNA, 22 nt, Human
uuuacuaagcccaguuauaugc

SEQ ID NO: 653238 - RNA, 22 nt, Human
agcagccaaaugaagauuuuac

SEQ ID NO: 653239 - RNA, 22 nt, Human
gagaaccucuccacaagucugg

SEQ ID NO: 653240 - RNA, 22 nt, Human
uuccauauguauauagcuguua

SEQ ID NO: 653241 - RNA, 22 nt, Human
uuauucuguagaaccuaguaca

SEQ ID NO: 653242 - RNA, 22 nt, Human
guaacacuagcucugucacuuu

SEQ ID NO: 653243 - RNA, 22 nt, Human
aggggcaguuccaaguuuugug

SEQ ID NO: 653244 - RNA, 21 nt, Human
agaugcaguuugcaggugggu

SEQ ID NO: 653245 - RNA, 22 nt, Human
auuucauggcagacuuuaaccc

SEQ ID NO: 653246 - RNA, 22 nt, Human
cugaggcuuugugugcaugccu

SEQ ID NO: 653247 - RNA, 19 nt, Human
acagggcuuggccugacau

SEQ ID NO: 653248 - RNA, 22 nt, Human
uuccaugagcucugaguucaca

SEQ ID NO: 653249 - RNA, 22 nt, Human
ucuugggagucccaggacauag

SEQ ID NO: 653250 - RNA, 22 nt, Human
agaaacugacaggaaaugaauu

SEQ ID NO: 653251 - RNA, 22 nt, Human
aacugcaaagccaaucucagga

SEQ ID NO: 653252 - RNA, 22 nt, Human
ucugggagcagcucagcagauu

SEQ ID NO: 653253 - RNA, 22 nt, Human
ccuggguggcagagguugcagu

SEQ ID NO: 653254 - RNA, 22 nt, Human
guagcuuauuagggauaauagu

SEQ ID NO: 653255 - RNA, 22 nt, Human
agauaugucccugucuaauauu

SEQ ID NO: 653256 - RNA, 22 nt, Human
gcccauggcuucccuaggcaca

SEQ ID NO: 653257 - RNA, 22 nt, Human
uguccuggugcuucuugggauu

SEQ ID NO: 653258 - RNA, 22 nt, Human
gaguuuaaauaacacauuucca

SEQ ID NO: 653259 - RNA, 22 nt, Human
aaccugaagaaaauauuugcug

SEQ ID NO: 653260 - RNA, 20 nt, Human
uaugaguauuacuuucagga

SEQ ID NO: 653261 - RNA, 21 nt, Human
ccucugugcuaaagggcuccc

SEQ ID NO: 653262 - RNA, 22 nt, Human
uacauguucaaauuugucuuuc

SEQ ID NO: 653263 - RNA, 22 nt, Human
caggcuuccgccagguuuccag

SEQ ID NO: 653264 - RNA, 22 nt, Human
cuccuccacuaggcaaaaugug

SEQ ID NO: 653265 - RNA, 22 nt, Human
cugcccugccuggccagugugg

SEQ ID NO: 653266 - RNA, 22 nt, Human
ucugacuugcaucuuaaaggag

SEQ ID NO: 653267 - RNA, 21 nt, Human
acagaaguggcuuggucucag

SEQ ID NO: 653268 - RNA, 22 nt, Human
uguacaaugccagggaacacca

SEQ ID NO: 653269 - RNA, 22 nt, Human
uuugcuuucuugauucagauua

SEQ ID NO: 653270 - RNA, 22 nt, Human
aggggugauuugggacaggaca

SEQ ID NO: 653271 - RNA, 22 nt, Human
auauuuucacugaaccaaagua

SEQ ID NO: 653272 - RNA, 22 nt, Human
ugauauuuaagcaaaaauaugg

SEQ ID NO: 653273 - RNA, 22 nt, Human
auauuacuuccugguauaaaau

SEQ ID NO: 653274 - RNA, 20 nt, Human
cgcagcaguggaaguggaau

SEQ ID NO: 653275 - RNA, 22 nt, Human
uucaugaauauauugaauuagc

SEQ ID NO: 653276 - RNA, 22 nt, Human
uacagucagagugccuuucuaa

SEQ ID NO: 653277 - RNA, 22 nt, Human
ugcuauaagaauuauauuacuc

SEQ ID NO: 653278 - RNA, 22 nt, Human
cugagcugaaacuugagaggcu

SEQ ID NO: 653279 - RNA, 19 nt, Human
uccaauuucuauucauguu

SEQ ID NO: 653280 - RNA, 22 nt, Human
gggguggaucaggcaggcccag

SEQ ID NO: 653281 - RNA, 20 nt, Human
gucuccacuggggguuaacc

SEQ ID NO: 653282 - RNA, 22 nt, Human
uuauucagcauuuagaggaagg

SEQ ID NO: 653283 - RNA, 22 nt, Human
ugagauaacauggaagaguagc

SEQ ID NO: 653284 - RNA, 22 nt, Human
ucacauuucucagcacugauga

SEQ ID NO: 653285 - RNA, 22 nt, Human
ugucauuuaugcuucuucagug

SEQ ID NO: 653286 - RNA, 22 nt, Human
acauuucagaaucacacagcuu

SEQ ID NO: 653287 - RNA, 22 nt, Human
uggcagagacuccuccugggag

SEQ ID NO: 653288 - RNA, 22 nt, Human
ugcuucuguuuguuucugucau

SEQ ID NO: 653289 - RNA, 22 nt, Human
cuccagccagagugccucuguu

SEQ ID NO: 653290 - RNA, 22 nt, Human
cugcagguugagcagccagguu

SEQ ID NO: 653291 - RNA, 22 nt, Human
uugagaaaacacagaguuuauu

SEQ ID NO: 653292 - RNA, 22 nt, Human
uccaggcaugguguaauuuugc

SEQ ID NO: 653293 - RNA, 22 nt, Human
ugugcugugggacucaggcucc

SEQ ID NO: 653294 - RNA, 22 nt, Human
gcuuuagauagauuuagucuuu

SEQ ID NO: 653295 - RNA, 22 nt, Human
auggcauuauagcaaugguuug

SEQ ID NO: 653296 - RNA, 22 nt, Human
uuauaugaacuggacuuuagga

SEQ ID NO: 653297 - RNA, 22 nt, Human
acaaaagaauaagaugagucau

SEQ ID NO: 653298 - RNA, 22 nt, Human
ggcuccagcuaaugguuucuau

SEQ ID NO: 653299 - RNA, 22 nt, Human
auuucugauacccggucacccu

SEQ ID NO: 653300 - RNA, 22 nt, Human
cugagccuugaugucccuuguc

SEQ ID NO: 653301 - RNA, 23 nt, Human
uggcugagauccuacuguuugcu

SEQ ID NO: 653302 - RNA, 22 nt, Human
ccagaggagggcucugaugagg

SEQ ID NO: 653303 - RNA, 22 nt, Human
aauguuuuuuggucugaugaau

SEQ ID NO: 653304 - RNA, 21 nt, Human
aagaagcaauuuauuggaagg

SEQ ID NO: 653305 - RNA, 22 nt, Human
gcccucugcucagcuccucagc

SEQ ID NO: 653306 - RNA, 20 nt, Human
gccuggcacccggggcuggc

SEQ ID NO: 653307 - RNA, 22 nt, Human
ucagguccucugggucccagcc

SEQ ID NO: 653308 - RNA, 21 nt, Human
auacacauacacauaaaugug

SEQ ID NO: 653309 - RNA, 22 nt, Human
ugauugcuucuuugcuaucugu

SEQ ID NO: 653310 - RNA, 22 nt, Human
auuucuguuugcuacuauaagu

SEQ ID NO: 653311 - RNA, 22 nt, Human
cagggaguuuuuguuccucuag

SEQ ID NO: 653312 - RNA, 22 nt, Human
ggcagaggaagcuggaaguggg

SEQ ID NO: 653313 - RNA, 22 nt, Human
cagggcuggcuuccaaguuguu

SEQ ID NO: 653314 - RNA, 22 nt, Human
uguauuaugauuguuguucaug

SEQ ID NO: 653315 - RNA, 22 nt, Human
uucugcuuuucucugucugagu

SEQ ID NO: 653316 - RNA, 22 nt, Human
uuucaguugcagugguugucua

SEQ ID NO: 653317 - RNA, 22 nt, Human
cacagaaucauauugucaguuu

SEQ ID NO: 653318 - RNA, 22 nt, Human
agaaggaaggauaacugcauua

SEQ ID NO: 653319 - RNA, 17 nt, Human
ccucccacaccgcccug

SEQ ID NO: 653320 - RNA, 22 nt, Human
guuuuauaggugaaauauuacu

SEQ ID NO: 653321 - RNA, 22 nt, Human
augcuguuaagauaauggguuc

SEQ ID NO: 653322 - RNA, 22 nt, Human
auuucucauuuugcuucaaagg

SEQ ID NO: 653323 - RNA, 22 nt, Human
cucucugggaauauuuuauucu

SEQ ID NO: 653324 - RNA, 22 nt, Human
gcuguguccucacacagccuuu

SEQ ID NO: 653325 - RNA, 22 nt, Human
cagggccuccccggcagucuuu

SEQ ID NO: 653326 - RNA, 22 nt, Human
acuuguuugccuaaaauuuuga

SEQ ID NO: 653327 - RNA, 22 nt, Human
ccaggaagcugucugauaugaa

SEQ ID NO: 653328 - RNA, 22 nt, Human
gcuuuacugagaugacacaggg

SEQ ID NO: 653329 - RNA, 22 nt, Human
uuguacauucugaaucuguccu

SEQ ID NO: 653330 - RNA, 22 nt, Human
uagggcuauucugaguaauaau

SEQ ID NO: 653331 - RNA, 22 nt, Human
uucauauugcuuccguggagug

SEQ ID NO: 653332 - RNA, 22 nt, Human
aaugucauuuaaaauaauucug

SEQ ID NO: 653333 - RNA, 22 nt, Human
guaaggcuaaugucuuuguggu

SEQ ID NO: 653334 - RNA, 22 nt, Human
uacacaguagaguauaaugcgu

SEQ ID NO: 653335 - RNA, 22 nt, Human
cuuagaaauaaugguuucaguu

SEQ ID NO: 653336 - RNA, 20 nt, Human
agcaccagugggggcagccc

SEQ ID NO: 653337 - RNA, 22 nt, Human
gacccuuagaaugugaucuuau

SEQ ID NO: 653338 - RNA, 22 nt, Human
ccugccugacagagaagguuca

SEQ ID NO: 653339 - RNA, 22 nt, Human
uccacugugcagcucugcugau

SEQ ID NO: 653340 - RNA, 22 nt, Human
uagaaucugaauauucuuauuu

SEQ ID NO: 653341 - RNA, 22 nt, Human
aacagcagggggaccugcuggu

SEQ ID NO: 653342 - RNA, 22 nt, Human
uguuaugaguccucauauacua

SEQ ID NO: 653343 - RNA, 22 nt, Human
uguuaauauacuaaaauccacu

SEQ ID NO: 653344 - RNA, 22 nt, Human
cacucugagaaguacaagcucc

SEQ ID NO: 653345 - RNA, 22 nt, Human
uuagggaaggacagugaagaaa

SEQ ID NO: 653346 - RNA, 22 nt, Human
auacaguaauugcauaggcuuc

SEQ ID NO: 653347 - RNA, 22 nt, Human
auguguccacaggugugagaga

SEQ ID NO: 653348 - RNA, 22 nt, Human
agacacugcggaggucgggugg

SEQ ID NO: 653349 - RNA, 22 nt, Human
uaaacaauuccucucuaggcau

SEQ ID NO: 653350 - RNA, 22 nt, Human
ccuguguuaguuaugggucucu

SEQ ID NO: 653351 - RNA, 22 nt, Human
guauuugucuuguuggucucca

SEQ ID NO: 653352 - RNA, 22 nt, Human
aucaguuugauaauaaggcuug

SEQ ID NO: 653353 - RNA, 22 nt, Human
auaauuuacaacugcuuuuaau

SEQ ID NO: 653354 - RNA, 22 nt, Human
aacaaaggccguuaauaaccac

SEQ ID NO: 653355 - RNA, 22 nt, Human
gcauuuagcuuuaaaauauuuc

SEQ ID NO: 653356 - RNA, 20 nt, Human
gucucaaguaucucacaguc

SEQ ID NO: 653357 - RNA, 22 nt, Human
uggcucaguuugggggauugaa

SEQ ID NO: 653358 - RNA, 22 nt, Human
augaggucuuauugcaguaguu

SEQ ID NO: 653359 - RNA, 22 nt, Human
aagaacaugauggccaugugca

SEQ ID NO: 653360 - RNA, 22 nt, Human
uauugcuucauaauuguugcca

SEQ ID NO: 653361 - RNA, 22 nt, Human
ugucugugaccucuuuggagcc

SEQ ID NO: 653362 - RNA, 23 nt, Human
cagaagacagucucaagacaagg

SEQ ID NO: 653363 - RNA, 21 nt, Human
agguuucucuuuuauggaggg

SEQ ID NO: 653364 - RNA, 22 nt, Human
cuggcucaggguggucuggguc

SEQ ID NO: 653365 - RNA, 22 nt, Human
ccaggacuuauuacaguauaac

SEQ ID NO: 653366 - RNA, 22 nt, Human
ucuuuacuuguguauuguauau

SEQ ID NO: 653367 - RNA, 22 nt, Human
uugcaaggugauaaaagaauga

SEQ ID NO: 653368 - RNA, 22 nt, Human
uuuuuguguauccugcuccaug

SEQ ID NO: 653369 - RNA, 22 nt, Human
uucacauuuacugguuuguccg

SEQ ID NO: 653370 - RNA, 22 nt, Human
ucucugagcccaauguagcaau

SEQ ID NO: 653371 - RNA, 22 nt, Human
acagacagggcaccugccuccu

SEQ ID NO: 653372 - RNA, 22 nt, Human
uccaguguggaccccugcaguc

SEQ ID NO: 653373 - RNA, 22 nt, Human
uuaggcuguucuuguguuguua

SEQ ID NO: 653374 - RNA, 22 nt, Human
ggcaguggcagagcuuggucua

SEQ ID NO: 653375 - RNA, 22 nt, Human
cugucuguuuuguauacaggcc

SEQ ID NO: 653376 - RNA, 19 nt, Human
aggaauuucucagggaggc

SEQ ID NO: 653377 - RNA, 22 nt, Human
cagaauuuagaaaacaacauaa

SEQ ID NO: 653378 - RNA, 22 nt, Human
uguauuugaguuaugaaagaga

SEQ ID NO: 653379 - RNA, 22 nt, Human
gugcaauuuugcaucuguaugc

SEQ ID NO: 653380 - RNA, 22 nt, Human
ucacagaaugucagaguugggg

SEQ ID NO: 653381 - RNA, 22 nt, Human
cacagcugcccuacuccaugug

SEQ ID NO: 653382 - RNA, 22 nt, Human
augugucugguuauugacaugc

SEQ ID NO: 653383 - RNA, 22 nt, Human
agcucccagagcucgagaguaa

SEQ ID NO: 653384 - RNA, 22 nt, Human
gcugggcaagugccuuggguuu

SEQ ID NO: 653385 - RNA, 22 nt, Human
cagcugccacuugcucucggcu

SEQ ID NO: 653386 - RNA, 22 nt, Human
ccagcucccugaagccuggucu

SEQ ID NO: 653387 - RNA, 22 nt, Human
aagcacaucauguuguucagac

SEQ ID NO: 653388 - RNA, 22 nt, Human
ggauggguuccgugggcaaaug

SEQ ID NO: 653389 - RNA, 22 nt, Human
gcagagccagaauggccaggac

SEQ ID NO: 653390 - RNA, 22 nt, Human
ugaaaucaauugcaauguuuau

SEQ ID NO: 653391 - RNA, 22 nt, Human
uugcuucauauuuguggcuugc

SEQ ID NO: 653392 - RNA, 22 nt, Human
gaauguuugugcagagucaucu

SEQ ID NO: 653393 - RNA, 22 nt, Human
acauuugacauuuaguaucagc

SEQ ID NO: 653394 - RNA, 22 nt, Human
gcagcucuuuucuuaaagagau

SEQ ID NO: 653395 - RNA, 22 nt, Human
agcucccagucuccucuccaug

SEQ ID NO: 653396 - RNA, 21 nt, Human
cuggcucuguugucacccggc

SEQ ID NO: 653397 - RNA, 22 nt, Human
ucaggucugaugccucauccau

SEQ ID NO: 653398 - RNA, 22 nt, Human
uagauccugagcccuaucuacu

SEQ ID NO: 653399 - RNA, 22 nt, Human
uggucugauuuuucaucuguug

SEQ ID NO: 653400 - RNA, 18 nt, Human
agcuugccucaagcuuuu

SEQ ID NO: 653401 - RNA, 22 nt, Human
cuugcuuuaucugguuucucau

SEQ ID NO: 653402 - RNA, 22 nt, Human
aagcugagccaguggcaagugc

SEQ ID NO: 653403 - RNA, 22 nt, Human
ccagcagcagcguccaaggaga

SEQ ID NO: 653404 - RNA, 22 nt, Human
gagaugguuggguuaacaacua

SEQ ID NO: 653405 - RNA, 22 nt, Human
aggaagaauguuuacauaucaa

SEQ ID NO: 653406 - RNA, 20 nt, Human
aguguaugaacagaugcggg

SEQ ID NO: 653407 - RNA, 20 nt, Human
uggaccugucucuuuaggga

SEQ ID NO: 653408 - RNA, 23 nt, Human
ggagagcuccucgugacucacug

SEQ ID NO: 653409 - RNA, 22 nt, Human
caagcagacaguaggccuagaa

SEQ ID NO: 653410 - RNA, 22 nt, Human
gggcagcccagaacugcugcag

SEQ ID NO: 653411 - RNA, 22 nt, Human
gccucaaaaguguuguagaggg

SEQ ID NO: 653412 - RNA, 22 nt, Human
guuauugacucucuuguggcuu

SEQ ID NO: 653413 - RNA, 22 nt, Human
acauuucucuugaugucucuau

SEQ ID NO: 653414 - RNA, 22 nt, Human
agucaaagaagaugguuccaaa

SEQ ID NO: 653415 - RNA, 22 nt, Human
cucagcucugucacuuacuagc

SEQ ID NO: 653416 - RNA, 20 nt, Human
aaacgagccaucauucuggu

SEQ ID NO: 653417 - RNA, 22 nt, Human
cagugcuccugauguacccuug

SEQ ID NO: 653418 - RNA, 22 nt, Human
ucucagagggaggauuacugcc

SEQ ID NO: 653419 - RNA, 22 nt, Human
cugucaccuguucacugcagca

SEQ ID NO: 653420 - RNA, 23 nt, Human
gaaucaguggcuaacaaggaaac

SEQ ID NO: 653421 - RNA, 22 nt, Human
ccaaaggccaggcacugagguu

SEQ ID NO: 653422 - RNA, 22 nt, Human
cagcacuaggauauacauuucc

SEQ ID NO: 653423 - RNA, 22 nt, Human
uucacaguggcccucucugagu

SEQ ID NO: 653424 - RNA, 22 nt, Human
uuuuaucuucauuccuaucuac

SEQ ID NO: 653425 - RNA, 22 nt, Human
ggaggccucaucuugccccgug

SEQ ID NO: 653426 - RNA, 21 nt, Human
agacugccauuguucuuuugg

SEQ ID NO: 653427 - RNA, 21 nt, Human
acucaggcaccaggggauggc

SEQ ID NO: 653428 - RNA, 22 nt, Human
guggcagaagaguaggaugggc

SEQ ID NO: 653429 - RNA, 22 nt, Human
aaagcuagaaggaaauuuuaug

SEQ ID NO: 653430 - RNA, 22 nt, Human
aggcuggccuauuucuuuaucg

SEQ ID NO: 653431 - RNA, 22 nt, Human
aacuuauuccauaggcucacug

SEQ ID NO: 653432 - RNA, 22 nt, Human
cuacuuuaacaauucgcaagaa

SEQ ID NO: 653433 - RNA, 22 nt, Human
cagguaggcagccggucucugg

SEQ ID NO: 653434 - RNA, 22 nt, Human
ccaggucuggaaccaccagggc

SEQ ID NO: 653435 - RNA, 22 nt, Human
aggcaacaugacucacuugcac

SEQ ID NO: 653436 - RNA, 22 nt, Human
gccccucuccuugugcaccugc

SEQ ID NO: 653437 - RNA, 22 nt, Human
ugcagaggcauuuauugaugua

SEQ ID NO: 653438 - RNA, 22 nt, Human
gaauugcugaaucauauguuua

SEQ ID NO: 653439 - RNA, 22 nt, Human
acccagaggcggagguugcagu

SEQ ID NO: 653440 - RNA, 22 nt, Human
cuugucagccaauuguggauuu

SEQ ID NO: 653441 - RNA, 22 nt, Human
caaauaguuuuucauguauuau

SEQ ID NO: 653442 - RNA, 22 nt, Human
ucacauuuucuacuacuguacg

SEQ ID NO: 653443 - RNA, 22 nt, Human
uaaacugugaaaggcuuaacau

SEQ ID NO: 653444 - RNA, 22 nt, Human
caggacagaccaagaucgugcu

SEQ ID NO: 653445 - RNA, 22 nt, Human
cccaggagguagagguugcagu

SEQ ID NO: 653446 - RNA, 22 nt, Human
ugauugccuacuaugugccaug

SEQ ID NO: 653447 - RNA, 19 nt, Human
aaaugugcacuguuuucca

SEQ ID NO: 653448 - RNA, 22 nt, Human
uuucacaggaauacccggcuuu

SEQ ID NO: 653449 - RNA, 22 nt, Human
uggaggccgcguagucugagca

SEQ ID NO: 653450 - RNA, 22 nt, Human
uaaaccaaguguccauauuagu

SEQ ID NO: 653451 - RNA, 22 nt, Human
gugaggagucugaagcacauaa

SEQ ID NO: 653452 - RNA, 22 nt, Human
aacccugggucggcaccauuuu

SEQ ID NO: 653453 - RNA, 22 nt, Human
ucugccuggguguggagcagag

SEQ ID NO: 653454 - RNA, 22 nt, Human
ugauggauguggcucuggagcu

SEQ ID NO: 653455 - RNA, 22 nt, Human
aaucacaguggguacuagauug

SEQ ID NO: 653456 - RNA, 22 nt, Human
gaaaggcaucuucagucucuga

SEQ ID NO: 653457 - RNA, 22 nt, Human
caaggcaggccaguuucaaggc

SEQ ID NO: 653458 - RNA, 19 nt, Human
ucucugcagcgcgcccggc

SEQ ID NO: 653459 - RNA, 19 nt, Human
gcaucauuugucucuucuu

SEQ ID NO: 653460 - RNA, 22 nt, Human
ucuguggagugaccugggcuuu

SEQ ID NO: 653461 - RNA, 22 nt, Human
caggaggugacuuccagggguu

SEQ ID NO: 653462 - RNA, 22 nt, Human
uuugauucuggccucugagaag

SEQ ID NO: 653463 - RNA, 22 nt, Human
ugaugcugcugggaguggugcu

SEQ ID NO: 653464 - RNA, 20 nt, Human
cucaggauugucuagccccu

SEQ ID NO: 653465 - RNA, 22 nt, Human
ggagacagugacuuagagacug

SEQ ID NO: 653466 - RNA, 18 nt, Human
uccucucuuuccccaggg

SEQ ID NO: 653467 - RNA, 22 nt, Human
cuguuaaagauaguuaagcuuc

SEQ ID NO: 653468 - RNA, 22 nt, Human
caggcucugcugcuacagcugu

SEQ ID NO: 653469 - RNA, 18 nt, Human
cagucccaaaccuuagga

SEQ ID NO: 653470 - RNA, 22 nt, Human
gccccaccgagggugcaguccu

SEQ ID NO: 653471 - RNA, 22 nt, Human
gagagugaaggcuucccagcaa

SEQ ID NO: 653472 - RNA, 22 nt, Human
aaucucuugggaggaaugaauu

SEQ ID NO: 653473 - RNA, 22 nt, Human
acauugcugcauucuccuuccc

SEQ ID NO: 653474 - RNA, 22 nt, Human
gaugcugggaccacagaguguu

SEQ ID NO: 653475 - RNA, 22 nt, Human
ucaguaaacagguuuaaguccu

SEQ ID NO: 653476 - RNA, 22 nt, Human
augugugccugagugauggacu

SEQ ID NO: 653477 - RNA, 22 nt, Human
cuggugcuggcaacagaguagg

SEQ ID NO: 653478 - RNA, 22 nt, Human
uacaagacgagggaaguucuuu

SEQ ID NO: 653479 - RNA, 22 nt, Human
agggaagcaggaauagcucuga

SEQ ID NO: 653480 - RNA, 22 nt, Human
ugagcagaagcccuccuggacu

SEQ ID NO: 653481 - RNA, 22 nt, Human
gcucaaagaauauucagaauga

SEQ ID NO: 653482 - RNA, 22 nt, Human
uuuacucaaguaugcauuuaug

SEQ ID NO: 653483 - RNA, 22 nt, Human
ugauacuuuggagacuugagua

SEQ ID NO: 653484 - RNA, 22 nt, Human
uaauuuacagagauacagucag

SEQ ID NO: 653485 - RNA, 20 nt, Human
ucucaggccccaguuuucuu

SEQ ID NO: 653486 - RNA, 18 nt, Human
uccagcucugccacuuac

SEQ ID NO: 653487 - RNA, 22 nt, Human
uuucagagcucuaggcucucag

SEQ ID NO: 653488 - RNA, 22 nt, Human
cacagugagcugggcaucaguu

SEQ ID NO: 653489 - RNA, 22 nt, Human
uguguauucagcaagcgaaaca

SEQ ID NO: 653490 - RNA, 22 nt, Human
augcugucaguauuaugugcag

SEQ ID NO: 653491 - RNA, 22 nt, Human
ugaaggagcugauguaaggggu

SEQ ID NO: 653492 - RNA, 22 nt, Human
agccucaguuucaggccuccuc

SEQ ID NO: 653493 - RNA, 22 nt, Human
ucaaugacauuguaucagaguu

SEQ ID NO: 653494 - RNA, 22 nt, Human
uguguucugaaggagaagagug

SEQ ID NO: 653495 - RNA, 22 nt, Human
ccaaagaaacccaagcucaggg

SEQ ID NO: 653496 - RNA, 21 nt, Human
uauacaugugugcauacgugu

SEQ ID NO: 653497 - RNA, 15 nt, Human
uguuuaagccacauu

SEQ ID NO: 653498 - RNA, 22 nt, Human
aggcagguagaaggaucuuuau

SEQ ID NO: 653499 - RNA, 22 nt, Human
gugugugcaagagguuuauuga

SEQ ID NO: 653500 - RNA, 23 nt, Human
agaugucuuagaaacugaagcug

SEQ ID NO: 653501 - RNA, 22 nt, Human
uagaaaucauuuagaaguauug

SEQ ID NO: 653502 - RNA, 22 nt, Human
aggcagaauguuggaaaggaag

SEQ ID NO: 653503 - RNA, 22 nt, Human
cucuggcucugacaguugaucc

SEQ ID NO: 653504 - RNA, 22 nt, Human
aaucuuucaaauuucuuugggu

SEQ ID NO: 653505 - RNA, 22 nt, Human
ggggccagagaggacccaggug

SEQ ID NO: 653506 - RNA, 22 nt, Human
aggcagcccacaggacacagga

SEQ ID NO: 653507 - RNA, 22 nt, Human
uggccugaauuauggcagaucu

SEQ ID NO: 653508 - RNA, 22 nt, Human
agugcuuugguauagaacuauu

SEQ ID NO: 653509 - RNA, 22 nt, Human
caguacugcuugugggagcaga

SEQ ID NO: 653510 - RNA, 23 nt, Human
acucagugaagcaaacagauagu

SEQ ID NO: 653511 - RNA, 22 nt, Human
uuguccugcaaccucacauggc

SEQ ID NO: 653512 - RNA, 19 nt, Human
ucaguaacuuuuaagagga

SEQ ID NO: 653513 - RNA, 22 nt, Human
acacugcucacuucuucccuug

SEQ ID NO: 653514 - RNA, 17 nt, Human
agcacuaaaaugcuucc

SEQ ID NO: 653515 - RNA, 22 nt, Human
uuugagcuuguagcauugcuau

SEQ ID NO: 653516 - RNA, 22 nt, Human
acacuucaaagggugacuugau

SEQ ID NO: 653517 - RNA, 22 nt, Human
aaauacuguagauaauagaguu

SEQ ID NO: 653518 - RNA, 17 nt, Human
uauacacagacagacug

SEQ ID NO: 653519 - RNA, 22 nt, Human
accuggaagugggugcuauggc

SEQ ID NO: 653520 - RNA, 22 nt, Human
uaagugcaauguuuuacuuaaa

SEQ ID NO: 653521 - RNA, 22 nt, Human
guaugaaaauuguaaaguucuu

SEQ ID NO: 653522 - RNA, 22 nt, Human
cacaugggcuuagcaggcaggg

SEQ ID NO: 653523 - RNA, 22 nt, Human
guuuauauucaacggaguaucu

SEQ ID NO: 653524 - RNA, 17 nt, Human
gcccaggaaggacggcc

SEQ ID NO: 653525 - RNA, 22 nt, Human
aauguuuuaaaagagauugaga

SEQ ID NO: 653526 - RNA, 22 nt, Human
agacacuuggcagagagcuguu

SEQ ID NO: 653527 - RNA, 23 nt, Human
agcuguguggccuugggcaaguu

SEQ ID NO: 653528 - RNA, 22 nt, Human
acaguguuuaaaauaauaugcu

SEQ ID NO: 653529 - RNA, 18 nt, Human
ugcuuucuagcuucagau

SEQ ID NO: 653530 - RNA, 21 nt, Human
guugaauauccauguaugugu

SEQ ID NO: 653531 - RNA, 22 nt, Human
gaaaggaaauugagggacgcau

SEQ ID NO: 653532 - RNA, 22 nt, Human
gaggcucaaaccuggacagagc

SEQ ID NO: 653533 - RNA, 22 nt, Human
uacauucaacaugucacuaugu

SEQ ID NO: 653534 - RNA, 17 nt, Human
agccgggcauggaccag

SEQ ID NO: 653535 - RNA, 22 nt, Human
acaaauuuggugagaguaaaua

SEQ ID NO: 653536 - RNA, 22 nt, Human
uaggagcuauaaugugaagucu

SEQ ID NO: 653537 - RNA, 22 nt, Human
ccugcuuugagaugggcagcag

SEQ ID NO: 653538 - RNA, 22 nt, Human
agauuucccaaauacuuguuau

SEQ ID NO: 653539 - RNA, 22 nt, Human
cacgggcuguuuccaugcaaaa

SEQ ID NO: 653540 - RNA, 22 nt, Human
cuucagaagaaaagcagugugu

SEQ ID NO: 653541 - RNA, 22 nt, Human
gauugaaacauaggcagucgag

SEQ ID NO: 653542 - RNA, 22 nt, Human
ccaggcacgguggcucaugccu

SEQ ID NO: 653543 - RNA, 23 nt, Human
ugguaauagggagcagaagguag

SEQ ID NO: 653544 - RNA, 22 nt, Human
ggaaagauuugucacaugaaug

SEQ ID NO: 653545 - RNA, 22 nt, Human
uucauugaugugguuuaaugua

SEQ ID NO: 653546 - RNA, 22 nt, Human
uugcauugaugucuauacgcug

SEQ ID NO: 653547 - RNA, 22 nt, Human
gguaauaaaauugugucaaaca

SEQ ID NO: 653548 - RNA, 22 nt, Human
acuuuugugcaggucucuccca

SEQ ID NO: 653549 - RNA, 18 nt, Human
uggagucagugacaccag

SEQ ID NO: 653550 - RNA, 22 nt, Human
aaauuguaaugacuucacuuga

SEQ ID NO: 653551 - RNA, 22 nt, Human
ccugugggagggagcggcugga

SEQ ID NO: 653552 - RNA, 22 nt, Human
agcauuuccgcccucuucugcc

SEQ ID NO: 653553 - RNA, 22 nt, Human
uggucaaaugccaaucuguagu

SEQ ID NO: 653554 - RNA, 22 nt, Human
uagacacuguaugagcugggug

SEQ ID NO: 653555 - RNA, 22 nt, Human
ucagaucaggaugcagcaacau

SEQ ID NO: 653556 - RNA, 22 nt, Human
cuccugcaugcucacauaugcc

SEQ ID NO: 653557 - RNA, 22 nt, Human
cuaggcagacugagcucuaggg

SEQ ID NO: 653558 - RNA, 22 nt, Human
uguauuuauucuucugguguuu

SEQ ID NO: 653559 - RNA, 22 nt, Human
uguuuucuguguagagaucaca

SEQ ID NO: 653560 - RNA, 22 nt, Human
auuuugaaucaccuuggaagaa

SEQ ID NO: 653561 - RNA, 22 nt, Human
agcugcugcgccucacccuggc

SEQ ID NO: 653562 - RNA, 22 nt, Human
gacuuugacgaaagagucauua

SEQ ID NO: 653563 - RNA, 22 nt, Human
ugccagcuacucuguaggcuga

SEQ ID NO: 653564 - RNA, 19 nt, Human
uccaaagaaguucacauuu

SEQ ID NO: 653565 - RNA, 23 nt, Human
cagaggcaucggauucaacauca

SEQ ID NO: 653566 - RNA, 20 nt, Human
ccagaggguagggccgcccc

SEQ ID NO: 653567 - RNA, 22 nt, Human
aacugcuucuuacugcugggca

SEQ ID NO: 653568 - RNA, 23 nt, Human
uaguguauaucaacauuuguccc

SEQ ID NO: 653569 - RNA, 22 nt, Human
agaagccagaggcaguggguac

SEQ ID NO: 653570 - RNA, 22 nt, Human
aaaguaagaccaagugaucauu

SEQ ID NO: 653571 - RNA, 22 nt, Human
agaaacauccugcuuuccauuu

SEQ ID NO: 653572 - RNA, 22 nt, Human
gugacucuacuuaagauuaagc

SEQ ID NO: 653573 - RNA, 22 nt, Human
uguggggaggcugcagugcugc

SEQ ID NO: 653574 - RNA, 22 nt, Human
ccuggcagcgugccgagcugcg

SEQ ID NO: 653575 - RNA, 22 nt, Human
ccagaugucugagccacacucc

SEQ ID NO: 653576 - RNA, 22 nt, Human
aagaaucaucugaacuuugagg

SEQ ID NO: 653577 - RNA, 22 nt, Human
uugaaaacauuuauauuagaau

SEQ ID NO: 653578 - RNA, 21 nt, Human
ugagggguuauaacagggugg

SEQ ID NO: 653579 - RNA, 22 nt, Human
cuagccagacucaagggccacc

SEQ ID NO: 653580 - RNA, 22 nt, Human
aggugccacucucaugggcuac

SEQ ID NO: 653581 - RNA, 22 nt, Human
uuaggaaucaaauuccgaaagg

SEQ ID NO: 653582 - RNA, 22 nt, Human
cggagcuggcgucuguguggac

SEQ ID NO: 653583 - RNA, 22 nt, Human
gucaucuucgcagagugauuuu

SEQ ID NO: 653584 - RNA, 22 nt, Human
ucacuggugugagaggagcaaa

SEQ ID NO: 653585 - RNA, 22 nt, Human
cuauuauuagauaaucuacuug

SEQ ID NO: 653586 - RNA, 22 nt, Human
ugcuucaggaagaaacgccagg

SEQ ID NO: 653587 - RNA, 22 nt, Human
uccagagcuaauucagcagcug

SEQ ID NO: 653588 - RNA, 22 nt, Human
uaacagagauagaaauguaaag

SEQ ID NO: 653589 - RNA, 22 nt, Human
aguguuugagacacauuucacu

SEQ ID NO: 653590 - RNA, 22 nt, Human
agugcauagggggaugcacagc

SEQ ID NO: 653591 - RNA, 22 nt, Human
uggaggcaggagacagggcaaa

SEQ ID NO: 653592 - RNA, 22 nt, Human
uggcuggaugugagaucaagag

SEQ ID NO: 653593 - RNA, 22 nt, Human
accaggcaacugugaaugggcu

SEQ ID NO: 653594 - RNA, 22 nt, Human
ggcagguacagcaagaggacaa

SEQ ID NO: 653595 - RNA, 22 nt, Human
ucagugcacaaugacgguggcu

SEQ ID NO: 653596 - RNA, 22 nt, Human
gaggaguggaguugcuggguug

SEQ ID NO: 653597 - RNA, 22 nt, Human
aauuuauuauauccuaggggaa

SEQ ID NO: 653598 - RNA, 22 nt, Human
cuagagggauguuaggauagca

SEQ ID NO: 653599 - RNA, 22 nt, Human
cccccaaaguuugcacggauaa

SEQ ID NO: 653600 - RNA, 22 nt, Human
aaagucauggaaaaucuuggaa

SEQ ID NO: 653601 - RNA, 22 nt, Human
uugauucugaugaaaguccauu

SEQ ID NO: 653602 - RNA, 22 nt, Human
ggcuucucucccccagcuccac

SEQ ID NO: 653603 - RNA, 22 nt, Human
cuccugagcugcagccuugugu

SEQ ID NO: 653604 - RNA, 22 nt, Human
gcucuguggcaggaggucuugu

SEQ ID NO: 653605 - RNA, 18 nt, Human
ucacucauagacaucuau

SEQ ID NO: 653606 - RNA, 22 nt, Human
uguuggcagauugucuaggguu

SEQ ID NO: 653607 - RNA, 22 nt, Human
ugcauuaaaaccaucgaccauc

SEQ ID NO: 653608 - RNA, 22 nt, Human
augcagaaggagccaugcuugc

SEQ ID NO: 653609 - RNA, 22 nt, Human
ugcuggcuuuuugguccuugcu

SEQ ID NO: 653610 - RNA, 22 nt, Human
uuaaacaccacagcagucccua

SEQ ID NO: 653611 - RNA, 22 nt, Human
gcugugcuugcaugagugucug

SEQ ID NO: 653612 - RNA, 21 nt, Human
uagcacuucgcuguaauuggg

SEQ ID NO: 653613 - RNA, 22 nt, Human
uagcugugagcacccaggcugu

SEQ ID NO: 653614 - RNA, 22 nt, Human
uuguuauuuacaacaauccuau

SEQ ID NO: 653615 - RNA, 22 nt, Human
ggggucaagcucagaauccuag

SEQ ID NO: 653616 - RNA, 19 nt, Human
uggaggagaggaaaaguca

SEQ ID NO: 653617 - RNA, 23 nt, Human
ugugucuguuuagggaggaugug

SEQ ID NO: 653618 - RNA, 22 nt, Human
ucacauuuguguuuuauuagag

SEQ ID NO: 653619 - RNA, 22 nt, Human
uuauuguuaggcuuuuggaauu

SEQ ID NO: 653620 - RNA, 22 nt, Human
aagcagcaugcuaugcuggugg

SEQ ID NO: 653621 - RNA, 22 nt, Human
cacaggcacgccucuggccagg

SEQ ID NO: 653622 - RNA, 22 nt, Human
cauuucuacagcuucuucagaa

SEQ ID NO: 653623 - RNA, 22 nt, Human
agggacaguuacaucaucagac

SEQ ID NO: 653624 - RNA, 22 nt, Human
ggggcgcucggagggauccccu

SEQ ID NO: 653625 - RNA, 22 nt, Human
ucauuuuucucuuacacguaga

SEQ ID NO: 653626 - RNA, 23 nt, Human
aaugcauuaauuugggagaguac

SEQ ID NO: 653627 - RNA, 22 nt, Human
ccuggacucaggcugugggcac

SEQ ID NO: 653628 - RNA, 22 nt, Human
ggaauucugcauguucaguugg

SEQ ID NO: 653629 - RNA, 22 nt, Human
auauuuaacuggucccaauaua

SEQ ID NO: 653630 - RNA, 22 nt, Human
cagcuuugucauuugauuuggg

SEQ ID NO: 653631 - RNA, 22 nt, Human
cugaaaaauauguuuuggagaa

SEQ ID NO: 653632 - RNA, 22 nt, Human
caucagucagucucuucaguau

SEQ ID NO: 653633 - RNA, 22 nt, Human
agaguggagagaaacaacucug

SEQ ID NO: 653634 - RNA, 22 nt, Human
auucuggacaaugagaaacugg

SEQ ID NO: 653635 - RNA, 22 nt, Human
gucaaacauagggacuuugugg

SEQ ID NO: 653636 - RNA, 22 nt, Human
augguuuguguggcccagauga

SEQ ID NO: 653637 - RNA, 22 nt, Human
ccaggcucacagcaucccagga

SEQ ID NO: 653638 - RNA, 22 nt, Human
acccacacaucucuaauucagu

SEQ ID NO: 653639 - RNA, 22 nt, Human
uucugucaugcucauguaauug

SEQ ID NO: 653640 - RNA, 22 nt, Human
ugaaagaagccucccuuuggag

SEQ ID NO: 653641 - RNA, 22 nt, Human
uuaaaagaauccuguuauccuc

SEQ ID NO: 653642 - RNA, 22 nt, Human
auaaaaugguaaacgaagcuga

SEQ ID NO: 653643 - RNA, 22 nt, Human
uguugauuugugggcugcaaaa

SEQ ID NO: 653644 - RNA, 22 nt, Human
aaugccuuggagagccuagagg

SEQ ID NO: 653645 - RNA, 23 nt, Human
ccagugugguagguccacaggug

SEQ ID NO: 653646 - RNA, 22 nt, Human
ugaggcaaagacaaagcagcau

SEQ ID NO: 653647 - RNA, 22 nt, Human
uuugauaguugauuaaauucca

SEQ ID NO: 653648 - RNA, 22 nt, Human
augggaagugaagucagggagg

SEQ ID NO: 653649 - RNA, 22 nt, Human
uauuguauuaaggauucaagua

SEQ ID NO: 653650 - RNA, 22 nt, Human
accuccccacaugguagugagu

SEQ ID NO: 653651 - RNA, 22 nt, Human
uguccucaggaccuggcacagu

SEQ ID NO: 653652 - RNA, 22 nt, Human
uacagucaauacuaggaccaua

SEQ ID NO: 653653 - RNA, 22 nt, Human
aagagaagaaagugucuacaca

SEQ ID NO: 653654 - RNA, 22 nt, Human
ccugccuggcuuccagaagaga

SEQ ID NO: 653655 - RNA, 22 nt, Human
ggccacacucugguagagguga

SEQ ID NO: 653656 - RNA, 22 nt, Human
uuagaacugaagaagauuaagg

SEQ ID NO: 653657 - RNA, 22 nt, Human
uccuccagucuuggugagguug

SEQ ID NO: 653658 - RNA, 22 nt, Human
ucacaguacugugacuauugac

SEQ ID NO: 653659 - RNA, 22 nt, Human
ugagcuucaaaguuggaucuga

SEQ ID NO: 653660 - RNA, 22 nt, Human
uuccugggacuggagcagccca

SEQ ID NO: 653661 - RNA, 23 nt, Human
agcacaucaaagcagggaggaga

SEQ ID NO: 653662 - RNA, 22 nt, Human
agacuacauaugccacaugaag

SEQ ID NO: 653663 - RNA, 22 nt, Human
agcucccauuaucuucugaaac

SEQ ID NO: 653664 - RNA, 22 nt, Human
ucucucugugacagcuuugcug

SEQ ID NO: 653665 - RNA, 22 nt, Human
ugagaaagccuuuagucccagg

SEQ ID NO: 653666 - RNA, 22 nt, Human
uugaaaaguuuugaaacacucu

SEQ ID NO: 653667 - RNA, 22 nt, Human
cacuccuguuccacuaaaugag

SEQ ID NO: 653668 - RNA, 22 nt, Human
auauuuuguaacuuggaauagg

SEQ ID NO: 653669 - RNA, 22 nt, Human
uagggaaauauagauuuagggc

SEQ ID NO: 653670 - RNA, 22 nt, Human
aaggcaguacuuuauguccaua

SEQ ID NO: 653671 - RNA, 22 nt, Human
ggcaaacagacuugaccaucuu

SEQ ID NO: 653672 - RNA, 22 nt, Human
auccugggaaugggagggucau

SEQ ID NO: 653673 - RNA, 22 nt, Human
aaucuguuuuaucauuuguuac

SEQ ID NO: 653674 - RNA, 22 nt, Human
uuuaaauguuuaaaacucguga

SEQ ID NO: 653675 - RNA, 17 nt, Human
ugaauucaaucugcacu

SEQ ID NO: 653676 - RNA, 20 nt, Human
ugccugggaaggcguggagg

SEQ ID NO: 653677 - RNA, 23 nt, Human
caaaaugcuaugugcccaaugca

SEQ ID NO: 653678 - RNA, 22 nt, Human
caggaggaaaguuccacucaac

SEQ ID NO: 653679 - RNA, 22 nt, Human
uucuggcuuaguuguuguauau

SEQ ID NO: 653680 - RNA, 22 nt, Human
ugcuucugucucuuaugccuug

SEQ ID NO: 653681 - RNA, 22 nt, Human
cugcuccuccccaucaggcagc

SEQ ID NO: 653682 - RNA, 22 nt, Human
uuacaugacugcccuugucagg

SEQ ID NO: 653683 - RNA, 22 nt, Human
ucaguuucuaaaucuuaccaau

SEQ ID NO: 653684 - RNA, 22 nt, Human
auuacaguggguaaacagaauu

SEQ ID NO: 653685 - RNA, 22 nt, Human
uugagcauuuguuuugaaagag

SEQ ID NO: 653686 - RNA, 22 nt, Human
uacaguaaccagucuacuuaga

SEQ ID NO: 653687 - RNA, 21 nt, Human
uucucuggcuucuguagcugg

SEQ ID NO: 653688 - RNA, 22 nt, Human
aucugcuucagugauaugugaa

SEQ ID NO: 653689 - RNA, 22 nt, Human
acuguccugaauacugcaugac

SEQ ID NO: 653690 - RNA, 22 nt, Human
acuuucuuggucccauguuuga

SEQ ID NO: 653691 - RNA, 22 nt, Human
uaacauuagguagacauaagcc

SEQ ID NO: 653692 - RNA, 22 nt, Human
caggagcuucugcccauggcca

SEQ ID NO: 653693 - RNA, 22 nt, Human
gcagcagugugggcugaaccua

SEQ ID NO: 653694 - RNA, 22 nt, Human
ggcccagugcuguucacccagu

SEQ ID NO: 653695 - RNA, 22 nt, Human
ugagcuagggcuggugaggagc

SEQ ID NO: 653696 - RNA, 22 nt, Human
cagcaaggcauucuguggauua

SEQ ID NO: 653697 - RNA, 22 nt, Human
caggcuugcugcuagagcacuu

SEQ ID NO: 653698 - RNA, 22 nt, Human
cuguggaauugaugcuuagugu

SEQ ID NO: 653699 - RNA, 22 nt, Human
ugugugaccuggggugagauag

SEQ ID NO: 653700 - RNA, 22 nt, Human
ucuugaauuguacucccauaag

SEQ ID NO: 653701 - RNA, 22 nt, Human
augucacauggccuguacuuug

SEQ ID NO: 653702 - RNA, 22 nt, Human
cuguuauuuagaacauggaauc

SEQ ID NO: 653703 - RNA, 22 nt, Human
aucuauuucugcuaauaacaau

SEQ ID NO: 653704 - RNA, 22 nt, Human
gggcggugccugucuccgaagc

SEQ ID NO: 653705 - RNA, 22 nt, Human
ucauccugaagaaccugcuucc

SEQ ID NO: 653706 - RNA, 22 nt, Human
ucugcacacaauuuaucuuucu

SEQ ID NO: 653707 - RNA, 22 nt, Human
agggagcuuuuucaugugucua

SEQ ID NO: 653708 - RNA, 19 nt, Human
cauauuuuugggcuggcau

SEQ ID NO: 653709 - RNA, 22 nt, Human
aagacauuuaugaaaagugcug

SEQ ID NO: 653710 - RNA, 22 nt, Human
aaggcuccgugacuggggcuga

SEQ ID NO: 653711 - RNA, 22 nt, Human
ucugagaagcgugucucuguuu

SEQ ID NO: 653712 - RNA, 22 nt, Human
acagccugagaguggagcuggc

SEQ ID NO: 653713 - RNA, 22 nt, Human
cagggccuuauccugccauuga

SEQ ID NO: 653714 - RNA, 22 nt, Human
agcaaugcaaucuuaaccuuga

SEQ ID NO: 653715 - RNA, 22 nt, Human
auucuuugcaucucuggguggc

SEQ ID NO: 653716 - RNA, 22 nt, Human
ucuguuccucaaggucugugug

SEQ ID NO: 653717 - RNA, 20 nt, Human
cuuagaaauuuuuacccugg

SEQ ID NO: 653718 - RNA, 22 nt, Human
acugagcugugacaaugcuuaa

SEQ ID NO: 653719 - RNA, 22 nt, Human
guguucauugcuagugaggugu

SEQ ID NO: 653720 - RNA, 22 nt, Human
caaacauuccgcuucucccagg

SEQ ID NO: 653721 - RNA, 22 nt, Human
gaauauauuggugaaaauaguu

SEQ ID NO: 653722 - RNA, 22 nt, Human
gggcacugcuggaggcucccug

SEQ ID NO: 653723 - RNA, 22 nt, Human
uuacauucuuggaaucuuguuu

SEQ ID NO: 653724 - RNA, 22 nt, Human
gccuggucucuuucaugucagu

SEQ ID NO: 653725 - RNA, 22 nt, Human
uccguugacagggcacuugaca

SEQ ID NO: 653726 - RNA, 22 nt, Human
cucagccaggagaguguucaca

SEQ ID NO: 653727 - RNA, 22 nt, Human
gcuucuggaagcugcuucugcc

SEQ ID NO: 653728 - RNA, 22 nt, Human
uccaggccuugacaggucaguu

SEQ ID NO: 653729 - RNA, 22 nt, Human
gcugucacaagcaucuggggca

SEQ ID NO: 653730 - RNA, 22 nt, Human
gccauuuagggaggcaagguga

SEQ ID NO: 653731 - RNA, 22 nt, Human
aggcccagagagccaguuagug

SEQ ID NO: 653732 - RNA, 22 nt, Human
ccugaggcuggcccuuccaucc

SEQ ID NO: 653733 - RNA, 21 nt, Human
gacaggcaaggagucacuuag

SEQ ID NO: 653734 - RNA, 22 nt, Human
cuauucagguguccauuaaucc

SEQ ID NO: 653735 - RNA, 22 nt, Human
aggcuucacucgacaugccaau

SEQ ID NO: 653736 - RNA, 22 nt, Human
augucuuucucacagccaguuc

SEQ ID NO: 653737 - RNA, 22 nt, Human
ugugucuuaaguuccaagacau

SEQ ID NO: 653738 - RNA, 22 nt, Human
gggggcaguaaccucaaagugu

SEQ ID NO: 653739 - RNA, 22 nt, Human
cuucagccucaacuacuauggu

SEQ ID NO: 653740 - RNA, 22 nt, Human
uauggcuuuucuuccuccccca

SEQ ID NO: 653741 - RNA, 19 nt, Human
agcugggcugucacaguga

SEQ ID NO: 653742 - RNA, 22 nt, Human
auguuacugugaucaugauacu

SEQ ID NO: 653743 - RNA, 21 nt, Human
cccuucuugggucaaaguaua

SEQ ID NO: 653744 - RNA, 22 nt, Human
uuguguacuacaguaugccaca

SEQ ID NO: 653745 - RNA, 22 nt, Human
uccaauguuccugcuuucagcu

SEQ ID NO: 653746 - RNA, 22 nt, Human
ggcagagucagaggugguucug

SEQ ID NO: 653747 - RNA, 22 nt, Human
cucuuaaagaauguuccagcug

SEQ ID NO: 653748 - RNA, 22 nt, Human
acuaaaugaacuauuaauacuu

SEQ ID NO: 653749 - RNA, 19 nt, Human
gaggaggaaaacuagugua

SEQ ID NO: 653750 - RNA, 22 nt, Human
gugccucagcaccgccugcagc

SEQ ID NO: 653751 - RNA, 22 nt, Human
aggccuuggaagccagggagcc

SEQ ID NO: 653752 - RNA, 22 nt, Human
uacaaagguaucuuuccuagau

SEQ ID NO: 653753 - RNA, 21 nt, Human
ugugucacuaacuagaggcua

SEQ ID NO: 653754 - RNA, 22 nt, Human
ucuggggugugaccugagcaug

SEQ ID NO: 653755 - RNA, 21 nt, Human
agucccaggggugagugaugu

SEQ ID NO: 653756 - RNA, 19 nt, Human
ucucagagcccuagaggcc

SEQ ID NO: 653757 - RNA, 22 nt, Human
ugggccauuuuuggaagacugg

SEQ ID NO: 653758 - RNA, 22 nt, Human
caaaguaucaacucccacacug

SEQ ID NO: 653759 - RNA, 22 nt, Human
aguggcagacagagacaguacc

SEQ ID NO: 653760 - RNA, 22 nt, Human
gacaaggguucugcagagccug

SEQ ID NO: 653761 - RNA, 22 nt, Human
ucaauaaaauuguuuuccuauc

SEQ ID NO: 653762 - RNA, 22 nt, Human
agagagagaaaugaaaugugcu

SEQ ID NO: 653763 - RNA, 22 nt, Human
cccagacucaucccugggagcu

SEQ ID NO: 653764 - RNA, 22 nt, Human
ucuacacugggggcuuugagca

SEQ ID NO: 653765 - RNA, 22 nt, Human
cuggagcucuccagagccccgu

SEQ ID NO: 653766 - RNA, 22 nt, Human
caggaccugaagacaggcaggu

SEQ ID NO: 653767 - RNA, 22 nt, Human
cuggauucuuucauaaaaguca

SEQ ID NO: 653768 - RNA, 22 nt, Human
aaagacauuagauuaacguaca

SEQ ID NO: 653769 - RNA, 22 nt, Human
aacauauuuggcugauauuccc

SEQ ID NO: 653770 - RNA, 19 nt, Human
ugcugaaguugucagucug

SEQ ID NO: 653771 - RNA, 22 nt, Human
uuuccugugacuaaucuggaca

SEQ ID NO: 653772 - RNA, 22 nt, Human
caguguuccaggcggcagugaa

SEQ ID NO: 653773 - RNA, 22 nt, Human
acuguacacagugguguacugu

SEQ ID NO: 653774 - RNA, 22 nt, Human
uuggcuucugauguauuccuga

SEQ ID NO: 653775 - RNA, 21 nt, Human
ccagcugucuguccuuaggca

SEQ ID NO: 653776 - RNA, 22 nt, Human
augauuuucugauaaagaacug

SEQ ID NO: 653777 - RNA, 22 nt, Human
augacugcucugggcucccaug

SEQ ID NO: 653778 - RNA, 22 nt, Human
uccuggagcuggugucuuuccc

SEQ ID NO: 653779 - RNA, 22 nt, Human
ugcuggcugcagugcugucaaa

SEQ ID NO: 653780 - RNA, 22 nt, Human
cugcagugaggauucuuaggug

SEQ ID NO: 653781 - RNA, 22 nt, Human
gccaaaucuugcacacucuugu

SEQ ID NO: 653782 - RNA, 22 nt, Human
auuuaugauagcugcauuaaag

SEQ ID NO: 653783 - RNA, 22 nt, Human
ggcuuuaacagcagcuuugcug

SEQ ID NO: 653784 - RNA, 22 nt, Human
uuuuuaugccuacgcugaaaag

SEQ ID NO: 653785 - RNA, 22 nt, Human
cccaggguggaugcaagcagca

SEQ ID NO: 653786 - RNA, 22 nt, Human
caaauguaauggcagguuuugc

SEQ ID NO: 653787 - RNA, 22 nt, Human
agauuguagaaacuguagcauu

SEQ ID NO: 653788 - RNA, 22 nt, Human
agggagcucuuuggucuugccg

SEQ ID NO: 653789 - RNA, 22 nt, Human
aaagcagcagaaagcuggcccc

SEQ ID NO: 653790 - RNA, 22 nt, Human
ggugagagucuuguggucccag

SEQ ID NO: 653791 - RNA, 22 nt, Human
agggccaguauuaagguaauua

SEQ ID NO: 653792 - RNA, 19 nt, Human
agaggccucagcagcuggc

SEQ ID NO: 653793 - RNA, 22 nt, Human
gacauuucaaucucauuauggg

SEQ ID NO: 653794 - RNA, 22 nt, Human
ugaaaucauugggguugaauaa

SEQ ID NO: 653795 - RNA, 22 nt, Human
cagcaggggaacugugggccag

SEQ ID NO: 653796 - RNA, 22 nt, Human
gggcuccagauugcagcgauca

SEQ ID NO: 653797 - RNA, 22 nt, Human
ucuggcucugacacuacuguua

SEQ ID NO: 653798 - RNA, 22 nt, Human
accaggaauauuuugcucauuu

SEQ ID NO: 653799 - RNA, 22 nt, Human
ggagccaggggaccuucacaga

SEQ ID NO: 653800 - RNA, 22 nt, Human
gacaacagcauauggacuguca

SEQ ID NO: 653801 - RNA, 22 nt, Human
uuucuaagaugugguuucaagg

SEQ ID NO: 653802 - RNA, 23 nt, Human
aagcuucuaucucugcagaagga

SEQ ID NO: 653803 - RNA, 22 nt, Human
aaucaagaguuguguaauauuu

SEQ ID NO: 653804 - RNA, 22 nt, Human
uuugaaagccuggcuuuucucu

SEQ ID NO: 653805 - RNA, 22 nt, Human
ucugugacugauggaggcuuuu

SEQ ID NO: 653806 - RNA, 22 nt, Human
gcagcucccaucagggcacaga

SEQ ID NO: 653807 - RNA, 22 nt, Human
auuagcaacauggugaauaugu

SEQ ID NO: 653808 - RNA, 22 nt, Human
gagggagggacuagcauucucu

SEQ ID NO: 653809 - RNA, 22 nt, Human
ugaggccugaagccuggagccu

SEQ ID NO: 653810 - RNA, 22 nt, Human
acccuggggucacccuucucug

SEQ ID NO: 653811 - RNA, 22 nt, Human
cuguuucaaaacuaguacaaca

SEQ ID NO: 653812 - RNA, 22 nt, Human
cagauggcagggcagcucugca

SEQ ID NO: 653813 - RNA, 22 nt, Human
agcccuggggcuggugcuuacc

SEQ ID NO: 653814 - RNA, 22 nt, Human
uccuuuugcugggaucaucagg

SEQ ID NO: 653815 - RNA, 22 nt, Human
ucuggagccuuggaugggaaag

SEQ ID NO: 653816 - RNA, 22 nt, Human
guauucuugguuaucaaaauac

SEQ ID NO: 653817 - RNA, 22 nt, Human
cucacugacgaggaagcugaga

SEQ ID NO: 653818 - RNA, 22 nt, Human
ugucuuuagccacuugccucuu

SEQ ID NO: 653819 - RNA, 22 nt, Human
uugggcagcauugcaguucccu

SEQ ID NO: 653820 - RNA, 22 nt, Human
agugugaguuacaaagugugaa

SEQ ID NO: 653821 - RNA, 22 nt, Human
uuucuacauguuuucuauugaa

SEQ ID NO: 653822 - RNA, 22 nt, Human
ggcaucuggaucugcuucuccc

SEQ ID NO: 653823 - RNA, 22 nt, Human
aguguggccaaugaggaugggc

SEQ ID NO: 653824 - RNA, 22 nt, Human
guuaucaugcuucaucaucacu

SEQ ID NO: 653825 - RNA, 22 nt, Human
gucacucaggcuggaguucagu

SEQ ID NO: 653826 - RNA, 22 nt, Human
agauacauagcugugagcacac

SEQ ID NO: 653827 - RNA, 22 nt, Human
aagcagugcgcucaucuaaggg

SEQ ID NO: 653828 - RNA, 21 nt, Human
ggcuguguucagggcaugcgg

SEQ ID NO: 653829 - RNA, 22 nt, Human
ucucaucuagacucugcccuug

SEQ ID NO: 653830 - RNA, 22 nt, Human
agcugcuguuuggugagucuug

SEQ ID NO: 653831 - RNA, 22 nt, Human
gccugcucuccggaucccugau

SEQ ID NO: 653832 - RNA, 21 nt, Human
accagcauuccacacuguccc

SEQ ID NO: 653833 - RNA, 22 nt, Human
agugagacaguggacucugcau

SEQ ID NO: 653834 - RNA, 22 nt, Human
gcugcaggcauuuuccugggca

SEQ ID NO: 653835 - RNA, 19 nt, Human
uccugcugugugaagggga

SEQ ID NO: 653836 - RNA, 19 nt, Human
gguccucagcagagcaugc

SEQ ID NO: 653837 - RNA, 22 nt, Human
aaaguacuuggauuacaggcau

SEQ ID NO: 653838 - RNA, 19 nt, Human
auuuauuguaugauuccau

SEQ ID NO: 653839 - RNA, 22 nt, Human
aacacugugcccacccuagucc

SEQ ID NO: 653840 - RNA, 22 nt, Human
acaauaaguauugggcuuuuga

SEQ ID NO: 653841 - RNA, 22 nt, Human
ggccuuccugcugcuccgggcc

SEQ ID NO: 653842 - RNA, 22 nt, Human
cuccuggcuuucccagaccagg

SEQ ID NO: 653843 - RNA, 22 nt, Human
ucuccaggaaccaucaugguaa

SEQ ID NO: 653844 - RNA, 20 nt, Human
uggcccagcacgacgaggac

SEQ ID NO: 653845 - RNA, 22 nt, Human
gcccagggcugcaaguggacgc

SEQ ID NO: 653846 - RNA, 22 nt, Human
agaaggaagccaggagggugca

SEQ ID NO: 653847 - RNA, 22 nt, Human
uugcuuuaucucuuaugccuca

SEQ ID NO: 653848 - RNA, 22 nt, Human
gaauuacauaauaaaaugagag

SEQ ID NO: 653849 - RNA, 22 nt, Human
uuagaaccacugaagacucaca

SEQ ID NO: 653850 - RNA, 22 nt, Human
ugccuggauacucauuaauuuc

SEQ ID NO: 653851 - RNA, 21 nt, Human
uugagggguauugcuuuucuc

SEQ ID NO: 653852 - RNA, 22 nt, Human
cugcuuugaggggcucuguaua

SEQ ID NO: 653853 - RNA, 22 nt, Human
guucacagcuuguguuuucucu

SEQ ID NO: 653854 - RNA, 22 nt, Human
ggagugaguggccuugucacug

SEQ ID NO: 653855 - RNA, 22 nt, Human
guuacaauguccuuacaugaaa

SEQ ID NO: 653856 - RNA, 22 nt, Human
ccuggaugauccaugucaugga

SEQ ID NO: 653857 - RNA, 22 nt, Human
uuucauaaugucacagucaaaa

SEQ ID NO: 653858 - RNA, 17 nt, Human
uuucuccuuccaucuca

SEQ ID NO: 653859 - RNA, 23 nt, Human
gcuuccagaagacucauugacau

SEQ ID NO: 653860 - RNA, 22 nt, Human
uccugaagucacaggcucugag

SEQ ID NO: 653861 - RNA, 22 nt, Human
aacauuuaugauugagguaaau

SEQ ID NO: 653862 - RNA, 22 nt, Human
ucuggcccagccccugagguca

SEQ ID NO: 653863 - RNA, 22 nt, Human
acauuaaaaaauguugcaugaa

SEQ ID NO: 653864 - RNA, 22 nt, Human
cacauguucuugaagccaacuc

SEQ ID NO: 653865 - RNA, 22 nt, Human
ucaggcagcuccaggaauggua

SEQ ID NO: 653866 - RNA, 22 nt, Human
cagcauuuucuuaauguaggug

SEQ ID NO: 653867 - RNA, 22 nt, Human
cucaaguuggcaugaacaaauu

SEQ ID NO: 653868 - RNA, 22 nt, Human
gaacauuuccagaaaggaacua

SEQ ID NO: 653869 - RNA, 23 nt, Human
uggcaccaggcauucuaggggua

SEQ ID NO: 653870 - RNA, 22 nt, Human
uuuggagaaguugcuaaagugu

SEQ ID NO: 653871 - RNA, 22 nt, Human
agacauggagaaggagccagug

SEQ ID NO: 653872 - RNA, 22 nt, Human
uacaggagcugcucugugauac

SEQ ID NO: 653873 - RNA, 22 nt, Human
ugagggcugacaggaggacagc

SEQ ID NO: 653874 - RNA, 22 nt, Human
ugaugcacaaagucagcauccu

SEQ ID NO: 653875 - RNA, 22 nt, Human
ggcucacuuuggggucagcugg

SEQ ID NO: 653876 - RNA, 22 nt, Human
gugccugcuaccugacuuguuu

SEQ ID NO: 653877 - RNA, 22 nt, Human
cagggcucgcucgcucgcucgc

SEQ ID NO: 653878 - RNA, 22 nt, Human
gcuggcuggagugagcuacccu

SEQ ID NO: 653879 - RNA, 22 nt, Human
agcagcauagaugcuauccgag

SEQ ID NO: 653880 - RNA, 22 nt, Human
aggcuagcugauugccuuagaa

SEQ ID NO: 653881 - RNA, 22 nt, Human
cauuagggucucucagcugaau

SEQ ID NO: 653882 - RNA, 22 nt, Human
agguacaucuauggggauagaa

SEQ ID NO: 653883 - RNA, 22 nt, Human
gcucuauuacuuucaauaaaaa

SEQ ID NO: 653884 - RNA, 22 nt, Human
uaauauauaccuuuguuaggaa

SEQ ID NO: 653885 - RNA, 22 nt, Human
gggcuggaucucacgugagacc

SEQ ID NO: 653886 - RNA, 22 nt, Human
ugggguccucucacuuggaggg

SEQ ID NO: 653887 - RNA, 22 nt, Human
ggcaccagcaggcaccgaugcc

SEQ ID NO: 653888 - RNA, 22 nt, Human
cccuggaggaccccaauguggc

SEQ ID NO: 653889 - RNA, 22 nt, Human
uacgaauccuguggaugaaugu

SEQ ID NO: 653890 - RNA, 22 nt, Human
acagaguagcucaagaagauug

SEQ ID NO: 653891 - RNA, 20 nt, Human
gauacacagcacagagggcc

SEQ ID NO: 653892 - RNA, 18 nt, Human
cacaggagaugaccugac

SEQ ID NO: 653893 - RNA, 22 nt, Human
gcuguuucuugaggcuacuccu

SEQ ID NO: 653894 - RNA, 22 nt, Human
gauuucuuuaugaaguacagaa

SEQ ID NO: 653895 - RNA, 22 nt, Human
ucugccuggauuuuggaaagcu

SEQ ID NO: 653896 - RNA, 22 nt, Human
uagcaaaggccuuggacacgcu

SEQ ID NO: 653897 - RNA, 18 nt, Human
uccaggcuccaggcuaac

SEQ ID NO: 653898 - RNA, 22 nt, Human
uaaaaugccagaccaguucacg

SEQ ID NO: 653899 - RNA, 22 nt, Human
uaagaugggggaaagaaauagu

SEQ ID NO: 653900 - RNA, 22 nt, Human
aaugcucuuugaauuugucaga

SEQ ID NO: 653901 - RNA, 22 nt, Human
uaguuuuacaucagccauuguu

SEQ ID NO: 653902 - RNA, 22 nt, Human
agcagccacccagcugcucauu

SEQ ID NO: 653903 - RNA, 17 nt, Human
ucagucucuguccugga

SEQ ID NO: 653904 - RNA, 22 nt, Human
guuacaaaggacugggggccac

SEQ ID NO: 653905 - RNA, 22 nt, Human
guuaguguauauugccuucaaa

SEQ ID NO: 653906 - RNA, 22 nt, Human
ccucagccuuggccccaggcag

SEQ ID NO: 653907 - RNA, 22 nt, Human
agagcuguggauaguccuggau

SEQ ID NO: 653908 - RNA, 22 nt, Human
agacaugacagauaguugcuag

SEQ ID NO: 653909 - RNA, 22 nt, Human
ggguggugggcacagaaucugg

SEQ ID NO: 653910 - RNA, 22 nt, Human
acaggauaguuuuuaaucuucc

SEQ ID NO: 653911 - RNA, 22 nt, Human
aguaccaugcuuccugacuggu

SEQ ID NO: 653912 - RNA, 22 nt, Human
ucugggaaguccucugucaugc

SEQ ID NO: 653913 - RNA, 22 nt, Human
cuguacaaaagaaaguuccuau

SEQ ID NO: 653914 - RNA, 20 nt, Human
guggaugaucaguguagugg

SEQ ID NO: 653915 - RNA, 22 nt, Human
ugggccugggagggcagacgcu

SEQ ID NO: 653916 - RNA, 22 nt, Human
ggaguggcagcgaggaucagau

SEQ ID NO: 653917 - RNA, 22 nt, Human
uaaaucacucuucucucaccac

SEQ ID NO: 653918 - RNA, 22 nt, Human
auaaaaacugacccauccuuug

SEQ ID NO: 653919 - RNA, 22 nt, Human
aagcagagaaaagcuuagguuc

SEQ ID NO: 653920 - RNA, 22 nt, Human
aucaguguuccuugagacugcc

SEQ ID NO: 653921 - RNA, 22 nt, Human
agaacagcaguuaugguucauu

SEQ ID NO: 653922 - RNA, 22 nt, Human
aguaacaaauauucauuggauu

SEQ ID NO: 653923 - RNA, 22 nt, Human
aaauuucuaagucaagaagaac

SEQ ID NO: 653924 - RNA, 22 nt, Human
aggucugucuggccccaugaau

SEQ ID NO: 653925 - RNA, 22 nt, Human
gaugaggcucaugcacccugcg

SEQ ID NO: 653926 - RNA, 22 nt, Human
gacagcuggacagacacugaug

SEQ ID NO: 653927 - RNA, 22 nt, Human
uagauuugauguaagcauaguc

SEQ ID NO: 653928 - RNA, 22 nt, Human
augggcuggccuuucccgcucu

SEQ ID NO: 653929 - RNA, 22 nt, Human
cucuuuaaaguaaaauuugucu

SEQ ID NO: 653930 - RNA, 21 nt, Human
cugucccucuuugcuucccuc

SEQ ID NO: 653931 - RNA, 22 nt, Human
cagggguggcugcagcagaggu

SEQ ID NO: 653932 - RNA, 22 nt, Human
cugggcuuguguuagcugacaa

SEQ ID NO: 653933 - RNA, 22 nt, Human
uggugucuuggaaguaggugcu

SEQ ID NO: 653934 - RNA, 22 nt, Human
uuccuguauucuaaagggaaag

SEQ ID NO: 653935 - RNA, 22 nt, Human
aggcacgagcaauggccgagga

SEQ ID NO: 653936 - RNA, 23 nt, Human
ggcuucagugagagucccugcug

SEQ ID NO: 653937 - RNA, 22 nt, Human
agcugagacacuugagagacua

SEQ ID NO: 653938 - RNA, 18 nt, Human
guucaaggucaagagaga

SEQ ID NO: 653939 - RNA, 22 nt, Human
uuauuugaaucuggcuagagaa

SEQ ID NO: 653940 - RNA, 22 nt, Human
cagcagcugggaaggaggcuga

SEQ ID NO: 653941 - RNA, 22 nt, Human
ccagggugggaggcugaaggcg

SEQ ID NO: 653942 - RNA, 22 nt, Human
uuuauauuucccaggauuggcc

SEQ ID NO: 653943 - RNA, 22 nt, Human
cucugcuggugaccacugggcc

SEQ ID NO: 653944 - RNA, 22 nt, Human
ugagcagaauguucagauaaau

SEQ ID NO: 653945 - RNA, 22 nt, Human
gggugggaacaggaugccagga

SEQ ID NO: 653946 - RNA, 22 nt, Human
ccucagaagacuuuagggaaga

SEQ ID NO: 653947 - RNA, 22 nt, Human
agagccuugaagaucuggaaaa

SEQ ID NO: 653948 - RNA, 22 nt, Human
gcucugcuugcaucaugacugc

SEQ ID NO: 653949 - RNA, 22 nt, Human
uaaagcaaugaaaguuuugcag

SEQ ID NO: 653950 - RNA, 17 nt, Human
ugcagcugcucccaggc

SEQ ID NO: 653951 - RNA, 22 nt, Human
uuuucuuuaaucugguggggug

SEQ ID NO: 653952 - RNA, 22 nt, Human
agggccugucagcgguguccug

SEQ ID NO: 653953 - RNA, 22 nt, Human
uauugcuucagcuuccugggcu

SEQ ID NO: 653954 - RNA, 22 nt, Human
uaggucuguacccuguccuucu

SEQ ID NO: 653955 - RNA, 22 nt, Human
uucuaccauugggaaaacagcc

SEQ ID NO: 653956 - RNA, 23 nt, Human
uacagcugcagaaucaggcuaag

SEQ ID NO: 653957 - RNA, 22 nt, Human
aggcuguguucugcccucuccc

SEQ ID NO: 653958 - RNA, 22 nt, Human
uccuggaacauggauaaagaau

SEQ ID NO: 653959 - RNA, 22 nt, Human
cucugcccucgcacaucugcca

SEQ ID NO: 653960 - RNA, 22 nt, Human
uuugcaaauuagccacccuguu

SEQ ID NO: 653961 - RNA, 22 nt, Human
ucacuugccuagcccaguucag

SEQ ID NO: 653962 - RNA, 22 nt, Human
aggcgcugugcuuggggcugga

SEQ ID NO: 653963 - RNA, 22 nt, Human
ccuuuccugccucaggaaguag

SEQ ID NO: 653964 - RNA, 22 nt, Human
acaaauuuauugaagggcauau

SEQ ID NO: 653965 - RNA, 22 nt, Human
ugacagcugagccccaggcaag

SEQ ID NO: 653966 - RNA, 22 nt, Human
aaauguuucuacuugugagcau

SEQ ID NO: 653967 - RNA, 22 nt, Human
caggaagcaagugauuuucuug

SEQ ID NO: 653968 - RNA, 22 nt, Human
agcuccaggaucugaaaguucg

SEQ ID NO: 653969 - RNA, 22 nt, Human
gaaccucuuuaaagaacagaau

SEQ ID NO: 653970 - RNA, 22 nt, Human
ccucagaugucuuaaggcacug

SEQ ID NO: 653971 - RNA, 22 nt, Human
uagggcuguggucaguccucua

SEQ ID NO: 653972 - RNA, 22 nt, Human
cuucuuaaugcauaaacugugu

SEQ ID NO: 653973 - RNA, 22 nt, Human
gucucagugucaccuccagcug

SEQ ID NO: 653974 - RNA, 20 nt, Human
gcuaggcuggugauugucaa

SEQ ID NO: 653975 - RNA, 21 nt, Human
auuuucucuggaugaugguca

SEQ ID NO: 653976 - RNA, 22 nt, Human
uuucugcuguguaaaaugaggg

SEQ ID NO: 653977 - RNA, 22 nt, Human
cuguggagaugcagaccaggcc

SEQ ID NO: 653978 - RNA, 22 nt, Human
uucauggcaggagucagaagcu

SEQ ID NO: 653979 - RNA, 22 nt, Human
ucugagguggacgauggagccu

SEQ ID NO: 653980 - RNA, 22 nt, Human
cuggccacugcaccucuuccuu

SEQ ID NO: 653981 - RNA, 22 nt, Human
cucaagauauuccagcucucaa

SEQ ID NO: 653982 - RNA, 22 nt, Human
gcucuugauuuccaggagcuag

SEQ ID NO: 653983 - RNA, 22 nt, Human
uucucaguuucauagcugagca

SEQ ID NO: 653984 - RNA, 22 nt, Human
ugccuguuauuguuggcuuagu

SEQ ID NO: 653985 - RNA, 22 nt, Human
ugaggcagugugagauaauaaa

SEQ ID NO: 653986 - RNA, 22 nt, Human
cucaggauugugccuagggaga

SEQ ID NO: 653987 - RNA, 22 nt, Human
uuugcacacauucuuagaaaug

SEQ ID NO: 653988 - RNA, 23 nt, Human
ugugaagguggguccaagggcug

SEQ ID NO: 653989 - RNA, 19 nt, Human
auggaagcugggaucaaug

SEQ ID NO: 653990 - RNA, 22 nt, Human
ugagaacauugggaaagcuaug

SEQ ID NO: 653991 - RNA, 22 nt, Human
caggugaguuugcuauuguaca

SEQ ID NO: 653992 - RNA, 22 nt, Human
aaauacauuagacggagaguua

SEQ ID NO: 653993 - RNA, 20 nt, Human
auuguuucauuuaauguaca

SEQ ID NO: 653994 - RNA, 22 nt, Human
acccugagggugcuggguuucu

SEQ ID NO: 653995 - RNA, 22 nt, Human
ugucuuaugcugcauagacuau

SEQ ID NO: 653996 - RNA, 22 nt, Human
ugccagcuuguggucagaggcu

SEQ ID NO: 653997 - RNA, 23 nt, Human
aaggucacagaacuuagcaagcc

SEQ ID NO: 653998 - RNA, 22 nt, Human
uaaagacaauuucgagcuguag

SEQ ID NO: 653999 - RNA, 22 nt, Human
guggagcauaacacacuagccu

SEQ ID NO: 654000 - RNA, 22 nt, Human
uccccaguaagccugcacugug

SEQ ID NO: 654001 - RNA, 20 nt, Human
uaaugucaaagucacaaggu

SEQ ID NO: 654002 - RNA, 22 nt, Human
aggugagggugccagugcaugg

SEQ ID NO: 654003 - RNA, 22 nt, Human
caguagcaugcuuaucuuuuga

SEQ ID NO: 654004 - RNA, 22 nt, Human
cagcuauuccaggaguagaauc

SEQ ID NO: 654005 - RNA, 22 nt, Human
ugcagaggcccagcgguucuuc

SEQ ID NO: 654006 - RNA, 21 nt, Human
uccuccuguagaggguccugg

SEQ ID NO: 654007 - RNA, 22 nt, Human
aaagacugcaaaaacgcacaga

SEQ ID NO: 654008 - RNA, 22 nt, Human
cagauauauuuuauuuggucaa

SEQ ID NO: 654009 - RNA, 22 nt, Human
uguacaguggaaaauggauucg

SEQ ID NO: 654010 - RNA, 22 nt, Human
guucugaggcaaaggcagcagc

SEQ ID NO: 654011 - RNA, 22 nt, Human
agaacacauagagaaguuuuau

SEQ ID NO: 654012 - RNA, 22 nt, Human
gguuuuauuaccccuuaaacac

SEQ ID NO: 654013 - RNA, 22 nt, Human
caggccccauuccucuugggac

SEQ ID NO: 654014 - RNA, 22 nt, Human
ggcucagcuuggugcgcagaaa

SEQ ID NO: 654015 - RNA, 20 nt, Human
ugcacauggcagccaucuag

SEQ ID NO: 654016 - RNA, 22 nt, Human
cccacagguggaagccucggaa

SEQ ID NO: 654017 - RNA, 23 nt, Human
acagcugcaccuggccgccuggc

SEQ ID NO: 654018 - RNA, 17 nt, Human
ucuuucccugggagaug

SEQ ID NO: 654019 - RNA, 22 nt, Human
aggcgcagacauacagggucug

SEQ ID NO: 654020 - RNA, 22 nt, Human
ccucugggaagccaguccugcu

SEQ ID NO: 654021 - RNA, 22 nt, Human
cacacauauugucccuagugug

SEQ ID NO: 654022 - RNA, 22 nt, Human
uaauaccuagagaugauacaaa

SEQ ID NO: 654023 - RNA, 22 nt, Human
ucuuugaccaaauuauccuguu

SEQ ID NO: 654024 - RNA, 22 nt, Human
ggccuuuaagcaauugaaaaga

SEQ ID NO: 654025 - RNA, 22 nt, Human
caggcucgguccaguggcaccc

SEQ ID NO: 654026 - RNA, 22 nt, Human
caauauucaguggaaaagccau

SEQ ID NO: 654027 - RNA, 22 nt, Human
uuaaugaccuagagcaguaauu

SEQ ID NO: 654028 - RNA, 22 nt, Human
uccagcagaaccagagaccugg

SEQ ID NO: 654029 - RNA, 22 nt, Human
ccucagaauaguccucagauca

SEQ ID NO: 654030 - RNA, 22 nt, Human
agcugaaacccaggccucagcu

SEQ ID NO: 654031 - RNA, 22 nt, Human
gagugcaucguggccauuuuaa

SEQ ID NO: 654032 - RNA, 22 nt, Human
gugaggugacuagcaggugggg

SEQ ID NO: 654033 - RNA, 22 nt, Human
uacaguggggagcucaggagag

SEQ ID NO: 654034 - RNA, 22 nt, Human
aggggagagaacauaaggaagu

SEQ ID NO: 654035 - RNA, 22 nt, Human
uucuuuccucccagccuuugga

SEQ ID NO: 654036 - RNA, 22 nt, Human
aagucaagauaaaggugcuggc

SEQ ID NO: 654037 - RNA, 22 nt, Human
ugcagggccaugguggcggcug

SEQ ID NO: 654038 - RNA, 22 nt, Human
aguuucuguuaccauauuugac

SEQ ID NO: 654039 - RNA, 22 nt, Human
ggaggcugagaggucgcagugg

SEQ ID NO: 654040 - RNA, 22 nt, Human
ugagcauuggaucaaaugacuu

SEQ ID NO: 654041 - RNA, 22 nt, Human
gaagaagacauggaacaauagu

SEQ ID NO: 654042 - RNA, 22 nt, Human
cugagcagugguucuugagcgc

SEQ ID NO: 654043 - RNA, 22 nt, Human
gggaggugaaaggucaugugug

SEQ ID NO: 654044 - RNA, 22 nt, Human
uuagucaggaccuuuugguuuc

SEQ ID NO: 654045 - RNA, 22 nt, Human
cagaguacugggagaacagaag

SEQ ID NO: 654046 - RNA, 18 nt, Human
aggugcucaaaugggaaa

SEQ ID NO: 654047 - RNA, 22 nt, Human
cacugagaccagagucccugac

SEQ ID NO: 654048 - RNA, 22 nt, Human
cuuccaaaauuuauauguugaa

SEQ ID NO: 654049 - RNA, 22 nt, Human
uccaggcauuggagagauaaug

SEQ ID NO: 654050 - RNA, 22 nt, Human
agguucagucuuuggaccccuc

SEQ ID NO: 654051 - RNA, 22 nt, Human
ccugaggccccugaggauagca

SEQ ID NO: 654052 - RNA, 22 nt, Human
acacaaauuguaggauaauugc

SEQ ID NO: 654053 - RNA, 22 nt, Human
gcuucugcuguugaagccacca

SEQ ID NO: 654054 - RNA, 22 nt, Human
gagagggcuggaaacuuccugg

SEQ ID NO: 654055 - RNA, 22 nt, Human
ucauuucuccuaagugaaauau

SEQ ID NO: 654056 - RNA, 22 nt, Human
gaucccugcccucagccuggac

SEQ ID NO: 654057 - RNA, 22 nt, Human
ugucauuuauuuugcugucugu

SEQ ID NO: 654058 - RNA, 22 nt, Human
cuucaugaggccggcuuuaucc

SEQ ID NO: 654059 - RNA, 22 nt, Human
ggccagcggcacagccuggccc

SEQ ID NO: 654060 - RNA, 22 nt, Human
ucauugaacgaagagcuccauu

SEQ ID NO: 654061 - RNA, 22 nt, Human
uagggaaaagacuucacuguuu

SEQ ID NO: 654062 - RNA, 22 nt, Human
ggacaguccaccucagugaaga

SEQ ID NO: 654063 - RNA, 22 nt, Human
uggccucugcaauggauucacc

SEQ ID NO: 654064 - RNA, 22 nt, Human
aggcuucaggaaauauacauuu

SEQ ID NO: 654065 - RNA, 22 nt, Human
gaguuagagccauagagcacgg

SEQ ID NO: 654066 - RNA, 22 nt, Human
cugcuuaaaaugcagauucugu

SEQ ID NO: 654067 - RNA, 22 nt, Human
uccaaagcaucugagugugcau

SEQ ID NO: 654068 - RNA, 21 nt, Human
uaggagcugauggggaaguag

SEQ ID NO: 654069 - RNA, 23 nt, Human
ggaggcucaaguaucacgggcag

SEQ ID NO: 654070 - RNA, 22 nt, Human
gccaaaucuggauuuagcaaga

SEQ ID NO: 654071 - RNA, 22 nt, Human
auuucagaauguccuaauuuag

SEQ ID NO: 654072 - RNA, 19 nt, Human
cacagugcagccauuucuc

SEQ ID NO: 654073 - RNA, 22 nt, Human
ccuggggagccgccugagcccc

SEQ ID NO: 654074 - RNA, 22 nt, Human
ugccaggcugaacagggucuua

SEQ ID NO: 654075 - RNA, 19 nt, Human
ccaggccuggcgucuccgc

SEQ ID NO: 654076 - RNA, 22 nt, Human
ucucuggggccuuucuacauca

SEQ ID NO: 654077 - RNA, 22 nt, Human
ucaggcuuauagguagugguua

SEQ ID NO: 654078 - RNA, 22 nt, Human
cuuccuggaugaagcccagcau

SEQ ID NO: 654079 - RNA, 22 nt, Human
uuuacagcagcaugauuuauaa

SEQ ID NO: 654080 - RNA, 22 nt, Human
auaaggcagucccuuaacaagg

SEQ ID NO: 654081 - RNA, 22 nt, Human
ucuguccaguggcucucaggga

SEQ ID NO: 654082 - RNA, 22 nt, Human
ucucucugaguugagcaggagu

SEQ ID NO: 654083 - RNA, 22 nt, Human
gaaagugcuaggaaguguuaga

SEQ ID NO: 654084 - RNA, 22 nt, Human
caauugucagugcuguuuaaau

SEQ ID NO: 654085 - RNA, 22 nt, Human
ugggauggagccugaguauagu

SEQ ID NO: 654086 - RNA, 22 nt, Human
cagacucugaugcagccuugug

SEQ ID NO: 654087 - RNA, 18 nt, Human
ccaggacaggcaaaaggu

SEQ ID NO: 654088 - RNA, 22 nt, Human
uauggcuuuuggcuucucucug

SEQ ID NO: 654089 - RNA, 21 nt, Human
cuuugguuuccuccugccuuc

SEQ ID NO: 654090 - RNA, 22 nt, Human
cugagcucuaaugucagccuug

SEQ ID NO: 654091 - RNA, 22 nt, Human
ggcccuuggagccuccacagug

SEQ ID NO: 654092 - RNA, 22 nt, Human
cuccugaggacuucuauugggu

SEQ ID NO: 654093 - RNA, 22 nt, Human
acuucacagaaauuuuaugagg

SEQ ID NO: 654094 - RNA, 22 nt, Human
aauaucagaauguaaugguccu

SEQ ID NO: 654095 - RNA, 22 nt, Human
ggugggagugggcacaguuacg

SEQ ID NO: 654096 - RNA, 22 nt, Human
agagcuguguccugugcacuag

SEQ ID NO: 654097 - RNA, 22 nt, Human
aaggcugggaaacaugcaggcc

SEQ ID NO: 654098 - RNA, 22 nt, Human
uacagugaccuagaauaaauac

SEQ ID NO: 654099 - RNA, 19 nt, Human
ugggaguggggaagguccu

SEQ ID NO: 654100 - RNA, 22 nt, Human
gcuagaaacuguuuaaucucuu

SEQ ID NO: 654101 - RNA, 22 nt, Human
uuacaaucugauugucucaucu

SEQ ID NO: 654102 - RNA, 22 nt, Human
uagaggggaaaaugcguauuaa

SEQ ID NO: 654103 - RNA, 22 nt, Human
gggguaggcaggugaucugauc

SEQ ID NO: 654104 - RNA, 22 nt, Human
ccucacccagucaccuaggugg

SEQ ID NO: 654105 - RNA, 20 nt, Human
aaggaauauuuguaucuggg

SEQ ID NO: 654106 - RNA, 22 nt, Human
gaaccuggaaucuauuacaagg

SEQ ID NO: 654107 - RNA, 20 nt, Human
agcccaggccugugugaguc

SEQ ID NO: 654108 - RNA, 22 nt, Human
gaacuuuguggggcugagagga

SEQ ID NO: 654109 - RNA, 22 nt, Human
ccucccaggcauugccauuuuc

SEQ ID NO: 654110 - RNA, 22 nt, Human
acauugaugaaaagguaucauu

SEQ ID NO: 654111 - RNA, 22 nt, Human
ccccugccauagucaaaucuaa

SEQ ID NO: 654112 - RNA, 22 nt, Human
caggaaugaaaggucaggguug

SEQ ID NO: 654113 - RNA, 22 nt, Human
aacaaauuuagcucugagugcu

SEQ ID NO: 654114 - RNA, 22 nt, Human
aucuuuguuuugaugcagaucu

SEQ ID NO: 654115 - RNA, 22 nt, Human
aauccauguugauguauauuuu

SEQ ID NO: 654116 - RNA, 22 nt, Human
uagauuugccugggaaagcuca

SEQ ID NO: 654117 - RNA, 22 nt, Human
aaugaacaaaauaugcuuugca

SEQ ID NO: 654118 - RNA, 22 nt, Human
ggggugagcugggccugugccu

SEQ ID NO: 654119 - RNA, 22 nt, Human
gccagccagaguggcugugugu

SEQ ID NO: 654120 - RNA, 22 nt, Human
cuauuucuaaaccuauaaguga

SEQ ID NO: 654121 - RNA, 22 nt, Human
acccccaaacaugaucauggug

SEQ ID NO: 654122 - RNA, 22 nt, Human
uuggaaaaacacgauagugguu

SEQ ID NO: 654123 - RNA, 22 nt, Human
aagcacagugccaaguucuauu

SEQ ID NO: 654124 - RNA, 22 nt, Human
cugcaguaucuuaaaauuugua

SEQ ID NO: 654125 - RNA, 22 nt, Human
aaauacauaaagguuguaccag

SEQ ID NO: 654126 - RNA, 22 nt, Human
ucacagugagccaugucagaga

SEQ ID NO: 654127 - RNA, 22 nt, Human
ccuuagugaaacagaggcaauu

SEQ ID NO: 654128 - RNA, 22 nt, Human
gccuggaggaauguagcugagg

SEQ ID NO: 654129 - RNA, 22 nt, Human
gugugucagagcucagagaagu

SEQ ID NO: 654130 - RNA, 19 nt, Human
gcccugaguaagcuaggag

SEQ ID NO: 654131 - RNA, 22 nt, Human
ccuggccacucagguguggggc

SEQ ID NO: 654132 - RNA, 22 nt, Human
uagggaggaggguuuucaaauc

SEQ ID NO: 654133 - RNA, 22 nt, Human
augcauauguacccauguucug

SEQ ID NO: 654134 - RNA, 22 nt, Human
gagauggggaauaggagcaagc

SEQ ID NO: 654135 - RNA, 22 nt, Human
aaaauauguauaacucuucugc

SEQ ID NO: 654136 - RNA, 22 nt, Human
cuacagaaguuucccuugcuua

SEQ ID NO: 654137 - RNA, 22 nt, Human
ucacaaagggagggauagcugg

SEQ ID NO: 654138 - RNA, 22 nt, Human
ugccagcacuucuggcugucug

SEQ ID NO: 654139 - RNA, 22 nt, Human
ccaucuccacugucccugucaa

SEQ ID NO: 654140 - RNA, 22 nt, Human
gccagcagguggagagaucaag

SEQ ID NO: 654141 - RNA, 22 nt, Human
acagggcuauauuccucagagu

SEQ ID NO: 654142 - RNA, 22 nt, Human
gauuuguggugugaggaagagc

SEQ ID NO: 654143 - RNA, 23 nt, Human
ugaaggccuggaggacgcguugu

SEQ ID NO: 654144 - RNA, 20 nt, Human
ccucaaauaagugccagcau

SEQ ID NO: 654145 - RNA, 20 nt, Human
uacagaaacaggacuuuugg

SEQ ID NO: 654146 - RNA, 22 nt, Human
ccagagucuaugaguccucauu

SEQ ID NO: 654147 - RNA, 18 nt, Human
gagucuuuguuacugcug

SEQ ID NO: 654148 - RNA, 22 nt, Human
aucucucuaugcacugaggacu

SEQ ID NO: 654149 - RNA, 22 nt, Human
uucuacaaauauuuacuguucc

SEQ ID NO: 654150 - RNA, 22 nt, Human
aggaggaacucagaaagaaggu

SEQ ID NO: 654151 - RNA, 22 nt, Human
ccuucaaacuuucauuaaccag

SEQ ID NO: 654152 - RNA, 22 nt, Human
acacugcagaugaaagcauaag

SEQ ID NO: 654153 - RNA, 22 nt, Human
acauuuaaugauccuacuguga

SEQ ID NO: 654154 - RNA, 22 nt, Human
ccccagcaggaauacagggguc

SEQ ID NO: 654155 - RNA, 22 nt, Human
aggucugaguuuguuguuggcu

SEQ ID NO: 654156 - RNA, 21 nt, Human
gcaaccagaccacagggcagu

SEQ ID NO: 654157 - RNA, 22 nt, Human
gagguauguaugcuacauucuu

SEQ ID NO: 654158 - RNA, 22 nt, Human
ucacuuagauggggaucaucac

SEQ ID NO: 654159 - RNA, 22 nt, Human
caguuuagcaaauuuguaucaa

SEQ ID NO: 654160 - RNA, 22 nt, Human
uccugggagaguuugauucauu

SEQ ID NO: 654161 - RNA, 22 nt, Human
acagauaaauuuauaggagugu

SEQ ID NO: 654162 - RNA, 22 nt, Human
gcugugcuggaaggggaccugc

SEQ ID NO: 654163 - RNA, 22 nt, Human
gguucacucucaagucugccua

SEQ ID NO: 654164 - RNA, 22 nt, Human
uucagcuccuuauuucugagca

SEQ ID NO: 654165 - RNA, 22 nt, Human
auuauuauuguugauguuaggg

SEQ ID NO: 654166 - RNA, 22 nt, Human
aggacagagccugugcagaccg

SEQ ID NO: 654167 - RNA, 23 nt, Human
ccuggaguacuaaggggauggaa

SEQ ID NO: 654168 - RNA, 22 nt, Human
auuauaaaccuuugaggguggg

SEQ ID NO: 654169 - RNA, 23 nt, Human
ucugagcugucuuuucagcagaa

SEQ ID NO: 654170 - RNA, 22 nt, Human
agugaacaaagguagugagcau

SEQ ID NO: 654171 - RNA, 22 nt, Human
aaaugacagagcugggacuagu

SEQ ID NO: 654172 - RNA, 22 nt, Human
uagcccagagagccaggggcuu

SEQ ID NO: 654173 - RNA, 22 nt, Human
caggcugggcagccuccccggc

SEQ ID NO: 654174 - RNA, 22 nt, Human
ugcacauucacuuagguauugu

SEQ ID NO: 654175 - RNA, 22 nt, Human
uaguuucugguucuugcucugg

SEQ ID NO: 654176 - RNA, 22 nt, Human
auaaagcuauuccucucuuuuu

SEQ ID NO: 654177 - RNA, 22 nt, Human
gauugaaagacuguuugggaga

SEQ ID NO: 654178 - RNA, 22 nt, Human
uuggaaggaccaggccuugauu

SEQ ID NO: 654179 - RNA, 22 nt, Human
ggccucucucccuggcuugcag

SEQ ID NO: 654180 - RNA, 22 nt, Human
auuaucuauguagaaugauuuu

SEQ ID NO: 654181 - RNA, 22 nt, Human
cagcccagagaaggggcccgug

SEQ ID NO: 654182 - RNA, 22 nt, Human
ugcauuauacuuuuagaaauuu

SEQ ID NO: 654183 - RNA, 22 nt, Human
agccacagccugacuuaacugu

SEQ ID NO: 654184 - RNA, 22 nt, Human
cacauggaagagauacagugag

SEQ ID NO: 654185 - RNA, 22 nt, Human
uaaauugaucguuugggaugaa

SEQ ID NO: 654186 - RNA, 22 nt, Human
uucacaauggcaaaccauuaaa

SEQ ID NO: 654187 - RNA, 22 nt, Human
agagccugguucaaauuuuacc

SEQ ID NO: 654188 - RNA, 22 nt, Human
ccugaguagcuggaauuaaagg

SEQ ID NO: 654189 - RNA, 22 nt, Human
aaagcuaccuuuguguucauag

SEQ ID NO: 654190 - RNA, 22 nt, Human
aauuagggaaaauuuacuugua

SEQ ID NO: 654191 - RNA, 21 nt, Human
ggcugcucaccuaggucccaa

SEQ ID NO: 654192 - RNA, 22 nt, Human
aggaaagauggaaggaggauaa

SEQ ID NO: 654193 - RNA, 22 nt, Human
gugcuuuuaaaggcaauuagua

SEQ ID NO: 654194 - RNA, 23 nt, Human
ucucuuaccugagacauuuccua

SEQ ID NO: 654195 - RNA, 22 nt, Human
augugcuuauggucucugguug

SEQ ID NO: 654196 - RNA, 22 nt, Human
aaauagaauuaacuagcuacug

SEQ ID NO: 654197 - RNA, 22 nt, Human
uuugggcaguagauguaucacu

SEQ ID NO: 654198 - RNA, 22 nt, Human
gaaguauaugucuuuaaucuau

SEQ ID NO: 654199 - RNA, 23 nt, Human
ggcagcucucaucugaugacuga

SEQ ID NO: 654200 - RNA, 22 nt, Human
uaugcacauucacacaaaaaug

SEQ ID NO: 654201 - RNA, 22 nt, Human
gccuucugauaucucuuggcau

SEQ ID NO: 654202 - RNA, 22 nt, Human
acagaauauuguaagugccacu

SEQ ID NO: 654203 - RNA, 22 nt, Human
ucuggagaaaguugaguuugug

SEQ ID NO: 654204 - RNA, 19 nt, Human
ugggcagcucccucugucc

SEQ ID NO: 654205 - RNA, 22 nt, Human
ccuccucugggaagauucagag

SEQ ID NO: 654206 - RNA, 22 nt, Human
ugguagugacucccccagggcu

SEQ ID NO: 654207 - RNA, 22 nt, Human
gguaggggcagggccaagcugu

SEQ ID NO: 654208 - RNA, 22 nt, Human
uucaagucuguuucauugcaug

SEQ ID NO: 654209 - RNA, 22 nt, Human
cagagacaggcuugcccuccac

SEQ ID NO: 654210 - RNA, 23 nt, Human
agcuucaucuugcugugucucag

SEQ ID NO: 654211 - RNA, 22 nt, Human
ggugagcaaagcuucaucugua

SEQ ID NO: 654212 - RNA, 22 nt, Human
uggaagcggacguuguggggug

SEQ ID NO: 654213 - RNA, 22 nt, Human
ggagaugccagaauugcaaauu

SEQ ID NO: 654214 - RNA, 22 nt, Human
cugaggaaggcugggggcaucc

SEQ ID NO: 654215 - RNA, 22 nt, Human
gaucacaguauuuuagaugugu

SEQ ID NO: 654216 - RNA, 22 nt, Human
agccaaagugguauauagggaa

SEQ ID NO: 654217 - RNA, 22 nt, Human
caaugcuuuuguucuuuacuca

SEQ ID NO: 654218 - RNA, 23 nt, Human
agcugaggugcagauccaaagaa

SEQ ID NO: 654219 - RNA, 22 nt, Human
agcuggggguuggauaagggua

SEQ ID NO: 654220 - RNA, 22 nt, Human
cuucagaauccagaaucagaau

SEQ ID NO: 654221 - RNA, 22 nt, Human
ucauuguuauguuuugcugucu

SEQ ID NO: 654222 - RNA, 22 nt, Human
ucagcaggcgguuccuuguggg

SEQ ID NO: 654223 - RNA, 22 nt, Human
gcuggcagggacagcugcgugu

SEQ ID NO: 654224 - RNA, 18 nt, Human
ucucucugaagaguuccc

SEQ ID NO: 654225 - RNA, 21 nt, Human
ccauaauuuuguuucagaagu

SEQ ID NO: 654226 - RNA, 22 nt, Human
acagugcagggcgggaagaagg

SEQ ID NO: 654227 - RNA, 22 nt, Human
acacagaagcuuuuucuauucc

SEQ ID NO: 654228 - RNA, 22 nt, Human
agcagcucauggaguaggcacu

SEQ ID NO: 654229 - RNA, 22 nt, Human
gagugguuagaaguaguguggc

SEQ ID NO: 654230 - RNA, 23 nt, Human
auuacaugagcaaauauagcuau

SEQ ID NO: 654231 - RNA, 22 nt, Human
uucugacauauccagucucagu

SEQ ID NO: 654232 - RNA, 22 nt, Human
gagagucugguagagcagcaag

SEQ ID NO: 654233 - RNA, 22 nt, Human
uggggccagagauggggcgcag

SEQ ID NO: 654234 - RNA, 22 nt, Human
ggugcauggaaagaguaaguaa

SEQ ID NO: 654235 - RNA, 19 nt, Human
cacaacuucgcuugauucc

SEQ ID NO: 654236 - RNA, 22 nt, Human
uugauucacaauuaccaagacu

SEQ ID NO: 654237 - RNA, 22 nt, Human
ugauuacagucugacagauguu

SEQ ID NO: 654238 - RNA, 22 nt, Human
aggcaugugacccuggacucag

SEQ ID NO: 654239 - RNA, 22 nt, Human
auggccacauuuaguaacuggu

SEQ ID NO: 654240 - RNA, 18 nt, Human
aguccuucuugguuuuac

SEQ ID NO: 654241 - RNA, 21 nt, Human
acacacugaguuuuccacugu

SEQ ID NO: 654242 - RNA, 22 nt, Human
uagcagcacaaauggacuauga

SEQ ID NO: 654243 - RNA, 22 nt, Human
gacuggggaaggacccgagacc

SEQ ID NO: 654244 - RNA, 22 nt, Human
gcuuuucuauaagaacuuucaa

SEQ ID NO: 654245 - RNA, 22 nt, Human
cauuuguaguaucuguuuauau

SEQ ID NO: 654246 - RNA, 22 nt, Human
cuuuagacauacagaauuucca

SEQ ID NO: 654247 - RNA, 22 nt, Human
ccagagccggauugugaagugc

SEQ ID NO: 654248 - RNA, 22 nt, Human
ucuuugcacacagcgauucuuc

SEQ ID NO: 654249 - RNA, 22 nt, Human
auuauucaacacuugagaaauu

SEQ ID NO: 654250 - RNA, 22 nt, Human
ucagaagcaaacaucacucuag

SEQ ID NO: 654251 - RNA, 22 nt, Human
agcauuugaaaacuauuuaauu

SEQ ID NO: 654252 - RNA, 22 nt, Human
ucaggaguaaagaagacuugac

SEQ ID NO: 654253 - RNA, 22 nt, Human
ucagagaacacagaggugaugu

SEQ ID NO: 654254 - RNA, 22 nt, Human
ucucuggcuccugccgggucca

SEQ ID NO: 654255 - RNA, 22 nt, Human
uugaaauggcagcagcugaccu

SEQ ID NO: 654256 - RNA, 22 nt, Human
accaggagggacccugguggcc

SEQ ID NO: 654257 - RNA, 22 nt, Human
cuguccuaugaguacucacuag

SEQ ID NO: 654258 - RNA, 22 nt, Human
cuggcuuucugaacaucaguga

SEQ ID NO: 654259 - RNA, 19 nt, Human
acagggcucuggacgccau

SEQ ID NO: 654260 - RNA, 22 nt, Human
cuucaaacccagauuaaaugca

SEQ ID NO: 654261 - RNA, 22 nt, Human
aagauguuuagguaaaaaguuu

SEQ ID NO: 654262 - RNA, 22 nt, Human
uccagggcuacaaggcaccaga

SEQ ID NO: 654263 - RNA, 22 nt, Human
uuauacgcucaauccuaucauc

SEQ ID NO: 654264 - RNA, 22 nt, Human
agcaggcagcaugggacccucc

SEQ ID NO: 654265 - RNA, 22 nt, Human
auaaagcuauuuuuaauucugu

SEQ ID NO: 654266 - RNA, 22 nt, Human
guuuuccuguugaguaguauuc

SEQ ID NO: 654267 - RNA, 22 nt, Human
aauuagcauuucccauauaaau

SEQ ID NO: 654268 - RNA, 22 nt, Human
uggaauuuaguuaauuccauuu

SEQ ID NO: 654269 - RNA, 22 nt, Human
ucugugccaucagucuccagag

SEQ ID NO: 654270 - RNA, 22 nt, Human
uacacauaggucugaauaaaaa

SEQ ID NO: 654271 - RNA, 22 nt, Human
ucugaaauuguuaguaaaaaug

SEQ ID NO: 654272 - RNA, 22 nt, Human
uggggaagggcacccuggagac

SEQ ID NO: 654273 - RNA, 22 nt, Human
uuauuugaaugauggcacaauu

SEQ ID NO: 654274 - RNA, 22 nt, Human
agggggcugccaaggaauguaa

SEQ ID NO: 654275 - RNA, 22 nt, Human
gccucuccgagccacugccucu

SEQ ID NO: 654276 - RNA, 22 nt, Human
ucuuuggaaugcuagcauucua

SEQ ID NO: 654277 - RNA, 22 nt, Human
auuuugaugcuaucuaaugaau

SEQ ID NO: 654278 - RNA, 21 nt, Human
aguuuuauauuauaagcuaaa

SEQ ID NO: 654279 - RNA, 22 nt, Human
agccugcuucccuuugugcccc

SEQ ID NO: 654280 - RNA, 22 nt, Human
gccuaggagacaagcgugaaag

SEQ ID NO: 654281 - RNA, 22 nt, Human
uguuuacuucaucgaguacuuc

SEQ ID NO: 654282 - RNA, 22 nt, Human
aaucuagucuccuuaagucuuu

SEQ ID NO: 654283 - RNA, 22 nt, Human
cccaggcagugugugcaugcgu

SEQ ID NO: 654284 - RNA, 22 nt, Human
uccagcagguuggucaggugca

SEQ ID NO: 654285 - RNA, 22 nt, Human
agucuuaacuaugcaaguacua

SEQ ID NO: 654286 - RNA, 22 nt, Human
ugucuucgcuacaaugaaaagg

SEQ ID NO: 654287 - RNA, 22 nt, Human
ggagucuggaguggggcccaag

SEQ ID NO: 654288 - RNA, 22 nt, Human
aaaccugaaguacguuacauaa

SEQ ID NO: 654289 - RNA, 22 nt, Human
aggucugacucuuugccacaua

SEQ ID NO: 654290 - RNA, 20 nt, Human
gggugaggauggagaauuug

SEQ ID NO: 654291 - RNA, 22 nt, Human
gugcuucucuucacacccaacu

SEQ ID NO: 654292 - RNA, 22 nt, Human
aaggggccucacagaugggcuu

SEQ ID NO: 654293 - RNA, 22 nt, Human
cuccguuuugugggacacggau

SEQ ID NO: 654294 - RNA, 22 nt, Human
agagccuguuuugugggagaug

SEQ ID NO: 654295 - RNA, 22 nt, Human
aagugugggaaguugcuaaaau

SEQ ID NO: 654296 - RNA, 22 nt, Human
cuuuacacuuggacccacacuu

SEQ ID NO: 654297 - RNA, 22 nt, Human
caagaaaucuagaagucagugg

SEQ ID NO: 654298 - RNA, 21 nt, Human
aaugaugaaagaugacagagu

SEQ ID NO: 654299 - RNA, 22 nt, Human
ggcaauauggugaaaccccauc

SEQ ID NO: 654300 - RNA, 22 nt, Human
aaauggcugacuuuucauggga

SEQ ID NO: 654301 - RNA, 22 nt, Human
ucugggccucaccugcugcuca

SEQ ID NO: 654302 - RNA, 22 nt, Human
uuuaguguaauucugccuuuug

SEQ ID NO: 654303 - RNA, 22 nt, Human
gugggcuggacccuccugcucc

SEQ ID NO: 654304 - RNA, 22 nt, Human
ccucuggcagccagccaguugu

SEQ ID NO: 654305 - RNA, 22 nt, Human
ccagugggugcugggcucugcc

SEQ ID NO: 654306 - RNA, 18 nt, Human
cagugaggaugaaggguu

SEQ ID NO: 654307 - RNA, 22 nt, Human
aggugacaggacaggagcuggu

SEQ ID NO: 654308 - RNA, 22 nt, Human
cugaaaggguuacauaguaagu

SEQ ID NO: 654309 - RNA, 22 nt, Human
uuugacaucuaagaauucuuac

SEQ ID NO: 654310 - RNA, 20 nt, Human
guuugaaaugauugguuggu

SEQ ID NO: 654311 - RNA, 22 nt, Human
gcccccucaaagaggaagcucu

SEQ ID NO: 654312 - RNA, 22 nt, Human
auucucuggcuaaaaccugaag

SEQ ID NO: 654313 - RNA, 22 nt, Human
cacaggccugucucuuucuaac

SEQ ID NO: 654314 - RNA, 22 nt, Human
aagaacuuuaaagcacuuauga

SEQ ID NO: 654315 - RNA, 22 nt, Human
uggcucaguggcagccgcagcu

SEQ ID NO: 654316 - RNA, 22 nt, Human
uuccugcaaaacuacuaguagc

SEQ ID NO: 654317 - RNA, 22 nt, Human
ucugagcagggcaguguccaug

SEQ ID NO: 654318 - RNA, 22 nt, Human
uuuccugccuggaccucugcuu

SEQ ID NO: 654319 - RNA, 23 nt, Human
cuguuaaauuccuuaagagcagg

SEQ ID NO: 654320 - RNA, 22 nt, Human
ggcuuugcaaacucauuccaca

SEQ ID NO: 654321 - RNA, 22 nt, Human
caggaagcugugaaggagacgg

SEQ ID NO: 654322 - RNA, 22 nt, Human
gaggacugaaacuuacaggaaa

SEQ ID NO: 654323 - RNA, 21 nt, Human
gccaagaacaagacagacaug

SEQ ID NO: 654324 - RNA, 22 nt, Human
aguucccuccacaacuucucac

SEQ ID NO: 654325 - RNA, 22 nt, Human
cuagagaauggcaaagauuaga

SEQ ID NO: 654326 - RNA, 22 nt, Human
cucagcuccaggugugcaucuu

SEQ ID NO: 654327 - RNA, 22 nt, Human
agcaguuaugugucucuugacu

SEQ ID NO: 654328 - RNA, 22 nt, Human
gucuucuuguuuugaaggaaau

SEQ ID NO: 654329 - RNA, 22 nt, Human
uagggcuucaggugugaggcag

SEQ ID NO: 654330 - RNA, 22 nt, Human
auggggagagaagggcugagcu

SEQ ID NO: 654331 - RNA, 22 nt, Human
cacuaggcgccggguggcugug

SEQ ID NO: 654332 - RNA, 22 nt, Human
ucagauagugauaauagcaugu

SEQ ID NO: 654333 - RNA, 22 nt, Human
guaggggugcugagaucuggaa

SEQ ID NO: 654334 - RNA, 22 nt, Human
uggcacaugguuaaucauaauu

SEQ ID NO: 654335 - RNA, 18 nt, Human
ugacccuuucucccugug

SEQ ID NO: 654336 - RNA, 22 nt, Human
gcuggaagggaggcccagccgg

SEQ ID NO: 654337 - RNA, 22 nt, Human
ggguccagcuacaucagggugg

SEQ ID NO: 654338 - RNA, 22 nt, Human
ccugggcauaaaucacuccaag

SEQ ID NO: 654339 - RNA, 22 nt, Human
cacuucaaggaauaucuagaaa

SEQ ID NO: 654340 - RNA, 22 nt, Human
aaccuaggacuauagauaucau

SEQ ID NO: 654341 - RNA, 22 nt, Human
acauaauagguaccugaauaau

SEQ ID NO: 654342 - RNA, 22 nt, Human
cauuugaaugagauugcuguaa

SEQ ID NO: 654343 - RNA, 22 nt, Human
uugugaauagugcugcaauaaa

SEQ ID NO: 654344 - RNA, 22 nt, Human
aaaaaggcuaagcaucuugugc

SEQ ID NO: 654345 - RNA, 22 nt, Human
uaugcacacauuagcacagggu

SEQ ID NO: 654346 - RNA, 22 nt, Human
ggaguggcacucugaggcgggg

SEQ ID NO: 654347 - RNA, 22 nt, Human
acacuguaaagugaugcuuaaa

SEQ ID NO: 654348 - RNA, 22 nt, Human
augcugugucaggaauuugaua

SEQ ID NO: 654349 - RNA, 22 nt, Human
uauacaauggcugaaucaucca

SEQ ID NO: 654350 - RNA, 22 nt, Human
ugucacaguuuguacuuuauag

SEQ ID NO: 654351 - RNA, 22 nt, Human
uuggcugucacugucaguucag

SEQ ID NO: 654352 - RNA, 22 nt, Human
ggcagggcagcgcugauuaggg

SEQ ID NO: 654353 - RNA, 22 nt, Human
auucaagagcuggcuuugaaau

SEQ ID NO: 654354 - RNA, 19 nt, Human
ugcuggaggguagugaguc

SEQ ID NO: 654355 - RNA, 23 nt, Human
acuuucccauagcauggcuuccu

SEQ ID NO: 654356 - RNA, 22 nt, Human
agcauguguggagaaauauuuu

SEQ ID NO: 654357 - RNA, 22 nt, Human
uuucuccugaguuccacgcuac

SEQ ID NO: 654358 - RNA, 22 nt, Human
ugcaauacucaucauuggagau

SEQ ID NO: 654359 - RNA, 23 nt, Human
ccucaugaaggucugcuuccugg

SEQ ID NO: 654360 - RNA, 22 nt, Human
ucugggcugugguuccacuccg

SEQ ID NO: 654361 - RNA, 22 nt, Human
aucuugaaugaaugacucuuua

SEQ ID NO: 654362 - RNA, 22 nt, Human
aaacagugcaggaaguuaagca

SEQ ID NO: 654363 - RNA, 22 nt, Human
uccaagaauacagauuugugaa

SEQ ID NO: 654364 - RNA, 22 nt, Human
uugcaaauuaaagaggauagca

SEQ ID NO: 654365 - RNA, 22 nt, Human
gggccagguggaccccagccuc

SEQ ID NO: 654366 - RNA, 22 nt, Human
uuaguuagucccugguaccuuu

SEQ ID NO: 654367 - RNA, 22 nt, Human
auggguggagggugacacggau

SEQ ID NO: 654368 - RNA, 22 nt, Human
ccucaggaaccacauugcugcu

SEQ ID NO: 654369 - RNA, 22 nt, Human
cccuuuaaaguuuuaccagcag

SEQ ID NO: 654370 - RNA, 16 nt, Human
gcuggaguccuggagc

SEQ ID NO: 654371 - RNA, 22 nt, Human
ugccuuuaaccagucuagacag

SEQ ID NO: 654372 - RNA, 19 nt, Human
ucacccaggcugcuggcuc

SEQ ID NO: 654373 - RNA, 22 nt, Human
gcaauacuaagugacuuuuggg

SEQ ID NO: 654374 - RNA, 20 nt, Human
cccagcccgggccgcgcucg

SEQ ID NO: 654375 - RNA, 22 nt, Human
agcugggcuccaagagggaucu

SEQ ID NO: 654376 - RNA, 22 nt, Human
ccaugcauggcacuggacuggg

SEQ ID NO: 654377 - RNA, 22 nt, Human
aaagacugguguguuacauaua

SEQ ID NO: 654378 - RNA, 22 nt, Human
cuacacuuguucgacugcagga

SEQ ID NO: 654379 - RNA, 20 nt, Human
uacaacaaguagagacauac

SEQ ID NO: 654380 - RNA, 22 nt, Human
gggucagcugcugggggcugac

SEQ ID NO: 654381 - RNA, 22 nt, Human
agcuuuggauuucuuauagccc

SEQ ID NO: 654382 - RNA, 22 nt, Human
cugccuuugcccuugacacugu

SEQ ID NO: 654383 - RNA, 22 nt, Human
auagaucacaaugguucacuuu

SEQ ID NO: 654384 - RNA, 22 nt, Human
uacauugcuuucuaauacaucu

SEQ ID NO: 654385 - RNA, 22 nt, Human
cuucaguuaguuucaugugagc

SEQ ID NO: 654386 - RNA, 22 nt, Human
uggagcugagagccaggcuggc

SEQ ID NO: 654387 - RNA, 22 nt, Human
gcuggaggaggaagugugaggg

SEQ ID NO: 654388 - RNA, 22 nt, Human
ugucugucagauauuaaguuuc

SEQ ID NO: 654389 - RNA, 22 nt, Human
uuaaaggcuauggcugccuggg

SEQ ID NO: 654390 - RNA, 22 nt, Human
agcuuucucccugacgcuuugg

SEQ ID NO: 654391 - RNA, 23 nt, Human
ggaguuggauuguacuugcugcu

SEQ ID NO: 654392 - RNA, 22 nt, Human
aacuggagccccucugccacug

SEQ ID NO: 654393 - RNA, 18 nt, Human
ggagggcuuuggggacug

SEQ ID NO: 654394 - RNA, 18 nt, Human
uuucuuucugccuggggc

SEQ ID NO: 654395 - RNA, 17 nt, Human
auguuaauuucacauuu

SEQ ID NO: 654396 - RNA, 19 nt, Human
cuggaaugauagagaccuc

SEQ ID NO: 654397 - RNA, 22 nt, Human
ugagcaccuaccuuguccagug

SEQ ID NO: 654398 - RNA, 22 nt, Human
ccuggcucugggaucuucgcuu

SEQ ID NO: 654399 - RNA, 22 nt, Human
ccacucugauuuuggcuccacu

SEQ ID NO: 654400 - RNA, 21 nt, Human
cccaggcugaauuaaaaauau

SEQ ID NO: 654401 - RNA, 22 nt, Human
gucaauaucuugguuguacuau

SEQ ID NO: 654402 - RNA, 22 nt, Human
agccugugugaagcccucagag

SEQ ID NO: 654403 - RNA, 22 nt, Human
aagggcugaucucacuuucuuu

SEQ ID NO: 654404 - RNA, 22 nt, Human
gcacaauaauucuuguuuugcu

SEQ ID NO: 654405 - RNA, 22 nt, Human
agaugcuuacuaugguuguaug

SEQ ID NO: 654406 - RNA, 22 nt, Human
auagauugcuaguuuuaaaauu

SEQ ID NO: 654407 - RNA, 22 nt, Human
uugccugggcuaguaagccaga

SEQ ID NO: 654408 - RNA, 22 nt, Human
aaggaagauauaucaagcuuaa

SEQ ID NO: 654409 - RNA, 22 nt, Human
auggcugugaaggucacacccu

SEQ ID NO: 654410 - RNA, 22 nt, Human
caggacuauguucaacagauag

SEQ ID NO: 654411 - RNA, 22 nt, Human
acccaggacucucuuccaguag

SEQ ID NO: 654412 - RNA, 19 nt, Human
agcacaguuuccacaugca

SEQ ID NO: 654413 - RNA, 22 nt, Human
uuccugaggugauucuaaugug

SEQ ID NO: 654414 - RNA, 22 nt, Human
ugaguauuccuuaucugaaaug

SEQ ID NO: 654415 - RNA, 22 nt, Human
guggcccaggcuuggcgcuggc

SEQ ID NO: 654416 - RNA, 19 nt, Human
caauauauagugaguggau

SEQ ID NO: 654417 - RNA, 22 nt, Human
uuacacaugaagguccaauguu

SEQ ID NO: 654418 - RNA, 22 nt, Human
gcacauaugcuguaagcacaug

SEQ ID NO: 654419 - RNA, 22 nt, Human
auuuuacuaaguggauaucugu

SEQ ID NO: 654420 - RNA, 22 nt, Human
agcaaggcagucagcuggcugg

SEQ ID NO: 654421 - RNA, 22 nt, Human
cuuuacagauggauaauuguuu

SEQ ID NO: 654422 - RNA, 22 nt, Human
aagaggaggacgguucccagaa

SEQ ID NO: 654423 - RNA, 22 nt, Human
uaucuuuaacuugcaguauuua

SEQ ID NO: 654424 - RNA, 22 nt, Human
ucuccuuucuggagccugcuca

SEQ ID NO: 654425 - RNA, 22 nt, Human
cacagaagaaucaugcuguguu

SEQ ID NO: 654426 - RNA, 22 nt, Human
uccuggggcugcaaggccuguc

SEQ ID NO: 654427 - RNA, 22 nt, Human
aaacaucuuucuauugcaaguu

SEQ ID NO: 654428 - RNA, 22 nt, Human
aauuugaugaguuuguaagucu

SEQ ID NO: 654429 - RNA, 22 nt, Human
gggcccuggccgaaucccucug

SEQ ID NO: 654430 - RNA, 22 nt, Human
augcacuaugaugagcuagucu

SEQ ID NO: 654431 - RNA, 19 nt, Human
acccagagcccuuugcagg

SEQ ID NO: 654432 - RNA, 22 nt, Human
caugcaaaugugcuaaucugaa

SEQ ID NO: 654433 - RNA, 22 nt, Human
uuggaggcaaugggaaggaggc

SEQ ID NO: 654434 - RNA, 22 nt, Human
agccagugucgugugacaugag

SEQ ID NO: 654435 - RNA, 22 nt, Human
uaggccagaggagcagcuuugg

SEQ ID NO: 654436 - RNA, 22 nt, Human
caccugagcaacccugugcggg

SEQ ID NO: 654437 - RNA, 20 nt, Human
acugacagggaacuaaggcu

SEQ ID NO: 654438 - RNA, 22 nt, Human
guagaggcagaaacugaaggac

SEQ ID NO: 654439 - RNA, 22 nt, Human
ggacucaggcugguguucggac

SEQ ID NO: 654440 - RNA, 18 nt, Human
ucaugagguagaggcugg

SEQ ID NO: 654441 - RNA, 22 nt, Human
auagcuuucuuaaauauauaaa

SEQ ID NO: 654442 - RNA, 22 nt, Human
cauugcacuccaucuugggcaa

SEQ ID NO: 654443 - RNA, 22 nt, Human
cugaaggagcauagucaguuuu

SEQ ID NO: 654444 - RNA, 22 nt, Human
aagagcaucuauuucacagugg

SEQ ID NO: 654445 - RNA, 23 nt, Human
augcaggacuuauaagguaaggu

SEQ ID NO: 654446 - RNA, 22 nt, Human
uguagaaccuguuuauuauaga

SEQ ID NO: 654447 - RNA, 22 nt, Human
guggcagagaacaaggagaggu

SEQ ID NO: 654448 - RNA, 19 nt, Human
ggcugcagagccccggcgc

SEQ ID NO: 654449 - RNA, 22 nt, Human
gacagugguuccaaggcagcuu

SEQ ID NO: 654450 - RNA, 22 nt, Human
aaaauuauggaguaucccaaag

SEQ ID NO: 654451 - RNA, 22 nt, Human
ucuuuugugauucuuuaguuac

SEQ ID NO: 654452 - RNA, 20 nt, Human
uccaguggccugaaucugga

SEQ ID NO: 654453 - RNA, 22 nt, Human
ccucagacuugauaauuggguu

SEQ ID NO: 654454 - RNA, 22 nt, Human
uccuggcccggccgggccugcu

SEQ ID NO: 654455 - RNA, 22 nt, Human
ggguaggaaauccagagguggc

SEQ ID NO: 654456 - RNA, 22 nt, Human
gguaacugcagaaugugccuca

SEQ ID NO: 654457 - RNA, 22 nt, Human
gucacaggccuggaugaggggc

SEQ ID NO: 654458 - RNA, 22 nt, Human
auaaacaucuguuucucuucug

SEQ ID NO: 654459 - RNA, 19 nt, Human
ccagcccacagugacuuuc

SEQ ID NO: 654460 - RNA, 22 nt, Human
ucaggggcagcugugcuuugug

SEQ ID NO: 654461 - RNA, 22 nt, Human
cuuauucagaaggagaaaugga

SEQ ID NO: 654462 - RNA, 22 nt, Human
cuaggccauauuuugagaacug

SEQ ID NO: 654463 - RNA, 19 nt, Human
ugagaacuuuuacuuaugc

SEQ ID NO: 654464 - RNA, 22 nt, Human
cacaaggacuggauggaguggg

SEQ ID NO: 654465 - RNA, 22 nt, Human
uucugugacuccucagagauuu

SEQ ID NO: 654466 - RNA, 22 nt, Human
agcuccagccgcugauggguuu

SEQ ID NO: 654467 - RNA, 22 nt, Human
uaacaguacauccuuuucucuu

SEQ ID NO: 654468 - RNA, 22 nt, Human
ugacauaauaauccaaacauac

SEQ ID NO: 654469 - RNA, 22 nt, Human
gauggcagcagcagccagggau

SEQ ID NO: 654470 - RNA, 22 nt, Human
gaaaugaugucugugcugccac

SEQ ID NO: 654471 - RNA, 22 nt, Human
cugcauuucacauuuaaacuuu

SEQ ID NO: 654472 - RNA, 18 nt, Human
ucugggcaaucucaguau

SEQ ID NO: 654473 - RNA, 22 nt, Human
acaguggaaaugugggagggga

SEQ ID NO: 654474 - RNA, 22 nt, Human
aggcagugugggccaagcuucc

SEQ ID NO: 654475 - RNA, 22 nt, Human
agcuucacuuuguacuuuguca

SEQ ID NO: 654476 - RNA, 22 nt, Human
gacacauugaugugaguacaua

SEQ ID NO: 654477 - RNA, 22 nt, Human
uugagucaguaauuccauuucu

SEQ ID NO: 654478 - RNA, 22 nt, Human
uugaggcagguccggguccuuc

SEQ ID NO: 654479 - RNA, 22 nt, Human
cacugucuugauuacuaugggu

SEQ ID NO: 654480 - RNA, 22 nt, Human
aaaggucaagcuggacucaggu

SEQ ID NO: 654481 - RNA, 22 nt, Human
cuguccuuacugcuucuggcuu

SEQ ID NO: 654482 - RNA, 20 nt, Human
uggcuccugcgguggaacca

SEQ ID NO: 654483 - RNA, 22 nt, Human
accaagcuguauauuauugguu

SEQ ID NO: 654484 - RNA, 20 nt, Human
guuaggagguuggacaugga

SEQ ID NO: 654485 - RNA, 22 nt, Human
aagcccagcucugccugcucug

SEQ ID NO: 654486 - RNA, 22 nt, Human
uguucauuuggcccuuuuguau

SEQ ID NO: 654487 - RNA, 22 nt, Human
gagauucucagaaguacuagga

SEQ ID NO: 654488 - RNA, 22 nt, Human
ggcuguguccuguaugauuauu

SEQ ID NO: 654489 - RNA, 22 nt, Human
ccugaggucaugguccaguguu

SEQ ID NO: 654490 - RNA, 22 nt, Human
aacaguguguacacaucauagg

SEQ ID NO: 654491 - RNA, 22 nt, Human
ucauggcacuuagcacaguccu

SEQ ID NO: 654492 - RNA, 22 nt, Human
aauauuucaaaaggaaacacag

SEQ ID NO: 654493 - RNA, 22 nt, Human
aagagguggguuggacagauac

SEQ ID NO: 654494 - RNA, 22 nt, Human
ugacugugcaagcagagagcau

SEQ ID NO: 654495 - RNA, 22 nt, Human
agacaaaugguaauuaugucua

SEQ ID NO: 654496 - RNA, 22 nt, Human
ucgaagguuauugucuuuacgu

SEQ ID NO: 654497 - RNA, 22 nt, Human
aaucauaauuguauacauucau

SEQ ID NO: 654498 - RNA, 22 nt, Human
uguaaacaaaugcauucuugcu

SEQ ID NO: 654499 - RNA, 22 nt, Human
gaguuguucaacgugugugaaa

SEQ ID NO: 654500 - RNA, 22 nt, Human
aagcauuuuagauaaagcauca

SEQ ID NO: 654501 - RNA, 22 nt, Human
ccagcuguuggaguuucacugc

SEQ ID NO: 654502 - RNA, 22 nt, Human
acugccugcauccuuaggguag

SEQ ID NO: 654503 - RNA, 22 nt, Human
aaucuggcucagaagaagauga

SEQ ID NO: 654504 - RNA, 18 nt, Human
gccagcugcacggcccuc

SEQ ID NO: 654505 - RNA, 22 nt, Human
aacaaaguuucaggaagauaga

SEQ ID NO: 654506 - RNA, 20 nt, Human
agcaggugacggggccugcu

SEQ ID NO: 654507 - RNA, 22 nt, Human
aagacauucaugaagaagggau

SEQ ID NO: 654508 - RNA, 22 nt, Human
ucaggaaggagcuggccugcca

SEQ ID NO: 654509 - RNA, 22 nt, Human
gaggaggccaguggaaggaagc

SEQ ID NO: 654510 - RNA, 22 nt, Human
ugggucagauugagccccuggu

SEQ ID NO: 654511 - RNA, 22 nt, Human
agucuucccugugccagagugu

SEQ ID NO: 654512 - RNA, 22 nt, Human
guuucagaaaugguuuaugcaa

SEQ ID NO: 654513 - RNA, 22 nt, Human
ugcaguguuuggaugcugaguc

SEQ ID NO: 654514 - RNA, 22 nt, Human
ucugugucuguuacuucacugc

SEQ ID NO: 654515 - RNA, 22 nt, Human
cccagagccgcuccccuacuuc

SEQ ID NO: 654516 - RNA, 22 nt, Human
cuggcagauuggggucagcagu

SEQ ID NO: 654517 - RNA, 22 nt, Human
ucauggcuggaagcucaguuag

SEQ ID NO: 654518 - RNA, 22 nt, Human
gcacccagagggcagggucucc

SEQ ID NO: 654519 - RNA, 22 nt, Human
ucuccagggacauguuucugga

SEQ ID NO: 654520 - RNA, 22 nt, Human
ugcagagcagcaacugcgugcg

SEQ ID NO: 654521 - RNA, 22 nt, Human
ugcuugaugauugcugucuccc

SEQ ID NO: 654522 - RNA, 22 nt, Human
ggcugugccucaaggcuacuca

SEQ ID NO: 654523 - RNA, 22 nt, Human
acacauucaugagugcaugcac

SEQ ID NO: 654524 - RNA, 22 nt, Human
caaagaaggaacuauaauccca

SEQ ID NO: 654525 - RNA, 22 nt, Human
gagucgagcagaaagccgucgg

SEQ ID NO: 654526 - RNA, 22 nt, Human
ugcucuggaguggcuugugcac

SEQ ID NO: 654527 - RNA, 22 nt, Human
acuggccaggcgaaccacacug

SEQ ID NO: 654528 - RNA, 21 nt, Human
ugcuggccaugugcugggcau

SEQ ID NO: 654529 - RNA, 21 nt, Human
acagaugggaugagcacacug

SEQ ID NO: 654530 - RNA, 22 nt, Human
gcuuuagaaauaucacugugga

SEQ ID NO: 654531 - RNA, 22 nt, Human
ccucuggccauucuuugaugga

SEQ ID NO: 654532 - RNA, 22 nt, Human
ugaguccugucuuugucacuua

SEQ ID NO: 654533 - RNA, 22 nt, Human
acauguuugccugcaggcuuag

SEQ ID NO: 654534 - RNA, 22 nt, Human
gaagaagcaggaguguguagca

SEQ ID NO: 654535 - RNA, 22 nt, Human
aauguacaucucaguguaguac

SEQ ID NO: 654536 - RNA, 22 nt, Human
cagagccccucagcucucuccc

SEQ ID NO: 654537 - RNA, 22 nt, Human
ugcacuuugcaggcauggaaac

SEQ ID NO: 654538 - RNA, 22 nt, Human
ggaaggguuuaagcaggagagu

SEQ ID NO: 654539 - RNA, 22 nt, Human
gcacugccugugagcccugguu

SEQ ID NO: 654540 - RNA, 22 nt, Human
ucuucaaagcauaugcaggcau

SEQ ID NO: 654541 - RNA, 22 nt, Human
aucuacucaguaacugcuuagg

SEQ ID NO: 654542 - RNA, 19 nt, Human
cugugagucuuguggccuc

SEQ ID NO: 654543 - RNA, 22 nt, Human
cuauucugcuugaaauuauucu

SEQ ID NO: 654544 - RNA, 22 nt, Human
ccucugggugacagacucuugg

SEQ ID NO: 654545 - RNA, 22 nt, Human
aagcugaaucugaaauagaauu

SEQ ID NO: 654546 - RNA, 22 nt, Human
aacuugaacugaugaguguuag

SEQ ID NO: 654547 - RNA, 22 nt, Human
ugucuuuggaauauuuagcuga

SEQ ID NO: 654548 - RNA, 20 nt, Human
ggcucaucuugucugcugac

SEQ ID NO: 654549 - RNA, 22 nt, Human
ugcccucauuauaagaggcuca

SEQ ID NO: 654550 - RNA, 22 nt, Human
cagauucugggcccagcuuguc

SEQ ID NO: 654551 - RNA, 22 nt, Human
uggcugaauaauauucuguugu

SEQ ID NO: 654552 - RNA, 22 nt, Human
uugcuucuggaacuuucuguuc

SEQ ID NO: 654553 - RNA, 22 nt, Human
agagcaggggcaauguguugca

SEQ ID NO: 654554 - RNA, 22 nt, Human
caggcugaucagggcugggaug

SEQ ID NO: 654555 - RNA, 22 nt, Human
gaauaucccgcuaugcaaagua

SEQ ID NO: 654556 - RNA, 23 nt, Human
ccuccccaccagacucuaacaua

SEQ ID NO: 654557 - RNA, 22 nt, Human
acaaggcacuuuaugaagagga

SEQ ID NO: 654558 - RNA, 22 nt, Human
ucagcucaucugagugucagcg

SEQ ID NO: 654559 - RNA, 22 nt, Human
uuuugaaagccagguuuguaug

SEQ ID NO: 654560 - RNA, 22 nt, Human
gggacaauggaggccucucucc

SEQ ID NO: 654561 - RNA, 22 nt, Human
ugaagagauagaaguacaugcu

SEQ ID NO: 654562 - RNA, 22 nt, Human
aggcuucaguuguaccuucuug

SEQ ID NO: 654563 - RNA, 22 nt, Human
ggcaggacauugacuacaguga

SEQ ID NO: 654564 - RNA, 22 nt, Human
uaggaacuaguagauguguaaa

SEQ ID NO: 654565 - RNA, 21 nt, Human
ugcaccugugccccauccuuc

SEQ ID NO: 654566 - RNA, 22 nt, Human
gagagggcugccuggugugagg

SEQ ID NO: 654567 - RNA, 22 nt, Human
acauuucagauguaaugugaug

SEQ ID NO: 654568 - RNA, 22 nt, Human
ucacugggcaucggagcugaaa

SEQ ID NO: 654569 - RNA, 23 nt, Human
gagguacagcaccagugaauagg

SEQ ID NO: 654570 - RNA, 22 nt, Human
gcagcugcucacauucucacaa

SEQ ID NO: 654571 - RNA, 22 nt, Human
uguggaaagucaaguuccagga

SEQ ID NO: 654572 - RNA, 22 nt, Human
ggaaaugugggcuguuucugua

SEQ ID NO: 654573 - RNA, 22 nt, Human
ugagcagaugucuaacuuuuac

SEQ ID NO: 654574 - RNA, 22 nt, Human
gcagugaagauggcagguuggg

SEQ ID NO: 654575 - RNA, 22 nt, Human
ucuggguaaucagggcugggag

SEQ ID NO: 654576 - RNA, 20 nt, Human
aucagaagugauauuaacca

SEQ ID NO: 654577 - RNA, 22 nt, Human
aguggggacaaugagagcaggu

SEQ ID NO: 654578 - RNA, 22 nt, Human
ccccuuccaggaagcagaaucg

SEQ ID NO: 654579 - RNA, 22 nt, Human
uaguuuuagcagcaaugggaug

SEQ ID NO: 654580 - RNA, 22 nt, Human
cugaucccauuggcaguccagu

SEQ ID NO: 654581 - RNA, 22 nt, Human
cuacaugaacucuuaagucaca

SEQ ID NO: 654582 - RNA, 22 nt, Human
ugcccagccuaaacuuggcaag

SEQ ID NO: 654583 - RNA, 22 nt, Human
caccugccugcaggggcuccac

SEQ ID NO: 654584 - RNA, 22 nt, Human
cuagagcuguucugugcacuca

SEQ ID NO: 654585 - RNA, 22 nt, Human
cuguuacauagcuuuucuuaac

SEQ ID NO: 654586 - RNA, 22 nt, Human
aauagcuuuggucaccaucugg

SEQ ID NO: 654587 - RNA, 22 nt, Human
cugagguguugaugaccuaugc

SEQ ID NO: 654588 - RNA, 22 nt, Human
ugugaaaucugaacucaaagau

SEQ ID NO: 654589 - RNA, 22 nt, Human
caaauagaagguacucagagaa

SEQ ID NO: 654590 - RNA, 22 nt, Human
uggcuucucgccugucaucccg

SEQ ID NO: 654591 - RNA, 22 nt, Human
ugucacauauauaauguucaau

SEQ ID NO: 654592 - RNA, 19 nt, Human
uuugccuugcagcugugug

SEQ ID NO: 654593 - RNA, 22 nt, Human
uuuacagucaccaaacuuugcu

SEQ ID NO: 654594 - RNA, 22 nt, Human
ucagcccugggcuuccucaugg

SEQ ID NO: 654595 - RNA, 22 nt, Human
cacccauuaaccaaagagugaa

SEQ ID NO: 654596 - RNA, 22 nt, Human
gagauggaaaacugcugguagu

SEQ ID NO: 654597 - RNA, 22 nt, Human
ucugucuuuagaggccugugcu

SEQ ID NO: 654598 - RNA, 22 nt, Human
uuuaucagaaguuagagaaaga

SEQ ID NO: 654599 - RNA, 22 nt, Human
uauuugaagauucuucugaugu

SEQ ID NO: 654600 - RNA, 22 nt, Human
agcccagggaaccaggaagugg

SEQ ID NO: 654601 - RNA, 22 nt, Human
auguccagaggugagucagagc

SEQ ID NO: 654602 - RNA, 23 nt, Human
uguaaauuuuguagucacauuuu

SEQ ID NO: 654603 - RNA, 22 nt, Human
aaguaaauguuggagcucaaau

SEQ ID NO: 654604 - RNA, 18 nt, Human
gcugcgugggaugugacc

SEQ ID NO: 654605 - RNA, 22 nt, Human
gaagcagcucagauugacugaa

SEQ ID NO: 654606 - RNA, 22 nt, Human
cuugaucuacauagugaaaccc

SEQ ID NO: 654607 - RNA, 22 nt, Human
cucuacagcugcugccccuggu

SEQ ID NO: 654608 - RNA, 22 nt, Human
aagcagucuuggcuggguucag

SEQ ID NO: 654609 - RNA, 22 nt, Human
cagugggugccaucgugcccuu

SEQ ID NO: 654610 - RNA, 22 nt, Human
ucagccagcaucagcuaagugc

SEQ ID NO: 654611 - RNA, 22 nt, Human
acaaauccagugaacuccagug

SEQ ID NO: 654612 - RNA, 22 nt, Human
ugaaggcuugacugaggcagga

SEQ ID NO: 654613 - RNA, 22 nt, Human
aagacugaguucaaaucacagc

SEQ ID NO: 654614 - RNA, 22 nt, Human
ugucaaagacagaaggaaaugg

SEQ ID NO: 654615 - RNA, 20 nt, Human
uuggcucugaucaguggagc

SEQ ID NO: 654616 - RNA, 22 nt, Human
uguccuccagcagcaugguaug

SEQ ID NO: 654617 - RNA, 22 nt, Human
ucaagaaacugugcuacagagu

SEQ ID NO: 654618 - RNA, 22 nt, Human
ugugccaugaggcucugauaug

SEQ ID NO: 654619 - RNA, 23 nt, Human
acagggaaaagucaucaguguga

SEQ ID NO: 654620 - RNA, 22 nt, Human
ucaggagcagggggaagcucug

SEQ ID NO: 654621 - RNA, 22 nt, Human
uggggggcacuucagcacaaug

SEQ ID NO: 654622 - RNA, 22 nt, Human
cuacauaaauauuuaugugucu

SEQ ID NO: 654623 - RNA, 22 nt, Human
ugaggcaggaguucaggcugcg

SEQ ID NO: 654624 - RNA, 22 nt, Human
gaagaacaccugcugcccagug

SEQ ID NO: 654625 - RNA, 22 nt, Human
uggcuagguagcuuucugcugu

SEQ ID NO: 654626 - RNA, 22 nt, Human
uuucuuagggacuguaaaauag

SEQ ID NO: 654627 - RNA, 22 nt, Human
cucuguguauccaaguucaggu

SEQ ID NO: 654628 - RNA, 22 nt, Human
ugcagcaugccaaacgaggagg

SEQ ID NO: 654629 - RNA, 22 nt, Human
cagagccugccaccuuucuccc

SEQ ID NO: 654630 - RNA, 22 nt, Human
cugugggaauacugcgagugua

SEQ ID NO: 654631 - RNA, 22 nt, Human
ggcugaguggcugggucuaguu

SEQ ID NO: 654632 - RNA, 22 nt, Human
acauaaaggugacuaacaucuu

SEQ ID NO: 654633 - RNA, 22 nt, Human
uccucaguuuucuaguauggca

SEQ ID NO: 654634 - RNA, 22 nt, Human
gccagcugcuggaacagcgcga

SEQ ID NO: 654635 - RNA, 22 nt, Human
ucauugaguugcacuuuuacua

SEQ ID NO: 654636 - RNA, 22 nt, Human
ugaggcucagagaacagugacu

SEQ ID NO: 654637 - RNA, 22 nt, Human
gcagcugcugggaucauuuagg

SEQ ID NO: 654638 - RNA, 22 nt, Human
gugagagaucccccacucaucu

SEQ ID NO: 654639 - RNA, 22 nt, Human
aaacucuggagauguuuaugca

SEQ ID NO: 654640 - RNA, 22 nt, Human
gccaggcaguucaaguacacca

SEQ ID NO: 654641 - RNA, 22 nt, Human
guuuaugaguuacguagggguu

SEQ ID NO: 654642 - RNA, 22 nt, Human
acaaucagcacugaguuuaucu

SEQ ID NO: 654643 - RNA, 22 nt, Human
gagaagcaauuuccaacugugc

SEQ ID NO: 654644 - RNA, 22 nt, Human
cacagcuucugucugacccaug

SEQ ID NO: 654645 - RNA, 22 nt, Human
cacagagaacugugggagugug

SEQ ID NO: 654646 - RNA, 22 nt, Human
aggcacaaagacagaaaagcac

SEQ ID NO: 654647 - RNA, 22 nt, Human
ugcauggacucaucagacaaga

SEQ ID NO: 654648 - RNA, 22 nt, Human
gagguagggcagaggcugaaug

SEQ ID NO: 654649 - RNA, 22 nt, Human
ugugaagauuaaguuacugggc

SEQ ID NO: 654650 - RNA, 19 nt, Human
uggucucugucucuuugca

SEQ ID NO: 654651 - RNA, 22 nt, Human
aagugagauuauauguacggga

SEQ ID NO: 654652 - RNA, 22 nt, Human
gagcucugauguuuaguggaga

SEQ ID NO: 654653 - RNA, 22 nt, Human
uggagguggcacaagggagguc

SEQ ID NO: 654654 - RNA, 22 nt, Human
ugagagagcgccugggaucauu

SEQ ID NO: 654655 - RNA, 22 nt, Human
aaagcacagagcucccacagga

SEQ ID NO: 654656 - RNA, 22 nt, Human
ucuugauuuguaaaagaaggau

SEQ ID NO: 654657 - RNA, 22 nt, Human
caaauagaacucacagacaaga

SEQ ID NO: 654658 - RNA, 22 nt, Human
uacagccacaggugacucucau

SEQ ID NO: 654659 - RNA, 22 nt, Human
uucaagaggcuuaauucuggau

SEQ ID NO: 654660 - RNA, 21 nt, Human
uaagccaccaugugaaaccag

SEQ ID NO: 654661 - RNA, 22 nt, Human
cccugaugacacgggcaucagg

SEQ ID NO: 654662 - RNA, 22 nt, Human
cacuggaaguucauucucagaa

SEQ ID NO: 654663 - RNA, 22 nt, Human
ugcaggaggauuuuguggagcu

SEQ ID NO: 654664 - RNA, 22 nt, Human
aggaaauaagggacaagacaaa

SEQ ID NO: 654665 - RNA, 22 nt, Human
auggcuggcauccaggugggcu

SEQ ID NO: 654666 - RNA, 22 nt, Human
cauugaauccuuccuucagaag

SEQ ID NO: 654667 - RNA, 23 nt, Human
auugaccagcugucucauuuuca

SEQ ID NO: 654668 - RNA, 22 nt, Human
gcuuuagacauaaaguucuuca

SEQ ID NO: 654669 - RNA, 22 nt, Human
gcagacagccagacugcacugg

SEQ ID NO: 654670 - RNA, 22 nt, Human
augcuuuacccacaccaggaug

SEQ ID NO: 654671 - RNA, 22 nt, Human
ucuggagagaucuuccacaaca

SEQ ID NO: 654672 - RNA, 22 nt, Human
aagcagaugccaagauuuacca

SEQ ID NO: 654673 - RNA, 22 nt, Human
acagaaauucaaacuggaauuu

SEQ ID NO: 654674 - RNA, 22 nt, Human
aggggcacuagaaugggagacu

SEQ ID NO: 654675 - RNA, 22 nt, Human
cuggagucuuagguuaugguga

SEQ ID NO: 654676 - RNA, 22 nt, Human
gcuaggagugggauggaagucg

SEQ ID NO: 654677 - RNA, 22 nt, Human
cuggggcaugggccccuagagg

SEQ ID NO: 654678 - RNA, 21 nt, Human
uuuagcauuuacauauuucca

SEQ ID NO: 654679 - RNA, 22 nt, Human
aaagaggcagguguuacuggaa

SEQ ID NO: 654680 - RNA, 22 nt, Human
aaguacaacgcauacagagaaa

SEQ ID NO: 654681 - RNA, 22 nt, Human
gguguguagcauguuuaagacc

SEQ ID NO: 654682 - RNA, 22 nt, Human
uguuuaaauagaacauacugca

SEQ ID NO: 654683 - RNA, 22 nt, Human
uuuucuuccuggauuuuggcau

SEQ ID NO: 654684 - RNA, 22 nt, Human
cugggcucuucccagauccaga

SEQ ID NO: 654685 - RNA, 22 nt, Human
agcuggugauguggucccucac

SEQ ID NO: 654686 - RNA, 22 nt, Human
uuucacauaugguuguugauug

SEQ ID NO: 654687 - RNA, 22 nt, Human
ugcauuuaauagaugcucccug

SEQ ID NO: 654688 - RNA, 22 nt, Human
acaaugcaauuguaaggugugu

SEQ ID NO: 654689 - RNA, 22 nt, Human
cuuuuguugcccuugucgcagg

SEQ ID NO: 654690 - RNA, 20 nt, Human
acaauauguagaugaauagc

SEQ ID NO: 654691 - RNA, 22 nt, Human
ucaccuaauugaagucaggagu

SEQ ID NO: 654692 - RNA, 22 nt, Human
ccacagggucagccacucugca

SEQ ID NO: 654693 - RNA, 22 nt, Human
ugggccugggcuggacagccug

SEQ ID NO: 654694 - RNA, 22 nt, Human
ggacagcugcuuucaggccaca

SEQ ID NO: 654695 - RNA, 22 nt, Human
aagaaugauuacaaagcaacga

SEQ ID NO: 654696 - RNA, 22 nt, Human
uguaucugugauguagggguuu

SEQ ID NO: 654697 - RNA, 22 nt, Human
acagccaggcccagcacgcagg

SEQ ID NO: 654698 - RNA, 21 nt, Human
ucuuccugacauaugcaaggc

SEQ ID NO: 654699 - RNA, 21 nt, Human
gggcaggucucugaugucaac

SEQ ID NO: 654700 - RNA, 18 nt, Human
ucuggcucaggacugaac

SEQ ID NO: 654701 - RNA, 22 nt, Human
ucagcuggcagguucugggaag

SEQ ID NO: 654702 - RNA, 22 nt, Human
aggaggccauucucucaguagc

SEQ ID NO: 654703 - RNA, 22 nt, Human
cuggccuggucuggccucucca

SEQ ID NO: 654704 - RNA, 22 nt, Human
uggcccugcuggacacgccugc

SEQ ID NO: 654705 - RNA, 22 nt, Human
uucagagguuagagcaguggga

SEQ ID NO: 654706 - RNA, 18 nt, Human
ucaggaguuuguggaugg

SEQ ID NO: 654707 - RNA, 22 nt, Human
caggaaagccgagugccauagg

SEQ ID NO: 654708 - RNA, 22 nt, Human
augcaucuauucccaagggcag

SEQ ID NO: 654709 - RNA, 22 nt, Human
acacuauaagacagauacagca

SEQ ID NO: 654710 - RNA, 22 nt, Human
cuggccagccugucgaugcccu

SEQ ID NO: 654711 - RNA, 22 nt, Human
auuaaggagguaaacuaugguu

SEQ ID NO: 654712 - RNA, 22 nt, Human
ucuacagagagucauagacuca

SEQ ID NO: 654713 - RNA, 22 nt, Human
gcaggcaggagcccaacugccu

SEQ ID NO: 654714 - RNA, 22 nt, Human
agacaaauggaguaugagcaac

SEQ ID NO: 654715 - RNA, 22 nt, Human
uccaggguugugggcuucagca

SEQ ID NO: 654716 - RNA, 22 nt, Human
gcaccugcuggggcugaugaga

SEQ ID NO: 654717 - RNA, 22 nt, Human
gcugaagggagugcugagucug

SEQ ID NO: 654718 - RNA, 18 nt, Human
agaaggagcuaugggcag

SEQ ID NO: 654719 - RNA, 22 nt, Human
cuggcucucgcugggaguacuu

SEQ ID NO: 654720 - RNA, 22 nt, Human
auaugcacacucugcccacaga

SEQ ID NO: 654721 - RNA, 22 nt, Human
aaguggcauguauaagaaagaa

SEQ ID NO: 654722 - RNA, 22 nt, Human
gggagagaugcugauugccaau

SEQ ID NO: 654723 - RNA, 20 nt, Human
caugccugcugguaucuggc

SEQ ID NO: 654724 - RNA, 22 nt, Human
ugaugggaaaaugaggccuggg

SEQ ID NO: 654725 - RNA, 22 nt, Human
aggcaggcagcugucaccacuc

SEQ ID NO: 654726 - RNA, 22 nt, Human
agaggggaaguaaugaaugaua

SEQ ID NO: 654727 - RNA, 22 nt, Human
guuauucucuuggccuaauuau

SEQ ID NO: 654728 - RNA, 22 nt, Human
uauuacugagguuuuauggagu

SEQ ID NO: 654729 - RNA, 19 nt, Human
ugcaucuugcaugggugag

SEQ ID NO: 654730 - RNA, 23 nt, Human
agccuuggagguugaggcugcag

SEQ ID NO: 654731 - RNA, 22 nt, Human
agugaauuguugccacagagac

SEQ ID NO: 654732 - RNA, 22 nt, Human
gccucagugauaugugggacaa

SEQ ID NO: 654733 - RNA, 22 nt, Human
gcagcaugagcuauacaaagua

SEQ ID NO: 654734 - RNA, 22 nt, Human
augcaguuuucaaagacuauuc

SEQ ID NO: 654735 - RNA, 22 nt, Human
gcugaauaauguguaaugucuc

SEQ ID NO: 654736 - RNA, 22 nt, Human
aagguagauguugucaugccca

SEQ ID NO: 654737 - RNA, 22 nt, Human
caggccagggagaauaugaagc

SEQ ID NO: 654738 - RNA, 22 nt, Human
ugcauauuauaaagagaauuag

SEQ ID NO: 654739 - RNA, 22 nt, Human
uccaccuccaugcugggcagag

SEQ ID NO: 654740 - RNA, 22 nt, Human
aucugucccuccucacagccuc

SEQ ID NO: 654741 - RNA, 18 nt, Human
ucaagacaucaugaaaua

SEQ ID NO: 654742 - RNA, 21 nt, Human
uaaagcuagaaccuuagcuuu

SEQ ID NO: 654743 - RNA, 22 nt, Human
uuucacaguagaaaucauuaug

SEQ ID NO: 654744 - RNA, 22 nt, Human
aggaggaaagaaggcccccagc

SEQ ID NO: 654745 - RNA, 22 nt, Human
uaagccugcaugaaccaugaga

SEQ ID NO: 654746 - RNA, 22 nt, Human
cagagacauguggccugcacgu

SEQ ID NO: 654747 - RNA, 22 nt, Human
cuucaugaguguacaaccugug

SEQ ID NO: 654748 - RNA, 22 nt, Human
agcuggaagcugaugagcacag

SEQ ID NO: 654749 - RNA, 22 nt, Human
aaaguguugauaugugacaucc

SEQ ID NO: 654750 - RNA, 22 nt, Human
uggcaggaucuuugagagugaa

SEQ ID NO: 654751 - RNA, 19 nt, Human
cauuuucccaucauccuuu

SEQ ID NO: 654752 - RNA, 22 nt, Human
ucuggccccgcaugcacuuuau

SEQ ID NO: 654753 - RNA, 22 nt, Human
cuaguauuaagugugaguaaaa

SEQ ID NO: 654754 - RNA, 22 nt, Human
cuggguuuagggucuccccuug

SEQ ID NO: 654755 - RNA, 22 nt, Human
cauccuucucaaagagugcaug

SEQ ID NO: 654756 - RNA, 22 nt, Human
gaggcacaguucuuccuccaga

SEQ ID NO: 654757 - RNA, 20 nt, Human
aucaucuuuacaaugucagu

SEQ ID NO: 654758 - RNA, 22 nt, Human
gcagggcuggggcugcuccuga

SEQ ID NO: 654759 - RNA, 21 nt, Human
augucaaaugcuuuauuuuau

SEQ ID NO: 654760 - RNA, 22 nt, Human
gcugccaguaguuggagcucca

SEQ ID NO: 654761 - RNA, 21 nt, Human
gccagccaugcuugccuaggc

SEQ ID NO: 654762 - RNA, 22 nt, Human
acucaggccccaucgcccaucu

SEQ ID NO: 654763 - RNA, 22 nt, Human
uagacaggagucaggcuagaau

SEQ ID NO: 654764 - RNA, 22 nt, Human
gaaggaagggcuggcugucuug

SEQ ID NO: 654765 - RNA, 22 nt, Human
gcagacagcauguugggcuauu

SEQ ID NO: 654766 - RNA, 22 nt, Human
ugggggacugcacuggcgucag

SEQ ID NO: 654767 - RNA, 22 nt, Human
caguccuugauccaauaguggg

SEQ ID NO: 654768 - RNA, 22 nt, Human
auuaaauguuggacguauacau

SEQ ID NO: 654769 - RNA, 22 nt, Human
cagcuaggaaguccuuggcgaa

SEQ ID NO: 654770 - RNA, 22 nt, Human
augacaaaagaagacaugaggu

SEQ ID NO: 654771 - RNA, 18 nt, Human
ccuagccuccaagcucau

SEQ ID NO: 654772 - RNA, 22 nt, Human
agcccagcuuucaccccucugg

SEQ ID NO: 654773 - RNA, 22 nt, Human
uaggguccucaucuguaaauga

SEQ ID NO: 654774 - RNA, 20 nt, Human
ggcauccuuuuggucacagc

SEQ ID NO: 654775 - RNA, 22 nt, Human
uuaaagagaacucaaugaauga

SEQ ID NO: 654776 - RNA, 22 nt, Human
gcacaagcacgagcagcgugcg

SEQ ID NO: 654777 - RNA, 22 nt, Human
uggagagagucgggauaguaca

SEQ ID NO: 654778 - RNA, 23 nt, Human
cagaaaguuugagaagauacauc

SEQ ID NO: 654779 - RNA, 22 nt, Human
aacagucaaaguuugguuccuu

SEQ ID NO: 654780 - RNA, 22 nt, Human
ccagagcuugacgugcaacgga

SEQ ID NO: 654781 - RNA, 22 nt, Human
agucagcagugaaagcacagcc

SEQ ID NO: 654782 - RNA, 22 nt, Human
ugaggggcggccugcagaggcc

SEQ ID NO: 654783 - RNA, 22 nt, Human
uaaagugucugccucagcucag

SEQ ID NO: 654784 - RNA, 22 nt, Human
guaaacaugcuguguacucagc

SEQ ID NO: 654785 - RNA, 22 nt, Human
uccaaaggcccuaauaagcuug

SEQ ID NO: 654786 - RNA, 22 nt, Human
uuuuuacagucauggucacuca

SEQ ID NO: 654787 - RNA, 22 nt, Human
ccaaagagcuagaauuauaggc

SEQ ID NO: 654788 - RNA, 22 nt, Human
aauugcuaaagauuauguuuuc

SEQ ID NO: 654789 - RNA, 22 nt, Human
ccagcagcuuuauuggcucucc

SEQ ID NO: 654790 - RNA, 22 nt, Human
agaaaacauaggagacaggaaa

SEQ ID NO: 654791 - RNA, 18 nt, Human
auugucagaagucaugug

SEQ ID NO: 654792 - RNA, 22 nt, Human
ucaggcuuauuacguuauuguc

SEQ ID NO: 654793 - RNA, 22 nt, Human
uuggggcagagaggauacggca

SEQ ID NO: 654794 - RNA, 22 nt, Human
gaaccuggcagcccuauaucug

SEQ ID NO: 654795 - RNA, 20 nt, Human
accugaggucccuauggucu

SEQ ID NO: 654796 - RNA, 22 nt, Human
auuuaaaugcuuaagaggguuu

SEQ ID NO: 654797 - RNA, 22 nt, Human
ccuuccagguuuuggcuccauu

SEQ ID NO: 654798 - RNA, 23 nt, Human
cuugccuggccucucugcccaga

SEQ ID NO: 654799 - RNA, 22 nt, Human
auauuguacuaggguuacaugu

SEQ ID NO: 654800 - RNA, 22 nt, Human
gacauuuauuagaaaacuauca

SEQ ID NO: 654801 - RNA, 22 nt, Human
gggcaggucugggucagccuga

SEQ ID NO: 654802 - RNA, 22 nt, Human
cugccagccaggccagguaggc

SEQ ID NO: 654803 - RNA, 22 nt, Human
aggcagcguagcaaggcuagua

SEQ ID NO: 654804 - RNA, 22 nt, Human
acaguuauuuucccagcauuua

SEQ ID NO: 654805 - RNA, 22 nt, Human
ugucuccucauacugucauauu

SEQ ID NO: 654806 - RNA, 22 nt, Human
gagaccucuugguaucgcuagg

SEQ ID NO: 654807 - RNA, 23 nt, Human
uuacagcuaacugcuguuauuag

SEQ ID NO: 654808 - RNA, 23 nt, Human
agcuuccuagugaccuggagucu

SEQ ID NO: 654809 - RNA, 22 nt, Human
cuuuguuaucuguaaaugguua

SEQ ID NO: 654810 - RNA, 19 nt, Human
ugccucagggcuuugagga

SEQ ID NO: 654811 - RNA, 22 nt, Human
aacagaauaguugauguacagu

SEQ ID NO: 654812 - RNA, 22 nt, Human
uacccaggaggaaacugaggcu

SEQ ID NO: 654813 - RNA, 22 nt, Human
acauucuaugaagauaauuuua

SEQ ID NO: 654814 - RNA, 22 nt, Human
uuguuucuccuggugccugaua

SEQ ID NO: 654815 - RNA, 22 nt, Human
acacaguaaauauguauugaau

SEQ ID NO: 654816 - RNA, 20 nt, Human
agccucugcccuucccacug

SEQ ID NO: 654817 - RNA, 22 nt, Human
acagagaugucagauuggcagc

SEQ ID NO: 654818 - RNA, 22 nt, Human
uucuaccagcuacucacugaua

SEQ ID NO: 654819 - RNA, 22 nt, Human
acuggcacaagaagagucgugg

SEQ ID NO: 654820 - RNA, 22 nt, Human
ucuggccaacaaaaacuaaguc

SEQ ID NO: 654821 - RNA, 22 nt, Human
gcaaugcaaucuuuauuauauu

SEQ ID NO: 654822 - RNA, 22 nt, Human
uuuuuauacuuugcucaagauu

SEQ ID NO: 654823 - RNA, 22 nt, Human
cuuugcaagggauuucaugucu

SEQ ID NO: 654824 - RNA, 22 nt, Human
uucacuauaaaguuucaacuuu

SEQ ID NO: 654825 - RNA, 22 nt, Human
uugaauucauuucucauugagu

SEQ ID NO: 654826 - RNA, 22 nt, Human
aagggcuguaguuuguugauca

SEQ ID NO: 654827 - RNA, 22 nt, Human
acaggggugcauggugcauggu

SEQ ID NO: 654828 - RNA, 22 nt, Human
uuaacauccuguuuaaauuugg

SEQ ID NO: 654829 - RNA, 22 nt, Human
cacacagggagaaagaaagccu

SEQ ID NO: 654830 - RNA, 22 nt, Human
uuucaacaccagagaccaugcg

SEQ ID NO: 654831 - RNA, 19 nt, Human
acagcagggauuuuuggag

SEQ ID NO: 654832 - RNA, 23 nt, Human
uucauucaaaaggaaaagucaug

SEQ ID NO: 654833 - RNA, 22 nt, Human
uggaaugucauaccauaaaaga

SEQ ID NO: 654834 - RNA, 22 nt, Human
gaggccucaugaggugagcauu

SEQ ID NO: 654835 - RNA, 22 nt, Human
ggucucagguagggccuaggaa

SEQ ID NO: 654836 - RNA, 22 nt, Human
gugcaauauugccauguucuug

SEQ ID NO: 654837 - RNA, 22 nt, Human
cugcucuggcuguguacuucag

SEQ ID NO: 654838 - RNA, 22 nt, Human
agcaaggcuucagagcugucug

SEQ ID NO: 654839 - RNA, 22 nt, Human
gcagccuuuggaauuagagacu

SEQ ID NO: 654840 - RNA, 22 nt, Human
agcugucuuuaagugagcuuug

SEQ ID NO: 654841 - RNA, 21 nt, Human
gggcucaguggaaaagagugu

SEQ ID NO: 654842 - RNA, 22 nt, Human
aguguacaguucuaugaauuuc

SEQ ID NO: 654843 - RNA, 22 nt, Human
aucuggaaaacacaguguagac

SEQ ID NO: 654844 - RNA, 22 nt, Human
guagcuucaaguacucucccug

SEQ ID NO: 654845 - RNA, 23 nt, Human
ucaauugaugauguucucuuuug

SEQ ID NO: 654846 - RNA, 22 nt, Human
gagcuuggugcacagugguuaa

SEQ ID NO: 654847 - RNA, 22 nt, Human
acaagaauaaggauaagagauu

SEQ ID NO: 654848 - RNA, 22 nt, Human
uucagcagugcagacacccagu

SEQ ID NO: 654849 - RNA, 22 nt, Human
gcccaggggaguagucaauuua

SEQ ID NO: 654850 - RNA, 22 nt, Human
ugagcagacuugaugaggcagc

SEQ ID NO: 654851 - RNA, 18 nt, Human
gggcugugagaugggaag

SEQ ID NO: 654852 - RNA, 22 nt, Human
gccuggcugcuuagccuacuuc

SEQ ID NO: 654853 - RNA, 22 nt, Human
guuggcuuugcucucuguccua

SEQ ID NO: 654854 - RNA, 22 nt, Human
caagcuuguuucuccugggggu

SEQ ID NO: 654855 - RNA, 22 nt, Human
uuccugccccugagagcuccca

SEQ ID NO: 654856 - RNA, 22 nt, Human
ucucuuccuagugaugggcuuu

SEQ ID NO: 654857 - RNA, 22 nt, Human
guuaauguuaucugaagacagu

SEQ ID NO: 654858 - RNA, 22 nt, Human
gcccuggccuggcgcguuguca

SEQ ID NO: 654859 - RNA, 22 nt, Human
auaacuuagaguaggcaaaagu

SEQ ID NO: 654860 - RNA, 21 nt, Human
uuacuaaacaaaacaugcagg

SEQ ID NO: 654861 - RNA, 22 nt, Human
agaaagauuuucaacaggaggu

SEQ ID NO: 654862 - RNA, 22 nt, Human
auguguauuaguuaguuuaaug

SEQ ID NO: 654863 - RNA, 22 nt, Human
ucucaccaaagccuugaccaua

SEQ ID NO: 654864 - RNA, 22 nt, Human
gccaggugcauggcugagucuc

SEQ ID NO: 654865 - RNA, 22 nt, Human
ggugcagccuuuguuucuacuu

SEQ ID NO: 654866 - RNA, 22 nt, Human
gguccuggcagcucugugucca

SEQ ID NO: 654867 - RNA, 22 nt, Human
aacagacagaaaaaugugaucu

SEQ ID NO: 654868 - RNA, 22 nt, Human
uaacuguauuuuucugagauuc

SEQ ID NO: 654869 - RNA, 22 nt, Human
uguuuacuuuccuucucacagg

SEQ ID NO: 654870 - RNA, 22 nt, Human
auaugaagaauuccaauuugga

SEQ ID NO: 654871 - RNA, 22 nt, Human
guuuauaaggcccaauauuucu

SEQ ID NO: 654872 - RNA, 22 nt, Human
gggcaggugcccagggccagag

SEQ ID NO: 654873 - RNA, 22 nt, Human
ugagcaggacucacugcagccu

SEQ ID NO: 654874 - RNA, 22 nt, Human
cauuuacauuuaagguuaauau

SEQ ID NO: 654875 - RNA, 22 nt, Human
uggcuguggguggaaggaaacc

SEQ ID NO: 654876 - RNA, 22 nt, Human
uaccagccucaguugugagccc

SEQ ID NO: 654877 - RNA, 22 nt, Human
uguuaacaucuuggacucguga

SEQ ID NO: 654878 - RNA, 22 nt, Human
agcaguauucuccuguggugga

SEQ ID NO: 654879 - RNA, 22 nt, Human
uuguuuuuaugaacauccagga

SEQ ID NO: 654880 - RNA, 22 nt, Human
gugauggagucaaggcuagaac

SEQ ID NO: 654881 - RNA, 22 nt, Human
gaugaagaggcacugacauauu

SEQ ID NO: 654882 - RNA, 22 nt, Human
ucugaagggcugaguggaggag

SEQ ID NO: 654883 - RNA, 22 nt, Human
gguuccccaggcggcccuugga

SEQ ID NO: 654884 - RNA, 22 nt, Human
aggcaagcagucagucuaugag

SEQ ID NO: 654885 - RNA, 21 nt, Human
guggcucugccaggacugaaa

SEQ ID NO: 654886 - RNA, 22 nt, Human
ggaggccuugaggccaggagcu

SEQ ID NO: 654887 - RNA, 22 nt, Human
cugcguguuugcacccugucug

SEQ ID NO: 654888 - RNA, 22 nt, Human
aagagguucuaauuuaacuauc

SEQ ID NO: 654889 - RNA, 22 nt, Human
guuuuaugagaccucaggaaua

SEQ ID NO: 654890 - RNA, 19 nt, Human
cuggaauguggcuggugca

SEQ ID NO: 654891 - RNA, 22 nt, Human
guccacucucugccgugccugu

SEQ ID NO: 654892 - RNA, 20 nt, Human
agaggaggauuauuuuauuc

SEQ ID NO: 654893 - RNA, 22 nt, Human
ggacuccucuagaaguugaggc

SEQ ID NO: 654894 - RNA, 22 nt, Human
agagaauuugagacuugcccaa

SEQ ID NO: 654895 - RNA, 22 nt, Human
uuggaacacagcagcugauuuu

SEQ ID NO: 654896 - RNA, 22 nt, Human
uccuggguggugguaggagcag

SEQ ID NO: 654897 - RNA, 22 nt, Human
uggagaaggccggccaggagug

SEQ ID NO: 654898 - RNA, 22 nt, Human
ggagguucugauuugucacaac

SEQ ID NO: 654899 - RNA, 22 nt, Human
aggauuuguauagcuuucuuuu

SEQ ID NO: 654900 - RNA, 22 nt, Human
cagcaucugaccaauaucuaca

SEQ ID NO: 654901 - RNA, 22 nt, Human
aagaguaaaugucuaauuagga

SEQ ID NO: 654902 - RNA, 22 nt, Human
agacacagguguaauuucugcu

SEQ ID NO: 654903 - RNA, 22 nt, Human
gaaaauaguucaucacaaugau

SEQ ID NO: 654904 - RNA, 19 nt, Human
uguguggguuuagaguagu

SEQ ID NO: 654905 - RNA, 22 nt, Human
uauaaucugguuuuauuaagag

SEQ ID NO: 654906 - RNA, 22 nt, Human
ugacuggagaccucaguagggu

SEQ ID NO: 654907 - RNA, 22 nt, Human
aacaugcuuugauaaauaaaag

SEQ ID NO: 654908 - RNA, 22 nt, Human
uucagcaagugucucuacuguc

SEQ ID NO: 654909 - RNA, 21 nt, Human
gggggaagaggaguugcuagu

SEQ ID NO: 654910 - RNA, 20 nt, Human
gccucagccaacccaugggg

SEQ ID NO: 654911 - RNA, 22 nt, Human
cugggacuuuguaggccaguug

SEQ ID NO: 654912 - RNA, 17 nt, Human
acacagagauuaacaca

SEQ ID NO: 654913 - RNA, 18 nt, Human
ucccucccugcuguggcc

SEQ ID NO: 654914 - RNA, 22 nt, Human
ggcaucuucaaaauugccaaau

SEQ ID NO: 654915 - RNA, 22 nt, Human
cuuggggaggacgcaguguccu

SEQ ID NO: 654916 - RNA, 22 nt, Human
agggggcauuaugaggcuuuuc

SEQ ID NO: 654917 - RNA, 22 nt, Human
aauugcuagacuauacuguaau

SEQ ID NO: 654918 - RNA, 22 nt, Human
acagaugaauuuauggauggaa

SEQ ID NO: 654919 - RNA, 22 nt, Human
uaaaucacauuuucuuuguguu

SEQ ID NO: 654920 - RNA, 22 nt, Human
ucaguccucacuugguucuaag

SEQ ID NO: 654921 - RNA, 22 nt, Human
cacagguuagguauuauacuau

SEQ ID NO: 654922 - RNA, 22 nt, Human
cagcuuuaccuuuaggaguaac

SEQ ID NO: 654923 - RNA, 22 nt, Human
uccaggcuugagaccaggcucu

SEQ ID NO: 654924 - RNA, 22 nt, Human
ccugugugucugucacugcaca

SEQ ID NO: 654925 - RNA, 22 nt, Human
ugcuccugaacacagcccuaug

SEQ ID NO: 654926 - RNA, 22 nt, Human
ccacaguacaggaaaucuuguu

SEQ ID NO: 654927 - RNA, 22 nt, Human
gagaaagcuucuuucccacagg

SEQ ID NO: 654928 - RNA, 22 nt, Human
agauggaguggagaugaguaaa

SEQ ID NO: 654929 - RNA, 22 nt, Human
aguucuuuugugaacauaugcu

SEQ ID NO: 654930 - RNA, 22 nt, Human
aaauagcacagcagcugaggcu

SEQ ID NO: 654931 - RNA, 22 nt, Human
ggggugaguuagcgucggcuug

SEQ ID NO: 654932 - RNA, 23 nt, Human
cccuucagcgagggcauuaaggu

SEQ ID NO: 654933 - RNA, 22 nt, Human
ugcugggcaccagugccugcag

SEQ ID NO: 654934 - RNA, 22 nt, Human
aaggcaaugacugauuuagaau

SEQ ID NO: 654935 - RNA, 22 nt, Human
aggagcagaacugauucugacu

SEQ ID NO: 654936 - RNA, 18 nt, Human
ugcugggcauuaggcuua

SEQ ID NO: 654937 - RNA, 19 nt, Human
auaaggcagugacuuuuuu

SEQ ID NO: 654938 - RNA, 22 nt, Human
ugggaagaggcgggaggcuguu

SEQ ID NO: 654939 - RNA, 22 nt, Human
gcuggagaguaguaagcaguua

SEQ ID NO: 654940 - RNA, 22 nt, Human
agggggcuccuccggugcuucc

SEQ ID NO: 654941 - RNA, 22 nt, Human
augcaccacaucacuucugcuc

SEQ ID NO: 654942 - RNA, 23 nt, Human
auuuccuaaaagauaaucauuac

SEQ ID NO: 654943 - RNA, 23 nt, Human
aguuucacauuuuacauguggcu

SEQ ID NO: 654944 - RNA, 22 nt, Human
gcuguccucugaucucuggagg

SEQ ID NO: 654945 - RNA, 22 nt, Human
cucugcuuggaacuggacagaa

SEQ ID NO: 654946 - RNA, 21 nt, Human
ggcuguggagccaugacucac

SEQ ID NO: 654947 - RNA, 22 nt, Human
ucaggacagaaggcugccaggg

SEQ ID NO: 654948 - RNA, 22 nt, Human
cguguguguaccugcgcauuua

SEQ ID NO: 654949 - RNA, 22 nt, Human
uggcugagcugcagcguggcuu

SEQ ID NO: 654950 - RNA, 22 nt, Human
cuggagccggcgagccccagcc

SEQ ID NO: 654951 - RNA, 22 nt, Human
gagcaaacaaaacugaugugac

SEQ ID NO: 654952 - RNA, 22 nt, Human
uccauacauacagauaugcauu

SEQ ID NO: 654953 - RNA, 22 nt, Human
ugaggggagacagaguggacuc

SEQ ID NO: 654954 - RNA, 23 nt, Human
ccacgucugcacuguagcuguug

SEQ ID NO: 654955 - RNA, 22 nt, Human
caggaaccugugcguagggaug

SEQ ID NO: 654956 - RNA, 22 nt, Human
ggaggguccacugugaggcaga

SEQ ID NO: 654957 - RNA, 17 nt, Human
ucauuuguugugacuag

SEQ ID NO: 654958 - RNA, 22 nt, Human
ggggucccugcaccagcauguc

SEQ ID NO: 654959 - RNA, 22 nt, Human
ugcagaguagcuauaccauuuu

SEQ ID NO: 654960 - RNA, 22 nt, Human
agggccagagucuguguagaua

SEQ ID NO: 654961 - RNA, 22 nt, Human
uauugacagaugcauuauguug

SEQ ID NO: 654962 - RNA, 22 nt, Human
gccuuuauaucccugauaucua

SEQ ID NO: 654963 - RNA, 22 nt, Human
aaugucauuuuuaaaugugaga

SEQ ID NO: 654964 - RNA, 22 nt, Human
uguccacaucacucacuuguca

SEQ ID NO: 654965 - RNA, 23 nt, Human
ucugcucugaaguucggcugagc

SEQ ID NO: 654966 - RNA, 22 nt, Human
gcuuuucuccuuagugucccug

SEQ ID NO: 654967 - RNA, 22 nt, Human
uuagugaaaagaaaaugagugg

SEQ ID NO: 654968 - RNA, 22 nt, Human
ccaggccuguguuguguggagg

SEQ ID NO: 654969 - RNA, 22 nt, Human
ucaaaggguccuuaacaugaga

SEQ ID NO: 654970 - RNA, 22 nt, Human
cuggacagugcugcuugagaug

SEQ ID NO: 654971 - RNA, 22 nt, Human
ccauccaugaacgaggaagugg

SEQ ID NO: 654972 - RNA, 22 nt, Human
auuuccaugaaguuuaguuaua

SEQ ID NO: 654973 - RNA, 22 nt, Human
ugugaugguucacugggcauga

SEQ ID NO: 654974 - RNA, 22 nt, Human
guuccccuuguguuguugccca

SEQ ID NO: 654975 - RNA, 22 nt, Human
cugugccuccaaguggucucug

SEQ ID NO: 654976 - RNA, 22 nt, Human
ggagaagggccaauuccaugua

SEQ ID NO: 654977 - RNA, 22 nt, Human
aaggccuggauuuagguuguga

SEQ ID NO: 654978 - RNA, 22 nt, Human
uggcagaggagaauuaagauua

SEQ ID NO: 654979 - RNA, 22 nt, Human
agcuuuggggguagguauagag

SEQ ID NO: 654980 - RNA, 22 nt, Human
cagggccuuucaggguaaaagg

SEQ ID NO: 654981 - RNA, 22 nt, Human
ugguugcauuaacugagagggg

SEQ ID NO: 654982 - RNA, 22 nt, Human
ucagacagcuugggauaacuga

SEQ ID NO: 654983 - RNA, 22 nt, Human
cagcucagucuggagagaugca

SEQ ID NO: 654984 - RNA, 21 nt, Human
acagccaggaacaugaggggc

SEQ ID NO: 654985 - RNA, 22 nt, Human
gagcugucucuauaugaaugcu

SEQ ID NO: 654986 - RNA, 20 nt, Human
acaaggaaccaggagguggc

SEQ ID NO: 654987 - RNA, 22 nt, Human
gccucagccggcggacgccagg

SEQ ID NO: 654988 - RNA, 22 nt, Human
uauauucuauuguaccucuccu

SEQ ID NO: 654989 - RNA, 21 nt, Human
ggagggcagcccagacuggcu

SEQ ID NO: 654990 - RNA, 22 nt, Human
guauuccuaagucaugacaaau

SEQ ID NO: 654991 - RNA, 22 nt, Human
agagcagugcugaagaguaggg

SEQ ID NO: 654992 - RNA, 22 nt, Human
agcucuggggccugucccacau

SEQ ID NO: 654993 - RNA, 22 nt, Human
caccaggaccccacgguggguu

SEQ ID NO: 654994 - RNA, 22 nt, Human
uuuagucauagauacccaaggu

SEQ ID NO: 654995 - RNA, 22 nt, Human
uuugacagacauuuacuacauu

SEQ ID NO: 654996 - RNA, 22 nt, Human
aucauuuugugacaaugccugu

SEQ ID NO: 654997 - RNA, 22 nt, Human
ucaguguucuggauuuggggca

SEQ ID NO: 654998 - RNA, 22 nt, Human
uaugcuuuuaaccuguaacuga

SEQ ID NO: 654999 - RNA, 22 nt, Human
uuucuaauucuaacuggcagag

SEQ ID NO: 655000 - RNA, 22 nt, Human
cacucugagaaacacuaaacca

SEQ ID NO: 655001 - RNA, 22 nt, Human
uacauauccaggcugagaagau

SEQ ID NO: 655002 - RNA, 22 nt, Human
aaguuaugaaauuuggacagcu

SEQ ID NO: 655003 - RNA, 22 nt, Human
ucacugucugaaagaaauggcc

SEQ ID NO: 655004 - RNA, 22 nt, Human
aagggcucgguagcaguccuga

SEQ ID NO: 655005 - RNA, 22 nt, Human
agaaauaagagcuuuccuuggg

SEQ ID NO: 655006 - RNA, 22 nt, Human
caguggcuuacaaugaacuaga

SEQ ID NO: 655007 - RNA, 22 nt, Human
agccuccaguagcugaagagac

SEQ ID NO: 655008 - RNA, 22 nt, Human
caguccugggcaggucaggcca

SEQ ID NO: 655009 - RNA, 19 nt, Human
gcucugugaugcugagggg

SEQ ID NO: 655010 - RNA, 22 nt, Human
uuuccauguuggugaaaugagg

SEQ ID NO: 655011 - RNA, 22 nt, Human
aagucucuuuucuuccuguauu

SEQ ID NO: 655012 - RNA, 22 nt, Human
ccaguggaguuuuuauacccag

SEQ ID NO: 655013 - RNA, 22 nt, Human
gacaaugugacagaccaaugau

SEQ ID NO: 655014 - RNA, 21 nt, Human
ucacaugcuuauuccuggaau

SEQ ID NO: 655015 - RNA, 22 nt, Human
gcuuccugggacaggcuaugug

SEQ ID NO: 655016 - RNA, 22 nt, Human
ccacucccuuccgguccagggc

SEQ ID NO: 655017 - RNA, 18 nt, Human
gccugcaggcacgggggu

SEQ ID NO: 655018 - RNA, 22 nt, Human
gccuggagagcacugugcgcuu

SEQ ID NO: 655019 - RNA, 22 nt, Human
gcuaaaucuccuacaaugcaca

SEQ ID NO: 655020 - RNA, 19 nt, Human
uccuguuauggagcuuagg

SEQ ID NO: 655021 - RNA, 19 nt, Human
ugcuugccugccuuuccca

SEQ ID NO: 655022 - RNA, 20 nt, Human
agcaguaggaccucugggcc

SEQ ID NO: 655023 - RNA, 22 nt, Human
auuuaauuuucucaacagugcu

SEQ ID NO: 655024 - RNA, 22 nt, Human
ggugagacuuuagaagagccag

SEQ ID NO: 655025 - RNA, 22 nt, Human
cugaagagcaaaccaacuggac

SEQ ID NO: 655026 - RNA, 22 nt, Human
aggagcuccagcccagggaagu

SEQ ID NO: 655027 - RNA, 22 nt, Human
cuggcccuugacuuacagcagg

SEQ ID NO: 655028 - RNA, 22 nt, Human
auuugccuuuuaaacucacaau

SEQ ID NO: 655029 - RNA, 22 nt, Human
ugcuggaaggguaguauuaacu

SEQ ID NO: 655030 - RNA, 22 nt, Human
cuaaagugccaggaauacaggu

SEQ ID NO: 655031 - RNA, 22 nt, Human
caaaccugagaacaugugcugu

SEQ ID NO: 655032 - RNA, 22 nt, Human
gagcuggugugugcccgagcac

SEQ ID NO: 655033 - RNA, 22 nt, Human
cauagugucugguaacauagua

SEQ ID NO: 655034 - RNA, 22 nt, Human
cugcuuggguccuggcaugggu

SEQ ID NO: 655035 - RNA, 22 nt, Human
uugucuguaaagacggccacca

SEQ ID NO: 655036 - RNA, 21 nt, Human
gggcuggacaugguggcucau

SEQ ID NO: 655037 - RNA, 22 nt, Human
agcuauguuccucgaugcucag

SEQ ID NO: 655038 - RNA, 22 nt, Human
aagucuggaagucucaguuuuc

SEQ ID NO: 655039 - RNA, 22 nt, Human
agaaauguauagugaauuuuuc

SEQ ID NO: 655040 - RNA, 22 nt, Human
gacuucucggcacccuuuggca

SEQ ID NO: 655041 - RNA, 22 nt, Human
gggcuggauguuugaugacgaa

SEQ ID NO: 655042 - RNA, 22 nt, Human
ggagcagcuugcaugcucaggg

SEQ ID NO: 655043 - RNA, 22 nt, Human
gccugagcccaggugugcagag

SEQ ID NO: 655044 - RNA, 21 nt, Human
uucucagagucuauuacaguu

SEQ ID NO: 655045 - RNA, 22 nt, Human
uguuuacuuaugugggucacau

SEQ ID NO: 655046 - RNA, 22 nt, Human
uacaguagaauuuuuaguaacu

SEQ ID NO: 655047 - RNA, 22 nt, Human
guuauauaagacaaaucagagu

SEQ ID NO: 655048 - RNA, 22 nt, Human
ucuuuguacaggaaggcacugu

SEQ ID NO: 655049 - RNA, 22 nt, Human
gaaaguauucucccugaauuuu

SEQ ID NO: 655050 - RNA, 22 nt, Human
ccugaagagugaauguggcagu

SEQ ID NO: 655051 - RNA, 22 nt, Human
aggccacaagaaaaugcuucau

SEQ ID NO: 655052 - RNA, 22 nt, Human
aauguguucacaggaaauacag

SEQ ID NO: 655053 - RNA, 22 nt, Human
cuuuguaaucauucccuugguu

SEQ ID NO: 655054 - RNA, 22 nt, Human
agacccugcauuuuccaggguu

SEQ ID NO: 655055 - RNA, 19 nt, Human
ggaacucacuuagagaaac

SEQ ID NO: 655056 - RNA, 22 nt, Human
ucugucucuuuguucugugagu

SEQ ID NO: 655057 - RNA, 18 nt, Human
ggagacuaaacuguugac

SEQ ID NO: 655058 - RNA, 22 nt, Human
ucugcugucuuuucugggugag

SEQ ID NO: 655059 - RNA, 22 nt, Human
ugauggaagguuucucggugau

SEQ ID NO: 655060 - RNA, 22 nt, Human
uauugucuucaacucuacuuuu

SEQ ID NO: 655061 - RNA, 22 nt, Human
uccagguaucuggcuuccacau

SEQ ID NO: 655062 - RNA, 22 nt, Human
accaggcaugauguggagcaca

SEQ ID NO: 655063 - RNA, 22 nt, Human
aagcugucaggagguuaccuuu

SEQ ID NO: 655064 - RNA, 22 nt, Human
ucucaacaccacuugcugaaga

SEQ ID NO: 655065 - RNA, 22 nt, Human
guauuuuacugcucaaagcucu

SEQ ID NO: 655066 - RNA, 22 nt, Human
aacagaaggggguauuuacauu

SEQ ID NO: 655067 - RNA, 22 nt, Human
guuuucucaggaugguguguac

SEQ ID NO: 655068 - RNA, 22 nt, Human
agacaauuucaaaguaauauua

SEQ ID NO: 655069 - RNA, 22 nt, Human
uuucccaaguguaaacauggca

SEQ ID NO: 655070 - RNA, 22 nt, Human
ucuagaccuggcacugcccugu

SEQ ID NO: 655071 - RNA, 22 nt, Human
cauggcagugauucagccuuug

SEQ ID NO: 655072 - RNA, 22 nt, Human
ugaaaugcuuuuacaggauauu

SEQ ID NO: 655073 - RNA, 21 nt, Human
ucaggaaacaccucuuaagga

SEQ ID NO: 655074 - RNA, 22 nt, Human
gcacuugauuacauuagugccu

SEQ ID NO: 655075 - RNA, 22 nt, Human
cagagcugcuucccaguuugug

SEQ ID NO: 655076 - RNA, 22 nt, Human
uaauguuugggaaggugcuuug

SEQ ID NO: 655077 - RNA, 22 nt, Human
uuaguugacccccaguccuggc

SEQ ID NO: 655078 - RNA, 22 nt, Human
gcaguauaaguggauuaugucc

SEQ ID NO: 655079 - RNA, 22 nt, Human
ugccagcuccgaggagcugcag

SEQ ID NO: 655080 - RNA, 22 nt, Human
uugucuaaugagcuccacuuca

SEQ ID NO: 655081 - RNA, 22 nt, Human
gccugaggaauugaggggguaa

SEQ ID NO: 655082 - RNA, 22 nt, Human
ucccagcuguguggaggagaug

SEQ ID NO: 655083 - RNA, 22 nt, Human
ucauguuugagacuaauuuuuc

SEQ ID NO: 655084 - RNA, 22 nt, Human
agcagcugggcucagagcuggg

SEQ ID NO: 655085 - RNA, 22 nt, Human
guccucagggagucccagucau

SEQ ID NO: 655086 - RNA, 22 nt, Human
ucagaacaauuccuuuauaaca

SEQ ID NO: 655087 - RNA, 23 nt, Human
agcuccaggugauuguaaugugu

SEQ ID NO: 655088 - RNA, 22 nt, Human
aaauggcugacuaaauuaaauu

SEQ ID NO: 655089 - RNA, 22 nt, Human
ugcagcagguuccaaaggguua

SEQ ID NO: 655090 - RNA, 22 nt, Human
aaaucguggaagacaccagugg

SEQ ID NO: 655091 - RNA, 22 nt, Human
accuucuuccaccaaaaacguc

SEQ ID NO: 655092 - RNA, 22 nt, Human
acacugugaucuugagaaaggu

SEQ ID NO: 655093 - RNA, 18 nt, Human
gacccagcagaugggcuu

SEQ ID NO: 655094 - RNA, 22 nt, Human
cuggcucugagugguaucuuga

SEQ ID NO: 655095 - RNA, 22 nt, Human
cucuggccccaguggccccuug

SEQ ID NO: 655096 - RNA, 22 nt, Human
gcaggcagagaaggaacauuua

SEQ ID NO: 655097 - RNA, 22 nt, Human
auagcuucagaauugagauauc

SEQ ID NO: 655098 - RNA, 22 nt, Human
aguaggacuagggguugaggca

SEQ ID NO: 655099 - RNA, 22 nt, Human
gcuggcagccaagugaagaggg

SEQ ID NO: 655100 - RNA, 22 nt, Human
gacaggcugugauggccgggag

SEQ ID NO: 655101 - RNA, 18 nt, Human
gugucuuauuacaguggg

SEQ ID NO: 655102 - RNA, 21 nt, Human
ucagagucucaggagcaaggg

SEQ ID NO: 655103 - RNA, 22 nt, Human
cugugccugcaggccacaucaa

SEQ ID NO: 655104 - RNA, 22 nt, Human
cccuugggcuucagcccuaccg

SEQ ID NO: 655105 - RNA, 22 nt, Human
uaagacacaaauaucuuuuaca

SEQ ID NO: 655106 - RNA, 18 nt, Human
aguaggcacugugggguu

SEQ ID NO: 655107 - RNA, 22 nt, Human
ccugaggcaaggacuugguggc

SEQ ID NO: 655108 - RNA, 22 nt, Human
agcccagcugccugccugcugu

SEQ ID NO: 655109 - RNA, 22 nt, Human
ccuugccucauugugcuucucc

SEQ ID NO: 655110 - RNA, 22 nt, Human
agcccagagacaaugcucagua

SEQ ID NO: 655111 - RNA, 22 nt, Human
aagguauuauuugcaaucauuu

SEQ ID NO: 655112 - RNA, 22 nt, Human
ggcagagcuugcagugagccga

SEQ ID NO: 655113 - RNA, 22 nt, Human
ggggaccuuuccauuucugaga

SEQ ID NO: 655114 - RNA, 22 nt, Human
ugcugccuaacagaacucuuuc

SEQ ID NO: 655115 - RNA, 22 nt, Human
agauugcuaaugaaguucuuga

SEQ ID NO: 655116 - RNA, 22 nt, Human
uuggcagagccccagccuugga

SEQ ID NO: 655117 - RNA, 22 nt, Human
ugcuggaaauaggcauuguagc

SEQ ID NO: 655118 - RNA, 22 nt, Human
augucugucuauagccaugaga

SEQ ID NO: 655119 - RNA, 22 nt, Human
aacccaggagacggaguuugug

SEQ ID NO: 655120 - RNA, 22 nt, Human
agugggaggcggcugacgggcg

SEQ ID NO: 655121 - RNA, 22 nt, Human
aggugccagugcuguggucccc

SEQ ID NO: 655122 - RNA, 22 nt, Human
ucccuccccacuucugagcuuu

SEQ ID NO: 655123 - RNA, 22 nt, Human
ucugggaggucacauuggucuu

SEQ ID NO: 655124 - RNA, 22 nt, Human
ucucagaggucuucagccucug

SEQ ID NO: 655125 - RNA, 22 nt, Human
aaggcuuuaugugaccaaaaga

SEQ ID NO: 655126 - RNA, 22 nt, Human
cauguucaccuguggcacuagu

SEQ ID NO: 655127 - RNA, 22 nt, Human
uccaggacugguucacacggug

SEQ ID NO: 655128 - RNA, 22 nt, Human
aggggcuucccuuccuggguag

SEQ ID NO: 655129 - RNA, 22 nt, Human
uuccaagagcuuuaauuguuga

SEQ ID NO: 655130 - RNA, 22 nt, Human
aagaaucauuguaaaguucugu

SEQ ID NO: 655131 - RNA, 22 nt, Human
cagcccagccgagggccuggcu

SEQ ID NO: 655132 - RNA, 22 nt, Human
ucuuuguaacugucuauugaga

SEQ ID NO: 655133 - RNA, 22 nt, Human
auucauucugaccucaagagaa

SEQ ID NO: 655134 - RNA, 22 nt, Human
ugaagccaucaggaagccagca

SEQ ID NO: 655135 - RNA, 20 nt, Human
uccagcucaguuuuuuuguc

SEQ ID NO: 655136 - RNA, 22 nt, Human
cccugcccugggcagaaguggg

SEQ ID NO: 655137 - RNA, 22 nt, Human
uauggcaguuacccuugaugau

SEQ ID NO: 655138 - RNA, 22 nt, Human
cuggcuuucauuucaagcacgu

SEQ ID NO: 655139 - RNA, 20 nt, Human
ugcauuaaguggcauugagc

SEQ ID NO: 655140 - RNA, 22 nt, Human
gaggcucagagacuuuaaguuu

SEQ ID NO: 655141 - RNA, 22 nt, Human
ccagaagacaagaauguucuua

SEQ ID NO: 655142 - RNA, 22 nt, Human
uggagaggaaagugcaguuuug

SEQ ID NO: 655143 - RNA, 22 nt, Human
agaauuacagcuuuuagaauag

SEQ ID NO: 655144 - RNA, 22 nt, Human
ccagagggcccuggucucagcu

SEQ ID NO: 655145 - RNA, 20 nt, Human
ggcuuaaggaauucuuuucu

SEQ ID NO: 655146 - RNA, 22 nt, Human
uuguccuguuacuuguuuggau

SEQ ID NO: 655147 - RNA, 22 nt, Human
aggaaugacuuguagcucugag

SEQ ID NO: 655148 - RNA, 22 nt, Human
cagagccucucagccccuuggg

SEQ ID NO: 655149 - RNA, 22 nt, Human
caggaaauaggcguuuguccuc

SEQ ID NO: 655150 - RNA, 22 nt, Human
aguagggaauacauugggguaa

SEQ ID NO: 655151 - RNA, 20 nt, Human
ugggcacagcuuuggagggc

SEQ ID NO: 655152 - RNA, 22 nt, Human
acacuugaggaauguggugauu

SEQ ID NO: 655153 - RNA, 22 nt, Human
gugggugucucaagaauggggg

SEQ ID NO: 655154 - RNA, 22 nt, Human
ccccaaagccucagccugccug

SEQ ID NO: 655155 - RNA, 19 nt, Human
auggaaaauuguacucaau

SEQ ID NO: 655156 - RNA, 22 nt, Human
acugagcugcuugaagugaacu

SEQ ID NO: 655157 - RNA, 22 nt, Human
ggugagaaagggauuccuguuc

SEQ ID NO: 655158 - RNA, 17 nt, Human
ugguccagguggagcca

SEQ ID NO: 655159 - RNA, 22 nt, Human
ucugucaucuguucagugcuca

SEQ ID NO: 655160 - RNA, 22 nt, Human
acauaaguuauggauaaaaugu

SEQ ID NO: 655161 - RNA, 22 nt, Human
uacuguuuucuuuauaguacag

SEQ ID NO: 655162 - RNA, 22 nt, Human
augacacaauuuuagagcugaa

SEQ ID NO: 655163 - RNA, 22 nt, Human
ggagcuaggcaaagcucacgga

SEQ ID NO: 655164 - RNA, 16 nt, Human
cuggcccuggcucugg

SEQ ID NO: 655165 - RNA, 22 nt, Human
ccuggagucugugacuuuccuc

SEQ ID NO: 655166 - RNA, 20 nt, Human
uauauuuucucuuuggccuu

SEQ ID NO: 655167 - RNA, 22 nt, Human
cagcccucucugggccccaagg

SEQ ID NO: 655168 - RNA, 22 nt, Human
ggcugggacgaugaggauuagu

SEQ ID NO: 655169 - RNA, 19 nt, Human
uuugaaaggauuguuauuu

SEQ ID NO: 655170 - RNA, 22 nt, Human
cucaugucuucacccauucuaa

SEQ ID NO: 655171 - RNA, 22 nt, Human
guccuggggauuauagaguguu

SEQ ID NO: 655172 - RNA, 22 nt, Human
agagccuggaccugggcucuga

SEQ ID NO: 655173 - RNA, 22 nt, Human
acagugcaaacuuuugucuccu

SEQ ID NO: 655174 - RNA, 22 nt, Human
uugcauugcuuggucuucaaga

SEQ ID NO: 655175 - RNA, 22 nt, Human
ggcuccugcuguccuuugaagc

SEQ ID NO: 655176 - RNA, 22 nt, Human
acaugaaaagacuaucugauua

SEQ ID NO: 655177 - RNA, 22 nt, Human
gcaggaugccagggcagcagcg

SEQ ID NO: 655178 - RNA, 22 nt, Human
aauaguaaaagauacagcuaau

SEQ ID NO: 655179 - RNA, 22 nt, Human
agacaauuuuugguuuugcaag

SEQ ID NO: 655180 - RNA, 22 nt, Human
gucccucacccagaugcuccca

SEQ ID NO: 655181 - RNA, 22 nt, Human
cugagcaugcuacaugcagcac

SEQ ID NO: 655182 - RNA, 22 nt, Human
ucuuuaaaguuggagcuugcaa

SEQ ID NO: 655183 - RNA, 22 nt, Human
caggaacauguuggaaagaaau

SEQ ID NO: 655184 - RNA, 22 nt, Human
caaaaccuaaacagacugucca

SEQ ID NO: 655185 - RNA, 22 nt, Human
ucuucauuuugaagaggcagaa

SEQ ID NO: 655186 - RNA, 22 nt, Human
ugcugcuucaccuguuguacag

SEQ ID NO: 655187 - RNA, 22 nt, Human
aaugucugccugaacuuuauau

SEQ ID NO: 655188 - RNA, 21 nt, Human
caggaaaucagugugaauuag

SEQ ID NO: 655189 - RNA, 23 nt, Human
cugcaacucagucuggagcaguu

SEQ ID NO: 655190 - RNA, 22 nt, Human
auucauagcucaguacagacuc

SEQ ID NO: 655191 - RNA, 22 nt, Human
ggcugccuucauagaccauggg

SEQ ID NO: 655192 - RNA, 22 nt, Human
gugugcagugagcaaaagaucu

SEQ ID NO: 655193 - RNA, 22 nt, Human
agacaggaugcauacucuuggu

SEQ ID NO: 655194 - RNA, 22 nt, Human
aggugucuuugcggcccgccgc

SEQ ID NO: 655195 - RNA, 22 nt, Human
uaccauuguaccaagguaauuu

SEQ ID NO: 655196 - RNA, 22 nt, Human
ugagggagucaugauuaaggaa

SEQ ID NO: 655197 - RNA, 22 nt, Human
aggauacacggggauuuaugua

SEQ ID NO: 655198 - RNA, 22 nt, Human
ggcacacauagaucugcacugg

SEQ ID NO: 655199 - RNA, 22 nt, Human
ugacucugauugccuuagcuug

SEQ ID NO: 655200 - RNA, 22 nt, Human
cagcagaguuuggcuucuaaug

SEQ ID NO: 655201 - RNA, 22 nt, Human
gagauucugugaaacggacauu

SEQ ID NO: 655202 - RNA, 22 nt, Human
agagcagauuucaaauauuggc

SEQ ID NO: 655203 - RNA, 22 nt, Human
ugaggcagguggauuacaaggu

SEQ ID NO: 655204 - RNA, 22 nt, Human
acuuuagaaaaggaacagagga

SEQ ID NO: 655205 - RNA, 22 nt, Human
aagagcugcaucuaagccauga

SEQ ID NO: 655206 - RNA, 22 nt, Human
ugcugccuggagccuuuuguuu

SEQ ID NO: 655207 - RNA, 22 nt, Human
accugccuaucagcugccugcu

SEQ ID NO: 655208 - RNA, 22 nt, Human
cugugucggacgugggcagcag

SEQ ID NO: 655209 - RNA, 22 nt, Human
gcuggcugcagauuuuagaggu

SEQ ID NO: 655210 - RNA, 22 nt, Human
cauccagcuccugggggccacc

SEQ ID NO: 655211 - RNA, 18 nt, Human
acucaggaaaugaugaca

SEQ ID NO: 655212 - RNA, 22 nt, Human
gcagcaguggcaguuaauauuu

SEQ ID NO: 655213 - RNA, 20 nt, Human
ugcaaacacagaguguauga

SEQ ID NO: 655214 - RNA, 21 nt, Human
ucagcauccugagcuguccuc

SEQ ID NO: 655215 - RNA, 22 nt, Human
uaaaggauaacuuucaagaauu

SEQ ID NO: 655216 - RNA, 22 nt, Human
uuguugucauuguagaggauuu

SEQ ID NO: 655217 - RNA, 22 nt, Human
aggccucacucucagagcuucu

SEQ ID NO: 655218 - RNA, 21 nt, Human
ugcaguccuuugacaugauuc

SEQ ID NO: 655219 - RNA, 22 nt, Human
uuuaaaguuuuugcacauucug

SEQ ID NO: 655220 - RNA, 22 nt, Human
aagugcaucacuacucauuaca

SEQ ID NO: 655221 - RNA, 22 nt, Human
cugggaggcagucucucuagaa

SEQ ID NO: 655222 - RNA, 23 nt, Human
ugcuuauucaaaaggugcuuuca

SEQ ID NO: 655223 - RNA, 22 nt, Human
caguuucucucauacauauuug

SEQ ID NO: 655224 - RNA, 20 nt, Human
cccugagaccagagagcagc

SEQ ID NO: 655225 - RNA, 22 nt, Human
ucugagcacaucacacagcuca

SEQ ID NO: 655226 - RNA, 22 nt, Human
ugguauguaaauuguaacucaa

SEQ ID NO: 655227 - RNA, 22 nt, Human
uuucaaagggaaguuaugaagu

SEQ ID NO: 655228 - RNA, 22 nt, Human
acaguguuuauguacagauugu

SEQ ID NO: 655229 - RNA, 22 nt, Human
agaaagcaucuccauuguaggu

SEQ ID NO: 655230 - RNA, 18 nt, Human
ccgggcuuuggugacaca

SEQ ID NO: 655231 - RNA, 22 nt, Human
auggccagagagagcacaccug

SEQ ID NO: 655232 - RNA, 22 nt, Human
ugcuccaucucucgugguucca

SEQ ID NO: 655233 - RNA, 22 nt, Human
cuuaaaguagaauacaagaccu

SEQ ID NO: 655234 - RNA, 22 nt, Human
uggccugggccggcagauauac

SEQ ID NO: 655235 - RNA, 22 nt, Human
aaugucauagcauuucuucaau

SEQ ID NO: 655236 - RNA, 22 nt, Human
gaggugggagggcagucccuaa

SEQ ID NO: 655237 - RNA, 22 nt, Human
cucuagcugaggucacugcuau

SEQ ID NO: 655238 - RNA, 22 nt, Human
augcuauuuaccacacaucauu

SEQ ID NO: 655239 - RNA, 20 nt, Human
acugcuucuuucucugaccu

SEQ ID NO: 655240 - RNA, 22 nt, Human
ucuuguauuugauuccuuccaa

SEQ ID NO: 655241 - RNA, 22 nt, Human
gccacauagaggaggauauuaa

SEQ ID NO: 655242 - RNA, 22 nt, Human
agccuggcacugaggcagggcg

SEQ ID NO: 655243 - RNA, 22 nt, Human
uuaccuguguguuugauacaua

SEQ ID NO: 655244 - RNA, 22 nt, Human
aguuuaugaaacacagauuuga

SEQ ID NO: 655245 - RNA, 22 nt, Human
gaauuuuaucuuauuacuugca

SEQ ID NO: 655246 - RNA, 22 nt, Human
agccuggcuaaauucucccaug

SEQ ID NO: 655247 - RNA, 22 nt, Human
ugcuccagcaacaggcuuagcu

SEQ ID NO: 655248 - RNA, 22 nt, Human
cauguguagugaaauaagcagu

SEQ ID NO: 655249 - RNA, 22 nt, Human
cuauaucauaaaucugaagagg

SEQ ID NO: 655250 - RNA, 22 nt, Human
uccaggccauugacugcauccu

SEQ ID NO: 655251 - RNA, 22 nt, Human
ucccugggaacaaaggaugaga

SEQ ID NO: 655252 - RNA, 22 nt, Human
agggagaagguccaugccuguc

SEQ ID NO: 655253 - RNA, 22 nt, Human
gacaugaaccuaccauaaugau

SEQ ID NO: 655254 - RNA, 22 nt, Human
aagcagcugaaggauucagggu

SEQ ID NO: 655255 - RNA, 22 nt, Human
gcuuuagagaagaaagguugcu

SEQ ID NO: 655256 - RNA, 22 nt, Human
cugcugacuuacacuguuuauu

SEQ ID NO: 655257 - RNA, 22 nt, Human
uagccucucuccuccacaaccu

SEQ ID NO: 655258 - RNA, 22 nt, Human
cuguaagaugggauaagacuuu

SEQ ID NO: 655259 - RNA, 20 nt, Human
gcacuuggcugcugcuucuc

SEQ ID NO: 655260 - RNA, 22 nt, Human
gccacuauuuucccaccuuucu

SEQ ID NO: 655261 - RNA, 22 nt, Human
gaggcugauucggggaacagca

SEQ ID NO: 655262 - RNA, 22 nt, Human
aagcuggcaugucaccugagaa

SEQ ID NO: 655263 - RNA, 22 nt, Human
uucugucauuuagcauugucau

SEQ ID NO: 655264 - RNA, 22 nt, Human
cauucaaacauuaauuuauuca

SEQ ID NO: 655265 - RNA, 19 nt, Human
cuguccuuggcugcacugu

SEQ ID NO: 655266 - RNA, 21 nt, Human
gacuuuaauuugagagcaaaa

SEQ ID NO: 655267 - RNA, 22 nt, Human
gucuggaagugucuuguuaagu

SEQ ID NO: 655268 - RNA, 22 nt, Human
ugcucccagcuccugcagcaac

SEQ ID NO: 655269 - RNA, 22 nt, Human
uccagccuugccacuuuucugu

SEQ ID NO: 655270 - RNA, 22 nt, Human
ucuuuagugaccaucucauucu

SEQ ID NO: 655271 - RNA, 22 nt, Human
ugucuuuagagucacaaaacca

SEQ ID NO: 655272 - RNA, 22 nt, Human
uggcuucuuuccacuguccugu

SEQ ID NO: 655273 - RNA, 22 nt, Human
ggaggcggagcuugcagugagc

SEQ ID NO: 655274 - RNA, 22 nt, Human
cuccagggaaaggggcguccgc

SEQ ID NO: 655275 - RNA, 22 nt, Human
aaaggucuucucaaacauccca

SEQ ID NO: 655276 - RNA, 19 nt, Human
acauuuaaauucagaucuc

SEQ ID NO: 655277 - RNA, 22 nt, Human
uuucacauuuguuuuaagaagu

SEQ ID NO: 655278 - RNA, 22 nt, Human
agaguuuguguccuuuaucagg

SEQ ID NO: 655279 - RNA, 22 nt, Human
ugaggccaggacccccagcagg

SEQ ID NO: 655280 - RNA, 22 nt, Human
aaacaauccaggaaccuguuua

SEQ ID NO: 655281 - RNA, 22 nt, Human
uucacauuucucugcuguuuga

SEQ ID NO: 655282 - RNA, 22 nt, Human
uucuguuuauuccuaggagcuc

SEQ ID NO: 655283 - RNA, 22 nt, Human
gcugugggccacacggcugagu

SEQ ID NO: 655284 - RNA, 22 nt, Human
ucugagguccugugauuucucu

SEQ ID NO: 655285 - RNA, 22 nt, Human
uguagcaguuuuucauuaucca

SEQ ID NO: 655286 - RNA, 20 nt, Human
ggcauuagauuuuaaauguc

SEQ ID NO: 655287 - RNA, 22 nt, Human
gacaguuaggacaacugacuuc

SEQ ID NO: 655288 - RNA, 22 nt, Human
auggccagcuuauaggggcuca

SEQ ID NO: 655289 - RNA, 21 nt, Human
ucaaagacuggggcugugugc

SEQ ID NO: 655290 - RNA, 22 nt, Human
uucuguuacuugcaaccacagg

SEQ ID NO: 655291 - RNA, 22 nt, Human
acugcuuccugagaaaucaaca

SEQ ID NO: 655292 - RNA, 22 nt, Human
ucugggcagcagcagcuaguag

SEQ ID NO: 655293 - RNA, 22 nt, Human
aagaguauagcuuuaggauuga

SEQ ID NO: 655294 - RNA, 22 nt, Human
gcaggcugcugagauccuuagg

SEQ ID NO: 655295 - RNA, 22 nt, Human
gacuucacaauaaugugacacu

SEQ ID NO: 655296 - RNA, 22 nt, Human
acucuggguccugccauucacu

SEQ ID NO: 655297 - RNA, 22 nt, Human
gauuuuacugucuguguaucuc

SEQ ID NO: 655298 - RNA, 22 nt, Human
ucauuuguaccauuuuuuaaga

SEQ ID NO: 655299 - RNA, 22 nt, Human
guuuuucuaaguagcgauauuu

SEQ ID NO: 655300 - RNA, 19 nt, Human
uguuaugacuuugccuuuu

SEQ ID NO: 655301 - RNA, 22 nt, Human
uugggggcauauugaguagugg

SEQ ID NO: 655302 - RNA, 22 nt, Human
aaaccaucagauaauucauacu

SEQ ID NO: 655303 - RNA, 22 nt, Human
uauuucuauuccccaggcaagu

SEQ ID NO: 655304 - RNA, 22 nt, Human
uccuggccuccguucucugcau

SEQ ID NO: 655305 - RNA, 22 nt, Human
agucaguggcuccgagccuggu

SEQ ID NO: 655306 - RNA, 22 nt, Human
caugcauuuggaguuuucaagu

SEQ ID NO: 655307 - RNA, 23 nt, Human
agucucagcuggaaacauguguc

SEQ ID NO: 655308 - RNA, 22 nt, Human
aguggggccggugaggccgagg

SEQ ID NO: 655309 - RNA, 22 nt, Human
ugaggcuggcaaggcugguauu

SEQ ID NO: 655310 - RNA, 22 nt, Human
ucaggagagaaagaauacaauu

SEQ ID NO: 655311 - RNA, 21 nt, Human
agagaagggacucuuccaguc

SEQ ID NO: 655312 - RNA, 22 nt, Human
uucuucuuaauguccugggaac

SEQ ID NO: 655313 - RNA, 20 nt, Human
ucauugcacauaauggaagc

SEQ ID NO: 655314 - RNA, 22 nt, Human
auggccuuucucaguggugcuu

SEQ ID NO: 655315 - RNA, 22 nt, Human
cacagcagagggagccauugaa

SEQ ID NO: 655316 - RNA, 22 nt, Human
cucaguaaggaugcuucagcgg

SEQ ID NO: 655317 - RNA, 22 nt, Human
ggccucucuggcauggcugccc

SEQ ID NO: 655318 - RNA, 22 nt, Human
agcucugauccauaauuuauac

SEQ ID NO: 655319 - RNA, 22 nt, Human
uagacacaucaaguauaguuaa

SEQ ID NO: 655320 - RNA, 22 nt, Human
gcuguuauaauauucuguuugu

SEQ ID NO: 655321 - RNA, 22 nt, Human
cuguggcugcgcccugggggag

SEQ ID NO: 655322 - RNA, 22 nt, Human
aggaggcucucagguccucccc

SEQ ID NO: 655323 - RNA, 22 nt, Human
cugcucuggucucuucauguuu

SEQ ID NO: 655324 - RNA, 22 nt, Human
uuccuucagcaaguccugagca

SEQ ID NO: 655325 - RNA, 22 nt, Human
aaauugcuaaggaucucaugug

SEQ ID NO: 655326 - RNA, 22 nt, Human
gcccuggacagugacggugacc

SEQ ID NO: 655327 - RNA, 22 nt, Human
agucaauucuuuucaacucaag

SEQ ID NO: 655328 - RNA, 20 nt, Human
auguagcagugugcugggaa

SEQ ID NO: 655329 - RNA, 22 nt, Human
ugguccuggggaucugcaguga

SEQ ID NO: 655330 - RNA, 22 nt, Human
gugcauaugguuacagcaccgc

SEQ ID NO: 655331 - RNA, 22 nt, Human
uucaguauuucaugacuuucuu

SEQ ID NO: 655332 - RNA, 22 nt, Human
caggaacaggggagugaaccug

SEQ ID NO: 655333 - RNA, 22 nt, Human
uuuaguagaaugauacagggca

SEQ ID NO: 655334 - RNA, 22 nt, Human
auuccacauaggccuucaugac

SEQ ID NO: 655335 - RNA, 22 nt, Human
cugccuccucacguccacagug

SEQ ID NO: 655336 - RNA, 22 nt, Human
aaugucucucuaaauaaacuuu

SEQ ID NO: 655337 - RNA, 22 nt, Human
gcagauggcagcccaggcuggg

SEQ ID NO: 655338 - RNA, 22 nt, Human
cuuaggaugaguuuuugcguuu

SEQ ID NO: 655339 - RNA, 22 nt, Human
ccagggcagccaacccagaugc

SEQ ID NO: 655340 - RNA, 22 nt, Human
guccagagcuggcacacuguca

SEQ ID NO: 655341 - RNA, 22 nt, Human
gccuuggacucggguggacuca

SEQ ID NO: 655342 - RNA, 22 nt, Human
ugugccuggagucccugaggag

SEQ ID NO: 655343 - RNA, 22 nt, Human
aaacugaaacaucaucauguug

SEQ ID NO: 655344 - RNA, 22 nt, Human
uauuaugaggggcagagggcau

SEQ ID NO: 655345 - RNA, 22 nt, Human
uggcauguuuaauguacuguau

SEQ ID NO: 655346 - RNA, 22 nt, Human
cagguacacucccuugugcuga

SEQ ID NO: 655347 - RNA, 22 nt, Human
aagcuuggaagucuuccuuuca

SEQ ID NO: 655348 - RNA, 22 nt, Human
ugcauauuuuauaaagauggaa

SEQ ID NO: 655349 - RNA, 22 nt, Human
acagggcagcaacuuugugccu

SEQ ID NO: 655350 - RNA, 22 nt, Human
gcccugagccaccaaugccauu

SEQ ID NO: 655351 - RNA, 23 nt, Human
cacaaagguuccauucucucacc

SEQ ID NO: 655352 - RNA, 22 nt, Human
guuuccacuuauaugguaccua

SEQ ID NO: 655353 - RNA, 22 nt, Human
ccacuguaguuaugaugaaguu

SEQ ID NO: 655354 - RNA, 22 nt, Human
cagcaucaacauucucagcucu

SEQ ID NO: 655355 - RNA, 22 nt, Human
gugaggauugcucuggagaauu

SEQ ID NO: 655356 - RNA, 23 nt, Human
ggguccagccaauuccaaggaaa

SEQ ID NO: 655357 - RNA, 22 nt, Human
gcaggauugggcugaaggagug

SEQ ID NO: 655358 - RNA, 21 nt, Human
agaggcaggcauuaaguacac

SEQ ID NO: 655359 - RNA, 22 nt, Human
agaaggaaaaccugucuuaugu

SEQ ID NO: 655360 - RNA, 22 nt, Human
agaaggguagggacuuauccaa

SEQ ID NO: 655361 - RNA, 22 nt, Human
gcugggagcccuggucugcucc

SEQ ID NO: 655362 - RNA, 22 nt, Human
auuucaugugaagaagagauaa

SEQ ID NO: 655363 - RNA, 22 nt, Human
ugcgggucccagggucacaggc

SEQ ID NO: 655364 - RNA, 23 nt, Human
cugaggccugcugcguucagguu

SEQ ID NO: 655365 - RNA, 22 nt, Human
cccagggguaaggcgcagcgug

SEQ ID NO: 655366 - RNA, 22 nt, Human
cagaguguggcaucuuccaacu

SEQ ID NO: 655367 - RNA, 22 nt, Human
gcuggcagcuggaaguugggcu

SEQ ID NO: 655368 - RNA, 22 nt, Human
uauguacaccaaggauugaaaa

SEQ ID NO: 655369 - RNA, 22 nt, Human
gguggggcuaggaccucaggau

SEQ ID NO: 655370 - RNA, 22 nt, Human
caaguccaggugggcaaauaaa

SEQ ID NO: 655371 - RNA, 19 nt, Human
agcagcagaagugugccuu

SEQ ID NO: 655372 - RNA, 22 nt, Human
aaucauguacugcuguggcuuu

SEQ ID NO: 655373 - RNA, 22 nt, Human
caacaccuugaucuuggacuuc

SEQ ID NO: 655374 - RNA, 22 nt, Human
ucagggcugccgggcagaccgu

SEQ ID NO: 655375 - RNA, 22 nt, Human
ccagaggugguggugucuagaa

SEQ ID NO: 655376 - RNA, 22 nt, Human
uagacauuuuaagacauauacc

SEQ ID NO: 655377 - RNA, 18 nt, Human
aggcaugguggugcgcac

SEQ ID NO: 655378 - RNA, 22 nt, Human
ugguuacagagauuuuuaagau

SEQ ID NO: 655379 - RNA, 22 nt, Human
ucugggcuauauggucucugcu

SEQ ID NO: 655380 - RNA, 22 nt, Human
cgagauccuucagagcgcggac

SEQ ID NO: 655381 - RNA, 22 nt, Human
ugguuuucuggugguggcagug

SEQ ID NO: 655382 - RNA, 22 nt, Human
auuucucuuagcaagacauuac

SEQ ID NO: 655383 - RNA, 22 nt, Human
ucccugcagccccugagccuuc

SEQ ID NO: 655384 - RNA, 22 nt, Human
gcuucauuacugacagucugug

SEQ ID NO: 655385 - RNA, 22 nt, Human
uuaugcaaggacuuauuacagu

SEQ ID NO: 655386 - RNA, 22 nt, Human
gcagcagcucccuauccaggcu

SEQ ID NO: 655387 - RNA, 22 nt, Human
ucauaaaguuacccaaauuuua

SEQ ID NO: 655388 - RNA, 22 nt, Human
guguggcccugcguccugaguc

SEQ ID NO: 655389 - RNA, 22 nt, Human
cagguccagaaaccaaaggauu

SEQ ID NO: 655390 - RNA, 22 nt, Human
cugcucugaguauuaacggagg

SEQ ID NO: 655391 - RNA, 22 nt, Human
ccuccagcauuacuggcccaug

SEQ ID NO: 655392 - RNA, 22 nt, Human
gcaauacucaacacuuuugcuu

SEQ ID NO: 655393 - RNA, 22 nt, Human
aaagcuguuguauggcccuugg

SEQ ID NO: 655394 - RNA, 22 nt, Human
ccagaugggccagggguuuguu

SEQ ID NO: 655395 - RNA, 22 nt, Human
uaaaagagaauggauaacagag

SEQ ID NO: 655396 - RNA, 22 nt, Human
gcagagcagaggugcagguugg

SEQ ID NO: 655397 - RNA, 22 nt, Human
gcaaacauguugugagauacca

SEQ ID NO: 655398 - RNA, 17 nt, Human
caucugcucugccccuu

SEQ ID NO: 655399 - RNA, 22 nt, Human
gcuggagauacugcucaguauc

SEQ ID NO: 655400 - RNA, 22 nt, Human
guuuucuaccagggaagagagu

SEQ ID NO: 655401 - RNA, 22 nt, Human
ugcaggugcugugucaagagag

SEQ ID NO: 655402 - RNA, 22 nt, Human
uccugucuuaaugaucucgugc

SEQ ID NO: 655403 - RNA, 22 nt, Human
ugacuugucucuuugggagaca

SEQ ID NO: 655404 - RNA, 22 nt, Human
acgugcaucuuuccauaugugg

SEQ ID NO: 655405 - RNA, 22 nt, Human
acacauaugccauuacagcaaa

SEQ ID NO: 655406 - RNA, 22 nt, Human
aaggcacauauuuuagagucac

SEQ ID NO: 655407 - RNA, 22 nt, Human
agauuuccugcacugccuuuga

SEQ ID NO: 655408 - RNA, 22 nt, Human
auuucugccauagccaggggau

SEQ ID NO: 655409 - RNA, 19 nt, Human
aaacucauagacucauauu

SEQ ID NO: 655410 - RNA, 20 nt, Human
uccucagaagacauuugggg

SEQ ID NO: 655411 - RNA, 22 nt, Human
gcuccuucaggugguagcuguu

SEQ ID NO: 655412 - RNA, 23 nt, Human
uccucgcaggagggagaugaugc

SEQ ID NO: 655413 - RNA, 22 nt, Human
acaguucuuaaaacuugaauua

SEQ ID NO: 655414 - RNA, 22 nt, Human
gcaggcucguuggaaguccccu

SEQ ID NO: 655415 - RNA, 19 nt, Human
aguccaugaauggaggaug

SEQ ID NO: 655416 - RNA, 20 nt, Human
cuguuaaaagguaugaauuc

SEQ ID NO: 655417 - RNA, 22 nt, Human
aggaaaaucgagucuggaggca

SEQ ID NO: 655418 - RNA, 22 nt, Human
uagaaagcaguaucuccauuuu

SEQ ID NO: 655419 - RNA, 22 nt, Human
uuauggcuaaauuucaauauua

SEQ ID NO: 655420 - RNA, 22 nt, Human
ugaggaauguuuugagugccga

SEQ ID NO: 655421 - RNA, 22 nt, Human
uccgauuagcucuuuauaaaac

SEQ ID NO: 655422 - RNA, 22 nt, Human
agcuucuuuuacagcucaugcu

SEQ ID NO: 655423 - RNA, 20 nt, Human
uauaacaguguugggugugu

SEQ ID NO: 655424 - RNA, 22 nt, Human
gggccagaccucuucucaggga

SEQ ID NO: 655425 - RNA, 22 nt, Human
ggcgccagcacugcagcgccuc

SEQ ID NO: 655426 - RNA, 22 nt, Human
gaagaggacuguggcauccuag

SEQ ID NO: 655427 - RNA, 22 nt, Human
uacaagcucacaaauuuuuaag

SEQ ID NO: 655428 - RNA, 22 nt, Human
ccugcuucagggaugauggcac

SEQ ID NO: 655429 - RNA, 22 nt, Human
gaacuauaucuucaagaaaaug

SEQ ID NO: 655430 - RNA, 22 nt, Human
ucauugccauggcauuugcaga

SEQ ID NO: 655431 - RNA, 22 nt, Human
aggcaugacuuuggcugaagaa

SEQ ID NO: 655432 - RNA, 22 nt, Human
guccacucuagggcagcucucg

SEQ ID NO: 655433 - RNA, 22 nt, Human
ugggaaauauaauuuagcugug

SEQ ID NO: 655434 - RNA, 22 nt, Human
gcucucuuugugccacuuaagg

SEQ ID NO: 655435 - RNA, 22 nt, Human
ucugaacuccagcccugcucuc

SEQ ID NO: 655436 - RNA, 20 nt, Human
ccagugggaagugauuaggu

SEQ ID NO: 655437 - RNA, 22 nt, Human
ggaacacucagaaaugcucguc

SEQ ID NO: 655438 - RNA, 22 nt, Human
aaacuucauuuucaacugcaaa

SEQ ID NO: 655439 - RNA, 22 nt, Human
agcacugauuuaaacuggauuu

SEQ ID NO: 655440 - RNA, 22 nt, Human
ggaggccaucuggcuggaggcu

SEQ ID NO: 655441 - RNA, 22 nt, Human
gacuggcucuaucuccuuggcg

SEQ ID NO: 655442 - RNA, 22 nt, Human
gcaccagggagggugugcuuca

SEQ ID NO: 655443 - RNA, 22 nt, Human
aucuccuuggucucguuccagg

SEQ ID NO: 655444 - RNA, 22 nt, Human
ggcccagagcucccuggcaccu

SEQ ID NO: 655445 - RNA, 22 nt, Human
uauuucccagggagcaacaagc

SEQ ID NO: 655446 - RNA, 22 nt, Human
aagucacuggaggaacucuacu

SEQ ID NO: 655447 - RNA, 22 nt, Human
agaaauguugaauacacaaaau

SEQ ID NO: 655448 - RNA, 22 nt, Human
ccacagggcucuaggcgcuucc

SEQ ID NO: 655449 - RNA, 22 nt, Human
cuuuacagcuuagugguaugga

SEQ ID NO: 655450 - RNA, 22 nt, Human
ggauggagguucucagaugcuc

SEQ ID NO: 655451 - RNA, 22 nt, Human
acacuucaaaugguuggaaaau

SEQ ID NO: 655452 - RNA, 22 nt, Human
ccugucuguuugcccauucuug

SEQ ID NO: 655453 - RNA, 22 nt, Human
auuacacagcgguuacuacuag

SEQ ID NO: 655454 - RNA, 22 nt, Human
cagaaguggccucagagggagu

SEQ ID NO: 655455 - RNA, 19 nt, Human
gcugugugaccuugggcaa

SEQ ID NO: 655456 - RNA, 22 nt, Human
uccuuagggauuuuuccaguca

SEQ ID NO: 655457 - RNA, 22 nt, Human
caggcccauuuguagccacuuu

SEQ ID NO: 655458 - RNA, 20 nt, Human
cagcaggaaaagugccucag

SEQ ID NO: 655459 - RNA, 22 nt, Human
cuacaaauauaaaacacagaua

SEQ ID NO: 655460 - RNA, 22 nt, Human
aagcauauuuuaauuagccaca

SEQ ID NO: 655461 - RNA, 22 nt, Human
ggcucagguugggucacaugac

SEQ ID NO: 655462 - RNA, 22 nt, Human
aggugcagugaaggaaaaggaa

SEQ ID NO: 655463 - RNA, 22 nt, Human
uguguacucaauugagccauuu

SEQ ID NO: 655464 - RNA, 19 nt, Human
gggcaucaaagugcuggug

SEQ ID NO: 655465 - RNA, 22 nt, Human
aggagagaauguuccaggcuug

SEQ ID NO: 655466 - RNA, 22 nt, Human
cccagaguuggucaggggaccc

SEQ ID NO: 655467 - RNA, 19 nt, Human
acagaaauguaagugagac

SEQ ID NO: 655468 - RNA, 22 nt, Human
agcaggugcauggcgagcgcgg

SEQ ID NO: 655469 - RNA, 21 nt, Human
agggccagaucaccaaggagc

SEQ ID NO: 655470 - RNA, 22 nt, Human
auagaucaaugagcaauuuaau

SEQ ID NO: 655471 - RNA, 22 nt, Human
ugucuuuguuauuguggacagg

SEQ ID NO: 655472 - RNA, 22 nt, Human
aaguucaagaucaagguuccag

SEQ ID NO: 655473 - RNA, 22 nt, Human
ugcuggaaaguuaaauuuugga

SEQ ID NO: 655474 - RNA, 22 nt, Human
gcccugaggauuugcauuuccu

SEQ ID NO: 655475 - RNA, 22 nt, Human
acauacuuaacauuaaagucau

SEQ ID NO: 655476 - RNA, 22 nt, Human
aaacacacagaaaugaaugagg

SEQ ID NO: 655477 - RNA, 22 nt, Human
aggccacaggcacccuguguuc

SEQ ID NO: 655478 - RNA, 22 nt, Human
gugcccucaugaaacgaaggau

SEQ ID NO: 655479 - RNA, 22 nt, Human
uucuuacuacauuugcaggcua

SEQ ID NO: 655480 - RNA, 22 nt, Human
ccccaccagcacccucucuauc

SEQ ID NO: 655481 - RNA, 22 nt, Human
aaauagauuuccuagcauugga

SEQ ID NO: 655482 - RNA, 22 nt, Human
ugcagcagcuccagguuacccu

SEQ ID NO: 655483 - RNA, 22 nt, Human
aacaugaaaacuaccugugauu

SEQ ID NO: 655484 - RNA, 22 nt, Human
ggaaucagaugaggggcagagc

SEQ ID NO: 655485 - RNA, 22 nt, Human
gguguggguccuugugcuugcu

SEQ ID NO: 655486 - RNA, 22 nt, Human
cagcaguaauuagugcugcaug

SEQ ID NO: 655487 - RNA, 22 nt, Human
aaguaacaucugaacaugaugu

SEQ ID NO: 655488 - RNA, 22 nt, Human
ggaauguagaaucucuggucuc

SEQ ID NO: 655489 - RNA, 22 nt, Human
aauaucacaggaggagaccaag

SEQ ID NO: 655490 - RNA, 22 nt, Human
cuuacauugucuuaguuuucaa

SEQ ID NO: 655491 - RNA, 22 nt, Human
auucauguucggggccacguug

SEQ ID NO: 655492 - RNA, 21 nt, Human
uaacacauuuugguacuuugg

SEQ ID NO: 655493 - RNA, 22 nt, Human
ucagcaaguggaccauccuggg

SEQ ID NO: 655494 - RNA, 21 nt, Human
ugcuggaaaaagugguucuag

SEQ ID NO: 655495 - RNA, 22 nt, Human
gccuggaggcgagaacccaaug

SEQ ID NO: 655496 - RNA, 22 nt, Human
acuugggucacaugaccuaccu

SEQ ID NO: 655497 - RNA, 22 nt, Human
gcucaggcccagcggcuggugu

SEQ ID NO: 655498 - RNA, 22 nt, Human
ugcuggaggaguuuacuguggc

SEQ ID NO: 655499 - RNA, 22 nt, Human
uaucacaggugugauuuacauu

SEQ ID NO: 655500 - RNA, 22 nt, Human
gggcagagguucaacuucaaca

SEQ ID NO: 655501 - RNA, 22 nt, Human
ucuaaacauuaugauaguagag

SEQ ID NO: 655502 - RNA, 22 nt, Human
uuguuuauguaauuggcacacu

SEQ ID NO: 655503 - RNA, 22 nt, Human
aaauaacagucagggacaacau

SEQ ID NO: 655504 - RNA, 22 nt, Human
uggcacacagagaagacacuug

SEQ ID NO: 655505 - RNA, 22 nt, Human
cugaaacauugcaauaacaaag

SEQ ID NO: 655506 - RNA, 20 nt, Human
uccuucagacgacaagcaag

SEQ ID NO: 655507 - RNA, 22 nt, Human
ggagugaaucacuagaugcaga

SEQ ID NO: 655508 - RNA, 22 nt, Human
cugggcacuugcucacagcucu

SEQ ID NO: 655509 - RNA, 22 nt, Human
uauguuuuaggaauuaauuguu

SEQ ID NO: 655510 - RNA, 20 nt, Human
uccuugaaagugggguauau

SEQ ID NO: 655511 - RNA, 22 nt, Human
aacagcagggaaauuccaaguc

SEQ ID NO: 655512 - RNA, 22 nt, Human
guggugcaggugucacugcaga

SEQ ID NO: 655513 - RNA, 22 nt, Human
uaggauuuuuuggauucuggau

SEQ ID NO: 655514 - RNA, 22 nt, Human
cuuccaauagcaacaaagauua

SEQ ID NO: 655515 - RNA, 22 nt, Human
agccaggacguugcucagcucc

SEQ ID NO: 655516 - RNA, 22 nt, Human
uccagcaguccaugugagacac

SEQ ID NO: 655517 - RNA, 22 nt, Human
gggcugaccaaugccuugcuuu

SEQ ID NO: 655518 - RNA, 22 nt, Human
ggagccuggcaaugcugcgucc

SEQ ID NO: 655519 - RNA, 22 nt, Human
gacuccugggccucugagaggc

SEQ ID NO: 655520 - RNA, 22 nt, Human
aggucaagguucacaggggauc

SEQ ID NO: 655521 - RNA, 22 nt, Human
acauugaugugaugcagaagug

SEQ ID NO: 655522 - RNA, 22 nt, Human
agggcucugggguggcagagau

SEQ ID NO: 655523 - RNA, 20 nt, Human
ggcaggugcuguccccuccu

SEQ ID NO: 655524 - RNA, 22 nt, Human
ugugucugaacuaguugcucuc

SEQ ID NO: 655525 - RNA, 22 nt, Human
uggcuucuugggaugggucauu

SEQ ID NO: 655526 - RNA, 22 nt, Human
cucugagguccuacagugaccc

SEQ ID NO: 655527 - RNA, 22 nt, Human
ccugugugauuggaagcugaga

SEQ ID NO: 655528 - RNA, 22 nt, Human
aauccauugcugugcugccagg

SEQ ID NO: 655529 - RNA, 22 nt, Human
ucccagcauaacaaacugcccg

SEQ ID NO: 655530 - RNA, 22 nt, Human
aauaauuauuugagagcagacc

SEQ ID NO: 655531 - RNA, 22 nt, Human
agaguguuauuugcucuguauu

SEQ ID NO: 655532 - RNA, 22 nt, Human
aguacacaagacacauuuaaaa

SEQ ID NO: 655533 - RNA, 22 nt, Human
gauuuucugagccuucaaauuu

SEQ ID NO: 655534 - RNA, 22 nt, Human
agggcccucuggcaggccaggc

SEQ ID NO: 655535 - RNA, 22 nt, Human
ucucuggguaaaguucucucau

SEQ ID NO: 655536 - RNA, 22 nt, Human
ucaggacaaccuguuuucagac

SEQ ID NO: 655537 - RNA, 22 nt, Human
uucugugaaacuaaagagagga

SEQ ID NO: 655538 - RNA, 22 nt, Human
ugggacaggaugaccagaaggu

SEQ ID NO: 655539 - RNA, 22 nt, Human
ugagaauagcagacugguaacu

SEQ ID NO: 655540 - RNA, 22 nt, Human
uuucuucuaugugugauauuuu

SEQ ID NO: 655541 - RNA, 22 nt, Human
aaauaagcacuuaacuguauca

SEQ ID NO: 655542 - RNA, 22 nt, Human
gucucacacagaguagauuuug

SEQ ID NO: 655543 - RNA, 22 nt, Human
cuugaaaugacaggagcacauc

SEQ ID NO: 655544 - RNA, 19 nt, Human
cuacuuuauaauaugccuc

SEQ ID NO: 655545 - RNA, 22 nt, Human
uugagcucagugacucgacuuu

SEQ ID NO: 655546 - RNA, 22 nt, Human
cagguucuggagaugcagagau

SEQ ID NO: 655547 - RNA, 22 nt, Human
ucuccaggcuuuuugugaauug

SEQ ID NO: 655548 - RNA, 21 nt, Human
ggggccucuccacacagccgg

SEQ ID NO: 655549 - RNA, 19 nt, Human
ucagaggauuuggcuauga

SEQ ID NO: 655550 - RNA, 22 nt, Human
gugaggucauauagcgaacucc

SEQ ID NO: 655551 - RNA, 22 nt, Human
ugaacacuguauauucuucuug

SEQ ID NO: 655552 - RNA, 22 nt, Human
acccuuuguccaauagaaauga

SEQ ID NO: 655553 - RNA, 22 nt, Human
ccagcugcgggcaucgagaguu

SEQ ID NO: 655554 - RNA, 22 nt, Human
uuucagaggaaaucucauugag

SEQ ID NO: 655555 - RNA, 22 nt, Human
acucuaaugcuaauaguauuuu

SEQ ID NO: 655556 - RNA, 22 nt, Human
cauugcucaggcccagcaggaa

SEQ ID NO: 655557 - RNA, 22 nt, Human
cuccccaagccuuggcuucucc

SEQ ID NO: 655558 - RNA, 21 nt, Human
ucucuccucaagcucgacccc

SEQ ID NO: 655559 - RNA, 22 nt, Human
cuccuggccccagaucccaauc

SEQ ID NO: 655560 - RNA, 22 nt, Human
auuucauauguaucaccuagcc

SEQ ID NO: 655561 - RNA, 22 nt, Human
uuacugauggaacagagauaga

SEQ ID NO: 655562 - RNA, 22 nt, Human
augaguucauugcauuugacag

SEQ ID NO: 655563 - RNA, 22 nt, Human
uuuagcaaauuacucacagggu

SEQ ID NO: 655564 - RNA, 22 nt, Human
gagagcccuuagguuuagaguu

SEQ ID NO: 655565 - RNA, 19 nt, Human
ucauggaucagguaguuua

SEQ ID NO: 655566 - RNA, 22 nt, Human
gcuaggaguggugggucaagga

SEQ ID NO: 655567 - RNA, 22 nt, Human
ccuggcugguggcagcgacaag

SEQ ID NO: 655568 - RNA, 22 nt, Human
uggcucagugcauucacaguaa

SEQ ID NO: 655569 - RNA, 22 nt, Human
gcagagcugucuaagucacuuc

SEQ ID NO: 655570 - RNA, 22 nt, Human
uggagcugagaaguggagcucu

SEQ ID NO: 655571 - RNA, 22 nt, Human
cagugguugguagauacuugag

SEQ ID NO: 655572 - RNA, 18 nt, Human
ucaguguagaucugugua

SEQ ID NO: 655573 - RNA, 22 nt, Human
agggagaaugaccaagguauau

SEQ ID NO: 655574 - RNA, 22 nt, Human
ccaggugcugaccggucagauu

SEQ ID NO: 655575 - RNA, 22 nt, Human
ggugaggguaaacuaaaacauc

SEQ ID NO: 655576 - RNA, 22 nt, Human
uuuccuaacucaucggauguac

SEQ ID NO: 655577 - RNA, 22 nt, Human
caugcagggagcagaggagaca

SEQ ID NO: 655578 - RNA, 22 nt, Human
aggugaguuacaggaggagguc

SEQ ID NO: 655579 - RNA, 22 nt, Human
guuguauucuucaauaucagag

SEQ ID NO: 655580 - RNA, 19 nt, Human
accaggagacagugagcuu

SEQ ID NO: 655581 - RNA, 22 nt, Human
uccagccuuccuuuucacucuc

SEQ ID NO: 655582 - RNA, 22 nt, Human
aagucuuuugcuaagaguaaug

SEQ ID NO: 655583 - RNA, 22 nt, Human
aaacugugaagcaaguacaagg

SEQ ID NO: 655584 - RNA, 22 nt, Human
uaguaucuuucuauauuuccca

SEQ ID NO: 655585 - RNA, 22 nt, Human
ugcagggcccuugggguugaac

SEQ ID NO: 655586 - RNA, 22 nt, Human
gcagggcuauuggaaggagaug

SEQ ID NO: 655587 - RNA, 22 nt, Human
cuccauggggaaaugaaggugg

SEQ ID NO: 655588 - RNA, 22 nt, Human
aauugcauaaaauucaacucug

SEQ ID NO: 655589 - RNA, 22 nt, Human
cccucucucaggcugacagccu

SEQ ID NO: 655590 - RNA, 22 nt, Human
acauagaguaucauacuggaug

SEQ ID NO: 655591 - RNA, 22 nt, Human
gcuuuggagccuguguucugcc

SEQ ID NO: 655592 - RNA, 22 nt, Human
ucacauuaggaaguaauguugu

SEQ ID NO: 655593 - RNA, 22 nt, Human
acagaugcgcuugguugccaga

SEQ ID NO: 655594 - RNA, 22 nt, Human
aaguucuacuguggguaaaaug

SEQ ID NO: 655595 - RNA, 22 nt, Human
ucuggcuuucucagcauggcau

SEQ ID NO: 655596 - RNA, 23 nt, Human
uggagcugggcucagacccuggg

SEQ ID NO: 655597 - RNA, 22 nt, Human
uuaaccuguaaaaugggagaag

SEQ ID NO: 655598 - RNA, 22 nt, Human
acuguaauuggauugucugacu

SEQ ID NO: 655599 - RNA, 22 nt, Human
aagaauuggucacaugcuacaa

SEQ ID NO: 655600 - RNA, 22 nt, Human
agaguacacuguacacacaauu

SEQ ID NO: 655601 - RNA, 22 nt, Human
gaggagggcuuuguugauguua

SEQ ID NO: 655602 - RNA, 22 nt, Human
aacuucagagcugugugguuug

SEQ ID NO: 655603 - RNA, 22 nt, Human
cuggcagaggauggggacccag

SEQ ID NO: 655604 - RNA, 21 nt, Human
aacacauccagaguauuugac

SEQ ID NO: 655605 - RNA, 21 nt, Human
cuuggaacggguagaacucac

SEQ ID NO: 655606 - RNA, 22 nt, Human
accagcugaacugcagcccagg

SEQ ID NO: 655607 - RNA, 20 nt, Human
ggacugaaaacacaaaccug

SEQ ID NO: 655608 - RNA, 22 nt, Human
gcucugcugauccgcagccauc

SEQ ID NO: 655609 - RNA, 22 nt, Human
agaauagagaaaaagguuauuu

SEQ ID NO: 655610 - RNA, 22 nt, Human
uuguauaagaaguuggcagaua

SEQ ID NO: 655611 - RNA, 22 nt, Human
ggguccagggacguuucugcag

SEQ ID NO: 655612 - RNA, 22 nt, Human
agugccuugugugugggcagcc

SEQ ID NO: 655613 - RNA, 22 nt, Human
uacagcauuuuguagaguacua

SEQ ID NO: 655614 - RNA, 22 nt, Human
agugcuuaaaacccugcacuag

SEQ ID NO: 655615 - RNA, 22 nt, Human
aaauccuaagcagaggaauuua

SEQ ID NO: 655616 - RNA, 19 nt, Human
ccagcuggccugggaccuc

SEQ ID NO: 655617 - RNA, 22 nt, Human
acagcuggagcccuauggcugg

SEQ ID NO: 655618 - RNA, 19 nt, Human
ugacaggcuguugccuuga

SEQ ID NO: 655619 - RNA, 22 nt, Human
agcaggcaggaaugguggaaca

SEQ ID NO: 655620 - RNA, 22 nt, Human
auugaaugcuugcuaacacuuu

SEQ ID NO: 655621 - RNA, 22 nt, Human
augaaacugaaggacaaccaga

SEQ ID NO: 655622 - RNA, 22 nt, Human
uucuggcaugagagaugggggu

SEQ ID NO: 655623 - RNA, 22 nt, Human
caccugccucauuugucccugc

SEQ ID NO: 655624 - RNA, 22 nt, Human
cuggguagaagauuccucagga

SEQ ID NO: 655625 - RNA, 23 nt, Human
gcuucugccauuugcuagcugug

SEQ ID NO: 655626 - RNA, 22 nt, Human
uguguuucucugaggggucccu

SEQ ID NO: 655627 - RNA, 22 nt, Human
uuagaaaucugcugccaugcaa

SEQ ID NO: 655628 - RNA, 22 nt, Human
ucuguucaucucaugggagaau

SEQ ID NO: 655629 - RNA, 22 nt, Human
ucuucaaaaacugcaccuugcu

SEQ ID NO: 655630 - RNA, 22 nt, Human
ucagcaaugugauacugugcaa

SEQ ID NO: 655631 - RNA, 22 nt, Human
uuccuucuucauuguguuacag

SEQ ID NO: 655632 - RNA, 21 nt, Human
ucucugagaggucugcuuaga

SEQ ID NO: 655633 - RNA, 22 nt, Human
uugcagggaaaucagugaggau

SEQ ID NO: 655634 - RNA, 22 nt, Human
agcaaaucuaugaauguauauu

SEQ ID NO: 655635 - RNA, 23 nt, Human
ccucaggggaccugugagccuga

SEQ ID NO: 655636 - RNA, 22 nt, Human
gaauuuaaauuuaaaucuacca

SEQ ID NO: 655637 - RNA, 22 nt, Human
uuuguacacaggucauucaggg

SEQ ID NO: 655638 - RNA, 22 nt, Human
acagagcauaaugucuagcaca

SEQ ID NO: 655639 - RNA, 22 nt, Human
aggugcaggagcugugcaggga

SEQ ID NO: 655640 - RNA, 22 nt, Human
ucagaaauaaugaaugaugggg

SEQ ID NO: 655641 - RNA, 22 nt, Human
gcugagugauugauauuuuagu

SEQ ID NO: 655642 - RNA, 22 nt, Human
acaguaaaacauuuuuauuagg

SEQ ID NO: 655643 - RNA, 23 nt, Human
acagccccaugcagguguguuug

SEQ ID NO: 655644 - RNA, 22 nt, Human
cagaggcauauaauugcugggg

SEQ ID NO: 655645 - RNA, 22 nt, Human
cagaaaccaaaugggaugggga

SEQ ID NO: 655646 - RNA, 22 nt, Human
cuggcucuaagugucagcuccc

SEQ ID NO: 655647 - RNA, 22 nt, Human
gcugcugcuggucuggggccac

SEQ ID NO: 655648 - RNA, 22 nt, Human
ugaaaauuguuguacuugauaa

SEQ ID NO: 655649 - RNA, 22 nt, Human
gccccagcagcaaugcgguuga

SEQ ID NO: 655650 - RNA, 22 nt, Human
ccauagcaagaggagcagaaau

SEQ ID NO: 655651 - RNA, 18 nt, Human
ggagagugagaucaaaca

SEQ ID NO: 655652 - RNA, 22 nt, Human
uuaauguaugggguugagauga

SEQ ID NO: 655653 - RNA, 22 nt, Human
aggcuucccuuccucugggggu

SEQ ID NO: 655654 - RNA, 22 nt, Human
caggcagcuagauuuauaacaa

SEQ ID NO: 655655 - RNA, 22 nt, Human
cccaggaguuggaggcuacggu

SEQ ID NO: 655656 - RNA, 22 nt, Human
ucacaggcuggucuccgaggac

SEQ ID NO: 655657 - RNA, 22 nt, Human
ugagccagugugguaaagcuga

SEQ ID NO: 655658 - RNA, 22 nt, Human
cuucccaagacuguauugcaag

SEQ ID NO: 655659 - RNA, 17 nt, Human
gaaggccugcacaggcc

SEQ ID NO: 655660 - RNA, 22 nt, Human
gggaagugaaguguagcugucu

SEQ ID NO: 655661 - RNA, 22 nt, Human
cccagcaguuguuggugcacau

SEQ ID NO: 655662 - RNA, 22 nt, Human
auauuuuggcaaaugucuagau

SEQ ID NO: 655663 - RNA, 22 nt, Human
acugcuagugagaaaauaacca

SEQ ID NO: 655664 - RNA, 22 nt, Human
cuggaaggagcccgggcggauc

SEQ ID NO: 655665 - RNA, 22 nt, Human
gcccaggaguucaaggcugcag

SEQ ID NO: 655666 - RNA, 23 nt, Human
agguccuggacauaugugcauca

SEQ ID NO: 655667 - RNA, 22 nt, Human
ccucugggccuggaagggcagu

SEQ ID NO: 655668 - RNA, 21 nt, Human
acaggcaauuucauaugguuc

SEQ ID NO: 655669 - RNA, 22 nt, Human
ugagguaggugucgagagaggu

SEQ ID NO: 655670 - RNA, 20 nt, Human
uauacuaacauauaucuguu

SEQ ID NO: 655671 - RNA, 22 nt, Human
cuacagugaagacuagcuauag

SEQ ID NO: 655672 - RNA, 21 nt, Human
ucaugcaggcagaguuuggua

SEQ ID NO: 655673 - RNA, 22 nt, Human
ugcauguguguguauuuauaaa

SEQ ID NO: 655674 - RNA, 22 nt, Human
ccauggagcgggugagugagug

SEQ ID NO: 655675 - RNA, 22 nt, Human
aaggcacuuuucuaaagaccuu

SEQ ID NO: 655676 - RNA, 18 nt, Human
guuucaugcaugugaaac

SEQ ID NO: 655677 - RNA, 22 nt, Human
uccugccaccugcacagcuccc

SEQ ID NO: 655678 - RNA, 22 nt, Human
uuccugagggacuuuugagauu

SEQ ID NO: 655679 - RNA, 22 nt, Human
aagucagagaucaaggugucua

SEQ ID NO: 655680 - RNA, 22 nt, Human
agcugucuuucauuaccucauu

SEQ ID NO: 655681 - RNA, 22 nt, Human
gugcuccuggccacaugaagcu

SEQ ID NO: 655682 - RNA, 22 nt, Human
acaaaagugagugugucucaga

SEQ ID NO: 655683 - RNA, 22 nt, Human
uccauacccagcuuucucacac

SEQ ID NO: 655684 - RNA, 22 nt, Human
ucucugugagccagguccuagu

SEQ ID NO: 655685 - RNA, 23 nt, Human
cagucugcagcccacuugggcag

SEQ ID NO: 655686 - RNA, 22 nt, Human
ucucagugacugcugggucccc

SEQ ID NO: 655687 - RNA, 21 nt, Human
uuuauuuauauaggacacaug

SEQ ID NO: 655688 - RNA, 22 nt, Human
ugcccagcugucaaaguagaua

SEQ ID NO: 655689 - RNA, 22 nt, Human
gcucaggaucagccaccucuuu

SEQ ID NO: 655690 - RNA, 22 nt, Human
gagguucagcugcugccuggua

SEQ ID NO: 655691 - RNA, 22 nt, Human
cagcccagguggcggagguugc

SEQ ID NO: 655692 - RNA, 22 nt, Human
aagcuucaguucuggggcaaug

SEQ ID NO: 655693 - RNA, 22 nt, Human
gggcuggaaaaacaacauacaa

SEQ ID NO: 655694 - RNA, 22 nt, Human
aguguuuagaggaggaaagaug

SEQ ID NO: 655695 - RNA, 22 nt, Human
cugcagggaacugaggcccaga

SEQ ID NO: 655696 - RNA, 22 nt, Human
cuggaagaguaauauaaauuag

SEQ ID NO: 655697 - RNA, 22 nt, Human
augagcuuccagacaaaggcau

SEQ ID NO: 655698 - RNA, 23 nt, Human
uggauaaaauacuuacauucaac

SEQ ID NO: 655699 - RNA, 22 nt, Human
gacauuuagaaguuagauucaa

SEQ ID NO: 655700 - RNA, 18 nt, Human
gggcucacacaggucauc

SEQ ID NO: 655701 - RNA, 22 nt, Human
caacauaugauuuuguauauaa

SEQ ID NO: 655702 - RNA, 22 nt, Human
ucccagccuccugacaguuuug

SEQ ID NO: 655703 - RNA, 22 nt, Human
gccuuauuaccugcacuuugaa

SEQ ID NO: 655704 - RNA, 22 nt, Human
caguggaagcuggcugugaaga

SEQ ID NO: 655705 - RNA, 22 nt, Human
gauuuacagaucuaagggucac

SEQ ID NO: 655706 - RNA, 22 nt, Human
ggugaaggucuacugugugcca

SEQ ID NO: 655707 - RNA, 22 nt, Human
ucacacuaggauguuguuucua

SEQ ID NO: 655708 - RNA, 22 nt, Human
aagaguuuaauuuugucuagac

SEQ ID NO: 655709 - RNA, 22 nt, Human
uagagcugggcagugcucugag

SEQ ID NO: 655710 - RNA, 22 nt, Human
uuuuugugauaugacacuguau

SEQ ID NO: 655711 - RNA, 22 nt, Human
aggccugccuggaucacacaga

SEQ ID NO: 655712 - RNA, 22 nt, Human
ucaggcccuucucccaggacuc

SEQ ID NO: 655713 - RNA, 22 nt, Human
aaaggccacuugaaggauuuuu

SEQ ID NO: 655714 - RNA, 22 nt, Human
ggcugcauaggcagaagcugug

SEQ ID NO: 655715 - RNA, 22 nt, Human
gccucugauggaggccagcgcu

SEQ ID NO: 655716 - RNA, 22 nt, Human
ucaggccacuucacaggugauu

SEQ ID NO: 655717 - RNA, 21 nt, Human
aggcagcucaggcccagagag

SEQ ID NO: 655718 - RNA, 22 nt, Human
auggcccaaacugcaauuacuu

SEQ ID NO: 655719 - RNA, 22 nt, Human
uauccaaaguggcauauuauag

SEQ ID NO: 655720 - RNA, 22 nt, Human
uauauacaagguagguuuaggu

SEQ ID NO: 655721 - RNA, 22 nt, Human
caguuuuaucaucugugaaaug

SEQ ID NO: 655722 - RNA, 22 nt, Human
ccuuuggccgcuuuauggagga

SEQ ID NO: 655723 - RNA, 22 nt, Human
ucugugucguucugugcucugg

SEQ ID NO: 655724 - RNA, 22 nt, Human
acaaugaaccaaauuuaccaau

SEQ ID NO: 655725 - RNA, 22 nt, Human
ucaaggcaaaguaaauauucaa

SEQ ID NO: 655726 - RNA, 22 nt, Human
acugcuuuugaucucuucugua

SEQ ID NO: 655727 - RNA, 22 nt, Human
auuugcauaaggaugcuacugu

SEQ ID NO: 655728 - RNA, 21 nt, Human
ucugcccuccaggagcucaua

SEQ ID NO: 655729 - RNA, 22 nt, Human
ucaggcuggagugcaguggcgc

SEQ ID NO: 655730 - RNA, 20 nt, Human
ucaaggaaugucauuuuguu

SEQ ID NO: 655731 - RNA, 22 nt, Human
uggcauccagccaugugauuuu

SEQ ID NO: 655732 - RNA, 22 nt, Human
acuuucauuugugaagacugua

SEQ ID NO: 655733 - RNA, 20 nt, Human
cugagccaacucucuucuug

SEQ ID NO: 655734 - RNA, 22 nt, Human
caggccuggguucaaaucccuu

SEQ ID NO: 655735 - RNA, 22 nt, Human
ucaugcacaugugucaccauca

SEQ ID NO: 655736 - RNA, 22 nt, Human
ccagcuggagcucgcagauagg

SEQ ID NO: 655737 - RNA, 22 nt, Human
augagauagacuaugucauaca

SEQ ID NO: 655738 - RNA, 22 nt, Human
gcucagagaugucugcugccuu

SEQ ID NO: 655739 - RNA, 22 nt, Human
cuggcaggcggcagagcccagg

SEQ ID NO: 655740 - RNA, 22 nt, Human
uggagcaggugcucaggguaau

SEQ ID NO: 655741 - RNA, 22 nt, Human
ccugggcugggcgucucauggg

SEQ ID NO: 655742 - RNA, 22 nt, Human
acuuuuaugauaaucaauguuc

SEQ ID NO: 655743 - RNA, 22 nt, Human
uuucccaauugagagguucugu

SEQ ID NO: 655744 - RNA, 22 nt, Human
acagucugucccccaggugcua

SEQ ID NO: 655745 - RNA, 22 nt, Human
aggaaacuuucuuuugcuucau

SEQ ID NO: 655746 - RNA, 22 nt, Human
aagaugcagcaaacuacuuuuu

SEQ ID NO: 655747 - RNA, 21 nt, Human
cagugggcugcugcgcuccag

SEQ ID NO: 655748 - RNA, 22 nt, Human
ggccagaguugauggcaucuug

SEQ ID NO: 655749 - RNA, 22 nt, Human
gaagggcugcaggucugggccc

SEQ ID NO: 655750 - RNA, 22 nt, Human
ggaaugggagcuauuaguggaa

SEQ ID NO: 655751 - RNA, 22 nt, Human
acaucucaaauuccaggcucca

SEQ ID NO: 655752 - RNA, 22 nt, Human
gcccacaccauuuauucuuugu

SEQ ID NO: 655753 - RNA, 22 nt, Human
caaauguguaaggaaguguuag

SEQ ID NO: 655754 - RNA, 21 nt, Human
gaggggcagcucuuagcauua

SEQ ID NO: 655755 - RNA, 22 nt, Human
cauaacuuuaaagacagugugg

SEQ ID NO: 655756 - RNA, 22 nt, Human
agcaggcacgcucccugcgcga

SEQ ID NO: 655757 - RNA, 22 nt, Human
cuaaacuuuuauaacauugaga

SEQ ID NO: 655758 - RNA, 22 nt, Human
ucuuuggcacuucuguuuuaag

SEQ ID NO: 655759 - RNA, 22 nt, Human
cauggccuugagugacugcacu

SEQ ID NO: 655760 - RNA, 22 nt, Human
cucagcucauuguggauccggu

SEQ ID NO: 655761 - RNA, 22 nt, Human
cauuucacuauucacuaaaagg

SEQ ID NO: 655762 - RNA, 22 nt, Human
uuugacuucugggcauuuuggu

SEQ ID NO: 655763 - RNA, 17 nt, Human
uguccauuugccuggag

SEQ ID NO: 655764 - RNA, 22 nt, Human
ggcguuucaccauguugaccag

SEQ ID NO: 655765 - RNA, 22 nt, Human
cagagcagggguuucccagguu

SEQ ID NO: 655766 - RNA, 22 nt, Human
gccagggaaacugcagaccagc

SEQ ID NO: 655767 - RNA, 22 nt, Human
uuguaacuugugauuauaaucu

SEQ ID NO: 655768 - RNA, 22 nt, Human
agaagccagcuucagcugcccg

SEQ ID NO: 655769 - RNA, 22 nt, Human
cugaauaucauuuacauuugga

SEQ ID NO: 655770 - RNA, 22 nt, Human
accaggagucuagccuagucaa

SEQ ID NO: 655771 - RNA, 22 nt, Human
uucaugccagcccuguguggua

SEQ ID NO: 655772 - RNA, 22 nt, Human
uuucaugcucauggaacacagc

SEQ ID NO: 655773 - RNA, 22 nt, Human
gggaaggccgguccagucaggu

SEQ ID NO: 655774 - RNA, 18 nt, Human
ggggagcagacugaacuc

SEQ ID NO: 655775 - RNA, 22 nt, Human
gagcaucacuguccucuccccg

SEQ ID NO: 655776 - RNA, 22 nt, Human
guuaguuugaacuugucuaugu

SEQ ID NO: 655777 - RNA, 22 nt, Human
acagagccaaaaggacauagua

SEQ ID NO: 655778 - RNA, 22 nt, Human
cccaggaguucgaggcuguagu

SEQ ID NO: 655779 - RNA, 22 nt, Human
aaugaagccacugaagacaauc

SEQ ID NO: 655780 - RNA, 22 nt, Human
aggcaggugggucacuugaguc

SEQ ID NO: 655781 - RNA, 22 nt, Human
aggcagcugcccucuccuuccu

SEQ ID NO: 655782 - RNA, 17 nt, Human
uguaacaacuccuauua

SEQ ID NO: 655783 - RNA, 22 nt, Human
cuccagagucaucgagcauucc

SEQ ID NO: 655784 - RNA, 22 nt, Human
aacagcuugaggaauaucauca

SEQ ID NO: 655785 - RNA, 22 nt, Human
uucccagaaugaauggauggag

SEQ ID NO: 655786 - RNA, 22 nt, Human
ggagcugggguuggcaucuucc

SEQ ID NO: 655787 - RNA, 22 nt, Human
cugagaaacauauuuccaucua

SEQ ID NO: 655788 - RNA, 22 nt, Human
aacacaggggguuacaaauugu

SEQ ID NO: 655789 - RNA, 22 nt, Human
auuucuauaggaggacaguauu

SEQ ID NO: 655790 - RNA, 22 nt, Human
uucaaguacuguagauuucagg

SEQ ID NO: 655791 - RNA, 22 nt, Human
gccugguggugugcucaagugg

SEQ ID NO: 655792 - RNA, 23 nt, Human
uuucaaagacuuucccuuagagu

SEQ ID NO: 655793 - RNA, 22 nt, Human
uaacaguagccuuauguggucu

SEQ ID NO: 655794 - RNA, 22 nt, Human
aaguugauuaaucuuucgagaa

SEQ ID NO: 655795 - RNA, 22 nt, Human
uuuugguagaaucaacaaugua

SEQ ID NO: 655796 - RNA, 22 nt, Human
aauguaugagcgugaaagcacu

SEQ ID NO: 655797 - RNA, 22 nt, Human
gggccagugggaccugggucuc

SEQ ID NO: 655798 - RNA, 22 nt, Human
cugucauuugucugcucccucu

SEQ ID NO: 655799 - RNA, 22 nt, Human
uucauggauguugguagaaaac

SEQ ID NO: 655800 - RNA, 22 nt, Human
ugugagaggagaaaugcauuaa

SEQ ID NO: 655801 - RNA, 22 nt, Human
cuggucuggcuacccagcgaau

SEQ ID NO: 655802 - RNA, 19 nt, Human
ucuuccagcaucugggggc

SEQ ID NO: 655803 - RNA, 22 nt, Human
gccugccacgcaugcagaguca

SEQ ID NO: 655804 - RNA, 22 nt, Human
cuggcugccuauagucucccuu

SEQ ID NO: 655805 - RNA, 22 nt, Human
gucccuggucuaccguggcuuc

SEQ ID NO: 655806 - RNA, 22 nt, Human
aaauaaaggaacuguuuuccca

SEQ ID NO: 655807 - RNA, 22 nt, Human
agauauggccucauacagacau

SEQ ID NO: 655808 - RNA, 22 nt, Human
cagaauguauucucauaaagcc

SEQ ID NO: 655809 - RNA, 22 nt, Human
ggugcauguagccaucaagaua

SEQ ID NO: 655810 - RNA, 22 nt, Human
auaaaggcuggcugcugugagc

SEQ ID NO: 655811 - RNA, 22 nt, Human
caucaucucuggcccuugaagu

SEQ ID NO: 655812 - RNA, 22 nt, Human
cggaggcaaacucaccuggcuc

SEQ ID NO: 655813 - RNA, 22 nt, Human
aaacuagauuaccacugcuaga

SEQ ID NO: 655814 - RNA, 22 nt, Human
cagaccagaaggaagccgacaa

SEQ ID NO: 655815 - RNA, 22 nt, Human
cuggcugugcagucuuccagaa

SEQ ID NO: 655816 - RNA, 22 nt, Human
uaaggcacccauguucauacag

SEQ ID NO: 655817 - RNA, 22 nt, Human
cccaggaucaccuggucaaggg

SEQ ID NO: 655818 - RNA, 22 nt, Human
uaucuguuugcucacagguguu

SEQ ID NO: 655819 - RNA, 22 nt, Human
gaggcuccgugcugcugcccug

SEQ ID NO: 655820 - RNA, 22 nt, Human
aaugcuauucauuaagccuacu

SEQ ID NO: 655821 - RNA, 22 nt, Human
ugagaggcagaauggugccugc

SEQ ID NO: 655822 - RNA, 22 nt, Human
ccucuggcauagcaaguggccu

SEQ ID NO: 655823 - RNA, 22 nt, Human
uccaggcuggaaaugucaaacu

SEQ ID NO: 655824 - RNA, 22 nt, Human
uauucaguggaaaauguguuga

SEQ ID NO: 655825 - RNA, 22 nt, Human
gggacaugaggccauagugauu

SEQ ID NO: 655826 - RNA, 22 nt, Human
uuuguuuagaaagagauuggug

SEQ ID NO: 655827 - RNA, 22 nt, Human
uaauuuuacuuccugagcaccu

SEQ ID NO: 655828 - RNA, 22 nt, Human
caugucuggguauaugcauaug

SEQ ID NO: 655829 - RNA, 22 nt, Human
uucacacuguuuuucauagugg

SEQ ID NO: 655830 - RNA, 22 nt, Human
uggcugcguuuuccgauguauu

SEQ ID NO: 655831 - RNA, 22 nt, Human
aggcucugaucagguggcugug

SEQ ID NO: 655832 - RNA, 22 nt, Human
ucuguucuugcuuuucuccaac

SEQ ID NO: 655833 - RNA, 19 nt, Human
ucugggcagggccagcacc

SEQ ID NO: 655834 - RNA, 22 nt, Human
gcaugaugaaggaggaggaguc

SEQ ID NO: 655835 - RNA, 22 nt, Human
aguaaacaguaucuuuaguguc

SEQ ID NO: 655836 - RNA, 18 nt, Human
guuuacacauucuagaaa

SEQ ID NO: 655837 - RNA, 21 nt, Human
uacaucaguuuucuuggcuca

SEQ ID NO: 655838 - RNA, 22 nt, Human
ccagcccaaacaagccgccuuc

SEQ ID NO: 655839 - RNA, 22 nt, Human
gcugagucagauugcagucuug

SEQ ID NO: 655840 - RNA, 22 nt, Human
cuggcaggaucuaaccagggaa

SEQ ID NO: 655841 - RNA, 22 nt, Human
ggcagguggaaguuggcagagc

SEQ ID NO: 655842 - RNA, 22 nt, Human
cucccuggcuuuguccugaggc

SEQ ID NO: 655843 - RNA, 22 nt, Human
cuaggaggcgggggcugcagua

SEQ ID NO: 655844 - RNA, 22 nt, Human
cuacaguagaguaggccucuga

SEQ ID NO: 655845 - RNA, 22 nt, Human
auaguuaugcucuagacaagaa

SEQ ID NO: 655846 - RNA, 23 nt, Human
uugcaaaaugcaauugaguuaga

SEQ ID NO: 655847 - RNA, 22 nt, Human
uauuugcaggacauagauaugg

SEQ ID NO: 655848 - RNA, 22 nt, Human
acagcauucccuuuggcugcuu

SEQ ID NO: 655849 - RNA, 22 nt, Human
uuauuccaccuccauuuuccua

SEQ ID NO: 655850 - RNA, 22 nt, Human
ggaaagcuuuguacuugaaaac

SEQ ID NO: 655851 - RNA, 22 nt, Human
uccaggcacgaggcccugugca

SEQ ID NO: 655852 - RNA, 18 nt, Human
aaaggcauauauagaagu

SEQ ID NO: 655853 - RNA, 18 nt, Human
uggauugaauugagaggu

SEQ ID NO: 655854 - RNA, 22 nt, Human
agaaacaucauuguuugguauu

SEQ ID NO: 655855 - RNA, 22 nt, Human
uagggggcuguccugugcauua

SEQ ID NO: 655856 - RNA, 22 nt, Human
augcugugucuagcaggaacac

SEQ ID NO: 655857 - RNA, 22 nt, Human
uaggagugcauaaaacuauauu

SEQ ID NO: 655858 - RNA, 22 nt, Human
uuucagcacuuuaggcagcagg

SEQ ID NO: 655859 - RNA, 21 nt, Human
cagagagcuagaacuucauga

SEQ ID NO: 655860 - RNA, 22 nt, Human
uuccccaggcuggagugcagug

SEQ ID NO: 655861 - RNA, 22 nt, Human
acacagaugcauuacacaucua

SEQ ID NO: 655862 - RNA, 22 nt, Human
caugagauuugggaggggccag

SEQ ID NO: 655863 - RNA, 22 nt, Human
gcuuggcuuugucuuguucacu

SEQ ID NO: 655864 - RNA, 22 nt, Human
uuuucagugggcaaugauguga

SEQ ID NO: 655865 - RNA, 22 nt, Human
uccagagggcgauggcuggggg

SEQ ID NO: 655866 - RNA, 22 nt, Human
uguugggaagcucugccagggg

SEQ ID NO: 655867 - RNA, 22 nt, Human
gccuucccucucauccugcugg

SEQ ID NO: 655868 - RNA, 22 nt, Human
auguccuuccauuuugaucugu

SEQ ID NO: 655869 - RNA, 22 nt, Human
uccugagagcagaguccaggug

SEQ ID NO: 655870 - RNA, 22 nt, Human
augggcugugggacccuggacc

SEQ ID NO: 655871 - RNA, 22 nt, Human
agcagccagaaagggcagucga

SEQ ID NO: 655872 - RNA, 22 nt, Human
auauuuauaagcaagcaggacu

SEQ ID NO: 655873 - RNA, 19 nt, Human
ccuguacauuauucucccc

SEQ ID NO: 655874 - RNA, 22 nt, Human
gccuuugcaccaucagugcaau

SEQ ID NO: 655875 - RNA, 22 nt, Human
uaguaaacaggcaagggaccac

SEQ ID NO: 655876 - RNA, 22 nt, Human
ggucucagacuggcaggcagug

SEQ ID NO: 655877 - RNA, 22 nt, Human
guggcagcagaggggugguaug

SEQ ID NO: 655878 - RNA, 20 nt, Human
agaaucugacccagagagac

SEQ ID NO: 655879 - RNA, 21 nt, Human
aggcacuguuugugguuuggg

SEQ ID NO: 655880 - RNA, 22 nt, Human
guacagaaugcuugguaaggca

SEQ ID NO: 655881 - RNA, 22 nt, Human
gcugggcaacgggcagaaagau

SEQ ID NO: 655882 - RNA, 22 nt, Human
uucaugcacuauuucuucuagc

SEQ ID NO: 655883 - RNA, 22 nt, Human
agguccugacgcccuuugaaau

SEQ ID NO: 655884 - RNA, 22 nt, Human
aguaauaaacucuuuuuaucuc

SEQ ID NO: 655885 - RNA, 22 nt, Human
ccagcacucugucccagcuucc

SEQ ID NO: 655886 - RNA, 22 nt, Human
caggucuccagcucagggucca

SEQ ID NO: 655887 - RNA, 23 nt, Human
gcauugucuccccacuucugggc

SEQ ID NO: 655888 - RNA, 22 nt, Human
uagcaucuguuucucuuuguga

SEQ ID NO: 655889 - RNA, 22 nt, Human
ugcagagauugaacaagaagga

SEQ ID NO: 655890 - RNA, 22 nt, Human
aggguguguucuccuaugagaa

SEQ ID NO: 655891 - RNA, 22 nt, Human
uuacaaggaggauagcauuucc

SEQ ID NO: 655892 - RNA, 22 nt, Human
ggaggcggggaaggcaucccau

SEQ ID NO: 655893 - RNA, 22 nt, Human
ugucaaauaguagaaagauggc

SEQ ID NO: 655894 - RNA, 22 nt, Human
cagagugaaauaggggaucaag

SEQ ID NO: 655895 - RNA, 20 nt, Human
agccccacccuuguccuggc

SEQ ID NO: 655896 - RNA, 22 nt, Human
ggucaguguacacaugugcagg

SEQ ID NO: 655897 - RNA, 22 nt, Human
acaaaugacuauuugguacagg

SEQ ID NO: 655898 - RNA, 22 nt, Human
uaacuucucugcuaucauagga

SEQ ID NO: 655899 - RNA, 21 nt, Human
ccagcccagccuccuucucuu

SEQ ID NO: 655900 - RNA, 22 nt, Human
gcaguguuuuucaaugcuucca

SEQ ID NO: 655901 - RNA, 22 nt, Human
ggcugccugaacuuuggggaaa

SEQ ID NO: 655902 - RNA, 23 nt, Human
auaaauuacuaucucccuagagc

SEQ ID NO: 655903 - RNA, 22 nt, Human
ugcauugguaaaauacauacac

SEQ ID NO: 655904 - RNA, 22 nt, Human
aagaaucuaugguacauccaag

SEQ ID NO: 655905 - RNA, 22 nt, Human
agguaggguuaauggagauaua

SEQ ID NO: 655906 - RNA, 22 nt, Human
ccagcagagcuggaagugugcu

SEQ ID NO: 655907 - RNA, 22 nt, Human
ucugcauuuggaucuugagcug

SEQ ID NO: 655908 - RNA, 22 nt, Human
cuaggcccaugagguuugcugg

SEQ ID NO: 655909 - RNA, 22 nt, Human
acaguguggggugagauggaac

SEQ ID NO: 655910 - RNA, 22 nt, Human
gucuuuauuugagauugucauu

SEQ ID NO: 655911 - RNA, 18 nt, Human
auccucuagcuucucaga

SEQ ID NO: 655912 - RNA, 22 nt, Human
guggcacaggguuguuggucau

SEQ ID NO: 655913 - RNA, 22 nt, Human
aggcuggucuguuggcauuuuu

SEQ ID NO: 655914 - RNA, 22 nt, Human
aaauguuuugcucccauguggu

SEQ ID NO: 655915 - RNA, 22 nt, Human
guuuccacuugagaggacuccu

SEQ ID NO: 655916 - RNA, 22 nt, Human
aguggcaucccuuuaacagggu

SEQ ID NO: 655917 - RNA, 21 nt, Human
agggucaggaaccaggguacc

SEQ ID NO: 655918 - RNA, 22 nt, Human
caaacugaacacgaaagucuuu

SEQ ID NO: 655919 - RNA, 22 nt, Human
ccagccacagcuuccagcuccu

SEQ ID NO: 655920 - RNA, 22 nt, Human
ucgagucauguucucccauuaa

SEQ ID NO: 655921 - RNA, 21 nt, Human
agcagcagcaguggggcuucu

SEQ ID NO: 655922 - RNA, 22 nt, Human
uucauucagugagacuaggacg

SEQ ID NO: 655923 - RNA, 22 nt, Human
cuuugcuucuccaaccugcuca

SEQ ID NO: 655924 - RNA, 22 nt, Human
uauuucaccucacccaggagaa

SEQ ID NO: 655925 - RNA, 22 nt, Human
uuguaagucacaccagggcagg

SEQ ID NO: 655926 - RNA, 22 nt, Human
uccagguccagagguucaacug

SEQ ID NO: 655927 - RNA, 22 nt, Human
agcuuaaacucuuugaaguuau

SEQ ID NO: 655928 - RNA, 22 nt, Human
uuucauugacaguugggggaaa

SEQ ID NO: 655929 - RNA, 22 nt, Human
ccaggagcagaguagguguuca

SEQ ID NO: 655930 - RNA, 22 nt, Human
agucaguggauuuaccaugcgu

SEQ ID NO: 655931 - RNA, 22 nt, Human
cagcaggguuaagugacucacc

SEQ ID NO: 655932 - RNA, 22 nt, Human
acaauagguguccaauuaacaa

SEQ ID NO: 655933 - RNA, 22 nt, Human
aaugcuaaaauggcacuaaagu

SEQ ID NO: 655934 - RNA, 22 nt, Human
ggagcccugaagcaagaaagua

SEQ ID NO: 655935 - RNA, 22 nt, Human
ucagcucuuccccccagccagg

SEQ ID NO: 655936 - RNA, 19 nt, Human
gcagccaggugcucuaccu

SEQ ID NO: 655937 - RNA, 18 nt, Human
gagggaguagcugagguu

SEQ ID NO: 655938 - RNA, 22 nt, Human
cauguuaacuaagauuaacuau

SEQ ID NO: 655939 - RNA, 22 nt, Human
gcccagcacauugcugaggacc

SEQ ID NO: 655940 - RNA, 22 nt, Human
uacauucugaaauaaaugguuu

SEQ ID NO: 655941 - RNA, 22 nt, Human
guuucccaggcuguggggcccu

SEQ ID NO: 655942 - RNA, 22 nt, Human
ucagggauugcaaaauucaucc

SEQ ID NO: 655943 - RNA, 22 nt, Human
gagacaggauuuaaccaaagcu

SEQ ID NO: 655944 - RNA, 22 nt, Human
uuuccacagcuguauaaaauaa

SEQ ID NO: 655945 - RNA, 22 nt, Human
cucucuggaagggggagcugau

SEQ ID NO: 655946 - RNA, 22 nt, Human
acuguucugccaagaucaacgu

SEQ ID NO: 655947 - RNA, 22 nt, Human
uggcaaaguaauuggguuucuc

SEQ ID NO: 655948 - RNA, 22 nt, Human
uaaguuuuaagcaaucugauaa

SEQ ID NO: 655949 - RNA, 22 nt, Human
aacuagaaaacaagaugcugau

SEQ ID NO: 655950 - RNA, 22 nt, Human
guccccucagccacccaugggg

SEQ ID NO: 655951 - RNA, 22 nt, Human
uuccugaaaauacagggagacc

SEQ ID NO: 655952 - RNA, 22 nt, Human
cagcuuggcgaauguagguaug

SEQ ID NO: 655953 - RNA, 21 nt, Human
ucucaucuccugaccugugcc

SEQ ID NO: 655954 - RNA, 19 nt, Human
uccagaacugcccuggccu

SEQ ID NO: 655955 - RNA, 22 nt, Human
acagaacuucaguaguauuccc

SEQ ID NO: 655956 - RNA, 22 nt, Human
cacagcuggggaagcugaggcc

SEQ ID NO: 655957 - RNA, 22 nt, Human
uugcaaggucaucaugcauugg

SEQ ID NO: 655958 - RNA, 20 nt, Human
acuuuacagagaagacugac

SEQ ID NO: 655959 - RNA, 22 nt, Human
uucuuuaccagugaaauguuau

SEQ ID NO: 655960 - RNA, 22 nt, Human
ucuggguucuugaugcuaccuu

SEQ ID NO: 655961 - RNA, 22 nt, Human
ucuggagagucacagugccaga

SEQ ID NO: 655962 - RNA, 22 nt, Human
cuacauucugggaaaucagaug

SEQ ID NO: 655963 - RNA, 22 nt, Human
uaugaagugaguuaugguugcu

SEQ ID NO: 655964 - RNA, 22 nt, Human
ugcuagugcaggguuuucaguu

SEQ ID NO: 655965 - RNA, 22 nt, Human
ccugaacagucugaaaggagac

SEQ ID NO: 655966 - RNA, 22 nt, Human
gccagagcagaauagaguggcc

SEQ ID NO: 655967 - RNA, 22 nt, Human
uccugaggacuaacaggaagga

SEQ ID NO: 655968 - RNA, 22 nt, Human
aaggcagcucagcucauggcag

SEQ ID NO: 655969 - RNA, 22 nt, Human
uggcuucuugaucuuggacuug

SEQ ID NO: 655970 - RNA, 22 nt, Human
aacaauaggagugaugcaguau

SEQ ID NO: 655971 - RNA, 22 nt, Human
agucugaaguagucuuuagugu

SEQ ID NO: 655972 - RNA, 19 nt, Human
uggaagaggaagggaaaua

SEQ ID NO: 655973 - RNA, 22 nt, Human
ucugggagggagccucagaauc

SEQ ID NO: 655974 - RNA, 22 nt, Human
cagguggcuuauuagggucagu

SEQ ID NO: 655975 - RNA, 22 nt, Human
ucaaagauagauguugagaaau

SEQ ID NO: 655976 - RNA, 22 nt, Human
agaaguuugaaauuaggagaaa

SEQ ID NO: 655977 - RNA, 22 nt, Human
caaaagcaguucuaucugaguu

SEQ ID NO: 655978 - RNA, 22 nt, Human
ccugugggucacaugggugacu

SEQ ID NO: 655979 - RNA, 22 nt, Human
ucccagagcucuggagguugga

SEQ ID NO: 655980 - RNA, 22 nt, Human
uacaguucacaguaucauaaau

SEQ ID NO: 655981 - RNA, 22 nt, Human
aucaucugccucaucacugcau

SEQ ID NO: 655982 - RNA, 22 nt, Human
aaagccaggggagggauuccca

SEQ ID NO: 655983 - RNA, 22 nt, Human
uuugacagauccuuaacucagc

SEQ ID NO: 655984 - RNA, 22 nt, Human
ccaggugccuccagucacagug

SEQ ID NO: 655985 - RNA, 22 nt, Human
uggaacacaucuaaggaagcag

SEQ ID NO: 655986 - RNA, 22 nt, Human
uucucugcauuguaaagagcca

SEQ ID NO: 655987 - RNA, 22 nt, Human
aaagugcugugggcuguaagug

SEQ ID NO: 655988 - RNA, 19 nt, Human
gguuugaagaaaaucuugc

SEQ ID NO: 655989 - RNA, 22 nt, Human
ggccucucaugcccagagccaa

SEQ ID NO: 655990 - RNA, 22 nt, Human
ccugauuauuguaaauauauuu

SEQ ID NO: 655991 - RNA, 22 nt, Human
ucagaagcauguggggagccug

SEQ ID NO: 655992 - RNA, 22 nt, Human
aaaggcaugcauggucugcucc

SEQ ID NO: 655993 - RNA, 22 nt, Human
gggcacugaguggaugaugcag

SEQ ID NO: 655994 - RNA, 22 nt, Human
caugaucagaaagagaagcuag

SEQ ID NO: 655995 - RNA, 23 nt, Human
aagguguuuguuuucagaaagca

SEQ ID NO: 655996 - RNA, 19 nt, Human
uggaggcaagacauggagg

SEQ ID NO: 655997 - RNA, 22 nt, Human
augauauagagaguagauuaaa

SEQ ID NO: 655998 - RNA, 22 nt, Human
aaaugcagauugucauucagga

SEQ ID NO: 655999 - RNA, 19 nt, Human
aauuagggagucgguuaag

SEQ ID NO: 656000 - RNA, 22 nt, Human
acaauuacucaacuuugcugcu

SEQ ID NO: 656001 - RNA, 22 nt, Human
agugggagggccauauggugaa

SEQ ID NO: 656002 - RNA, 23 nt, Human
auuacaguuaauuacaacaucuu

SEQ ID NO: 656003 - RNA, 22 nt, Human
aggaauaugagcugcugcagug

SEQ ID NO: 656004 - RNA, 22 nt, Human
gccugagcuacuagggagucug

SEQ ID NO: 656005 - RNA, 22 nt, Human
cugccucagcguuguggcccua

SEQ ID NO: 656006 - RNA, 22 nt, Human
agggcuccgggcaggcgaugga

SEQ ID NO: 656007 - RNA, 22 nt, Human
acaggaggagcuguuucaggga

SEQ ID NO: 656008 - RNA, 22 nt, Human
gcucucagcccacugaggggaa

SEQ ID NO: 656009 - RNA, 22 nt, Human
uauaacaggaaguauucaaaca

SEQ ID NO: 656010 - RNA, 22 nt, Human
ucaaagguuaacucuguuguuc

SEQ ID NO: 656011 - RNA, 22 nt, Human
acugggccagacacugauuccc

SEQ ID NO: 656012 - RNA, 22 nt, Human
gggcuugguggagagaaugcug

SEQ ID NO: 656013 - RNA, 22 nt, Human
gggcucuggggucagacagccu

SEQ ID NO: 656014 - RNA, 22 nt, Human
gacaguggagggcugauguuaa

SEQ ID NO: 656015 - RNA, 22 nt, Human
agccaggccagcugucuugagu

SEQ ID NO: 656016 - RNA, 22 nt, Human
cacuucaaauaagcucuucuca

SEQ ID NO: 656017 - RNA, 22 nt, Human
ugcuccuuccucauccugugca

SEQ ID NO: 656018 - RNA, 22 nt, Human
gaccacugaugacaugaggaga

SEQ ID NO: 656019 - RNA, 19 nt, Human
ugagggugagcuuuggaga

SEQ ID NO: 656020 - RNA, 22 nt, Human
aaucauucuuauuucacagcaa

SEQ ID NO: 656021 - RNA, 22 nt, Human
gauuucuucauucauuagaugg

SEQ ID NO: 656022 - RNA, 22 nt, Human
ucaauagcaaucaagccuucca

SEQ ID NO: 656023 - RNA, 22 nt, Human
gagcagggcuuguccuccucau

SEQ ID NO: 656024 - RNA, 22 nt, Human
ugcugaaggcaggggagguggc

SEQ ID NO: 656025 - RNA, 22 nt, Human
gccaggaaauucaugccagauc

SEQ ID NO: 656026 - RNA, 22 nt, Human
uucuccucuguuaccuugcaaa

SEQ ID NO: 656027 - RNA, 22 nt, Human
gugugcagggaugagugcaggu

SEQ ID NO: 656028 - RNA, 20 nt, Human
uuacaaguuucuaauaacca

SEQ ID NO: 656029 - RNA, 22 nt, Human
uucccucucacuuaaagcuugg

SEQ ID NO: 656030 - RNA, 21 nt, Human
acacugugucauaaugcuuaa

SEQ ID NO: 656031 - RNA, 19 nt, Human
acauauguggauauacaug

SEQ ID NO: 656032 - RNA, 18 nt, Human
cagggccccagaauuauc

SEQ ID NO: 656033 - RNA, 22 nt, Human
aagccuaaaugaugcuauuaug

SEQ ID NO: 656034 - RNA, 22 nt, Human
gaaugcagauggcugguguaug

SEQ ID NO: 656035 - RNA, 19 nt, Human
agcuuccauauucucuagu

SEQ ID NO: 656036 - RNA, 22 nt, Human
uuccugggaggcuguguacuug

SEQ ID NO: 656037 - RNA, 22 nt, Human
guagccauuggcaaugaagccu

SEQ ID NO: 656038 - RNA, 22 nt, Human
ugcuccaugcgcucggccggcg

SEQ ID NO: 656039 - RNA, 22 nt, Human
agcccagaggcugggcgugcau

SEQ ID NO: 656040 - RNA, 22 nt, Human
gauggggaugagaagugagcag

SEQ ID NO: 656041 - RNA, 20 nt, Human
gucagugucuucaguaguga

SEQ ID NO: 656042 - RNA, 22 nt, Human
ugagccaggcccagugggguca

SEQ ID NO: 656043 - RNA, 22 nt, Human
gcacuugauaaauguuaacuga

SEQ ID NO: 656044 - RNA, 22 nt, Human
guccccagcugugacgagagcc

SEQ ID NO: 656045 - RNA, 22 nt, Human
auugucagugggauuugucaac

SEQ ID NO: 656046 - RNA, 22 nt, Human
aaagguuuuucagcagggagau

SEQ ID NO: 656047 - RNA, 17 nt, Human
uggcaagaauggaaaug

SEQ ID NO: 656048 - RNA, 22 nt, Human
gggcugaggcuaccacuggucu

SEQ ID NO: 656049 - RNA, 22 nt, Human
auuuucucucaaaccuuaaaau

SEQ ID NO: 656050 - RNA, 22 nt, Human
augaagauaagaccaggcugga

SEQ ID NO: 656051 - RNA, 22 nt, Human
ugccccucagggaacggguauc

SEQ ID NO: 656052 - RNA, 22 nt, Human
acaaugaacgcuuuuuaacugu

SEQ ID NO: 656053 - RNA, 22 nt, Human
cacaugcauaaggauaauuacu

SEQ ID NO: 656054 - RNA, 22 nt, Human
agcugaggguucgguguccaca

SEQ ID NO: 656055 - RNA, 22 nt, Human
gagguccucucggaaccccuuu

SEQ ID NO: 656056 - RNA, 22 nt, Human
ggggaagaauggcagaaaacau

SEQ ID NO: 656057 - RNA, 22 nt, Human
ugcugcccguaccugugcacuu

SEQ ID NO: 656058 - RNA, 22 nt, Human
ucauaaagcucuuccaaaugua

SEQ ID NO: 656059 - RNA, 22 nt, Human
cuuuggcaugguccucacuaua

SEQ ID NO: 656060 - RNA, 22 nt, Human
ucagggcaaagggcagaguuug

SEQ ID NO: 656061 - RNA, 22 nt, Human
ucuggcuuggguagguaguuca

SEQ ID NO: 656062 - RNA, 22 nt, Human
ugagggaauauugauagauccg

SEQ ID NO: 656063 - RNA, 22 nt, Human
cuuguuuucuucugcagucuau

SEQ ID NO: 656064 - RNA, 22 nt, Human
auuuauuaugggauuuggcuca

SEQ ID NO: 656065 - RNA, 22 nt, Human
cuccacucaacaagcccagugu

SEQ ID NO: 656066 - RNA, 22 nt, Human
ucucagaauccuugcccaggug

SEQ ID NO: 656067 - RNA, 21 nt, Human
ucuuauacagcaauagaucug

SEQ ID NO: 656068 - RNA, 22 nt, Human
cugaagacugcugagaaguuac

SEQ ID NO: 656069 - RNA, 22 nt, Human
gaacucuagguaaaugagauau

SEQ ID NO: 656070 - RNA, 22 nt, Human
ugcugggcggugggcucauccc

SEQ ID NO: 656071 - RNA, 22 nt, Human
caggaggaagaacucugcaaca

SEQ ID NO: 656072 - RNA, 22 nt, Human
guguguauguagaacuauguau

SEQ ID NO: 656073 - RNA, 22 nt, Human
ugcgcgcuggcgucacuuagca

SEQ ID NO: 656074 - RNA, 22 nt, Human
gucacaaauccccucagcaacu

SEQ ID NO: 656075 - RNA, 22 nt, Human
acauggaagauaaaaauacuca

SEQ ID NO: 656076 - RNA, 20 nt, Human
aauuauauaacuccaacauu

SEQ ID NO: 656077 - RNA, 22 nt, Human
aggaggugagcggucauguggu

SEQ ID NO: 656078 - RNA, 22 nt, Human
auauauauugcccaggcugguu

SEQ ID NO: 656079 - RNA, 21 nt, Human
agccagauccauuuugcaugg

SEQ ID NO: 656080 - RNA, 23 nt, Human
acauuucauauaaaagggaucag

SEQ ID NO: 656081 - RNA, 22 nt, Human
gcaguguuuacauauuagaaac

SEQ ID NO: 656082 - RNA, 22 nt, Human
agguggcugguccaggcugcag

SEQ ID NO: 656083 - RNA, 22 nt, Human
ucucucagucagaugcuaaaga

SEQ ID NO: 656084 - RNA, 22 nt, Human
aaggggugcaaguuaaucagca

SEQ ID NO: 656085 - RNA, 22 nt, Human
uggagcaggccggaaguggcuu

SEQ ID NO: 656086 - RNA, 22 nt, Human
uucaauacaaagaaaggaauuu

SEQ ID NO: 656087 - RNA, 19 nt, Human
ugcucucuggugcuucaug

SEQ ID NO: 656088 - RNA, 22 nt, Human
agcucuggaauaaugaugugau

SEQ ID NO: 656089 - RNA, 22 nt, Human
ucucuggguaugguaacguugg

SEQ ID NO: 656090 - RNA, 22 nt, Human
acauuugugcacaugugcaugg

SEQ ID NO: 656091 - RNA, 22 nt, Human
gggguacuggcuggagccccac

SEQ ID NO: 656092 - RNA, 22 nt, Human
agagccuggcaaaagguccugc

SEQ ID NO: 656093 - RNA, 22 nt, Human
caagaucaaucaauacuccuua

SEQ ID NO: 656094 - RNA, 22 nt, Human
uucacaagucuggaauaugcua

SEQ ID NO: 656095 - RNA, 22 nt, Human
ggcaggugcccagagagcacga

SEQ ID NO: 656096 - RNA, 22 nt, Human
ucuaggagcaugaagggaaggc

SEQ ID NO: 656097 - RNA, 23 nt, Human
aacgacagcuacaggcaucccac

SEQ ID NO: 656098 - RNA, 22 nt, Human
auaauaaugaaagccacugugu

SEQ ID NO: 656099 - RNA, 22 nt, Human
uggccagacagagaggcuuugu

SEQ ID NO: 656100 - RNA, 21 nt, Human
agauucaggacagcagucacu

SEQ ID NO: 656101 - RNA, 21 nt, Human
uaucuacuggugucuuucaga

SEQ ID NO: 656102 - RNA, 19 nt, Human
gggcucuggccucaguggg

SEQ ID NO: 656103 - RNA, 22 nt, Human
ucaggcugguggucagauggcu

SEQ ID NO: 656104 - RNA, 22 nt, Human
ucugugccagcagccuccugga

SEQ ID NO: 656105 - RNA, 22 nt, Human
acagcuacucugcagauaaauc

SEQ ID NO: 656106 - RNA, 22 nt, Human
uuuaauauucugcauucuccuu

SEQ ID NO: 656107 - RNA, 22 nt, Human
agccaacuccagccccugcagc

SEQ ID NO: 656108 - RNA, 22 nt, Human
acugucaugaucgaagauguca

SEQ ID NO: 656109 - RNA, 22 nt, Human
cccucacucugccuccuggggu

SEQ ID NO: 656110 - RNA, 22 nt, Human
uuucaaauagaaucuuuccaaa

SEQ ID NO: 656111 - RNA, 22 nt, Human
acauguaaaaggaacaugcaug

SEQ ID NO: 656112 - RNA, 22 nt, Human
gucccucaguagugcacagugg

SEQ ID NO: 656113 - RNA, 22 nt, Human
aaagaucaauagauaaagcuac

SEQ ID NO: 656114 - RNA, 22 nt, Human
ugauucacagacuucacaaggc

SEQ ID NO: 656115 - RNA, 22 nt, Human
ccagaaagauaggaaaucaagu

SEQ ID NO: 656116 - RNA, 22 nt, Human
agcugcuuccucuuugauguca

SEQ ID NO: 656117 - RNA, 22 nt, Human
aaaauugguuccuuucugaggc

SEQ ID NO: 656118 - RNA, 22 nt, Human
aguuuaacuuuggaaaacuaua

SEQ ID NO: 656119 - RNA, 22 nt, Human
acaauaaggauuuuuaggggca

SEQ ID NO: 656120 - RNA, 22 nt, Human
gaaggcaucucuggacuuauuu

SEQ ID NO: 656121 - RNA, 23 nt, Human
guccuauuuuuugaaauacugag

SEQ ID NO: 656122 - RNA, 22 nt, Human
ucuccacuauuuucuagcucuu

SEQ ID NO: 656123 - RNA, 19 nt, Human
ucccaagauuucuguauca

SEQ ID NO: 656124 - RNA, 22 nt, Human
uucagugcagacgccgaagccc

SEQ ID NO: 656125 - RNA, 22 nt, Human
uauggcuucuuguguuacugug

SEQ ID NO: 656126 - RNA, 22 nt, Human
aaagaucugacuuagacacaga

SEQ ID NO: 656127 - RNA, 22 nt, Human
ggcacuagugacaaggggacau

SEQ ID NO: 656128 - RNA, 22 nt, Human
agccacugguaaacugguagga

SEQ ID NO: 656129 - RNA, 22 nt, Human
ccagcagaguugguuucuggua

SEQ ID NO: 656130 - RNA, 22 nt, Human
uguuuguaucucucucuguggc

SEQ ID NO: 656131 - RNA, 20 nt, Human
caguaucugaagccacacaa

SEQ ID NO: 656132 - RNA, 22 nt, Human
aaggcccuggccccagcuucuu

SEQ ID NO: 656133 - RNA, 22 nt, Human
ugcucugggcucaauggcagcu

SEQ ID NO: 656134 - RNA, 22 nt, Human
aagaccagaggauauaaccaga

SEQ ID NO: 656135 - RNA, 22 nt, Human
auuuaaugucgagcuauuguag

SEQ ID NO: 656136 - RNA, 22 nt, Human
gcuggcuuugucaagggcagca

SEQ ID NO: 656137 - RNA, 22 nt, Human
acugucucucuagcaguucagg

SEQ ID NO: 656138 - RNA, 22 nt, Human
ggcucaguguuuguggaacaua

SEQ ID NO: 656139 - RNA, 22 nt, Human
ugcagugugauuuucuggcuga

SEQ ID NO: 656140 - RNA, 22 nt, Human
caggggcucuaaugcaugauca

SEQ ID NO: 656141 - RNA, 22 nt, Human
guuucuccucugugucuuguuu

SEQ ID NO: 656142 - RNA, 22 nt, Human
aaguccaaggucaccauucaca

SEQ ID NO: 656143 - RNA, 22 nt, Human
aacaggcuuccaggagggacga

SEQ ID NO: 656144 - RNA, 22 nt, Human
agcaggagaacacuguggcucu

SEQ ID NO: 656145 - RNA, 19 nt, Human
aaggcuggagaaggccucu

SEQ ID NO: 656146 - RNA, 22 nt, Human
ugauugaagcuagaacaaccau

SEQ ID NO: 656147 - RNA, 22 nt, Human
ucccagagugugggcaucaagg

SEQ ID NO: 656148 - RNA, 22 nt, Human
gagcagcagcugggccagguuc

SEQ ID NO: 656149 - RNA, 22 nt, Human
uucaacagcuuccaaagugugu

SEQ ID NO: 656150 - RNA, 22 nt, Human
acauucuuggacuccacucuag

SEQ ID NO: 656151 - RNA, 22 nt, Human
gauucugagcugguguuuuacg

SEQ ID NO: 656152 - RNA, 22 nt, Human
guccuggaguggcauggcaugg

SEQ ID NO: 656153 - RNA, 22 nt, Human
uuguaacagcuguuuauauagu

SEQ ID NO: 656154 - RNA, 22 nt, Human
gcugccagaagaggagggguua

SEQ ID NO: 656155 - RNA, 22 nt, Human
ggguccagaguugaagagguua

SEQ ID NO: 656156 - RNA, 22 nt, Human
cugcagauuuggugucugguga

SEQ ID NO: 656157 - RNA, 22 nt, Human
gaggacacggccuuuuggaaaa

SEQ ID NO: 656158 - RNA, 21 nt, Human
cagcuuugucugucuucgggg

SEQ ID NO: 656159 - RNA, 22 nt, Human
cugagagccuccuguuggcuag

SEQ ID NO: 656160 - RNA, 22 nt, Human
acagagcaucagaugaaaucaa

SEQ ID NO: 656161 - RNA, 22 nt, Human
acccaggcuggagugcaguguc

SEQ ID NO: 656162 - RNA, 22 nt, Human
agccuucagcaguucaggugcc

SEQ ID NO: 656163 - RNA, 22 nt, Human
ugagaccuguagcuucacagag

SEQ ID NO: 656164 - RNA, 22 nt, Human
gugggccagcauuuugaagagu

SEQ ID NO: 656165 - RNA, 22 nt, Human
gguguuaacaaagauugaaaug

SEQ ID NO: 656166 - RNA, 22 nt, Human
ugucucugggugauucaguccu

SEQ ID NO: 656167 - RNA, 22 nt, Human
ugcauauaucuuauuuuucugu

SEQ ID NO: 656168 - RNA, 22 nt, Human
ggaaaagacagaauucuagaau

SEQ ID NO: 656169 - RNA, 22 nt, Human
gguggccugaauuagcucaggg

SEQ ID NO: 656170 - RNA, 22 nt, Human
aagagaugauggcagccagagg

SEQ ID NO: 656171 - RNA, 22 nt, Human
ucacugcuuaacucaagaucuc

SEQ ID NO: 656172 - RNA, 22 nt, Human
ggcucauguaugaaagggugug

SEQ ID NO: 656173 - RNA, 22 nt, Human
cagcacuucaaugagcauuuca

SEQ ID NO: 656174 - RNA, 22 nt, Human
aggaauuuaagggcucagagag

SEQ ID NO: 656175 - RNA, 22 nt, Human
ccacacagauaaguguuuucua

SEQ ID NO: 656176 - RNA, 22 nt, Human
ugaaggcauugaugaaggaauc

SEQ ID NO: 656177 - RNA, 22 nt, Human
gcccccagaagggccacagauu

SEQ ID NO: 656178 - RNA, 22 nt, Human
agugccauggaggaacagaugc

SEQ ID NO: 656179 - RNA, 22 nt, Human
caaaguauauuucauagucuca

SEQ ID NO: 656180 - RNA, 22 nt, Human
ccaggaccacacgacaggagag

SEQ ID NO: 656181 - RNA, 22 nt, Human
caggugggcuugggagaacacu

SEQ ID NO: 656182 - RNA, 22 nt, Human
cggggagggcagaggcucccuc

SEQ ID NO: 656183 - RNA, 22 nt, Human
ccagggaggguccuguggcuuc

SEQ ID NO: 656184 - RNA, 22 nt, Human
gaaggagcuaccaagacugaau

SEQ ID NO: 656185 - RNA, 22 nt, Human
uggcccugccgcacuauccuca

SEQ ID NO: 656186 - RNA, 22 nt, Human
ggaaaauuuccuucaaaaugug

SEQ ID NO: 656187 - RNA, 22 nt, Human
cugugccaccugagggacucua

SEQ ID NO: 656188 - RNA, 21 nt, Human
uaauaauuccacuacagagua

SEQ ID NO: 656189 - RNA, 22 nt, Human
ucauugcaguagggagagaccc

SEQ ID NO: 656190 - RNA, 22 nt, Human
ggagaggcuuccagagucgugc

SEQ ID NO: 656191 - RNA, 18 nt, Human
ucugucuguacaaguauc

SEQ ID NO: 656192 - RNA, 22 nt, Human
ucauuucaguggcacagaagau

SEQ ID NO: 656193 - RNA, 22 nt, Human
uaccaagguaguggagacagaa

SEQ ID NO: 656194 - RNA, 22 nt, Human
ucacccagguccaggcucuggc

SEQ ID NO: 656195 - RNA, 22 nt, Human
cuucccccaaaucaagagaccu

SEQ ID NO: 656196 - RNA, 19 nt, Human
uaaggcagcagugacaggc

SEQ ID NO: 656197 - RNA, 22 nt, Human
ucaugucucuaugugccuauua

SEQ ID NO: 656198 - RNA, 22 nt, Human
ucuuccagugcuguguagagcu

SEQ ID NO: 656199 - RNA, 21 nt, Human
acagagcauaaugguguggca

SEQ ID NO: 656200 - RNA, 22 nt, Human
gcucacaguacagugcuggcuc

SEQ ID NO: 656201 - RNA, 22 nt, Human
ugauuugagguacauaaaucca

SEQ ID NO: 656202 - RNA, 22 nt, Human
cagcccagagauguuaucuagu

SEQ ID NO: 656203 - RNA, 22 nt, Human
acaguauaccauugugacuuug

SEQ ID NO: 656204 - RNA, 22 nt, Human
aggucauugaaguuauuuucuu

SEQ ID NO: 656205 - RNA, 22 nt, Human
agugaauacaugucacucagca

SEQ ID NO: 656206 - RNA, 22 nt, Human
uaggacuuuggcgucagaacug

SEQ ID NO: 656207 - RNA, 22 nt, Human
ugguggcuaccagguccugggg

SEQ ID NO: 656208 - RNA, 22 nt, Human
uacacugaaagagaggauugaa

SEQ ID NO: 656209 - RNA, 22 nt, Human
gguggcucagugucaggcccug

SEQ ID NO: 656210 - RNA, 22 nt, Human
ggcaaagcugggauucaaaccc

SEQ ID NO: 656211 - RNA, 22 nt, Human
agaggccuccgaaaggugggcu

SEQ ID NO: 656212 - RNA, 22 nt, Human
aaaaaugucauuauggaacuga

SEQ ID NO: 656213 - RNA, 22 nt, Human
cagggggugguccaggcugcgc

SEQ ID NO: 656214 - RNA, 22 nt, Human
gcuuuacugucuggaaaguuug

SEQ ID NO: 656215 - RNA, 22 nt, Human
aaaguguaggcuucaaagaggg

SEQ ID NO: 656216 - RNA, 22 nt, Human
ugaaauauuuagagaguaaguu

SEQ ID NO: 656217 - RNA, 22 nt, Human
uaugcaacagcauuauuacaau

SEQ ID NO: 656218 - RNA, 22 nt, Human
cagcauuucaggaggcugaggu

SEQ ID NO: 656219 - RNA, 22 nt, Human
gccagggagucugggccacaga

SEQ ID NO: 656220 - RNA, 22 nt, Human
acaggccuuaggagagaugggg

SEQ ID NO: 656221 - RNA, 22 nt, Human
gccauuaaugagaucaagaauc

SEQ ID NO: 656222 - RNA, 22 nt, Human
ucugcuuugaccuucuugaugc

SEQ ID NO: 656223 - RNA, 22 nt, Human
agcagggcagcugaugcgcacg

SEQ ID NO: 656224 - RNA, 22 nt, Human
ucugggaacuauaucugguggu

SEQ ID NO: 656225 - RNA, 22 nt, Human
ggccacacagaugacugcuuuc

SEQ ID NO: 656226 - RNA, 22 nt, Human
ggcacagggugauguugcaguu

SEQ ID NO: 656227 - RNA, 22 nt, Human
caaaagcaaagucccugaaugu

SEQ ID NO: 656228 - RNA, 22 nt, Human
uuuacgagugcuaaugauauug

SEQ ID NO: 656229 - RNA, 22 nt, Human
ugucugaacccuggcccugccu

SEQ ID NO: 656230 - RNA, 22 nt, Human
acugggccaacuauuuguucua

SEQ ID NO: 656231 - RNA, 22 nt, Human
ugcaauauguugcauuguaugg

SEQ ID NO: 656232 - RNA, 22 nt, Human
uagauuguucuuaacuuuauaa

SEQ ID NO: 656233 - RNA, 22 nt, Human
uacuuuggauccuuacaauagc

SEQ ID NO: 656234 - RNA, 22 nt, Human
auugcuucauguccuuugccgg

SEQ ID NO: 656235 - RNA, 22 nt, Human
agggcugaugcaccauguagcc

SEQ ID NO: 656236 - RNA, 22 nt, Human
acaguugagaugcaacuuuggg

SEQ ID NO: 656237 - RNA, 22 nt, Human
uuguauuaaaauguguuucugu

SEQ ID NO: 656238 - RNA, 22 nt, Human
uaucagcucggaaucuguugaa

SEQ ID NO: 656239 - RNA, 22 nt, Human
ugcccuggcucuccacuaguuu

SEQ ID NO: 656240 - RNA, 22 nt, Human
agggcagcucucaccucuggcc

SEQ ID NO: 656241 - RNA, 22 nt, Human
gagcuguucaaggacaggcacg

SEQ ID NO: 656242 - RNA, 22 nt, Human
aucauccuauugugccccaggu

SEQ ID NO: 656243 - RNA, 22 nt, Human
aagcaggcaugggaggccaucc

SEQ ID NO: 656244 - RNA, 20 nt, Human
cugcccugcccuggguccug

SEQ ID NO: 656245 - RNA, 22 nt, Human
caguauguuuauuagaacugca

SEQ ID NO: 656246 - RNA, 22 nt, Human
ugggcucuagacuuuagugugg

SEQ ID NO: 656247 - RNA, 17 nt, Human
uuacacaggagagcucu

SEQ ID NO: 656248 - RNA, 22 nt, Human
uucaggauggaguaccuuuuau

SEQ ID NO: 656249 - RNA, 22 nt, Human
cuuggcugcuuuugugcacauu

SEQ ID NO: 656250 - RNA, 22 nt, Human
ugauuagcuuugaaugugcugc

SEQ ID NO: 656251 - RNA, 22 nt, Human
guggcaucgucugagguggggu

SEQ ID NO: 656252 - RNA, 22 nt, Human
uaggaagggaaaggcuucaacu

SEQ ID NO: 656253 - RNA, 22 nt, Human
caguuuaggucauccuugcuuu

SEQ ID NO: 656254 - RNA, 17 nt, Human
aggcaccucuuccugcu

SEQ ID NO: 656255 - RNA, 22 nt, Human
ggcucaggccuguaauccuagc

SEQ ID NO: 656256 - RNA, 22 nt, Human
ucucugagccccugccucuuuc

SEQ ID NO: 656257 - RNA, 22 nt, Human
ccagcuggggaaguggggcaua

SEQ ID NO: 656258 - RNA, 21 nt, Human
uccuguaagcuuggguggcuc

SEQ ID NO: 656259 - RNA, 22 nt, Human
gaggggagaggcuuauggauca

SEQ ID NO: 656260 - RNA, 22 nt, Human
ccuccaguacuccaguccagcg

SEQ ID NO: 656261 - RNA, 22 nt, Human
agccaggauggucucgaucggc

SEQ ID NO: 656262 - RNA, 20 nt, Human
ucuuauacagaaaacauuuu

SEQ ID NO: 656263 - RNA, 22 nt, Human
caggcuuggcagggaggcuggu

SEQ ID NO: 656264 - RNA, 22 nt, Human
uuuccuuugggcacccgagcuc

SEQ ID NO: 656265 - RNA, 22 nt, Human
aagucaucacuccucugaacuu

SEQ ID NO: 656266 - RNA, 22 nt, Human
auacagcuuucuuucacaugag

SEQ ID NO: 656267 - RNA, 22 nt, Human
uguguuuauaguguaucuucca

SEQ ID NO: 656268 - RNA, 22 nt, Human
ggccaccaguccucuggcaggg

SEQ ID NO: 656269 - RNA, 21 nt, Human
gucuuuuaagugaagagaggc

SEQ ID NO: 656270 - RNA, 22 nt, Human
aagaggcuggcauugaugguag

SEQ ID NO: 656271 - RNA, 22 nt, Human
ccuucucugcagguaguuggcu

SEQ ID NO: 656272 - RNA, 22 nt, Human
acauuaacacuggugcuggugu

SEQ ID NO: 656273 - RNA, 22 nt, Human
agcauccagaugccugauguca

SEQ ID NO: 656274 - RNA, 16 nt, Human
gcuuagugagagcaac

SEQ ID NO: 656275 - RNA, 22 nt, Human
uaguuauuauuguuacuaucag

SEQ ID NO: 656276 - RNA, 22 nt, Human
ggcaguuuuaacagagguagua

SEQ ID NO: 656277 - RNA, 22 nt, Human
aaguuccuguuacuccccagaa

SEQ ID NO: 656278 - RNA, 22 nt, Human
gaccacagcagugcaagaggag

SEQ ID NO: 656279 - RNA, 22 nt, Human
gagaagcagguuuagcagacaa

SEQ ID NO: 656280 - RNA, 22 nt, Human
uuccagagcuuugcgcuuggaa

SEQ ID NO: 656281 - RNA, 22 nt, Human
uucacagaauugucuugacugg

SEQ ID NO: 656282 - RNA, 22 nt, Human
gucaugccagcggagcucggga

SEQ ID NO: 656283 - RNA, 19 nt, Human
ucugaggguccagaugcau

SEQ ID NO: 656284 - RNA, 22 nt, Human
agaggaucuaagugaguccuca

SEQ ID NO: 656285 - RNA, 22 nt, Human
uacagaguuuuccugccaagaa

SEQ ID NO: 656286 - RNA, 22 nt, Human
cuggcuguguccacagaguaag

SEQ ID NO: 656287 - RNA, 22 nt, Human
acauucugaaugccugacagua

SEQ ID NO: 656288 - RNA, 22 nt, Human
cgcugccuucaucccacgccua

SEQ ID NO: 656289 - RNA, 18 nt, Human
ccacccagggggagagga

SEQ ID NO: 656290 - RNA, 18 nt, Human
guuuccugaggugaaggg

SEQ ID NO: 656291 - RNA, 22 nt, Human
uauugccaaaugucugcuggaa

SEQ ID NO: 656292 - RNA, 22 nt, Human
acaguacauaauccugagucug

SEQ ID NO: 656293 - RNA, 22 nt, Human
cacuguccaugcuugcuaaccc

SEQ ID NO: 656294 - RNA, 22 nt, Human
gucugcccuuggcucagccaua

SEQ ID NO: 656295 - RNA, 18 nt, Human
gugcugugggcaguggcc

SEQ ID NO: 656296 - RNA, 22 nt, Human
ugcuucacuggcuccacauagg

SEQ ID NO: 656297 - RNA, 22 nt, Human
cuggagagagaaaaagccuuaa

SEQ ID NO: 656298 - RNA, 22 nt, Human
uggaggacguguccaccaugaa

SEQ ID NO: 656299 - RNA, 22 nt, Human
uuacaucaugcuuaucccuuuc

SEQ ID NO: 656300 - RNA, 22 nt, Human
ucaggccuucagaccuggcccg

SEQ ID NO: 656301 - RNA, 22 nt, Human
ugggcagaucuuugguggcuag

SEQ ID NO: 656302 - RNA, 22 nt, Human
gccaccuguuucagaugugguu

SEQ ID NO: 656303 - RNA, 22 nt, Human
guuugcauuuauuagucuucug

SEQ ID NO: 656304 - RNA, 23 nt, Human
ccaguggcguaaacuagaggaua

SEQ ID NO: 656305 - RNA, 18 nt, Human
cugggccagaguuucugc

SEQ ID NO: 656306 - RNA, 23 nt, Human
ccucagcauggcaggagcccagc

SEQ ID NO: 656307 - RNA, 22 nt, Human
caaauguuucuugaacaccaac

SEQ ID NO: 656308 - RNA, 22 nt, Human
cguggcuggggaggucagccag

SEQ ID NO: 656309 - RNA, 20 nt, Human
cagcuagugguaggagucgg

SEQ ID NO: 656310 - RNA, 22 nt, Human
ggccagggggcuucagacucca

SEQ ID NO: 656311 - RNA, 19 nt, Human
gaggcaguagucaaagcuu

SEQ ID NO: 656312 - RNA, 22 nt, Human
gggagacaagaaguagccugcu

SEQ ID NO: 656313 - RNA, 22 nt, Human
agaaugcauuuuguguagcuau

SEQ ID NO: 656314 - RNA, 22 nt, Human
uugggcagucuggcugcagagu

SEQ ID NO: 656315 - RNA, 22 nt, Human
augcaguaaaauaggagguaau

SEQ ID NO: 656316 - RNA, 22 nt, Human
cuauccauauccugggcauggc

SEQ ID NO: 656317 - RNA, 22 nt, Human
ccucuguccccagugcaggccu

SEQ ID NO: 656318 - RNA, 22 nt, Human
agguuccagggauuaggaugug

SEQ ID NO: 656319 - RNA, 22 nt, Human
acugggagaaacugacaccuua

SEQ ID NO: 656320 - RNA, 22 nt, Human
ucccucagcuugucuccaugca

SEQ ID NO: 656321 - RNA, 22 nt, Human
aggaagagcccgggugacauaa

SEQ ID NO: 656322 - RNA, 22 nt, Human
gcaccaggcagcugagcaggcc

SEQ ID NO: 656323 - RNA, 22 nt, Human
acacaugugauucuaagacagc

SEQ ID NO: 656324 - RNA, 22 nt, Human
cagagucuuguguguucagccc

SEQ ID NO: 656325 - RNA, 22 nt, Human
auuaggauguuccuaugcacau

SEQ ID NO: 656326 - RNA, 18 nt, Human
ugauggaggagggcuggu

SEQ ID NO: 656327 - RNA, 22 nt, Human
ggcaccaggcugggcauaggcc

SEQ ID NO: 656328 - RNA, 22 nt, Human
uggccuuguguuuaagcaagaa

SEQ ID NO: 656329 - RNA, 22 nt, Human
uacacauacauugcuuacaagg

SEQ ID NO: 656330 - RNA, 22 nt, Human
gagaaauuuugaguggcuuucu

SEQ ID NO: 656331 - RNA, 22 nt, Human
ggcaguuucucaggcaggggua

SEQ ID NO: 656332 - RNA, 22 nt, Human
auuuggucuccauacugguuag

SEQ ID NO: 656333 - RNA, 22 nt, Human
uguauacaggauuacucauagc

SEQ ID NO: 656334 - RNA, 22 nt, Human
agucaaagcuacaggcauuuga

SEQ ID NO: 656335 - RNA, 22 nt, Human
ggcgcugucgugagcucgcccg

SEQ ID NO: 656336 - RNA, 22 nt, Human
uuuccuggaggguccccagcag

SEQ ID NO: 656337 - RNA, 22 nt, Human
cuggcccucgucaguuucacug

SEQ ID NO: 656338 - RNA, 22 nt, Human
gcaguguugguuugcucugcag

SEQ ID NO: 656339 - RNA, 22 nt, Human
cuugagcacagcggcuucagga

SEQ ID NO: 656340 - RNA, 22 nt, Human
auucaaacuguguuaggcagca

SEQ ID NO: 656341 - RNA, 22 nt, Human
uuuauguuccucuugagcuuuc

SEQ ID NO: 656342 - RNA, 22 nt, Human
gcaccugaggaggcaucuggag

SEQ ID NO: 656343 - RNA, 22 nt, Human
uuauucaguucccuucacucuc

SEQ ID NO: 656344 - RNA, 23 nt, Human
acagggcuggcagcugcaagacc

SEQ ID NO: 656345 - RNA, 22 nt, Human
aagcacuaggacuucagucucu

SEQ ID NO: 656346 - RNA, 22 nt, Human
aaguguuaaagacuugaacacu

SEQ ID NO: 656347 - RNA, 22 nt, Human
guuucuuaaguuacaaaaucuu

SEQ ID NO: 656348 - RNA, 22 nt, Human
auggcccaggccuccuguggcu

SEQ ID NO: 656349 - RNA, 22 nt, Human
ucaaaggguaauguaauagucu

SEQ ID NO: 656350 - RNA, 21 nt, Human
uuccuggggaaggagcugccu

SEQ ID NO: 656351 - RNA, 22 nt, Human
gguuuaauugguccaggauggg

SEQ ID NO: 656352 - RNA, 23 nt, Human
ggccauggagacuuagaaugggc

SEQ ID NO: 656353 - RNA, 22 nt, Human
cagaugucauuucccaugcagc

SEQ ID NO: 656354 - RNA, 22 nt, Human
acauccaucuuaugagauaggu

SEQ ID NO: 656355 - RNA, 22 nt, Human
uagcucuggcauucuuuccaaa

SEQ ID NO: 656356 - RNA, 22 nt, Human
gugacaguggucacuuguaguu

SEQ ID NO: 656357 - RNA, 22 nt, Human
agucuacaaagggaagcccuuu

SEQ ID NO: 656358 - RNA, 22 nt, Human
ucagguccagcuccugugccuc

SEQ ID NO: 656359 - RNA, 22 nt, Human
uuauagcaggugacuaaugagu

SEQ ID NO: 656360 - RNA, 20 nt, Human
ucaaagaagauucagcucaa

SEQ ID NO: 656361 - RNA, 22 nt, Human
aagacuuucccucaucagaacg

SEQ ID NO: 656362 - RNA, 22 nt, Human
agcuguuggcuggcugagcucu

SEQ ID NO: 656363 - RNA, 23 nt, Human
uaggggcuggcguggagccugcg

SEQ ID NO: 656364 - RNA, 22 nt, Human
agaaugauagcuaguauuuacu

SEQ ID NO: 656365 - RNA, 22 nt, Human
cccuggagaaggggacgcggag

SEQ ID NO: 656366 - RNA, 22 nt, Human
ugucaugucuguaaauacacca

SEQ ID NO: 656367 - RNA, 22 nt, Human
uacacuaaaucuucaucuuuua

SEQ ID NO: 656368 - RNA, 22 nt, Human
gggcugagggccaauuccuacu

SEQ ID NO: 656369 - RNA, 22 nt, Human
aucuguuauugaauaggugcua

SEQ ID NO: 656370 - RNA, 22 nt, Human
augggcaugauauuaguaccua

SEQ ID NO: 656371 - RNA, 22 nt, Human
ugcaaggcugccucugaggacc

SEQ ID NO: 656372 - RNA, 22 nt, Human
ggcacaaguuugaugugaguua

SEQ ID NO: 656373 - RNA, 22 nt, Human
gaacacaagcguaugucuuugu

SEQ ID NO: 656374 - RNA, 22 nt, Human
uuagaaaugauuucaccucuuu

SEQ ID NO: 656375 - RNA, 22 nt, Human
ucuauaauccuauuucaacugc

SEQ ID NO: 656376 - RNA, 22 nt, Human
uggcuccagcccugagcaagcu

SEQ ID NO: 656377 - RNA, 22 nt, Human
guccugugcaccgugggauguu

SEQ ID NO: 656378 - RNA, 22 nt, Human
guugcuuuacagcuggugacag

SEQ ID NO: 656379 - RNA, 22 nt, Human
cauagaauggauugacaagauu

SEQ ID NO: 656380 - RNA, 22 nt, Human
uaauggauuaacgucccugucg

SEQ ID NO: 656381 - RNA, 21 nt, Human
gccagggaguuaaagagucuu

SEQ ID NO: 656382 - RNA, 18 nt, Human
cacaggcaggugauaggu

SEQ ID NO: 656383 - RNA, 22 nt, Human
cugagaucuuuauacgaggcac

SEQ ID NO: 656384 - RNA, 22 nt, Human
ggguguccugugccaagcuggg

SEQ ID NO: 656385 - RNA, 22 nt, Human
uuucucaaauacuguuccagga

SEQ ID NO: 656386 - RNA, 22 nt, Human
uuauugcaacuuuagggauaga

SEQ ID NO: 656387 - RNA, 22 nt, Human
uccucagaugcucuuggacgcc

SEQ ID NO: 656388 - RNA, 22 nt, Human
uuuagcuugaaaguuuuggagg

SEQ ID NO: 656389 - RNA, 22 nt, Human
cacugaguucccugacauuuca

SEQ ID NO: 656390 - RNA, 22 nt, Human
aggagucauugagagggguccu

SEQ ID NO: 656391 - RNA, 22 nt, Human
uuccugggugguccugguagag

SEQ ID NO: 656392 - RNA, 22 nt, Human
uguauguguauguacauaugca

SEQ ID NO: 656393 - RNA, 22 nt, Human
agguccuguccuuggucucuga

SEQ ID NO: 656394 - RNA, 22 nt, Human
aguccugggugugcaaggcaga

SEQ ID NO: 656395 - RNA, 22 nt, Human
ugaaugcaagaaggaacaugaa

SEQ ID NO: 656396 - RNA, 22 nt, Human
guuuuucugugagcgguaaagg

SEQ ID NO: 656397 - RNA, 22 nt, Human
augagggaggcaaggagaugcu

SEQ ID NO: 656398 - RNA, 22 nt, Human
gcagccacugggagugcuuaua

SEQ ID NO: 656399 - RNA, 22 nt, Human
aggucuccucauauucugccuc

SEQ ID NO: 656400 - RNA, 22 nt, Human
uugacagaugugaaagugagca

SEQ ID NO: 656401 - RNA, 22 nt, Human
uggcucaggguccccaaauggu

SEQ ID NO: 656402 - RNA, 22 nt, Human
uucuacauauauuuuucucacu

SEQ ID NO: 656403 - RNA, 22 nt, Human
agaggacagagugcuggauuua

SEQ ID NO: 656404 - RNA, 22 nt, Human
uguguugguagaucugaggucu

SEQ ID NO: 656405 - RNA, 22 nt, Human
cacagcuucaguuucugacuug

SEQ ID NO: 656406 - RNA, 22 nt, Human
uagcccagcaugagcagagcug

SEQ ID NO: 656407 - RNA, 22 nt, Human
augugugccccuuuuacucuuu

SEQ ID NO: 656408 - RNA, 22 nt, Human
aagaauuauugcaauacuagau

SEQ ID NO: 656409 - RNA, 22 nt, Human
ggacacagguaaauaccacuga

SEQ ID NO: 656410 - RNA, 19 nt, Human
agugggcaaggaagaugac

SEQ ID NO: 656411 - RNA, 22 nt, Human
ucaugcucugguuuagcuguuu

SEQ ID NO: 656412 - RNA, 22 nt, Human
auacacaggugcuaggucaaua

SEQ ID NO: 656413 - RNA, 22 nt, Human
gcaucaagacgaugugaaaucg

SEQ ID NO: 656414 - RNA, 22 nt, Human
uugacaagaacaccgguuugag

SEQ ID NO: 656415 - RNA, 22 nt, Human
ggcaggggugaggccacucuga

SEQ ID NO: 656416 - RNA, 22 nt, Human
uuaugcauauagcagauacgag

SEQ ID NO: 656417 - RNA, 22 nt, Human
ugaaagguuauuuaggucugcu

SEQ ID NO: 656418 - RNA, 22 nt, Human
gugcugagcacagcugcccagg

SEQ ID NO: 656419 - RNA, 22 nt, Human
ccugggagcuguggaaaggcug

SEQ ID NO: 656420 - RNA, 23 nt, Human
gcccaugcuguugggcccgagca

SEQ ID NO: 656421 - RNA, 22 nt, Human
ucaagcaaacucugagaaauaa

SEQ ID NO: 656422 - RNA, 23 nt, Human
ugugcucccaaauguaggucuau

SEQ ID NO: 656423 - RNA, 22 nt, Human
aauucaaugguuuuuaggauau

SEQ ID NO: 656424 - RNA, 22 nt, Human
auguggcuauuuuaauguuaau

SEQ ID NO: 656425 - RNA, 22 nt, Human
agaaauagaggaaagguuugac

SEQ ID NO: 656426 - RNA, 23 nt, Human
agcuuuggugaugugacagauaa

SEQ ID NO: 656427 - RNA, 22 nt, Human
acacaauaaauuuauccuuuga

SEQ ID NO: 656428 - RNA, 22 nt, Human
ucuguaaagauguuuauaccuu

SEQ ID NO: 656429 - RNA, 22 nt, Human
ugauucaagccaccacauacug

SEQ ID NO: 656430 - RNA, 22 nt, Human
aacagggcuuuggaagucuccg

SEQ ID NO: 656431 - RNA, 22 nt, Human
ugugaggaacaggacuagagca

SEQ ID NO: 656432 - RNA, 22 nt, Human
agcucugggaguaguuccaccu

SEQ ID NO: 656433 - RNA, 22 nt, Human
gagauaaagcuaccauguugau

SEQ ID NO: 656434 - RNA, 22 nt, Human
auuaagaugugggaaaauuuaa

SEQ ID NO: 656435 - RNA, 22 nt, Human
ggcuauguguguccaguguauu

SEQ ID NO: 656436 - RNA, 22 nt, Human
gagucaacaagucagaucucac

SEQ ID NO: 656437 - RNA, 22 nt, Human
caggguggccagguagauaaua

SEQ ID NO: 656438 - RNA, 22 nt, Human
cuggagcccugaaugggcagga

SEQ ID NO: 656439 - RNA, 20 nt, Human
uagaaaucuuauaaaagacu

SEQ ID NO: 656440 - RNA, 22 nt, Human
uaauuauucuagucacauagca

SEQ ID NO: 656441 - RNA, 22 nt, Human
caccaugcuugauuuguaaugu

SEQ ID NO: 656442 - RNA, 22 nt, Human
uaucuucuugccaggcuggugu

SEQ ID NO: 656443 - RNA, 21 nt, Human
ugaggccucuccugggcuggc

SEQ ID NO: 656444 - RNA, 21 nt, Human
uuaagacacacagauuaagga

SEQ ID NO: 656445 - RNA, 22 nt, Human
ugacugaaggacuagauugauu

SEQ ID NO: 656446 - RNA, 22 nt, Human
cucugcuggccaugaagagaga

SEQ ID NO: 656447 - RNA, 22 nt, Human
ucaaaguaaaaguauagaguuu

SEQ ID NO: 656448 - RNA, 23 nt, Human
cucagggauagaaaggaagacag

SEQ ID NO: 656449 - RNA, 21 nt, Human
uuucggucccagaugccugug

SEQ ID NO: 656450 - RNA, 22 nt, Human
gcaguguuaaugcgaguguuca

SEQ ID NO: 656451 - RNA, 18 nt, Human
aacaugcauuagaacugc

SEQ ID NO: 656452 - RNA, 22 nt, Human
auuauaugugggauagaauuua

SEQ ID NO: 656453 - RNA, 22 nt, Human
ucagaagcuaaauuugauauuu

SEQ ID NO: 656454 - RNA, 20 nt, Human
aggaggccugcagauaguuc

SEQ ID NO: 656455 - RNA, 22 nt, Human
ccuggagugacagguguagccu

SEQ ID NO: 656456 - RNA, 22 nt, Human
gcccagguuggagagcaguggc

SEQ ID NO: 656457 - RNA, 22 nt, Human
gugaggggaguaaagccauguu

SEQ ID NO: 656458 - RNA, 22 nt, Human
gaaggaggugucaguuggacug

SEQ ID NO: 656459 - RNA, 22 nt, Human
acauguauugacauuauauucu

SEQ ID NO: 656460 - RNA, 22 nt, Human
ggaggggugcucagcugucacg

SEQ ID NO: 656461 - RNA, 22 nt, Human
cccuggaagguucucuggcuca

SEQ ID NO: 656462 - RNA, 22 nt, Human
uccaggccugcaaugacaaagc

SEQ ID NO: 656463 - RNA, 21 nt, Human
cugggcucaugguguuacaga

SEQ ID NO: 656464 - RNA, 22 nt, Human
guauccuuugcggaaauuucua

SEQ ID NO: 656465 - RNA, 22 nt, Human
ggggagugacgcagggccauag

SEQ ID NO: 656466 - RNA, 22 nt, Human
cagaugcugcuauuucacccug

SEQ ID NO: 656467 - RNA, 22 nt, Human
uuucauaaccucaagcuacagu

SEQ ID NO: 656468 - RNA, 23 nt, Human
uccaccccagcugaggcuuagcc

SEQ ID NO: 656469 - RNA, 22 nt, Human
cuuucaaugugccugccuuggg

SEQ ID NO: 656470 - RNA, 22 nt, Human
uguccuggaaaaauggagaguu

SEQ ID NO: 656471 - RNA, 22 nt, Human
gcuggcucuucaguggagauag

SEQ ID NO: 656472 - RNA, 22 nt, Human
acaagguuuaaauagccaucag

SEQ ID NO: 656473 - RNA, 22 nt, Human
ccuugggacccugcuggagguu

SEQ ID NO: 656474 - RNA, 23 nt, Human
auguccccuucuugaugccuggc

SEQ ID NO: 656475 - RNA, 22 nt, Human
uuccuguucaggaaaguugugu

SEQ ID NO: 656476 - RNA, 20 nt, Human
auguaaaauuauaaggcuga

SEQ ID NO: 656477 - RNA, 22 nt, Human
auuacagaaagcaauauugagu

SEQ ID NO: 656478 - RNA, 20 nt, Human
gaggaaccacugggaggaga

SEQ ID NO: 656479 - RNA, 22 nt, Human
cacuaaaacuacauuggaaaca

SEQ ID NO: 656480 - RNA, 22 nt, Human
ucagagaagguaagugaccugc

SEQ ID NO: 656481 - RNA, 22 nt, Human
acagugcaaacccucgggaaag

SEQ ID NO: 656482 - RNA, 21 nt, Human
uagggggcagugggaugcuua

SEQ ID NO: 656483 - RNA, 22 nt, Human
ggcagccucagguuuucuuuga

SEQ ID NO: 656484 - RNA, 22 nt, Human
gggucagagcaagacugggguc

SEQ ID NO: 656485 - RNA, 22 nt, Human
gucaggcagccuggagauucag

SEQ ID NO: 656486 - RNA, 22 nt, Human
auccacucucccauucaugcau

SEQ ID NO: 656487 - RNA, 22 nt, Human
gcugggcucaccaggccacuag

SEQ ID NO: 656488 - RNA, 22 nt, Human
aaccuggcccuaaucccaguag

SEQ ID NO: 656489 - RNA, 21 nt, Human
uuucccucauuguguuggcac

SEQ ID NO: 656490 - RNA, 22 nt, Human
cucucagacugaagggccugug

SEQ ID NO: 656491 - RNA, 22 nt, Human
cugggugagcuggccagagggu

SEQ ID NO: 656492 - RNA, 22 nt, Human
uccucugacuucugguugaguu

SEQ ID NO: 656493 - RNA, 22 nt, Human
ugaggcagcauucuucaagaca

SEQ ID NO: 656494 - RNA, 22 nt, Human
ucuccaaaucaaucaauaugaa

SEQ ID NO: 656495 - RNA, 22 nt, Human
cuaaccugcauggcagcuagaa

SEQ ID NO: 656496 - RNA, 22 nt, Human
acaguuucuccauuuacaccuu

SEQ ID NO: 656497 - RNA, 22 nt, Human
cggcuggguagaggugccgggu

SEQ ID NO: 656498 - RNA, 22 nt, Human
augcaguuuaucuccaaaucau

SEQ ID NO: 656499 - RNA, 17 nt, Human
aggcaugaggcaucacu

SEQ ID NO: 656500 - RNA, 22 nt, Human
uggcucuggggacaguaagucc

SEQ ID NO: 656501 - RNA, 22 nt, Human
ugcaguuuuccuucaacauugu

SEQ ID NO: 656502 - RNA, 22 nt, Human
agccacagugggcuaccagcuc

SEQ ID NO: 656503 - RNA, 22 nt, Human
cugcccuguaucuucucccaau

SEQ ID NO: 656504 - RNA, 22 nt, Human
ucaaucaaugguuuccaaauuu

SEQ ID NO: 656505 - RNA, 22 nt, Human
auucuucucccuuagggcccag

SEQ ID NO: 656506 - RNA, 22 nt, Human
guccuucaagguccuuggugug

SEQ ID NO: 656507 - RNA, 23 nt, Human
aguacauucgaaaaauucuguga

SEQ ID NO: 656508 - RNA, 19 nt, Human
agacucugugugagacuuu

SEQ ID NO: 656509 - RNA, 22 nt, Human
aauggcuuauguaaugcuguuu

SEQ ID NO: 656510 - RNA, 22 nt, Human
ugggagcccaagggagcugccg

SEQ ID NO: 656511 - RNA, 20 nt, Human
ugcccagcaagagugcaguu

SEQ ID NO: 656512 - RNA, 22 nt, Human
accagcagggcugggccaaugg

SEQ ID NO: 656513 - RNA, 22 nt, Human
cuggggaccagugucuguuugu

SEQ ID NO: 656514 - RNA, 22 nt, Human
agaucugaguaugauuugccug

SEQ ID NO: 656515 - RNA, 22 nt, Human
aggaggguggccucaugugagu

SEQ ID NO: 656516 - RNA, 22 nt, Human
uccuggagccucauucaaacac

SEQ ID NO: 656517 - RNA, 22 nt, Human
agccaggcucaaggccugcucc

SEQ ID NO: 656518 - RNA, 22 nt, Human
ggcuccugaggaccaggcacag

SEQ ID NO: 656519 - RNA, 22 nt, Human
ugcuuccuauccacacaaugcc

SEQ ID NO: 656520 - RNA, 22 nt, Human
uuugacaauucaugacauuuau

SEQ ID NO: 656521 - RNA, 22 nt, Human
uccaggcuggacaugaggcggg

SEQ ID NO: 656522 - RNA, 22 nt, Human
acauuucagcgugcaugacaug

SEQ ID NO: 656523 - RNA, 21 nt, Human
ccagugcuacagcugccugac

SEQ ID NO: 656524 - RNA, 20 nt, Human
ucuggcucuuugcuccuccc

SEQ ID NO: 656525 - RNA, 23 nt, Human
ccucuaauaaacuugaccuugug

SEQ ID NO: 656526 - RNA, 22 nt, Human
uagcacaagcaacuacugaagu

SEQ ID NO: 656527 - RNA, 22 nt, Human
agcuuuaucuucaccugggaau

SEQ ID NO: 656528 - RNA, 22 nt, Human
uguauguaaaggucuucauguu

SEQ ID NO: 656529 - RNA, 22 nt, Human
aagucccaucugccuccaugua

SEQ ID NO: 656530 - RNA, 22 nt, Human
ggaauucucuaugcucuguucc

SEQ ID NO: 656531 - RNA, 22 nt, Human
aguggcagagccaagauaugau

SEQ ID NO: 656532 - RNA, 22 nt, Human
uuaauacaagcauaugcacaca

SEQ ID NO: 656533 - RNA, 22 nt, Human
aagccagugugacaggaaacuu

SEQ ID NO: 656534 - RNA, 23 nt, Human
auauaaacaccagauagauugua

SEQ ID NO: 656535 - RNA, 19 nt, Human
aauucuguuucagcagauc

SEQ ID NO: 656536 - RNA, 22 nt, Human
uccagcuguuguuuuaucucag

SEQ ID NO: 656537 - RNA, 23 nt, Human
auagacccaagaguaaaggcauc

SEQ ID NO: 656538 - RNA, 22 nt, Human
auauauacuuugacacauucug

SEQ ID NO: 656539 - RNA, 22 nt, Human
uuuuguuuaaaauccuggaugg

SEQ ID NO: 656540 - RNA, 22 nt, Human
auaugccauuagcuagaaauaa

SEQ ID NO: 656541 - RNA, 22 nt, Human
augcaacauccaauuccuuuug

SEQ ID NO: 656542 - RNA, 22 nt, Human
ucaugugucugccaguguuuau

SEQ ID NO: 656543 - RNA, 22 nt, Human
auauuucucucagacauggaag

SEQ ID NO: 656544 - RNA, 22 nt, Human
cuauuaaacacuacugugcacu

SEQ ID NO: 656545 - RNA, 22 nt, Human
caugggcagaaguggcaucauu

SEQ ID NO: 656546 - RNA, 22 nt, Human
gcacuugaggacgacucagcug

SEQ ID NO: 656547 - RNA, 22 nt, Human
cacagggcaggccccaggccuc

SEQ ID NO: 656548 - RNA, 22 nt, Human
aucucaaagcauggagcagaau

SEQ ID NO: 656549 - RNA, 21 nt, Human
augugcuuagcugcugguagu

SEQ ID NO: 656550 - RNA, 22 nt, Human
cacaguggcaaaggggcuuggg

SEQ ID NO: 656551 - RNA, 20 nt, Human
gcaugaggaaucauugcagc

SEQ ID NO: 656552 - RNA, 22 nt, Human
gcuaauacuuuggaaagaaugu

SEQ ID NO: 656553 - RNA, 22 nt, Human
uccagucauuuccauuguuccc

SEQ ID NO: 656554 - RNA, 18 nt, Human
uggugaaggguggaggag

SEQ ID NO: 656555 - RNA, 22 nt, Human
cucaggauagauuguccucuca

SEQ ID NO: 656556 - RNA, 22 nt, Human
agcaggcuccuuccuucucugg

SEQ ID NO: 656557 - RNA, 22 nt, Human
ugcuggcccaugaagacgcagu

SEQ ID NO: 656558 - RNA, 22 nt, Human
ugauuucauaguauauacauga

SEQ ID NO: 656559 - RNA, 22 nt, Human
uaggcugagguugaugccaggg

SEQ ID NO: 656560 - RNA, 22 nt, Human
gacauacaagcugguaccuccu

SEQ ID NO: 656561 - RNA, 22 nt, Human
gcagaugcuguggugauagaag

SEQ ID NO: 656562 - RNA, 20 nt, Human
cuguacaucaccaaggugac

SEQ ID NO: 656563 - RNA, 22 nt, Human
aucauaagacccagccaguauu

SEQ ID NO: 656564 - RNA, 22 nt, Human
ccgggagaguggaaccaagagg

SEQ ID NO: 656565 - RNA, 22 nt, Human
auugugcagcucugcucuuauu

SEQ ID NO: 656566 - RNA, 22 nt, Human
augggcugaggaagcuccugag

SEQ ID NO: 656567 - RNA, 22 nt, Human
agcugcccaauccugcagggcg

SEQ ID NO: 656568 - RNA, 22 nt, Human
cucugcuuuguaaguugugagg

SEQ ID NO: 656569 - RNA, 22 nt, Human
ugcagcucugaacagucaugaa

SEQ ID NO: 656570 - RNA, 22 nt, Human
auaguuugugaaacacagcagu

SEQ ID NO: 656571 - RNA, 22 nt, Human
uucuugaauagggauugauaaa

SEQ ID NO: 656572 - RNA, 22 nt, Human
agccugagugcuuaggacuguu

SEQ ID NO: 656573 - RNA, 22 nt, Human
uuacuugauuugaaaaucauag

SEQ ID NO: 656574 - RNA, 22 nt, Human
cagcucccaguggcagcuccuu

SEQ ID NO: 656575 - RNA, 22 nt, Human
ugggcugagaguaccuuauaaa

SEQ ID NO: 656576 - RNA, 22 nt, Human
ugcuucugaacucagcaugugg

SEQ ID NO: 656577 - RNA, 22 nt, Human
acauucaaaauugugguuuaga

SEQ ID NO: 656578 - RNA, 20 nt, Human
cccagagcacuuuuucaugu

SEQ ID NO: 656579 - RNA, 22 nt, Human
ggugccuguauuuggggcacag

SEQ ID NO: 656580 - RNA, 22 nt, Human
uuuuauugucaaugaagacaga

SEQ ID NO: 656581 - RNA, 22 nt, Human
gggagcacugagaggcagguag

SEQ ID NO: 656582 - RNA, 22 nt, Human
uuuccacaucaccaugagguga

SEQ ID NO: 656583 - RNA, 21 nt, Human
agcagaacagucgagcacugc

SEQ ID NO: 656584 - RNA, 22 nt, Human
cagcacaggccccucucuccca

SEQ ID NO: 656585 - RNA, 21 nt, Human
gggcuuuuuauuuagcacugu

SEQ ID NO: 656586 - RNA, 22 nt, Human
uucccacagagauuacauugaa

SEQ ID NO: 656587 - RNA, 22 nt, Human
aaggcugguuccaucccuggug

SEQ ID NO: 656588 - RNA, 22 nt, Human
cuggcucagugccuucagaagu

SEQ ID NO: 656589 - RNA, 22 nt, Human
uucucugguaaacacaugcgua

SEQ ID NO: 656590 - RNA, 22 nt, Human
cacagagaucggaacagaagua

SEQ ID NO: 656591 - RNA, 23 nt, Human
ugagacacucauucauggaguau

SEQ ID NO: 656592 - RNA, 22 nt, Human
ccagggaaacuuuggaguggag

SEQ ID NO: 656593 - RNA, 23 nt, Human
aggaagcuaccaauuuuguaggc

SEQ ID NO: 656594 - RNA, 20 nt, Human
uccaagggcagcagaaucag

SEQ ID NO: 656595 - RNA, 22 nt, Human
uucaggagcuagggaugugaaa

SEQ ID NO: 656596 - RNA, 21 nt, Human
uacacaaagcgugguccagag

SEQ ID NO: 656597 - RNA, 22 nt, Human
gcccugcucuguuggucaccug

SEQ ID NO: 656598 - RNA, 22 nt, Human
uccguugacacugcauggagau

SEQ ID NO: 656599 - RNA, 22 nt, Human
uagaaaagaauuuuauuugaua

SEQ ID NO: 656600 - RNA, 22 nt, Human
cccagugucugggccugcaggg

SEQ ID NO: 656601 - RNA, 22 nt, Human
cccuggagcugcuugcauguug

SEQ ID NO: 656602 - RNA, 17 nt, Human
gcagacacuucuauuga

SEQ ID NO: 656603 - RNA, 22 nt, Human
ugugacuuagggcaggugagau

SEQ ID NO: 656604 - RNA, 22 nt, Human
guggccguguaacuugaguaca

SEQ ID NO: 656605 - RNA, 22 nt, Human
acguggcggccgccgugagcgg

SEQ ID NO: 656606 - RNA, 22 nt, Human
acacaagugaauauuuuaagga

SEQ ID NO: 656607 - RNA, 22 nt, Human
acagcugauaguuaccucuguc

SEQ ID NO: 656608 - RNA, 19 nt, Human
gcugggugggguccacagc

SEQ ID NO: 656609 - RNA, 21 nt, Human
uuccacaguccugaggauuca

SEQ ID NO: 656610 - RNA, 22 nt, Human
aucauucagucucugggacagu

SEQ ID NO: 656611 - RNA, 22 nt, Human
gugcuuaaccuaguuucuagua

SEQ ID NO: 656612 - RNA, 22 nt, Human
guccagccccugacucccaggc

SEQ ID NO: 656613 - RNA, 23 nt, Human
uuucucugagaagcaguucucua

SEQ ID NO: 656614 - RNA, 22 nt, Human
uuggggaguuaaugccaaagau

SEQ ID NO: 656615 - RNA, 22 nt, Human
auguccuguuuuggcuugcucu

SEQ ID NO: 656616 - RNA, 22 nt, Human
gaaaucaaggcuacauucaggu

SEQ ID NO: 656617 - RNA, 22 nt, Human
uauggcuuugggccaaaucuac

SEQ ID NO: 656618 - RNA, 22 nt, Human
aguuuuauaucuuccauugguu

SEQ ID NO: 656619 - RNA, 22 nt, Human
cuggaugauaacagcaauauuu

SEQ ID NO: 656620 - RNA, 22 nt, Human
gcaaagcaagcugucagccuca

SEQ ID NO: 656621 - RNA, 22 nt, Human
augaggauguuaguggacugga

SEQ ID NO: 656622 - RNA, 19 nt, Human
ucuccaggcaggugagcga

SEQ ID NO: 656623 - RNA, 22 nt, Human
uuucagacauaccaguuauuga

SEQ ID NO: 656624 - RNA, 23 nt, Human
aguuaggucaaguuaggucaauu

SEQ ID NO: 656625 - RNA, 22 nt, Human
ucugcauuuuuaacaagauccc

SEQ ID NO: 656626 - RNA, 22 nt, Human
caaaggcaacauauacuuguuu

SEQ ID NO: 656627 - RNA, 22 nt, Human
ggccuggacaaaugcaccaagg

SEQ ID NO: 656628 - RNA, 22 nt, Human
uucagaaggugcagccugggcc

SEQ ID NO: 656629 - RNA, 22 nt, Human
agaaagcacgggccccaggcuc

SEQ ID NO: 656630 - RNA, 22 nt, Human
gaaguuauuugcuaucuacuga

SEQ ID NO: 656631 - RNA, 22 nt, Human
ucaggccugagaaaaauccuuu

SEQ ID NO: 656632 - RNA, 22 nt, Human
ucauguguguuucauguaugga

SEQ ID NO: 656633 - RNA, 22 nt, Human
gccuucaggaggguuccagaca

SEQ ID NO: 656634 - RNA, 22 nt, Human
gcuaaugauagcaagauaaaca

SEQ ID NO: 656635 - RNA, 22 nt, Human
uucucugggaacauaaaugaag

SEQ ID NO: 656636 - RNA, 22 nt, Human
uaggauacaaauucuguaauuu

SEQ ID NO: 656637 - RNA, 21 nt, Human
uggcuucugccaauguuaaga

SEQ ID NO: 656638 - RNA, 22 nt, Human
cagacacuuauugagcaaguac

SEQ ID NO: 656639 - RNA, 22 nt, Human
cuugcuuuguccagaaauucag

SEQ ID NO: 656640 - RNA, 22 nt, Human
ucucauuugccucaucuauaaa

SEQ ID NO: 656641 - RNA, 22 nt, Human
auggaagaguccccauggauga

SEQ ID NO: 656642 - RNA, 22 nt, Human
cuggaccagaaaggacauggcu

SEQ ID NO: 656643 - RNA, 22 nt, Human
gcagaagcacaggugacgggcc

SEQ ID NO: 656644 - RNA, 22 nt, Human
gcaggucuugaaggugugauuu

SEQ ID NO: 656645 - RNA, 22 nt, Human
guauuuaauucugugcuucuag

SEQ ID NO: 656646 - RNA, 22 nt, Human
uuccaauauuuacaaugcauua

SEQ ID NO: 656647 - RNA, 22 nt, Human
uuagcucagaaaauuuaaacuu

SEQ ID NO: 656648 - RNA, 22 nt, Human
agaccuggaugugagggaagua

SEQ ID NO: 656649 - RNA, 22 nt, Human
ccagggccugccacuuagcaag

SEQ ID NO: 656650 - RNA, 22 nt, Human
aauucaguaaucauuaaugaug

SEQ ID NO: 656651 - RNA, 22 nt, Human
gagguggcuuagucucuggaca

SEQ ID NO: 656652 - RNA, 22 nt, Human
ugcccaaggauccauuggcugg

SEQ ID NO: 656653 - RNA, 22 nt, Human
uguggccagcagguggcugugu

SEQ ID NO: 656654 - RNA, 22 nt, Human
uccuuggggacgcugacaucgu

SEQ ID NO: 656655 - RNA, 22 nt, Human
gaagggaaggaaagaaccagca

SEQ ID NO: 656656 - RNA, 22 nt, Human
ucccaggagcaccuuuugagcc

SEQ ID NO: 656657 - RNA, 22 nt, Human
gcgaaaaauguguaaauauguu

SEQ ID NO: 656658 - RNA, 22 nt, Human
ugagguaguuuguuguacagua

SEQ ID NO: 656659 - RNA, 22 nt, Human
acucagaaugacugaugcugug

SEQ ID NO: 656660 - RNA, 22 nt, Human
agaucauaugaaaaauuucaag

SEQ ID NO: 656661 - RNA, 22 nt, Human
cuuucccacgcaguggaugaga

SEQ ID NO: 656662 - RNA, 22 nt, Human
uguacaguauugguguuaguag

SEQ ID NO: 656663 - RNA, 22 nt, Human
gaguaaggcugcugauggagug

SEQ ID NO: 656664 - RNA, 22 nt, Human
ucuuccaggcccugccacagcu

SEQ ID NO: 656665 - RNA, 22 nt, Human
ugcagggaagcaaggguggcuc

SEQ ID NO: 656666 - RNA, 22 nt, Human
uuugacauugaaagcagaaucg

SEQ ID NO: 656667 - RNA, 22 nt, Human
guugaauaucguguucuuguuu

SEQ ID NO: 656668 - RNA, 22 nt, Human
aacagauaauuucuaaguuacu

SEQ ID NO: 656669 - RNA, 22 nt, Human
uuacuuuccagcucuagcuuca

SEQ ID NO: 656670 - RNA, 23 nt, Human
gcuguacaggaaccaguuuggag

SEQ ID NO: 656671 - RNA, 22 nt, Human
auucccacuagcucuuuauaga

SEQ ID NO: 656672 - RNA, 22 nt, Human
cauguaauccuggggagaugaa

SEQ ID NO: 656673 - RNA, 22 nt, Human
agcugggacucaacugucuggg

SEQ ID NO: 656674 - RNA, 22 nt, Human
agcugcugugugcucaggcagg

SEQ ID NO: 656675 - RNA, 22 nt, Human
guguuuaauagguagcugaauc

SEQ ID NO: 656676 - RNA, 22 nt, Human
uccugggcuuaguggcuagguc

SEQ ID NO: 656677 - RNA, 20 nt, Human
cugggaggucuuccaaauca

SEQ ID NO: 656678 - RNA, 22 nt, Human
caggcacacccacuggugcaga

SEQ ID NO: 656679 - RNA, 22 nt, Human
gcuguauuuauuuucuaggguu

SEQ ID NO: 656680 - RNA, 22 nt, Human
aagaaaguggguaauaugauuu

SEQ ID NO: 656681 - RNA, 22 nt, Human
gaugucuuucugugugccuaga

SEQ ID NO: 656682 - RNA, 22 nt, Human
caguuucuacgaaggucaaccc

SEQ ID NO: 656683 - RNA, 19 nt, Human
cauggcugcugcuugggag

SEQ ID NO: 656684 - RNA, 18 nt, Human
ggacaggagacaugggug

SEQ ID NO: 656685 - RNA, 22 nt, Human
caugccauuuacuuggaggaga

SEQ ID NO: 656686 - RNA, 18 nt, Human
ucagcuggggcugcagcc

SEQ ID NO: 656687 - RNA, 22 nt, Human
ggaagaguaacaggagguggaa

SEQ ID NO: 656688 - RNA, 22 nt, Human
cuguggcucagcacggggucag

SEQ ID NO: 656689 - RNA, 22 nt, Human
uaacagaaacagauaaguguaa

SEQ ID NO: 656690 - RNA, 22 nt, Human
gcaggagcuuugcuuacugcug

SEQ ID NO: 656691 - RNA, 22 nt, Human
ccugugcucccauagcuucugu

SEQ ID NO: 656692 - RNA, 22 nt, Human
uuugcagcaaggagagagcauu

SEQ ID NO: 656693 - RNA, 22 nt, Human
ucaguggaacugucugggugag

SEQ ID NO: 656694 - RNA, 22 nt, Human
uggagggauacaaagaugaaaa

SEQ ID NO: 656695 - RNA, 22 nt, Human
auuguauuuccagcuugaaugu

SEQ ID NO: 656696 - RNA, 22 nt, Human
gcagcaucuguacauagacgcu

SEQ ID NO: 656697 - RNA, 22 nt, Human
caggcagaaugaccgaccucgc

SEQ ID NO: 656698 - RNA, 22 nt, Human
uccgggagcugaacgucuugcg

SEQ ID NO: 656699 - RNA, 22 nt, Human
aaagcugcccuacacggaagca

SEQ ID NO: 656700 - RNA, 22 nt, Human
ucugccagguggggagaggcca

SEQ ID NO: 656701 - RNA, 22 nt, Human
ugcaggugucuccagggcaggu

SEQ ID NO: 656702 - RNA, 22 nt, Human
guggcagucggaagucaggaga

SEQ ID NO: 656703 - RNA, 22 nt, Human
uauuauugacauuuacuuggug

SEQ ID NO: 656704 - RNA, 22 nt, Human
ugcuguggauucagagaugaaa

SEQ ID NO: 656705 - RNA, 22 nt, Human
ccugccagcugugggccagccu

SEQ ID NO: 656706 - RNA, 22 nt, Human
uuuacagaucuguugauuuguu

SEQ ID NO: 656707 - RNA, 19 nt, Human
aggaauggaauuaauucug

SEQ ID NO: 656708 - RNA, 22 nt, Human
uaaaacuuugaaggugcucagu

SEQ ID NO: 656709 - RNA, 22 nt, Human
agcagggcugcggccccaccac

SEQ ID NO: 656710 - RNA, 22 nt, Human
uuaaacaguguuucaugugggg

SEQ ID NO: 656711 - RNA, 21 nt, Human
uccuugggcagugcccagcuu

SEQ ID NO: 656712 - RNA, 22 nt, Human
ccagcaucccugggguuggcca

SEQ ID NO: 656713 - RNA, 22 nt, Human
uggaccgcagggaugcccggca

SEQ ID NO: 656714 - RNA, 20 nt, Human
auugugaauacugcauaugu

SEQ ID NO: 656715 - RNA, 22 nt, Human
augucaccaguuuccaaauuug

SEQ ID NO: 656716 - RNA, 20 nt, Human
uccaauuuaagaauuuagag

SEQ ID NO: 656717 - RNA, 22 nt, Human
uccuuccagguccagggaugug

SEQ ID NO: 656718 - RNA, 20 nt, Human
auugacagaaaguguucacc

SEQ ID NO: 656719 - RNA, 22 nt, Human
augucugauaaauaaugcauaa

SEQ ID NO: 656720 - RNA, 22 nt, Human
cauguacaguuuuucuguccug

SEQ ID NO: 656721 - RNA, 22 nt, Human
ggaaagaggauaguggguaggu

SEQ ID NO: 656722 - RNA, 22 nt, Human
ugcaggggcuugucugggccug

SEQ ID NO: 656723 - RNA, 22 nt, Human
gagcccugugaggaaagagggu

SEQ ID NO: 656724 - RNA, 22 nt, Human
uucagugucacaagagcaagcc

SEQ ID NO: 656725 - RNA, 22 nt, Human
gugcauauguguguauacaaac

SEQ ID NO: 656726 - RNA, 22 nt, Human
caauuuuuuccaugcucuuaca

SEQ ID NO: 656727 - RNA, 20 nt, Human
ugucugugccacggcacucc

SEQ ID NO: 656728 - RNA, 22 nt, Human
gugcuuccuccuuaaacuguca

SEQ ID NO: 656729 - RNA, 22 nt, Human
auggaaaaggcugauuucauua

SEQ ID NO: 656730 - RNA, 22 nt, Human
aaggcugagggcuguaccuggc

SEQ ID NO: 656731 - RNA, 21 nt, Human
ugauugauauuugcaaacaga

SEQ ID NO: 656732 - RNA, 22 nt, Human
cugcugccauuagggcacagac

SEQ ID NO: 656733 - RNA, 22 nt, Human
cuccacagguguacuguaccuu

SEQ ID NO: 656734 - RNA, 22 nt, Human
uaaauguauaggcacuaaaccu

SEQ ID NO: 656735 - RNA, 22 nt, Human
ugcccuggaaccaucuacaguc

SEQ ID NO: 656736 - RNA, 22 nt, Human
cuggcugcaggaugaggcugcc

SEQ ID NO: 656737 - RNA, 22 nt, Human
ggcuuccuuucacuacccucag

SEQ ID NO: 656738 - RNA, 22 nt, Human
ucugggcuuggguagaaaucac

SEQ ID NO: 656739 - RNA, 22 nt, Human
accaggcugugaagugagacua

SEQ ID NO: 656740 - RNA, 22 nt, Human
cuggcucugaccgcgcuggccu

SEQ ID NO: 656741 - RNA, 21 nt, Human
ccuucuccacagggucuccgg

SEQ ID NO: 656742 - RNA, 22 nt, Human
uuauuguuagugagacuguaga

SEQ ID NO: 656743 - RNA, 22 nt, Human
aaucacaggcauagauugcucc

SEQ ID NO: 656744 - RNA, 22 nt, Human
cugggcagcuccauaccaccca

SEQ ID NO: 656745 - RNA, 22 nt, Human
auuuauugagccuuuccuaugu

SEQ ID NO: 656746 - RNA, 23 nt, Human
acuuuauccuauaucuuuguucu

SEQ ID NO: 656747 - RNA, 20 nt, Human
gggaggcgagggcugagcag

SEQ ID NO: 656748 - RNA, 22 nt, Human
ucugcauggagaggagaugcua

SEQ ID NO: 656749 - RNA, 22 nt, Human
auagaauuugcacuaaaucugc

SEQ ID NO: 656750 - RNA, 22 nt, Human
aaaaaccauugucuucagucuc

SEQ ID NO: 656751 - RNA, 22 nt, Human
ccucuggggugagugggccacu

SEQ ID NO: 656752 - RNA, 22 nt, Human
uguauaagccuagugaaauuuc

SEQ ID NO: 656753 - RNA, 22 nt, Human
guacacuauuaaaccugcucau

SEQ ID NO: 656754 - RNA, 22 nt, Human
acauucugugagucauguuuua

SEQ ID NO: 656755 - RNA, 22 nt, Human
ucugaggcuauguucaggcuaa

SEQ ID NO: 656756 - RNA, 22 nt, Human
ucaguguuacauuauauagaac

SEQ ID NO: 656757 - RNA, 19 nt, Human
acauagcuggcuacacugu

SEQ ID NO: 656758 - RNA, 22 nt, Human
aagagucauagagacauugauu

SEQ ID NO: 656759 - RNA, 22 nt, Human
uuaauuuauacauaaucacagg

SEQ ID NO: 656760 - RNA, 22 nt, Human
ucuguuuaugugucuaaauaaa

SEQ ID NO: 656761 - RNA, 22 nt, Human
uccaggcauguugggaagauga

SEQ ID NO: 656762 - RNA, 22 nt, Human
guccugagcauuaagcaauugu

SEQ ID NO: 656763 - RNA, 22 nt, Human
gagguggaaggcaggaacaaau

SEQ ID NO: 656764 - RNA, 22 nt, Human
gcagaggacagggauuuagauu

SEQ ID NO: 656765 - RNA, 22 nt, Human
caugagaaugaagaagacuuaa

SEQ ID NO: 656766 - RNA, 22 nt, Human
gcagcaggcuuuucauaccuug

SEQ ID NO: 656767 - RNA, 22 nt, Human
cugaggcaugggaaguugggug

SEQ ID NO: 656768 - RNA, 22 nt, Human
ucauuucccuccuacaaagagg

SEQ ID NO: 656769 - RNA, 22 nt, Human
ccagcaggggaauauuuuuagg

SEQ ID NO: 656770 - RNA, 22 nt, Human
uuugaucagcaagauaaauaga

SEQ ID NO: 656771 - RNA, 22 nt, Human
guuauuagaagugaaggauugu

SEQ ID NO: 656772 - RNA, 20 nt, Human
aguaccuuuuguauguuacc

SEQ ID NO: 656773 - RNA, 22 nt, Human
ucacaggagaauguacuuacca

SEQ ID NO: 656774 - RNA, 22 nt, Human
cagcagcuuugccaagucagcc

SEQ ID NO: 656775 - RNA, 22 nt, Human
uguagugugacauaggugucca

SEQ ID NO: 656776 - RNA, 22 nt, Human
aaaaucugguaauuugaaugug

SEQ ID NO: 656777 - RNA, 21 nt, Human
aggcucccagaaaugggcauc

SEQ ID NO: 656778 - RNA, 20 nt, Human
ucucagcauaagaacccuuc

SEQ ID NO: 656779 - RNA, 22 nt, Human
gcucaggccuggcccaugggac

SEQ ID NO: 656780 - RNA, 22 nt, Human
uuguggcucuugaggcucucgu

SEQ ID NO: 656781 - RNA, 22 nt, Human
cccagccucuggauucugcccu

SEQ ID NO: 656782 - RNA, 22 nt, Human
uucaggagaaaguucaguacuu

SEQ ID NO: 656783 - RNA, 22 nt, Human
uucuccucacugcagccuuuca

SEQ ID NO: 656784 - RNA, 22 nt, Human
uuugagcuaugggcuuggauuu

SEQ ID NO: 656785 - RNA, 22 nt, Human
cagugccauauugaaagacauu

SEQ ID NO: 656786 - RNA, 21 nt, Human
guuauacauucuauggauuug

SEQ ID NO: 656787 - RNA, 22 nt, Human
ggcuggaaugcaacuguguguu

SEQ ID NO: 656788 - RNA, 23 nt, Human
uggacaggacccccuucggaccc

SEQ ID NO: 656789 - RNA, 22 nt, Human
aguccgccugcugccguggcag

SEQ ID NO: 656790 - RNA, 22 nt, Human
agccuccaaaugucaggucccg

SEQ ID NO: 656791 - RNA, 22 nt, Human
auauaaagaaguggaaaaugag

SEQ ID NO: 656792 - RNA, 22 nt, Human
gagguucaguccugcucuguca

SEQ ID NO: 656793 - RNA, 23 nt, Human
aacuugcuguaaaguucuaggca

SEQ ID NO: 656794 - RNA, 22 nt, Human
uuggaaggagucuuuggggaug

SEQ ID NO: 656795 - RNA, 22 nt, Human
ucugugccaagcuuauaucugu

SEQ ID NO: 656796 - RNA, 22 nt, Human
aaauggcaauuuaguuuauuua

SEQ ID NO: 656797 - RNA, 22 nt, Human
guuucucaaauuauuucagcuu

SEQ ID NO: 656798 - RNA, 22 nt, Human
cuguccauggugcuggacgguc

SEQ ID NO: 656799 - RNA, 22 nt, Human
guaaauauaaaugcuagcugcc

SEQ ID NO: 656800 - RNA, 22 nt, Human
accgugucugacacuuugggcg

SEQ ID NO: 656801 - RNA, 22 nt, Human
gggcggcgucggcgaggccauc

SEQ ID NO: 656802 - RNA, 22 nt, Human
gugcaaagugcauggggaaggg

SEQ ID NO: 656803 - RNA, 22 nt, Human
aagauggaguaguguaaugguu

SEQ ID NO: 656804 - RNA, 23 nt, Human
aaugauuucaugaugauagcagc

SEQ ID NO: 656805 - RNA, 22 nt, Human
aggauccuccuuagaaaagacc

SEQ ID NO: 656806 - RNA, 23 nt, Human
uggacagcagcagcagugucacc

SEQ ID NO: 656807 - RNA, 22 nt, Human
ggacaacauguuuuaauuaagg

SEQ ID NO: 656808 - RNA, 22 nt, Human
uaugaguucaguuaucuuaagu

SEQ ID NO: 656809 - RNA, 22 nt, Human
uucugcauccuaugaucgcaua

SEQ ID NO: 656810 - RNA, 22 nt, Human
aaaugauggaaaugaggcugaa

SEQ ID NO: 656811 - RNA, 22 nt, Human
gccuggggucucugacucacag

SEQ ID NO: 656812 - RNA, 22 nt, Human
caggcccuggcagggcugaguc

SEQ ID NO: 656813 - RNA, 19 nt, Human
uauauuugagugugcaugc

SEQ ID NO: 656814 - RNA, 22 nt, Human
gcaaaauuuacacuccuucuuc

SEQ ID NO: 656815 - RNA, 22 nt, Human
guaaacauuacugugcuguaua

SEQ ID NO: 656816 - RNA, 22 nt, Human
gcugccacuuggucaugucaug

SEQ ID NO: 656817 - RNA, 22 nt, Human
aucaguauauuccuuggucuuu

SEQ ID NO: 656818 - RNA, 22 nt, Human
uucacaggaggguggaugcaug

SEQ ID NO: 656819 - RNA, 20 nt, Human
aggcaguuagaaggagauga

SEQ ID NO: 656820 - RNA, 22 nt, Human
aguauuuagcugacucgcuaca

SEQ ID NO: 656821 - RNA, 22 nt, Human
aagaagguguggaaagaugcuc

SEQ ID NO: 656822 - RNA, 22 nt, Human
cccaggucuaugccagcucuga

SEQ ID NO: 656823 - RNA, 22 nt, Human
acccuggcccauugcugugccu

SEQ ID NO: 656824 - RNA, 22 nt, Human
aggcuggggaauugaauuugcu

SEQ ID NO: 656825 - RNA, 22 nt, Human
aaucccuacuagagcauaccgu

SEQ ID NO: 656826 - RNA, 22 nt, Human
agccagugccagucaugccugc

SEQ ID NO: 656827 - RNA, 22 nt, Human
acauucuauuucaucaugucua

SEQ ID NO: 656828 - RNA, 21 nt, Human
ggugggcacaggagagcagag

SEQ ID NO: 656829 - RNA, 22 nt, Human
augcacaugaggcaagcaaaau

SEQ ID NO: 656830 - RNA, 22 nt, Human
ggcacugggugagggucacugg

SEQ ID NO: 656831 - RNA, 22 nt, Human
uaaagucagggagauugaggcu

SEQ ID NO: 656832 - RNA, 22 nt, Human
uaauaauuaguuauugaucgug

SEQ ID NO: 656833 - RNA, 22 nt, Human
uucccaugccuggccccuaucc

SEQ ID NO: 656834 - RNA, 22 nt, Human
ccacaggacacaacugcugacc

SEQ ID NO: 656835 - RNA, 22 nt, Human
aggcagcuucugauuagcagcg

SEQ ID NO: 656836 - RNA, 22 nt, Human
aggucagaugggagaugggaug

SEQ ID NO: 656837 - RNA, 22 nt, Human
cacucucagcauaaugaaugug

SEQ ID NO: 656838 - RNA, 22 nt, Human
ucaggcuguggcuucaguucuu

SEQ ID NO: 656839 - RNA, 22 nt, Human
cuuggagagagccucagcuguu

SEQ ID NO: 656840 - RNA, 22 nt, Human
cuauuuguacagcauuaguaau

SEQ ID NO: 656841 - RNA, 22 nt, Human
acccucugagaggcacacuuug

SEQ ID NO: 656842 - RNA, 20 nt, Human
uggaggcagagccagaggga

SEQ ID NO: 656843 - RNA, 22 nt, Human
auuucccagggccugggauuug

SEQ ID NO: 656844 - RNA, 20 nt, Human
aauugaagcagaggagaggc

SEQ ID NO: 656845 - RNA, 23 nt, Human
agguucucuuaucaucucugccc

SEQ ID NO: 656846 - RNA, 22 nt, Human
gacccuggaguuaguccugugu

SEQ ID NO: 656847 - RNA, 22 nt, Human
gaggggcuggguagggcaaccc

SEQ ID NO: 656848 - RNA, 22 nt, Human
ugccuccaggaggggcagcucu

SEQ ID NO: 656849 - RNA, 22 nt, Human
caaagcaagggcugaagacucc

SEQ ID NO: 656850 - RNA, 19 nt, Human
augugcuugggccaugcua

SEQ ID NO: 656851 - RNA, 22 nt, Human
ggggcagccuccaggaaagcug

SEQ ID NO: 656852 - RNA, 22 nt, Human
agcauggacaguggcagcagug

SEQ ID NO: 656853 - RNA, 22 nt, Human
gacuguggcguagaugcuggga

SEQ ID NO: 656854 - RNA, 22 nt, Human
agaaaugaagagagucaagguu

SEQ ID NO: 656855 - RNA, 22 nt, Human
agucugcuuuugugaagagcug

SEQ ID NO: 656856 - RNA, 20 nt, Human
ccucucugaagaggucaucu

SEQ ID NO: 656857 - RNA, 22 nt, Human
agcugcccagcuaggaagaagg

SEQ ID NO: 656858 - RNA, 22 nt, Human
guguguccucaguaguggcaug

SEQ ID NO: 656859 - RNA, 20 nt, Human
aggucugaaugucagggcug

SEQ ID NO: 656860 - RNA, 22 nt, Human
guucuucaaagugacaacuaaa

SEQ ID NO: 656861 - RNA, 22 nt, Human
gcucccagcauugcuucccagg

SEQ ID NO: 656862 - RNA, 22 nt, Human
cuggugggagcagcaggcagcu

SEQ ID NO: 656863 - RNA, 22 nt, Human
ccagcugcagguguuccagaug

SEQ ID NO: 656864 - RNA, 22 nt, Human
cugccucacauuggcuguguga

SEQ ID NO: 656865 - RNA, 22 nt, Human
agacuguaauuuguggccuccu

SEQ ID NO: 656866 - RNA, 22 nt, Human
uucugcuuuuagcuaaacuaua

SEQ ID NO: 656867 - RNA, 22 nt, Human
ucaguggauauuucuguggcug

SEQ ID NO: 656868 - RNA, 22 nt, Human
uguuuuguuagcacucugggaa

SEQ ID NO: 656869 - RNA, 22 nt, Human
acuggcugaaguuuacuuuuug

SEQ ID NO: 656870 - RNA, 22 nt, Human
acagggcuuaguggaaauuuuu

SEQ ID NO: 656871 - RNA, 22 nt, Human
uuucuuuccaugagccuaugua

SEQ ID NO: 656872 - RNA, 22 nt, Human
cucugggaugaggccuaggcac

SEQ ID NO: 656873 - RNA, 22 nt, Human
gagagaagaacaaugucauuca

SEQ ID NO: 656874 - RNA, 22 nt, Human
ggaggccauaguuugggaguca

SEQ ID NO: 656875 - RNA, 22 nt, Human
gcaaauggagugaagagcugga

SEQ ID NO: 656876 - RNA, 17 nt, Human
gagagcccucagauguc

SEQ ID NO: 656877 - RNA, 22 nt, Human
gucccaggcuccauggcagcca

SEQ ID NO: 656878 - RNA, 22 nt, Human
augcacagauccccaggacccu

SEQ ID NO: 656879 - RNA, 22 nt, Human
aaaugucagaggaacauauuga

SEQ ID NO: 656880 - RNA, 22 nt, Human
uggcccuuuugugaaguggcca

SEQ ID NO: 656881 - RNA, 22 nt, Human
agaggccauggggcauuuuuca

SEQ ID NO: 656882 - RNA, 22 nt, Human
aauuccaggggguaccauucau

SEQ ID NO: 656883 - RNA, 22 nt, Human
cccagcauuucugggcugcacu

SEQ ID NO: 656884 - RNA, 20 nt, Human
gcacccagcuucuuguucua

SEQ ID NO: 656885 - RNA, 22 nt, Human
acaggaaaugaaaugguaucua

SEQ ID NO: 656886 - RNA, 22 nt, Human
gcauuccugagaaugcagagug

SEQ ID NO: 656887 - RNA, 22 nt, Human
uucuuggcaaugguauucaucc

SEQ ID NO: 656888 - RNA, 22 nt, Human
ggcuuucuaugaacucaaaggc

SEQ ID NO: 656889 - RNA, 22 nt, Human
gcuggcuuuaucgucagacucc

SEQ ID NO: 656890 - RNA, 22 nt, Human
caugcauaugucaaaaaagcua

SEQ ID NO: 656891 - RNA, 22 nt, Human
gagaaagaaagggaaguuuguu

SEQ ID NO: 656892 - RNA, 22 nt, Human
uuuaauggcaagaaggcugcag

SEQ ID NO: 656893 - RNA, 23 nt, Human
gcugucugucaucucugcgggag

SEQ ID NO: 656894 - RNA, 20 nt, Human
cucugggucgagacagacuu

SEQ ID NO: 656895 - RNA, 22 nt, Human
caccagcuacuccagggccgug

SEQ ID NO: 656896 - RNA, 22 nt, Human
gcagcagcagggagucugacuu

SEQ ID NO: 656897 - RNA, 22 nt, Human
uucagagucagggaucucagag

SEQ ID NO: 656898 - RNA, 18 nt, Human
uaagucauuugaaaugcc

SEQ ID NO: 656899 - RNA, 22 nt, Human
uuccagagaaaagguuuauuuc

SEQ ID NO: 656900 - RNA, 22 nt, Human
gcagggccuuagcagcggcugc

SEQ ID NO: 656901 - RNA, 22 nt, Human
caggaacaggguguccuggcag

SEQ ID NO: 656902 - RNA, 22 nt, Human
aaucccagcuacucaggaaguu

SEQ ID NO: 656903 - RNA, 22 nt, Human
acagucuggcagguguugaaag

SEQ ID NO: 656904 - RNA, 22 nt, Human
uacagcaugaucacaauggaaa

SEQ ID NO: 656905 - RNA, 22 nt, Human
guggcuugaccaucccugcuac

SEQ ID NO: 656906 - RNA, 22 nt, Human
cuguguagucagguggucccac

SEQ ID NO: 656907 - RNA, 22 nt, Human
gcugcccaaugguagugucuuu

SEQ ID NO: 656908 - RNA, 22 nt, Human
uaagaggcagcauuccucgccu

SEQ ID NO: 656909 - RNA, 22 nt, Human
agacaaggcccccuugggcucu

SEQ ID NO: 656910 - RNA, 22 nt, Human
ugaugagggggaacagagauuu

SEQ ID NO: 656911 - RNA, 22 nt, Human
acugagaaauuuccagacuugc

SEQ ID NO: 656912 - RNA, 22 nt, Human
uagaacaugcucauguauaaau

SEQ ID NO: 656913 - RNA, 22 nt, Human
gacagaggcuggagcaccuccu

SEQ ID NO: 656914 - RNA, 22 nt, Human
cugagaauaaagccagcaggag

SEQ ID NO: 656915 - RNA, 22 nt, Human
uuucaguuagcugagacccagg

SEQ ID NO: 656916 - RNA, 22 nt, Human
augaaugggucauuauuugauc

SEQ ID NO: 656917 - RNA, 21 nt, Human
uggcauggagguagcagugug

SEQ ID NO: 656918 - RNA, 22 nt, Human
uacacauguuuggcaaguaugu

SEQ ID NO: 656919 - RNA, 22 nt, Human
augugcaacuucagcagaaagg

SEQ ID NO: 656920 - RNA, 22 nt, Human
agggucuaucucucugccuuug

SEQ ID NO: 656921 - RNA, 22 nt, Human
acugagguuauugcaauaaaau

SEQ ID NO: 656922 - RNA, 16 nt, Human
ugggcagaugagaaga

SEQ ID NO: 656923 - RNA, 22 nt, Human
cacaggccaauacccucucucu

SEQ ID NO: 656924 - RNA, 22 nt, Human
ugcauuggguugacauacuaaa

SEQ ID NO: 656925 - RNA, 23 nt, Human
accagcugcccugaacuuugugc

SEQ ID NO: 656926 - RNA, 21 nt, Human
agaaaaaccagcauguuuuca

SEQ ID NO: 656927 - RNA, 22 nt, Human
gugccugggguugagcuaugaa

SEQ ID NO: 656928 - RNA, 22 nt, Human
augaggcagucuggccugaggg

SEQ ID NO: 656929 - RNA, 22 nt, Human
ccaggcucugugugggcuagag

SEQ ID NO: 656930 - RNA, 22 nt, Human
uugagaaaccuggcaguagaga

SEQ ID NO: 656931 - RNA, 22 nt, Human
ccugcugugaaacuggcauaug

SEQ ID NO: 656932 - RNA, 22 nt, Human
gcuccuguuuguuuguuccuga

SEQ ID NO: 656933 - RNA, 22 nt, Human
aaaucagaguagaauugagcca

SEQ ID NO: 656934 - RNA, 22 nt, Human
caagacauugauuuuguacaga

SEQ ID NO: 656935 - RNA, 22 nt, Human
agcugguggauuaugcuguaca

SEQ ID NO: 656936 - RNA, 22 nt, Human
uucuucugacacugaugcugua

SEQ ID NO: 656937 - RNA, 22 nt, Human
cacaauuuggacuucacugguu

SEQ ID NO: 656938 - RNA, 22 nt, Human
gugccuuccccgguggucuguu

SEQ ID NO: 656939 - RNA, 19 nt, Human
cuuccccuguuaccucacu

SEQ ID NO: 656940 - RNA, 21 nt, Human
uuguguuuccccagucacuuu

SEQ ID NO: 656941 - RNA, 22 nt, Human
ggcccucccugagccagguggg

SEQ ID NO: 656942 - RNA, 22 nt, Human
cauuuaugauaguaauaugaaa

SEQ ID NO: 656943 - RNA, 22 nt, Human
gagggugcagcugggccccacg

SEQ ID NO: 656944 - RNA, 23 nt, Human
caggaagcagaugggguagaaga

SEQ ID NO: 656945 - RNA, 22 nt, Human
uaacaguguggacuugagaucu

SEQ ID NO: 656946 - RNA, 19 nt, Human
ggagucugagcccagguau

SEQ ID NO: 656947 - RNA, 19 nt, Human
ggggccugugauggucaca

SEQ ID NO: 656948 - RNA, 22 nt, Human
auagaaacagggaagcaaagca

SEQ ID NO: 656949 - RNA, 22 nt, Human
ugaaaaggguagaucccuaagu

SEQ ID NO: 656950 - RNA, 22 nt, Human
cugaggcuaaccucgagagaca

SEQ ID NO: 656951 - RNA, 22 nt, Human
cugcuggugaugucugggcaug

SEQ ID NO: 656952 - RNA, 22 nt, Human
caucuucaggggcuacaucugu

SEQ ID NO: 656953 - RNA, 22 nt, Human
aauauaauuuuauuccuagagu

SEQ ID NO: 656954 - RNA, 22 nt, Human
uucaguguauauuuuuugagua

SEQ ID NO: 656955 - RNA, 22 nt, Human
aaguccaucucugccccacaca

SEQ ID NO: 656956 - RNA, 22 nt, Human
ugagcagaggaggcugccaacu

SEQ ID NO: 656957 - RNA, 22 nt, Human
ccugggcagugcuggaguugaa

SEQ ID NO: 656958 - RNA, 22 nt, Human
ccugggcucacagccaaggcuc

SEQ ID NO: 656959 - RNA, 22 nt, Human
ggaccaugaggagaugggccuc

SEQ ID NO: 656960 - RNA, 22 nt, Human
cugagccauaagggaggcuggg

SEQ ID NO: 656961 - RNA, 22 nt, Human
aauccuguagauucuaauuccu

SEQ ID NO: 656962 - RNA, 23 nt, Human
ccacuagcaccuguucaacuucu

SEQ ID NO: 656963 - RNA, 22 nt, Human
uuuauucagcagcagcaguggu

SEQ ID NO: 656964 - RNA, 22 nt, Human
gccucaguguccuccuccaugu

SEQ ID NO: 656965 - RNA, 22 nt, Human
cugaaauauuuuaaucucagga

SEQ ID NO: 656966 - RNA, 22 nt, Human
ggcuccuguccccucagcugcu

SEQ ID NO: 656967 - RNA, 22 nt, Human
cugacagcuguugcagugaaug

SEQ ID NO: 656968 - RNA, 22 nt, Human
gaaaguuuucucacacaguaau

SEQ ID NO: 656969 - RNA, 18 nt, Human
gacacauccccaggccuc

SEQ ID NO: 656970 - RNA, 22 nt, Human
cuccugcaagccuccccaagca

SEQ ID NO: 656971 - RNA, 22 nt, Human
cucccauugcuucaaagauccu

SEQ ID NO: 656972 - RNA, 22 nt, Human
uggccagugggguugagcagga

SEQ ID NO: 656973 - RNA, 22 nt, Human
ucacauuugauaaugcccauug

SEQ ID NO: 656974 - RNA, 22 nt, Human
agaugcaaccucugcuuaacaa

SEQ ID NO: 656975 - RNA, 22 nt, Human
uacacaugcauguacuccagga

SEQ ID NO: 656976 - RNA, 22 nt, Human
aauguguagcauuuaaugcagu

SEQ ID NO: 656977 - RNA, 22 nt, Human
ucagcaaccaggggcacagucc

SEQ ID NO: 656978 - RNA, 22 nt, Human
ugggggagagaggcauucuuuc

SEQ ID NO: 656979 - RNA, 20 nt, Human
uacauuguagaaauauucaa

SEQ ID NO: 656980 - RNA, 22 nt, Human
acugucaucuuguaagcaaugu

SEQ ID NO: 656981 - RNA, 22 nt, Human
aguggggaagagcaugggcccu

SEQ ID NO: 656982 - RNA, 22 nt, Human
cagaggcacaagaaagcaaggc

SEQ ID NO: 656983 - RNA, 22 nt, Human
ugccauuucucaggcuauuuca

SEQ ID NO: 656984 - RNA, 16 nt, Human
ggcuccagaauagcga

SEQ ID NO: 656985 - RNA, 21 nt, Human
uuucauugaaugagauaaggu

SEQ ID NO: 656986 - RNA, 22 nt, Human
ugagagcuugaguaucacuggc

SEQ ID NO: 656987 - RNA, 22 nt, Human
ggucucaucuuucagcgucgag

SEQ ID NO: 656988 - RNA, 22 nt, Human
uuggggucccacaggcugccug

SEQ ID NO: 656989 - RNA, 22 nt, Human
cacuugaaugaaagagacuccu

SEQ ID NO: 656990 - RNA, 22 nt, Human
ugaaaaaacaaguuggcccauu

SEQ ID NO: 656991 - RNA, 22 nt, Human
uucagaguacacagagaucuuc

SEQ ID NO: 656992 - RNA, 22 nt, Human
uugcugaaguuaaugcuugcaa

SEQ ID NO: 656993 - RNA, 22 nt, Human
auaguggggacaggaugguugg

SEQ ID NO: 656994 - RNA, 22 nt, Human
cagacagggaccucgcuccaga

SEQ ID NO: 656995 - RNA, 21 nt, Human
acucaggagacuaacuauguc

SEQ ID NO: 656996 - RNA, 22 nt, Human
cucgcaagucgcuccgguuacu

SEQ ID NO: 656997 - RNA, 22 nt, Human
uucuaacuuuugaggcaaugug

SEQ ID NO: 656998 - RNA, 22 nt, Human
auugucucugaauuuccagcug

SEQ ID NO: 656999 - RNA, 22 nt, Human
uucccacaguucagaacaaagg

SEQ ID NO: 657000 - RNA, 22 nt, Human
cucacagauacggcuauuccug

SEQ ID NO: 657001 - RNA, 22 nt, Human
uccaaguccauuaugguggucu

SEQ ID NO: 657002 - RNA, 22 nt, Human
ugaaaucauugccaaguauuga

SEQ ID NO: 657003 - RNA, 22 nt, Human
cauguacaaaaggcaaaugccu

SEQ ID NO: 657004 - RNA, 22 nt, Human
aucuuacauucccucaccauuu

SEQ ID NO: 657005 - RNA, 22 nt, Human
cagaggcugacccugcuguugu

SEQ ID NO: 657006 - RNA, 22 nt, Human
ugagacaauaaggcugagaagc

SEQ ID NO: 657007 - RNA, 22 nt, Human
uuauuuauuguguaccuacugu

SEQ ID NO: 657008 - RNA, 22 nt, Human
augugugcauguuagagagagu

SEQ ID NO: 657009 - RNA, 22 nt, Human
gcugugugacugagagccuggc

SEQ ID NO: 657010 - RNA, 22 nt, Human
cccuuagcuccaagggguuugg

SEQ ID NO: 657011 - RNA, 22 nt, Human
aauuuucugaugaugaagcacg

SEQ ID NO: 657012 - RNA, 19 nt, Human
acaguuugggaaaugagca

SEQ ID NO: 657013 - RNA, 22 nt, Human
gcagggcagugugucugugggg

SEQ ID NO: 657014 - RNA, 22 nt, Human
agcaguggugugaggagggcuc

SEQ ID NO: 657015 - RNA, 22 nt, Human
guccccucaaaauucauauguu

SEQ ID NO: 657016 - RNA, 22 nt, Human
gcugaauagaagucuucaaagg

SEQ ID NO: 657017 - RNA, 22 nt, Human
aggaggugacagccugcaucug

SEQ ID NO: 657018 - RNA, 22 nt, Human
acagcaaaggacgaacacucug

SEQ ID NO: 657019 - RNA, 22 nt, Human
ccagcucuaaacggcucugugg

SEQ ID NO: 657020 - RNA, 18 nt, Human
uccaggccugaagugucc

SEQ ID NO: 657021 - RNA, 22 nt, Human
cccacaggcuagggguagggca

SEQ ID NO: 657022 - RNA, 22 nt, Human
gccacacuuauucucaugcaca

SEQ ID NO: 657023 - RNA, 19 nt, Human
ucagcucuggggucagugg

SEQ ID NO: 657024 - RNA, 20 nt, Human
ggcagaccugcugagagccc

SEQ ID NO: 657025 - RNA, 22 nt, Human
uguuauuuaucugagcauuuau

SEQ ID NO: 657026 - RNA, 22 nt, Human
ccugggccuggcgggucggcuc

SEQ ID NO: 657027 - RNA, 22 nt, Human
auccaucuuuccugcugaacug

SEQ ID NO: 657028 - RNA, 22 nt, Human
uucugugaaucuuuuuucccac

SEQ ID NO: 657029 - RNA, 22 nt, Human
uugaaacugcuuauugaauuug

SEQ ID NO: 657030 - RNA, 20 nt, Human
aaacacagccucucuuuaca

SEQ ID NO: 657031 - RNA, 22 nt, Human
ucagaugagugcuuucagcugc

SEQ ID NO: 657032 - RNA, 22 nt, Human
gauaauuauaggcuaagccacu

SEQ ID NO: 657033 - RNA, 22 nt, Human
cuuucucuucgaaaaccugccc

SEQ ID NO: 657034 - RNA, 22 nt, Human
cagcauuuggugaucaucuuaa

SEQ ID NO: 657035 - RNA, 22 nt, Human
uuuguagaggguaauugacaga

SEQ ID NO: 657036 - RNA, 22 nt, Human
agagugaagguugacacuucac

SEQ ID NO: 657037 - RNA, 17 nt, Human
agguggcugcugcgccu

SEQ ID NO: 657038 - RNA, 22 nt, Human
agagcuuuuacuuacauucuau

SEQ ID NO: 657039 - RNA, 23 nt, Human
ccagcgcucacucagagcauguu

SEQ ID NO: 657040 - RNA, 22 nt, Human
uacuuuauucaggaaggcuggu

SEQ ID NO: 657041 - RNA, 22 nt, Human
guggugcauccuugaguaagcu

SEQ ID NO: 657042 - RNA, 22 nt, Human
guacauuucucccaacacuaaa

SEQ ID NO: 657043 - RNA, 22 nt, Human
gacaauaagaaaagaggaggca

SEQ ID NO: 657044 - RNA, 22 nt, Human
guccucuguguaggcugcagac

SEQ ID NO: 657045 - RNA, 22 nt, Human
ugcauuggucauuuagaaaaua

SEQ ID NO: 657046 - RNA, 22 nt, Human
uaggccaaggacaguaaggaca

SEQ ID NO: 657047 - RNA, 22 nt, Human
ccacaagugaaguacaccugcc

SEQ ID NO: 657048 - RNA, 22 nt, Human
ugcuugucucagauaaaacuau

SEQ ID NO: 657049 - RNA, 22 nt, Human
acaucauuguccguugucauga

SEQ ID NO: 657050 - RNA, 22 nt, Human
ggaggaagagguuguucucuca

SEQ ID NO: 657051 - RNA, 22 nt, Human
uuuuaagcaaaagaauggugug

SEQ ID NO: 657052 - RNA, 22 nt, Human
ggcucugggcauagaaggaagc

SEQ ID NO: 657053 - RNA, 22 nt, Human
gaugucuucucaacuguagacc

SEQ ID NO: 657054 - RNA, 22 nt, Human
uuuguagacuaccaguaauugu

SEQ ID NO: 657055 - RNA, 19 nt, Human
aaaagucuauucaauuaca

SEQ ID NO: 657056 - RNA, 22 nt, Human
ccucagagcagcacccagauga

SEQ ID NO: 657057 - RNA, 22 nt, Human
aggggucuugggaguccuggcu

SEQ ID NO: 657058 - RNA, 22 nt, Human
gcugcuccagcugugcugcaga

SEQ ID NO: 657059 - RNA, 22 nt, Human
guggauggacaugggcaagagg

SEQ ID NO: 657060 - RNA, 22 nt, Human
ugaguucagauccuggcucugc

SEQ ID NO: 657061 - RNA, 22 nt, Human
agggccagaggcaccuugcagc

SEQ ID NO: 657062 - RNA, 22 nt, Human
caaaggacccauaauuaaaacc

SEQ ID NO: 657063 - RNA, 22 nt, Human
cggggccuagcugcacacccuc

SEQ ID NO: 657064 - RNA, 22 nt, Human
uccaccugggcaacagugccuc

SEQ ID NO: 657065 - RNA, 22 nt, Human
gugcagaggucacaaaagugaa

SEQ ID NO: 657066 - RNA, 22 nt, Human
ugaaugaguggauucugaguag

SEQ ID NO: 657067 - RNA, 22 nt, Human
cauuagcaggcacuaagaaggu

SEQ ID NO: 657068 - RNA, 22 nt, Human
ucuaaacacgucucuuugaaua

SEQ ID NO: 657069 - RNA, 22 nt, Human
caaggcuuagucagagggugcu

SEQ ID NO: 657070 - RNA, 22 nt, Human
augaggcaaggaucagguaagg

SEQ ID NO: 657071 - RNA, 22 nt, Human
uggaucaucuuaagaagugauu

SEQ ID NO: 657072 - RNA, 22 nt, Human
ggcuccuggaggcaccacuggu

SEQ ID NO: 657073 - RNA, 22 nt, Human
uauguuguggggugcaucaaaa

SEQ ID NO: 657074 - RNA, 22 nt, Human
uggaaagucucuuuugacugua

SEQ ID NO: 657075 - RNA, 22 nt, Human
agggcagcaauuugguuccugg

SEQ ID NO: 657076 - RNA, 22 nt, Human
uugacuuuacaguuuucuuagg

SEQ ID NO: 657077 - RNA, 19 nt, Human
auauagcauuauucaauuu

SEQ ID NO: 657078 - RNA, 22 nt, Human
agaauuagucacaauuauagga

SEQ ID NO: 657079 - RNA, 22 nt, Human
uccagagccuauauguucaacu

SEQ ID NO: 657080 - RNA, 21 nt, Human
caggccccaggccuggggugc

SEQ ID NO: 657081 - RNA, 22 nt, Human
uaaauugcauaaguacaaauga

SEQ ID NO: 657082 - RNA, 22 nt, Human
uccacugcagcuucugauggaa

SEQ ID NO: 657083 - RNA, 22 nt, Human
ucacuugauccuucccugaaau

SEQ ID NO: 657084 - RNA, 22 nt, Human
ggagcaugcgcucugugaccga

SEQ ID NO: 657085 - RNA, 22 nt, Human
gcucagagauggggaaugaaaa

SEQ ID NO: 657086 - RNA, 22 nt, Human
uuacuuuaagggugucuuauua

SEQ ID NO: 657087 - RNA, 22 nt, Human
cagcagaagugcauuugugauu

SEQ ID NO: 657088 - RNA, 22 nt, Human
gauauuuucagucuccuuucaa

SEQ ID NO: 657089 - RNA, 22 nt, Human
gccagggcucgcggucccucgu

SEQ ID NO: 657090 - RNA, 22 nt, Human
cagagcucagagcagggcacuc

SEQ ID NO: 657091 - RNA, 22 nt, Human
acuguguguuugucuagcacag

SEQ ID NO: 657092 - RNA, 22 nt, Human
ggcucuccacuauggaugagaa

SEQ ID NO: 657093 - RNA, 22 nt, Human
acacagagggcagaagauacau

SEQ ID NO: 657094 - RNA, 23 nt, Human
ucacagggcacuggcugggguug

SEQ ID NO: 657095 - RNA, 22 nt, Human
uggcuggucacaugguaggucu

SEQ ID NO: 657096 - RNA, 22 nt, Human
gugcuuccuagguaaguaggua

SEQ ID NO: 657097 - RNA, 22 nt, Human
auaggcaagcacaaagucagga

SEQ ID NO: 657098 - RNA, 22 nt, Human
uguuuuuaaaauguccugguua

SEQ ID NO: 657099 - RNA, 22 nt, Human
aggaaaggccuuugcauuuggu

SEQ ID NO: 657100 - RNA, 22 nt, Human
ucuggcaguuccuuguugauau

SEQ ID NO: 657101 - RNA, 22 nt, Human
aguuuauguaaaauuaguaaug

SEQ ID NO: 657102 - RNA, 22 nt, Human
cuggaagggggacagccacaca

SEQ ID NO: 657103 - RNA, 22 nt, Human
ccugugugcugaugacgacaga

SEQ ID NO: 657104 - RNA, 22 nt, Human
ccaggcuuuguaccaggcuuuc

SEQ ID NO: 657105 - RNA, 21 nt, Human
ucucacaauaugaugccagau

SEQ ID NO: 657106 - RNA, 20 nt, Human
ggaggguggaagaaagcaag

SEQ ID NO: 657107 - RNA, 22 nt, Human
cacuggugaguccagaagucau

SEQ ID NO: 657108 - RNA, 22 nt, Human
uucauagagcagcucacugaau

SEQ ID NO: 657109 - RNA, 23 nt, Human
ugugucugaggauauaugugcau

SEQ ID NO: 657110 - RNA, 22 nt, Human
auacauauaugguacuuccugg

SEQ ID NO: 657111 - RNA, 22 nt, Human
aaugccucuuggaagaagacuu

SEQ ID NO: 657112 - RNA, 22 nt, Human
gcugcuaagcguuucuguucca

SEQ ID NO: 657113 - RNA, 22 nt, Human
ugaugguugauuauaaaucagu

SEQ ID NO: 657114 - RNA, 22 nt, Human
ccaaggaguagagcaggaagcu

SEQ ID NO: 657115 - RNA, 23 nt, Human
auccacauuacaguaucauacaa

SEQ ID NO: 657116 - RNA, 22 nt, Human
agauuaugcuggcugcuacaag

SEQ ID NO: 657117 - RNA, 22 nt, Human
gacaucaggaagacaugagagg

SEQ ID NO: 657118 - RNA, 22 nt, Human
gcaaguuuagcuaacuggccca

SEQ ID NO: 657119 - RNA, 22 nt, Human
acagagcacugcccugugccgc

SEQ ID NO: 657120 - RNA, 21 nt, Human
auuaacuuguuaaccuaaagu

SEQ ID NO: 657121 - RNA, 22 nt, Human
cacugagccuugccagcuuggu

SEQ ID NO: 657122 - RNA, 22 nt, Human
aaacugcaggucaugacccauu

SEQ ID NO: 657123 - RNA, 22 nt, Human
ucaucaaaggauugcaugauuu

SEQ ID NO: 657124 - RNA, 23 nt, Human
aaauggcuuuagacgugccuuau

SEQ ID NO: 657125 - RNA, 22 nt, Human
caggagcucuuaaggaugugau

SEQ ID NO: 657126 - RNA, 22 nt, Human
ucaguugcuaugagaaauaaau

SEQ ID NO: 657127 - RNA, 22 nt, Human
ugaggaagggugugacggcacc

SEQ ID NO: 657128 - RNA, 22 nt, Human
gcccaagaucaguggggcagau

SEQ ID NO: 657129 - RNA, 22 nt, Human
uuccugcauggauugaggcuau

SEQ ID NO: 657130 - RNA, 22 nt, Human
aacaucucauggacuacauucu

SEQ ID NO: 657131 - RNA, 22 nt, Human
gcugccuguggcccuucugggu

SEQ ID NO: 657132 - RNA, 22 nt, Human
cagcuauugauaaauguugggg

SEQ ID NO: 657133 - RNA, 22 nt, Human
cuuuuccuauugauucuguuac

SEQ ID NO: 657134 - RNA, 21 nt, Human
cccaggaggagcuccggcucc

SEQ ID NO: 657135 - RNA, 22 nt, Human
ugccuggcugggcugcucaugg

SEQ ID NO: 657136 - RNA, 21 nt, Human
uccuccuccacuaggcuagcc

SEQ ID NO: 657137 - RNA, 22 nt, Human
acuuuaugcuaaacuuuacucu

SEQ ID NO: 657138 - RNA, 15 nt, Human
aaagugcacccaaua

SEQ ID NO: 657139 - RNA, 22 nt, Human
cagcaagagaggcagggcaaau

SEQ ID NO: 657140 - RNA, 17 nt, Human
gaagguuucucuuaggu

SEQ ID NO: 657141 - RNA, 21 nt, Human
gaccccagaccagcagacaca

SEQ ID NO: 657142 - RNA, 22 nt, Human
uccaggccacugcagaggcucu

SEQ ID NO: 657143 - RNA, 19 nt, Human
uccaaaggacccaccucca

SEQ ID NO: 657144 - RNA, 22 nt, Human
uucuccacccacucuuuuguug

SEQ ID NO: 657145 - RNA, 22 nt, Human
cagccucucuguaucucaggau

SEQ ID NO: 657146 - RNA, 22 nt, Human
cagcugucugaagcaggagucc

SEQ ID NO: 657147 - RNA, 22 nt, Human
aauuauacauugaacaaucuag

SEQ ID NO: 657148 - RNA, 22 nt, Human
cagcugaguaugcauucaagca

SEQ ID NO: 657149 - RNA, 21 nt, Human
auacagaacauugauccaaga

SEQ ID NO: 657150 - RNA, 22 nt, Human
cagcagccuggccccuccucgg

SEQ ID NO: 657151 - RNA, 22 nt, Human
ugcccugcggcuaucuagauga

SEQ ID NO: 657152 - RNA, 21 nt, Human
ccugagccuguuuauccagaa

SEQ ID NO: 657153 - RNA, 20 nt, Human
acugagguuagauaacaggu

SEQ ID NO: 657154 - RNA, 22 nt, Human
uuccuugaaugagucauggaaa

SEQ ID NO: 657155 - RNA, 22 nt, Human
aacugcaagaguaaaugucuag

SEQ ID NO: 657156 - RNA, 22 nt, Human
aucuuacacuguuggguuucuc

SEQ ID NO: 657157 - RNA, 22 nt, Human
gagagucuaggaaccucauaua

SEQ ID NO: 657158 - RNA, 22 nt, Human
auguggcuuucaugauuaagca

SEQ ID NO: 657159 - RNA, 22 nt, Human
ccugagcuccaguagcagccag

SEQ ID NO: 657160 - RNA, 22 nt, Human
uuagaaauacaagugagguuga

SEQ ID NO: 657161 - RNA, 22 nt, Human
uugugucuaugguuugagcauc

SEQ ID NO: 657162 - RNA, 22 nt, Human
agagccagccuucucagcuuac

SEQ ID NO: 657163 - RNA, 18 nt, Human
gcucugguuccuucaacc

SEQ ID NO: 657164 - RNA, 22 nt, Human
acuaacuugcugagugaccaug

SEQ ID NO: 657165 - RNA, 22 nt, Human
cugcagguuaggagcacuccuu

SEQ ID NO: 657166 - RNA, 16 nt, Human
ucacauacuuccuugc

SEQ ID NO: 657167 - RNA, 22 nt, Human
gcucucuggguggugggcaaca

SEQ ID NO: 657168 - RNA, 22 nt, Human
ucagcucuaaguuuuaugcaaa

SEQ ID NO: 657169 - RNA, 22 nt, Human
ugagagugauugguucgaaugu

SEQ ID NO: 657170 - RNA, 22 nt, Human
ucaaugaaagagcaugcauuuu

SEQ ID NO: 657171 - RNA, 22 nt, Human
cgcgguggcggccuccagcgcc

SEQ ID NO: 657172 - RNA, 22 nt, Human
uauauucuuaccaguguaugua

SEQ ID NO: 657173 - RNA, 22 nt, Human
acugcccauuaaaggugcuuug

SEQ ID NO: 657174 - RNA, 22 nt, Human
gcagaggaucaggcucuggaaa

SEQ ID NO: 657175 - RNA, 22 nt, Human
gagagaccuugcuaagugccuu

SEQ ID NO: 657176 - RNA, 21 nt, Human
uuucuaaguaacuggcagcau

SEQ ID NO: 657177 - RNA, 20 nt, Human
ggggcaguggcucaugccug

SEQ ID NO: 657178 - RNA, 22 nt, Human
gcccugagaaugugugugucua

SEQ ID NO: 657179 - RNA, 22 nt, Human
uccuguguucuagguauggucu

SEQ ID NO: 657180 - RNA, 22 nt, Human
aaauggaauguguuuauaauuc

SEQ ID NO: 657181 - RNA, 22 nt, Human
uccaccagccaggcccaggcug

SEQ ID NO: 657182 - RNA, 22 nt, Human
agcuuuaucagaggagucucua

SEQ ID NO: 657183 - RNA, 22 nt, Human
gugggcagccuccuuuauuuuc

SEQ ID NO: 657184 - RNA, 22 nt, Human
uuuacuaacaccauacaugcug

SEQ ID NO: 657185 - RNA, 22 nt, Human
cuccuuccccuacucagcaucc

SEQ ID NO: 657186 - RNA, 22 nt, Human
gcauaauauacaugcuugaucc

SEQ ID NO: 657187 - RNA, 21 nt, Human
aagugguuuacauccagcugu

SEQ ID NO: 657188 - RNA, 22 nt, Human
cucccucauauacccagcgaga

SEQ ID NO: 657189 - RNA, 22 nt, Human
guccugugcucagacauggggg

SEQ ID NO: 657190 - RNA, 21 nt, Human
agcugcuuucagcuccuagag

SEQ ID NO: 657191 - RNA, 22 nt, Human
uggacaggggcugcuguuguca

SEQ ID NO: 657192 - RNA, 20 nt, Human
caucuccugccuccauguuc

SEQ ID NO: 657193 - RNA, 22 nt, Human
agggaggugguuccccagugga

SEQ ID NO: 657194 - RNA, 22 nt, Human
caugggcaccuuaaaaugaggc

SEQ ID NO: 657195 - RNA, 22 nt, Human
ucauucaauguaagcauauaua

SEQ ID NO: 657196 - RNA, 22 nt, Human
cuggagcccaggccuggugucu

SEQ ID NO: 657197 - RNA, 22 nt, Human
uacucucaggguuaguacagga

SEQ ID NO: 657198 - RNA, 22 nt, Human
guuugcaguugucauccuccug

SEQ ID NO: 657199 - RNA, 20 nt, Human
ggguaaaaggcaguguugca

SEQ ID NO: 657200 - RNA, 22 nt, Human
uccucccacauaggacaauggg

SEQ ID NO: 657201 - RNA, 22 nt, Human
cucuucuugccugaugaggcag

SEQ ID NO: 657202 - RNA, 22 nt, Human
acccaggagccgugagagguua

SEQ ID NO: 657203 - RNA, 22 nt, Human
uguccucuccaacagccucugu

SEQ ID NO: 657204 - RNA, 22 nt, Human
cuuaaauucuuaaugcccucau

SEQ ID NO: 657205 - RNA, 22 nt, Human
auagcaaacuggcagcuugugg

SEQ ID NO: 657206 - RNA, 19 nt, Human
agugugaguaauuggaguu

SEQ ID NO: 657207 - RNA, 22 nt, Human
aagcucagcagccaggcccugu

SEQ ID NO: 657208 - RNA, 17 nt, Human
ugcaggcuccugucccu

SEQ ID NO: 657209 - RNA, 17 nt, Human
gagcucuguggcacaag

SEQ ID NO: 657210 - RNA, 22 nt, Human
uaggaaauauuugaacauagga

SEQ ID NO: 657211 - RNA, 22 nt, Human
gcuccugaaggcucugcagggu

SEQ ID NO: 657212 - RNA, 22 nt, Human
ugcaauaaguauugcuuacaug

SEQ ID NO: 657213 - RNA, 21 nt, Human
ucucuuucuggaagcuucccu

SEQ ID NO: 657214 - RNA, 22 nt, Human
ggcagagugcucugggcagggg

SEQ ID NO: 657215 - RNA, 22 nt, Human
gaaugcuggcuuacaggcaguu

SEQ ID NO: 657216 - RNA, 22 nt, Human
gcuucugugagugcagaugcug

SEQ ID NO: 657217 - RNA, 22 nt, Human
gcaggcuccaggccggccccuu

SEQ ID NO: 657218 - RNA, 23 nt, Human
ccugcagcugccacgcccugcuc

SEQ ID NO: 657219 - RNA, 22 nt, Human
uccuagaaggaucauucuagug

SEQ ID NO: 657220 - RNA, 22 nt, Human
caccaggcugcccaggacaggg

SEQ ID NO: 657221 - RNA, 22 nt, Human
ugucucucugcccccauugcuc

SEQ ID NO: 657222 - RNA, 19 nt, Human
gaaggggaagguggguacc

SEQ ID NO: 657223 - RNA, 22 nt, Human
uggcaaagauuaccacaucuac

SEQ ID NO: 657224 - RNA, 22 nt, Human
uuaguuaaaauucugcugacau

SEQ ID NO: 657225 - RNA, 22 nt, Human
ugcagguaggccugacuuccag

SEQ ID NO: 657226 - RNA, 22 nt, Human
ccagcaucagcauugucuuagg

SEQ ID NO: 657227 - RNA, 22 nt, Human
cauguauauuuuauguggagag

SEQ ID NO: 657228 - RNA, 22 nt, Human
ugcacagacauacacauauaug

SEQ ID NO: 657229 - RNA, 22 nt, Human
cacagugcuuuaugagagaucu

SEQ ID NO: 657230 - RNA, 22 nt, Human
cucuccuggggagcacacacac

SEQ ID NO: 657231 - RNA, 22 nt, Human
uauacugauuugucuauacucu

SEQ ID NO: 657232 - RNA, 22 nt, Human
auaguaugagcucauacacuug

SEQ ID NO: 657233 - RNA, 22 nt, Human
gaaaauacaaauagccuugaaa

SEQ ID NO: 657234 - RNA, 22 nt, Human
ucuagagacaaaggaaggaggg

SEQ ID NO: 657235 - RNA, 21 nt, Human
ggccacaagcggaggagccgc

SEQ ID NO: 657236 - RNA, 22 nt, Human
ucugcugaggugguuuuagaga

SEQ ID NO: 657237 - RNA, 22 nt, Human
gggccccuuguaucucuggcuc

SEQ ID NO: 657238 - RNA, 22 nt, Human
caggagucccucuggccagcau

SEQ ID NO: 657239 - RNA, 22 nt, Human
agcagccuuugaucaucuggga

SEQ ID NO: 657240 - RNA, 22 nt, Human
uagcucaucuaggcuaccacag

SEQ ID NO: 657241 - RNA, 22 nt, Human
ggcugcugcuguguaggccugu

SEQ ID NO: 657242 - RNA, 22 nt, Human
ccuaggcccucaaagagcauaa

SEQ ID NO: 657243 - RNA, 22 nt, Human
acauuccugaaugggcacauuu

SEQ ID NO: 657244 - RNA, 22 nt, Human
agucugaaauaaugucacuaag

SEQ ID NO: 657245 - RNA, 21 nt, Human
ccagagagagggaaguggguu

SEQ ID NO: 657246 - RNA, 22 nt, Human
ccauuaaaauggaauguaguga

SEQ ID NO: 657247 - RNA, 22 nt, Human
gagccugggacugggggucaug

SEQ ID NO: 657248 - RNA, 22 nt, Human
ccuggcucugaaguccacauca

SEQ ID NO: 657249 - RNA, 22 nt, Human
ucuaaccuuugaaacugcuuuc

SEQ ID NO: 657250 - RNA, 22 nt, Human
aggagcugcuuuggugcgguuu

SEQ ID NO: 657251 - RNA, 22 nt, Human
accagagcuuacaugcuagaaa

SEQ ID NO: 657252 - RNA, 22 nt, Human
agucuauuucagucuuacuagu

SEQ ID NO: 657253 - RNA, 22 nt, Human
gcacagaggaagcacagacucu

SEQ ID NO: 657254 - RNA, 22 nt, Human
uuccuaacgccaguauuuucau

SEQ ID NO: 657255 - RNA, 22 nt, Human
acugcaugcuuuacaugacaug

SEQ ID NO: 657256 - RNA, 22 nt, Human
uugguacauguuaaggaagagu

SEQ ID NO: 657257 - RNA, 22 nt, Human
cugagcacagaaauaagauauu

SEQ ID NO: 657258 - RNA, 22 nt, Human
uguuuuaagcucuagaagggga

SEQ ID NO: 657259 - RNA, 22 nt, Human
cccucaccaggcuccaggcaug

SEQ ID NO: 657260 - RNA, 22 nt, Human
gaauuuuaauaaagguuuauca

SEQ ID NO: 657261 - RNA, 22 nt, Human
uccagucaggcugaauucaagg

SEQ ID NO: 657262 - RNA, 22 nt, Human
acuuuuaaaugaguuucaguug

SEQ ID NO: 657263 - RNA, 22 nt, Human
ucaggaguaaggguaacccaga

SEQ ID NO: 657264 - RNA, 22 nt, Human
gagcuuuagcugagaccugcuu

SEQ ID NO: 657265 - RNA, 22 nt, Human
guggcagagccaggcuuugaac

SEQ ID NO: 657266 - RNA, 18 nt, Human
ucuuccagcuucuggagg

SEQ ID NO: 657267 - RNA, 22 nt, Human
gccuccaccgaacgcucucuug

SEQ ID NO: 657268 - RNA, 22 nt, Human
uauccguuguuaccagauaaga

SEQ ID NO: 657269 - RNA, 22 nt, Human
gcccaagaucacacuggaaauc

SEQ ID NO: 657270 - RNA, 22 nt, Human
ucaggcagaguggaagcugcaa

SEQ ID NO: 657271 - RNA, 22 nt, Human
uuucacagucaauuuggaguca

SEQ ID NO: 657272 - RNA, 22 nt, Human
ggugggaggacuguuugaggca

SEQ ID NO: 657273 - RNA, 22 nt, Human
cacuauaucucuuucaucuuuu

SEQ ID NO: 657274 - RNA, 22 nt, Human
ucugagggaauagcuauuguag

SEQ ID NO: 657275 - RNA, 22 nt, Human
auucuacaacccaauaauaauu

SEQ ID NO: 657276 - RNA, 22 nt, Human
cuguguccugcgucaagccaau

SEQ ID NO: 657277 - RNA, 22 nt, Human
ucacaucuguugauacagcauc

SEQ ID NO: 657278 - RNA, 22 nt, Human
caggugguuguuuggauucuaa

SEQ ID NO: 657279 - RNA, 20 nt, Human
agagaauucccuuuggagau

SEQ ID NO: 657280 - RNA, 22 nt, Human
uuucucugugccauuuccauaa

SEQ ID NO: 657281 - RNA, 22 nt, Human
ccaggagaauaauggcagauua

SEQ ID NO: 657282 - RNA, 22 nt, Human
acaacaguaggaaaacaugucu

SEQ ID NO: 657283 - RNA, 22 nt, Human
cauuggucuucuaacagagaga

SEQ ID NO: 657284 - RNA, 22 nt, Human
cagacaucuguacccagccugu

SEQ ID NO: 657285 - RNA, 22 nt, Human
aaauugucauuucugugcccua

SEQ ID NO: 657286 - RNA, 22 nt, Human
aagcccuguaaauugcccuuaa

SEQ ID NO: 657287 - RNA, 22 nt, Human
uugaggucuuugagcaaacgca

SEQ ID NO: 657288 - RNA, 22 nt, Human
uucagcuucauuugucuuuaug

SEQ ID NO: 657289 - RNA, 22 nt, Human
caaagguuguugagagugcagg

SEQ ID NO: 657290 - RNA, 22 nt, Human
cacacugauagcacuaagucag

SEQ ID NO: 657291 - RNA, 22 nt, Human
ucuuuucugccagcugagcccu

SEQ ID NO: 657292 - RNA, 21 nt, Human
gcauguguggugugcuccaca

SEQ ID NO: 657293 - RNA, 22 nt, Human
agggcuguaccaucagguuccu

SEQ ID NO: 657294 - RNA, 22 nt, Human
aauuaaaaaaggagagcuugcu

SEQ ID NO: 657295 - RNA, 22 nt, Human
ggagucugggaauuggagagaa

SEQ ID NO: 657296 - RNA, 22 nt, Human
ugacuuuacagauauguuuccu

SEQ ID NO: 657297 - RNA, 22 nt, Human
aggggcaggugcugcacuuaga

SEQ ID NO: 657298 - RNA, 22 nt, Human
ucuagguucaugggauucagug

SEQ ID NO: 657299 - RNA, 22 nt, Human
ggugccaggcucccagcucagg

SEQ ID NO: 657300 - RNA, 19 nt, Human
ucucagugccgcugaccgc

SEQ ID NO: 657301 - RNA, 22 nt, Human
cagcccaggccgacaguuccuc

SEQ ID NO: 657302 - RNA, 22 nt, Human
gcuggccugucuagagccuuac

SEQ ID NO: 657303 - RNA, 22 nt, Human
cuuucuggaguggaaagguauu

SEQ ID NO: 657304 - RNA, 22 nt, Human
ccagguacauggagaagaacag

SEQ ID NO: 657305 - RNA, 22 nt, Human
acacaguaugaaaagucuaguu

SEQ ID NO: 657306 - RNA, 22 nt, Human
uuggcccagggucagcggcgcu

SEQ ID NO: 657307 - RNA, 22 nt, Human
uuccucagggcggaugggcagg

SEQ ID NO: 657308 - RNA, 18 nt, Human
gaagugaagugacucaau

SEQ ID NO: 657309 - RNA, 22 nt, Human
aguggccagcagccuagccuag

SEQ ID NO: 657310 - RNA, 22 nt, Human
uggcccuuugguuuaugacuga

SEQ ID NO: 657311 - RNA, 22 nt, Human
gagguagcgaguggacagugca

SEQ ID NO: 657312 - RNA, 22 nt, Human
agccaaggacucagugguaggc

SEQ ID NO: 657313 - RNA, 22 nt, Human
ugggugggagcacccugucugg

SEQ ID NO: 657314 - RNA, 22 nt, Human
ccagcagcugacaccaguccca

SEQ ID NO: 657315 - RNA, 22 nt, Human
uauaaagagucuaucugguggc

SEQ ID NO: 657316 - RNA, 21 nt, Human
ucaguugccaaagugauguca

SEQ ID NO: 657317 - RNA, 18 nt, Human
auuucuacuacuauaaag

SEQ ID NO: 657318 - RNA, 23 nt, Human
aaagacugcugagaauuuuagga

SEQ ID NO: 657319 - RNA, 17 nt, Human
ucaggcugggugcagug

SEQ ID NO: 657320 - RNA, 22 nt, Human
acaaaagcacugcagaguaagc

SEQ ID NO: 657321 - RNA, 22 nt, Human
caguagcacucugucagugaag

SEQ ID NO: 657322 - RNA, 22 nt, Human
ucagagaguuacacaaauuguu

SEQ ID NO: 657323 - RNA, 22 nt, Human
caggagagcccggguccgggcu

SEQ ID NO: 657324 - RNA, 22 nt, Human
ggcaugcaugcaagguggugua

SEQ ID NO: 657325 - RNA, 22 nt, Human
ugguccacagggaguccgugcu

SEQ ID NO: 657326 - RNA, 22 nt, Human
cugccuggaccggcagcccucc

SEQ ID NO: 657327 - RNA, 22 nt, Human
agcuccugugugaagccucccu

SEQ ID NO: 657328 - RNA, 22 nt, Human
ugcaggcaggggaugagcagcc

SEQ ID NO: 657329 - RNA, 22 nt, Human
ucaucacaauuuuaugacccuc

SEQ ID NO: 657330 - RNA, 22 nt, Human
cuaggaacaguucaacaguuua

SEQ ID NO: 657331 - RNA, 22 nt, Human
acaggcagcgucauugcugcuc

SEQ ID NO: 657332 - RNA, 22 nt, Human
guggagcaugugaggacugagu

SEQ ID NO: 657333 - RNA, 22 nt, Human
ucuccagggacugaggcuggag

SEQ ID NO: 657334 - RNA, 22 nt, Human
ugcacagcugccuccucucugc

SEQ ID NO: 657335 - RNA, 22 nt, Human
cuuuggauuuuuaucaggcaau

SEQ ID NO: 657336 - RNA, 21 nt, Human
cacuuuaauggauauuuguuu

SEQ ID NO: 657337 - RNA, 22 nt, Human
ucugaaagagaguacauacagu

SEQ ID NO: 657338 - RNA, 22 nt, Human
uggcaguggcacugcccccaua

SEQ ID NO: 657339 - RNA, 22 nt, Human
cuggcucagacagcugugcagu

SEQ ID NO: 657340 - RNA, 22 nt, Human
aagauccaugggaauguuuggc

SEQ ID NO: 657341 - RNA, 22 nt, Human
agcacuccugucuuuccccuuu

SEQ ID NO: 657342 - RNA, 22 nt, Human
guaguauuuucugugauguagg

SEQ ID NO: 657343 - RNA, 22 nt, Human
caacaaguguucguaaagugcc

SEQ ID NO: 657344 - RNA, 22 nt, Human
aacaacugcuaagguguguccu

SEQ ID NO: 657345 - RNA, 22 nt, Human
ccaaggagaaugacaccaugga

SEQ ID NO: 657346 - RNA, 22 nt, Human
ggcugccucaaagcucaagcuc

SEQ ID NO: 657347 - RNA, 22 nt, Human
cucacccauaucuccaugacuc

SEQ ID NO: 657348 - RNA, 22 nt, Human
aggccaagcucccagagaagcu

SEQ ID NO: 657349 - RNA, 22 nt, Human
aggucugguguugggccugaaa

SEQ ID NO: 657350 - RNA, 22 nt, Human
acaugagaucacaaagauaaau

SEQ ID NO: 657351 - RNA, 22 nt, Human
acagugaaaauaauaucuucaa

SEQ ID NO: 657352 - RNA, 22 nt, Human
aggccuggccuuuauguucaag

SEQ ID NO: 657353 - RNA, 22 nt, Human
agggaccugucaaugacaguua

SEQ ID NO: 657354 - RNA, 22 nt, Human
acuggcugaucaccugccucag

SEQ ID NO: 657355 - RNA, 22 nt, Human
aguuaaugagcauuuuggaaug

SEQ ID NO: 657356 - RNA, 20 nt, Human
gaacauuuggccauacugag

SEQ ID NO: 657357 - RNA, 22 nt, Human
cugaggcaccuacagucucggg

SEQ ID NO: 657358 - RNA, 22 nt, Human
cugccccagugccaggcaggug

SEQ ID NO: 657359 - RNA, 17 nt, Human
gguggccugcaguggcu

SEQ ID NO: 657360 - RNA, 22 nt, Human
ucucucagaaagcccaugucug

SEQ ID NO: 657361 - RNA, 22 nt, Human
cuguagcaaguuauucaauaaa

SEQ ID NO: 657362 - RNA, 22 nt, Human
ucuguaggacagagaaaugggg

SEQ ID NO: 657363 - RNA, 22 nt, Human
acacugugucuagcauuuuaca

SEQ ID NO: 657364 - RNA, 22 nt, Human
cuucacagcaugagcuuuggag

SEQ ID NO: 657365 - RNA, 22 nt, Human
gauggacaccuccugagguucu

SEQ ID NO: 657366 - RNA, 22 nt, Human
caggugcccaggggacaguggc

SEQ ID NO: 657367 - RNA, 22 nt, Human
auccugggcaaaguaugcuguc

SEQ ID NO: 657368 - RNA, 22 nt, Human
uguuauugauaucuaaugcucu

SEQ ID NO: 657369 - RNA, 22 nt, Human
cuggagggagauucaaaggagg

SEQ ID NO: 657370 - RNA, 22 nt, Human
uggcuucccauagcuugcuagu

SEQ ID NO: 657371 - RNA, 22 nt, Human
aagaguggagcuggaaaguggg

SEQ ID NO: 657372 - RNA, 22 nt, Human
guauucugggccgauuacaaaa

SEQ ID NO: 657373 - RNA, 23 nt, Human
auuauuaaggacauggacuuugu

SEQ ID NO: 657374 - RNA, 23 nt, Human
aggaaguuaaggcagacagacag

SEQ ID NO: 657375 - RNA, 22 nt, Human
guuugcauguguacuuaauugg

SEQ ID NO: 657376 - RNA, 22 nt, Human
ugcucaucaacaugaugaucau

SEQ ID NO: 657377 - RNA, 22 nt, Human
cacaggcuuuucugacauaggc

SEQ ID NO: 657378 - RNA, 22 nt, Human
agaucacaguucucuauucgua

SEQ ID NO: 657379 - RNA, 22 nt, Human
aggaucugugagugcugcagac

SEQ ID NO: 657380 - RNA, 22 nt, Human
aggacuuuagagccagaaagac

SEQ ID NO: 657381 - RNA, 22 nt, Human
ccaguguuuucauccucccuug

SEQ ID NO: 657382 - RNA, 22 nt, Human
gauagaaagagugguucuuuuu

SEQ ID NO: 657383 - RNA, 22 nt, Human
aaugacaugcuuuuuaauuaua

SEQ ID NO: 657384 - RNA, 22 nt, Human
uuuccuguugccaucaagaaug

SEQ ID NO: 657385 - RNA, 22 nt, Human
ggagcagagcucuucaucugca

SEQ ID NO: 657386 - RNA, 22 nt, Human
ugcugaaaaugcguaucuucca

SEQ ID NO: 657387 - RNA, 22 nt, Human
uuugcaaaugaagcucugagga

SEQ ID NO: 657388 - RNA, 22 nt, Human
cuuauucagcaaguuuggguac

SEQ ID NO: 657389 - RNA, 22 nt, Human
aucauagguauaaguaaauuag

SEQ ID NO: 657390 - RNA, 22 nt, Human
ugccugccaaugaugcuugugu

SEQ ID NO: 657391 - RNA, 23 nt, Human
ugauggccgcccuuugcccuguc

SEQ ID NO: 657392 - RNA, 22 nt, Human
cccaggcuccuagaggcccaga

SEQ ID NO: 657393 - RNA, 22 nt, Human
ucugagguugaacuuugcaaag

SEQ ID NO: 657394 - RNA, 21 nt, Human
cacauuccaugggucuauuua

SEQ ID NO: 657395 - RNA, 22 nt, Human
gcuccugcaggacccaggagac

SEQ ID NO: 657396 - RNA, 22 nt, Human
acaaaaucaaaggagugauuca

SEQ ID NO: 657397 - RNA, 22 nt, Human
gcaagcaguuguggcuucugag

SEQ ID NO: 657398 - RNA, 22 nt, Human
ccccuggguccaggcuucucug

SEQ ID NO: 657399 - RNA, 21 nt, Human
augcauauuuuaaguuguguc

SEQ ID NO: 657400 - RNA, 22 nt, Human
uugaaacauauacaaaguggug

SEQ ID NO: 657401 - RNA, 22 nt, Human
agaagagaaauagugccacugu

SEQ ID NO: 657402 - RNA, 22 nt, Human
ccagcccugccagagagagcug

SEQ ID NO: 657403 - RNA, 22 nt, Human
ccauggcuuucuuucauuguaa

SEQ ID NO: 657404 - RNA, 22 nt, Human
ugucacuuuggggagaguuuug

SEQ ID NO: 657405 - RNA, 22 nt, Human
cugugggaugggaccucagcug

SEQ ID NO: 657406 - RNA, 22 nt, Human
aauguccuaggcaugauuuugu

SEQ ID NO: 657407 - RNA, 22 nt, Human
gacagcuuagugaaaauguaaa

SEQ ID NO: 657408 - RNA, 23 nt, Human
auacaaaccuugcaggacauguu

SEQ ID NO: 657409 - RNA, 22 nt, Human
uggagggcaucuguggucaggc

SEQ ID NO: 657410 - RNA, 22 nt, Human
ggcacugacugugcagcgcacc

SEQ ID NO: 657411 - RNA, 22 nt, Human
agggggaggcugugcugcgucu

SEQ ID NO: 657412 - RNA, 22 nt, Human
ugcagagaguuagggcccguau

SEQ ID NO: 657413 - RNA, 22 nt, Human
cagcugcagaaagcaagcaggu

SEQ ID NO: 657414 - RNA, 22 nt, Human
auguuaaaaaccaguacaguug

SEQ ID NO: 657415 - RNA, 22 nt, Human
ggcugcugacaaacaugaucau

SEQ ID NO: 657416 - RNA, 22 nt, Human
uuauccugguggccccuaaauc

SEQ ID NO: 657417 - RNA, 22 nt, Human
gcuggccagggcugcucgcgga

SEQ ID NO: 657418 - RNA, 22 nt, Human
uuccaaaugcccaucuacacag

SEQ ID NO: 657419 - RNA, 22 nt, Human
uaugugcaaauuaauugcuaga

SEQ ID NO: 657420 - RNA, 22 nt, Human
cuuuacacauccuaaccagugu

SEQ ID NO: 657421 - RNA, 22 nt, Human
agcugggcgcaguggcugguga

SEQ ID NO: 657422 - RNA, 22 nt, Human
uggcucugggaaucuguugcuu

SEQ ID NO: 657423 - RNA, 20 nt, Human
gcugcuuucaaaugacacgu

SEQ ID NO: 657424 - RNA, 22 nt, Human
uacaguaaccuuauuugucauu

SEQ ID NO: 657425 - RNA, 22 nt, Human
gucccagggaagaaggcagcac

SEQ ID NO: 657426 - RNA, 22 nt, Human
gagcagcucgagaaggaagcag

SEQ ID NO: 657427 - RNA, 22 nt, Human
uuauuuccuagggaauuugccu

SEQ ID NO: 657428 - RNA, 22 nt, Human
auguacauaaaauguauaauga

SEQ ID NO: 657429 - RNA, 22 nt, Human
aacguuuuaucgugugcucuuc

SEQ ID NO: 657430 - RNA, 22 nt, Human
ggcagcuccuccuagucugccc

SEQ ID NO: 657431 - RNA, 19 nt, Human
uguggccuggggacaggcc

SEQ ID NO: 657432 - RNA, 22 nt, Human
acuugccccagaauugcugcug

SEQ ID NO: 657433 - RNA, 22 nt, Human
aaggcaaaagaggugucaucac

SEQ ID NO: 657434 - RNA, 21 nt, Human
cucaaaugccaguuuuauuua

SEQ ID NO: 657435 - RNA, 22 nt, Human
ggcugaguggagguagcccugu

SEQ ID NO: 657436 - RNA, 22 nt, Human
gcacacugcggugaugugaguc

SEQ ID NO: 657437 - RNA, 22 nt, Human
gcugggaggcagcaccuuuagc

SEQ ID NO: 657438 - RNA, 22 nt, Human
acacauuucucuuuuuguaagu

SEQ ID NO: 657439 - RNA, 22 nt, Human
acagugauaaaauuucacaugu

SEQ ID NO: 657440 - RNA, 22 nt, Human
ugcuguguuaaauacaagcaug

SEQ ID NO: 657441 - RNA, 22 nt, Human
uagcagaggcuacugcuccuug

SEQ ID NO: 657442 - RNA, 22 nt, Human
cuggcugugaaauggcaguguc

SEQ ID NO: 657443 - RNA, 22 nt, Human
aggcacaggaggugguaagaag

SEQ ID NO: 657444 - RNA, 22 nt, Human
gcuggcuguguuucaucucuga

SEQ ID NO: 657445 - RNA, 23 nt, Human
ggcaugcaauggacagagcugga

SEQ ID NO: 657446 - RNA, 22 nt, Human
acaggcuuuuuuagaaugacau

SEQ ID NO: 657447 - RNA, 22 nt, Human
gaccugaaagagauuaaaugac

SEQ ID NO: 657448 - RNA, 22 nt, Human
augaaaauguacauguguauaa

SEQ ID NO: 657449 - RNA, 22 nt, Human
ucucagaguuuagagcugagcc

SEQ ID NO: 657450 - RNA, 22 nt, Human
cucacaguuucacaguguagau

SEQ ID NO: 657451 - RNA, 22 nt, Human
guccagcuccagggaggcaggc

SEQ ID NO: 657452 - RNA, 22 nt, Human
ucucagagcaucauuuucuuag

SEQ ID NO: 657453 - RNA, 22 nt, Human
auuucccagcuuugaucaguuu

SEQ ID NO: 657454 - RNA, 22 nt, Human
cagaaaaggguguuuguucagg

SEQ ID NO: 657455 - RNA, 22 nt, Human
ggagcugucuguagggcacagg

SEQ ID NO: 657456 - RNA, 22 nt, Human
gcacaaggagcaguguaugaaa

SEQ ID NO: 657457 - RNA, 22 nt, Human
ugagguucaguucuuggccaca

SEQ ID NO: 657458 - RNA, 22 nt, Human
gcugggcucguucccacacgcg

SEQ ID NO: 657459 - RNA, 22 nt, Human
aaauauuauugcuuaaggggag

SEQ ID NO: 657460 - RNA, 22 nt, Human
ugugggcaggagcacaagucag

SEQ ID NO: 657461 - RNA, 20 nt, Human
agcuggcccacagguguggg

SEQ ID NO: 657462 - RNA, 22 nt, Human
uucagcaguuucugagaagcaa

SEQ ID NO: 657463 - RNA, 22 nt, Human
ugcaggcagggccagcgugagg

SEQ ID NO: 657464 - RNA, 22 nt, Human
uuuccucagaagugucuacuau

SEQ ID NO: 657465 - RNA, 22 nt, Human
acaguaaagccuucugguugac

SEQ ID NO: 657466 - RNA, 22 nt, Human
uagccaaagaagguauauuugu

SEQ ID NO: 657467 - RNA, 22 nt, Human
aggaaaugccgcggcucucuuu

SEQ ID NO: 657468 - RNA, 22 nt, Human
ccggcgggcgcggugacgucag

SEQ ID NO: 657469 - RNA, 22 nt, Human
ccagccugguucagaauuggcu

SEQ ID NO: 657470 - RNA, 22 nt, Human
auauaccucauucuuugagugc

SEQ ID NO: 657471 - RNA, 22 nt, Human
ugccugcugccacugcuguuac

SEQ ID NO: 657472 - RNA, 22 nt, Human
aguguuuaaguuacacacauau

SEQ ID NO: 657473 - RNA, 22 nt, Human
gcccagccagagcugugugaug

SEQ ID NO: 657474 - RNA, 22 nt, Human
guuaaagugagcuacuuuaggu

SEQ ID NO: 657475 - RNA, 22 nt, Human
cuggagcauccaugcccagggu

SEQ ID NO: 657476 - RNA, 22 nt, Human
guugaaauccuaacccccuagu

SEQ ID NO: 657477 - RNA, 22 nt, Human
ggaggaagugcaguucuacuac

SEQ ID NO: 657478 - RNA, 22 nt, Human
uguuugcaacaacuagauggag

SEQ ID NO: 657479 - RNA, 20 nt, Human
aggagcugaauuagaggguu

SEQ ID NO: 657480 - RNA, 22 nt, Human
aaacacucauguguuacucucc

SEQ ID NO: 657481 - RNA, 22 nt, Human
cacaguaucuuuugaguaagca

SEQ ID NO: 657482 - RNA, 22 nt, Human
uguuuacaugcauaagcuuaag

SEQ ID NO: 657483 - RNA, 19 nt, Human
ucacucucccugucugucc

SEQ ID NO: 657484 - RNA, 22 nt, Human
gggcuucugggcaccacucccu

SEQ ID NO: 657485 - RNA, 22 nt, Human
cuggggugugcucagagcaggg

SEQ ID NO: 657486 - RNA, 22 nt, Human
acacaggacagggauguguuuu

SEQ ID NO: 657487 - RNA, 22 nt, Human
agucagaguuuugaggugugac

SEQ ID NO: 657488 - RNA, 22 nt, Human
ugugaauagauugaagcuuugg

SEQ ID NO: 657489 - RNA, 20 nt, Human
cuccucaguuccaugggagg

SEQ ID NO: 657490 - RNA, 22 nt, Human
cuccuggaggcuccaagggaga

SEQ ID NO: 657491 - RNA, 22 nt, Human
aucugcauguccccauggaucc

SEQ ID NO: 657492 - RNA, 22 nt, Human
acauauuggcuuagcucuguga

SEQ ID NO: 657493 - RNA, 22 nt, Human
augaggaggccaguaagagccu

SEQ ID NO: 657494 - RNA, 22 nt, Human
gagcccagcuugcacauggagc

SEQ ID NO: 657495 - RNA, 22 nt, Human
gguuguaguuggagguuguaua

SEQ ID NO: 657496 - RNA, 22 nt, Human
ccuccuggugacaaggcaaagc

SEQ ID NO: 657497 - RNA, 17 nt, Human
aaggagcugagagaugg

SEQ ID NO: 657498 - RNA, 23 nt, Human
uagcagcauuuuuagccucuguc

SEQ ID NO: 657499 - RNA, 22 nt, Human
ccuugcauauauuauaucuuug

SEQ ID NO: 657500 - RNA, 22 nt, Human
uugucugaauucuucuaggcag

SEQ ID NO: 657501 - RNA, 22 nt, Human
uccugggugugauauucauaga

SEQ ID NO: 657502 - RNA, 22 nt, Human
cugggucugggccuccuggagu

SEQ ID NO: 657503 - RNA, 22 nt, Human
gaccugggguggaaggaaggca

SEQ ID NO: 657504 - RNA, 22 nt, Human
uggcucuggcgugaagcccaga

SEQ ID NO: 657505 - RNA, 21 nt, Human
ugggccucaggcagcugugac

SEQ ID NO: 657506 - RNA, 22 nt, Human
uuugcagaagaaaacaugaaca

SEQ ID NO: 657507 - RNA, 22 nt, Human
auuuuguuaucagggcuuugca

SEQ ID NO: 657508 - RNA, 22 nt, Human
uacugcugauuagagcugaggu

SEQ ID NO: 657509 - RNA, 22 nt, Human
aaaaugcuauuucauggaggag

SEQ ID NO: 657510 - RNA, 22 nt, Human
ugaaggcacguggguggauacu

SEQ ID NO: 657511 - RNA, 22 nt, Human
uccugagacaucucugcugguc

SEQ ID NO: 657512 - RNA, 22 nt, Human
uguaagaaaaguaaauagugac

SEQ ID NO: 657513 - RNA, 22 nt, Human
uagcugcugcagcacagggagg

SEQ ID NO: 657514 - RNA, 22 nt, Human
gaauaacauuuuuuccuuuaca

SEQ ID NO: 657515 - RNA, 22 nt, Human
gugaaggauaaggaucuaaauu

SEQ ID NO: 657516 - RNA, 22 nt, Human
aaaauugugaagguuucugaaa

SEQ ID NO: 657517 - RNA, 22 nt, Human
gggaagugugcagaguucucuu

SEQ ID NO: 657518 - RNA, 22 nt, Human
auguagaagcugacagugcugu

SEQ ID NO: 657519 - RNA, 22 nt, Human
aggccagggucccacacucgca

SEQ ID NO: 657520 - RNA, 22 nt, Human
cccagguggcagaagcugcagu

SEQ ID NO: 657521 - RNA, 19 nt, Human
aagcaauguugugaaucua

SEQ ID NO: 657522 - RNA, 22 nt, Human
guuuccuggaaacugcuccacu

SEQ ID NO: 657523 - RNA, 22 nt, Human
acccugagucagacagccugac

SEQ ID NO: 657524 - RNA, 22 nt, Human
ucacuuuacuuuguuaaucugg

SEQ ID NO: 657525 - RNA, 22 nt, Human
uuauguaaguggagucauauag

SEQ ID NO: 657526 - RNA, 22 nt, Human
acagugagcccacuccaggaga

SEQ ID NO: 657527 - RNA, 22 nt, Human
gcuuuucuucagcagccugaug

SEQ ID NO: 657528 - RNA, 22 nt, Human
gaaauuguaaaggauugcgcca

SEQ ID NO: 657529 - RNA, 22 nt, Human
uuguuucuccagucuaggaaaa

SEQ ID NO: 657530 - RNA, 22 nt, Human
accugggcauuuuggaugauua

SEQ ID NO: 657531 - RNA, 22 nt, Human
cugccagcucgccacaaugaca

SEQ ID NO: 657532 - RNA, 22 nt, Human
cagaaggcauagaugaaggccu

SEQ ID NO: 657533 - RNA, 22 nt, Human
agcuaggggaccaagguggccc

SEQ ID NO: 657534 - RNA, 22 nt, Human
uuggccacaauccaagccuugg

SEQ ID NO: 657535 - RNA, 22 nt, Human
cucacaggcaucucaucaggcu

SEQ ID NO: 657536 - RNA, 22 nt, Human
cagcugcuguucaguuuuguuu

SEQ ID NO: 657537 - RNA, 22 nt, Human
uuaagacacauuucucagacgg

SEQ ID NO: 657538 - RNA, 22 nt, Human
ugucccagaucacaggagggga

SEQ ID NO: 657539 - RNA, 22 nt, Human
cacagguggcuccaaguuagag

SEQ ID NO: 657540 - RNA, 22 nt, Human
cuucauuaaugucuauaaguuu

SEQ ID NO: 657541 - RNA, 22 nt, Human
uuuauuauucucuggagaaugu

SEQ ID NO: 657542 - RNA, 23 nt, Human
caugugugacaguaucacuguuu

SEQ ID NO: 657543 - RNA, 22 nt, Human
ccagagaauccggagaguccau

SEQ ID NO: 657544 - RNA, 22 nt, Human
agagaagcagggagucaucugu

SEQ ID NO: 657545 - RNA, 22 nt, Human
cagcaggcguugggagaaagac

SEQ ID NO: 657546 - RNA, 22 nt, Human
gcuuccuccaucuggggcuugc

SEQ ID NO: 657547 - RNA, 22 nt, Human
cggcugagcagugcugauggaa

SEQ ID NO: 657548 - RNA, 20 nt, Human
ucucuggguucucacucagc

SEQ ID NO: 657549 - RNA, 22 nt, Human
gaugcagggaacuuagugggcu

SEQ ID NO: 657550 - RNA, 22 nt, Human
uugaauguaggucuuggugagc

SEQ ID NO: 657551 - RNA, 22 nt, Human
ucugagaacuccggguuagauc

SEQ ID NO: 657552 - RNA, 22 nt, Human
gaaaugcauggaucuuggcaga

SEQ ID NO: 657553 - RNA, 19 nt, Human
gcuguacaguaaggagaca

SEQ ID NO: 657554 - RNA, 22 nt, Human
augugugcauauucugccaccu

SEQ ID NO: 657555 - RNA, 22 nt, Human
aaaugucagaaaacauggagug

SEQ ID NO: 657556 - RNA, 22 nt, Human
caucuuuaauuugugacaacua

SEQ ID NO: 657557 - RNA, 22 nt, Human
gcacagcuccgcuuccucacac

SEQ ID NO: 657558 - RNA, 22 nt, Human
cugacaguuuuugcuguauugu

SEQ ID NO: 657559 - RNA, 22 nt, Human
acucaugauaugccuauaagau

SEQ ID NO: 657560 - RNA, 22 nt, Human
gaggcaggcacuguuaucagca

SEQ ID NO: 657561 - RNA, 22 nt, Human
uauguaguguugagaaugcuug

SEQ ID NO: 657562 - RNA, 22 nt, Human
uugucugcuuguucagauggaa

SEQ ID NO: 657563 - RNA, 22 nt, Human
aaggcacuagcaagcugccugg

SEQ ID NO: 657564 - RNA, 22 nt, Human
aggagacccagaauguugcugu

SEQ ID NO: 657565 - RNA, 22 nt, Human
gugcagagcaagggcugagggc

SEQ ID NO: 657566 - RNA, 22 nt, Human
gcugagugaaaguuugcugugu

SEQ ID NO: 657567 - RNA, 22 nt, Human
cagcuuuaguaacccacugcuc

SEQ ID NO: 657568 - RNA, 22 nt, Human
uaauaucuacuucauagaguuu

SEQ ID NO: 657569 - RNA, 22 nt, Human
gacccagcuuaagucacauguu

SEQ ID NO: 657570 - RNA, 23 nt, Human
ugaggaaguaauuguaaaggucu

SEQ ID NO: 657571 - RNA, 22 nt, Human
auucuaacacaugcucuaagaa

SEQ ID NO: 657572 - RNA, 22 nt, Human
ggaggcagaauagagugugggu

SEQ ID NO: 657573 - RNA, 22 nt, Human
agauucauuaggagacauucag

SEQ ID NO: 657574 - RNA, 22 nt, Human
cuggaauguagagacagcuuag

SEQ ID NO: 657575 - RNA, 22 nt, Human
uggggaggaagucagauuucag

SEQ ID NO: 657576 - RNA, 22 nt, Human
uaccaguaauugcuugugcugu

SEQ ID NO: 657577 - RNA, 22 nt, Human
uuuuacaggugugagccaccau

SEQ ID NO: 657578 - RNA, 22 nt, Human
uaugcuuuaacauuaaacaaca

SEQ ID NO: 657579 - RNA, 22 nt, Human
gcucuguaaagaagagaaaugc

SEQ ID NO: 657580 - RNA, 22 nt, Human
aaaguguacuaugucaugaaca

SEQ ID NO: 657581 - RNA, 19 nt, Human
uuccugggguuccauugug

SEQ ID NO: 657582 - RNA, 22 nt, Human
uuggauccaucucaggcauagg

SEQ ID NO: 657583 - RNA, 22 nt, Human
gggcucaguucugcuucaugcu

SEQ ID NO: 657584 - RNA, 22 nt, Human
cucagaauuuagggcucugagg

SEQ ID NO: 657585 - RNA, 22 nt, Human
gaaucacagaggcaaauucuga

SEQ ID NO: 657586 - RNA, 22 nt, Human
ugcagccccugaaaauggcagc

SEQ ID NO: 657587 - RNA, 22 nt, Human
aaugacaauaaucauuaacuuu

SEQ ID NO: 657588 - RNA, 22 nt, Human
gcuggggagggcgucaaggcca

SEQ ID NO: 657589 - RNA, 22 nt, Human
uuauucuguauuucagguaugu

SEQ ID NO: 657590 - RNA, 22 nt, Human
ugugcacaaugugcagguuugu

SEQ ID NO: 657591 - RNA, 22 nt, Human
cuguuauuucugaaugccaucc

SEQ ID NO: 657592 - RNA, 22 nt, Human
uggcauguggcagcugguucag

SEQ ID NO: 657593 - RNA, 22 nt, Human
uugaaaggugacauuguuagag

SEQ ID NO: 657594 - RNA, 22 nt, Human
uugagacacaaggcacaguaag

SEQ ID NO: 657595 - RNA, 22 nt, Human
caugcagccugugaacaguguc

SEQ ID NO: 657596 - RNA, 23 nt, Human
ugcugguguuuuugggaccaggg

SEQ ID NO: 657597 - RNA, 22 nt, Human
aaaucaguaaauguucauuaac

SEQ ID NO: 657598 - RNA, 22 nt, Human
ccuccugcacuugcuuuccuuc

SEQ ID NO: 657599 - RNA, 22 nt, Human
gcuuuaagucucaguuuguuag

SEQ ID NO: 657600 - RNA, 22 nt, Human
uuucaacucaugcuaaaggaag

SEQ ID NO: 657601 - RNA, 22 nt, Human
aaaugguguuucuaaugcuaga

SEQ ID NO: 657602 - RNA, 22 nt, Human
aagagccaggacagauccagcu

SEQ ID NO: 657603 - RNA, 22 nt, Human
gugguccuggcaaccaugguga

SEQ ID NO: 657604 - RNA, 22 nt, Human
ucacccagcgggcgcacacucg

SEQ ID NO: 657605 - RNA, 22 nt, Human
ggagacacauauacagaaagag

SEQ ID NO: 657606 - RNA, 22 nt, Human
gaugccuguggugagcacacau

SEQ ID NO: 657607 - RNA, 22 nt, Human
accugggauggggccagguuua

SEQ ID NO: 657608 - RNA, 22 nt, Human
auuuucuauucugcugguuuag

SEQ ID NO: 657609 - RNA, 22 nt, Human
ggaacccaugauuaugguuagg

SEQ ID NO: 657610 - RNA, 22 nt, Human
gggccucugugcagaggggccu

SEQ ID NO: 657611 - RNA, 22 nt, Human
aguguuccuugcuuucccagag

SEQ ID NO: 657612 - RNA, 22 nt, Human
ccucucuuggccgcagucuucu

SEQ ID NO: 657613 - RNA, 22 nt, Human
cugccugugcaugcagucagaa

SEQ ID NO: 657614 - RNA, 22 nt, Human
ccaguguggacucucuccuuug

SEQ ID NO: 657615 - RNA, 22 nt, Human
uucuuuuagucauucagggaag

SEQ ID NO: 657616 - RNA, 23 nt, Human
ucagaagugggauacaaagcuga

SEQ ID NO: 657617 - RNA, 22 nt, Human
ucugccuuucccaggcuacugu

SEQ ID NO: 657618 - RNA, 20 nt, Human
cugcagggugagugggcgau

SEQ ID NO: 657619 - RNA, 22 nt, Human
gcucagagaguuucacaaguuu

SEQ ID NO: 657620 - RNA, 22 nt, Human
caggucuguuuucaaggucagu

SEQ ID NO: 657621 - RNA, 20 nt, Human
acccugaggcuccccagccu

SEQ ID NO: 657622 - RNA, 22 nt, Human
uucuccagaguuucucucacug

SEQ ID NO: 657623 - RNA, 19 nt, Human
aaauggcuuucuacuuaau

SEQ ID NO: 657624 - RNA, 22 nt, Human
gcuuccuguauccuccuguacc

SEQ ID NO: 657625 - RNA, 21 nt, Human
gcacaugagggagggcaugcc

SEQ ID NO: 657626 - RNA, 22 nt, Human
uaagugaaauaagucagauaca

SEQ ID NO: 657627 - RNA, 22 nt, Human
gucucugcucuagagucuguga

SEQ ID NO: 657628 - RNA, 22 nt, Human
guggacaugcauacauauguuu

SEQ ID NO: 657629 - RNA, 22 nt, Human
uuucaaauggaucccucagccu

SEQ ID NO: 657630 - RNA, 22 nt, Human
uggauuuauuagguuggugaaa

SEQ ID NO: 657631 - RNA, 22 nt, Human
ucagggcucaccagccucugcc

SEQ ID NO: 657632 - RNA, 21 nt, Human
acugcaucugaagucccagga

SEQ ID NO: 657633 - RNA, 22 nt, Human
uguuucuaggucaauaauuuuu

SEQ ID NO: 657634 - RNA, 22 nt, Human
gcauccauuguuuauguguuuc

SEQ ID NO: 657635 - RNA, 22 nt, Human
cccuucccuucugggagaucca

SEQ ID NO: 657636 - RNA, 22 nt, Human
uucaaaggcaggauagcagcug

SEQ ID NO: 657637 - RNA, 22 nt, Human
gcagggcuggguccugucucau

SEQ ID NO: 657638 - RNA, 17 nt, Human
gccaaaggguuccaauc

SEQ ID NO: 657639 - RNA, 22 nt, Human
aacuguugucauauggucuuaa

SEQ ID NO: 657640 - RNA, 22 nt, Human
uauuuugacuauuaaaccaaca

SEQ ID NO: 657641 - RNA, 22 nt, Human
ggagaagccaggugauaagcaa

SEQ ID NO: 657642 - RNA, 22 nt, Human
ucuggggagggagccacagguc

SEQ ID NO: 657643 - RNA, 22 nt, Human
caaaaguaauggcgguuuuuac

SEQ ID NO: 657644 - RNA, 22 nt, Human
gcaaauguuuuugaguguuuac

SEQ ID NO: 657645 - RNA, 22 nt, Human
uugauucagaaaaagauggaga

SEQ ID NO: 657646 - RNA, 22 nt, Human
ggucaguggcaggggguacuuc

SEQ ID NO: 657647 - RNA, 22 nt, Human
cagagugauggcaccugcuggg

SEQ ID NO: 657648 - RNA, 22 nt, Human
aguguaugaguuucaguucuuc

SEQ ID NO: 657649 - RNA, 22 nt, Human
aagacccuaccccuggagagga

SEQ ID NO: 657650 - RNA, 22 nt, Human
ucucaugguuugugauucaaau

SEQ ID NO: 657651 - RNA, 22 nt, Human
ccauggcuaaguaucuguagaa

SEQ ID NO: 657652 - RNA, 17 nt, Human
ggacacagcucauggcu

SEQ ID NO: 657653 - RNA, 22 nt, Human
cuggcugcgucugcucugacag

SEQ ID NO: 657654 - RNA, 22 nt, Human
gacccagugacucgucucugug

SEQ ID NO: 657655 - RNA, 19 nt, Human
ucucuucucccugguuuua

SEQ ID NO: 657656 - RNA, 20 nt, Human
ggcugaaaguagaaaguauu

SEQ ID NO: 657657 - RNA, 22 nt, Human
cucaggucuuaguucugucauc

SEQ ID NO: 657658 - RNA, 22 nt, Human
cagcgcugugggaacagggcua

SEQ ID NO: 657659 - RNA, 22 nt, Human
uacucuaacauuuguuagaugu

SEQ ID NO: 657660 - RNA, 22 nt, Human
aagaaaacguuuugaggaguuu

SEQ ID NO: 657661 - RNA, 22 nt, Human
caguacuuuucuggcuuucuac

SEQ ID NO: 657662 - RNA, 22 nt, Human
ugggcugaguggcagccagagu

SEQ ID NO: 657663 - RNA, 22 nt, Human
cacugucccuguuuccuggaaa

SEQ ID NO: 657664 - RNA, 22 nt, Human
ugcuucagugcucugagccugu

SEQ ID NO: 657665 - RNA, 22 nt, Human
ucaggcugcccguucagggcuc

SEQ ID NO: 657666 - RNA, 22 nt, Human
agggggugcuacuuccagaguu

SEQ ID NO: 657667 - RNA, 22 nt, Human
augaaacagaguacuuaauaua

SEQ ID NO: 657668 - RNA, 22 nt, Human
uaugcuguauucuguauguuag

SEQ ID NO: 657669 - RNA, 22 nt, Human
ggagagauggaaaaccucccag

SEQ ID NO: 657670 - RNA, 23 nt, Human
uuugcaaauuuuccugacuacuc

SEQ ID NO: 657671 - RNA, 22 nt, Human
aacauacuuauacuaaauaaug

SEQ ID NO: 657672 - RNA, 23 nt, Human
aagcuuccuucacgucuccuggg

SEQ ID NO: 657673 - RNA, 22 nt, Human
ucaggaaacuacaguugaacua

SEQ ID NO: 657674 - RNA, 22 nt, Human
ucagaggaaacaaucuuuagua

SEQ ID NO: 657675 - RNA, 22 nt, Human
aguggcugaauauauuuuacua

SEQ ID NO: 657676 - RNA, 22 nt, Human
ugcauggauaaaaguauauuau

SEQ ID NO: 657677 - RNA, 22 nt, Human
agccagaguugaaugugagucu

SEQ ID NO: 657678 - RNA, 22 nt, Human
aggacugacuuuugccaugaaa

SEQ ID NO: 657679 - RNA, 22 nt, Human
uccugggagacccagcugugga

SEQ ID NO: 657680 - RNA, 22 nt, Human
uuaaacacacugagauuuaugu

SEQ ID NO: 657681 - RNA, 22 nt, Human
aaaucuguaagcaauugcucag

SEQ ID NO: 657682 - RNA, 22 nt, Human
ugaacaaaugaaucaguguagc

SEQ ID NO: 657683 - RNA, 22 nt, Human
uaugacaagguggaguaugagu

SEQ ID NO: 657684 - RNA, 22 nt, Human
cuuggagauacaagugguaccu

SEQ ID NO: 657685 - RNA, 22 nt, Human
ccucuuccugcacugacauuuu

SEQ ID NO: 657686 - RNA, 19 nt, Human
ucacuucuguuagcaugga

SEQ ID NO: 657687 - RNA, 22 nt, Human
acugagcagaacaaugggagcc

SEQ ID NO: 657688 - RNA, 22 nt, Human
uuaaaugacgggacuggguuuu

SEQ ID NO: 657689 - RNA, 22 nt, Human
aaacacugcgugguggcaacuc

SEQ ID NO: 657690 - RNA, 22 nt, Human
agugugucuuauccugggagaa

SEQ ID NO: 657691 - RNA, 21 nt, Human
agugucucuggaagcacgugu

SEQ ID NO: 657692 - RNA, 22 nt, Human
aggaaacuucagaguuuugguc

SEQ ID NO: 657693 - RNA, 22 nt, Human
augcagggauuaaaugacugcc

SEQ ID NO: 657694 - RNA, 22 nt, Human
ugugcagaguugaagacaggag

SEQ ID NO: 657695 - RNA, 22 nt, Human
ugagguuagcugggauuucaug

SEQ ID NO: 657696 - RNA, 22 nt, Human
auacauagcagagucaauuaau

SEQ ID NO: 657697 - RNA, 17 nt, Human
cugagcauccgugcucu

SEQ ID NO: 657698 - RNA, 22 nt, Human
ucacuaagugccgaguuuaguu

SEQ ID NO: 657699 - RNA, 18 nt, Human
uucuuuucaugugaucuc

SEQ ID NO: 657700 - RNA, 22 nt, Human
caggccucccggugcacacuga

SEQ ID NO: 657701 - RNA, 22 nt, Human
ggaacauguagagggccuguag

SEQ ID NO: 657702 - RNA, 22 nt, Human
ugucacaauaucccaaucugcc

SEQ ID NO: 657703 - RNA, 22 nt, Human
gcuggcagggugguugagagag

SEQ ID NO: 657704 - RNA, 22 nt, Human
uuugucaucccuuuugaaacug

SEQ ID NO: 657705 - RNA, 22 nt, Human
aggaacacaacuuccugagagc

SEQ ID NO: 657706 - RNA, 22 nt, Human
uggcugugccucuuuccaggcc

SEQ ID NO: 657707 - RNA, 19 nt, Human
cuuuggaggaugaggcugg

SEQ ID NO: 657708 - RNA, 22 nt, Human
auguagaacagguuaaugacag

SEQ ID NO: 657709 - RNA, 22 nt, Human
ucaaaagucugcauucuucaca

SEQ ID NO: 657710 - RNA, 22 nt, Human
aacuaaaucuggcauuuagagc

SEQ ID NO: 657711 - RNA, 18 nt, Human
aaggccuagucccucucu

SEQ ID NO: 657712 - RNA, 22 nt, Human
uuucuccugcccagaugccugg

SEQ ID NO: 657713 - RNA, 22 nt, Human
aaccuagacagggccucuguua

SEQ ID NO: 657714 - RNA, 22 nt, Human
agagcccugcaguucuucagga

SEQ ID NO: 657715 - RNA, 22 nt, Human
guuuccuacacuguaguauuau

SEQ ID NO: 657716 - RNA, 22 nt, Human
aacugcaaguggggcuugucau

SEQ ID NO: 657717 - RNA, 23 nt, Human
cugucuccugggcuagguggaau

SEQ ID NO: 657718 - RNA, 22 nt, Human
uuacaguaccuguauggccacu

SEQ ID NO: 657719 - RNA, 22 nt, Human
cagauagcguuugagagcauaa

SEQ ID NO: 657720 - RNA, 20 nt, Human
uuauuugcucuuuaucugca

SEQ ID NO: 657721 - RNA, 22 nt, Human
augcugcagcugcaggaucaga

SEQ ID NO: 657722 - RNA, 22 nt, Human
ggcaggcuuucagcaucaaguc

SEQ ID NO: 657723 - RNA, 22 nt, Human
ccucugcugcuguugagcaccg

SEQ ID NO: 657724 - RNA, 21 nt, Human
uagcuuccagcucaagcugag

SEQ ID NO: 657725 - RNA, 22 nt, Human
gaagcggcaucaggaggcugcc

SEQ ID NO: 657726 - RNA, 22 nt, Human
cccagcccacgguccugggugg

SEQ ID NO: 657727 - RNA, 22 nt, Human
gcugggaugcgucuucccaggc

SEQ ID NO: 657728 - RNA, 22 nt, Human
cugauuaacugaacugaauuua

SEQ ID NO: 657729 - RNA, 22 nt, Human
cccugagccacacagagcaggu

SEQ ID NO: 657730 - RNA, 22 nt, Human
uuugauucucaauugcccucug

SEQ ID NO: 657731 - RNA, 22 nt, Human
ucauuuguugaacuuuagugcg

SEQ ID NO: 657732 - RNA, 22 nt, Human
gucugaaauggaggugggaacu

SEQ ID NO: 657733 - RNA, 22 nt, Human
agcacagagcucggggaaugga

SEQ ID NO: 657734 - RNA, 22 nt, Human
ugucccugcuguacuuagagca

SEQ ID NO: 657735 - RNA, 23 nt, Human
gcucauccacggagaggggcucc

SEQ ID NO: 657736 - RNA, 22 nt, Human
cccaaaggcauuuugcugacca

SEQ ID NO: 657737 - RNA, 22 nt, Human
agagcccuugcccucagucacc

SEQ ID NO: 657738 - RNA, 20 nt, Human
gggcaguggcgcuaucucag

SEQ ID NO: 657739 - RNA, 22 nt, Human
cauguaaagcauccuucuaggg

SEQ ID NO: 657740 - RNA, 22 nt, Human
ucuuauuugcaacuggcucaga

SEQ ID NO: 657741 - RNA, 22 nt, Human
cccaggguagcugagcuggcag

SEQ ID NO: 657742 - RNA, 20 nt, Human
gcccucagucuugucuuuau

SEQ ID NO: 657743 - RNA, 22 nt, Human
auugggcuuuauguaggggaag

SEQ ID NO: 657744 - RNA, 22 nt, Human
ugggagcaguugcaucuccagu

SEQ ID NO: 657745 - RNA, 22 nt, Human
cacacaggaugaagcagcagaa

SEQ ID NO: 657746 - RNA, 22 nt, Human
gcucucuggcuaguccaucggg

SEQ ID NO: 657747 - RNA, 22 nt, Human
aauguucauugauuaaaugaau

SEQ ID NO: 657748 - RNA, 22 nt, Human
agaugguaaucacauuuaucug

SEQ ID NO: 657749 - RNA, 22 nt, Human
cagcauauuacuuuaaaaaauc

SEQ ID NO: 657750 - RNA, 22 nt, Human
auuuaccauccugugaauggcc

SEQ ID NO: 657751 - RNA, 22 nt, Human
ugaaacuuauucaguuucuacc

SEQ ID NO: 657752 - RNA, 22 nt, Human
gugagacaagauuuguaggcag

SEQ ID NO: 657753 - RNA, 22 nt, Human
ucauaaugaccccagaguccgc

SEQ ID NO: 657754 - RNA, 22 nt, Human
acugggcccauauacucagucu

SEQ ID NO: 657755 - RNA, 22 nt, Human
cuuccugcauugugccagaguu

SEQ ID NO: 657756 - RNA, 22 nt, Human
gagcugcugguugcuggugccu

SEQ ID NO: 657757 - RNA, 22 nt, Human
ugcuuuaucaaagcuauaguga

SEQ ID NO: 657758 - RNA, 22 nt, Human
gcucagagcagaugguacucag

SEQ ID NO: 657759 - RNA, 22 nt, Human
agcacuagccuguuuugcugug

SEQ ID NO: 657760 - RNA, 22 nt, Human
acugagguugaaauagugaugu

SEQ ID NO: 657761 - RNA, 19 nt, Human
uucauucuuucuacuuacc

SEQ ID NO: 657762 - RNA, 22 nt, Human
ggagagcugaagcauggacagg

SEQ ID NO: 657763 - RNA, 22 nt, Human
uucacagggccacuggcaggag

SEQ ID NO: 657764 - RNA, 20 nt, Human
ggggcccaagcccucuugcc

SEQ ID NO: 657765 - RNA, 22 nt, Human
uuuagaguugaguauucauugg

SEQ ID NO: 657766 - RNA, 22 nt, Human
guuccucagcccuuacuuagcc

SEQ ID NO: 657767 - RNA, 22 nt, Human
uucugcugaagucacugggagc

SEQ ID NO: 657768 - RNA, 22 nt, Human
cucaggacagauuccagagaaa

SEQ ID NO: 657769 - RNA, 22 nt, Human
uugugcaauuuaaaaucuuccu

SEQ ID NO: 657770 - RNA, 22 nt, Human
guuuauacagugcaugguguua

SEQ ID NO: 657771 - RNA, 22 nt, Human
aacaauuaucauauacauugca

SEQ ID NO: 657772 - RNA, 22 nt, Human
cugggagcugucaggagcgugu

SEQ ID NO: 657773 - RNA, 21 nt, Human
gaugaagcaaucuuucuguug

SEQ ID NO: 657774 - RNA, 22 nt, Human
ccucagagccuccagaaggaau

SEQ ID NO: 657775 - RNA, 22 nt, Human
auugcaccuuggguuuugaaag

SEQ ID NO: 657776 - RNA, 22 nt, Human
uaguugcuaaaaagugccuaac

SEQ ID NO: 657777 - RNA, 22 nt, Human
ugauuuucaugggugaucuuug

SEQ ID NO: 657778 - RNA, 22 nt, Human
gcguuauuuccugucugauuuc

SEQ ID NO: 657779 - RNA, 22 nt, Human
auuguuuuccaaagaugcugcu

SEQ ID NO: 657780 - RNA, 22 nt, Human
ccuggacaaugagaugucaggg

SEQ ID NO: 657781 - RNA, 22 nt, Human
uuaaagcugagcccucagaagc

SEQ ID NO: 657782 - RNA, 22 nt, Human
cacauucuguccuugaacugca

SEQ ID NO: 657783 - RNA, 22 nt, Human
gugucaugggguuuguuauaca

SEQ ID NO: 657784 - RNA, 22 nt, Human
uugagcuguauaccuaugacug

SEQ ID NO: 657785 - RNA, 22 nt, Human
ucccuguguccaugccaggagg

SEQ ID NO: 657786 - RNA, 22 nt, Human
gcaagacaugucuaagguuuaa

SEQ ID NO: 657787 - RNA, 22 nt, Human
auuuaugacagaagauaugcug

SEQ ID NO: 657788 - RNA, 19 nt, Human
uaugugugcauuugugcau

SEQ ID NO: 657789 - RNA, 22 nt, Human
uaaagcagugguucucaaacuu

SEQ ID NO: 657790 - RNA, 22 nt, Human
cugugcuucagagucagugcug

SEQ ID NO: 657791 - RNA, 22 nt, Human
ugggagcucagaaagggagguc

SEQ ID NO: 657792 - RNA, 22 nt, Human
cauccugagaaaauaaaggaga

SEQ ID NO: 657793 - RNA, 22 nt, Human
gcugaggcaguccacccuugug

SEQ ID NO: 657794 - RNA, 22 nt, Human
ccaggguuuagcaagccuacaa

SEQ ID NO: 657795 - RNA, 22 nt, Human
gcugugugacccuagccaguag

SEQ ID NO: 657796 - RNA, 22 nt, Human
agucaacaaaaauguggagccu

SEQ ID NO: 657797 - RNA, 22 nt, Human
uuaaucacagauauuaaacaug

SEQ ID NO: 657798 - RNA, 22 nt, Human
cugcaauaguuuagaauaauug

SEQ ID NO: 657799 - RNA, 22 nt, Human
ggagaucugagagcuggaagug

SEQ ID NO: 657800 - RNA, 22 nt, Human
gggucugggcaggcgcuuccuc

SEQ ID NO: 657801 - RNA, 22 nt, Human
augcauuguaugaaaggaaaua

SEQ ID NO: 657802 - RNA, 22 nt, Human
acuccagguaggcacauugaca

SEQ ID NO: 657803 - RNA, 23 nt, Human
uaacuuacaucauucugcacaag

SEQ ID NO: 657804 - RNA, 22 nt, Human
agaagccaacagggcaggagag

SEQ ID NO: 657805 - RNA, 22 nt, Human
caggaaugcauucuagaauggc

SEQ ID NO: 657806 - RNA, 19 nt, Human
agugguagaugagcaggag

SEQ ID NO: 657807 - RNA, 19 nt, Human
ugucuggaagagcugcagg

SEQ ID NO: 657808 - RNA, 22 nt, Human
cauggacagugggacagugugu

SEQ ID NO: 657809 - RNA, 22 nt, Human
uucuucccuucauuccaccacc

SEQ ID NO: 657810 - RNA, 18 nt, Human
agcagggcauuuugccau

SEQ ID NO: 657811 - RNA, 22 nt, Human
ugccugggccucugaggaaggc

SEQ ID NO: 657812 - RNA, 22 nt, Human
uggcacaguccugggugccugc

SEQ ID NO: 657813 - RNA, 22 nt, Human
uaggcacaagaccaugcaaagg

SEQ ID NO: 657814 - RNA, 23 nt, Human
auuuaaugcugaguugaauguua

SEQ ID NO: 657815 - RNA, 18 nt, Human
uggagagcagcagugggg

SEQ ID NO: 657816 - RNA, 22 nt, Human
auaacauuuugacaacugguga

SEQ ID NO: 657817 - RNA, 22 nt, Human
agccacagcacauuguaagaaa

SEQ ID NO: 657818 - RNA, 22 nt, Human
aagucagaauaauguuucuuuu

SEQ ID NO: 657819 - RNA, 22 nt, Human
uaaggcagaaauaugagcaggg

SEQ ID NO: 657820 - RNA, 22 nt, Human
acuggggauuagggacucagug

SEQ ID NO: 657821 - RNA, 22 nt, Human
uuauuuaaaagugguaagauuc

SEQ ID NO: 657822 - RNA, 22 nt, Human
auguuuuaugcuucagaugagg

SEQ ID NO: 657823 - RNA, 22 nt, Human
caauacaauuaccaguuaauca

SEQ ID NO: 657824 - RNA, 22 nt, Human
ccauuauccacgggcuuccuga

SEQ ID NO: 657825 - RNA, 22 nt, Human
auauucguggucaaguaaggcc

SEQ ID NO: 657826 - RNA, 23 nt, Human
ugcuguccaacagacuggccaug

SEQ ID NO: 657827 - RNA, 22 nt, Human
cccaggcuggagggcaguguca

SEQ ID NO: 657828 - RNA, 22 nt, Human
ucucaaggacuuugggcacuaa

SEQ ID NO: 657829 - RNA, 22 nt, Human
agcauuuauagccccuaucauc

SEQ ID NO: 657830 - RNA, 22 nt, Human
gccugcuggauguggccaggcc

SEQ ID NO: 657831 - RNA, 20 nt, Human
cgaggccaaggggcugggcc

SEQ ID NO: 657832 - RNA, 22 nt, Human
ugggcugagcagugaagcucau

SEQ ID NO: 657833 - RNA, 22 nt, Human
uaaagauaagacaucaacugag

SEQ ID NO: 657834 - RNA, 22 nt, Human
gaagcacugccauaauucagac

SEQ ID NO: 657835 - RNA, 22 nt, Human
uccagaaaauucagaaauuguu

SEQ ID NO: 657836 - RNA, 22 nt, Human
aagcaacuguugaauuggacua

SEQ ID NO: 657837 - RNA, 22 nt, Human
guucucaguggggagcaggguu

SEQ ID NO: 657838 - RNA, 22 nt, Human
gcaccccugcgugccuucccuu

SEQ ID NO: 657839 - RNA, 22 nt, Human
acuuucaacuuggugggagagc

SEQ ID NO: 657840 - RNA, 22 nt, Human
cacugaaggacaguaggaaggg

SEQ ID NO: 657841 - RNA, 21 nt, Human
agagaagaggacuuucucaca

SEQ ID NO: 657842 - RNA, 22 nt, Human
ccagugcaccaagaggccuaga

SEQ ID NO: 657843 - RNA, 22 nt, Human
ccaccccuguagagggacagac

SEQ ID NO: 657844 - RNA, 22 nt, Human
ggcagugaaucugagagccugg

SEQ ID NO: 657845 - RNA, 22 nt, Human
uucuccaaggauacaguccugu

SEQ ID NO: 657846 - RNA, 22 nt, Human
ucccaaggauaagagagucuga

SEQ ID NO: 657847 - RNA, 20 nt, Human
aaaguguaagcauauaauua

SEQ ID NO: 657848 - RNA, 22 nt, Human
aggaccugccaggugcaaagca

SEQ ID NO: 657849 - RNA, 22 nt, Human
acccagcaaagauaaacuuaug

SEQ ID NO: 657850 - RNA, 22 nt, Human
cuggaggagaacuugaggaagg

SEQ ID NO: 657851 - RNA, 23 nt, Human
uuugaaaguaucaacucgccuga

SEQ ID NO: 657852 - RNA, 22 nt, Human
uuucucauggcccuuggcuuuu

SEQ ID NO: 657853 - RNA, 22 nt, Human
gugacugugagucgcugugaca

SEQ ID NO: 657854 - RNA, 22 nt, Human
gggagaugacucagugaccucg

SEQ ID NO: 657855 - RNA, 22 nt, Human
aggccugggucucgugccuacc

SEQ ID NO: 657856 - RNA, 22 nt, Human
aauuccacagaugucuaucugu

SEQ ID NO: 657857 - RNA, 22 nt, Human
ugagacagccucugcacucaug

SEQ ID NO: 657858 - RNA, 22 nt, Human
gcagcaggaauaggauaagcaa

SEQ ID NO: 657859 - RNA, 22 nt, Human
uggcuucauggcugugcaaucu

SEQ ID NO: 657860 - RNA, 18 nt, Human
ucuguggcagcagugcac

SEQ ID NO: 657861 - RNA, 22 nt, Human
agaaauacuaggaauauucaua

SEQ ID NO: 657862 - RNA, 22 nt, Human
ggcagaggugacagugucuuuu

SEQ ID NO: 657863 - RNA, 22 nt, Human
cuccaguggcaaguccgggcgg

SEQ ID NO: 657864 - RNA, 22 nt, Human
ucagagguggagauaguuggga

SEQ ID NO: 657865 - RNA, 22 nt, Human
aacucagucauaaagcgaaugc

SEQ ID NO: 657866 - RNA, 22 nt, Human
cucugggcuucaagucagauuu

SEQ ID NO: 657867 - RNA, 22 nt, Human
uugcccugucucacuauguuaa

SEQ ID NO: 657868 - RNA, 22 nt, Human
uugcagacagugagagugaaag

SEQ ID NO: 657869 - RNA, 23 nt, Human
ccugcagcugcuggggcuccacc

SEQ ID NO: 657870 - RNA, 22 nt, Human
uuuagcagcugguguuaccaua

SEQ ID NO: 657871 - RNA, 22 nt, Human
ccugauggagcccugcugcaug

SEQ ID NO: 657872 - RNA, 22 nt, Human
gcaacaguuggauuccagagga

SEQ ID NO: 657873 - RNA, 21 nt, Human
uucucuggauaggccaguccu

SEQ ID NO: 657874 - RNA, 22 nt, Human
gaccuccguguacaccucccag

SEQ ID NO: 657875 - RNA, 22 nt, Human
agagaagggguaaagaguccug

SEQ ID NO: 657876 - RNA, 22 nt, Human
gcugccuguugaagggucugug

SEQ ID NO: 657877 - RNA, 22 nt, Human
guucauuuuacuguaaauagca

SEQ ID NO: 657878 - RNA, 22 nt, Human
ucucuuaggagaaauucauaaa

SEQ ID NO: 657879 - RNA, 20 nt, Human
acacaugugcguguucagua

SEQ ID NO: 657880 - RNA, 22 nt, Human
cuucauuucaggcugaagaaua

SEQ ID NO: 657881 - RNA, 22 nt, Human
ucucuucucuagugagcaacug

SEQ ID NO: 657882 - RNA, 22 nt, Human
gagccauuguccaagccuguuu

SEQ ID NO: 657883 - RNA, 22 nt, Human
auccuucaguggaagacaguag

SEQ ID NO: 657884 - RNA, 22 nt, Human
augaacacauguacacauuucu

SEQ ID NO: 657885 - RNA, 22 nt, Human
augcaaaugcagccauugcaga

SEQ ID NO: 657886 - RNA, 22 nt, Human
gcccuguggacagugagaagug

SEQ ID NO: 657887 - RNA, 22 nt, Human
uguuucaugauugcugucauuu

SEQ ID NO: 657888 - RNA, 22 nt, Human
uggguccacuucugcacugugg

SEQ ID NO: 657889 - RNA, 22 nt, Human
gcgguagcucaagcuuguaauc

SEQ ID NO: 657890 - RNA, 22 nt, Human
cagacaggaauucuggcguggu

SEQ ID NO: 657891 - RNA, 22 nt, Human
uggagagaaaguugaauggagg

SEQ ID NO: 657892 - RNA, 22 nt, Human
cugcugccucgacauugggaca

SEQ ID NO: 657893 - RNA, 22 nt, Human
aacagaggauguuugaaauuca

SEQ ID NO: 657894 - RNA, 23 nt, Human
acuagaaaaugacuuucucccug

SEQ ID NO: 657895 - RNA, 22 nt, Human
auucugucagaucuuacuggau

SEQ ID NO: 657896 - RNA, 22 nt, Human
ccagguagccaaggggucuggg

SEQ ID NO: 657897 - RNA, 22 nt, Human
acccagagcacagaugcaacgu

SEQ ID NO: 657898 - RNA, 22 nt, Human
cauguucaucagaucaauugua

SEQ ID NO: 657899 - RNA, 22 nt, Human
aaugguuuggacuauucaauag

SEQ ID NO: 657900 - RNA, 22 nt, Human
ccucaggcuuacgggcaaugga

SEQ ID NO: 657901 - RNA, 22 nt, Human
aaaccuggaacauuugacuagg

SEQ ID NO: 657902 - RNA, 22 nt, Human
caggauguaugucuuauucuuc

SEQ ID NO: 657903 - RNA, 22 nt, Human
gcugagagcaaggacaaagcau

SEQ ID NO: 657904 - RNA, 22 nt, Human
agcccagcuccuccacagaaua

SEQ ID NO: 657905 - RNA, 22 nt, Human
acuccucagccagcaucaggga

SEQ ID NO: 657906 - RNA, 22 nt, Human
agggucagugaugagggagccc

SEQ ID NO: 657907 - RNA, 22 nt, Human
ggcacugggcaccggcugaggg

SEQ ID NO: 657908 - RNA, 20 nt, Human
aaacauaguggauaccacag

SEQ ID NO: 657909 - RNA, 21 nt, Human
agggaaagaaaaugagcuaau

SEQ ID NO: 657910 - RNA, 22 nt, Human
gaauuugucccuugauauaaaa

SEQ ID NO: 657911 - RNA, 17 nt, Human
gcuccagaauucuaguc

SEQ ID NO: 657912 - RNA, 22 nt, Human
agggucaguagugaugcgugaa

SEQ ID NO: 657913 - RNA, 22 nt, Human
cauuuggaccaaaauagccaac

SEQ ID NO: 657914 - RNA, 22 nt, Human
cuucuuccaagcuuaugcucaa

SEQ ID NO: 657915 - RNA, 22 nt, Human
uuaaaaccuagagaucagacag

SEQ ID NO: 657916 - RNA, 22 nt, Human
cacaggcuuccaguccccagcu

SEQ ID NO: 657917 - RNA, 20 nt, Human
uucaggaauaagauagcagc

SEQ ID NO: 657918 - RNA, 20 nt, Human
uuccucaggagaggauguua

SEQ ID NO: 657919 - RNA, 22 nt, Human
aaaacagacagccaguguagag

SEQ ID NO: 657920 - RNA, 22 nt, Human
ggcaagcauaaccuguacagcc

SEQ ID NO: 657921 - RNA, 22 nt, Human
gggcucuguguucuagcucucg

SEQ ID NO: 657922 - RNA, 18 nt, Human
aucaaggaggggaagguc

SEQ ID NO: 657923 - RNA, 22 nt, Human
uucugucuucucgguuguuuac

SEQ ID NO: 657924 - RNA, 22 nt, Human
uggcucaguuaggucagaaaca

SEQ ID NO: 657925 - RNA, 22 nt, Human
cuggacacaaacaucuccucug

SEQ ID NO: 657926 - RNA, 22 nt, Human
gggugaggcccauuugaggcca

SEQ ID NO: 657927 - RNA, 22 nt, Human
acugcauugagguuucauacuu

SEQ ID NO: 657928 - RNA, 22 nt, Human
uuacagaaguuucagcguuuua

SEQ ID NO: 657929 - RNA, 22 nt, Human
aucacacuuuuguaaccaucag

SEQ ID NO: 657930 - RNA, 22 nt, Human
gcugagcacaccuaggguagag

SEQ ID NO: 657931 - RNA, 22 nt, Human
uuguccuuggaugaagcuggga

SEQ ID NO: 657932 - RNA, 22 nt, Human
gcccaagcuccgccuccugucg

SEQ ID NO: 657933 - RNA, 22 nt, Human
aagcccuuggcgcacaccgggc

SEQ ID NO: 657934 - RNA, 22 nt, Human
guagaauauaugguuaguauug

SEQ ID NO: 657935 - RNA, 22 nt, Human
gcuaggaaaggaagaacuuuga

SEQ ID NO: 657936 - RNA, 22 nt, Human
gagguacagaguguuccaaugu

SEQ ID NO: 657937 - RNA, 22 nt, Human
cuuuagauguugcuuuaacuau

SEQ ID NO: 657938 - RNA, 22 nt, Human
aggcagcugugaggacuggauu

SEQ ID NO: 657939 - RNA, 22 nt, Human
ugagagcugcugagacuguccu

SEQ ID NO: 657940 - RNA, 22 nt, Human
gggggaagaggcaugaaguccu

SEQ ID NO: 657941 - RNA, 22 nt, Human
gaggguggguuucuugcacguc

SEQ ID NO: 657942 - RNA, 22 nt, Human
gaaguuauagcuaugaucuuaa

SEQ ID NO: 657943 - RNA, 22 nt, Human
ucccucuguguugggcaugccu

SEQ ID NO: 657944 - RNA, 22 nt, Human
cuuucucuguggugaggagggu

SEQ ID NO: 657945 - RNA, 22 nt, Human
ucugggaauaaaacuagggacu

SEQ ID NO: 657946 - RNA, 22 nt, Human
cuggguggcgucuggggccagu

SEQ ID NO: 657947 - RNA, 22 nt, Human
guucacagaaauuguguaccuc

SEQ ID NO: 657948 - RNA, 22 nt, Human
gucuuuggagaggugccauuuc

SEQ ID NO: 657949 - RNA, 22 nt, Human
guagaucugccuuaaccuggga

SEQ ID NO: 657950 - RNA, 22 nt, Human
ccugagcucugcacuuuuuaga

SEQ ID NO: 657951 - RNA, 22 nt, Human
augcaauaccuucugaaaauaa

SEQ ID NO: 657952 - RNA, 22 nt, Human
gaggcuucccgcccaugcugga

SEQ ID NO: 657953 - RNA, 22 nt, Human
cccagcccugaccuauuggaaa

SEQ ID NO: 657954 - RNA, 22 nt, Human
cugcagcuuaaaggaguucaau

SEQ ID NO: 657955 - RNA, 21 nt, Human
gauaaaaugggccuugguccu

SEQ ID NO: 657956 - RNA, 22 nt, Human
gggaaggcagugucugguugaa

SEQ ID NO: 657957 - RNA, 22 nt, Human
uauagacuugaugguauuaagu

SEQ ID NO: 657958 - RNA, 19 nt, Human
cccagagcauccugaacuu

SEQ ID NO: 657959 - RNA, 22 nt, Human
uuuggaaugguaccuucaguug

SEQ ID NO: 657960 - RNA, 22 nt, Human
ugcaagagguaaaaugaaagga

SEQ ID NO: 657961 - RNA, 22 nt, Human
caaacugagcaucagaaaguuu

SEQ ID NO: 657962 - RNA, 23 nt, Human
cuguggccaccccuagcuggagg

SEQ ID NO: 657963 - RNA, 22 nt, Human
cuuucccuuuugccuugcgugg

SEQ ID NO: 657964 - RNA, 22 nt, Human
gcuccagcuccggcuccgaagc

SEQ ID NO: 657965 - RNA, 22 nt, Human
cuacaguagagguugucaggga

SEQ ID NO: 657966 - RNA, 22 nt, Human
aaccauguacuuuauucuguuu

SEQ ID NO: 657967 - RNA, 22 nt, Human
cuggagggggaaauguucauug

SEQ ID NO: 657968 - RNA, 22 nt, Human
uccaacuaggcacacagcuggu

SEQ ID NO: 657969 - RNA, 22 nt, Human
acauuuaaccuuugaggaacug

SEQ ID NO: 657970 - RNA, 22 nt, Human
aacacaguuuuccaaaauagag

SEQ ID NO: 657971 - RNA, 22 nt, Human
uucugcauacacugaauguagu

SEQ ID NO: 657972 - RNA, 22 nt, Human
ggcugccucccaggagaaucug

SEQ ID NO: 657973 - RNA, 22 nt, Human
uaccugagaagaaacccguguu

SEQ ID NO: 657974 - RNA, 22 nt, Human
agcacugugauuuauaacauuu

SEQ ID NO: 657975 - RNA, 23 nt, Human
gugagucuugccuuugcugugga

SEQ ID NO: 657976 - RNA, 22 nt, Human
uaagguuugaagaagacugagc

SEQ ID NO: 657977 - RNA, 22 nt, Human
uggucugggcaaauccuucuga

SEQ ID NO: 657978 - RNA, 22 nt, Human
ucuugcaggcaugaaaggacuc

SEQ ID NO: 657979 - RNA, 22 nt, Human
cccagcuucugagggggccuug

SEQ ID NO: 657980 - RNA, 22 nt, Human
ggaacacaaaugggagagcugg

SEQ ID NO: 657981 - RNA, 18 nt, Human
agcugguggggagacagc

SEQ ID NO: 657982 - RNA, 22 nt, Human
gguggggcccuggcacugguau

SEQ ID NO: 657983 - RNA, 22 nt, Human
uccguguucuccagagauaauc

SEQ ID NO: 657984 - RNA, 22 nt, Human
cugugugccuccugugaucagg

SEQ ID NO: 657985 - RNA, 22 nt, Human
augagugauggguacauuggcu

SEQ ID NO: 657986 - RNA, 22 nt, Human
acucagaaccauuuacucugag

SEQ ID NO: 657987 - RNA, 22 nt, Human
cagcuuguuuuauuuggggacc

SEQ ID NO: 657988 - RNA, 22 nt, Human
auucuccaguagucauucuauc

SEQ ID NO: 657989 - RNA, 22 nt, Human
ugaaguuuucugguugauuaag

SEQ ID NO: 657990 - RNA, 22 nt, Human
guacagcuaagaauuucaucuu

SEQ ID NO: 657991 - RNA, 22 nt, Human
cacccuggcuggaggugcagug

SEQ ID NO: 657992 - RNA, 22 nt, Human
cuguggcuuucucugccuccuu

SEQ ID NO: 657993 - RNA, 22 nt, Human
auuuggaggccucuccugcuug

SEQ ID NO: 657994 - RNA, 22 nt, Human
cccaguaagaagcuggcaccag

SEQ ID NO: 657995 - RNA, 19 nt, Human
ucucagaauuggcaaucau

SEQ ID NO: 657996 - RNA, 22 nt, Human
gcacugcuuucugagucauugu

SEQ ID NO: 657997 - RNA, 22 nt, Human
gaacuguauaggagcaguguuu

SEQ ID NO: 657998 - RNA, 22 nt, Human
agugagcuaugaucauguuacu

SEQ ID NO: 657999 - RNA, 22 nt, Human
uuucuaaggccagagacugcug

SEQ ID NO: 658000 - RNA, 22 nt, Human
aucugccugcuuaugaugccug

SEQ ID NO: 658001 - RNA, 22 nt, Human
gggccccaguccucccacgugg

SEQ ID NO: 658002 - RNA, 22 nt, Human
cccuggagugccggaaucaaga

SEQ ID NO: 658003 - RNA, 22 nt, Human
ucaguuuucucauuuaugagau

SEQ ID NO: 658004 - RNA, 22 nt, Human
cacugacuaaguuugugaaggu

SEQ ID NO: 658005 - RNA, 22 nt, Human
uuuuaaguuaauauaauugagg

SEQ ID NO: 658006 - RNA, 22 nt, Human
agucuguguauauucacugccc

SEQ ID NO: 658007 - RNA, 22 nt, Human
auuaauguguagccaacuuaau

SEQ ID NO: 658008 - RNA, 22 nt, Human
ggucccaguccucucccugcua

SEQ ID NO: 658009 - RNA, 22 nt, Human
uuaagucacuuaucuaaagaca

SEQ ID NO: 658010 - RNA, 22 nt, Human
acccugcuuuaugccguccucu

SEQ ID NO: 658011 - RNA, 22 nt, Human
acaguguucucuuccuguauag

SEQ ID NO: 658012 - RNA, 22 nt, Human
gucuggccauuugcccauugug

SEQ ID NO: 658013 - RNA, 20 nt, Human
cagucccaauccagggccag

SEQ ID NO: 658014 - RNA, 22 nt, Human
uuaccacagugccugucuaaug

SEQ ID NO: 658015 - RNA, 22 nt, Human
cuggacagaaaccaguccuggg

SEQ ID NO: 658016 - RNA, 22 nt, Human
ggauggcauguugggcucuguu

SEQ ID NO: 658017 - RNA, 22 nt, Human
guccugguagggcucugugucu

SEQ ID NO: 658018 - RNA, 19 nt, Human
ucagugcuccuauguccuu

SEQ ID NO: 658019 - RNA, 22 nt, Human
uuucuccucuccagagugcagu

SEQ ID NO: 658020 - RNA, 22 nt, Human
gcucugugccagggcugggcca

SEQ ID NO: 658021 - RNA, 22 nt, Human
uaguacaguggagagcaaagaa

SEQ ID NO: 658022 - RNA, 22 nt, Human
acaaaguguuuucugaaggccu

SEQ ID NO: 658023 - RNA, 22 nt, Human
ccaauacacuuuauagaagaaa

SEQ ID NO: 658024 - RNA, 22 nt, Human
cagcccaaagccccaggcuaga

SEQ ID NO: 658025 - RNA, 22 nt, Human
uacugugacagaguacuuaaac

SEQ ID NO: 658026 - RNA, 22 nt, Human
guuuccaggcgauaucagcugc

SEQ ID NO: 658027 - RNA, 22 nt, Human
gcagauuucuaauaagcaaugu

SEQ ID NO: 658028 - RNA, 22 nt, Human
augcauauuucuugggcuuacc

SEQ ID NO: 658029 - RNA, 22 nt, Human
uuuuuaagagauucuccagucu

SEQ ID NO: 658030 - RNA, 22 nt, Human
acucuuguuuguagagcccacc

SEQ ID NO: 658031 - RNA, 22 nt, Human
ucaggcuuuuucucaaccucuu

SEQ ID NO: 658032 - RNA, 22 nt, Human
aaggaaggaauugaucaugcgc

SEQ ID NO: 658033 - RNA, 22 nt, Human
cuuauuuccugacauggaaaga

SEQ ID NO: 658034 - RNA, 22 nt, Human
cagugccaaggauggccuggga

SEQ ID NO: 658035 - RNA, 22 nt, Human
cugugggagaagcuagcacagg

SEQ ID NO: 658036 - RNA, 22 nt, Human
aaucuuucguuucuccugucug

SEQ ID NO: 658037 - RNA, 22 nt, Human
gccagugugcaagaaaacagaa

SEQ ID NO: 658038 - RNA, 20 nt, Human
cuggacuugcugcucaccug

SEQ ID NO: 658039 - RNA, 22 nt, Human
cuucuugcugggggccucagug

SEQ ID NO: 658040 - RNA, 22 nt, Human
agggccagaguacaucagggcu

SEQ ID NO: 658041 - RNA, 22 nt, Human
uuccugggagcuagccacaucu

SEQ ID NO: 658042 - RNA, 22 nt, Human
ugcugcucgccacggcccaggg

SEQ ID NO: 658043 - RNA, 22 nt, Human
agaacaggcaguugguuggauu

SEQ ID NO: 658044 - RNA, 22 nt, Human
augcauauagaacauuugacau

SEQ ID NO: 658045 - RNA, 22 nt, Human
cacugaaggcuaggauuagaug

SEQ ID NO: 658046 - RNA, 23 nt, Human
ucagcaucaccugggaacuuacu

SEQ ID NO: 658047 - RNA, 22 nt, Human
uucaauuucauaauaucuagcu

SEQ ID NO: 658048 - RNA, 22 nt, Human
cugcuguggaugcaggaccuca

SEQ ID NO: 658049 - RNA, 22 nt, Human
gcugccuucuggaggaagugaa

SEQ ID NO: 658050 - RNA, 22 nt, Human
caggaagcuggucagauccugu

SEQ ID NO: 658051 - RNA, 22 nt, Human
agcugacucuggccucuggucc

SEQ ID NO: 658052 - RNA, 22 nt, Human
acccaggggcagccuugcugug

SEQ ID NO: 658053 - RNA, 22 nt, Human
cuucucugacagucuguuucac

SEQ ID NO: 658054 - RNA, 22 nt, Human
agaaggcuaaagaaacagauug

SEQ ID NO: 658055 - RNA, 20 nt, Human
ggacacuguagauuucaaac

SEQ ID NO: 658056 - RNA, 22 nt, Human
augcaggggcagcagagccugg

SEQ ID NO: 658057 - RNA, 22 nt, Human
acauucccuuggcuugaagcag

SEQ ID NO: 658058 - RNA, 22 nt, Human
ucaauauauuccauguuuucuc

SEQ ID NO: 658059 - RNA, 22 nt, Human
gugcugcugccagcaggauccu

SEQ ID NO: 658060 - RNA, 21 nt, Human
acaaugucaaggucagacauu

SEQ ID NO: 658061 - RNA, 22 nt, Human
uauggcuuuaaauugaaggagu

SEQ ID NO: 658062 - RNA, 22 nt, Human
ggcucugguggcaauugacugg

SEQ ID NO: 658063 - RNA, 22 nt, Human
acagacaugggccgcucuugag

SEQ ID NO: 658064 - RNA, 22 nt, Human
uggaacacuuuguugaaaugca

SEQ ID NO: 658065 - RNA, 22 nt, Human
ucaguaucuacuaucuugauga

SEQ ID NO: 658066 - RNA, 18 nt, Human
ugcuggcaacuacuauug

SEQ ID NO: 658067 - RNA, 20 nt, Human
uauugccuaaauaccagaau

SEQ ID NO: 658068 - RNA, 22 nt, Human
agugacacggagagacagcaug

SEQ ID NO: 658069 - RNA, 19 nt, Human
ucaggaaguugaugaggug

SEQ ID NO: 658070 - RNA, 22 nt, Human
gcagugcauuacucacauguuu

SEQ ID NO: 658071 - RNA, 20 nt, Human
uuaugcaagcaucaauauug

SEQ ID NO: 658072 - RNA, 23 nt, Human
uauucagcagugggauuuguugu

SEQ ID NO: 658073 - RNA, 22 nt, Human
uggcuaagcaugcuccagcugc

SEQ ID NO: 658074 - RNA, 22 nt, Human
caagaugccccugguagggauc

SEQ ID NO: 658075 - RNA, 22 nt, Human
uucccagguaauucugaggcag

SEQ ID NO: 658076 - RNA, 20 nt, Human
uauuuugcaauuaugguuca

SEQ ID NO: 658077 - RNA, 22 nt, Human
uggggcagggaugggaaacuau

SEQ ID NO: 658078 - RNA, 22 nt, Human
cugaggucaccccacuggcugu

SEQ ID NO: 658079 - RNA, 22 nt, Human
cagagagaggccacugcuauua

SEQ ID NO: 658080 - RNA, 22 nt, Human
gcugggcaugugaccaacagaa

SEQ ID NO: 658081 - RNA, 22 nt, Human
aacagcuguucgcagauguagg

SEQ ID NO: 658082 - RNA, 22 nt, Human
cagucccaugagcccagaacau

SEQ ID NO: 658083 - RNA, 22 nt, Human
uccuggguagagaccugaugaa

SEQ ID NO: 658084 - RNA, 18 nt, Human
ccugucugggguccccac

SEQ ID NO: 658085 - RNA, 22 nt, Human
ggcgcucaguguugccccagag

SEQ ID NO: 658086 - RNA, 22 nt, Human
gccugugacucgucuugggcca

SEQ ID NO: 658087 - RNA, 22 nt, Human
acugagcaguagauuuucuguu

SEQ ID NO: 658088 - RNA, 22 nt, Human
ucagagccccuccgcuguccca

SEQ ID NO: 658089 - RNA, 22 nt, Human
uauacacaccuccaaagcagga

SEQ ID NO: 658090 - RNA, 22 nt, Human
acacauuaucucauuaaauacu

SEQ ID NO: 658091 - RNA, 22 nt, Human
aaguuuguucauucauucaucc

SEQ ID NO: 658092 - RNA, 22 nt, Human
accuggagggaaguucugacuu

SEQ ID NO: 658093 - RNA, 22 nt, Human
cccccagccagcagugcucagc

SEQ ID NO: 658094 - RNA, 19 nt, Human
agcugugcagacacuucgc

SEQ ID NO: 658095 - RNA, 22 nt, Human
cagcccugcugccuuagugccu

SEQ ID NO: 658096 - RNA, 22 nt, Human
gcaggggcugcugggaacucgg

SEQ ID NO: 658097 - RNA, 20 nt, Human
aagcaauauagugcaaaugu

SEQ ID NO: 658098 - RNA, 22 nt, Human
aaauugucuuuaaucaggucau

SEQ ID NO: 658099 - RNA, 22 nt, Human
agaagcaccugucagcuacaug

SEQ ID NO: 658100 - RNA, 22 nt, Human
aucagcaucuuuaacaauuacc

SEQ ID NO: 658101 - RNA, 22 nt, Human
uacaacauaacgggcauucagu

SEQ ID NO: 658102 - RNA, 22 nt, Human
caggcuagauuggggccaguag

SEQ ID NO: 658103 - RNA, 22 nt, Human
acacagauaaugcucauauagg

SEQ ID NO: 658104 - RNA, 22 nt, Human
ugaaacagaguggauacaguga

SEQ ID NO: 658105 - RNA, 22 nt, Human
auccacagugcagcaagggccc

SEQ ID NO: 658106 - RNA, 22 nt, Human
ccaggaagccuuuuucuuugac

SEQ ID NO: 658107 - RNA, 22 nt, Human
ucaaacuguucagaacuccuuu

SEQ ID NO: 658108 - RNA, 22 nt, Human
cuggcuguauuaguuugauccu

SEQ ID NO: 658109 - RNA, 19 nt, Human
ucacuugaaguucagaaau

SEQ ID NO: 658110 - RNA, 22 nt, Human
ccucugcaucuggcugcugcag

SEQ ID NO: 658111 - RNA, 22 nt, Human
gcggcgccugggacccgccagc

SEQ ID NO: 658112 - RNA, 22 nt, Human
uccaucuguuuacuauaaagau

SEQ ID NO: 658113 - RNA, 22 nt, Human
uauguagguaaacacagacaua

SEQ ID NO: 658114 - RNA, 22 nt, Human
gccuuggaaagcuggagcaguu

SEQ ID NO: 658115 - RNA, 22 nt, Human
gcucucugggugugucuagaua

SEQ ID NO: 658116 - RNA, 20 nt, Human
cugggcaccugucugcaguu

SEQ ID NO: 658117 - RNA, 22 nt, Human
agugcuccaaagguuggucauu

SEQ ID NO: 658118 - RNA, 22 nt, Human
uuagaaccagcauuuguccugg

SEQ ID NO: 658119 - RNA, 22 nt, Human
uauuuauaacagugagaacggg

SEQ ID NO: 658120 - RNA, 22 nt, Human
guugaacuauguuuuaucugac

SEQ ID NO: 658121 - RNA, 22 nt, Human
cugcaggcucgaagacacggau

SEQ ID NO: 658122 - RNA, 22 nt, Human
aaaauucucuugaucuugacag

SEQ ID NO: 658123 - RNA, 22 nt, Human
uggcuucauggcaagucuuagu

SEQ ID NO: 658124 - RNA, 22 nt, Human
gacaggguggcugauagggcuc

SEQ ID NO: 658125 - RNA, 22 nt, Human
ucugcagagcauuauagcaaaa

SEQ ID NO: 658126 - RNA, 22 nt, Human
uuucuaagugaacauucaaguu

SEQ ID NO: 658127 - RNA, 21 nt, Human
aggauggaaaggacuaggggu

SEQ ID NO: 658128 - RNA, 23 nt, Human
ggagaggggugugggcaucuuua

SEQ ID NO: 658129 - RNA, 21 nt, Human
guggcccugccgcagugucca

SEQ ID NO: 658130 - RNA, 22 nt, Human
cccagugucuccaacaucagau

SEQ ID NO: 658131 - RNA, 22 nt, Human
aauaagcaagccugugugcaag

SEQ ID NO: 658132 - RNA, 22 nt, Human
ugccaucuuccuuccucugcac

SEQ ID NO: 658133 - RNA, 21 nt, Human
gugcacaguccugcacacagg

SEQ ID NO: 658134 - RNA, 22 nt, Human
agacaguaugauauaugaauac

SEQ ID NO: 658135 - RNA, 16 nt, Human
aaggagggaagagaau

SEQ ID NO: 658136 - RNA, 22 nt, Human
caguguuuuguuacuugggcac

SEQ ID NO: 658137 - RNA, 22 nt, Human
agacaggcagaggcugcagagg

SEQ ID NO: 658138 - RNA, 23 nt, Human
ugcugggguaguuuguggcacag

SEQ ID NO: 658139 - RNA, 22 nt, Human
auuugucuaaugaguguguacu

SEQ ID NO: 658140 - RNA, 21 nt, Human
gcugugcacauaguagaagug

SEQ ID NO: 658141 - RNA, 22 nt, Human
uggcaggaaauacccugccuag

SEQ ID NO: 658142 - RNA, 22 nt, Human
ugugcguggauuccuguacuca

SEQ ID NO: 658143 - RNA, 21 nt, Human
gccagagcaguacaaugaggu

SEQ ID NO: 658144 - RNA, 22 nt, Human
acacacagaaggaagccccacu

SEQ ID NO: 658145 - RNA, 22 nt, Human
aacaugaugugaagcaugaacu

SEQ ID NO: 658146 - RNA, 22 nt, Human
cacaauuuguauuuugcaucca

SEQ ID NO: 658147 - RNA, 22 nt, Human
auucuuuuuuaaggaauagaac

SEQ ID NO: 658148 - RNA, 22 nt, Human
ucucugugcaggaugcugaguu

SEQ ID NO: 658149 - RNA, 22 nt, Human
aggcagcccugugcuggaugcu

SEQ ID NO: 658150 - RNA, 22 nt, Human
gagugucucacaguagcauuuu

SEQ ID NO: 658151 - RNA, 22 nt, Human
acuugauuuuuauaauaaaugg

SEQ ID NO: 658152 - RNA, 22 nt, Human
gacuccauccaaucuguguucu

SEQ ID NO: 658153 - RNA, 22 nt, Human
guggagagagauaagccugguc

SEQ ID NO: 658154 - RNA, 22 nt, Human
caggaaguuguguguucgaggc

SEQ ID NO: 658155 - RNA, 21 nt, Human
ggaagcuguguccaugcuccu

SEQ ID NO: 658156 - RNA, 22 nt, Human
uuggccaguggaaagaggagga

SEQ ID NO: 658157 - RNA, 22 nt, Human
ucacaugccuuuuacucugcac

SEQ ID NO: 658158 - RNA, 22 nt, Human
agcccuggcccggcugugcuuu

SEQ ID NO: 658159 - RNA, 22 nt, Human
ugucacauaggcaaaauguuuu

SEQ ID NO: 658160 - RNA, 22 nt, Human
agcacaggaacauggagauggg

SEQ ID NO: 658161 - RNA, 22 nt, Human
auuccugagacuuaucuguuuc

SEQ ID NO: 658162 - RNA, 22 nt, Human
cuaugcaucugaacaauagaga

SEQ ID NO: 658163 - RNA, 22 nt, Human
uucauaaucaccaaaaacugga

SEQ ID NO: 658164 - RNA, 22 nt, Human
gacaggguccaaaggcagggga

SEQ ID NO: 658165 - RNA, 22 nt, Human
guucauaauuugaaggaauagg

SEQ ID NO: 658166 - RNA, 22 nt, Human
agaagaacuuagcuuucuaucu

SEQ ID NO: 658167 - RNA, 22 nt, Human
augcuauacauaugacaucaca

SEQ ID NO: 658168 - RNA, 22 nt, Human
cacugcccuuacaugcccugca

SEQ ID NO: 658169 - RNA, 22 nt, Human
uccuguguugauagagaugguu

SEQ ID NO: 658170 - RNA, 22 nt, Human
aaacaagguacacaguaauggu

SEQ ID NO: 658171 - RNA, 22 nt, Human
gcagggcucugcuguaguccua

SEQ ID NO: 658172 - RNA, 22 nt, Human
cuucagccucaucucagcccgu

SEQ ID NO: 658173 - RNA, 22 nt, Human
aaacugcacaagggugcauagc

SEQ ID NO: 658174 - RNA, 22 nt, Human
cugaggugagaggaggccaugu

SEQ ID NO: 658175 - RNA, 22 nt, Human
auuugacagugaguuguggaug

SEQ ID NO: 658176 - RNA, 22 nt, Human
ccagaggaaaaauaucucccua

SEQ ID NO: 658177 - RNA, 21 nt, Human
auccauccaucuuggccuaac

SEQ ID NO: 658178 - RNA, 22 nt, Human
uaaaggcacugcgucccucaaa

SEQ ID NO: 658179 - RNA, 22 nt, Human
cuuggguguuuuaaaacuagau

SEQ ID NO: 658180 - RNA, 22 nt, Human
cuggagaguaaucucuguguua

SEQ ID NO: 658181 - RNA, 20 nt, Human
augugucuguaaacaacucu

SEQ ID NO: 658182 - RNA, 22 nt, Human
ugcugugcaucauaguguuugg

SEQ ID NO: 658183 - RNA, 22 nt, Human
uaccagccucuguugggggugg

SEQ ID NO: 658184 - RNA, 22 nt, Human
agcagccaauuggaggaugaag

SEQ ID NO: 658185 - RNA, 22 nt, Human
aaugcuuccaaaauaccaagcc

SEQ ID NO: 658186 - RNA, 22 nt, Human
ugccuugguuuccccaucugua

SEQ ID NO: 658187 - RNA, 22 nt, Human
auggccagagaggccagccugg

SEQ ID NO: 658188 - RNA, 22 nt, Human
gaggagccaagguauguguguu

SEQ ID NO: 658189 - RNA, 22 nt, Human
gaagccacguuaaauuggcugu

SEQ ID NO: 658190 - RNA, 22 nt, Human
cauaaauuguacccauuccaac

SEQ ID NO: 658191 - RNA, 22 nt, Human
aaugucuaugauccuuuaaguu

SEQ ID NO: 658192 - RNA, 21 nt, Human
ucccagggucuuaugggaugu

SEQ ID NO: 658193 - RNA, 22 nt, Human
caaagugcuggaauuacaggug

SEQ ID NO: 658194 - RNA, 22 nt, Human
cugagcaguagagggucucuuu

SEQ ID NO: 658195 - RNA, 22 nt, Human
agucuggagugauuauguggga

SEQ ID NO: 658196 - RNA, 22 nt, Human
ggugagcacugcccugggucuc

SEQ ID NO: 658197 - RNA, 20 nt, Human
ggugcagguaacgcugugcu

SEQ ID NO: 658198 - RNA, 22 nt, Human
ccugucugaaucaugauuuccu

SEQ ID NO: 658199 - RNA, 22 nt, Human
ccuggaggcucugggagggcag

SEQ ID NO: 658200 - RNA, 22 nt, Human
uuuaauguuugagucaguauau

SEQ ID NO: 658201 - RNA, 22 nt, Human
agggaucaaaaaauguacaugc

SEQ ID NO: 658202 - RNA, 22 nt, Human
uccagccaagggagguuacuag

SEQ ID NO: 658203 - RNA, 22 nt, Human
uccccagucccggcggugggug

SEQ ID NO: 658204 - RNA, 22 nt, Human
acaguuugcacuguucaucaaa

SEQ ID NO: 658205 - RNA, 22 nt, Human
gacaugcaugaaugcaggucuc

SEQ ID NO: 658206 - RNA, 22 nt, Human
cuuucagcaucccugggauuac

SEQ ID NO: 658207 - RNA, 22 nt, Human
gggcaggagagggccaccugga

SEQ ID NO: 658208 - RNA, 17 nt, Human
ucugccgacugccagcu

SEQ ID NO: 658209 - RNA, 22 nt, Human
ucaaaggaauuugauuuugaug

SEQ ID NO: 658210 - RNA, 22 nt, Human
aggcuuaaugaguuaaaucacu

SEQ ID NO: 658211 - RNA, 22 nt, Human
aaagcagcaacagcuguuagaa

SEQ ID NO: 658212 - RNA, 22 nt, Human
cugugcccucuuugcuggccuu

SEQ ID NO: 658213 - RNA, 22 nt, Human
agaguuuggagagggugaggca

SEQ ID NO: 658214 - RNA, 22 nt, Human
gagcugggaggacugggaacuu

SEQ ID NO: 658215 - RNA, 22 nt, Human
uaacagaguaacagguauguaa

SEQ ID NO: 658216 - RNA, 23 nt, Human
auguccaguuuacuucaggauga

SEQ ID NO: 658217 - RNA, 22 nt, Human
ugcuauuaaugaggcugcauuu

SEQ ID NO: 658218 - RNA, 22 nt, Human
cuuagaaaugcagauucucagg

SEQ ID NO: 658219 - RNA, 22 nt, Human
augugcuuggaaaagcaguggu

SEQ ID NO: 658220 - RNA, 22 nt, Human
ccuggcucagcagcucuuucuc

SEQ ID NO: 658221 - RNA, 22 nt, Human
aacuuuauuguuaggggcuaaa

SEQ ID NO: 658222 - RNA, 22 nt, Human
uuuuccuaguaggccuauuaga

SEQ ID NO: 658223 - RNA, 22 nt, Human
ccaggacaagccagagggacag

SEQ ID NO: 658224 - RNA, 22 nt, Human
aggcuucuugggcuucauucug

SEQ ID NO: 658225 - RNA, 22 nt, Human
gggaccugaggcccugcuccac

SEQ ID NO: 658226 - RNA, 22 nt, Human
acaguguuuaagagauggcauu

SEQ ID NO: 658227 - RNA, 22 nt, Human
acaugcauauacuuaaauaugu

SEQ ID NO: 658228 - RNA, 22 nt, Human
acauacauauguuuaaaugcau

SEQ ID NO: 658229 - RNA, 22 nt, Human
aaacaaguuuagaauaaugaau

SEQ ID NO: 658230 - RNA, 22 nt, Human
gucccugggaaaggagagggca

SEQ ID NO: 658231 - RNA, 22 nt, Human
auuccacagcuacaucaaucua

SEQ ID NO: 658232 - RNA, 22 nt, Human
ucauauuucaaaauggcuggag

SEQ ID NO: 658233 - RNA, 22 nt, Human
ugucauuuaucuuauaguaauc

SEQ ID NO: 658234 - RNA, 22 nt, Human
guuccuaaccagcagagaaaca

SEQ ID NO: 658235 - RNA, 22 nt, Human
aaggacaggcacagugguggag

SEQ ID NO: 658236 - RNA, 22 nt, Human
ugcagagggagugacgguucac

SEQ ID NO: 658237 - RNA, 22 nt, Human
ugauucugccacguacuggcug

SEQ ID NO: 658238 - RNA, 22 nt, Human
aagugcauuagauagaaugaug

SEQ ID NO: 658239 - RNA, 22 nt, Human
ggacacagccacuuaggguacc

SEQ ID NO: 658240 - RNA, 22 nt, Human
uuacacaaaagcaagugugugu

SEQ ID NO: 658241 - RNA, 22 nt, Human
uugacaaauacccauuagacca

SEQ ID NO: 658242 - RNA, 22 nt, Human
uggcauguuaaaguaguauuaa

SEQ ID NO: 658243 - RNA, 22 nt, Human
ggaggcccagaaggaagcccag

SEQ ID NO: 658244 - RNA, 22 nt, Human
cuuaucagauuaucugggcugu

SEQ ID NO: 658245 - RNA, 22 nt, Human
gcuguuuccccuucacaguggc

SEQ ID NO: 658246 - RNA, 22 nt, Human
cuugcuucugcugcacuauccu

SEQ ID NO: 658247 - RNA, 22 nt, Human
gauguacaaugucacuaugacc

SEQ ID NO: 658248 - RNA, 22 nt, Human
aucuggcucaccuggguaaaua

SEQ ID NO: 658249 - RNA, 22 nt, Human
ccaaggcacacucugcaagguu

SEQ ID NO: 658250 - RNA, 22 nt, Human
aaaagacaggugucugcggccc

SEQ ID NO: 658251 - RNA, 22 nt, Human
ggccugagaaccauggggccaa

SEQ ID NO: 658252 - RNA, 22 nt, Human
gugaaguugauuguuaucguca

SEQ ID NO: 658253 - RNA, 22 nt, Human
gacagccucaugaggagcaaaa

SEQ ID NO: 658254 - RNA, 22 nt, Human
caguuuauaguuguuaugugug

SEQ ID NO: 658255 - RNA, 22 nt, Human
aucaagcagugaaaaaugcuag

SEQ ID NO: 658256 - RNA, 22 nt, Human
auguggcuagugcagaugaaua

SEQ ID NO: 658257 - RNA, 22 nt, Human
ucaccaccagaagagcuauucu

SEQ ID NO: 658258 - RNA, 22 nt, Human
agaugugagaaucaagugacca

SEQ ID NO: 658259 - RNA, 22 nt, Human
ccucuugauugguuggaagcgg

SEQ ID NO: 658260 - RNA, 22 nt, Human
guggcacacaggagagagcuca

SEQ ID NO: 658261 - RNA, 22 nt, Human
auauuucuccaaauguuuucaa

SEQ ID NO: 658262 - RNA, 22 nt, Human
caaguuuguguucuaucauucu

SEQ ID NO: 658263 - RNA, 22 nt, Human
gcugacugauggacacagcacc

SEQ ID NO: 658264 - RNA, 22 nt, Human
acauggaagcaaaguucuauuu

SEQ ID NO: 658265 - RNA, 22 nt, Human
aaggcacuagcagaauuaguga

SEQ ID NO: 658266 - RNA, 22 nt, Human
aacauucaccucuaccuccuuc

SEQ ID NO: 658267 - RNA, 22 nt, Human
cccaggaggcgcagguugcggu

SEQ ID NO: 658268 - RNA, 22 nt, Human
ugcagccaucgcagagucugua

SEQ ID NO: 658269 - RNA, 22 nt, Human
ucucagcacguuguuuucauug

SEQ ID NO: 658270 - RNA, 22 nt, Human
uccugucagugaggcagaugaa

SEQ ID NO: 658271 - RNA, 22 nt, Human
agcagggccugagugaccuaac

SEQ ID NO: 658272 - RNA, 22 nt, Human
gcaggccugacuguagggggca

SEQ ID NO: 658273 - RNA, 22 nt, Human
aguguguagcaauaugcuggca

SEQ ID NO: 658274 - RNA, 22 nt, Human
aaaaaucuaugacugcuucucc

SEQ ID NO: 658275 - RNA, 22 nt, Human
gcugggucuggaugcucaggug

SEQ ID NO: 658276 - RNA, 22 nt, Human
ugagauugugugcuucagaaau

SEQ ID NO: 658277 - RNA, 22 nt, Human
ccugucugaaggcagggggaug

SEQ ID NO: 658278 - RNA, 22 nt, Human
ucaguguccggagccugagugc

SEQ ID NO: 658279 - RNA, 22 nt, Human
ucucuaagauaggaauacaguu

SEQ ID NO: 658280 - RNA, 22 nt, Human
guauguguugaauucagggguc

SEQ ID NO: 658281 - RNA, 22 nt, Human
ggagggcccugggugcagcucu

SEQ ID NO: 658282 - RNA, 22 nt, Human
uaagaauuccaucgcagaguau

SEQ ID NO: 658283 - RNA, 22 nt, Human
agccacagucugaugccugaga

SEQ ID NO: 658284 - RNA, 22 nt, Human
auauauucuuaaagaaucugac

SEQ ID NO: 658285 - RNA, 22 nt, Human
cagugagggcauucagugcugg

SEQ ID NO: 658286 - RNA, 22 nt, Human
ucuggcccuauggcauguaccu

SEQ ID NO: 658287 - RNA, 22 nt, Human
ccagcucugcagggccuggggu

SEQ ID NO: 658288 - RNA, 22 nt, Human
ugauucaauuaucugaugcuuu

SEQ ID NO: 658289 - RNA, 22 nt, Human
uagcugucaccagaaauggcca

SEQ ID NO: 658290 - RNA, 22 nt, Human
caccaugacugguugagagagg

SEQ ID NO: 658291 - RNA, 22 nt, Human
acaguuucccccuagggcagca

SEQ ID NO: 658292 - RNA, 22 nt, Human
cuucugugaaugaaguguggga

SEQ ID NO: 658293 - RNA, 22 nt, Human
gggacagcuguagugcuuggcu

SEQ ID NO: 658294 - RNA, 22 nt, Human
aagacuguacauuuuccagucu

SEQ ID NO: 658295 - RNA, 22 nt, Human
aguauacaguaaugacauaucu

SEQ ID NO: 658296 - RNA, 22 nt, Human
uuaugcagucgacaucugauca

SEQ ID NO: 658297 - RNA, 22 nt, Human
agagcuggguggacuuguaguu

SEQ ID NO: 658298 - RNA, 22 nt, Human
aacaacagcugcuaaagaguug

SEQ ID NO: 658299 - RNA, 22 nt, Human
uggaggugggagggacuguccu

SEQ ID NO: 658300 - RNA, 22 nt, Human
ucuggcccaugauccugcuaac

SEQ ID NO: 658301 - RNA, 22 nt, Human
aggucugagaacuaccuauagg

SEQ ID NO: 658302 - RNA, 22 nt, Human
agguuuauguuuggugcaggag

SEQ ID NO: 658303 - RNA, 22 nt, Human
ggaggcucuaaacuuuccuugg

SEQ ID NO: 658304 - RNA, 22 nt, Human
uucuguuuccugccuucccauu

SEQ ID NO: 658305 - RNA, 22 nt, Human
acagagaaacuaaggaguuugg

SEQ ID NO: 658306 - RNA, 18 nt, Human
gcaggccuagaacuuggu

SEQ ID NO: 658307 - RNA, 22 nt, Human
acucucugagcuaccaggugag

SEQ ID NO: 658308 - RNA, 22 nt, Human
caggcccagcccuuagccaggu

SEQ ID NO: 658309 - RNA, 17 nt, Human
acaguaacuauguuaug

SEQ ID NO: 658310 - RNA, 22 nt, Human
cuacagaguaucuaaagaggua

SEQ ID NO: 658311 - RNA, 22 nt, Human
cacuuugaagagcuuuuugaca

SEQ ID NO: 658312 - RNA, 22 nt, Human
ugccgcugucgccaccauggcu

SEQ ID NO: 658313 - RNA, 18 nt, Human
gagcccugggagaucucu

SEQ ID NO: 658314 - RNA, 22 nt, Human
aaucagagcccucugagcuuca

SEQ ID NO: 658315 - RNA, 22 nt, Human
uaauccaggguauucuaguuuc

SEQ ID NO: 658316 - RNA, 21 nt, Human
acagggcaugcagcuggcugu

SEQ ID NO: 658317 - RNA, 22 nt, Human
auaguaugaauuaaaucaugag

SEQ ID NO: 658318 - RNA, 22 nt, Human
gugacaaaggucaagcuuuuga

SEQ ID NO: 658319 - RNA, 22 nt, Human
auucagaauugugggcaguaca

SEQ ID NO: 658320 - RNA, 22 nt, Human
agggagcucugggggcacacgg

SEQ ID NO: 658321 - RNA, 22 nt, Human
aaggcugaccaguuuacacuuu

SEQ ID NO: 658322 - RNA, 22 nt, Human
uggugucucuuaguacauagau

SEQ ID NO: 658323 - RNA, 22 nt, Human
aacuuacaaggaugauagcugc

SEQ ID NO: 658324 - RNA, 22 nt, Human
gcauguuauguaucugcccagc

SEQ ID NO: 658325 - RNA, 22 nt, Human
acuguccaagcaugccuggcuu

SEQ ID NO: 658326 - RNA, 23 nt, Human
ugagacccuaauuuagcaagugu

SEQ ID NO: 658327 - RNA, 22 nt, Human
agaagagcccuuuaagggggaa

SEQ ID NO: 658328 - RNA, 20 nt, Human
ccaauaaagcucuauaggga

SEQ ID NO: 658329 - RNA, 20 nt, Human
agggcugagaagggacuagc

SEQ ID NO: 658330 - RNA, 22 nt, Human
acagggaaggauuuagugggaa

SEQ ID NO: 658331 - RNA, 18 nt, Human
ggagucucaggagaggaa

SEQ ID NO: 658332 - RNA, 22 nt, Human
uucuauguuaguaugggucucc

SEQ ID NO: 658333 - RNA, 20 nt, Human
cccaguguccagccuugcca

SEQ ID NO: 658334 - RNA, 22 nt, Human
auuuauuauugugguuacuucu

SEQ ID NO: 658335 - RNA, 22 nt, Human
uacacaucucugucaguaguga

SEQ ID NO: 658336 - RNA, 22 nt, Human
aaugucugaggcucaucugagg

SEQ ID NO: 658337 - RNA, 22 nt, Human
ucuucucucauguaggagggaa

SEQ ID NO: 658338 - RNA, 22 nt, Human
acagaugagguguuuggagagc

SEQ ID NO: 658339 - RNA, 22 nt, Human
ugcagaguagugaggggacaga

SEQ ID NO: 658340 - RNA, 22 nt, Human
uuuagcaacgaagcacucgaca

SEQ ID NO: 658341 - RNA, 22 nt, Human
auggucaggcaaggagggcugg

SEQ ID NO: 658342 - RNA, 22 nt, Human
uucauuuguaacucuguuaggg

SEQ ID NO: 658343 - RNA, 22 nt, Human
agcucugggucacggcugccga

SEQ ID NO: 658344 - RNA, 22 nt, Human
agggcaguguggugggacugac

SEQ ID NO: 658345 - RNA, 22 nt, Human
ugaggccugcauugaacuagaa

SEQ ID NO: 658346 - RNA, 17 nt, Human
acucaggaucugggagu

SEQ ID NO: 658347 - RNA, 22 nt, Human
cuggugagacgguugacaggag

SEQ ID NO: 658348 - RNA, 22 nt, Human
caggggcucugggugaugugag

SEQ ID NO: 658349 - RNA, 22 nt, Human
uagaaagugaagguuaauuaau

SEQ ID NO: 658350 - RNA, 22 nt, Human
cagcugcuuuaguuuuccaucc

SEQ ID NO: 658351 - RNA, 22 nt, Human
uggcugaggagggucuucuggu

SEQ ID NO: 658352 - RNA, 22 nt, Human
auucacaauagcagcuugcaug

SEQ ID NO: 658353 - RNA, 19 nt, Human
gcuuuggagggagguucua

SEQ ID NO: 658354 - RNA, 21 nt, Human
uauacaugugcacacacaugc

SEQ ID NO: 658355 - RNA, 22 nt, Human
uuggcugccuucaccccuggcc

SEQ ID NO: 658356 - RNA, 17 nt, Human
uucagcaguguuucucc

SEQ ID NO: 658357 - RNA, 22 nt, Human
cgugggaguggugggugcucag

SEQ ID NO: 658358 - RNA, 22 nt, Human
cauauauucugguuuucacugg

SEQ ID NO: 658359 - RNA, 22 nt, Human
uggaguccgcuccaaguucucu

SEQ ID NO: 658360 - RNA, 22 nt, Human
uggccccauuuuacagaugaaa

SEQ ID NO: 658361 - RNA, 22 nt, Human
ugaagcaauagagacaagacca

SEQ ID NO: 658362 - RNA, 22 nt, Human
uuggcuaaccuggguuaucagc

SEQ ID NO: 658363 - RNA, 23 nt, Human
gcaggacaacagagugggaaggc

SEQ ID NO: 658364 - RNA, 22 nt, Human
caggcagcagccacucugguau

SEQ ID NO: 658365 - RNA, 22 nt, Human
caguuugugcuaggcacuauuu

SEQ ID NO: 658366 - RNA, 22 nt, Human
uacaauguuaaggaaagagaga

SEQ ID NO: 658367 - RNA, 22 nt, Human
ucuucaucucagauuaacagga

SEQ ID NO: 658368 - RNA, 22 nt, Human
ggagaagggcaugguaguuuua

SEQ ID NO: 658369 - RNA, 19 nt, Human
ugcacguuggaaucaccug

SEQ ID NO: 658370 - RNA, 22 nt, Human
gucuggacagcagcaccucggc

SEQ ID NO: 658371 - RNA, 22 nt, Human
cuggcuggccggagcgaggcgg

SEQ ID NO: 658372 - RNA, 22 nt, Human
acagggugaaugugacauuauc

SEQ ID NO: 658373 - RNA, 22 nt, Human
guuuuccuucucagccauugcc

SEQ ID NO: 658374 - RNA, 22 nt, Human
uggcugaggagagggcggaagu

SEQ ID NO: 658375 - RNA, 22 nt, Human
gggccuggcaugcagccccguu

SEQ ID NO: 658376 - RNA, 22 nt, Human
augcuucuccugaacaucccug

SEQ ID NO: 658377 - RNA, 20 nt, Human
acuugcugggcuuuguuacc

SEQ ID NO: 658378 - RNA, 22 nt, Human
acugaaggcuuaacucuuucau

SEQ ID NO: 658379 - RNA, 22 nt, Human
ugaugaaauguugaggcaguga

SEQ ID NO: 658380 - RNA, 22 nt, Human
ucugucacccaggcuggagugc

SEQ ID NO: 658381 - RNA, 22 nt, Human
uucaaucauuuuuacauagucc

SEQ ID NO: 658382 - RNA, 22 nt, Human
gacagucacuuccaggagagga

SEQ ID NO: 658383 - RNA, 22 nt, Human
uaagaacaucuguccccagauu

SEQ ID NO: 658384 - RNA, 17 nt, Human
ggagccaggagcccacc

SEQ ID NO: 658385 - RNA, 20 nt, Human
caugacacuguuccucugcc

SEQ ID NO: 658386 - RNA, 22 nt, Human
gccaggagggaaaggacaauuu

SEQ ID NO: 658387 - RNA, 20 nt, Human
uaaggcuguuuuguauuccu

SEQ ID NO: 658388 - RNA, 22 nt, Human
gcaaagcauucuguggagucua

SEQ ID NO: 658389 - RNA, 22 nt, Human
cuggguggaucgcagccccagg

SEQ ID NO: 658390 - RNA, 22 nt, Human
uuccagccaugguuucccuaug

SEQ ID NO: 658391 - RNA, 22 nt, Human
aagcaggcgagggccuggagca

SEQ ID NO: 658392 - RNA, 22 nt, Human
agcuccagaggcagugaugaag

SEQ ID NO: 658393 - RNA, 17 nt, Human
acaggccugcuugcacu

SEQ ID NO: 658394 - RNA, 22 nt, Human
uugucuuuggaaauuuaauguu

SEQ ID NO: 658395 - RNA, 22 nt, Human
aagccaggaagagagccuucac

SEQ ID NO: 658396 - RNA, 22 nt, Human
aagacagugacagucacaauug

SEQ ID NO: 658397 - RNA, 22 nt, Human
uuggaaggugagucccuggguu

SEQ ID NO: 658398 - RNA, 22 nt, Human
caccaggcugaaccagagggga

SEQ ID NO: 658399 - RNA, 22 nt, Human
agaagggaacucagagaugauu

SEQ ID NO: 658400 - RNA, 20 nt, Human
cagaugcuggaucuuggucc

SEQ ID NO: 658401 - RNA, 22 nt, Human
ggccccuggcaccaggcugauu

SEQ ID NO: 658402 - RNA, 22 nt, Human
auaugcuugacucuuucacauc

SEQ ID NO: 658403 - RNA, 21 nt, Human
caugaacaugcuuauccucag

SEQ ID NO: 658404 - RNA, 22 nt, Human
ucuucuguuaccacagcgauga

SEQ ID NO: 658405 - RNA, 22 nt, Human
acugggcuuauuucuugugaac

SEQ ID NO: 658406 - RNA, 22 nt, Human
uucacaggauagcuauugcacg

SEQ ID NO: 658407 - RNA, 22 nt, Human
ccauggaguuccucuggucuau

SEQ ID NO: 658408 - RNA, 22 nt, Human
acagaauuaaugaaaauuacaa

SEQ ID NO: 658409 - RNA, 22 nt, Human
uggacaacugguuuuugacaaa

SEQ ID NO: 658410 - RNA, 22 nt, Human
agaggccagggacacugcucaa

SEQ ID NO: 658411 - RNA, 22 nt, Human
uuaucuuguagagauauuuucg

SEQ ID NO: 658412 - RNA, 22 nt, Human
gagaaacaggaauugagucgcu

SEQ ID NO: 658413 - RNA, 22 nt, Human
cucacugcccugaaguuggguu

SEQ ID NO: 658414 - RNA, 22 nt, Human
ggcccugugauggauguauuag

SEQ ID NO: 658415 - RNA, 22 nt, Human
aauccuggaaugaguuugcuga

SEQ ID NO: 658416 - RNA, 22 nt, Human
augaaaugaaguuggccuggcu

SEQ ID NO: 658417 - RNA, 22 nt, Human
uuguagaaucauuauuucuagu

SEQ ID NO: 658418 - RNA, 22 nt, Human
aggauaauaauaaucucguuua

SEQ ID NO: 658419 - RNA, 22 nt, Human
uucuaaagacucauggaagugg

SEQ ID NO: 658420 - RNA, 22 nt, Human
guggggggagcugcaagcugga

SEQ ID NO: 658421 - RNA, 22 nt, Human
agcugcucaggagagccagguc

SEQ ID NO: 658422 - RNA, 22 nt, Human
cugagcagcguggggagcuggc

SEQ ID NO: 658423 - RNA, 22 nt, Human
auuaaacugagcaaauuaacau

SEQ ID NO: 658424 - RNA, 22 nt, Human
cuugaaagucagcagaguggau

SEQ ID NO: 658425 - RNA, 22 nt, Human
augcuccagugugaugcuucau

SEQ ID NO: 658426 - RNA, 23 nt, Human
uagauguauuaagugcauuuuca

SEQ ID NO: 658427 - RNA, 22 nt, Human
ucccagggcacucacccucccu

SEQ ID NO: 658428 - RNA, 22 nt, Human
acaaauugccuagucuagcauc

SEQ ID NO: 658429 - RNA, 22 nt, Human
agagcugggugguggugacuca

SEQ ID NO: 658430 - RNA, 22 nt, Human
uuuauugggccuggaggaucua

SEQ ID NO: 658431 - RNA, 22 nt, Human
agcgcgcucuaggacaccgcgg

SEQ ID NO: 658432 - RNA, 22 nt, Human
ucagugcaggaaucucuagcca

SEQ ID NO: 658433 - RNA, 22 nt, Human
auccagaguaauacagaaugca

SEQ ID NO: 658434 - RNA, 22 nt, Human
cuggucccagcagagcucugag

SEQ ID NO: 658435 - RNA, 22 nt, Human
agguggcuucuggccaggugug

SEQ ID NO: 658436 - RNA, 22 nt, Human
ggcccagccucagacaugcccu

SEQ ID NO: 658437 - RNA, 22 nt, Human
caguaucuugcuuauagacaca

SEQ ID NO: 658438 - RNA, 22 nt, Human
auuagcaaguuuuccagcuaau

SEQ ID NO: 658439 - RNA, 22 nt, Human
gcuggacucaggggacucaggg

SEQ ID NO: 658440 - RNA, 22 nt, Human
aggcaaggugcucuugcucuau

SEQ ID NO: 658441 - RNA, 22 nt, Human
cuguuggaugugacacuguuag

SEQ ID NO: 658442 - RNA, 22 nt, Human
uuauuuagucuagaugaauuuu

SEQ ID NO: 658443 - RNA, 22 nt, Human
aucuugcauuugcuaaaaugca

SEQ ID NO: 658444 - RNA, 22 nt, Human
aggauccuuuuucugcuguuug

SEQ ID NO: 658445 - RNA, 22 nt, Human
gaggagcccuguuccccaggcc

SEQ ID NO: 658446 - RNA, 22 nt, Human
acaguugaggacuuaaacaaaa

SEQ ID NO: 658447 - RNA, 22 nt, Human
ucuucacagaugcauauacuuc

SEQ ID NO: 658448 - RNA, 20 nt, Human
aagcuuccaggaucuggugu

SEQ ID NO: 658449 - RNA, 23 nt, Human
acaucagaguuaguucaaucagg

SEQ ID NO: 658450 - RNA, 22 nt, Human
ucugggaagccuguaugcagaa

SEQ ID NO: 658451 - RNA, 22 nt, Human
gggaggagggugcuggcuaaac

SEQ ID NO: 658452 - RNA, 22 nt, Human
ccagggcauguaacuaauggug

SEQ ID NO: 658453 - RNA, 20 nt, Human
ugugacaaaggcauauuuua

SEQ ID NO: 658454 - RNA, 22 nt, Human
uggcaguguuucuaaggggcuc

SEQ ID NO: 658455 - RNA, 22 nt, Human
uguguuuugaacucaucuacug

SEQ ID NO: 658456 - RNA, 22 nt, Human
guccuggauugaacauaggcag

SEQ ID NO: 658457 - RNA, 22 nt, Human
cugacaggguagacagagggca

SEQ ID NO: 658458 - RNA, 22 nt, Human
cugggcauauacgugcaaguca

SEQ ID NO: 658459 - RNA, 22 nt, Human
uggagacucagaaggggaagca

SEQ ID NO: 658460 - RNA, 22 nt, Human
gagcacagcuggagguagcauu

SEQ ID NO: 658461 - RNA, 23 nt, Human
uauugcacacauagaaacauaga

SEQ ID NO: 658462 - RNA, 22 nt, Human
gauacaguauuuaaagagcaac

SEQ ID NO: 658463 - RNA, 22 nt, Human
uccaugaguuugaggaaaagag

SEQ ID NO: 658464 - RNA, 22 nt, Human
ucucucuuuuuaaucauguaau

SEQ ID NO: 658465 - RNA, 22 nt, Human
cagugagggcccccuuccaggu

SEQ ID NO: 658466 - RNA, 22 nt, Human
ucucacugauuugagaccaagg

SEQ ID NO: 658467 - RNA, 21 nt, Human
ucagucauugccuccuucugg

SEQ ID NO: 658468 - RNA, 22 nt, Human
uuuuaucagcagggauaacaag

SEQ ID NO: 658469 - RNA, 22 nt, Human
aagagagagugcgcucacagaa

SEQ ID NO: 658470 - RNA, 22 nt, Human
uguagaaguucuucaggagaau

SEQ ID NO: 658471 - RNA, 22 nt, Human
uaagacacgggcugaucuaaag

SEQ ID NO: 658472 - RNA, 22 nt, Human
ccaccaagucccacuauaauuu

SEQ ID NO: 658473 - RNA, 22 nt, Human
uggggucuggaguugcccauga

SEQ ID NO: 658474 - RNA, 22 nt, Human
uaaagugaaggucauaaugauu

SEQ ID NO: 658475 - RNA, 22 nt, Human
augugcuugacuacucucuauu

SEQ ID NO: 658476 - RNA, 23 nt, Human
augcucugggcugugggaccugc

SEQ ID NO: 658477 - RNA, 22 nt, Human
gugucccagccccacaggccug

SEQ ID NO: 658478 - RNA, 22 nt, Human
uuucuucuguuuguaguuacac

SEQ ID NO: 658479 - RNA, 22 nt, Human
uucuguauguacauauguguau

SEQ ID NO: 658480 - RNA, 22 nt, Human
acagcuguauucaaguugcaag

SEQ ID NO: 658481 - RNA, 22 nt, Human
ugaaaugaagggcuuguucugg

SEQ ID NO: 658482 - RNA, 20 nt, Human
guaggcauaugaccaauuac

SEQ ID NO: 658483 - RNA, 22 nt, Human
ugucucuuuggccucccauaug

SEQ ID NO: 658484 - RNA, 22 nt, Human
gcugauaaauaguugauguacc

SEQ ID NO: 658485 - RNA, 21 nt, Human
uuuaauuugcauguaugacgc

SEQ ID NO: 658486 - RNA, 22 nt, Human
ucaugcagguuuccagccagau

SEQ ID NO: 658487 - RNA, 22 nt, Human
ccuggcacaucuaacucacucu

SEQ ID NO: 658488 - RNA, 22 nt, Human
ggguccagcgacagcaggcuca

SEQ ID NO: 658489 - RNA, 22 nt, Human
uagagcagccuucagagcaguu

SEQ ID NO: 658490 - RNA, 19 nt, Human
uucuccagccugaccugag

SEQ ID NO: 658491 - RNA, 22 nt, Human
aacuugcuucaacuuauuucac

SEQ ID NO: 658492 - RNA, 22 nt, Human
auacagguguacacacaugcaa

SEQ ID NO: 658493 - RNA, 22 nt, Human
augcuguguccuagugaaagaa

SEQ ID NO: 658494 - RNA, 22 nt, Human
caaagguaguauauauauuguu

SEQ ID NO: 658495 - RNA, 22 nt, Human
aaguaaaagcaggugugcuggg

SEQ ID NO: 658496 - RNA, 20 nt, Human
uccagcuccguguucuuccu

SEQ ID NO: 658497 - RNA, 22 nt, Human
gugcagaggacguggcggccuc

SEQ ID NO: 658498 - RNA, 22 nt, Human
aagccaaguuggaagacugaau

SEQ ID NO: 658499 - RNA, 22 nt, Human
ggagaagggacagacucagcuu

SEQ ID NO: 658500 - RNA, 22 nt, Human
ugguccuguguucuuccugccu

SEQ ID NO: 658501 - RNA, 20 nt, Human
gcauggcauguagugaagug

SEQ ID NO: 658502 - RNA, 22 nt, Human
uuagucacuucuuccuucauca

SEQ ID NO: 658503 - RNA, 22 nt, Human
accaaggagccacauacaaccu

SEQ ID NO: 658504 - RNA, 22 nt, Human
ugugugcacaggaguguuugaa

SEQ ID NO: 658505 - RNA, 22 nt, Human
gcugcccagggcugaguguccu

SEQ ID NO: 658506 - RNA, 22 nt, Human
agcuucuguucaucuuccaggc

SEQ ID NO: 658507 - RNA, 22 nt, Human
uauuuucauucugugugacugu

SEQ ID NO: 658508 - RNA, 22 nt, Human
aauuggcuuccauuuucuguuu

SEQ ID NO: 658509 - RNA, 19 nt, Human
ggagaucccgcugcagaug

SEQ ID NO: 658510 - RNA, 22 nt, Human
uaauauacuucccauaguuuga

SEQ ID NO: 658511 - RNA, 22 nt, Human
uaaaggcaauucagcaagccac

SEQ ID NO: 658512 - RNA, 22 nt, Human
gggccugagacugagggugagg

SEQ ID NO: 658513 - RNA, 21 nt, Human
cccuaacucuaaaggauccau

SEQ ID NO: 658514 - RNA, 22 nt, Human
ugagacaggagaggccccuccu

SEQ ID NO: 658515 - RNA, 20 nt, Human
uuuuccuucugaguauguug

SEQ ID NO: 658516 - RNA, 20 nt, Human
gcuuagcaggcauaguagcu

SEQ ID NO: 658517 - RNA, 22 nt, Human
ucuccagguaaauggcauccug

SEQ ID NO: 658518 - RNA, 22 nt, Human
cuccagggaugagacagaguag

SEQ ID NO: 658519 - RNA, 22 nt, Human
gcuggaggaucacuugagccca

SEQ ID NO: 658520 - RNA, 22 nt, Human
aguggcagaucucuggucugga

SEQ ID NO: 658521 - RNA, 18 nt, Human
cugcuucugucugccagu

SEQ ID NO: 658522 - RNA, 22 nt, Human
guuagggagggugcauaugugu

SEQ ID NO: 658523 - RNA, 22 nt, Human
ccaucauuugauacagcugucu

SEQ ID NO: 658524 - RNA, 22 nt, Human
cccaggaggucgaagcugcagu

SEQ ID NO: 658525 - RNA, 22 nt, Human
cccagaaggucgaggcugcagu

SEQ ID NO: 658526 - RNA, 22 nt, Human
augggcagacagggagcucacg

SEQ ID NO: 658527 - RNA, 22 nt, Human
uuacagaguucgcaccuggugg

SEQ ID NO: 658528 - RNA, 22 nt, Human
agggccucgggcucaguggguc

SEQ ID NO: 658529 - RNA, 22 nt, Human
uguuuucagaugcagggacaca

SEQ ID NO: 658530 - RNA, 22 nt, Human
ugaugaaaauaugauucugagg

SEQ ID NO: 658531 - RNA, 22 nt, Human
caaaguuaugaaugauaagauu

SEQ ID NO: 658532 - RNA, 22 nt, Human
aguuuccugggagauucuuaca

SEQ ID NO: 658533 - RNA, 22 nt, Human
uggggucgaggguucucuggca

SEQ ID NO: 658534 - RNA, 22 nt, Human
cuuacacagucuggcacuucuu

SEQ ID NO: 658535 - RNA, 22 nt, Human
ggggagcuuagggucucugaau

SEQ ID NO: 658536 - RNA, 22 nt, Human
gagggaggcaucaugaauccag

SEQ ID NO: 658537 - RNA, 22 nt, Human
ccucggagaaaggcagcuccac

SEQ ID NO: 658538 - RNA, 23 nt, Human
cagaugugcaacucuaggcaaug

SEQ ID NO: 658539 - RNA, 22 nt, Human
ggguuaggucccucccuucugg

SEQ ID NO: 658540 - RNA, 22 nt, Human
ccuggacuguguccugugguca

SEQ ID NO: 658541 - RNA, 22 nt, Human
ccucaaauaaguuuuauuuauc

SEQ ID NO: 658542 - RNA, 22 nt, Human
ugggaugaguuguuaggacuga

SEQ ID NO: 658543 - RNA, 22 nt, Human
uccucagcauuagcacagacau

SEQ ID NO: 658544 - RNA, 22 nt, Human
agcauuccacacugaagucugc

SEQ ID NO: 658545 - RNA, 22 nt, Human
uagaaaauagggccuguggagc

SEQ ID NO: 658546 - RNA, 22 nt, Human
cuccaaguccgagggcucucaa

SEQ ID NO: 658547 - RNA, 22 nt, Human
cugggaaauggcuucgagcuca

SEQ ID NO: 658548 - RNA, 22 nt, Human
uaaagacaauaggaaaguuguu

SEQ ID NO: 658549 - RNA, 22 nt, Human
caaaucacaaugugagacugag

SEQ ID NO: 658550 - RNA, 22 nt, Human
acccacagccgcugugcguccc

SEQ ID NO: 658551 - RNA, 22 nt, Human
uuuguuuacucauucauugaug

SEQ ID NO: 658552 - RNA, 22 nt, Human
ugccugggacuguacuaaauuu

SEQ ID NO: 658553 - RNA, 22 nt, Human
ugucugaaggcagguggagaac

SEQ ID NO: 658554 - RNA, 22 nt, Human
ccagguggugccucuguucgca

SEQ ID NO: 658555 - RNA, 22 nt, Human
gccugagauucccggagccgug

SEQ ID NO: 658556 - RNA, 22 nt, Human
ugggcacuauggcucugugcac

SEQ ID NO: 658557 - RNA, 22 nt, Human
ucugcuuuuucauugacugaaa

SEQ ID NO: 658558 - RNA, 22 nt, Human
ggcaaagccuuccagcuguuac

SEQ ID NO: 658559 - RNA, 22 nt, Human
ggccagcucagucuccaucagg

SEQ ID NO: 658560 - RNA, 22 nt, Human
agugcuuugugcucucacugca

SEQ ID NO: 658561 - RNA, 19 nt, Human
agucaguucugaggaggaa

SEQ ID NO: 658562 - RNA, 22 nt, Human
caggugggccaugaaaaaugac

SEQ ID NO: 658563 - RNA, 22 nt, Human
aaaaugugaucuacaaaugcaa

SEQ ID NO: 658564 - RNA, 22 nt, Human
gcaaacuguuggaguagagucu

SEQ ID NO: 658565 - RNA, 22 nt, Human
cagguugggcugcgaggaggag

SEQ ID NO: 658566 - RNA, 22 nt, Human
uagcagaguaauacuuuggagc

SEQ ID NO: 658567 - RNA, 22 nt, Human
gcacccagauauugccuugacc

SEQ ID NO: 658568 - RNA, 22 nt, Human
uucacccacuagagaacucagg

SEQ ID NO: 658569 - RNA, 20 nt, Human
gaaccucucccagccccugg

SEQ ID NO: 658570 - RNA, 22 nt, Human
cagugagcacggccagagggga

SEQ ID NO: 658571 - RNA, 22 nt, Human
ucacuggcaacuugugcucccu

SEQ ID NO: 658572 - RNA, 22 nt, Human
ugagaggauauuuugggaggau

SEQ ID NO: 658573 - RNA, 22 nt, Human
ggcugccuccucgagacaggau

SEQ ID NO: 658574 - RNA, 17 nt, Human
agucugggaccugcgug

SEQ ID NO: 658575 - RNA, 22 nt, Human
uucauuacugcgguagucacac

SEQ ID NO: 658576 - RNA, 22 nt, Human
cccugcugugucccaccuggaa

SEQ ID NO: 658577 - RNA, 22 nt, Human
cagugauguuucugcaucagag

SEQ ID NO: 658578 - RNA, 22 nt, Human
gcagggacaucuucagaucacu

SEQ ID NO: 658579 - RNA, 22 nt, Human
ucgcauuugggcaggagaugcu

SEQ ID NO: 658580 - RNA, 22 nt, Human
accugaggcuguuagucuaggu

SEQ ID NO: 658581 - RNA, 22 nt, Human
uauguacauacaugugcauacg

SEQ ID NO: 658582 - RNA, 18 nt, Human
cgauguguaugugauuug

SEQ ID NO: 658583 - RNA, 22 nt, Human
cgugcaaauauaugugugauga

SEQ ID NO: 658584 - RNA, 22 nt, Human
auccuuaagaaaguuuucuaua

SEQ ID NO: 658585 - RNA, 22 nt, Human
caauuauauuuagaaugauaca

SEQ ID NO: 658586 - RNA, 22 nt, Human
uguauuuucagaguggcauuuc

SEQ ID NO: 658587 - RNA, 21 nt, Human
ucuggagcccuaagcugagaa

SEQ ID NO: 658588 - RNA, 18 nt, Human
cagugucuugguaaaaua

SEQ ID NO: 658589 - RNA, 22 nt, Human
agcagcauaucagagaaaguca

SEQ ID NO: 658590 - RNA, 22 nt, Human
uccuguaguugcuaaguuuguu

SEQ ID NO: 658591 - RNA, 22 nt, Human
uagaaagugguugagaguuuag

SEQ ID NO: 658592 - RNA, 22 nt, Human
cauuuacaauguacagguugug

SEQ ID NO: 658593 - RNA, 22 nt, Human
ucacugcaaccucugccuuccg

SEQ ID NO: 658594 - RNA, 22 nt, Human
uggcugcagacaccuauggcag

SEQ ID NO: 658595 - RNA, 21 nt, Human
gcuuuagauuuagugagccag

SEQ ID NO: 658596 - RNA, 22 nt, Human
gauucaauguugcagauggaau

SEQ ID NO: 658597 - RNA, 22 nt, Human
ugcugcacucaccaacagauaa

SEQ ID NO: 658598 - RNA, 22 nt, Human
ugauuaaagguggaaggcaggu

SEQ ID NO: 658599 - RNA, 22 nt, Human
ucucccucauuccugcuuccau

SEQ ID NO: 658600 - RNA, 22 nt, Human
gaguuauauuugcgauauugga

SEQ ID NO: 658601 - RNA, 22 nt, Human
auuuugacugcauuacagaaca

SEQ ID NO: 658602 - RNA, 22 nt, Human
cuccaaaggauaaaagcagagu

SEQ ID NO: 658603 - RNA, 22 nt, Human
aucuucaucaaguucacagugg

SEQ ID NO: 658604 - RNA, 22 nt, Human
agcuaggagauuuugugaggcu

SEQ ID NO: 658605 - RNA, 22 nt, Human
agcugucuuucugccuccugau

SEQ ID NO: 658606 - RNA, 22 nt, Human
cuaaggaauuggagcauguguu

SEQ ID NO: 658607 - RNA, 22 nt, Human
ccugacucuggccaggccagcu

SEQ ID NO: 658608 - RNA, 22 nt, Human
ggcagacuguaauaggagaauu

SEQ ID NO: 658609 - RNA, 22 nt, Human
aagaacugugcuccaggcucca

SEQ ID NO: 658610 - RNA, 22 nt, Human
aauugcuuaguugcaacuaugc

SEQ ID NO: 658611 - RNA, 22 nt, Human
uuaauaaguaguaguuauuguu

SEQ ID NO: 658612 - RNA, 22 nt, Human
aggcacuugcauugaugagguc

SEQ ID NO: 658613 - RNA, 22 nt, Human
agcagcaguugcugacguucua

SEQ ID NO: 658614 - RNA, 22 nt, Human
uuccccaggggcuccugccuuu

SEQ ID NO: 658615 - RNA, 22 nt, Human
ucugauuucucuuguggaugcu

SEQ ID NO: 658616 - RNA, 22 nt, Human
gacaggggcuuugcaugcuuua

SEQ ID NO: 658617 - RNA, 22 nt, Human
ugauucaacuuucauaacaaaa

SEQ ID NO: 658618 - RNA, 22 nt, Human
gacugugggcucuguuugucuu

SEQ ID NO: 658619 - RNA, 22 nt, Human
ugccauagcaaugguaagcuga

SEQ ID NO: 658620 - RNA, 22 nt, Human
aucuggaggcauuacucugucu

SEQ ID NO: 658621 - RNA, 22 nt, Human
acauucuuugaguuuuguuaaa

SEQ ID NO: 658622 - RNA, 22 nt, Human
ggagggagggcuagaccaaaga

SEQ ID NO: 658623 - RNA, 22 nt, Human
gagcacagcugucuugcaagcu

SEQ ID NO: 658624 - RNA, 20 nt, Human
ggcagcucuagucgaggccc

SEQ ID NO: 658625 - RNA, 22 nt, Human
ccggcgucucuuccacuuccua

SEQ ID NO: 658626 - RNA, 22 nt, Human
cuucccauauaacuaauuucug

SEQ ID NO: 658627 - RNA, 22 nt, Human
gagcuccaccaccuucaggcag

SEQ ID NO: 658628 - RNA, 22 nt, Human
uguacauuuucucagaguuuau

SEQ ID NO: 658629 - RNA, 22 nt, Human
ucaguggauugacaugaaaaag

SEQ ID NO: 658630 - RNA, 22 nt, Human
gucucaguuugaagugaugcca

SEQ ID NO: 658631 - RNA, 22 nt, Human
uggaacaaggguucauuuaaau

SEQ ID NO: 658632 - RNA, 22 nt, Human
ucagcagggccaugcucucucu

SEQ ID NO: 658633 - RNA, 22 nt, Human
auaucuucuuuauuuugugagg

SEQ ID NO: 658634 - RNA, 22 nt, Human
uuccagaaaacgcuuuauuuag

SEQ ID NO: 658635 - RNA, 17 nt, Human
acaugggcugagacucc

SEQ ID NO: 658636 - RNA, 22 nt, Human
gccugcuuccuuuucauagaug

SEQ ID NO: 658637 - RNA, 22 nt, Human
cuggucaauaaucauguaguac

SEQ ID NO: 658638 - RNA, 22 nt, Human
cauccagaguccaaggcugggc

SEQ ID NO: 658639 - RNA, 23 nt, Human
uuuccaggugaccgucagaauua

SEQ ID NO: 658640 - RNA, 21 nt, Human
agacacagggguugcuggggu

SEQ ID NO: 658641 - RNA, 22 nt, Human
ucacuucuucagcuuuccuuga

SEQ ID NO: 658642 - RNA, 18 nt, Human
ugucucuccuuucugugu

SEQ ID NO: 658643 - RNA, 22 nt, Human
ggcuuuaaggaguaaaaaugcc

SEQ ID NO: 658644 - RNA, 22 nt, Human
cuuuucuuauguggacguaccu

SEQ ID NO: 658645 - RNA, 22 nt, Human
uagcuguuuuuugugaggaaau

SEQ ID NO: 658646 - RNA, 22 nt, Human
ccuggagauuauuugguccaau

SEQ ID NO: 658647 - RNA, 22 nt, Human
acacagagauguaaaguuaggc

SEQ ID NO: 658648 - RNA, 22 nt, Human
uuuuucuggauaacuguaucuc

SEQ ID NO: 658649 - RNA, 22 nt, Human
gcaguuuacugucaauaacucu

SEQ ID NO: 658650 - RNA, 22 nt, Human
uucuggagagaaaccuuacaaa

SEQ ID NO: 658651 - RNA, 22 nt, Human
cuguccagcugaccagagcagc

SEQ ID NO: 658652 - RNA, 22 nt, Human
ccuggacacccauuccuuggcu

SEQ ID NO: 658653 - RNA, 22 nt, Human
uacuucauaccugcuagaaugg

SEQ ID NO: 658654 - RNA, 22 nt, Human
cuuauacacccucuucccaggc

SEQ ID NO: 658655 - RNA, 22 nt, Human
ucccugcccucagugcacccgg

SEQ ID NO: 658656 - RNA, 22 nt, Human
aauccaugcaugcaaggaaagg

SEQ ID NO: 658657 - RNA, 22 nt, Human
uaccuggauguuuagauuggca

SEQ ID NO: 658658 - RNA, 22 nt, Human
cugcccugggauggucugugcg

SEQ ID NO: 658659 - RNA, 18 nt, Human
auuucucuggggugauuc

SEQ ID NO: 658660 - RNA, 22 nt, Human
aagcacacaucucuggcugggu

SEQ ID NO: 658661 - RNA, 22 nt, Human
uccugagguggauugagcagag

SEQ ID NO: 658662 - RNA, 22 nt, Human
gcagugaagccagaucugaaau

SEQ ID NO: 658663 - RNA, 22 nt, Human
uaaauguaaauggcgucuugcg

SEQ ID NO: 658664 - RNA, 22 nt, Human
uaaaugugcacuuuacuuuuca

SEQ ID NO: 658665 - RNA, 22 nt, Human
aaaugcaggaaauuaugcuuuu

SEQ ID NO: 658666 - RNA, 22 nt, Human
agacauaagcgagcaucacagg

SEQ ID NO: 658667 - RNA, 22 nt, Human
ugaggccagagaguuugcauuu

SEQ ID NO: 658668 - RNA, 22 nt, Human
aacaaccaaaaagaugaaugua

SEQ ID NO: 658669 - RNA, 19 nt, Human
gcuggccacgccccaguug

SEQ ID NO: 658670 - RNA, 22 nt, Human
aagcacuuuagugagaauaagg

SEQ ID NO: 658671 - RNA, 21 nt, Human
aaggaaaagcuuggucucuga

SEQ ID NO: 658672 - RNA, 22 nt, Human
aauggccuguauggaaagugaa

SEQ ID NO: 658673 - RNA, 22 nt, Human
uaucuacauguagguauguaug

SEQ ID NO: 658674 - RNA, 22 nt, Human
ugggagaguuuguuuagaguga

SEQ ID NO: 658675 - RNA, 22 nt, Human
ggagggccaucuugggugugau

SEQ ID NO: 658676 - RNA, 22 nt, Human
uuaacuugucagaaaauacagu

SEQ ID NO: 658677 - RNA, 22 nt, Human
uuccuuggauacaaguaacuuu

SEQ ID NO: 658678 - RNA, 22 nt, Human
uucauuaguucugaagaugucu

SEQ ID NO: 658679 - RNA, 22 nt, Human
uggcuggcuggaccacaccugc

SEQ ID NO: 658680 - RNA, 22 nt, Human
ccagaggugagggggauucuug

SEQ ID NO: 658681 - RNA, 22 nt, Human
gcagcagaggcccuacucuuug

SEQ ID NO: 658682 - RNA, 22 nt, Human
gcuguguggcaaagggauuaca

SEQ ID NO: 658683 - RNA, 22 nt, Human
cugagcaauuucagcucucacu

SEQ ID NO: 658684 - RNA, 22 nt, Human
cuggcugggcagacagaaugcu

SEQ ID NO: 658685 - RNA, 18 nt, Human
uggcagugagguaggcau

SEQ ID NO: 658686 - RNA, 22 nt, Human
uacagccuucaucuuugccuug

SEQ ID NO: 658687 - RNA, 22 nt, Human
cagacaguggacuugauaaagg

SEQ ID NO: 658688 - RNA, 22 nt, Human
augacaaaauucacagguguga

SEQ ID NO: 658689 - RNA, 22 nt, Human
uuucagagaggcuucaaaucuu

SEQ ID NO: 658690 - RNA, 22 nt, Human
cagaaccaggaacugauggaga

SEQ ID NO: 658691 - RNA, 22 nt, Human
aauguuacgaucaacaacacau

SEQ ID NO: 658692 - RNA, 22 nt, Human
aauaacagauuuucaagcugug

SEQ ID NO: 658693 - RNA, 22 nt, Human
agggacacaugugauuauuuau

SEQ ID NO: 658694 - RNA, 22 nt, Human
aguaacaggguauuuguguggg

SEQ ID NO: 658695 - RNA, 22 nt, Human
gcugucugacuccaaguuggag

SEQ ID NO: 658696 - RNA, 22 nt, Human
uguguccacgcacuggcaugau

SEQ ID NO: 658697 - RNA, 22 nt, Human
cagaacagacuuaacagggcug

SEQ ID NO: 658698 - RNA, 22 nt, Human
ugcuccaggagcacuuuccauu

SEQ ID NO: 658699 - RNA, 22 nt, Human
gcccuggccuccuggaacaggc

SEQ ID NO: 658700 - RNA, 22 nt, Human
gccaggcaauguguuagaagcg

SEQ ID NO: 658701 - RNA, 20 nt, Human
aauuuuacuguccuauagag

SEQ ID NO: 658702 - RNA, 22 nt, Human
aauauuguuucaagaucacaga

SEQ ID NO: 658703 - RNA, 22 nt, Human
uccuccuucgggacugcuugac

SEQ ID NO: 658704 - RNA, 22 nt, Human
uggcagugucuugcuggggcag

SEQ ID NO: 658705 - RNA, 22 nt, Human
auccuggaggcuggaggcuugc

SEQ ID NO: 658706 - RNA, 22 nt, Human
uucuauuucuuaaucuuggcug

SEQ ID NO: 658707 - RNA, 22 nt, Human
uuacuguagcuugacauauguc

SEQ ID NO: 658708 - RNA, 22 nt, Human
cuuguugcuaacauaugcuucu

SEQ ID NO: 658709 - RNA, 22 nt, Human
aguguguaagggaucaaagagu

SEQ ID NO: 658710 - RNA, 22 nt, Human
uggcaggaaccuuaaccacaaa

SEQ ID NO: 658711 - RNA, 22 nt, Human
ccccauggcaacugcugggggu

SEQ ID NO: 658712 - RNA, 22 nt, Human
ggcuguccuuggccaaggcacu

SEQ ID NO: 658713 - RNA, 22 nt, Human
ccuggagaccagaggauacuuc

SEQ ID NO: 658714 - RNA, 22 nt, Human
gaaagaaugcuauagugacuuc

SEQ ID NO: 658715 - RNA, 22 nt, Human
uggagcugguaaacagugacau

SEQ ID NO: 658716 - RNA, 22 nt, Human
uacagugaaugaauggcugugc

SEQ ID NO: 658717 - RNA, 18 nt, Human
ucugagggugcgggagcu

SEQ ID NO: 658718 - RNA, 22 nt, Human
uggaggcagguggaggagugaa

SEQ ID NO: 658719 - RNA, 22 nt, Human
cacagauaaggauguuaauuuu

SEQ ID NO: 658720 - RNA, 20 nt, Human
aucaccuguagguucuuugu

SEQ ID NO: 658721 - RNA, 22 nt, Human
uggcacugaagcuggaaagccu

SEQ ID NO: 658722 - RNA, 22 nt, Human
gcacugugaucaaggcuaagca

SEQ ID NO: 658723 - RNA, 22 nt, Human
uaaaaccauaaggcuggaagga

SEQ ID NO: 658724 - RNA, 22 nt, Human
ucucagaguuccucuggagucc

SEQ ID NO: 658725 - RNA, 22 nt, Human
ucagaaagcuuuuacuuaaaca

SEQ ID NO: 658726 - RNA, 22 nt, Human
uggaggaaguggacaguugugu

SEQ ID NO: 658727 - RNA, 22 nt, Human
uucagugacuuaccuggagcca

SEQ ID NO: 658728 - RNA, 22 nt, Human
uuguaaacugcugcaggagugc

SEQ ID NO: 658729 - RNA, 22 nt, Human
auauaucugcaguacugaagaa

SEQ ID NO: 658730 - RNA, 19 nt, Human
gcuguuaaggacccucgga

SEQ ID NO: 658731 - RNA, 21 nt, Human
acagcaagccuucacaugagu

SEQ ID NO: 658732 - RNA, 22 nt, Human
aguggggagguccaggccaccc

SEQ ID NO: 658733 - RNA, 22 nt, Human
cggccgcagcagugucggccca

SEQ ID NO: 658734 - RNA, 22 nt, Human
cucuguguucagccuagcagaa

SEQ ID NO: 658735 - RNA, 18 nt, Human
agccucuggcagagagaa

SEQ ID NO: 658736 - RNA, 22 nt, Human
acuaaugauuauugucauugug

SEQ ID NO: 658737 - RNA, 22 nt, Human
uuuagcaauuauuaaggguuga

SEQ ID NO: 658738 - RNA, 22 nt, Human
agauuagguaugguuuaaguag

SEQ ID NO: 658739 - RNA, 22 nt, Human
gcagcuggucuggccuagagua

SEQ ID NO: 658740 - RNA, 21 nt, Human
cucaggauggcggccuggugg

SEQ ID NO: 658741 - RNA, 22 nt, Human
cuaggcugcagaugcauggaau

SEQ ID NO: 658742 - RNA, 22 nt, Human
cuggucugagggcucuugaggc

SEQ ID NO: 658743 - RNA, 22 nt, Human
cucaaaaugguuaauuuuaaua

SEQ ID NO: 658744 - RNA, 22 nt, Human
ugucaccuugcucauccucgga

SEQ ID NO: 658745 - RNA, 22 nt, Human
ugucuucuaccuugacagcauu

SEQ ID NO: 658746 - RNA, 22 nt, Human
gugcuucacugaccuguuuuca

SEQ ID NO: 658747 - RNA, 23 nt, Human
gcacagagcaguuaggggaagau

SEQ ID NO: 658748 - RNA, 22 nt, Human
acuuuguuccuuucacaaagaa

SEQ ID NO: 658749 - RNA, 22 nt, Human
gucaggauguuuauucuccagu

SEQ ID NO: 658750 - RNA, 22 nt, Human
agaaauacugccuaagacugua

SEQ ID NO: 658751 - RNA, 22 nt, Human
cagcugugucuaauuauggcug

SEQ ID NO: 658752 - RNA, 22 nt, Human
ucugccuuucacacagacggcc

SEQ ID NO: 658753 - RNA, 22 nt, Human
uaagauaauccauuauaauguu

SEQ ID NO: 658754 - RNA, 22 nt, Human
ccaugugcuugcucuggcaccu

SEQ ID NO: 658755 - RNA, 22 nt, Human
aggugggcggauucaugagguc

SEQ ID NO: 658756 - RNA, 22 nt, Human
acacauuugcuaaaaugagcuc

SEQ ID NO: 658757 - RNA, 22 nt, Human
cuugggaggggagcauuggccu

SEQ ID NO: 658758 - RNA, 22 nt, Human
gcaauaaagauuuuacugucag

SEQ ID NO: 658759 - RNA, 22 nt, Human
ucuuugcaggccaaauuguuaa

SEQ ID NO: 658760 - RNA, 22 nt, Human
cuucuggcguuggaggucugag

SEQ ID NO: 658761 - RNA, 22 nt, Human
cugagcaccuguuauagguuag

SEQ ID NO: 658762 - RNA, 22 nt, Human
uugcaucuagggcaacccagag

SEQ ID NO: 658763 - RNA, 22 nt, Human
gaauacuuuuguuaggaaaacg

SEQ ID NO: 658764 - RNA, 22 nt, Human
uuuagaaggacuacagugugau

SEQ ID NO: 658765 - RNA, 23 nt, Human
ucagugauguugaaccuagcagu

SEQ ID NO: 658766 - RNA, 22 nt, Human
cagaacagaaucguguggugag

SEQ ID NO: 658767 - RNA, 22 nt, Human
uugcaaaagccgaggcacucca

SEQ ID NO: 658768 - RNA, 22 nt, Human
gggccuggggacaccaccauga

SEQ ID NO: 658769 - RNA, 22 nt, Human
gccuggcuaguuagugucaggu

SEQ ID NO: 658770 - RNA, 22 nt, Human
gcaggaugggagcuucacucug

SEQ ID NO: 658771 - RNA, 22 nt, Human
ccagugugccaauuuacagcug

SEQ ID NO: 658772 - RNA, 19 nt, Human
aacuacagcgcacuguccu

SEQ ID NO: 658773 - RNA, 19 nt, Human
acagggaauuuccacagaa

SEQ ID NO: 658774 - RNA, 22 nt, Human
cugauggauggacagggguagu

SEQ ID NO: 658775 - RNA, 22 nt, Human
augaagcagcguuguagaguga

SEQ ID NO: 658776 - RNA, 22 nt, Human
ugguaaauauguccauucucuu

SEQ ID NO: 658777 - RNA, 22 nt, Human
uuccaagucuaaguuauaaauc

SEQ ID NO: 658778 - RNA, 22 nt, Human
acuauacaguauguacgugcac

SEQ ID NO: 658779 - RNA, 22 nt, Human
uauucagaaaauaaauuggauu

SEQ ID NO: 658780 - RNA, 22 nt, Human
acagagguguguguaggacagu

SEQ ID NO: 658781 - RNA, 22 nt, Human
caaagguuaugaaccacuugua

SEQ ID NO: 658782 - RNA, 22 nt, Human
ccagggcaauuauuuggagggu

SEQ ID NO: 658783 - RNA, 22 nt, Human
cacuuacacuucugaaagccua

SEQ ID NO: 658784 - RNA, 22 nt, Human
guuuucaauuauaagauggcuu

SEQ ID NO: 658785 - RNA, 22 nt, Human
ugccuggggauugcucugggcc

SEQ ID NO: 658786 - RNA, 22 nt, Human
uacugcuucauauagggaugua

SEQ ID NO: 658787 - RNA, 22 nt, Human
uugucaaggcuuuuaauauucu

SEQ ID NO: 658788 - RNA, 22 nt, Human
aacauucuucaaauaucacucu

SEQ ID NO: 658789 - RNA, 22 nt, Human
aguuaaggggguucaucuguaa

SEQ ID NO: 658790 - RNA, 22 nt, Human
cgggucaccuaucaauuuugug

SEQ ID NO: 658791 - RNA, 22 nt, Human
accgggaaguccugcacugggc

SEQ ID NO: 658792 - RNA, 22 nt, Human
uuuacagagagagaacuggacu

SEQ ID NO: 658793 - RNA, 22 nt, Human
gacaagacuauguagaaaguau

SEQ ID NO: 658794 - RNA, 22 nt, Human
aauucuucaagugcuuuggaga

SEQ ID NO: 658795 - RNA, 22 nt, Human
aacugcuuugugagcuuucugg

SEQ ID NO: 658796 - RNA, 22 nt, Human
auuugcauuuacauagcauaga

SEQ ID NO: 658797 - RNA, 18 nt, Human
ccagauggccagucugcu

SEQ ID NO: 658798 - RNA, 22 nt, Human
auacaugcgccauguuggugug

SEQ ID NO: 658799 - RNA, 22 nt, Human
gaaguuguaagccugggaaggu

SEQ ID NO: 658800 - RNA, 22 nt, Human
ucauuuacgcgccuccuuccuu

SEQ ID NO: 658801 - RNA, 22 nt, Human
gucugcucaugcuaccgcgggc

SEQ ID NO: 658802 - RNA, 22 nt, Human
cucuggaguuagugaucugggc

SEQ ID NO: 658803 - RNA, 22 nt, Human
agugcucucuccccagugcuac

SEQ ID NO: 658804 - RNA, 22 nt, Human
ucacuuuuggguuuccaguaga

SEQ ID NO: 658805 - RNA, 22 nt, Human
auuggagacagaugggcuccag

SEQ ID NO: 658806 - RNA, 22 nt, Human
uccagccaccaccuugauugcc

SEQ ID NO: 658807 - RNA, 22 nt, Human
uggcucaccuucagaauauacc

SEQ ID NO: 658808 - RNA, 23 nt, Human
uuuuuaguuacaccucugccacc

SEQ ID NO: 658809 - RNA, 22 nt, Human
gcaugcagucaaccaguaaggg

SEQ ID NO: 658810 - RNA, 22 nt, Human
gugcauuggugcgccacuucac

SEQ ID NO: 658811 - RNA, 22 nt, Human
cccguguggacagcgugccagu

SEQ ID NO: 658812 - RNA, 16 nt, Human
auucugcugccugcuc

SEQ ID NO: 658813 - RNA, 22 nt, Human
ggagacugaucugagugauaac

SEQ ID NO: 658814 - RNA, 22 nt, Human
agugucuuucauauccuccauc

SEQ ID NO: 658815 - RNA, 23 nt, Human
agacccagagacuggcucugcuc

SEQ ID NO: 658816 - RNA, 22 nt, Human
aagcuauacaaugcacaaauga

SEQ ID NO: 658817 - RNA, 22 nt, Human
ggugauucugugaggggcugac

SEQ ID NO: 658818 - RNA, 19 nt, Human
gggagcuuuccaucugucc

SEQ ID NO: 658819 - RNA, 18 nt, Human
ccagcaugccagaggcug

SEQ ID NO: 658820 - RNA, 22 nt, Human
uguguguaaggaagcuuuaugg

SEQ ID NO: 658821 - RNA, 22 nt, Human
gaggcugcggggaggagccugc

SEQ ID NO: 658822 - RNA, 22 nt, Human
ugcuuacaacuuuauugaggaa

SEQ ID NO: 658823 - RNA, 22 nt, Human
guuuugaagaagaccuugaaac

SEQ ID NO: 658824 - RNA, 22 nt, Human
ucuaaacuuguaaacaagcaua

SEQ ID NO: 658825 - RNA, 22 nt, Human
augagcugggccauccagugau

SEQ ID NO: 658826 - RNA, 22 nt, Human
cagacaaggccaucuuucauuu

SEQ ID NO: 658827 - RNA, 22 nt, Human
ucaggaagaagacggggcagga

SEQ ID NO: 658828 - RNA, 21 nt, Human
cauuuacaugacagauugguu

SEQ ID NO: 658829 - RNA, 22 nt, Human
uguaacauauagcauguucuug

SEQ ID NO: 658830 - RNA, 22 nt, Human
uucugccuuggcaggguggucc

SEQ ID NO: 658831 - RNA, 22 nt, Human
agcacagagguggaaguguaua

SEQ ID NO: 658832 - RNA, 22 nt, Human
aauuugauucagcaaauguuca

SEQ ID NO: 658833 - RNA, 22 nt, Human
aguauuuguggauuuguauugg

SEQ ID NO: 658834 - RNA, 22 nt, Human
cucuggguccuggggcuacaag

SEQ ID NO: 658835 - RNA, 22 nt, Human
agccucugguccucccucagcu

SEQ ID NO: 658836 - RNA, 22 nt, Human
ccaagcuggauuuagcugcaca

SEQ ID NO: 658837 - RNA, 20 nt, Human
cucugggcugcacccucgcc

SEQ ID NO: 658838 - RNA, 22 nt, Human
gaguguucccacaccccaguug

SEQ ID NO: 658839 - RNA, 22 nt, Human
caaucacugaccugcagaugca

SEQ ID NO: 658840 - RNA, 22 nt, Human
uuucugcuaaucuuuuacugag

SEQ ID NO: 658841 - RNA, 22 nt, Human
uauuccuguuccccaucaccac

SEQ ID NO: 658842 - RNA, 22 nt, Human
acccagguggcucugacggggg

SEQ ID NO: 658843 - RNA, 22 nt, Human
aguauuuagagacacaagaugg

SEQ ID NO: 658844 - RNA, 22 nt, Human
ugcagccugguggucacuggag

SEQ ID NO: 658845 - RNA, 22 nt, Human
aguggacccggaacagaggccc

SEQ ID NO: 658846 - RNA, 22 nt, Human
augcucacuucagagaagauga

SEQ ID NO: 658847 - RNA, 22 nt, Human
agacacagaaguugcuguuggg

SEQ ID NO: 658848 - RNA, 22 nt, Human
agguuuauuaaguaaauagagc

SEQ ID NO: 658849 - RNA, 22 nt, Human
agagcuguguuuaguaguuacg

SEQ ID NO: 658850 - RNA, 22 nt, Human
cagcuucauugccugaugucuu

SEQ ID NO: 658851 - RNA, 21 nt, Human
ggcaggauggcaguggacccc

SEQ ID NO: 658852 - RNA, 22 nt, Human
ucacagugacagccaauguuuu

SEQ ID NO: 658853 - RNA, 22 nt, Human
cagagaagaaagugacuauaau

SEQ ID NO: 658854 - RNA, 22 nt, Human
ugggaagcugcauuuuaacaag

SEQ ID NO: 658855 - RNA, 22 nt, Human
ggcugccugccuccaagccggg

SEQ ID NO: 658856 - RNA, 22 nt, Human
ugagucugcuccugguagcaga

SEQ ID NO: 658857 - RNA, 22 nt, Human
uuugaaaguucuucugacacua

SEQ ID NO: 658858 - RNA, 22 nt, Human
uuuucauuguaaaucaggaaac

SEQ ID NO: 658859 - RNA, 20 nt, Human
uucuuuacgaccuuucugca

SEQ ID NO: 658860 - RNA, 22 nt, Human
guuacaaacucaggugccaaaa

SEQ ID NO: 658861 - RNA, 22 nt, Human
acacaaacagucuauagcacca

SEQ ID NO: 658862 - RNA, 22 nt, Human
acaggagaauuaucuggaacaa

SEQ ID NO: 658863 - RNA, 22 nt, Human
auauauaauacuugcugugggc

SEQ ID NO: 658864 - RNA, 22 nt, Human
uuuccagguaucaagcuucagg

SEQ ID NO: 658865 - RNA, 22 nt, Human
cuugcuugccaugggcuugggc

SEQ ID NO: 658866 - RNA, 22 nt, Human
gugguguaggucacaguuagga

SEQ ID NO: 658867 - RNA, 22 nt, Human
uggggcacuuaugaugugccac

SEQ ID NO: 658868 - RNA, 22 nt, Human
gcuggaagaaugagugccucgu

SEQ ID NO: 658869 - RNA, 22 nt, Human
auguacaaaauguuuugaaaug

SEQ ID NO: 658870 - RNA, 22 nt, Human
acagugucugacacguaggaag

SEQ ID NO: 658871 - RNA, 22 nt, Human
aaggggcucuugucaggcgcag

SEQ ID NO: 658872 - RNA, 19 nt, Human
ugagacagaagaugagccu

SEQ ID NO: 658873 - RNA, 22 nt, Human
aggucucaaucucaggugguca

SEQ ID NO: 658874 - RNA, 22 nt, Human
acagggcaugugcaagagacau

SEQ ID NO: 658875 - RNA, 22 nt, Human
ugaaagaaacagguauauuggg

SEQ ID NO: 658876 - RNA, 22 nt, Human
uaaaucacuguacuuuauuccu

SEQ ID NO: 658877 - RNA, 22 nt, Human
uaucuauuauguucuauguguc

SEQ ID NO: 658878 - RNA, 22 nt, Human
uugccagggucaggaugagauc

SEQ ID NO: 658879 - RNA, 22 nt, Human
gucccaggaguugcugggccuu

SEQ ID NO: 658880 - RNA, 19 nt, Human
gccugggaugggcagaacu

SEQ ID NO: 658881 - RNA, 22 nt, Human
gcauccaucagcagauugacug

SEQ ID NO: 658882 - RNA, 17 nt, Human
agagggcucaaggcauc

SEQ ID NO: 658883 - RNA, 22 nt, Human
aagaacaugaacacaauguuua

SEQ ID NO: 658884 - RNA, 22 nt, Human
accgaaggaaacuggaaccguu

SEQ ID NO: 658885 - RNA, 22 nt, Human
aacagaauuguacaccagggag

SEQ ID NO: 658886 - RNA, 22 nt, Human
acagugugguuugagcacuggg

SEQ ID NO: 658887 - RNA, 18 nt, Human
aaugugaauauuuacuuc

SEQ ID NO: 658888 - RNA, 22 nt, Human
cauggcuucgcgcguccccgcu

SEQ ID NO: 658889 - RNA, 22 nt, Human
gugcugcuugggggcagagcag

SEQ ID NO: 658890 - RNA, 22 nt, Human
aggccucuugucuuccucacau

SEQ ID NO: 658891 - RNA, 22 nt, Human
cucugccaucucacuggguccu

SEQ ID NO: 658892 - RNA, 22 nt, Human
cugggacccacaccuggaaucu

SEQ ID NO: 658893 - RNA, 22 nt, Human
ugcuggcuuuuugugucaaaga

SEQ ID NO: 658894 - RNA, 22 nt, Human
aaaaguaauugcaguuuugcca

SEQ ID NO: 658895 - RNA, 22 nt, Human
acauugcaauaauaauucucuu

SEQ ID NO: 658896 - RNA, 22 nt, Human
gccugugucauguaguagcuuc

SEQ ID NO: 658897 - RNA, 22 nt, Human
gcucaaaugucauggggagccu

SEQ ID NO: 658898 - RNA, 22 nt, Human
gaguagacauuaaauuacacug

SEQ ID NO: 658899 - RNA, 22 nt, Human
uuuacacaaaauguuaguagau

SEQ ID NO: 658900 - RNA, 21 nt, Human
ucugaugguagaugagaugug

SEQ ID NO: 658901 - RNA, 22 nt, Human
ucaggagcuugguagugugauu

SEQ ID NO: 658902 - RNA, 22 nt, Human
ccagggcaucacauccaguguu

SEQ ID NO: 658903 - RNA, 22 nt, Human
uagaaaugucgucuccacauuu

SEQ ID NO: 658904 - RNA, 22 nt, Human
uauagguaugucgagaaaugaa

SEQ ID NO: 658905 - RNA, 22 nt, Human
aucacacuggacauuggauacu

SEQ ID NO: 658906 - RNA, 22 nt, Human
ggcaggcaggucuucauggccc

SEQ ID NO: 658907 - RNA, 22 nt, Human
uauuuguauuucaugcaguaaa

SEQ ID NO: 658908 - RNA, 22 nt, Human
ugucugaugauagugucucucc

SEQ ID NO: 658909 - RNA, 22 nt, Human
ccaggccaguguuugguccagg

SEQ ID NO: 658910 - RNA, 22 nt, Human
cuggcagcugugugaagaacug

SEQ ID NO: 658911 - RNA, 22 nt, Human
uaggggcagaagcggcggucca

SEQ ID NO: 658912 - RNA, 22 nt, Human
aggagguggcaacugucgacag

SEQ ID NO: 658913 - RNA, 22 nt, Human
uauuucaagaacuucuauccau

SEQ ID NO: 658914 - RNA, 22 nt, Human
gcugcagaauuuccuucucauu

SEQ ID NO: 658915 - RNA, 22 nt, Human
cacagggaguuacagaagcacu

SEQ ID NO: 658916 - RNA, 17 nt, Human
agugucagaagacaguu

SEQ ID NO: 658917 - RNA, 22 nt, Human
cuggaaagauuucuuuggaguc

SEQ ID NO: 658918 - RNA, 22 nt, Human
aaugcuucaaccucccacaugu

SEQ ID NO: 658919 - RNA, 22 nt, Human
gugugcgccgacacagccaggu

SEQ ID NO: 658920 - RNA, 22 nt, Human
cugugccacugggggccggcaa

SEQ ID NO: 658921 - RNA, 22 nt, Human
ugaggucuuuuauaguguguca

SEQ ID NO: 658922 - RNA, 22 nt, Human
auuguaucuugucauuaugcau

SEQ ID NO: 658923 - RNA, 22 nt, Human
uucugcauaggcuauauuuguu

SEQ ID NO: 658924 - RNA, 22 nt, Human
cuuuccagauuuguccaguuau

SEQ ID NO: 658925 - RNA, 22 nt, Human
uuccuagaaugguuagaaaaua

SEQ ID NO: 658926 - RNA, 22 nt, Human
cuggcuuucucugugguguuca

SEQ ID NO: 658927 - RNA, 22 nt, Human
ugccccugaccucaggcgaagg

SEQ ID NO: 658928 - RNA, 22 nt, Human
ccaggagucaauaaaggaagcu

SEQ ID NO: 658929 - RNA, 22 nt, Human
ccugugggagguucugugaguc

SEQ ID NO: 658930 - RNA, 22 nt, Human
acagcagcacuauugacauuuu

SEQ ID NO: 658931 - RNA, 22 nt, Human
aaaaggcagugcaagagagggu

SEQ ID NO: 658932 - RNA, 22 nt, Human
guauuuuuaguagagucggggu

SEQ ID NO: 658933 - RNA, 22 nt, Human
ugggccagagaguaagaaaggu

SEQ ID NO: 658934 - RNA, 22 nt, Human
ccagcagcugcuaugugguuuu

SEQ ID NO: 658935 - RNA, 22 nt, Human
gcuguggguuccuggcauuuga

SEQ ID NO: 658936 - RNA, 22 nt, Human
gaaggagaggauugugaggcug

SEQ ID NO: 658937 - RNA, 22 nt, Human
cugccugggccggccacccucu

SEQ ID NO: 658938 - RNA, 22 nt, Human
gccuggcaggccucaugagggg

SEQ ID NO: 658939 - RNA, 22 nt, Human
gccaggaauuucaagagccacu

SEQ ID NO: 658940 - RNA, 23 nt, Human
ggccuccuggucuaggcuagacu

SEQ ID NO: 658941 - RNA, 22 nt, Human
augucaacaggccuuuaaacau

SEQ ID NO: 658942 - RNA, 22 nt, Human
uugaaaggaauacagaggccua

SEQ ID NO: 658943 - RNA, 22 nt, Human
ggcugaguugagaggauuacuu

SEQ ID NO: 658944 - RNA, 22 nt, Human
ggccucugggguccugagccca

SEQ ID NO: 658945 - RNA, 22 nt, Human
ugugaggagaggcccagcuccc

SEQ ID NO: 658946 - RNA, 22 nt, Human
acuugaauuauauuucuagaga

SEQ ID NO: 658947 - RNA, 22 nt, Human
gccaggcuaagaaaggugugau

SEQ ID NO: 658948 - RNA, 22 nt, Human
gcucucuuuccauguggaggau

SEQ ID NO: 658949 - RNA, 22 nt, Human
ggcucaggaccugggauugcca

SEQ ID NO: 658950 - RNA, 22 nt, Human
ccagagucugugugugucaucc

SEQ ID NO: 658951 - RNA, 21 nt, Human
guucuugcaggauuuccuucc

SEQ ID NO: 658952 - RNA, 21 nt, Human
cucucugcuuaugaauaguga

SEQ ID NO: 658953 - RNA, 22 nt, Human
ucacaguuacuccuucagauga

SEQ ID NO: 658954 - RNA, 22 nt, Human
uauugauuccugcuuucugcuc

SEQ ID NO: 658955 - RNA, 22 nt, Human
cccucgcucuaggcagcccugu

SEQ ID NO: 658956 - RNA, 22 nt, Human
aaagcaauggaugagaaucugu

SEQ ID NO: 658957 - RNA, 22 nt, Human
uuaaauagucaaaucaguggca

SEQ ID NO: 658958 - RNA, 22 nt, Human
agagggugcuggagagacauug

SEQ ID NO: 658959 - RNA, 21 nt, Human
gccugggaagagaaagguaag

SEQ ID NO: 658960 - RNA, 22 nt, Human
uuuacuuugugucaagucaaga

SEQ ID NO: 658961 - RNA, 22 nt, Human
acaggcuguugggguccagggu

SEQ ID NO: 658962 - RNA, 20 nt, Human
ucacuaguaaccaucugcuu

SEQ ID NO: 658963 - RNA, 22 nt, Human
uaggcugaaaggagaggugaag

SEQ ID NO: 658964 - RNA, 22 nt, Human
uguauugaauuguguuauaucu

SEQ ID NO: 658965 - RNA, 22 nt, Human
auuuacagccuugccaucuaua

SEQ ID NO: 658966 - RNA, 22 nt, Human
uuaguguacuuagugcucuaag

SEQ ID NO: 658967 - RNA, 22 nt, Human
aucaucuuaaaucuagaaugug

SEQ ID NO: 658968 - RNA, 22 nt, Human
gcacacagggauuuuugaaugg

SEQ ID NO: 658969 - RNA, 22 nt, Human
ggccucuggugccugaagcgcc

SEQ ID NO: 658970 - RNA, 22 nt, Human
ccugcacagccuuggcugacac

SEQ ID NO: 658971 - RNA, 22 nt, Human
ugugaggaacccggaauguggg

SEQ ID NO: 658972 - RNA, 22 nt, Human
cucuggucaagcaaagagguuu

SEQ ID NO: 658973 - RNA, 22 nt, Human
caaugugugcuuacaggccagu

SEQ ID NO: 658974 - RNA, 22 nt, Human
uccaggugggcugcacccaggc

SEQ ID NO: 658975 - RNA, 22 nt, Human
agcuggucuuaaauguguccag

SEQ ID NO: 658976 - RNA, 22 nt, Human
caccuggacccugggaggaggg

SEQ ID NO: 658977 - RNA, 22 nt, Human
agaggcucuuugagcugggaga

SEQ ID NO: 658978 - RNA, 22 nt, Human
agcugugugcauuugggucuca

SEQ ID NO: 658979 - RNA, 22 nt, Human
cuaagaggaaguacucuguuau

SEQ ID NO: 658980 - RNA, 22 nt, Human
cuagagaaacgccgugggagga

SEQ ID NO: 658981 - RNA, 22 nt, Human
accaggcaaaaccacaggagca

SEQ ID NO: 658982 - RNA, 17 nt, Human
gcugcagcgguaggcag

SEQ ID NO: 658983 - RNA, 22 nt, Human
gcagcaacgcggcccuacugcu

SEQ ID NO: 658984 - RNA, 22 nt, Human
cccugcucuucugacucaagcu

SEQ ID NO: 658985 - RNA, 22 nt, Human
gcagagccugacgggauuuuuc

SEQ ID NO: 658986 - RNA, 22 nt, Human
auuauggacguuaauuuuggaa

SEQ ID NO: 658987 - RNA, 19 nt, Human
cagaacagcugggaagaga

SEQ ID NO: 658988 - RNA, 22 nt, Human
uucuuaacucaaauauauaucc

SEQ ID NO: 658989 - RNA, 22 nt, Human
uguccuggccuccagaaagucg

SEQ ID NO: 658990 - RNA, 22 nt, Human
aaagaugcauaaaugccaaugg

SEQ ID NO: 658991 - RNA, 22 nt, Human
aggaggcaggaagucuauggga

SEQ ID NO: 658992 - RNA, 23 nt, Human
cagcuuucagggcuuuagggaag

SEQ ID NO: 658993 - RNA, 22 nt, Human
aaaggcauggaacagauucucc

SEQ ID NO: 658994 - RNA, 22 nt, Human
uccugagcacagagacaaggaa

SEQ ID NO: 658995 - RNA, 22 nt, Human
agccaggaauuggacaacacau

SEQ ID NO: 658996 - RNA, 22 nt, Human
auucacaugcccaagcagcacc

SEQ ID NO: 658997 - RNA, 22 nt, Human
agagauguaugcauuugucaca

SEQ ID NO: 658998 - RNA, 22 nt, Human
guggaggcagugacacaguagc

SEQ ID NO: 658999 - RNA, 23 nt, Human
aggaacugcuucauuuuugaaag

SEQ ID NO: 659000 - RNA, 22 nt, Human
gcagaggggaagcugaggaauu

SEQ ID NO: 659001 - RNA, 22 nt, Human
acacaggagaaaagaucuccca

SEQ ID NO: 659002 - RNA, 22 nt, Human
augccuggacugacaugcacug

SEQ ID NO: 659003 - RNA, 22 nt, Human
uauuucucagcauuuuacaucc

SEQ ID NO: 659004 - RNA, 18 nt, Human
gcugaaauucuaaacaaa

SEQ ID NO: 659005 - RNA, 22 nt, Human
ucaccccuugugaaugcugcuc

SEQ ID NO: 659006 - RNA, 22 nt, Human
ggugaaauuccuuguggaaagu

SEQ ID NO: 659007 - RNA, 22 nt, Human
gcuggccugcugggcaccaccg

SEQ ID NO: 659008 - RNA, 22 nt, Human
uguguuguuuuaagcugcugca

SEQ ID NO: 659009 - RNA, 22 nt, Human
gggcaugagaggcaggcaagug

SEQ ID NO: 659010 - RNA, 22 nt, Human
uagaggugagacuucagugaca

SEQ ID NO: 659011 - RNA, 22 nt, Human
caggcuggcaaugcgucaagca

SEQ ID NO: 659012 - RNA, 22 nt, Human
uuuaccaaauagauuaugucag

SEQ ID NO: 659013 - RNA, 22 nt, Human
ggccacagagggcgggaugcug

SEQ ID NO: 659014 - RNA, 22 nt, Human
ugaggggcagagagguguccag

SEQ ID NO: 659015 - RNA, 22 nt, Human
cuacagcagagcuacacuaacu

SEQ ID NO: 659016 - RNA, 22 nt, Human
aaagacugggacugcagcaggc

SEQ ID NO: 659017 - RNA, 22 nt, Human
gcaguaagaaagucaagcaguu

SEQ ID NO: 659018 - RNA, 22 nt, Human
aggccuggguguucaccagaag

SEQ ID NO: 659019 - RNA, 22 nt, Human
ugugugugacaaccuaguucag

SEQ ID NO: 659020 - RNA, 22 nt, Human
ucaguaacuucaugaccaagca

SEQ ID NO: 659021 - RNA, 20 nt, Human
aggaggggauagaaucaaag

SEQ ID NO: 659022 - RNA, 22 nt, Human
guacagaaaguacccauagaag

SEQ ID NO: 659023 - RNA, 22 nt, Human
uugagggacagaggugcugucu

SEQ ID NO: 659024 - RNA, 22 nt, Human
gaaucacacucguaagugaguu

SEQ ID NO: 659025 - RNA, 22 nt, Human
cugggccaucuccuuugugugg

SEQ ID NO: 659026 - RNA, 22 nt, Human
caggaacagcugaccugacaau

SEQ ID NO: 659027 - RNA, 22 nt, Human
uggguagaggaauugggcuacc

SEQ ID NO: 659028 - RNA, 22 nt, Human
auuucccaggacuagaaauaua

SEQ ID NO: 659029 - RNA, 22 nt, Human
accuuaaaugugacauagucua

SEQ ID NO: 659030 - RNA, 22 nt, Human
gguggggccagggcuccaaccu

SEQ ID NO: 659031 - RNA, 22 nt, Human
uuggcugugcagaucuugccua

SEQ ID NO: 659032 - RNA, 22 nt, Human
gguaacugcaccuuuggccuga

SEQ ID NO: 659033 - RNA, 23 nt, Human
aguguuaaauuucgcaccuaaau

SEQ ID NO: 659034 - RNA, 20 nt, Human
aagauucauuguaauuaggg

SEQ ID NO: 659035 - RNA, 22 nt, Human
gcaugcagugcaauucaaugua

SEQ ID NO: 659036 - RNA, 21 nt, Human
ucagaagugcagcccaggaau

SEQ ID NO: 659037 - RNA, 20 nt, Human
uggcaucucucaauuguagg

SEQ ID NO: 659038 - RNA, 23 nt, Human
ggccuguguuuugucugaaguac

SEQ ID NO: 659039 - RNA, 22 nt, Human
acaggucugcaguaacugggaa

SEQ ID NO: 659040 - RNA, 22 nt, Human
accugcccggggacauuccuuu

SEQ ID NO: 659041 - RNA, 21 nt, Human
aucugaaaugucaaagcagau

SEQ ID NO: 659042 - RNA, 22 nt, Human
ccucugggugggaggccgggcg

SEQ ID NO: 659043 - RNA, 19 nt, Human
aacuguaaagaucuguagc

SEQ ID NO: 659044 - RNA, 22 nt, Human
uuuaaacuguugauuuuaugaa

SEQ ID NO: 659045 - RNA, 23 nt, Human
uuuuaauuuggacauaagaagau

SEQ ID NO: 659046 - RNA, 22 nt, Human
agucugggauguauaaacugaa

SEQ ID NO: 659047 - RNA, 22 nt, Human
uaguuuaggugggguagacaga

SEQ ID NO: 659048 - RNA, 22 nt, Human
uggaaucaguuacaugugguug

SEQ ID NO: 659049 - RNA, 22 nt, Human
cagaaacagacaugacgcagua

SEQ ID NO: 659050 - RNA, 22 nt, Human
acaguggagaagcaaaugcagu

SEQ ID NO: 659051 - RNA, 22 nt, Human
aauuugauucccugcaccuguu

SEQ ID NO: 659052 - RNA, 22 nt, Human
guuacagugcauguggcuucug

SEQ ID NO: 659053 - RNA, 22 nt, Human
uauguucaugucaaacaaaugc

SEQ ID NO: 659054 - RNA, 22 nt, Human
ucagaggaauaaugcugcauuu

SEQ ID NO: 659055 - RNA, 23 nt, Human
cacauggauuaaaugagaccaca

SEQ ID NO: 659056 - RNA, 22 nt, Human
gucuggaagaacuagggauguu

SEQ ID NO: 659057 - RNA, 22 nt, Human
uacaucugauuuaccuacugaa

SEQ ID NO: 659058 - RNA, 22 nt, Human
auauucaucguguagaaauacu

SEQ ID NO: 659059 - RNA, 22 nt, Human
aagcuggagugcagugcaaugg

SEQ ID NO: 659060 - RNA, 22 nt, Human
agagguugggucugaggugaga

SEQ ID NO: 659061 - RNA, 22 nt, Human
uuucuagucucgaucucuuaau

SEQ ID NO: 659062 - RNA, 22 nt, Human
ucucagggccucccucuguuuc

SEQ ID NO: 659063 - RNA, 22 nt, Human
gaagaugggaaugaugaguggg

SEQ ID NO: 659064 - RNA, 22 nt, Human
acucaaauagcugccccuagug

SEQ ID NO: 659065 - RNA, 22 nt, Human
uucuucauucccuuacuuccga

SEQ ID NO: 659066 - RNA, 22 nt, Human
uuaucuacguauuuaaacucuu

SEQ ID NO: 659067 - RNA, 22 nt, Human
uagagguacuccccucaaaguu

SEQ ID NO: 659068 - RNA, 22 nt, Human
cugcagagaauuguggggcuuc

SEQ ID NO: 659069 - RNA, 22 nt, Human
aucugucaggagcaaggacuac

SEQ ID NO: 659070 - RNA, 22 nt, Human
ucuuagaaauuccccaguggcu

SEQ ID NO: 659071 - RNA, 22 nt, Human
uacucucuggaaauuauaguga

SEQ ID NO: 659072 - RNA, 22 nt, Human
ugaaagucucuguuauagagaa

SEQ ID NO: 659073 - RNA, 22 nt, Human
cauuggcacaaguagcuucauc

SEQ ID NO: 659074 - RNA, 22 nt, Human
uuccaggaacagaugaagguug

SEQ ID NO: 659075 - RNA, 20 nt, Human
ugcagcugguuucacaggga

SEQ ID NO: 659076 - RNA, 22 nt, Human
ggugaccucaccuggucccacc

SEQ ID NO: 659077 - RNA, 22 nt, Human
ugggcccaucauugcugugggc

SEQ ID NO: 659078 - RNA, 22 nt, Human
ccuuuucuguuuccugucacug

SEQ ID NO: 659079 - RNA, 21 nt, Human
agggaaauccagucacuuuuc

SEQ ID NO: 659080 - RNA, 22 nt, Human
uuuuucucuaugccaggggccu

SEQ ID NO: 659081 - RNA, 22 nt, Human
gcucugcugucuucuugcaggc

SEQ ID NO: 659082 - RNA, 22 nt, Human
cuacagcuguguguuuaugugc

SEQ ID NO: 659083 - RNA, 22 nt, Human
uagaacuuagcacuagacuugu

SEQ ID NO: 659084 - RNA, 22 nt, Human
uaauuucuggagggagaaagag

SEQ ID NO: 659085 - RNA, 19 nt, Human
ugagcugcugcugcccauc

SEQ ID NO: 659086 - RNA, 22 nt, Human
cauuaaaauaucucaugguguu

SEQ ID NO: 659087 - RNA, 22 nt, Human
uggcuucaaggugauaauuuac

SEQ ID NO: 659088 - RNA, 17 nt, Human
aucugcauuucuaauga

SEQ ID NO: 659089 - RNA, 22 nt, Human
cugcuuuagguggaauguucua

SEQ ID NO: 659090 - RNA, 22 nt, Human
uucacacacagcuuccuauugu

SEQ ID NO: 659091 - RNA, 22 nt, Human
aaugucaugggaauuuauucau

SEQ ID NO: 659092 - RNA, 20 nt, Human
acaauagauuugagcaaagu

SEQ ID NO: 659093 - RNA, 22 nt, Human
ucccuguacacuaacuugagac

SEQ ID NO: 659094 - RNA, 22 nt, Human
ugacugccaugagggugagggc

SEQ ID NO: 659095 - RNA, 22 nt, Human
cauacauugaauuugcacgugu

SEQ ID NO: 659096 - RNA, 22 nt, Human
auguguagaacuguaaugccca

SEQ ID NO: 659097 - RNA, 22 nt, Human
uuugaauaucacaaacuuucaa

SEQ ID NO: 659098 - RNA, 19 nt, Human
gguuaauguuaggauacuu

SEQ ID NO: 659099 - RNA, 22 nt, Human
uuacauguuuauggggguacau

SEQ ID NO: 659100 - RNA, 22 nt, Human
ccuggggaauagagucaagggg

SEQ ID NO: 659101 - RNA, 22 nt, Human
ucuggggauaagacccagguau

SEQ ID NO: 659102 - RNA, 22 nt, Human
acagccagaagucaggguggga

SEQ ID NO: 659103 - RNA, 22 nt, Human
aucagagauggcuccagugcuc

SEQ ID NO: 659104 - RNA, 22 nt, Human
gcuguauuuaacaacuggcuca

SEQ ID NO: 659105 - RNA, 22 nt, Human
gaguauaugacuuucuuuugca

SEQ ID NO: 659106 - RNA, 22 nt, Human
gggaaauugucaacacucucaa

SEQ ID NO: 659107 - RNA, 20 nt, Human
ucagugcagauuguccaagu

SEQ ID NO: 659108 - RNA, 22 nt, Human
uguccugggucaaauccugguc

SEQ ID NO: 659109 - RNA, 22 nt, Human
ccagaagggcuauugcagugac

SEQ ID NO: 659110 - RNA, 22 nt, Human
gugugccucccauuagggugua

SEQ ID NO: 659111 - RNA, 20 nt, Human
uguugauuggugucaucuca

SEQ ID NO: 659112 - RNA, 22 nt, Human
ccagucuggcaggagggggaac

SEQ ID NO: 659113 - RNA, 22 nt, Human
ggucagcaucugguugagggca

SEQ ID NO: 659114 - RNA, 22 nt, Human
uucuugcucaaugucuguuuaa

SEQ ID NO: 659115 - RNA, 22 nt, Human
caggagcuacucagguuggguu

SEQ ID NO: 659116 - RNA, 22 nt, Human
augaaauauucuuugguaagaa

SEQ ID NO: 659117 - RNA, 20 nt, Human
gccagcccugacacaggagc

SEQ ID NO: 659118 - RNA, 22 nt, Human
cuaaggcagguccauuccagga

SEQ ID NO: 659119 - RNA, 23 nt, Human
gcaggaguuccuggacuccagga

SEQ ID NO: 659120 - RNA, 22 nt, Human
aggcuagaggcuucuggcuuca

SEQ ID NO: 659121 - RNA, 22 nt, Human
gccugaugagcuuccagcugag

SEQ ID NO: 659122 - RNA, 22 nt, Human
acagaauugaagcugaguaaau

SEQ ID NO: 659123 - RNA, 22 nt, Human
uugugaguagugccgcaauaaa

SEQ ID NO: 659124 - RNA, 22 nt, Human
ucuucuacuauaauaauuuucu

SEQ ID NO: 659125 - RNA, 22 nt, Human
caguggcucaugccuauaaucc

SEQ ID NO: 659126 - RNA, 22 nt, Human
guguacaugagaaaucaacuuu

SEQ ID NO: 659127 - RNA, 22 nt, Human
auucagcaugcaauuagguaau

SEQ ID NO: 659128 - RNA, 22 nt, Human
ucaagacaggguuuaagguuga

SEQ ID NO: 659129 - RNA, 22 nt, Human
uuaacuuuuauuucugcucgcc

SEQ ID NO: 659130 - RNA, 22 nt, Human
auaaaagaucccuucugagcuc

SEQ ID NO: 659131 - RNA, 22 nt, Human
cuuauucauaagucagacacac

SEQ ID NO: 659132 - RNA, 22 nt, Human
acggguggcugaggaggccucu

SEQ ID NO: 659133 - RNA, 22 nt, Human
aguggcugguaguuacugagca

SEQ ID NO: 659134 - RNA, 22 nt, Human
gagcacagggaauagacagaua

SEQ ID NO: 659135 - RNA, 22 nt, Human
aggcuuuggaaucagaguucug

SEQ ID NO: 659136 - RNA, 22 nt, Human
uuuaaugauagucuuacgaaaa

SEQ ID NO: 659137 - RNA, 22 nt, Human
aagagcugcacauauuuauauc

SEQ ID NO: 659138 - RNA, 22 nt, Human
uccauucauucauugaugaaca

SEQ ID NO: 659139 - RNA, 22 nt, Human
cuccucugucuaccacgagggu

SEQ ID NO: 659140 - RNA, 22 nt, Human
uggcuggagagggucccaugag

SEQ ID NO: 659141 - RNA, 22 nt, Human
aaguaaaagcuuuaccaugcgc

SEQ ID NO: 659142 - RNA, 22 nt, Human
augcauauaaggcacauguauu

SEQ ID NO: 659143 - RNA, 22 nt, Human
gaagcuucguggcucuucaaau

SEQ ID NO: 659144 - RNA, 22 nt, Human
aguggguguagucuuccuccug

SEQ ID NO: 659145 - RNA, 19 nt, Human
gacagugcaguuguaguac

SEQ ID NO: 659146 - RNA, 22 nt, Human
aaauggcaguagaaaagaaucc

SEQ ID NO: 659147 - RNA, 19 nt, Human
uggguuggaagggaaugaa

SEQ ID NO: 659148 - RNA, 22 nt, Human
uguccccagagccuguuccugc

SEQ ID NO: 659149 - RNA, 22 nt, Human
ggaggccacgguuuagcaccga

SEQ ID NO: 659150 - RNA, 22 nt, Human
ggcagcugauuagcaucaagga

SEQ ID NO: 659151 - RNA, 22 nt, Human
cuaaccuguugaaggaauugcu

SEQ ID NO: 659152 - RNA, 22 nt, Human
uaaguccuauuccaggucucuc

SEQ ID NO: 659153 - RNA, 23 nt, Human
gaacccagcucugccacuugcca

SEQ ID NO: 659154 - RNA, 22 nt, Human
gcgugggguagguagacaugga

SEQ ID NO: 659155 - RNA, 22 nt, Human
uccaggccccagaccguacugc

SEQ ID NO: 659156 - RNA, 22 nt, Human
aauauaugugguauugaccagc

SEQ ID NO: 659157 - RNA, 22 nt, Human
ccucaagaacaauccaccauua

SEQ ID NO: 659158 - RNA, 22 nt, Human
gggauggcugccugcaucagga

SEQ ID NO: 659159 - RNA, 22 nt, Human
uuugguccaaguuuuacucuuu

SEQ ID NO: 659160 - RNA, 22 nt, Human
aaugucauugagcuccaauccu

SEQ ID NO: 659161 - RNA, 22 nt, Human
uaaaauguguuucuguaugguu

SEQ ID NO: 659162 - RNA, 17 nt, Human
ggagagugggaauggcc

SEQ ID NO: 659163 - RNA, 22 nt, Human
ucauuucuuaacuagagugaac

SEQ ID NO: 659164 - RNA, 22 nt, Human
uuuaugacccaagaagauacca

SEQ ID NO: 659165 - RNA, 22 nt, Human
ccaaguacucucaccaaagcuu

SEQ ID NO: 659166 - RNA, 22 nt, Human
cuucucagaggccagaagcuau

SEQ ID NO: 659167 - RNA, 22 nt, Human
aggcaaauagauaguccauaca

SEQ ID NO: 659168 - RNA, 22 nt, Human
acauuccagguuggugcagggu

SEQ ID NO: 659169 - RNA, 22 nt, Human
uucauucuuugaaucugaggua

SEQ ID NO: 659170 - RNA, 22 nt, Human
aaagcaugugaauagaauaugg

SEQ ID NO: 659171 - RNA, 22 nt, Human
ggcucuggguucugcaaugcgu

SEQ ID NO: 659172 - RNA, 22 nt, Human
acaucucacuucuuugaaggcu

SEQ ID NO: 659173 - RNA, 22 nt, Human
aguuuauguguaagacagcugu

SEQ ID NO: 659174 - RNA, 22 nt, Human
augaggaugggaagggagccaa

SEQ ID NO: 659175 - RNA, 22 nt, Human
auucauucuugguaugaacagc

SEQ ID NO: 659176 - RNA, 20 nt, Human
ucagacuugauucuaugcua

SEQ ID NO: 659177 - RNA, 21 nt, Human
ucagcuuugcaacugcacauc

SEQ ID NO: 659178 - RNA, 22 nt, Human
ugucuuuuggagcaucuuucuu

SEQ ID NO: 659179 - RNA, 22 nt, Human
acagaugagaaggcugaccagu

SEQ ID NO: 659180 - RNA, 22 nt, Human
ggcuacagcgggguggagacgg

SEQ ID NO: 659181 - RNA, 22 nt, Human
ugggcugcagagcccggccuuc

SEQ ID NO: 659182 - RNA, 22 nt, Human
acugggccaggugugggugagu

SEQ ID NO: 659183 - RNA, 21 nt, Human
uuccacagugagaacugcaag

SEQ ID NO: 659184 - RNA, 22 nt, Human
aggcugccucugcaggaucccu

SEQ ID NO: 659185 - RNA, 22 nt, Human
ugggaagaagcagagaacugga

SEQ ID NO: 659186 - RNA, 22 nt, Human
uucuagcagagggcaucugcug

SEQ ID NO: 659187 - RNA, 22 nt, Human
uugaaaguuuauggagucugca

SEQ ID NO: 659188 - RNA, 22 nt, Human
cuggcuccauuacucagcaucu

SEQ ID NO: 659189 - RNA, 22 nt, Human
acagcaugagagaugaacauuc

SEQ ID NO: 659190 - RNA, 22 nt, Human
aaagaagagcuggaaggagucu

SEQ ID NO: 659191 - RNA, 22 nt, Human
ucucuggcugauauuccucugc

SEQ ID NO: 659192 - RNA, 22 nt, Human
uuucugaagguuaaggaauuag

SEQ ID NO: 659193 - RNA, 21 nt, Human
caauggcgagaucuuggcuca

SEQ ID NO: 659194 - RNA, 22 nt, Human
uaguacaguuuaaauauuaaua

SEQ ID NO: 659195 - RNA, 22 nt, Human
uacagaggaggggauuuuaaua

SEQ ID NO: 659196 - RNA, 22 nt, Human
agucaucucagguagcauuuac

SEQ ID NO: 659197 - RNA, 22 nt, Human
acaagaguaauuucaacagagu

SEQ ID NO: 659198 - RNA, 22 nt, Human
gcuuccuucuaccacaucaugc

SEQ ID NO: 659199 - RNA, 22 nt, Human
agagcagaggcauggccguggg

SEQ ID NO: 659200 - RNA, 22 nt, Human
ucuggagcaacagagcaggaca

SEQ ID NO: 659201 - RNA, 22 nt, Human
cagcauggagacaaagugggca

SEQ ID NO: 659202 - RNA, 22 nt, Human
ucccagggggaugaacacugcc

SEQ ID NO: 659203 - RNA, 22 nt, Human
ugucucuucugccuccagcugu

SEQ ID NO: 659204 - RNA, 20 nt, Human
uuugacaccuugggagagac

SEQ ID NO: 659205 - RNA, 22 nt, Human
aguguuuaccccaaucaguuua

SEQ ID NO: 659206 - RNA, 22 nt, Human
aucaggaaauacuuauuuauaa

SEQ ID NO: 659207 - RNA, 22 nt, Human
guaucuuuaucccucguuggag

SEQ ID NO: 659208 - RNA, 22 nt, Human
uggcugggugcuauccaguacu

SEQ ID NO: 659209 - RNA, 22 nt, Human
uuggaaggauuuagagaugucu

SEQ ID NO: 659210 - RNA, 17 nt, Human
agcugaaauugcugaag

SEQ ID NO: 659211 - RNA, 22 nt, Human
auacagaaguuuuccacuuauu

SEQ ID NO: 659212 - RNA, 22 nt, Human
uuauuccauuauuucacuuagg

SEQ ID NO: 659213 - RNA, 22 nt, Human
aaugucaaaauggaaugagacu

SEQ ID NO: 659214 - RNA, 22 nt, Human
gaaauauacaugaagucggcug

SEQ ID NO: 659215 - RNA, 22 nt, Human
ucaaugcaacuuccaccuccca

SEQ ID NO: 659216 - RNA, 22 nt, Human
ccucaggcuagcuacugucccu

SEQ ID NO: 659217 - RNA, 22 nt, Human
uuauucugacuaauguauaacu

SEQ ID NO: 659218 - RNA, 20 nt, Human
gcugaggucccugugguuuu

SEQ ID NO: 659219 - RNA, 19 nt, Human
augucucuguagcacauac

SEQ ID NO: 659220 - RNA, 22 nt, Human
cacuguggcuuaccaaagcuaa

SEQ ID NO: 659221 - RNA, 22 nt, Human
cugagcugcggcaggcaccugg

SEQ ID NO: 659222 - RNA, 22 nt, Human
ugccccugaugccuagaacaga

SEQ ID NO: 659223 - RNA, 22 nt, Human
agccugcaggaugggcagcacc

SEQ ID NO: 659224 - RNA, 22 nt, Human
cgcugggcgccgaccugcuggc

SEQ ID NO: 659225 - RNA, 22 nt, Human
gagggaguaacguacuacagug

SEQ ID NO: 659226 - RNA, 22 nt, Human
gacagcugcauccucagacaca

SEQ ID NO: 659227 - RNA, 22 nt, Human
uggguccucugagagggcagcg

SEQ ID NO: 659228 - RNA, 22 nt, Human
ggcaugcauacguagugauuuu

SEQ ID NO: 659229 - RNA, 22 nt, Human
uugaacaauuugguauacaaac

SEQ ID NO: 659230 - RNA, 22 nt, Human
gcacucaguaccaggucacugc

SEQ ID NO: 659231 - RNA, 22 nt, Human
cugccuggccugaucuccacgc

SEQ ID NO: 659232 - RNA, 21 nt, Human
ucagaggcugggggaaugccc

SEQ ID NO: 659233 - RNA, 22 nt, Human
cagcugcucugguggucucucc

SEQ ID NO: 659234 - RNA, 22 nt, Human
aaguguguauuguuuaugcugc

SEQ ID NO: 659235 - RNA, 22 nt, Human
aggauguguucauagcugacgc

SEQ ID NO: 659236 - RNA, 22 nt, Human
gaguccucaacggggagaggcg

SEQ ID NO: 659237 - RNA, 22 nt, Human
uuccuagggcagagccgcuggg

SEQ ID NO: 659238 - RNA, 22 nt, Human
agggccaccucucuggguuccc

SEQ ID NO: 659239 - RNA, 22 nt, Human
gaggauggaggugugagcuaug

SEQ ID NO: 659240 - RNA, 22 nt, Human
ugugucagcacaguaucaauua

SEQ ID NO: 659241 - RNA, 22 nt, Human
ccacaaguuucagcacccagag

SEQ ID NO: 659242 - RNA, 22 nt, Human
gaacauuacugcuugggagagg

SEQ ID NO: 659243 - RNA, 22 nt, Human
ucaggcugugucuuuaaacaau

SEQ ID NO: 659244 - RNA, 22 nt, Human
ucuggcugacauccuguaugag

SEQ ID NO: 659245 - RNA, 22 nt, Human
gucccagaggcuuuggccacag

SEQ ID NO: 659246 - RNA, 23 nt, Human
ccagcccuccaccagcucuaggc

SEQ ID NO: 659247 - RNA, 22 nt, Human
aaaaugcaugagaaugugcucg

SEQ ID NO: 659248 - RNA, 22 nt, Human
aaaccuuugugugucugugccu

SEQ ID NO: 659249 - RNA, 22 nt, Human
agguccuguuucuucccugggg

SEQ ID NO: 659250 - RNA, 20 nt, Human
gcuccuguccugguggaggg

SEQ ID NO: 659251 - RNA, 22 nt, Human
agaaacagaaccaggugucauu

SEQ ID NO: 659252 - RNA, 22 nt, Human
ugcaccagagcagggugcccaa

SEQ ID NO: 659253 - RNA, 22 nt, Human
aggcucagagaugaguaagcac

SEQ ID NO: 659254 - RNA, 22 nt, Human
ucucccaggugggugccuggag

SEQ ID NO: 659255 - RNA, 19 nt, Human
uuuucacauacuggauccu

SEQ ID NO: 659256 - RNA, 22 nt, Human
cucucuauggaugcaguuuuuc

SEQ ID NO: 659257 - RNA, 19 nt, Human
guauauuuauauggcugua

SEQ ID NO: 659258 - RNA, 22 nt, Human
uugcaggguugaccaauaggcu

SEQ ID NO: 659259 - RNA, 22 nt, Human
gaggggcaguugauugugcuau

SEQ ID NO: 659260 - RNA, 18 nt, Human
agcugcccugggcuggag

SEQ ID NO: 659261 - RNA, 22 nt, Human
aacuuaaacaagcucccaaguu

SEQ ID NO: 659262 - RNA, 22 nt, Human
aaucccuuuuucauuuaauaga

SEQ ID NO: 659263 - RNA, 22 nt, Human
ugcuggcucaguuugcagacuc

SEQ ID NO: 659264 - RNA, 20 nt, Human
aggaggaaaaaaugacgagc

SEQ ID NO: 659265 - RNA, 22 nt, Human
uggagucacuuucucuuccagu

SEQ ID NO: 659266 - RNA, 19 nt, Human
gcucagagucccccugcgg

SEQ ID NO: 659267 - RNA, 22 nt, Human
guucacaagaguuacagacaga

SEQ ID NO: 659268 - RNA, 22 nt, Human
auucuucauguugaagcuguca

SEQ ID NO: 659269 - RNA, 22 nt, Human
aguaauaauagcuguaaagugc

SEQ ID NO: 659270 - RNA, 22 nt, Human
ucucagugcagagaggcuaucu

SEQ ID NO: 659271 - RNA, 22 nt, Human
uaccuggauaucauucauucuc

SEQ ID NO: 659272 - RNA, 22 nt, Human
aaugcucaaaauguuucaucua

SEQ ID NO: 659273 - RNA, 22 nt, Human
acugaguguaggacuuugaguu

SEQ ID NO: 659274 - RNA, 22 nt, Human
ggcugagccaugggcacugcag

SEQ ID NO: 659275 - RNA, 22 nt, Human
ggagccugugggaugagaugug

SEQ ID NO: 659276 - RNA, 22 nt, Human
aauaaaugaacaaagcagguug

SEQ ID NO: 659277 - RNA, 22 nt, Human
agcucugaugacuuuacaacuu

SEQ ID NO: 659278 - RNA, 22 nt, Human
gcuuucuggagccugggggaac

SEQ ID NO: 659279 - RNA, 22 nt, Human
ucugucucucaagggccguccu

SEQ ID NO: 659280 - RNA, 22 nt, Human
uauuugaagggagaaagugcca

SEQ ID NO: 659281 - RNA, 23 nt, Human
cucuggguccgauguccugacag

SEQ ID NO: 659282 - RNA, 22 nt, Human
ggcuggcuggcuuagcagagga

SEQ ID NO: 659283 - RNA, 22 nt, Human
ucagcucugcacuccacugugg

SEQ ID NO: 659284 - RNA, 22 nt, Human
aaacacugauggauauuuuucc

SEQ ID NO: 659285 - RNA, 22 nt, Human
cagcaggaagguuuccccugca

SEQ ID NO: 659286 - RNA, 22 nt, Human
aacagcuuagaaauguugcuaa

SEQ ID NO: 659287 - RNA, 22 nt, Human
gagccccaggacagcucuaguu

SEQ ID NO: 659288 - RNA, 22 nt, Human
cuucaaaugugauuuuaauaac

SEQ ID NO: 659289 - RNA, 22 nt, Human
agaagccucauccucucuagug

SEQ ID NO: 659290 - RNA, 23 nt, Human
uugugggcagauuccauggggag

SEQ ID NO: 659291 - RNA, 22 nt, Human
ucuuuucuugcauuauugcacu

SEQ ID NO: 659292 - RNA, 22 nt, Human
ugagggugggcccugggcaucu

SEQ ID NO: 659293 - RNA, 22 nt, Human
auucagaagcaaucacagugag

SEQ ID NO: 659294 - RNA, 22 nt, Human
aaagucauuuuccagaccagua

SEQ ID NO: 659295 - RNA, 22 nt, Human
aggcaacaugggccaggcagaa

SEQ ID NO: 659296 - RNA, 22 nt, Human
gcuguguugggaaucauguggg

SEQ ID NO: 659297 - RNA, 22 nt, Human
aucuguguguugaguucucagc

SEQ ID NO: 659298 - RNA, 22 nt, Human
ucaggaaguugaggcguagaga

SEQ ID NO: 659299 - RNA, 22 nt, Human
ucagaagcugguguccuuugaa

SEQ ID NO: 659300 - RNA, 22 nt, Human
uauggcuuaggagaguuuaacu

SEQ ID NO: 659301 - RNA, 22 nt, Human
ggggaccuggccacccauccuu

SEQ ID NO: 659302 - RNA, 22 nt, Human
accgggcuaauuuuuguaucuu

SEQ ID NO: 659303 - RNA, 22 nt, Human
gagagcuguccggcugagcagc

SEQ ID NO: 659304 - RNA, 22 nt, Human
cauuggcaccucacaggauaga

SEQ ID NO: 659305 - RNA, 22 nt, Human
gcagcuccuccugggcuggaga

SEQ ID NO: 659306 - RNA, 21 nt, Human
ucacaggcucagggagagagu

SEQ ID NO: 659307 - RNA, 22 nt, Human
cugaagaggacuggguuggagg

SEQ ID NO: 659308 - RNA, 22 nt, Human
ucugggcuuuguaaugggaggu

SEQ ID NO: 659309 - RNA, 22 nt, Human
ucuggccaggauggcaagacca

SEQ ID NO: 659310 - RNA, 22 nt, Human
cucagauguagaaagauuguga

SEQ ID NO: 659311 - RNA, 22 nt, Human
uucaagauccagcacaacagug

SEQ ID NO: 659312 - RNA, 22 nt, Human
cuuaauuuuuguaguagaugga

SEQ ID NO: 659313 - RNA, 22 nt, Human
cuguuuauuacguaauuaauau

SEQ ID NO: 659314 - RNA, 22 nt, Human
agggccaguucagaggacaugg

SEQ ID NO: 659315 - RNA, 22 nt, Human
aggagagagguuuuaaaugggg

SEQ ID NO: 659316 - RNA, 22 nt, Human
cacacugucuuucagaaugguu

SEQ ID NO: 659317 - RNA, 21 nt, Human
ucccagggccaggugccauca

SEQ ID NO: 659318 - RNA, 22 nt, Human
aagacucuaucuuuagagauca

SEQ ID NO: 659319 - RNA, 22 nt, Human
auacaguauaacuaauaaaccc

SEQ ID NO: 659320 - RNA, 22 nt, Human
uuuccuuguucauuugcccuau

SEQ ID NO: 659321 - RNA, 22 nt, Human
ugucuccagaaagcaccaggag

SEQ ID NO: 659322 - RNA, 22 nt, Human
auucuuauuaaauagccagaag

SEQ ID NO: 659323 - RNA, 19 nt, Human
gauuuaaacguggcucuau

SEQ ID NO: 659324 - RNA, 18 nt, Human
cuccagguaauucugaua

SEQ ID NO: 659325 - RNA, 20 nt, Human
gccugccucagcuagcugag

SEQ ID NO: 659326 - RNA, 18 nt, Human
ugaggcccgcagaggugg

SEQ ID NO: 659327 - RNA, 22 nt, Human
augcauugcuugaggguaggaa

SEQ ID NO: 659328 - RNA, 22 nt, Human
cacccaggacaaaauauggaau

SEQ ID NO: 659329 - RNA, 22 nt, Human
acaaguuuauuugauuagaaca

SEQ ID NO: 659330 - RNA, 22 nt, Human
uugcacuagucucagaggcaaa

SEQ ID NO: 659331 - RNA, 22 nt, Human
uuucaaggcuaguuuuaauuag

SEQ ID NO: 659332 - RNA, 22 nt, Human
augacagugggucuugcaaaga

SEQ ID NO: 659333 - RNA, 22 nt, Human
cugggagucuaagcuagcaccg

SEQ ID NO: 659334 - RNA, 22 nt, Human
aagagguugucugugaugaguu

SEQ ID NO: 659335 - RNA, 22 nt, Human
uucugugugcuuacugguguuc

SEQ ID NO: 659336 - RNA, 22 nt, Human
ugcuuuauaaccauuucugugg

SEQ ID NO: 659337 - RNA, 19 nt, Human
ggcaccuuucugcuguguc

SEQ ID NO: 659338 - RNA, 22 nt, Human
gcugccugccuugccuggagga

SEQ ID NO: 659339 - RNA, 22 nt, Human
agcagauguuucagagcaggcu

SEQ ID NO: 659340 - RNA, 22 nt, Human
ucuggggguuaagugaggacaa

SEQ ID NO: 659341 - RNA, 22 nt, Human
uaauuccaaguugagacaugca

SEQ ID NO: 659342 - RNA, 22 nt, Human
uuucugaauaacucuaugauau

SEQ ID NO: 659343 - RNA, 22 nt, Human
cuuccaguaguaucauucucau

SEQ ID NO: 659344 - RNA, 22 nt, Human
gccacaggugggcucugggaaa

SEQ ID NO: 659345 - RNA, 22 nt, Human
agaauaaaucaaauguccugag

SEQ ID NO: 659346 - RNA, 22 nt, Human
cagcagugucuccagcaucaca

SEQ ID NO: 659347 - RNA, 22 nt, Human
auucaaaagaccaugcagacuc

SEQ ID NO: 659348 - RNA, 22 nt, Human
ucacaguuuuagcuguuaaaua

SEQ ID NO: 659349 - RNA, 22 nt, Human
auaaagauuuuuaggcauuucu

SEQ ID NO: 659350 - RNA, 22 nt, Human
gggggcuggacuuucccacaca

SEQ ID NO: 659351 - RNA, 22 nt, Human
guccuggcccacuggcaggcug

SEQ ID NO: 659352 - RNA, 22 nt, Human
gugugggugggacaucaucuuu

SEQ ID NO: 659353 - RNA, 18 nt, Human
auuguucugugacauguc

SEQ ID NO: 659354 - RNA, 22 nt, Human
cugaaaggcaguggguagugug

SEQ ID NO: 659355 - RNA, 22 nt, Human
ucagaaucucuggaggcuuggc

SEQ ID NO: 659356 - RNA, 22 nt, Human
uguguauguaagcaugugcaua

SEQ ID NO: 659357 - RNA, 22 nt, Human
acaaaaauuagcugggcauggu

SEQ ID NO: 659358 - RNA, 22 nt, Human
gugcaaaaguacuugcggauuu

SEQ ID NO: 659359 - RNA, 22 nt, Human
uuucagagucagcuccucucua

SEQ ID NO: 659360 - RNA, 22 nt, Human
uggucaggauucucagcccuuc

SEQ ID NO: 659361 - RNA, 22 nt, Human
ggcagcacugcagcuuguuggg

SEQ ID NO: 659362 - RNA, 22 nt, Human
uauguuauauuuugucaauugu

SEQ ID NO: 659363 - RNA, 22 nt, Human
aaggcaccauaggcaaauccag

SEQ ID NO: 659364 - RNA, 22 nt, Human
uccuggcauugugcagggugug

SEQ ID NO: 659365 - RNA, 22 nt, Human
cagcccacugccucugugguag

SEQ ID NO: 659366 - RNA, 22 nt, Human
gaggggcagaaugugaucaggg

SEQ ID NO: 659367 - RNA, 22 nt, Human
acauuuaaauaugccuuauauu

SEQ ID NO: 659368 - RNA, 22 nt, Human
cuacaguagagaggauguagaa

SEQ ID NO: 659369 - RNA, 20 nt, Human
gggugagauguaggagaggg

SEQ ID NO: 659370 - RNA, 22 nt, Human
ucaaauaaugccauucaucauc

SEQ ID NO: 659371 - RNA, 17 nt, Human
auacaaagccauaaacc

SEQ ID NO: 659372 - RNA, 22 nt, Human
cucaggagacaguguccacaug

SEQ ID NO: 659373 - RNA, 22 nt, Human
ggcuggcucagggcuugagaga

SEQ ID NO: 659374 - RNA, 22 nt, Human
ccgggagcaggcgccaccgcca

SEQ ID NO: 659375 - RNA, 22 nt, Human
uuuaaugaauaauucaaaucug

SEQ ID NO: 659376 - RNA, 22 nt, Human
caguggauuagccagagcugga

SEQ ID NO: 659377 - RNA, 22 nt, Human
acuguggggggcuuugcucagu

SEQ ID NO: 659378 - RNA, 22 nt, Human
gccaggugcuaucccugcgcug

SEQ ID NO: 659379 - RNA, 20 nt, Human
ucagugauuuugaagaggaa

SEQ ID NO: 659380 - RNA, 18 nt, Human
ugaggcugaauauggggc

SEQ ID NO: 659381 - RNA, 22 nt, Human
ucucaggcuaccuugcacaagg

SEQ ID NO: 659382 - RNA, 21 nt, Human
cccaggucguggucuucccag

SEQ ID NO: 659383 - RNA, 22 nt, Human
uccaagaagcuuacaaucuaau

SEQ ID NO: 659384 - RNA, 22 nt, Human
agugugugaccuuuuaauuuaa

SEQ ID NO: 659385 - RNA, 22 nt, Human
agcaggaaggggaugaugggca

SEQ ID NO: 659386 - RNA, 22 nt, Human
gccugcaagauggcuggucacu

SEQ ID NO: 659387 - RNA, 22 nt, Human
agcauccugccucuccucccaa

SEQ ID NO: 659388 - RNA, 17 nt, Human
cucagagaggguaagua

SEQ ID NO: 659389 - RNA, 22 nt, Human
uaugaagacaaugauagcauga

SEQ ID NO: 659390 - RNA, 22 nt, Human
cuucaagucgccaaaugcugaa

SEQ ID NO: 659391 - RNA, 22 nt, Human
agcaggcuuaugguugaaggga

SEQ ID NO: 659392 - RNA, 22 nt, Human
ggcacacagcuuggcaggagau

SEQ ID NO: 659393 - RNA, 19 nt, Human
acuuccugcccgcuccuuu

SEQ ID NO: 659394 - RNA, 20 nt, Human
auaugcugagugaaggcaga

SEQ ID NO: 659395 - RNA, 22 nt, Human
uauaucugggaaccaaaggggg

SEQ ID NO: 659396 - RNA, 22 nt, Human
aaagugcucggauuacagguau

SEQ ID NO: 659397 - RNA, 22 nt, Human
gccauuuucugucuuguuuauu

SEQ ID NO: 659398 - RNA, 22 nt, Human
uagucacaugaucacaggaucg

SEQ ID NO: 659399 - RNA, 22 nt, Human
acugggguuuaggccugggcaa

SEQ ID NO: 659400 - RNA, 22 nt, Human
auucuuuuaaauggcaguagua

SEQ ID NO: 659401 - RNA, 22 nt, Human
uuucuaguaaucaauauaaagu

SEQ ID NO: 659402 - RNA, 22 nt, Human
accuggcacuacaggcaccugu

SEQ ID NO: 659403 - RNA, 22 nt, Human
uguccuggccaaggccuugcuu

SEQ ID NO: 659404 - RNA, 22 nt, Human
gcuugguuacugauggaaagga

SEQ ID NO: 659405 - RNA, 22 nt, Human
ugggcugcugcggugcucuugg

SEQ ID NO: 659406 - RNA, 22 nt, Human
agacaauggaccaagcaccuuc

SEQ ID NO: 659407 - RNA, 22 nt, Human
uugaauaguuuuggauagcaua

SEQ ID NO: 659408 - RNA, 22 nt, Human
aagcucagugaugccuccaggg

SEQ ID NO: 659409 - RNA, 22 nt, Human
aggauccuuuggccacuucuua

SEQ ID NO: 659410 - RNA, 22 nt, Human
cacccuggaaagaaggucuggg

SEQ ID NO: 659411 - RNA, 22 nt, Human
caggaagauuagaccaagagcu

SEQ ID NO: 659412 - RNA, 23 nt, Human
uuaaacacuaguucgaguagcau

SEQ ID NO: 659413 - RNA, 22 nt, Human
cagggccucuccuccaggaacu

SEQ ID NO: 659414 - RNA, 22 nt, Human
auaugcaugcaugcuugugaga

SEQ ID NO: 659415 - RNA, 22 nt, Human
ucagguccuuacugugcucccu

SEQ ID NO: 659416 - RNA, 22 nt, Human
caggagcuuucuucccaaacuu

SEQ ID NO: 659417 - RNA, 22 nt, Human
augcaacagaaaauugccuggg

SEQ ID NO: 659418 - RNA, 22 nt, Human
cuuguacauagagaagaagccu

SEQ ID NO: 659419 - RNA, 22 nt, Human
aguauacauauauuagccuucg

SEQ ID NO: 659420 - RNA, 21 nt, Human
ggcugggucaugcagcuggcc

SEQ ID NO: 659421 - RNA, 22 nt, Human
ccaguuuagguacuaggcucua

SEQ ID NO: 659422 - RNA, 22 nt, Human
gagucaguaauggauaugucau

SEQ ID NO: 659423 - RNA, 22 nt, Human
cagagcugucauuugccaguga

SEQ ID NO: 659424 - RNA, 22 nt, Human
uacaucauguaagcagaaucau

SEQ ID NO: 659425 - RNA, 22 nt, Human
aauauuuaugacaggaaguagc

SEQ ID NO: 659426 - RNA, 22 nt, Human
ucacaaagagaauugugggugu

SEQ ID NO: 659427 - RNA, 22 nt, Human
cauuagagcagauaauaugugu

SEQ ID NO: 659428 - RNA, 22 nt, Human
gcagucauccagccuuuccacu

SEQ ID NO: 659429 - RNA, 22 nt, Human
gccaggcagcaggaagccagug

SEQ ID NO: 659430 - RNA, 22 nt, Human
aucugccuccaaguccaugugu

SEQ ID NO: 659431 - RNA, 22 nt, Human
gaaaacugugauuagaaugccu

SEQ ID NO: 659432 - RNA, 22 nt, Human
augcacagaaaaauugcuuacu

SEQ ID NO: 659433 - RNA, 19 nt, Human
gugauuucuuuccacaagc

SEQ ID NO: 659434 - RNA, 22 nt, Human
cgcaggcaaugcuccgcggggg

SEQ ID NO: 659435 - RNA, 22 nt, Human
cagaguuucgguaagcauagaa

SEQ ID NO: 659436 - RNA, 22 nt, Human
cgggcacacacuugacagguuc

SEQ ID NO: 659437 - RNA, 22 nt, Human
cugggagagaagcgaagcuggg

SEQ ID NO: 659438 - RNA, 22 nt, Human
uccccucucugcgcucccaggu

SEQ ID NO: 659439 - RNA, 22 nt, Human
ggugacgaauccauagcaucga

SEQ ID NO: 659440 - RNA, 22 nt, Human
gaagauugaaggcugggaauua

SEQ ID NO: 659441 - RNA, 22 nt, Human
ggcagggguggccuuccuuugg

SEQ ID NO: 659442 - RNA, 22 nt, Human
cugggcugucccagggcggcag

SEQ ID NO: 659443 - RNA, 22 nt, Human
ucugucaggagauuggcagcug

SEQ ID NO: 659444 - RNA, 22 nt, Human
ggaacauuuccuggcagagagg

SEQ ID NO: 659445 - RNA, 22 nt, Human
cucuggcucuguugagauuugu

SEQ ID NO: 659446 - RNA, 22 nt, Human
uauaaccuuuucuuuauccucc

SEQ ID NO: 659447 - RNA, 20 nt, Human
aguguauuuggguagagugu

SEQ ID NO: 659448 - RNA, 22 nt, Human
acauccauuugcuuuauuugcu

SEQ ID NO: 659449 - RNA, 20 nt, Human
ucauccaggacaggaguggc

SEQ ID NO: 659450 - RNA, 22 nt, Human
ggagucugcucccagacaugau

SEQ ID NO: 659451 - RNA, 22 nt, Human
cuuguacauugauuucugcauu

SEQ ID NO: 659452 - RNA, 22 nt, Human
aguuucccccuucacagcuuaa

SEQ ID NO: 659453 - RNA, 22 nt, Human
ucuguuccauguuuuguuccau

SEQ ID NO: 659454 - RNA, 22 nt, Human
auaugaaaagaagucaccauug

SEQ ID NO: 659455 - RNA, 22 nt, Human
augcagaaugaguucacgaucu

SEQ ID NO: 659456 - RNA, 22 nt, Human
augcaaaaguaacugugauuuu

SEQ ID NO: 659457 - RNA, 22 nt, Human
auuuuguuauagaacucuguga

SEQ ID NO: 659458 - RNA, 22 nt, Human
uacacauaggaggguaauaaaa

SEQ ID NO: 659459 - RNA, 22 nt, Human
uugaaaagcaaaugauggguag

SEQ ID NO: 659460 - RNA, 22 nt, Human
caguacuugggggguucuaagu

SEQ ID NO: 659461 - RNA, 22 nt, Human
uuucucaacagaguaugcccuu

SEQ ID NO: 659462 - RNA, 22 nt, Human
ugguacaaucacagcucacugu

SEQ ID NO: 659463 - RNA, 20 nt, Human
gccucuggagccaaggacca

SEQ ID NO: 659464 - RNA, 22 nt, Human
auagauguuuuaguaauacugu

SEQ ID NO: 659465 - RNA, 22 nt, Human
uagaucauaaauacuauggugc

SEQ ID NO: 659466 - RNA, 18 nt, Human
gagcagaggaggguuuuu

SEQ ID NO: 659467 - RNA, 22 nt, Human
aaggauuuguccaaagucacac

SEQ ID NO: 659468 - RNA, 22 nt, Human
cagagcagauuucuaaguauug

SEQ ID NO: 659469 - RNA, 22 nt, Human
ugaucccuggacuugaguaagu

SEQ ID NO: 659470 - RNA, 22 nt, Human
auguggaggaaaugaguguaca

SEQ ID NO: 659471 - RNA, 22 nt, Human
auaaaaaugagggcgguagcua

SEQ ID NO: 659472 - RNA, 22 nt, Human
gacuggcuuauuucacuuagca

SEQ ID NO: 659473 - RNA, 22 nt, Human
cucaagucccgcaguguuccuc

SEQ ID NO: 659474 - RNA, 22 nt, Human
auuagacaucauaugauucagc

SEQ ID NO: 659475 - RNA, 22 nt, Human
cagccaggacucccauuuagga

SEQ ID NO: 659476 - RNA, 22 nt, Human
ugugugggcgaagacagccuuu

SEQ ID NO: 659477 - RNA, 22 nt, Human
uaguccagaaacugagcuuaua

SEQ ID NO: 659478 - RNA, 22 nt, Human
ccuucacaccaucuuuaccagg

SEQ ID NO: 659479 - RNA, 22 nt, Human
agucccagagaggucggggcca

SEQ ID NO: 659480 - RNA, 18 nt, Human
uguuaaaugaagauuugc

SEQ ID NO: 659481 - RNA, 22 nt, Human
acacagguacacauauguaccu

SEQ ID NO: 659482 - RNA, 22 nt, Human
acuguaaaacugcuuuggaaac

SEQ ID NO: 659483 - RNA, 20 nt, Human
agucacauugagcuuuugga

SEQ ID NO: 659484 - RNA, 21 nt, Human
cuccugggcuaagauauagug

SEQ ID NO: 659485 - RNA, 22 nt, Human
gccagucugcucccacaaguuc

SEQ ID NO: 659486 - RNA, 22 nt, Human
gauaaugaugacaaugacaacc

SEQ ID NO: 659487 - RNA, 22 nt, Human
caggcucagaagccaguggagc

SEQ ID NO: 659488 - RNA, 22 nt, Human
acagaaagaccuuguaacacuu

SEQ ID NO: 659489 - RNA, 19 nt, Human
cuguccacacacucgcuuc

SEQ ID NO: 659490 - RNA, 20 nt, Human
uuaucugucaaucugucuca

SEQ ID NO: 659491 - RNA, 22 nt, Human
uagcugcuucucacaugggcaa

SEQ ID NO: 659492 - RNA, 22 nt, Human
aucugugaucaagacagacagu

SEQ ID NO: 659493 - RNA, 22 nt, Human
gggucuggcaugcugagaugga

SEQ ID NO: 659494 - RNA, 22 nt, Human
cuguaaauaaugacaguugacu

SEQ ID NO: 659495 - RNA, 22 nt, Human
cagggggcucaaaggagagugc

SEQ ID NO: 659496 - RNA, 22 nt, Human
aggaggagcagcuuuuugucuc

SEQ ID NO: 659497 - RNA, 22 nt, Human
agcagccagagaaugaugcagu

SEQ ID NO: 659498 - RNA, 22 nt, Human
aacucaguucuuuccacaaugc

SEQ ID NO: 659499 - RNA, 22 nt, Human
gaguggcagaacuggggguccu

SEQ ID NO: 659500 - RNA, 22 nt, Human
ucacaggguguacaucaccuau

SEQ ID NO: 659501 - RNA, 22 nt, Human
cccugugcagauggcagcuggg

SEQ ID NO: 659502 - RNA, 22 nt, Human
auguguacaaccaagcacuaaa

SEQ ID NO: 659503 - RNA, 22 nt, Human
uacacugucagauuucgauugc

SEQ ID NO: 659504 - RNA, 23 nt, Human
aggcuccacucccugggaugugg

SEQ ID NO: 659505 - RNA, 22 nt, Human
acucagugggcuugaugucgaa

SEQ ID NO: 659506 - RNA, 22 nt, Human
cugcuguguggauucaauggcu

SEQ ID NO: 659507 - RNA, 22 nt, Human
cccugggauugccuuggccuug

SEQ ID NO: 659508 - RNA, 22 nt, Human
aaucaucuccgaaaaaagagua

SEQ ID NO: 659509 - RNA, 22 nt, Human
ggagcuguaacgagccauugcu

SEQ ID NO: 659510 - RNA, 22 nt, Human
cuauuaggcuuccauuucaugc

SEQ ID NO: 659511 - RNA, 22 nt, Human
gugugccaccacugacaggauu

SEQ ID NO: 659512 - RNA, 22 nt, Human
uacaaaugaccauagccacuua

SEQ ID NO: 659513 - RNA, 22 nt, Human
aaacagcugggagguagaggcg

SEQ ID NO: 659514 - RNA, 22 nt, Human
acagaaguguguguguaggaau

SEQ ID NO: 659515 - RNA, 20 nt, Human
ucucuggccagaaacaacag

SEQ ID NO: 659516 - RNA, 22 nt, Human
uguggcugggaagaagguaacu

SEQ ID NO: 659517 - RNA, 22 nt, Human
aaggucugugaggcuguuuguc

SEQ ID NO: 659518 - RNA, 22 nt, Human
agcugcuucaaaaugggcuccu

SEQ ID NO: 659519 - RNA, 22 nt, Human
gcgugcauggccguguguaugc

SEQ ID NO: 659520 - RNA, 22 nt, Human
caagggugaaggcagaggacau

SEQ ID NO: 659521 - RNA, 22 nt, Human
uagcacuauuuuucacuauccu

SEQ ID NO: 659522 - RNA, 22 nt, Human
cagauggauuuuguaggcugau

SEQ ID NO: 659523 - RNA, 22 nt, Human
cgucacuucuuagucuauuuuc

SEQ ID NO: 659524 - RNA, 22 nt, Human
aucugcuggcaucucuagccca

SEQ ID NO: 659525 - RNA, 22 nt, Human
ucugcguuauugaaaagcagcc

SEQ ID NO: 659526 - RNA, 20 nt, Human
uugcaaauaucuauugauug

SEQ ID NO: 659527 - RNA, 22 nt, Human
agcucagggcuccaggaccgcu

SEQ ID NO: 659528 - RNA, 22 nt, Human
uagcuccuggcugcagggccuc

SEQ ID NO: 659529 - RNA, 22 nt, Human
ugcaaauaaauuucuguucauu

SEQ ID NO: 659530 - RNA, 22 nt, Human
gcuuugcuaugacucaccagca

SEQ ID NO: 659531 - RNA, 22 nt, Human
cagcaagauggugaaugagacg

SEQ ID NO: 659532 - RNA, 22 nt, Human
cauuuaauccucacaagccuau

SEQ ID NO: 659533 - RNA, 22 nt, Human
gaaggcugcugggaaguguggu

SEQ ID NO: 659534 - RNA, 22 nt, Human
ggcaagucaggaaguugacauu

SEQ ID NO: 659535 - RNA, 22 nt, Human
gagagguacggaaagagcgugg

SEQ ID NO: 659536 - RNA, 21 nt, Human
cacacagugaucuauccacau

SEQ ID NO: 659537 - RNA, 22 nt, Human
augaaaagcauaaacgcugaag

SEQ ID NO: 659538 - RNA, 22 nt, Human
aauaacuuaagaaauuucccca

SEQ ID NO: 659539 - RNA, 22 nt, Human
ugauucaaauauuguguaugau

SEQ ID NO: 659540 - RNA, 22 nt, Human
aaagauuugaaauuaggcauca

SEQ ID NO: 659541 - RNA, 22 nt, Human
aaacagcugcaguacacggccu

SEQ ID NO: 659542 - RNA, 22 nt, Human
gcugggagucgcgucuguggcc

SEQ ID NO: 659543 - RNA, 22 nt, Human
augcuaaauucagacaggguua

SEQ ID NO: 659544 - RNA, 22 nt, Human
aaaguucagauuagacucaaga

SEQ ID NO: 659545 - RNA, 22 nt, Human
uaauaauuuuaaagaaggcuag

SEQ ID NO: 659546 - RNA, 22 nt, Human
uccugcagucugcacucugccu

SEQ ID NO: 659547 - RNA, 22 nt, Human
uguuuacuugagguggaaacaa

SEQ ID NO: 659548 - RNA, 22 nt, Human
caggcuccacaggggaauccgg

SEQ ID NO: 659549 - RNA, 22 nt, Human
aacaugucuuacuuugcuuucu

SEQ ID NO: 659550 - RNA, 22 nt, Human
ucacuuuggaagauagcacauc

SEQ ID NO: 659551 - RNA, 21 nt, Human
ugggcccaguucccgcugggc

SEQ ID NO: 659552 - RNA, 22 nt, Human
gaggccaacuuuggagaacagg

SEQ ID NO: 659553 - RNA, 22 nt, Human
uggcccugcccucuucaucuuu

SEQ ID NO: 659554 - RNA, 22 nt, Human
agccccaggcccggacgccucu

SEQ ID NO: 659555 - RNA, 22 nt, Human
cugaaugaggaaaagagugagg

SEQ ID NO: 659556 - RNA, 22 nt, Human
uuaagagguggucgugucugug

SEQ ID NO: 659557 - RNA, 22 nt, Human
uauugacuuuuaaagugauaua

SEQ ID NO: 659558 - RNA, 22 nt, Human
uacaccugggacccauccaaga

SEQ ID NO: 659559 - RNA, 22 nt, Human
acagaugcuuacuggugguucc

SEQ ID NO: 659560 - RNA, 22 nt, Human
agcagggggaguuagacuagau

SEQ ID NO: 659561 - RNA, 22 nt, Human
cagcacauagcaugcuugucag

SEQ ID NO: 659562 - RNA, 22 nt, Human
acgcagaagggccuggcgugcc

SEQ ID NO: 659563 - RNA, 22 nt, Human
gcccuccuuugcuucuccuagu

SEQ ID NO: 659564 - RNA, 22 nt, Human
uguggcugugguuuucauaaau

SEQ ID NO: 659565 - RNA, 22 nt, Human
ucugagcugccccuuuacuuug

SEQ ID NO: 659566 - RNA, 22 nt, Human
gcucaguuauccgugugugacu

SEQ ID NO: 659567 - RNA, 21 nt, Human
ggcagcugugguuaauugaac

SEQ ID NO: 659568 - RNA, 22 nt, Human
gggcuggagucuucugaaagcc

SEQ ID NO: 659569 - RNA, 22 nt, Human
ccaggcuccucaugaucuuguu

SEQ ID NO: 659570 - RNA, 22 nt, Human
uccagugguaguaaagaggucu

SEQ ID NO: 659571 - RNA, 22 nt, Human
gcaggaugaaggcagaggcuga

SEQ ID NO: 659572 - RNA, 22 nt, Human
gcaggaguuaaaauauguaaug

SEQ ID NO: 659573 - RNA, 22 nt, Human
uuguuaaaacuccauugguuug

SEQ ID NO: 659574 - RNA, 22 nt, Human
ugacagggugauuaugagagcu

SEQ ID NO: 659575 - RNA, 18 nt, Human
agcucacagaucuguuuu

SEQ ID NO: 659576 - RNA, 18 nt, Human
uucaccagugugaugggu

SEQ ID NO: 659577 - RNA, 22 nt, Human
cugaggcucugagaaagccaaa

SEQ ID NO: 659578 - RNA, 22 nt, Human
ccauccauuuucuugcuugccu

SEQ ID NO: 659579 - RNA, 21 nt, Human
uucaggguuucacaauacuaa

SEQ ID NO: 659580 - RNA, 22 nt, Human
ugucacauucugaugugaggug

SEQ ID NO: 659581 - RNA, 22 nt, Human
gccaugggcaaaugcagagcug

SEQ ID NO: 659582 - RNA, 22 nt, Human
acucaggcuacaacgcguggcu

SEQ ID NO: 659583 - RNA, 23 nt, Human
uggagguuuuacugaguugagga

SEQ ID NO: 659584 - RNA, 22 nt, Human
ccccugaagacaauggagaggu

SEQ ID NO: 659585 - RNA, 22 nt, Human
cagcauggggcuuggagucagc

SEQ ID NO: 659586 - RNA, 17 nt, Human
ccugccugagccauagc

SEQ ID NO: 659587 - RNA, 22 nt, Human
ccaagggcuauuuacagaacag

SEQ ID NO: 659588 - RNA, 22 nt, Human
cuuucacucgagcuccugcagc

SEQ ID NO: 659589 - RNA, 22 nt, Human
uugagaagguggucauuugcaa

SEQ ID NO: 659590 - RNA, 22 nt, Human
aggggagaaaaaugccuucugu

SEQ ID NO: 659591 - RNA, 22 nt, Human
ugcucccacacuacucggaggc

SEQ ID NO: 659592 - RNA, 22 nt, Human
gcacaugagcugcugggauggg

SEQ ID NO: 659593 - RNA, 22 nt, Human
ucuucaugaaauugauugcuua

SEQ ID NO: 659594 - RNA, 19 nt, Human
gcagcugugggaagagcca

SEQ ID NO: 659595 - RNA, 22 nt, Human
cauuguuuugagaacaaccuga

SEQ ID NO: 659596 - RNA, 22 nt, Human
guguugcucuguuuggggguug

SEQ ID NO: 659597 - RNA, 22 nt, Human
ggaaggagggcggcaaugauga

SEQ ID NO: 659598 - RNA, 22 nt, Human
aaauuuuagacuccugggucua

SEQ ID NO: 659599 - RNA, 22 nt, Human
agcuguuuucuaaugcauuuga

SEQ ID NO: 659600 - RNA, 22 nt, Human
guugaaagagcauggacuugaa

SEQ ID NO: 659601 - RNA, 22 nt, Human
gccagcugcaucuccugggcug

SEQ ID NO: 659602 - RNA, 22 nt, Human
cuccaucagcuguugguugagg

SEQ ID NO: 659603 - RNA, 22 nt, Human
uuuccauguguacuggccagaa

SEQ ID NO: 659604 - RNA, 22 nt, Human
cuguaugaaauuaaguaaacag

SEQ ID NO: 659605 - RNA, 22 nt, Human
uguccuggaucaugccucugaa

SEQ ID NO: 659606 - RNA, 22 nt, Human
gucacaggaaaggguguaaggg

SEQ ID NO: 659607 - RNA, 22 nt, Human
aguaugaaucucuuuauucugc

SEQ ID NO: 659608 - RNA, 22 nt, Human
cuauuagaaagcaucuucuaua

SEQ ID NO: 659609 - RNA, 22 nt, Human
cacugagguaucugucucuccu

SEQ ID NO: 659610 - RNA, 22 nt, Human
uucuguacccucgcgauucucc

SEQ ID NO: 659611 - RNA, 22 nt, Human
auguggcucauuguuugcuuac

SEQ ID NO: 659612 - RNA, 17 nt, Human
auuccacagggaaucug

SEQ ID NO: 659613 - RNA, 22 nt, Human
uguacaugugucuguauaucuu

SEQ ID NO: 659614 - RNA, 22 nt, Human
gagguggccagagucaagagcc

SEQ ID NO: 659615 - RNA, 22 nt, Human
uccugaauaaauuagcugucac

SEQ ID NO: 659616 - RNA, 22 nt, Human
ugaaguggacccuggacagacc

SEQ ID NO: 659617 - RNA, 22 nt, Human
ugcaggugaaaauuaugaggau

SEQ ID NO: 659618 - RNA, 22 nt, Human
gcugauuuugagaagcacaguc

SEQ ID NO: 659619 - RNA, 22 nt, Human
agggccugaggcugacggggag

SEQ ID NO: 659620 - RNA, 22 nt, Human
gcccacuggcuggagugcuggu

SEQ ID NO: 659621 - RNA, 22 nt, Human
ucaugccacuuacaaaauaaug

SEQ ID NO: 659622 - RNA, 22 nt, Human
ugauuuccccagucuugcugcu

SEQ ID NO: 659623 - RNA, 22 nt, Human
guuucacagguuggagccagca

SEQ ID NO: 659624 - RNA, 20 nt, Human
cuuuaguuauuaacagcacu

SEQ ID NO: 659625 - RNA, 22 nt, Human
uacuguuuuuuagacucauggu

SEQ ID NO: 659626 - RNA, 22 nt, Human
ugcccaaguguuuggcugaguc

SEQ ID NO: 659627 - RNA, 22 nt, Human
gccuuuggagaugucauaggau

SEQ ID NO: 659628 - RNA, 22 nt, Human
agaggcugucccuugcuauucc

SEQ ID NO: 659629 - RNA, 22 nt, Human
cccagcagccuugucccuucuc

SEQ ID NO: 659630 - RNA, 22 nt, Human
cucagggagagccaagaguucc

SEQ ID NO: 659631 - RNA, 22 nt, Human
ccacauuuacuggaugcucagg

SEQ ID NO: 659632 - RNA, 22 nt, Human
uggggugagauucagauauuca

SEQ ID NO: 659633 - RNA, 22 nt, Human
gcuugaaaauucauagguauuu

SEQ ID NO: 659634 - RNA, 22 nt, Human
caaggcaugaaaggagugagug

SEQ ID NO: 659635 - RNA, 22 nt, Human
acccaggagagagcuauaaaau

SEQ ID NO: 659636 - RNA, 22 nt, Human
auagaauucuuugaaauuuaug

SEQ ID NO: 659637 - RNA, 22 nt, Human
uaggcuggggguaggaauugag

SEQ ID NO: 659638 - RNA, 22 nt, Human
uggcuccaggggacacgcagua

SEQ ID NO: 659639 - RNA, 22 nt, Human
ugucugaagcacugggcguugc

SEQ ID NO: 659640 - RNA, 23 nt, Human
ggagccuccggugugugagaggc

SEQ ID NO: 659641 - RNA, 22 nt, Human
uuccaggaggagguacuagagg

SEQ ID NO: 659642 - RNA, 22 nt, Human
ugccugggccuucccaccucug

SEQ ID NO: 659643 - RNA, 19 nt, Human
ucuaaacacagggacaagc

SEQ ID NO: 659644 - RNA, 22 nt, Human
auucugcuccacacugauucau

SEQ ID NO: 659645 - RNA, 22 nt, Human
agucugucuaauauuauucagg

SEQ ID NO: 659646 - RNA, 20 nt, Human
gagccuuccccucaccacug

SEQ ID NO: 659647 - RNA, 22 nt, Human
gcguccagggaaggcccagcug

SEQ ID NO: 659648 - RNA, 22 nt, Human
ucugcugcagcaggauucucug

SEQ ID NO: 659649 - RNA, 22 nt, Human
cugaccaggguagaggugagag

SEQ ID NO: 659650 - RNA, 22 nt, Human
cagcccuggcgcccccagaucu

SEQ ID NO: 659651 - RNA, 22 nt, Human
aucuuuguugcucucauuucug

SEQ ID NO: 659652 - RNA, 22 nt, Human
gaaaggaaauauucuaagcacu

SEQ ID NO: 659653 - RNA, 22 nt, Human
cuacaucaaguaaucuucaaaa

SEQ ID NO: 659654 - RNA, 22 nt, Human
cuccagagggucagacucugag

SEQ ID NO: 659655 - RNA, 22 nt, Human
agugggaccggugcuauuccag

SEQ ID NO: 659656 - RNA, 22 nt, Human
cuccucuucugaguaccaggga

SEQ ID NO: 659657 - RNA, 22 nt, Human
cauaacauuaagccucuauuuc

SEQ ID NO: 659658 - RNA, 22 nt, Human
cccacauuuuugagucuucauc

SEQ ID NO: 659659 - RNA, 22 nt, Human
uccaucaccauuucugcgagcu

SEQ ID NO: 659660 - RNA, 22 nt, Human
gcuccuguuuucuuccagaaau

SEQ ID NO: 659661 - RNA, 22 nt, Human
ucucugugugccuucaucugcc

SEQ ID NO: 659662 - RNA, 19 nt, Human
ucugaauuauuuauguacc

SEQ ID NO: 659663 - RNA, 22 nt, Human
ccagagcuccagggcuacagaa

SEQ ID NO: 659664 - RNA, 22 nt, Human
uauuggugggggcagagagaga

SEQ ID NO: 659665 - RNA, 22 nt, Human
uuaauuuuuauguauagugugu

SEQ ID NO: 659666 - RNA, 22 nt, Human
uauggaugaguuccugaggagu

SEQ ID NO: 659667 - RNA, 15 nt, Human
cacacagacagcuug

SEQ ID NO: 659668 - RNA, 22 nt, Human
ugcuugaugagugugccaagca

SEQ ID NO: 659669 - RNA, 22 nt, Human
cacaauuuccaagucauguuau

SEQ ID NO: 659670 - RNA, 22 nt, Human
gaaacagucaacuuucuuuccc

SEQ ID NO: 659671 - RNA, 17 nt, Human
gggcuggauggccaugg

SEQ ID NO: 659672 - RNA, 22 nt, Human
ugugcugagugaucccauuccu

SEQ ID NO: 659673 - RNA, 18 nt, Human
uguguaugucucagggaa

SEQ ID NO: 659674 - RNA, 22 nt, Human
uugcauauauuucuaaggaggu

SEQ ID NO: 659675 - RNA, 22 nt, Human
guggucaggggcuguggcuaug

SEQ ID NO: 659676 - RNA, 18 nt, Human
acucaaggguggagagaa

SEQ ID NO: 659677 - RNA, 22 nt, Human
ugaguccuggcuuugggaugua

SEQ ID NO: 659678 - RNA, 22 nt, Human
cucugagcuccuggaagcgugc

SEQ ID NO: 659679 - RNA, 22 nt, Human
agaauaaacugcuuuagggcag

SEQ ID NO: 659680 - RNA, 23 nt, Human
ugagcagcuaaaggugaugcggg

SEQ ID NO: 659681 - RNA, 22 nt, Human
ccuccugggccuugcucuguga

SEQ ID NO: 659682 - RNA, 22 nt, Human
uugcauguuauuuaaucuguau

SEQ ID NO: 659683 - RNA, 22 nt, Human
gcagagugaagggagaggugug

SEQ ID NO: 659684 - RNA, 22 nt, Human
cccagcugcaccucuauggccu

SEQ ID NO: 659685 - RNA, 22 nt, Human
acuggccaggagcuggaaauac

SEQ ID NO: 659686 - RNA, 22 nt, Human
agugugugccuuuggauaccug

SEQ ID NO: 659687 - RNA, 19 nt, Human
ccucuccgcccaccagccc

SEQ ID NO: 659688 - RNA, 22 nt, Human
ugaggccaugcccgugccggcc

SEQ ID NO: 659689 - RNA, 21 nt, Human
uucuuucugaaucugaaguau

SEQ ID NO: 659690 - RNA, 22 nt, Human
uucaacaaugcacuugaguaua

SEQ ID NO: 659691 - RNA, 22 nt, Human
ccaggcaagagaggcucuggca

SEQ ID NO: 659692 - RNA, 22 nt, Human
uaaaugagggcugacaugauug

SEQ ID NO: 659693 - RNA, 22 nt, Human
uuuccuuugugcaggccuuggg

SEQ ID NO: 659694 - RNA, 22 nt, Human
uggagagcaagucgcagacaug

SEQ ID NO: 659695 - RNA, 22 nt, Human
aaggcugagagucacaguccua

SEQ ID NO: 659696 - RNA, 22 nt, Human
uaguguucuaagaacauccaug

SEQ ID NO: 659697 - RNA, 22 nt, Human
cugcuuucugcaccccaggucg

SEQ ID NO: 659698 - RNA, 22 nt, Human
aacauacagugagcaguggacu

SEQ ID NO: 659699 - RNA, 22 nt, Human
acacuaauuaagcugcuuuacu

SEQ ID NO: 659700 - RNA, 23 nt, Human
uucauuuaggaguucauaagagc

SEQ ID NO: 659701 - RNA, 22 nt, Human
ucagauauucaauuaaguuaaa

SEQ ID NO: 659702 - RNA, 22 nt, Human
cauauucuguuggucacauaga

SEQ ID NO: 659703 - RNA, 22 nt, Human
augugcuuggacauucuaggaa

SEQ ID NO: 659704 - RNA, 22 nt, Human
cugcugcaggaugggcacucug

SEQ ID NO: 659705 - RNA, 22 nt, Human
ggccugugggaggacagcuggg

SEQ ID NO: 659706 - RNA, 22 nt, Human
ugcagagacuugugugcauuug

SEQ ID NO: 659707 - RNA, 22 nt, Human
uaaaaggagguugaagcuguca

SEQ ID NO: 659708 - RNA, 22 nt, Human
uguauacauucucuuggguuug

SEQ ID NO: 659709 - RNA, 22 nt, Human
acaggcaccugccaccacaucu

SEQ ID NO: 659710 - RNA, 22 nt, Human
ucagaggcaucauucauaguua

SEQ ID NO: 659711 - RNA, 22 nt, Human
uuaauuaagagauacugcagua

SEQ ID NO: 659712 - RNA, 22 nt, Human
caccucugcuguccacaggaug

SEQ ID NO: 659713 - RNA, 22 nt, Human
ucuucagauggccaguuguccc

SEQ ID NO: 659714 - RNA, 22 nt, Human
aggcuguguuuccccuggagcu

SEQ ID NO: 659715 - RNA, 22 nt, Human
agauguggauccuaggguagaa

SEQ ID NO: 659716 - RNA, 22 nt, Human
agaggccaugcuagaggccugg

SEQ ID NO: 659717 - RNA, 22 nt, Human
ugagcaaggagcagucuuucuu

SEQ ID NO: 659718 - RNA, 22 nt, Human
aaaaguaauugcaauuuuguag

SEQ ID NO: 659719 - RNA, 22 nt, Human
auugaagaaacccaaauaaugg

SEQ ID NO: 659720 - RNA, 22 nt, Human
gcugagagugugagaucagauu

SEQ ID NO: 659721 - RNA, 22 nt, Human
gggcuggucuggcuuagucagg

SEQ ID NO: 659722 - RNA, 19 nt, Human
gcccugagagcuuggguuc

SEQ ID NO: 659723 - RNA, 22 nt, Human
aaacuacugauuugugaauuga

SEQ ID NO: 659724 - RNA, 22 nt, Human
ucaggaagacaaucuuuggcuc

SEQ ID NO: 659725 - RNA, 22 nt, Human
agucaggacacagcaugaacau

SEQ ID NO: 659726 - RNA, 22 nt, Human
uagcugccuaugugauaagaga

SEQ ID NO: 659727 - RNA, 22 nt, Human
cucccaggacucagaggagaag

SEQ ID NO: 659728 - RNA, 22 nt, Human
ggcacauguaugugggagugug

SEQ ID NO: 659729 - RNA, 20 nt, Human
ggggaagaaaaggaugugau

SEQ ID NO: 659730 - RNA, 22 nt, Human
aggacauguaaauggagaggga

SEQ ID NO: 659731 - RNA, 22 nt, Human
cugggagucuggaauuuuggua

SEQ ID NO: 659732 - RNA, 22 nt, Human
uagaggcagaagaaauugacaa

SEQ ID NO: 659733 - RNA, 22 nt, Human
gaaggcugaugacagauucugc

SEQ ID NO: 659734 - RNA, 22 nt, Human
auggcagagaaagcgagccaca

SEQ ID NO: 659735 - RNA, 19 nt, Human
cacuguuguccuaguacuu

SEQ ID NO: 659736 - RNA, 20 nt, Human
gcucugggagggaugugaug

SEQ ID NO: 659737 - RNA, 23 nt, Human
uagauacugcauauagguggaau

SEQ ID NO: 659738 - RNA, 22 nt, Human
gucuccuguccugcaggaugga

SEQ ID NO: 659739 - RNA, 22 nt, Human
aaggcacuuaacgugggaggau

SEQ ID NO: 659740 - RNA, 22 nt, Human
ccuguguggccgcacugcuccc

SEQ ID NO: 659741 - RNA, 22 nt, Human
gugcccagcuccaccucacaga

SEQ ID NO: 659742 - RNA, 17 nt, Human
ggcaggugcggggccgc

SEQ ID NO: 659743 - RNA, 22 nt, Human
cccuggaggaaaaucugaggcu

SEQ ID NO: 659744 - RNA, 23 nt, Human
uguaacuucuuaaauucuucacu

SEQ ID NO: 659745 - RNA, 22 nt, Human
cuguugcugagguucaaggguc

SEQ ID NO: 659746 - RNA, 22 nt, Human
aagagauuccucacucagaaug

SEQ ID NO: 659747 - RNA, 20 nt, Human
uuggcaguuaagaaucuuac

SEQ ID NO: 659748 - RNA, 22 nt, Human
ugcauuaaauauaaucuguuga

SEQ ID NO: 659749 - RNA, 22 nt, Human
aauagauggguuaaacagcaaa

SEQ ID NO: 659750 - RNA, 22 nt, Human
uucucauagagacaugauuaua

SEQ ID NO: 659751 - RNA, 22 nt, Human
aauguggggaagccauggcuga

SEQ ID NO: 659752 - RNA, 22 nt, Human
ccugggcuuugagggcaggaug

SEQ ID NO: 659753 - RNA, 22 nt, Human
augcauugaggaugacaugagu

SEQ ID NO: 659754 - RNA, 22 nt, Human
ugucacaaaaaucaguaauugc

SEQ ID NO: 659755 - RNA, 21 nt, Human
auggaaaaacagguagagcau

SEQ ID NO: 659756 - RNA, 22 nt, Human
ugcauuugucuugucucaugaa

SEQ ID NO: 659757 - RNA, 19 nt, Human
aaccaggaacuaaagcaga

SEQ ID NO: 659758 - RNA, 22 nt, Human
auagaugucauugucauccauc

SEQ ID NO: 659759 - RNA, 19 nt, Human
uccaugcccaggcaccaag

SEQ ID NO: 659760 - RNA, 22 nt, Human
guugacagcuggugagcugcua

SEQ ID NO: 659761 - RNA, 22 nt, Human
cugcugggauagaaguaucuca

SEQ ID NO: 659762 - RNA, 22 nt, Human
gguggagagcuggaugagaggu

SEQ ID NO: 659763 - RNA, 22 nt, Human
cacaaaguggguggaaaacuaa

SEQ ID NO: 659764 - RNA, 22 nt, Human
acauacacaugaauauauuuuu

SEQ ID NO: 659765 - RNA, 22 nt, Human
auuucaggagcaguuucagugg

SEQ ID NO: 659766 - RNA, 22 nt, Human
agugcauguccaguaguuuaug

SEQ ID NO: 659767 - RNA, 22 nt, Human
agcuucucccuuuccuauuggu

SEQ ID NO: 659768 - RNA, 22 nt, Human
agguggggccaaaugcuacagu

SEQ ID NO: 659769 - RNA, 22 nt, Human
cuacauacuguguguaaagaau

SEQ ID NO: 659770 - RNA, 22 nt, Human
uagauucuuaguuucauagaau

SEQ ID NO: 659771 - RNA, 22 nt, Human
agauauaguuguugagaagaac

SEQ ID NO: 659772 - RNA, 22 nt, Human
uacagguagggucuauguuaga

SEQ ID NO: 659773 - RNA, 22 nt, Human
acauuucuucccuuuagcagaa

SEQ ID NO: 659774 - RNA, 22 nt, Human
uacuuaaugccacugaauugua

SEQ ID NO: 659775 - RNA, 22 nt, Human
agauccaucaucauauuuucua

SEQ ID NO: 659776 - RNA, 22 nt, Human
ugcaauacauacuuagacccag

SEQ ID NO: 659777 - RNA, 22 nt, Human
ccugucaggguuugccucagaa

SEQ ID NO: 659778 - RNA, 22 nt, Human
aggcugugagaaguccuucagu

SEQ ID NO: 659779 - RNA, 22 nt, Human
cuacccagcaccuaggcugccu

SEQ ID NO: 659780 - RNA, 22 nt, Human
gagcugcagcggcugacgcaac

SEQ ID NO: 659781 - RNA, 22 nt, Human
uuucagaggugcuuggaaugcu

SEQ ID NO: 659782 - RNA, 22 nt, Human
agaguggccucagagaaauaca

SEQ ID NO: 659783 - RNA, 22 nt, Human
guaaaucauggucagaauaaau

SEQ ID NO: 659784 - RNA, 22 nt, Human
gagagaagaaagccaugguccu

SEQ ID NO: 659785 - RNA, 23 nt, Human
cucaacccuaguaagggaguagg

SEQ ID NO: 659786 - RNA, 22 nt, Human
auucaagguuggcucaggaauu

SEQ ID NO: 659787 - RNA, 22 nt, Human
guucucuggagucccugggccc

SEQ ID NO: 659788 - RNA, 22 nt, Human
uuucccucucaucucuauuauu

SEQ ID NO: 659789 - RNA, 22 nt, Human
acuucagccaagaaaacucagu

SEQ ID NO: 659790 - RNA, 22 nt, Human
cucuccagccaggggcuuccug

SEQ ID NO: 659791 - RNA, 21 nt, Human
uguaacaaguucccuagguga

SEQ ID NO: 659792 - RNA, 22 nt, Human
ccugaagcucuuaagaccuuua

SEQ ID NO: 659793 - RNA, 22 nt, Human
aagaaacuguugcgugacagcg

SEQ ID NO: 659794 - RNA, 22 nt, Human
gagugcaggccugagcaccauc

SEQ ID NO: 659795 - RNA, 22 nt, Human
cuauuagguaugcagccuauuu

SEQ ID NO: 659796 - RNA, 22 nt, Human
ggcucuggagcacagacgucug

SEQ ID NO: 659797 - RNA, 22 nt, Human
gggaaagagugcuuguccagag

SEQ ID NO: 659798 - RNA, 21 nt, Human
ucuccaguugacagugucucc

SEQ ID NO: 659799 - RNA, 22 nt, Human
gagggcagagucuaaugaugca

SEQ ID NO: 659800 - RNA, 20 nt, Human
auacaaagagauugauguau

SEQ ID NO: 659801 - RNA, 22 nt, Human
ugcauuaucgucuugauccucu

SEQ ID NO: 659802 - RNA, 22 nt, Human
uuugauacugagaaaaacaaau

SEQ ID NO: 659803 - RNA, 22 nt, Human
uacucaaacucacuaagacaga

SEQ ID NO: 659804 - RNA, 22 nt, Human
uguuagaaguuaaucacuaauu

SEQ ID NO: 659805 - RNA, 22 nt, Human
gggcacagucugcagcccccca

SEQ ID NO: 659806 - RNA, 22 nt, Human
auugugcuuugcaucuuguucc

SEQ ID NO: 659807 - RNA, 22 nt, Human
uagcauuuggacauugucaccu

SEQ ID NO: 659808 - RNA, 22 nt, Human
guccuuggcuucuuguugacug

SEQ ID NO: 659809 - RNA, 22 nt, Human
ucucagggugaggaaagaauuu

SEQ ID NO: 659810 - RNA, 22 nt, Human
agcugugugacucuaagcaagu

SEQ ID NO: 659811 - RNA, 22 nt, Human
agaggggcgggaacucaaccuc

SEQ ID NO: 659812 - RNA, 22 nt, Human
cucacaggagaaagucaugguc

SEQ ID NO: 659813 - RNA, 22 nt, Human
ucugucuuagcaucuuugcuca

SEQ ID NO: 659814 - RNA, 22 nt, Human
acagucugcuugucuccauggu

SEQ ID NO: 659815 - RNA, 22 nt, Human
ucaggagguugaccacggggca

SEQ ID NO: 659816 - RNA, 22 nt, Human
uucaguuuuauuguacugcuau

SEQ ID NO: 659817 - RNA, 22 nt, Human
agggcuuuugagcgcacgucug

SEQ ID NO: 659818 - RNA, 22 nt, Human
gaggagcaugggaaggcucugg

SEQ ID NO: 659819 - RNA, 22 nt, Human
uccucugcuguucugguucuuu

SEQ ID NO: 659820 - RNA, 22 nt, Human
auuauuugaguuccucucuacc

SEQ ID NO: 659821 - RNA, 22 nt, Human
gcuucagaaaugaacacugucu

SEQ ID NO: 659822 - RNA, 22 nt, Human
ccuucuucuguguggcccaaga

SEQ ID NO: 659823 - RNA, 22 nt, Human
uccaugaggcagggaggcuggc

SEQ ID NO: 659824 - RNA, 22 nt, Human
uaacagaauuugcuaaacuccg

SEQ ID NO: 659825 - RNA, 22 nt, Human
gcagcaggagaguaauagcggu

SEQ ID NO: 659826 - RNA, 22 nt, Human
aucugcuucgcgccaauuucau

SEQ ID NO: 659827 - RNA, 22 nt, Human
gagcaggacgugggaaugggaa

SEQ ID NO: 659828 - RNA, 22 nt, Human
gcuacaggugacagccucugca

SEQ ID NO: 659829 - RNA, 22 nt, Human
cagagagaggggcugccuggcc

SEQ ID NO: 659830 - RNA, 22 nt, Human
uacccuggagcaaguuuccuca

SEQ ID NO: 659831 - RNA, 22 nt, Human
acugagcaggguuccgcaugga

SEQ ID NO: 659832 - RNA, 22 nt, Human
uucccgucuuugcuaugccugc

SEQ ID NO: 659833 - RNA, 22 nt, Human
ucacugcagguuuuucaggagg

SEQ ID NO: 659834 - RNA, 22 nt, Human
ccuggggcucugcacagagcag

SEQ ID NO: 659835 - RNA, 22 nt, Human
gagacaggccaggugguacuua

SEQ ID NO: 659836 - RNA, 21 nt, Human
uacaugaagcugguguuuguc

SEQ ID NO: 659837 - RNA, 22 nt, Human
cagaaguggauauuagaguaau

SEQ ID NO: 659838 - RNA, 22 nt, Human
caaugcuuuuagcuucagcuug

SEQ ID NO: 659839 - RNA, 22 nt, Human
acuaaguaguuucacauauaau

SEQ ID NO: 659840 - RNA, 23 nt, Human
uuguccagcugguuugggccaca

SEQ ID NO: 659841 - RNA, 22 nt, Human
uugauuaaaaugagacaucauu

SEQ ID NO: 659842 - RNA, 22 nt, Human
gcauggcagaacaccucgcccg

SEQ ID NO: 659843 - RNA, 22 nt, Human
uugcuuuuuaauuaggaggcag

SEQ ID NO: 659844 - RNA, 22 nt, Human
agaacaauguuaaauuauuaag

SEQ ID NO: 659845 - RNA, 22 nt, Human
cagugauuuuaaacuauggaug

SEQ ID NO: 659846 - RNA, 22 nt, Human
gugagcagccucaccugagggu

SEQ ID NO: 659847 - RNA, 22 nt, Human
accagagggagacuuccucuuc

SEQ ID NO: 659848 - RNA, 22 nt, Human
ggggcagaguagcuggggugug

SEQ ID NO: 659849 - RNA, 22 nt, Human
aaucuucuacuugacaguucuc

SEQ ID NO: 659850 - RNA, 22 nt, Human
uucagacuucuugacuggcuuu

SEQ ID NO: 659851 - RNA, 22 nt, Human
uccucugguccugcagcagauc

SEQ ID NO: 659852 - RNA, 22 nt, Human
cccagugugccccuccugcagc

SEQ ID NO: 659853 - RNA, 22 nt, Human
acccagagcccuuagcacagac

SEQ ID NO: 659854 - RNA, 22 nt, Human
guuuuccauggaggucugaccu

SEQ ID NO: 659855 - RNA, 22 nt, Human
gggcuugcugauuugggcagga

SEQ ID NO: 659856 - RNA, 22 nt, Human
gccccuucucugaggaaccugc

SEQ ID NO: 659857 - RNA, 22 nt, Human
aguggcaggaucucgguucacu

SEQ ID NO: 659858 - RNA, 22 nt, Human
gauuauggagaaauaauuagaa

SEQ ID NO: 659859 - RNA, 22 nt, Human
gcagaggcacagccccagauga

SEQ ID NO: 659860 - RNA, 22 nt, Human
agccagagagccccagguucua

SEQ ID NO: 659861 - RNA, 22 nt, Human
uggcucauucuacucucccugg

SEQ ID NO: 659862 - RNA, 20 nt, Human
agugagauugcugcucuagc

SEQ ID NO: 659863 - RNA, 22 nt, Human
aggcuuccuggaggaagaggua

SEQ ID NO: 659864 - RNA, 22 nt, Human
acacaaaguuggaugacaaaau

SEQ ID NO: 659865 - RNA, 22 nt, Human
aggucuccuugugggucuugcc

SEQ ID NO: 659866 - RNA, 22 nt, Human
gacucugugggaggaggcucag

SEQ ID NO: 659867 - RNA, 22 nt, Human
cagagcuggccugugauuuuug

SEQ ID NO: 659868 - RNA, 22 nt, Human
uccaggagaggccugaccaggu

SEQ ID NO: 659869 - RNA, 22 nt, Human
ccucagcugcugcacagcuuuu

SEQ ID NO: 659870 - RNA, 22 nt, Human
cugacccuugcucgggcccugu

SEQ ID NO: 659871 - RNA, 19 nt, Human
uucugggcagcacaugaau

SEQ ID NO: 659872 - RNA, 22 nt, Human
auaugcauuuaccuggcauaua

SEQ ID NO: 659873 - RNA, 19 nt, Human
ccacacagugugcaauuua

SEQ ID NO: 659874 - RNA, 22 nt, Human
agagcugggacuuggacucaau

SEQ ID NO: 659875 - RNA, 22 nt, Human
caggauggucagaugcauuguc

SEQ ID NO: 659876 - RNA, 22 nt, Human
guccucagaagccugcuuagcu

SEQ ID NO: 659877 - RNA, 18 nt, Human
aggcaggauccuggccuc

SEQ ID NO: 659878 - RNA, 22 nt, Human
gggcuggcucugucuagaaagg

SEQ ID NO: 659879 - RNA, 22 nt, Human
cagacacugcagcagucuccca

SEQ ID NO: 659880 - RNA, 22 nt, Human
uuuguaaaauuagggaauucaa

SEQ ID NO: 659881 - RNA, 22 nt, Human
gcuggcugccaauuucagagcu

SEQ ID NO: 659882 - RNA, 22 nt, Human
uacaugaacaaaauagcagaaa

SEQ ID NO: 659883 - RNA, 17 nt, Human
uuccagcauguuacuaa

SEQ ID NO: 659884 - RNA, 22 nt, Human
aguagcauaaauagugguagua

SEQ ID NO: 659885 - RNA, 22 nt, Human
gacuuuauuacuaacccuguga

SEQ ID NO: 659886 - RNA, 22 nt, Human
uucuuaaguuuagcaacuugug

SEQ ID NO: 659887 - RNA, 22 nt, Human
cuccaggcuucaagggccggcc

SEQ ID NO: 659888 - RNA, 22 nt, Human
uggauuugcuaccuucugauau

SEQ ID NO: 659889 - RNA, 22 nt, Human
agcaggggucucugcuaaugaa

SEQ ID NO: 659890 - RNA, 22 nt, Human
cuggccuagcucucugcuugaa

SEQ ID NO: 659891 - RNA, 22 nt, Human
cuggcaugaaauggcaucucau

SEQ ID NO: 659892 - RNA, 22 nt, Human
uccaauaaccacaaucagauag

SEQ ID NO: 659893 - RNA, 22 nt, Human
cugcccuguagcuguucuagca

SEQ ID NO: 659894 - RNA, 22 nt, Human
gagauucucgagggcuuccagc

SEQ ID NO: 659895 - RNA, 22 nt, Human
cugggaaggggaagguccucuc

SEQ ID NO: 659896 - RNA, 22 nt, Human
gcaggcaguugcaguuuucuag

SEQ ID NO: 659897 - RNA, 22 nt, Human
ucugccuguugagccuaaggcc

SEQ ID NO: 659898 - RNA, 21 nt, Human
agagucugagugugcaagggc

SEQ ID NO: 659899 - RNA, 22 nt, Human
cacaucuucuuaacuccaaagu

SEQ ID NO: 659900 - RNA, 22 nt, Human
gcuuugaagucugugucuuuug

SEQ ID NO: 659901 - RNA, 22 nt, Human
cacccaggcuggagugcauugg

SEQ ID NO: 659902 - RNA, 22 nt, Human
cugcuuuggacaacuauucuug

SEQ ID NO: 659903 - RNA, 22 nt, Human
guuauucuacagucauugaagu

SEQ ID NO: 659904 - RNA, 22 nt, Human
ucacauugaagaaauuuuaagu

SEQ ID NO: 659905 - RNA, 22 nt, Human
ucacagaaguguguuucaggag

SEQ ID NO: 659906 - RNA, 22 nt, Human
gugcauuccaccgugcagguug

SEQ ID NO: 659907 - RNA, 22 nt, Human
aaguucaaguaguguuacaugg

SEQ ID NO: 659908 - RNA, 22 nt, Human
gcaaaugcucuccuuggucagg

SEQ ID NO: 659909 - RNA, 23 nt, Human
uaaauuucuugauucuuauguga

SEQ ID NO: 659910 - RNA, 22 nt, Human
uucuggaaguuggaaauagcag

SEQ ID NO: 659911 - RNA, 22 nt, Human
ucuagacaaugcacuguaagga

SEQ ID NO: 659912 - RNA, 21 nt, Human
ucucugggcccuccugugggg

SEQ ID NO: 659913 - RNA, 22 nt, Human
ucacuugaauucauucugcgaa

SEQ ID NO: 659914 - RNA, 22 nt, Human
cacagagcugaaccugggucau

SEQ ID NO: 659915 - RNA, 22 nt, Human
gcagccaggaagcccaggacac

SEQ ID NO: 659916 - RNA, 22 nt, Human
ucaggagggcuaagacuguagc

SEQ ID NO: 659917 - RNA, 23 nt, Human
gagauucuccuguugucaagucu

SEQ ID NO: 659918 - RNA, 23 nt, Human
aggcagagccaaggucaaaaccc

SEQ ID NO: 659919 - RNA, 22 nt, Human
caaugucagagaagcucauauc

SEQ ID NO: 659920 - RNA, 22 nt, Human
gagaaggaggcgaagcgugugc

SEQ ID NO: 659921 - RNA, 20 nt, Human
ugggauuguuuuuuagcuuc

SEQ ID NO: 659922 - RNA, 22 nt, Human
uccaguggagugugggggugaa

SEQ ID NO: 659923 - RNA, 17 nt, Human
acagggcagaaacagcu

SEQ ID NO: 659924 - RNA, 22 nt, Human
aaauccaucaaaucuucuagaa

SEQ ID NO: 659925 - RNA, 22 nt, Human
ggaacugauuaagucaugagaa

SEQ ID NO: 659926 - RNA, 22 nt, Human
cucccuggaggugagcuggcac

SEQ ID NO: 659927 - RNA, 22 nt, Human
agagcacacugacgucagucug

SEQ ID NO: 659928 - RNA, 22 nt, Human
uggcucagccagcccuaggaac

SEQ ID NO: 659929 - RNA, 21 nt, Human
ccuucuccauuacaguaagcu

SEQ ID NO: 659930 - RNA, 22 nt, Human
cacugaaaauuagcuuuccuga

SEQ ID NO: 659931 - RNA, 22 nt, Human
gucugcuggcacgucacagaua

SEQ ID NO: 659932 - RNA, 22 nt, Human
ccaccagcagugugcaaggauu

SEQ ID NO: 659933 - RNA, 22 nt, Human
gacaucugaggcccucagagcc

SEQ ID NO: 659934 - RNA, 22 nt, Human
uaacugaagcuggaagcgcugg

SEQ ID NO: 659935 - RNA, 22 nt, Human
auuuguuccacacauauuuacu

SEQ ID NO: 659936 - RNA, 22 nt, Human
gaugcacaugugaguauagaag

SEQ ID NO: 659937 - RNA, 22 nt, Human
guguuuauuuagaguaggccau

SEQ ID NO: 659938 - RNA, 22 nt, Human
auucagaauuuuggggagcuaa

SEQ ID NO: 659939 - RNA, 22 nt, Human
uacaguuaaaaaguucaauggu

SEQ ID NO: 659940 - RNA, 22 nt, Human
cccagcucuuuuagcggcaucu

SEQ ID NO: 659941 - RNA, 22 nt, Human
ugcugcagguguguucagugag

SEQ ID NO: 659942 - RNA, 22 nt, Human
ugaaagcaggcgggcuacuuua

SEQ ID NO: 659943 - RNA, 22 nt, Human
uucuggaaagauuugcguguaa

SEQ ID NO: 659944 - RNA, 22 nt, Human
aaaggcuuguuugaggacuggu

SEQ ID NO: 659945 - RNA, 22 nt, Human
cuggaaggcucugcugccuguc

SEQ ID NO: 659946 - RNA, 22 nt, Human
ugugggaagauguugcaggaga

SEQ ID NO: 659947 - RNA, 22 nt, Human
gaggaggaaacccuguuccucu

SEQ ID NO: 659948 - RNA, 22 nt, Human
uuugaaagcaccauuugaguag

SEQ ID NO: 659949 - RNA, 22 nt, Human
gggaugauaaugccagaguuaa

SEQ ID NO: 659950 - RNA, 22 nt, Human
acugaccagauaugucauaccu

SEQ ID NO: 659951 - RNA, 22 nt, Human
cgaggcucagagagggugacuu

SEQ ID NO: 659952 - RNA, 22 nt, Human
aagaggagaaaggcuggcuuug

SEQ ID NO: 659953 - RNA, 23 nt, Human
acaagauagggauaaaaagauaa

SEQ ID NO: 659954 - RNA, 22 nt, Human
uuuauguacauauccacaagga

SEQ ID NO: 659955 - RNA, 22 nt, Human
aagugguuugauucaguuuaug

SEQ ID NO: 659956 - RNA, 22 nt, Human
caaagacugcauaacacaugaa

SEQ ID NO: 659957 - RNA, 22 nt, Human
ucuccccaaccauggcacucac

SEQ ID NO: 659958 - RNA, 22 nt, Human
guacauuggcaacucucuuaga

SEQ ID NO: 659959 - RNA, 22 nt, Human
uggaaaaaacccagacucuaga

SEQ ID NO: 659960 - RNA, 22 nt, Human
agagccagguguagucucggag

SEQ ID NO: 659961 - RNA, 22 nt, Human
aggaagaggguggcagauaauc

SEQ ID NO: 659962 - RNA, 22 nt, Human
gcagcuggaagugacacucugu

SEQ ID NO: 659963 - RNA, 19 nt, Human
ccagcagcuuugauucucu

SEQ ID NO: 659964 - RNA, 22 nt, Human
uccugucugucuuuggucccuu

SEQ ID NO: 659965 - RNA, 22 nt, Human
cauuugcagagggugacacucu

SEQ ID NO: 659966 - RNA, 22 nt, Human
ucugcagcuuuuugguggggug

SEQ ID NO: 659967 - RNA, 22 nt, Human
agccaggugcaguggcacacac

SEQ ID NO: 659968 - RNA, 22 nt, Human
gccauggcccauaccaggugca

SEQ ID NO: 659969 - RNA, 22 nt, Human
cugcuuuauauugagcuugaaa

SEQ ID NO: 659970 - RNA, 22 nt, Human
ucucugcugagaagggcuggca

SEQ ID NO: 659971 - RNA, 22 nt, Human
uucagaaagguaaauggauuuc

SEQ ID NO: 659972 - RNA, 22 nt, Human
ggaggguuagcaaaggcacaga

SEQ ID NO: 659973 - RNA, 22 nt, Human
ugacagagcugggauuugaagc

SEQ ID NO: 659974 - RNA, 22 nt, Human
ugggcagagaguagaggcaacg

SEQ ID NO: 659975 - RNA, 22 nt, Human
gcuuccugaguacacccucauc

SEQ ID NO: 659976 - RNA, 22 nt, Human
aucuucuacuuugccaaucagg

SEQ ID NO: 659977 - RNA, 22 nt, Human
ggcuauauccucacaagaugga

SEQ ID NO: 659978 - RNA, 22 nt, Human
aaaaugaauaaguuaacccagg

SEQ ID NO: 659979 - RNA, 22 nt, Human
accuacugcuccacagugacua

SEQ ID NO: 659980 - RNA, 22 nt, Human
cuguguuuggacaacuuuucag

SEQ ID NO: 659981 - RNA, 22 nt, Human
ggccuaagugguuaaauggcuu

SEQ ID NO: 659982 - RNA, 22 nt, Human
acaaugcaccagcaucuucacc

SEQ ID NO: 659983 - RNA, 22 nt, Human
uaggccuucggugugugcuugg

SEQ ID NO: 659984 - RNA, 23 nt, Human
agagaaagggauaacacguugaa

SEQ ID NO: 659985 - RNA, 19 nt, Human
ccuggcugcugugggaugc

SEQ ID NO: 659986 - RNA, 21 nt, Human
gcagagccggggcgagaaggc

SEQ ID NO: 659987 - RNA, 22 nt, Human
uauggauguuuaucuacaggcu

SEQ ID NO: 659988 - RNA, 22 nt, Human
cagaaccugagagcacaauccu

SEQ ID NO: 659989 - RNA, 22 nt, Human
cagcuuggaggaggaucuaaga

SEQ ID NO: 659990 - RNA, 22 nt, Human
cacauuuacauauaaaacuuuc

SEQ ID NO: 659991 - RNA, 22 nt, Human
guagaauuuuaauaauggagau

SEQ ID NO: 659992 - RNA, 21 nt, Human
uggcugaguggaugcaugaau

SEQ ID NO: 659993 - RNA, 22 nt, Human
ugacaguuaagguauacauuca

SEQ ID NO: 659994 - RNA, 22 nt, Human
gcuguccaugucuggccucagu

SEQ ID NO: 659995 - RNA, 22 nt, Human
aguaccauuauccaguaaagga

SEQ ID NO: 659996 - RNA, 22 nt, Human
uucuguuacauggggcacagug

SEQ ID NO: 659997 - RNA, 22 nt, Human
uacaugucuggguuuuguuucc

SEQ ID NO: 659998 - RNA, 22 nt, Human
auguaugaugcuaggcucucag

SEQ ID NO: 659999 - RNA, 22 nt, Human
ucugaggaauaagaaggaagug

SEQ ID NO: 660000 - RNA, 22 nt, Human
gcuggcugcacaggggcucacu

SEQ ID NO: 660001 - RNA, 22 nt, Human
agagccugcagcugugaagaaa

SEQ ID NO: 660002 - RNA, 22 nt, Human
ccaguuuaagacuuaucucaau

SEQ ID NO: 660003 - RNA, 22 nt, Human
ucuuaagaaagugacaaauagg

SEQ ID NO: 660004 - RNA, 22 nt, Human
uggguaggaaucgaguguaugg

SEQ ID NO: 660005 - RNA, 22 nt, Human
aagggcuggucuagaaagggag

SEQ ID NO: 660006 - RNA, 22 nt, Human
uuagaguuuuaucauugccuua

SEQ ID NO: 660007 - RNA, 22 nt, Human
gcuggguuuucuuccgggccua

SEQ ID NO: 660008 - RNA, 22 nt, Human
ucugggcagagggucuuaguca

SEQ ID NO: 660009 - RNA, 22 nt, Human
ucuggcuucuaugaauguccuu

SEQ ID NO: 660010 - RNA, 22 nt, Human
acuuaacagacauuauuuaccu

SEQ ID NO: 660011 - RNA, 22 nt, Human
ucuggccacuaauaggucucac

SEQ ID NO: 660012 - RNA, 23 nt, Human
cuucucagaagucugugccagga

SEQ ID NO: 660013 - RNA, 22 nt, Human
augcucucuguccugcucagag

SEQ ID NO: 660014 - RNA, 22 nt, Human
cauaucuuaugguuuucuaagu

SEQ ID NO: 660015 - RNA, 22 nt, Human
uuuacaguuaagaaauguuacc

SEQ ID NO: 660016 - RNA, 22 nt, Human
auucacaaaugcugccccauuc

SEQ ID NO: 660017 - RNA, 21 nt, Human
ccucaaagaugaugggguuuc

SEQ ID NO: 660018 - RNA, 22 nt, Human
gcuggguccuaugcugguagag

SEQ ID NO: 660019 - RNA, 22 nt, Human
acugccugaugugguucuaaau

SEQ ID NO: 660020 - RNA, 22 nt, Human
uggagcugggauuugaacugca

SEQ ID NO: 660021 - RNA, 20 nt, Human
ugcauuuguuauuuguacuc

SEQ ID NO: 660022 - RNA, 22 nt, Human
caaggcagaauucagacucagg

SEQ ID NO: 660023 - RNA, 22 nt, Human
ugaagcaguucucagaaguggg

SEQ ID NO: 660024 - RNA, 22 nt, Human
ggguggcaggauuggcaggagu

SEQ ID NO: 660025 - RNA, 22 nt, Human
uguucccauuuucugcauaauc

SEQ ID NO: 660026 - RNA, 22 nt, Human
gcugccacauuuucaggacuaa

SEQ ID NO: 660027 - RNA, 22 nt, Human
guuuaaaguagcuuccuuuugg

SEQ ID NO: 660028 - RNA, 22 nt, Human
aucagaaaguucaucauguuug

SEQ ID NO: 660029 - RNA, 22 nt, Human
auggccuuggcugcagagacau

SEQ ID NO: 660030 - RNA, 22 nt, Human
uuuuuucagccugucugugcca

SEQ ID NO: 660031 - RNA, 22 nt, Human
acagaguuuauguguguacaaa

SEQ ID NO: 660032 - RNA, 21 nt, Human
uaggcagaggagcagguaucu

SEQ ID NO: 660033 - RNA, 18 nt, Human
agcaaagcaagagaucac

SEQ ID NO: 660034 - RNA, 22 nt, Human
uucuuucugucaugguguacug

SEQ ID NO: 660035 - RNA, 23 nt, Human
ucuggcucuaugugacagcucuc

SEQ ID NO: 660036 - RNA, 22 nt, Human
acaugaaauucuagcugaaccc

SEQ ID NO: 660037 - RNA, 22 nt, Human
gaccuccagcggcccugcagag

SEQ ID NO: 660038 - RNA, 20 nt, Human
ggcaccaggcuaggauugga

SEQ ID NO: 660039 - RNA, 22 nt, Human
ugcuuucaaugaauuguauacu

SEQ ID NO: 660040 - RNA, 22 nt, Human
uuugaacugauaaucuucuguu

SEQ ID NO: 660041 - RNA, 22 nt, Human
ucuggcuugucucagggucuga

SEQ ID NO: 660042 - RNA, 22 nt, Human
ucucuuugucugcucuuaguug

SEQ ID NO: 660043 - RNA, 22 nt, Human
uccugggacccugggugcagag

SEQ ID NO: 660044 - RNA, 22 nt, Human
agcuuguuguuacugaugcauu

SEQ ID NO: 660045 - RNA, 22 nt, Human
uuccagucuggccugugcuuag

SEQ ID NO: 660046 - RNA, 22 nt, Human
augcugugagugugccgcagag

SEQ ID NO: 660047 - RNA, 22 nt, Human
gaaaccagcuagaggcagaggg

SEQ ID NO: 660048 - RNA, 22 nt, Human
guaggaaaguaaaugaaauaca

SEQ ID NO: 660049 - RNA, 22 nt, Human
agucucuggggaggaguggaaa

SEQ ID NO: 660050 - RNA, 22 nt, Human
ugucaccucuuuggcugcagcu

SEQ ID NO: 660051 - RNA, 22 nt, Human
cucugcaugccuugcucagaca

SEQ ID NO: 660052 - RNA, 22 nt, Human
ccagagaaaagaggccaaggau

SEQ ID NO: 660053 - RNA, 22 nt, Human
uagauauaucugucauacuggu

SEQ ID NO: 660054 - RNA, 22 nt, Human
aauucaguuggcaaacaugcug

SEQ ID NO: 660055 - RNA, 23 nt, Human
ucuaaaauucaucauuuacguuc

SEQ ID NO: 660056 - RNA, 22 nt, Human
uucacagugugaucuaugggca

SEQ ID NO: 660057 - RNA, 22 nt, Human
uuugcauaaaggagcauuucuc

SEQ ID NO: 660058 - RNA, 22 nt, Human
ucaaugcacacaggacuuggug

SEQ ID NO: 660059 - RNA, 18 nt, Human
gaagggagcuggaaugca

SEQ ID NO: 660060 - RNA, 22 nt, Human
gcagagccaugggagguuuuug

SEQ ID NO: 660061 - RNA, 23 nt, Human
uugaagucucaguuuucucauag

SEQ ID NO: 660062 - RNA, 22 nt, Human
gagggaugguaguugacacuga

SEQ ID NO: 660063 - RNA, 22 nt, Human
ugucuguuauugguguauaaga

SEQ ID NO: 660064 - RNA, 22 nt, Human
uggaggcaucagagugcuuggc

SEQ ID NO: 660065 - RNA, 22 nt, Human
agcucccagcuccuuugagaga

SEQ ID NO: 660066 - RNA, 22 nt, Human
ggugagugccuggccuggccac

SEQ ID NO: 660067 - RNA, 22 nt, Human
ucagggcauucaagaggccugg

SEQ ID NO: 660068 - RNA, 20 nt, Human
gcagugcuggugccucugcu

SEQ ID NO: 660069 - RNA, 22 nt, Human
uauguuuaaauguauguguaug

SEQ ID NO: 660070 - RNA, 21 nt, Human
acaguauauuagauauuugaa

SEQ ID NO: 660071 - RNA, 22 nt, Human
uugcaaaugaccauugccacau

SEQ ID NO: 660072 - RNA, 22 nt, Human
guauuuuucaguuaggagcuua

SEQ ID NO: 660073 - RNA, 22 nt, Human
cugcuuuagacaacugcuggga

SEQ ID NO: 660074 - RNA, 22 nt, Human
cagggaagaauaguuagcaaag

SEQ ID NO: 660075 - RNA, 22 nt, Human
cacagacuccccgccauagugg

SEQ ID NO: 660076 - RNA, 22 nt, Human
auuuauuaccucggaguuucug

SEQ ID NO: 660077 - RNA, 22 nt, Human
cacccuagcugucauuucaguu

SEQ ID NO: 660078 - RNA, 22 nt, Human
ccagugugaaaggucauuuauc

SEQ ID NO: 660079 - RNA, 22 nt, Human
guggccagaggauuuguucagu

SEQ ID NO: 660080 - RNA, 20 nt, Human
ggcaggacccgguagggagc

SEQ ID NO: 660081 - RNA, 22 nt, Human
accaagcucucuucccggcucu

SEQ ID NO: 660082 - RNA, 22 nt, Human
uucuggaagcugcagguggccg

SEQ ID NO: 660083 - RNA, 22 nt, Human
uuggcaggaggcuucaguuccu

SEQ ID NO: 660084 - RNA, 22 nt, Human
ugaggccuggagggaggaguuu

SEQ ID NO: 660085 - RNA, 22 nt, Human
aggcucucagaucagccacauu

SEQ ID NO: 660086 - RNA, 22 nt, Human
aguuggcauuccugcauccuau

SEQ ID NO: 660087 - RNA, 22 nt, Human
aaggugucacugggacaggaaa

SEQ ID NO: 660088 - RNA, 22 nt, Human
ucuauuacuuaccacuaauuca

SEQ ID NO: 660089 - RNA, 22 nt, Human
augcugcacaagccacauguag

SEQ ID NO: 660090 - RNA, 22 nt, Human
cuucaggaaaaucucuaaggau

SEQ ID NO: 660091 - RNA, 22 nt, Human
uuacaacaccaggcaguauccu

SEQ ID NO: 660092 - RNA, 22 nt, Human
cugaggccuguguuggggcagu

SEQ ID NO: 660093 - RNA, 22 nt, Human
agccuggccaggccugcccagg

SEQ ID NO: 660094 - RNA, 22 nt, Human
auuuggaaggcguuucucugua

SEQ ID NO: 660095 - RNA, 22 nt, Human
cuguauaaccccaugcgacugu

SEQ ID NO: 660096 - RNA, 22 nt, Human
cuguuuaaugagguguaacaac

SEQ ID NO: 660097 - RNA, 22 nt, Human
cacaggagcccugaggccuccc

SEQ ID NO: 660098 - RNA, 22 nt, Human
uuuggguucagacaugauuaca

SEQ ID NO: 660099 - RNA, 22 nt, Human
uauggcaauauguaucaagauc

SEQ ID NO: 660100 - RNA, 22 nt, Human
acacaccaugauuuauuuaccc

SEQ ID NO: 660101 - RNA, 22 nt, Human
agcaauguaaacccugaaguug

SEQ ID NO: 660102 - RNA, 20 nt, Human
agaagcugagacuggguuuu

SEQ ID NO: 660103 - RNA, 22 nt, Human
gugacaaaaacacugauuauuu

SEQ ID NO: 660104 - RNA, 22 nt, Human
ggagguggcagagggacauucu

SEQ ID NO: 660105 - RNA, 22 nt, Human
aucuguggcgcaaacaaaggcu

SEQ ID NO: 660106 - RNA, 22 nt, Human
agguuccucuuccucuggccug

SEQ ID NO: 660107 - RNA, 22 nt, Human
aaaugauugucaaaguucuguu

SEQ ID NO: 660108 - RNA, 22 nt, Human
gagcuuccugaugccgaccagu

SEQ ID NO: 660109 - RNA, 20 nt, Human
uguauuuaaugaaggcuuuu

SEQ ID NO: 660110 - RNA, 22 nt, Human
ggcuccugggagauagagguca

SEQ ID NO: 660111 - RNA, 22 nt, Human
gggcugagucaucuggggccuc

SEQ ID NO: 660112 - RNA, 22 nt, Human
agcagaaaauuggaaaugacaa

SEQ ID NO: 660113 - RNA, 22 nt, Human
auucaguuccuugaggguauag

SEQ ID NO: 660114 - RNA, 22 nt, Human
guaugcuuauuccuuguuguga

SEQ ID NO: 660115 - RNA, 22 nt, Human
acugucaugacguuugucaccc

SEQ ID NO: 660116 - RNA, 22 nt, Human
gaggcuucuguaacccuguccu

SEQ ID NO: 660117 - RNA, 22 nt, Human
aaagcagaggugauaugacuua

SEQ ID NO: 660118 - RNA, 22 nt, Human
ccaggucuucacuuuacugaag

SEQ ID NO: 660119 - RNA, 22 nt, Human
agagacaggaauggcauuaaga

SEQ ID NO: 660120 - RNA, 22 nt, Human
ugagaguuuugacgcuuguaac

SEQ ID NO: 660121 - RNA, 22 nt, Human
guuauauugccaaguauauugu

SEQ ID NO: 660122 - RNA, 22 nt, Human
guuuguuuguagggaagccgug

SEQ ID NO: 660123 - RNA, 22 nt, Human
aaucuuacuuaugauuuuucgg

SEQ ID NO: 660124 - RNA, 22 nt, Human
cccuccagggagccaugcuggg

SEQ ID NO: 660125 - RNA, 22 nt, Human
guuucagauauauuuguacuua

SEQ ID NO: 660126 - RNA, 19 nt, Human
ggcccaaguacugagugcc

SEQ ID NO: 660127 - RNA, 22 nt, Human
uaauugcuuuauccuguuagaa

SEQ ID NO: 660128 - RNA, 22 nt, Human
ucagaccauccugcuguuagug

SEQ ID NO: 660129 - RNA, 22 nt, Human
ucagaagaaagauguuauuacu

SEQ ID NO: 660130 - RNA, 22 nt, Human
cauggccagggcagauggcagg

SEQ ID NO: 660131 - RNA, 19 nt, Human
caucucugcaaggagcugc

SEQ ID NO: 660132 - RNA, 22 nt, Human
gauauagguucauaguguuaca

SEQ ID NO: 660133 - RNA, 22 nt, Human
cuucugugaccaccagcagccc

SEQ ID NO: 660134 - RNA, 22 nt, Human
uauaaagaaaugauuuccagaa

SEQ ID NO: 660135 - RNA, 22 nt, Human
uucaaagcagagggucaauaca

SEQ ID NO: 660136 - RNA, 22 nt, Human
ugacagaccacugcaacucugu

SEQ ID NO: 660137 - RNA, 22 nt, Human
agugacagauuaccggcagagc

SEQ ID NO: 660138 - RNA, 17 nt, Human
accaggcaacacgccca

SEQ ID NO: 660139 - RNA, 22 nt, Human
aaaaauagcuucucuugucccu

SEQ ID NO: 660140 - RNA, 22 nt, Human
ugugcgcgugcagcggaguguu

SEQ ID NO: 660141 - RNA, 22 nt, Human
caagcucugggauagcagagag

SEQ ID NO: 660142 - RNA, 20 nt, Human
uguggaugagguaaggauag

SEQ ID NO: 660143 - RNA, 22 nt, Human
uuaaacagagucugaaauguaa

SEQ ID NO: 660144 - RNA, 22 nt, Human
cugcuuuaacucugggaagcca

SEQ ID NO: 660145 - RNA, 22 nt, Human
gauugagucugaggaugcugca

SEQ ID NO: 660146 - RNA, 22 nt, Human
ccugagcucaagaaggugacca

SEQ ID NO: 660147 - RNA, 23 nt, Human
ugcucccaggugacgcugcuguu

SEQ ID NO: 660148 - RNA, 22 nt, Human
gagcugaguuaccuccagauca

SEQ ID NO: 660149 - RNA, 22 nt, Human
gagagagagcuaauauuaagcu

SEQ ID NO: 660150 - RNA, 22 nt, Human
ggcuuuauuauguggccaugug

SEQ ID NO: 660151 - RNA, 22 nt, Human
uccaggaggugaggggaccaaa

SEQ ID NO: 660152 - RNA, 22 nt, Human
aggcacugauucucagaguuac

SEQ ID NO: 660153 - RNA, 22 nt, Human
ggccuugggcgagucccucagu

SEQ ID NO: 660154 - RNA, 22 nt, Human
uguguucuggaaagcucacuga

SEQ ID NO: 660155 - RNA, 21 nt, Human
uucaaaaugguguguuugucu

SEQ ID NO: 660156 - RNA, 22 nt, Human
ucagcuuuccuugcuuuagauu

SEQ ID NO: 660157 - RNA, 22 nt, Human
aaagcagugcaccuuaauugau

SEQ ID NO: 660158 - RNA, 22 nt, Human
ccuuggagaagacagugccagg

SEQ ID NO: 660159 - RNA, 20 nt, Human
acaguuuauuuuacuugguu

SEQ ID NO: 660160 - RNA, 22 nt, Human
gccuucaguaacugagacggaa

SEQ ID NO: 660161 - RNA, 23 nt, Human
gcaugcaacuugcaguaguauuc

SEQ ID NO: 660162 - RNA, 22 nt, Human
agcagcacgaguccacaaaucc

SEQ ID NO: 660163 - RNA, 22 nt, Human
uagagagccaguugucauaguu

SEQ ID NO: 660164 - RNA, 22 nt, Human
uauuauuauauuggaugagacu

SEQ ID NO: 660165 - RNA, 21 nt, Human
agagcugguagguagguaggu

SEQ ID NO: 660166 - RNA, 22 nt, Human
uguguccuucugggagucccag

SEQ ID NO: 660167 - RNA, 22 nt, Human
ggguggcuccuaugggcauagc

SEQ ID NO: 660168 - RNA, 22 nt, Human
uccuuuuuaagucguuguggua

SEQ ID NO: 660169 - RNA, 22 nt, Human
uuuuuagccaagccauaggucu

SEQ ID NO: 660170 - RNA, 22 nt, Human
gcagaggugaccagcagcaggg

SEQ ID NO: 660171 - RNA, 22 nt, Human
uagcagcuuaaguaauuagaau

SEQ ID NO: 660172 - RNA, 20 nt, Human
gccuguccugagugucaugg

SEQ ID NO: 660173 - RNA, 22 nt, Human
aucuacaggauaguuuaauauu

SEQ ID NO: 660174 - RNA, 22 nt, Human
auuuaugacaaccaaagaguga

SEQ ID NO: 660175 - RNA, 22 nt, Human
caggccugauacacugaacucu

SEQ ID NO: 660176 - RNA, 23 nt, Human
agggcaugaagcagaggacgugg

SEQ ID NO: 660177 - RNA, 22 nt, Human
acagaaauaacuuuuuauguuu

SEQ ID NO: 660178 - RNA, 22 nt, Human
aacuccagacuacuaauuuagu

SEQ ID NO: 660179 - RNA, 22 nt, Human
gaaauguuuuacaaggcauacu

SEQ ID NO: 660180 - RNA, 22 nt, Human
uacaccugcugagccuguccuc

SEQ ID NO: 660181 - RNA, 22 nt, Human
ugcugugauaauucaaugagcu

SEQ ID NO: 660182 - RNA, 22 nt, Human
uuuccuugggucucuuaguggc

SEQ ID NO: 660183 - RNA, 22 nt, Human
uuuuccugccugucucuagagg

SEQ ID NO: 660184 - RNA, 22 nt, Human
ggacagggcucuuggcacuccu

SEQ ID NO: 660185 - RNA, 16 nt, Human
uccuggccccuaugga

SEQ ID NO: 660186 - RNA, 22 nt, Human
aacaggacacugggauggcuac

SEQ ID NO: 660187 - RNA, 20 nt, Human
cccaggagugagcagcuuua

SEQ ID NO: 660188 - RNA, 22 nt, Human
gucaaaacaaaguuaagaauuc

SEQ ID NO: 660189 - RNA, 22 nt, Human
gcuggugagcaaaggagaagga

SEQ ID NO: 660190 - RNA, 22 nt, Human
cuuaaaggagguuuuguuucca

SEQ ID NO: 660191 - RNA, 22 nt, Human
aaggucucaaguuuuccaaagu

SEQ ID NO: 660192 - RNA, 22 nt, Human
ucugggcucacgagucuggaca

SEQ ID NO: 660193 - RNA, 23 nt, Human
agcagccagagauccucggcccu

SEQ ID NO: 660194 - RNA, 22 nt, Human
aagaaagggcuauuguucucca

SEQ ID NO: 660195 - RNA, 22 nt, Human
ccuccagacuuuggccauccuc

SEQ ID NO: 660196 - RNA, 22 nt, Human
cuucuugugcugggccagcuuc

SEQ ID NO: 660197 - RNA, 22 nt, Human
ugguggcuucugaggauggcga

SEQ ID NO: 660198 - RNA, 19 nt, Human
ugcucuggagccagcucuc

SEQ ID NO: 660199 - RNA, 22 nt, Human
uuuaagcacagggauaaaguua

SEQ ID NO: 660200 - RNA, 22 nt, Human
ugcuggaggauuaaacaaguca

SEQ ID NO: 660201 - RNA, 22 nt, Human
auuguuaauguugcacuaaggu

SEQ ID NO: 660202 - RNA, 20 nt, Human
aaguuuucuccaaauacagu

SEQ ID NO: 660203 - RNA, 22 nt, Human
uaggaaggaagagccucagauu

SEQ ID NO: 660204 - RNA, 22 nt, Human
gagcuccacuuagcaaggccac

SEQ ID NO: 660205 - RNA, 22 nt, Human
auuacaauaagguuuauuugua

SEQ ID NO: 660206 - RNA, 22 nt, Human
uacagaagcugagacacugaga

SEQ ID NO: 660207 - RNA, 22 nt, Human
agagggcaugcuugguggccug

SEQ ID NO: 660208 - RNA, 22 nt, Human
ugagcaggagauaaacagguag

SEQ ID NO: 660209 - RNA, 17 nt, Human
gcacugagccacaguuu

SEQ ID NO: 660210 - RNA, 22 nt, Human
uacuagcuaacauucucaccaa

SEQ ID NO: 660211 - RNA, 22 nt, Human
cuggaggaaucacagaaggcuu

SEQ ID NO: 660212 - RNA, 22 nt, Human
caugcaaacacguaaacauuca

SEQ ID NO: 660213 - RNA, 22 nt, Human
cagugaacuugaguacuucauu

SEQ ID NO: 660214 - RNA, 22 nt, Human
uagacauuuggaguuuuaugac

SEQ ID NO: 660215 - RNA, 22 nt, Human
agaaauucuaagcaucaauagc

SEQ ID NO: 660216 - RNA, 22 nt, Human
aggaacuggugggaggugauug

SEQ ID NO: 660217 - RNA, 22 nt, Human
gagugaggcuggaaucauggcu

SEQ ID NO: 660218 - RNA, 22 nt, Human
ggucacauucugagguauuagg

SEQ ID NO: 660219 - RNA, 22 nt, Human
gaaucaauuauccaggcuguug

SEQ ID NO: 660220 - RNA, 22 nt, Human
uuccuauuuccaugaaacacaa

SEQ ID NO: 660221 - RNA, 20 nt, Human
cagggccacgcuccaaggca

SEQ ID NO: 660222 - RNA, 22 nt, Human
uaaggcaggcuuucauccagag

SEQ ID NO: 660223 - RNA, 22 nt, Human
ggccucaguuucuucaacugua

SEQ ID NO: 660224 - RNA, 22 nt, Human
aaggccagagcguguccugccu

SEQ ID NO: 660225 - RNA, 21 nt, Human
gccaccucgucucggagcagc

SEQ ID NO: 660226 - RNA, 22 nt, Human
cucugugggccagagaggcccc

SEQ ID NO: 660227 - RNA, 22 nt, Human
agcugcagcacuccaguagccg

SEQ ID NO: 660228 - RNA, 22 nt, Human
uugcaucuaccauaucaaagau

SEQ ID NO: 660229 - RNA, 22 nt, Human
aggcuggauuuauggggacuuc

SEQ ID NO: 660230 - RNA, 22 nt, Human
uggcaugggccagggagagcug

SEQ ID NO: 660231 - RNA, 22 nt, Human
ugcggguugguggcauaugcag

SEQ ID NO: 660232 - RNA, 22 nt, Human
cuguagcuccagccugucuaca

SEQ ID NO: 660233 - RNA, 22 nt, Human
auucugaugccuggguacugcc

SEQ ID NO: 660234 - RNA, 22 nt, Human
gagccccagcccugcuucuaua

SEQ ID NO: 660235 - RNA, 21 nt, Human
acaguuuuaaggagcacaugg

SEQ ID NO: 660236 - RNA, 22 nt, Human
aguuguauuagagaacacaaac

SEQ ID NO: 660237 - RNA, 22 nt, Human
ugucucuggcugcagccuguuc

SEQ ID NO: 660238 - RNA, 22 nt, Human
aucuggcuuggguguggguagc

SEQ ID NO: 660239 - RNA, 22 nt, Human
uagcaucugaacuguugaaaag

SEQ ID NO: 660240 - RNA, 22 nt, Human
uagacauacagugcaguacaua

SEQ ID NO: 660241 - RNA, 22 nt, Human
gggcugcuuuuuucuuagcaga

SEQ ID NO: 660242 - RNA, 23 nt, Human
ucugauguucucuuaugcuguag

SEQ ID NO: 660243 - RNA, 22 nt, Human
ugagggcaaaguggugcugagg

SEQ ID NO: 660244 - RNA, 22 nt, Human
aaaucaguuagugguaggauug

SEQ ID NO: 660245 - RNA, 21 nt, Human
cuuuucuguguuccucccugu

SEQ ID NO: 660246 - RNA, 22 nt, Human
caguauuucauucagaauuguu

SEQ ID NO: 660247 - RNA, 21 nt, Human
ccuccaggugauuccgugcuc

SEQ ID NO: 660248 - RNA, 22 nt, Human
ccagggccaguaagauuggcau

SEQ ID NO: 660249 - RNA, 22 nt, Human
cagucacuccagccugccucag

SEQ ID NO: 660250 - RNA, 22 nt, Human
agaggcuccuagccacuggcuu

SEQ ID NO: 660251 - RNA, 22 nt, Human
uucucuggggacugucucuauu

SEQ ID NO: 660252 - RNA, 22 nt, Human
uaaucuguuucccaaggugaua

SEQ ID NO: 660253 - RNA, 22 nt, Human
gcagcuuucugcaaugucaucc

SEQ ID NO: 660254 - RNA, 22 nt, Human
gagcaugagggaaggcagcaga

SEQ ID NO: 660255 - RNA, 22 nt, Human
ucuaguucuagaucccugagga

SEQ ID NO: 660256 - RNA, 22 nt, Human
gcgcagaguagcagagugcuga

SEQ ID NO: 660257 - RNA, 20 nt, Human
agggccugcucugugguguc

SEQ ID NO: 660258 - RNA, 22 nt, Human
ccauaaggagccagacauucca

SEQ ID NO: 660259 - RNA, 22 nt, Human
agggaagcugcuggguccaccu

SEQ ID NO: 660260 - RNA, 22 nt, Human
cagcucuggcuauugaggacca

SEQ ID NO: 660261 - RNA, 22 nt, Human
ggcuggcuccaccuagguagcu

SEQ ID NO: 660262 - RNA, 20 nt, Human
gggagacagggccagugucc

SEQ ID NO: 660263 - RNA, 22 nt, Human
uaaauaugcauguauccuuauc

SEQ ID NO: 660264 - RNA, 22 nt, Human
ucuuaauugagaacaguguagg

SEQ ID NO: 660265 - RNA, 21 nt, Human
ugucucaaucagaagucauua

SEQ ID NO: 660266 - RNA, 22 nt, Human
cggccaagccggggccccgaag

SEQ ID NO: 660267 - RNA, 20 nt, Human
uaaauuagccuugaagauua

SEQ ID NO: 660268 - RNA, 22 nt, Human
uccugggagagugggacuguau

SEQ ID NO: 660269 - RNA, 22 nt, Human
acuucuugaugaaaaugguacu

SEQ ID NO: 660270 - RNA, 22 nt, Human
ccugcagguugcagaggcggaa

SEQ ID NO: 660271 - RNA, 22 nt, Human
cuugccucugcuaaugguuucu

SEQ ID NO: 660272 - RNA, 17 nt, Human
aggcuccuccuaagguc

SEQ ID NO: 660273 - RNA, 22 nt, Human
gagagcccuacaaggcguuuug

SEQ ID NO: 660274 - RNA, 22 nt, Human
acacagggcaaugcuuugaccu

SEQ ID NO: 660275 - RNA, 22 nt, Human
ucacuggggccuuuggucagga

SEQ ID NO: 660276 - RNA, 22 nt, Human
uggccucucuaccaggcagccu

SEQ ID NO: 660277 - RNA, 22 nt, Human
aggcaggauugcugacaacaau

SEQ ID NO: 660278 - RNA, 22 nt, Human
gugcauuucucauacacuaaau

SEQ ID NO: 660279 - RNA, 19 nt, Human
aagcuuucccauuaacccc

SEQ ID NO: 660280 - RNA, 23 nt, Human
cugcauugucuccugggagcaug

SEQ ID NO: 660281 - RNA, 22 nt, Human
ucuuuagccaguaucauaauga

SEQ ID NO: 660282 - RNA, 22 nt, Human
uuaacauacaucaugaacaaug

SEQ ID NO: 660283 - RNA, 22 nt, Human
agggagcuaggauccugaaggu

SEQ ID NO: 660284 - RNA, 22 nt, Human
uauauacuaugcgauuccugcc

SEQ ID NO: 660285 - RNA, 22 nt, Human
uagagcagaacuuguuaacacc

SEQ ID NO: 660286 - RNA, 22 nt, Human
ccaggcaucacgggcauguggc

SEQ ID NO: 660287 - RNA, 22 nt, Human
uuugaaaggugucgagaugugu

SEQ ID NO: 660288 - RNA, 22 nt, Human
ggcuuccagugaugccucuuug

SEQ ID NO: 660289 - RNA, 22 nt, Human
agcugcuugggaaccaucaauu

SEQ ID NO: 660290 - RNA, 22 nt, Human
ccugcaggcugcaggccaguuc

SEQ ID NO: 660291 - RNA, 22 nt, Human
cccuaggcugaggccagggugc

SEQ ID NO: 660292 - RNA, 22 nt, Human
uccaggagguuuggaggaagca

SEQ ID NO: 660293 - RNA, 22 nt, Human
caggagucuguuccucauuugu

SEQ ID NO: 660294 - RNA, 22 nt, Human
ccugggagguggagguugcagc

SEQ ID NO: 660295 - RNA, 22 nt, Human
uccagccucauuucuccugcuu

SEQ ID NO: 660296 - RNA, 22 nt, Human
cugaggcaucauggagaacagu

SEQ ID NO: 660297 - RNA, 22 nt, Human
ugagcacacuccuggugagcga

SEQ ID NO: 660298 - RNA, 22 nt, Human
gcauuucauguagauugagaac

SEQ ID NO: 660299 - RNA, 20 nt, Human
auacaguaggugcucaauau

SEQ ID NO: 660300 - RNA, 22 nt, Human
aucuacaggcugaggugggagg

SEQ ID NO: 660301 - RNA, 22 nt, Human
gucugucaucugagauggagug

SEQ ID NO: 660302 - RNA, 23 nt, Human
cagggcugggcuugguguuaggc

SEQ ID NO: 660303 - RNA, 22 nt, Human
aggcuuuccugucacucaugcu

SEQ ID NO: 660304 - RNA, 22 nt, Human
uuacagcuuacauuuuaccuug

SEQ ID NO: 660305 - RNA, 22 nt, Human
ugucccauggauaccaggcuau

SEQ ID NO: 660306 - RNA, 22 nt, Human
guccuucaaaggcacgcaguua

SEQ ID NO: 660307 - RNA, 22 nt, Human
agacaaggcaaggcggccagau

SEQ ID NO: 660308 - RNA, 22 nt, Human
agggaauggaugauggcagguu

SEQ ID NO: 660309 - RNA, 22 nt, Human
cugucugugaccucugcauguc

SEQ ID NO: 660310 - RNA, 22 nt, Human
aaauaggaaugugguccuggga

SEQ ID NO: 660311 - RNA, 22 nt, Human
acaggaagcuggagacccuuga

SEQ ID NO: 660312 - RNA, 22 nt, Human
agcuccaggugcaagucauggu

SEQ ID NO: 660313 - RNA, 22 nt, Human
cucagagaggcaguggaaguca

SEQ ID NO: 660314 - RNA, 22 nt, Human
ccuuacaaugcaguuuacuuag

SEQ ID NO: 660315 - RNA, 22 nt, Human
auggcucucuagggcccagguu

SEQ ID NO: 660316 - RNA, 22 nt, Human
auggccaagcuuacucuguugu

SEQ ID NO: 660317 - RNA, 22 nt, Human
auuuucugugugcagauaaaua

SEQ ID NO: 660318 - RNA, 22 nt, Human
gcuggcugcgucaucacagggc

SEQ ID NO: 660319 - RNA, 22 nt, Human
uggcagggaguugcaggauuuc

SEQ ID NO: 660320 - RNA, 22 nt, Human
caggguggaacaggcaauacuu

SEQ ID NO: 660321 - RNA, 22 nt, Human
gacagugacagcuuggaaagca

SEQ ID NO: 660322 - RNA, 22 nt, Human
gccuucagaguaccauguccuc

SEQ ID NO: 660323 - RNA, 22 nt, Human
ucucagggaguugaggcugccu

SEQ ID NO: 660324 - RNA, 22 nt, Human
cauuuuacgacauagggcaggc

SEQ ID NO: 660325 - RNA, 20 nt, Human
caauagaauguggagauaag

SEQ ID NO: 660326 - RNA, 22 nt, Human
uguacaauagcuauuaucucca

SEQ ID NO: 660327 - RNA, 22 nt, Human
cuguucuaucauuaaaagcuau

SEQ ID NO: 660328 - RNA, 22 nt, Human
cugagccauccauaccagcuua

SEQ ID NO: 660329 - RNA, 22 nt, Human
ggguggcacaggugcagagggu

SEQ ID NO: 660330 - RNA, 18 nt, Human
agaggggagguaagucug

SEQ ID NO: 660331 - RNA, 22 nt, Human
ggcagcccuuucuggccagcuc

SEQ ID NO: 660332 - RNA, 22 nt, Human
aaaaauugcugagaacggaauu

SEQ ID NO: 660333 - RNA, 22 nt, Human
uccaggaugcccgcuuuugcuu

SEQ ID NO: 660334 - RNA, 22 nt, Human
gugcauuuauauuugccuuugg

SEQ ID NO: 660335 - RNA, 22 nt, Human
uauguguauaucuguaugugca

SEQ ID NO: 660336 - RNA, 22 nt, Human
uaaugcaauuuagcaaaguuuu

SEQ ID NO: 660337 - RNA, 22 nt, Human
cugcagcaggaggcuccugcag

SEQ ID NO: 660338 - RNA, 22 nt, Human
uuuggcacuguucuaggugcaa

SEQ ID NO: 660339 - RNA, 22 nt, Human
aagggcagcugacagaugcuua

SEQ ID NO: 660340 - RNA, 22 nt, Human
ggugacagcgggucaagaggag

SEQ ID NO: 660341 - RNA, 22 nt, Human
guguggcuaccucagaggagca

SEQ ID NO: 660342 - RNA, 22 nt, Human
ugcaggcuccaugaggacaggc

SEQ ID NO: 660343 - RNA, 22 nt, Human
ccagcccucgguagucccauag

SEQ ID NO: 660344 - RNA, 22 nt, Human
auacuacacauugacuauauuu

SEQ ID NO: 660345 - RNA, 22 nt, Human
cuccucccacggucucaggaag

SEQ ID NO: 660346 - RNA, 22 nt, Human
aaggcuggggugcagacggccu

SEQ ID NO: 660347 - RNA, 22 nt, Human
ucugucugcaccuaagcacagu

SEQ ID NO: 660348 - RNA, 22 nt, Human
gagcucagcccaaagagcagug

SEQ ID NO: 660349 - RNA, 22 nt, Human
uuucucaaauugcaugaguagc

SEQ ID NO: 660350 - RNA, 22 nt, Human
acuugaauuaggccuugagaga

SEQ ID NO: 660351 - RNA, 22 nt, Human
cccaacuacucucaggcagcuu

SEQ ID NO: 660352 - RNA, 22 nt, Human
ugcuguccugcugagggaugug

SEQ ID NO: 660353 - RNA, 23 nt, Human
ucugagguggcucuugcuuugaa

SEQ ID NO: 660354 - RNA, 23 nt, Human
aagcacagaaugguuuaggaguu

SEQ ID NO: 660355 - RNA, 21 nt, Human
uguuuuccaccuugaggcaag

SEQ ID NO: 660356 - RNA, 22 nt, Human
gcaaagaaaugucagugagagg

SEQ ID NO: 660357 - RNA, 22 nt, Human
ucauuuuuugcauaccuguguc

SEQ ID NO: 660358 - RNA, 22 nt, Human
ugcaggcugcuggcaguagcuu

SEQ ID NO: 660359 - RNA, 21 nt, Human
agaugaggauacugaggccua

SEQ ID NO: 660360 - RNA, 22 nt, Human
acuggccaggcacagcuguggg

SEQ ID NO: 660361 - RNA, 22 nt, Human
guccaggcucaaaagguuguua

SEQ ID NO: 660362 - RNA, 22 nt, Human
caggaaauggcugaauaaauuc

SEQ ID NO: 660363 - RNA, 22 nt, Human
gacagguauuugagagcuggga

SEQ ID NO: 660364 - RNA, 22 nt, Human
uuuccucauuuaucugcuggga

SEQ ID NO: 660365 - RNA, 22 nt, Human
guucagggagggacagaugaag

SEQ ID NO: 660366 - RNA, 22 nt, Human
ugacagggucagagcugagcug

SEQ ID NO: 660367 - RNA, 22 nt, Human
ugaggccugacagaccaagccu

SEQ ID NO: 660368 - RNA, 22 nt, Human
acauucauugccaggguggaag

SEQ ID NO: 660369 - RNA, 22 nt, Human
cugggccugugacucccauccu

SEQ ID NO: 660370 - RNA, 22 nt, Human
uccuggauuuaacccuggcucu

SEQ ID NO: 660371 - RNA, 23 nt, Human
cuuuucauugccuuagcgcagag

SEQ ID NO: 660372 - RNA, 19 nt, Human
agccagggugagaaggagc

SEQ ID NO: 660373 - RNA, 22 nt, Human
gggggcagaauguacucuuguc

SEQ ID NO: 660374 - RNA, 22 nt, Human
gcugaggcuccucgggaggaca

SEQ ID NO: 660375 - RNA, 22 nt, Human
guuugcugcccucuccuguccg

SEQ ID NO: 660376 - RNA, 22 nt, Human
ucaaagcagcacauucgcaagc

SEQ ID NO: 660377 - RNA, 20 nt, Human
gggcuuggaggacucgaggg

SEQ ID NO: 660378 - RNA, 22 nt, Human
gcuuuguguagaaggaggaugg

SEQ ID NO: 660379 - RNA, 22 nt, Human
ucaguguggguaagcaugcugu

SEQ ID NO: 660380 - RNA, 22 nt, Human
acauuuauuuuggcacggcaca

SEQ ID NO: 660381 - RNA, 23 nt, Human
uaugugugggucuacuagaaguc

SEQ ID NO: 660382 - RNA, 22 nt, Human
cccaggaggccaagguugcagu

SEQ ID NO: 660383 - RNA, 22 nt, Human
aaucacaguuaguaagggagaa

SEQ ID NO: 660384 - RNA, 22 nt, Human
uuggcauaccuuagugguggag

SEQ ID NO: 660385 - RNA, 22 nt, Human
gccaauuuauagccaaaaauca

SEQ ID NO: 660386 - RNA, 22 nt, Human
ucccugggaaaugucaguuuca

SEQ ID NO: 660387 - RNA, 22 nt, Human
agagggccauaggugcauaguu

SEQ ID NO: 660388 - RNA, 22 nt, Human
aaaguuacacaucuaguaagug

SEQ ID NO: 660389 - RNA, 22 nt, Human
ucugcaggcuuggaguggcagc

SEQ ID NO: 660390 - RNA, 20 nt, Human
uuauuuguuuacuuuggucc

SEQ ID NO: 660391 - RNA, 22 nt, Human
cuguaaauaugaagaauauaug

SEQ ID NO: 660392 - RNA, 22 nt, Human
caaaggaggugauaggcccucu

SEQ ID NO: 660393 - RNA, 22 nt, Human
aagugcuuucauauagucuuaa

SEQ ID NO: 660394 - RNA, 22 nt, Human
gagaaagauggaaucuuacagg

SEQ ID NO: 660395 - RNA, 21 nt, Human
uguggcugccucuggcccugg

SEQ ID NO: 660396 - RNA, 22 nt, Human
uguaggucucagugucugagcu

SEQ ID NO: 660397 - RNA, 23 nt, Human
gugugccaagcacugugccagga

SEQ ID NO: 660398 - RNA, 22 nt, Human
gcguuuaaagauagcuaauaag

SEQ ID NO: 660399 - RNA, 22 nt, Human
uugucugauguucccucaugau

SEQ ID NO: 660400 - RNA, 22 nt, Human
ugcccaagcagaggagugauuc

SEQ ID NO: 660401 - RNA, 22 nt, Human
ucugcuguguccccugugcggg

SEQ ID NO: 660402 - RNA, 22 nt, Human
uaaacagccuccccuuucacuc

SEQ ID NO: 660403 - RNA, 22 nt, Human
auggaaauacagccagagcaga

SEQ ID NO: 660404 - RNA, 22 nt, Human
ggggcagagaauaaaaaccuaa

SEQ ID NO: 660405 - RNA, 23 nt, Human
ucacauuuaaccccucagaccuc

SEQ ID NO: 660406 - RNA, 22 nt, Human
gccuguucugcccugagagccu

SEQ ID NO: 660407 - RNA, 22 nt, Human
cugugagggccagagucagggc

SEQ ID NO: 660408 - RNA, 22 nt, Human
ucaacacuggcuacaguuaugc

SEQ ID NO: 660409 - RNA, 22 nt, Human
gcucacaggggcagacgaguug

SEQ ID NO: 660410 - RNA, 21 nt, Human
uugaccaagggugcgugcucc

SEQ ID NO: 660411 - RNA, 22 nt, Human
ugauuucucuccguuauuucag

SEQ ID NO: 660412 - RNA, 22 nt, Human
agcuucucagcuucagaacugu

SEQ ID NO: 660413 - RNA, 22 nt, Human
uaaucuuagcaaccuccagugu

SEQ ID NO: 660414 - RNA, 22 nt, Human
agcuggcuggccccuuccugcc

SEQ ID NO: 660415 - RNA, 22 nt, Human
cagcccugccauggagccuccu

SEQ ID NO: 660416 - RNA, 22 nt, Human
ccagcucuuggugcacuuacau

SEQ ID NO: 660417 - RNA, 22 nt, Human
uccugggucccgcacaucuguc

SEQ ID NO: 660418 - RNA, 22 nt, Human
cuuauguauauuuggaacguac

SEQ ID NO: 660419 - RNA, 21 nt, Human
aucagaaaauguaauggagca

SEQ ID NO: 660420 - RNA, 22 nt, Human
caguagcaggauuugggauuau

SEQ ID NO: 660421 - RNA, 22 nt, Human
uauacucugagaaacgugucac

SEQ ID NO: 660422 - RNA, 19 nt, Human
uaguacaaaagcagccaua

SEQ ID NO: 660423 - RNA, 20 nt, Human
guugcuuuagucugguuugg

SEQ ID NO: 660424 - RNA, 20 nt, Human
uggcucucucuaguaagugg

SEQ ID NO: 660425 - RNA, 22 nt, Human
gccuccaguuuuuuucugaacu

SEQ ID NO: 660426 - RNA, 19 nt, Human
ucacauucagccuugcuga

SEQ ID NO: 660427 - RNA, 22 nt, Human
caggagccacauuccaccuuga

SEQ ID NO: 660428 - RNA, 22 nt, Human
ugggagagucuaaaaccgaggu

SEQ ID NO: 660429 - RNA, 22 nt, Human
acaaggcuucacacaguaugaa

SEQ ID NO: 660430 - RNA, 22 nt, Human
uuacucugaauguuucuacuga

SEQ ID NO: 660431 - RNA, 22 nt, Human
cgcaggcuggcgcggaguggca

SEQ ID NO: 660432 - RNA, 22 nt, Human
cagaaacuauguaagaaaguga

SEQ ID NO: 660433 - RNA, 22 nt, Human
agcagggcagugcuucagcucu

SEQ ID NO: 660434 - RNA, 22 nt, Human
ugcugucuuccaggauggugaa

SEQ ID NO: 660435 - RNA, 20 nt, Human
uauugaguaccuacuguaua

SEQ ID NO: 660436 - RNA, 22 nt, Human
gaauucugggagagaucugaca

SEQ ID NO: 660437 - RNA, 22 nt, Human
cuguggccagucccacaccucc

SEQ ID NO: 660438 - RNA, 22 nt, Human
guuuucugccugaaggugacca

SEQ ID NO: 660439 - RNA, 22 nt, Human
ccaaaguccauaguuuacuuua

SEQ ID NO: 660440 - RNA, 20 nt, Human
auauuucuuaagaacuuuca

SEQ ID NO: 660441 - RNA, 22 nt, Human
ugccauugggcagucauugaag

SEQ ID NO: 660442 - RNA, 22 nt, Human
ggucccagcuggucacugucag

SEQ ID NO: 660443 - RNA, 22 nt, Human
guaacauucuagaaacuuaaca

SEQ ID NO: 660444 - RNA, 22 nt, Human
ccugggaaggugaggcccugga

SEQ ID NO: 660445 - RNA, 22 nt, Human
uugucucuaagugugaucuuca

SEQ ID NO: 660446 - RNA, 22 nt, Human
aaaguauuuuugacaggcauua

SEQ ID NO: 660447 - RNA, 22 nt, Human
aggacacacccagcucacgggg

SEQ ID NO: 660448 - RNA, 22 nt, Human
guuaauaaagguauagaaucag

SEQ ID NO: 660449 - RNA, 20 nt, Human
gcuucuuuucuggcccauga

SEQ ID NO: 660450 - RNA, 22 nt, Human
acuuuauguuugauaucuaugg

SEQ ID NO: 660451 - RNA, 22 nt, Human
ugggugugaagucuguuggccu

SEQ ID NO: 660452 - RNA, 22 nt, Human
uaacagaaauauuuccagguga

SEQ ID NO: 660453 - RNA, 22 nt, Human
gaccugaaaugggggccugucc

SEQ ID NO: 660454 - RNA, 23 nt, Human
caguggucagaacgugggagggu

SEQ ID NO: 660455 - RNA, 22 nt, Human
uuucacauauaggggaagcuac

SEQ ID NO: 660456 - RNA, 22 nt, Human
ucuuacagccacucugugaagc

SEQ ID NO: 660457 - RNA, 22 nt, Human
uuuaauguuaaauuuguagaug

SEQ ID NO: 660458 - RNA, 22 nt, Human
uucuagauagagugcaaauuau

SEQ ID NO: 660459 - RNA, 20 nt, Human
cucuggcaaaggaugccuau

SEQ ID NO: 660460 - RNA, 17 nt, Human
aaacugaaaaauucacu

SEQ ID NO: 660461 - RNA, 22 nt, Human
uagaaagcugaguaauacauuu

SEQ ID NO: 660462 - RNA, 20 nt, Human
guggcaggcagugaaggagc

SEQ ID NO: 660463 - RNA, 22 nt, Human
cuggaagaacuccaguucugug

SEQ ID NO: 660464 - RNA, 20 nt, Human
aggcugccaggucucacauc

SEQ ID NO: 660465 - RNA, 22 nt, Human
cuacaugaauggguguauuacu

SEQ ID NO: 660466 - RNA, 22 nt, Human
uccuucagaggacggcagccag

SEQ ID NO: 660467 - RNA, 22 nt, Human
uccagcuggggcaguggcuggg

SEQ ID NO: 660468 - RNA, 22 nt, Human
cagcauggugccagugagucca

SEQ ID NO: 660469 - RNA, 22 nt, Human
uagucucuggagacucuagggg

SEQ ID NO: 660470 - RNA, 22 nt, Human
uagagguuggccuuagaaagau

SEQ ID NO: 660471 - RNA, 22 nt, Human
ugggcagcaaagacugugugcu

SEQ ID NO: 660472 - RNA, 22 nt, Human
cauuugaaauucuuagaacaaa

SEQ ID NO: 660473 - RNA, 22 nt, Human
aaggcacuguacuaguuaguua

SEQ ID NO: 660474 - RNA, 22 nt, Human
ucaaggaauuuaguuuaguaaa

SEQ ID NO: 660475 - RNA, 22 nt, Human
uggcagccucagacaaggaccu

SEQ ID NO: 660476 - RNA, 22 nt, Human
ugggccacagcucacacaucca

SEQ ID NO: 660477 - RNA, 22 nt, Human
ucugacauuagauuaauuggaa

SEQ ID NO: 660478 - RNA, 22 nt, Human
cagauggagucccguggaguuc

SEQ ID NO: 660479 - RNA, 19 nt, Human
gcagguagagacagcagcc

SEQ ID NO: 660480 - RNA, 22 nt, Human
ucccauguguuccucuagucua

SEQ ID NO: 660481 - RNA, 22 nt, Human
uggcagagcuggcugcggauga

SEQ ID NO: 660482 - RNA, 22 nt, Human
gcauucauucaggcucccaggg

SEQ ID NO: 660483 - RNA, 22 nt, Human
uaaguaaaacauucaagaaguc

SEQ ID NO: 660484 - RNA, 22 nt, Human
aggagccaagauggggcaagua

SEQ ID NO: 660485 - RNA, 22 nt, Human
gauuucaaagguucugcaugcc

SEQ ID NO: 660486 - RNA, 22 nt, Human
cucuuacaagcucccgauauaa

SEQ ID NO: 660487 - RNA, 22 nt, Human
uuucagguaagaaaacuaagaa

SEQ ID NO: 660488 - RNA, 22 nt, Human
uaucuguucauguuuauauguc

SEQ ID NO: 660489 - RNA, 22 nt, Human
agggauggaagacuugaagacc

SEQ ID NO: 660490 - RNA, 22 nt, Human
uacuuauuguugaacugaauca

SEQ ID NO: 660491 - RNA, 22 nt, Human
caugcacagagcuuggucauug

SEQ ID NO: 660492 - RNA, 19 nt, Human
cuggaaugagaacaugccc

SEQ ID NO: 660493 - RNA, 22 nt, Human
ccaggaagauuuauuuuggcuu

SEQ ID NO: 660494 - RNA, 22 nt, Human
aggguccuaagccucagauaag

SEQ ID NO: 660495 - RNA, 22 nt, Human
gagcaggcuugcagagaagggg

SEQ ID NO: 660496 - RNA, 22 nt, Human
acagcaggcaugaaugacacug

SEQ ID NO: 660497 - RNA, 20 nt, Human
agguccacugaggcugccuc

SEQ ID NO: 660498 - RNA, 22 nt, Human
uucacauuaucaggauuguuuc

SEQ ID NO: 660499 - RNA, 22 nt, Human
uuuagcuaagacauagauucuu

SEQ ID NO: 660500 - RNA, 23 nt, Human
aaguucuuuuagaugucuucgug

SEQ ID NO: 660501 - RNA, 22 nt, Human
cuuccaggacaccaggguagua

SEQ ID NO: 660502 - RNA, 19 nt, Human
ccugaguguuucagagaca

SEQ ID NO: 660503 - RNA, 20 nt, Human
ucucgcacucggagcagccg

SEQ ID NO: 660504 - RNA, 22 nt, Human
ccugccaggcgagucuaggcca

SEQ ID NO: 660505 - RNA, 19 nt, Human
ucuguaacacucuagccuu

SEQ ID NO: 660506 - RNA, 22 nt, Human
ggugagaggcagaggacagcuu

SEQ ID NO: 660507 - RNA, 22 nt, Human
cugugugucauuugucaauccu

SEQ ID NO: 660508 - RNA, 22 nt, Human
ugggacagguuggagagaagca

SEQ ID NO: 660509 - RNA, 22 nt, Human
uagggcucagagaaguggggcc

SEQ ID NO: 660510 - RNA, 20 nt, Human
aagaggcuguggauccuacu

SEQ ID NO: 660511 - RNA, 18 nt, Human
ucccaucauccucuccag

SEQ ID NO: 660512 - RNA, 22 nt, Human
cugccucugcgucccacagagu

SEQ ID NO: 660513 - RNA, 22 nt, Human
aauaguccugauuuaaucuggg

SEQ ID NO: 660514 - RNA, 22 nt, Human
ccugaggcucuccugaauaaug

SEQ ID NO: 660515 - RNA, 22 nt, Human
gcagcacugauccuaaacuuag

SEQ ID NO: 660516 - RNA, 22 nt, Human
ucagcacugucuuuuauuugaa

SEQ ID NO: 660517 - RNA, 22 nt, Human
uggaagagaaaggaguggaucu

SEQ ID NO: 660518 - RNA, 22 nt, Human
guggccuuuuagaauaaacucu

SEQ ID NO: 660519 - RNA, 17 nt, Human
uguuaauuccaaugaua

SEQ ID NO: 660520 - RNA, 22 nt, Human
ccacacuaaacugcucaaacca

SEQ ID NO: 660521 - RNA, 22 nt, Human
agcagggcaguuaaaggguccu

SEQ ID NO: 660522 - RNA, 22 nt, Human
agugcugucaguuuuauagaua

SEQ ID NO: 660523 - RNA, 22 nt, Human
agaggucucaguuauguuuaaa

SEQ ID NO: 660524 - RNA, 22 nt, Human
aggcagcaugggccccagcucc

SEQ ID NO: 660525 - RNA, 22 nt, Human
uugacuauacucuggcggaaaa

SEQ ID NO: 660526 - RNA, 22 nt, Human
cuggcugcaguagcaagagacu

SEQ ID NO: 660527 - RNA, 22 nt, Human
ugaagacaagugugcugguguu

SEQ ID NO: 660528 - RNA, 22 nt, Human
gcuggggagaauuggguuaucu

SEQ ID NO: 660529 - RNA, 22 nt, Human
ugagcugcauuacagccucugu

SEQ ID NO: 660530 - RNA, 18 nt, Human
gaggcacauaguuggggc

SEQ ID NO: 660531 - RNA, 22 nt, Human
uauugcuuauucuugagaguca

SEQ ID NO: 660532 - RNA, 22 nt, Human
ccuguguccuuggcagauaucc

SEQ ID NO: 660533 - RNA, 22 nt, Human
cccagcucccauguucuccaau

SEQ ID NO: 660534 - RNA, 23 nt, Human
uccugagaugagacagugcugcc

SEQ ID NO: 660535 - RNA, 22 nt, Human
agggaaagguagugaggucaca

SEQ ID NO: 660536 - RNA, 22 nt, Human
ccucucuccuuccuuugccaaa

SEQ ID NO: 660537 - RNA, 22 nt, Human
uguacacauaucauuuguggga

SEQ ID NO: 660538 - RNA, 22 nt, Human
ugggaaggcguggaaguagaag

SEQ ID NO: 660539 - RNA, 22 nt, Human
cagcaauauacacagucuaugg

SEQ ID NO: 660540 - RNA, 22 nt, Human
uuauucugaacuagacucucau

SEQ ID NO: 660541 - RNA, 22 nt, Human
ugcuugagacacauaugaauuu

SEQ ID NO: 660542 - RNA, 22 nt, Human
acccagagucauguuuauuccc

SEQ ID NO: 660543 - RNA, 22 nt, Human
ggaaacaugccugcuggacagu

SEQ ID NO: 660544 - RNA, 22 nt, Human
cuggcagccaagugggauacuc

SEQ ID NO: 660545 - RNA, 22 nt, Human
ugcccacauucaaaaggugaug

SEQ ID NO: 660546 - RNA, 22 nt, Human
agaggugggagccuggucacau

SEQ ID NO: 660547 - RNA, 22 nt, Human
ggagucugauacugaguuccuc

SEQ ID NO: 660548 - RNA, 22 nt, Human
uccaggagggguaggcaguaug

SEQ ID NO: 660549 - RNA, 22 nt, Human
uaaagcaauuugagcaaguucu

SEQ ID NO: 660550 - RNA, 23 nt, Human
cgugucugugggcgauccggccu

SEQ ID NO: 660551 - RNA, 22 nt, Human
auggcuggcacuggccuggguu

SEQ ID NO: 660552 - RNA, 22 nt, Human
ccauuguaguaucuguuuuagu

SEQ ID NO: 660553 - RNA, 23 nt, Human
agaaaguuugugccuugugacac

SEQ ID NO: 660554 - RNA, 17 nt, Human
gcuggcugacccaugcc

SEQ ID NO: 660555 - RNA, 21 nt, Human
cucuguguugaggguguugag

SEQ ID NO: 660556 - RNA, 22 nt, Human
aguugugaauagaucugauugg

SEQ ID NO: 660557 - RNA, 22 nt, Human
accaucuuagcagacugcagug

SEQ ID NO: 660558 - RNA, 22 nt, Human
caagauuuccaacccuggguaa

SEQ ID NO: 660559 - RNA, 22 nt, Human
uuguauauauucuuaaagaugu

SEQ ID NO: 660560 - RNA, 22 nt, Human
cuggaaguuuccuuccugguca

SEQ ID NO: 660561 - RNA, 22 nt, Human
ucucuguccccucagcuggggu

SEQ ID NO: 660562 - RNA, 22 nt, Human
ucuagaauuuugccauauagcu

SEQ ID NO: 660563 - RNA, 21 nt, Human
uguucacauggagcagaaugu

SEQ ID NO: 660564 - RNA, 22 nt, Human
acaaucuuauuaguaguauaga

SEQ ID NO: 660565 - RNA, 22 nt, Human
cuggcaggagcauucacagagg

SEQ ID NO: 660566 - RNA, 22 nt, Human
gugggugcugucaggcagggaa

SEQ ID NO: 660567 - RNA, 22 nt, Human
uauuuccagcaguaagaagaca

SEQ ID NO: 660568 - RNA, 22 nt, Human
ccaggguggaggcuggauggag

SEQ ID NO: 660569 - RNA, 22 nt, Human
uuuggcucugguucuggcucca

SEQ ID NO: 660570 - RNA, 22 nt, Human
acucucugggcaugccccacca

SEQ ID NO: 660571 - RNA, 22 nt, Human
cuguuucaccacuggcucuuug

SEQ ID NO: 660572 - RNA, 22 nt, Human
ugguccagacauuucugaggua

SEQ ID NO: 660573 - RNA, 22 nt, Human
gcuucuauccuaccaugucuug

SEQ ID NO: 660574 - RNA, 22 nt, Human
agucacaugaggaaggggaagg

SEQ ID NO: 660575 - RNA, 21 nt, Human
ugcauauucuucugguggcug

SEQ ID NO: 660576 - RNA, 22 nt, Human
gaggucaggggagaggcugaug

SEQ ID NO: 660577 - RNA, 22 nt, Human
gagggaccccaggcuggcccuu

SEQ ID NO: 660578 - RNA, 22 nt, Human
auucagcaaacauuuauuaucu

SEQ ID NO: 660579 - RNA, 22 nt, Human
cagcaagaggguaagguugaag

SEQ ID NO: 660580 - RNA, 22 nt, Human
uuuguucuuaguaucugugugc

SEQ ID NO: 660581 - RNA, 20 nt, Human
ugagacaaggcuggagagac

SEQ ID NO: 660582 - RNA, 19 nt, Human
cucuuaaauugucucuugc

SEQ ID NO: 660583 - RNA, 22 nt, Human
acauacacgggaaaccucuuuu

SEQ ID NO: 660584 - RNA, 22 nt, Human
gagccugugagccccaacucca

SEQ ID NO: 660585 - RNA, 22 nt, Human
caggacaauuuugagccaccug

SEQ ID NO: 660586 - RNA, 22 nt, Human
aauauucaaguuauucuuucuu

SEQ ID NO: 660587 - RNA, 22 nt, Human
cacugucugcuucgacucuuca

SEQ ID NO: 660588 - RNA, 19 nt, Human
ccaggagcaguggugagcu

SEQ ID NO: 660589 - RNA, 22 nt, Human
aggaauuugggguuacaugaug

SEQ ID NO: 660590 - RNA, 22 nt, Human
agguuucuggauuuauuauggc

SEQ ID NO: 660591 - RNA, 22 nt, Human
cacuggucagcaugguagacca

SEQ ID NO: 660592 - RNA, 22 nt, Human
gcugagguggugaugguucauc

SEQ ID NO: 660593 - RNA, 22 nt, Human
ugucauguguucuuaaauacau

SEQ ID NO: 660594 - RNA, 22 nt, Human
guuuccagcuuucugaugcuug

SEQ ID NO: 660595 - RNA, 22 nt, Human
uuauuuaaaauguagguuggga

SEQ ID NO: 660596 - RNA, 22 nt, Human
guucuucaguaaaauuaaaugu

SEQ ID NO: 660597 - RNA, 22 nt, Human
gguaaaaugcagauucuuagcc

SEQ ID NO: 660598 - RNA, 22 nt, Human
ucagucaucccagcuuucaucu

SEQ ID NO: 660599 - RNA, 20 nt, Human
caguccugucccugcugccc

SEQ ID NO: 660600 - RNA, 22 nt, Human
ugucuucagauaggcauucuuc

SEQ ID NO: 660601 - RNA, 23 nt, Human
acuuccaguugcuucagcauaug

SEQ ID NO: 660602 - RNA, 22 nt, Human
cagcaucccucaggggccucug

SEQ ID NO: 660603 - RNA, 22 nt, Human
auuaugcugguuuacacauuuu

SEQ ID NO: 660604 - RNA, 22 nt, Human
acaucuguucuucucuuguccc

SEQ ID NO: 660605 - RNA, 22 nt, Human
auacagauguuaaagcaauuuc

SEQ ID NO: 660606 - RNA, 22 nt, Human
ccuuggcaagacaguggagggu

SEQ ID NO: 660607 - RNA, 22 nt, Human
ggcagccacccugggaggcaga

SEQ ID NO: 660608 - RNA, 22 nt, Human
aagcuugggaaccacgguaauc

SEQ ID NO: 660609 - RNA, 22 nt, Human
uaauccugaucaauuuuagcuu

SEQ ID NO: 660610 - RNA, 22 nt, Human
agcugccugcuuaugagcucca

SEQ ID NO: 660611 - RNA, 22 nt, Human
ccagcagcccacaggcgucccu

SEQ ID NO: 660612 - RNA, 22 nt, Human
acauuuacauuuucucuggccu

SEQ ID NO: 660613 - RNA, 22 nt, Human
ggcugcaggcagaggcugucug

SEQ ID NO: 660614 - RNA, 22 nt, Human
gccuggggaacuugauccuguc

SEQ ID NO: 660615 - RNA, 22 nt, Human
ugugcccucagaagaguacauc

SEQ ID NO: 660616 - RNA, 22 nt, Human
aaacagcuacuucuguauaaug

SEQ ID NO: 660617 - RNA, 22 nt, Human
uguccuggugcuccagguggcu

SEQ ID NO: 660618 - RNA, 17 nt, Human
acagugagaagucaucu

SEQ ID NO: 660619 - RNA, 22 nt, Human
acugugugcccugacgccaggg

SEQ ID NO: 660620 - RNA, 22 nt, Human
agugugggugagggaggcccuc

SEQ ID NO: 660621 - RNA, 18 nt, Human
ugacauuuccagagugua

SEQ ID NO: 660622 - RNA, 22 nt, Human
ccuccagccuuccugaagagcc

SEQ ID NO: 660623 - RNA, 22 nt, Human
gcuguguuggugaagcuguagc

SEQ ID NO: 660624 - RNA, 22 nt, Human
augcagggagguaagaggugcc

SEQ ID NO: 660625 - RNA, 22 nt, Human
aaggcaguaaaaucuaccuugc

SEQ ID NO: 660626 - RNA, 20 nt, Human
cuguggcucaugcaucugcc

SEQ ID NO: 660627 - RNA, 22 nt, Human
gcucugggcugcccucuggaca

SEQ ID NO: 660628 - RNA, 19 nt, Human
ucugcccaguugucugccc

SEQ ID NO: 660629 - RNA, 22 nt, Human
aacuacagaaucauagaaaaua

SEQ ID NO: 660630 - RNA, 22 nt, Human
agcaauguuggccuauauaccu

SEQ ID NO: 660631 - RNA, 22 nt, Human
cagugggguuucugugggugcu

SEQ ID NO: 660632 - RNA, 22 nt, Human
ccacugcuagagaugcaucccc

SEQ ID NO: 660633 - RNA, 22 nt, Human
uagcaaggacguccaaagaacu

SEQ ID NO: 660634 - RNA, 22 nt, Human
aggcaggcuggucugaagagug

SEQ ID NO: 660635 - RNA, 22 nt, Human
acaugcauaaacuacuucuuau

SEQ ID NO: 660636 - RNA, 22 nt, Human
ucagagguuccggccauaacca

SEQ ID NO: 660637 - RNA, 22 nt, Human
gccagccccuccauccuguuca

SEQ ID NO: 660638 - RNA, 22 nt, Human
auguacaguuucuagacucaaa

SEQ ID NO: 660639 - RNA, 22 nt, Human
ugaggccugcuuggaauugaau

SEQ ID NO: 660640 - RNA, 22 nt, Human
cucuccagcagauguagucugu

SEQ ID NO: 660641 - RNA, 22 nt, Human
uacaaagucaccagcuucuugc

SEQ ID NO: 660642 - RNA, 22 nt, Human
uuggaaggccagcaccuugagu

SEQ ID NO: 660643 - RNA, 22 nt, Human
agaauucuguucuucgggugug

SEQ ID NO: 660644 - RNA, 22 nt, Human
agggaagcuuguuacugagaag

SEQ ID NO: 660645 - RNA, 22 nt, Human
ccuggcuccugccucugcaggg

SEQ ID NO: 660646 - RNA, 22 nt, Human
acuguacaaauauugcaaaaua

SEQ ID NO: 660647 - RNA, 22 nt, Human
uuacauuuuaguuaaccuguga

SEQ ID NO: 660648 - RNA, 22 nt, Human
aaaccuguuaauagagcgaugc

SEQ ID NO: 660649 - RNA, 18 nt, Human
cugacccuuuuacauucc

SEQ ID NO: 660650 - RNA, 22 nt, Human
aauucauagcaacaaagaccca

SEQ ID NO: 660651 - RNA, 22 nt, Human
ucugagguccuacuauaagugg

SEQ ID NO: 660652 - RNA, 22 nt, Human
ugagaauauuugaagauguuag

SEQ ID NO: 660653 - RNA, 22 nt, Human
gacaucaggccugcagucuggg

SEQ ID NO: 660654 - RNA, 21 nt, Human
agagcucaaggcaaaaauaau

SEQ ID NO: 660655 - RNA, 22 nt, Human
gccuuaggggucagacagagcu

SEQ ID NO: 660656 - RNA, 20 nt, Human
agcaugcagccagagccaac

SEQ ID NO: 660657 - RNA, 22 nt, Human
cugagacaugguuugacuggca

SEQ ID NO: 660658 - RNA, 22 nt, Human
gagaaggacuacacaucuggcc

SEQ ID NO: 660659 - RNA, 22 nt, Human
gcugcagggaauguauggauuu

SEQ ID NO: 660660 - RNA, 22 nt, Human
uuucugaacaaagccauuauca

SEQ ID NO: 660661 - RNA, 22 nt, Human
gcugauguuuaguugauguuac

SEQ ID NO: 660662 - RNA, 22 nt, Human
guaggcagauaggagugcagcc

SEQ ID NO: 660663 - RNA, 22 nt, Human
guuuccugggccccaacccaga

SEQ ID NO: 660664 - RNA, 22 nt, Human
uugcagggcuuggggauuacag

SEQ ID NO: 660665 - RNA, 22 nt, Human
ucaggcaaucugacagcuggag

SEQ ID NO: 660666 - RNA, 22 nt, Human
aagacagccuuucccuggugcc

SEQ ID NO: 660667 - RNA, 22 nt, Human
ggacugaggacaugugaggcau

SEQ ID NO: 660668 - RNA, 22 nt, Human
gaaaaguauguuuauuuugacu

SEQ ID NO: 660669 - RNA, 22 nt, Human
ugccaagugcuuacuuggcccu

SEQ ID NO: 660670 - RNA, 23 nt, Human
gggcccagcacaggaccuggcag

SEQ ID NO: 660671 - RNA, 22 nt, Human
agacagcauuucccggaaccgc

SEQ ID NO: 660672 - RNA, 21 nt, Human
ggugcuccuccaugcugcucu

SEQ ID NO: 660673 - RNA, 22 nt, Human
uccagcucaucugucuccauua

SEQ ID NO: 660674 - RNA, 22 nt, Human
agcuucuuugugggcuccagaa

SEQ ID NO: 660675 - RNA, 22 nt, Human
cgggcuccgggucuuugcaguc

SEQ ID NO: 660676 - RNA, 22 nt, Human
agauucauuguggauauuuucu

SEQ ID NO: 660677 - RNA, 22 nt, Human
agaggucuuaagaucuagacug

SEQ ID NO: 660678 - RNA, 22 nt, Human
gcaugcagggagggucuggcug

SEQ ID NO: 660679 - RNA, 22 nt, Human
auauauagagcuagauguuaaa

SEQ ID NO: 660680 - RNA, 22 nt, Human
aggcuguguaaagugcuuuccc

SEQ ID NO: 660681 - RNA, 22 nt, Human
accagcagcugccagaguggag

SEQ ID NO: 660682 - RNA, 22 nt, Human
cuuuaugugcugggcauuaagg

SEQ ID NO: 660683 - RNA, 22 nt, Human
agggaagaggcaagguuuaugg

SEQ ID NO: 660684 - RNA, 22 nt, Human
ugcuuccuucccguucuucucc

SEQ ID NO: 660685 - RNA, 22 nt, Human
ugacaggcuaggaggcugaagg

SEQ ID NO: 660686 - RNA, 22 nt, Human
gcuguggaugcuauggaucauc

SEQ ID NO: 660687 - RNA, 22 nt, Human
uguccuuuaugaaaugguguuu

SEQ ID NO: 660688 - RNA, 22 nt, Human
gcaggccuaagagaaggcauug

SEQ ID NO: 660689 - RNA, 22 nt, Human
agagaaacccuucaguguuuug

SEQ ID NO: 660690 - RNA, 22 nt, Human
ccagcagcccucuuccaagacu

SEQ ID NO: 660691 - RNA, 22 nt, Human
ugggccacugcugcggaaggcg

SEQ ID NO: 660692 - RNA, 23 nt, Human
cuucacagguucaggggauuaag

SEQ ID NO: 660693 - RNA, 22 nt, Human
ucuacccagagcuaugaccuga

SEQ ID NO: 660694 - RNA, 22 nt, Human
aauuaacagagggcuuauuacu

SEQ ID NO: 660695 - RNA, 22 nt, Human
ucagcccaccuucaggggaguu

SEQ ID NO: 660696 - RNA, 23 nt, Human
cccuguagcccaggacaggcuuu

SEQ ID NO: 660697 - RNA, 22 nt, Human
gauugaaucauaugaaauugug

SEQ ID NO: 660698 - RNA, 22 nt, Human
agauaucaccaguuuuacauac

SEQ ID NO: 660699 - RNA, 22 nt, Human
guccagugacaaguagcuggcc

SEQ ID NO: 660700 - RNA, 22 nt, Human
acuggcaguagagggagcgcau

SEQ ID NO: 660701 - RNA, 22 nt, Human
aacaugaaaagcccagagaggu

SEQ ID NO: 660702 - RNA, 22 nt, Human
aggggaaaugccuuggugguac

SEQ ID NO: 660703 - RNA, 22 nt, Human
cccacccacucugaccagaagc

SEQ ID NO: 660704 - RNA, 22 nt, Human
uuuccuuuaugacaucaccacu

SEQ ID NO: 660705 - RNA, 22 nt, Human
gaauaguucuauggcugcaggg

SEQ ID NO: 660706 - RNA, 22 nt, Human
ggugcaggacgaaguggggguu

SEQ ID NO: 660707 - RNA, 22 nt, Human
cagacccugggccacagaggag

SEQ ID NO: 660708 - RNA, 22 nt, Human
caugaaaauaacauuguuguga

SEQ ID NO: 660709 - RNA, 22 nt, Human
ggcuguguuccaagugucagga

SEQ ID NO: 660710 - RNA, 22 nt, Human
caauguuuuguugaaugaauag

SEQ ID NO: 660711 - RNA, 22 nt, Human
uucucuagguuuuagaugaaga

SEQ ID NO: 660712 - RNA, 22 nt, Human
gcaguggaagccucuuuaagca

SEQ ID NO: 660713 - RNA, 22 nt, Human
agaggacagacggaaagugcca

SEQ ID NO: 660714 - RNA, 22 nt, Human
gagaugggcgagaagguggacu

SEQ ID NO: 660715 - RNA, 22 nt, Human
uagcuucccugcuggaucauaa

SEQ ID NO: 660716 - RNA, 22 nt, Human
ucugugugcccuaaagccugcu

SEQ ID NO: 660717 - RNA, 22 nt, Human
ucugggaacgaaggcuaauaug

SEQ ID NO: 660718 - RNA, 22 nt, Human
gcagggaccuugcccacccucc

SEQ ID NO: 660719 - RNA, 22 nt, Human
ccucagggccaucucugucccu

SEQ ID NO: 660720 - RNA, 22 nt, Human
gacuucaacuucuggggagcaa

SEQ ID NO: 660721 - RNA, 22 nt, Human
aagcagggugucuugacccaug

SEQ ID NO: 660722 - RNA, 22 nt, Human
gcagugcuaaguagcuggccca

SEQ ID NO: 660723 - RNA, 22 nt, Human
uuguguuaaggugcaucuagug

SEQ ID NO: 660724 - RNA, 22 nt, Human
ucugggagagcugcugucagag

SEQ ID NO: 660725 - RNA, 22 nt, Human
acucuguagccuguaagagagc

SEQ ID NO: 660726 - RNA, 22 nt, Human
uucuguacucuuugagaagaau

SEQ ID NO: 660727 - RNA, 22 nt, Human
ucaguguuuacaugcauccuug

SEQ ID NO: 660728 - RNA, 22 nt, Human
uucccugaucacgugucaggag

SEQ ID NO: 660729 - RNA, 22 nt, Human
uggcugcugagaaggcagcugu

SEQ ID NO: 660730 - RNA, 22 nt, Human
uuucuacucauccuuuggagaa

SEQ ID NO: 660731 - RNA, 22 nt, Human
uguguguagaaagggcccuggu

SEQ ID NO: 660732 - RNA, 22 nt, Human
aucaacaugucauaaagugaaa

SEQ ID NO: 660733 - RNA, 22 nt, Human
ucuaaaaugcagaucuacuggu

SEQ ID NO: 660734 - RNA, 22 nt, Human
uuugcaaaguccauugaaguua

SEQ ID NO: 660735 - RNA, 22 nt, Human
ggucccaaucuaaucacaugag

SEQ ID NO: 660736 - RNA, 22 nt, Human
uauucuacaguguuaguguuag

SEQ ID NO: 660737 - RNA, 22 nt, Human
agcacagugcugggcacacagu

SEQ ID NO: 660738 - RNA, 22 nt, Human
cuguggcacucaagaagccucc

SEQ ID NO: 660739 - RNA, 21 nt, Human
cacagaauauacauuuuaguu

SEQ ID NO: 660740 - RNA, 23 nt, Human
acacuuucaaauaugcacagagc

SEQ ID NO: 660741 - RNA, 22 nt, Human
cacaagucauuuucagcaggcu

SEQ ID NO: 660742 - RNA, 22 nt, Human
auguagauguucacuugauuuu

SEQ ID NO: 660743 - RNA, 22 nt, Human
caguucuaauuaauaggaguaa

SEQ ID NO: 660744 - RNA, 22 nt, Human
ggucagcaauuuggacugggcu

SEQ ID NO: 660745 - RNA, 22 nt, Human
aggcuucugugagcucauacaa

SEQ ID NO: 660746 - RNA, 22 nt, Human
caggaacaggcugaugggcagg

SEQ ID NO: 660747 - RNA, 22 nt, Human
gcuggcaaugguguggucuggu

SEQ ID NO: 660748 - RNA, 22 nt, Human
agaaaggagcaccgugggggau

SEQ ID NO: 660749 - RNA, 22 nt, Human
aaauccauucuguuuuaaaagu

SEQ ID NO: 660750 - RNA, 22 nt, Human
ugcauuuaguuaugagaaaaac

SEQ ID NO: 660751 - RNA, 22 nt, Human
gcacuguucucagagcauuaga

SEQ ID NO: 660752 - RNA, 22 nt, Human
cagcagagcauuugguaggagg

SEQ ID NO: 660753 - RNA, 22 nt, Human
acuuucuccagaaaaccaagga

SEQ ID NO: 660754 - RNA, 22 nt, Human
uuguucuuggagcaggcagaga

SEQ ID NO: 660755 - RNA, 22 nt, Human
accuucaacucaaaguguccca

SEQ ID NO: 660756 - RNA, 22 nt, Human
ccugagcuggagacauuacaua

SEQ ID NO: 660757 - RNA, 22 nt, Human
agcauagauacauugagccaca

SEQ ID NO: 660758 - RNA, 22 nt, Human
ucccugcugagagugcucuccc

SEQ ID NO: 660759 - RNA, 22 nt, Human
uugaagcauuugcuauagcauu

SEQ ID NO: 660760 - RNA, 22 nt, Human
gaagagagagcccugggguccg

SEQ ID NO: 660761 - RNA, 22 nt, Human
cuggcuggagcaggcaucuugu

SEQ ID NO: 660762 - RNA, 22 nt, Human
uucaggcauggaaacuggauua

SEQ ID NO: 660763 - RNA, 22 nt, Human
uuucucugcuguguuggcagcu

SEQ ID NO: 660764 - RNA, 20 nt, Human
gcagagccucacugcaaggg

SEQ ID NO: 660765 - RNA, 22 nt, Human
uagcuguugcaauaaacaguuc

SEQ ID NO: 660766 - RNA, 22 nt, Human
uuucuccugcuagaacaaggag

SEQ ID NO: 660767 - RNA, 22 nt, Human
uaaugacauuguauccacagag

SEQ ID NO: 660768 - RNA, 22 nt, Human
acagccacucaaagggccgaag

SEQ ID NO: 660769 - RNA, 21 nt, Human
gcaggaugcaucuuggugucu

SEQ ID NO: 660770 - RNA, 22 nt, Human
uuuauccauucaccaguugaac

SEQ ID NO: 660771 - RNA, 22 nt, Human
agaggaauggagacuaaacgcu

SEQ ID NO: 660772 - RNA, 22 nt, Human
uauugacaggugccugcagaca

SEQ ID NO: 660773 - RNA, 22 nt, Human
ugucugccaaagcuuccuccug

SEQ ID NO: 660774 - RNA, 22 nt, Human
gaggggccggcaugugccucuc

SEQ ID NO: 660775 - RNA, 22 nt, Human
gugccagggaguggaggagcuu

SEQ ID NO: 660776 - RNA, 22 nt, Human
aagugucuuuauauuugagaaa

SEQ ID NO: 660777 - RNA, 22 nt, Human
auguaugcauagugaguaaaug

SEQ ID NO: 660778 - RNA, 22 nt, Human
uccagccuucucaaggcuggcu

SEQ ID NO: 660779 - RNA, 22 nt, Human
uaccaugucuucaauaagucua

SEQ ID NO: 660780 - RNA, 22 nt, Human
agccuaggucugggucuagcag

SEQ ID NO: 660781 - RNA, 22 nt, Human
acaaaccagcuuaagcaagaug

SEQ ID NO: 660782 - RNA, 22 nt, Human
uuucagaaccaagagagacauc

SEQ ID NO: 660783 - RNA, 22 nt, Human
uuacagugagggugacauuuac

SEQ ID NO: 660784 - RNA, 22 nt, Human
uguaugccuuuuucuguuguaa

SEQ ID NO: 660785 - RNA, 22 nt, Human
cucuucaguaaaugacacuguu

SEQ ID NO: 660786 - RNA, 22 nt, Human
cccuggaggucagaggccuggg

SEQ ID NO: 660787 - RNA, 18 nt, Human
cugugcagcaaacugagc

SEQ ID NO: 660788 - RNA, 22 nt, Human
uggauuuaacagaauaccaggu

SEQ ID NO: 660789 - RNA, 22 nt, Human
aguaucuucaaguuucuucuag

SEQ ID NO: 660790 - RNA, 22 nt, Human
agccagggaugcagcacaguga

SEQ ID NO: 660791 - RNA, 22 nt, Human
ccacuguauaagcaaaaugaaa

SEQ ID NO: 660792 - RNA, 22 nt, Human
gaucucuguggacucuuagcac

SEQ ID NO: 660793 - RNA, 22 nt, Human
acuggacuccccaagggccagg

SEQ ID NO: 660794 - RNA, 23 nt, Human
ucagucuuggcuucugauuuucc

SEQ ID NO: 660795 - RNA, 22 nt, Human
ugaggcuccagccaggccagca

SEQ ID NO: 660796 - RNA, 22 nt, Human
gagcccugcuuccaagggggca

SEQ ID NO: 660797 - RNA, 22 nt, Human
gcagagaagaugcccaggcuuc

SEQ ID NO: 660798 - RNA, 22 nt, Human
cuuuacauuaauuucuacugau

SEQ ID NO: 660799 - RNA, 22 nt, Human
gaggccucugucccgccaggga

SEQ ID NO: 660800 - RNA, 22 nt, Human
cggcuggagcuuugaaccugau

SEQ ID NO: 660801 - RNA, 22 nt, Human
uaaauguguguagccaucugug

SEQ ID NO: 660802 - RNA, 22 nt, Human
agaggcacaaacuggaaaggac

SEQ ID NO: 660803 - RNA, 22 nt, Human
caggaggcaucauggagcggac

SEQ ID NO: 660804 - RNA, 22 nt, Human
ucugagcugggcacagaaggcg

SEQ ID NO: 660805 - RNA, 22 nt, Human
ucugccaguuuauagacaagcc

SEQ ID NO: 660806 - RNA, 19 nt, Human
ugcuucuggaaccaugauc

SEQ ID NO: 660807 - RNA, 22 nt, Human
uaaaugugaccuucauuuuaua

SEQ ID NO: 660808 - RNA, 22 nt, Human
uagauucuuugcuagaucauug

SEQ ID NO: 660809 - RNA, 22 nt, Human
augaggcagcacaugggauugu

SEQ ID NO: 660810 - RNA, 22 nt, Human
gacauuuagaagucuaauggcc

SEQ ID NO: 660811 - RNA, 22 nt, Human
uaacaagucauuuuaaauuaug

SEQ ID NO: 660812 - RNA, 22 nt, Human
gaggcaaggccgcacgucucag

SEQ ID NO: 660813 - RNA, 22 nt, Human
uuugugcagugguuaagaccau

SEQ ID NO: 660814 - RNA, 19 nt, Human
ccaaaggaaguuucccucc

SEQ ID NO: 660815 - RNA, 22 nt, Human
cuccagagucacacugccuggg

SEQ ID NO: 660816 - RNA, 22 nt, Human
ucagugucuugaccugggugug

SEQ ID NO: 660817 - RNA, 18 nt, Human
agcucucccccacaugcc

SEQ ID NO: 660818 - RNA, 22 nt, Human
gacugugacuucugaagcaaua

SEQ ID NO: 660819 - RNA, 22 nt, Human
acuguuuaggaggcuuauaugc

SEQ ID NO: 660820 - RNA, 22 nt, Human
ggcgagggagcagugcgguggg

SEQ ID NO: 660821 - RNA, 22 nt, Human
ugcuggaagcuccugcaugucu

SEQ ID NO: 660822 - RNA, 22 nt, Human
acuggaugaggggaaagagaca

SEQ ID NO: 660823 - RNA, 22 nt, Human
uaauaguugugacuuuguaaag

SEQ ID NO: 660824 - RNA, 22 nt, Human
uguggcagaacugggacucaaa

SEQ ID NO: 660825 - RNA, 22 nt, Human
uacugcaugguggaguggagcu

SEQ ID NO: 660826 - RNA, 22 nt, Human
auuuugacagaagaggcccuaa

SEQ ID NO: 660827 - RNA, 20 nt, Human
agacagaaucagagauaaag

SEQ ID NO: 660828 - RNA, 22 nt, Human
aacacuuuccugccuuucugau

SEQ ID NO: 660829 - RNA, 22 nt, Human
ggaaggaagugcagacuuuaaa

SEQ ID NO: 660830 - RNA, 22 nt, Human
aagcagugaugcauacagcugu

SEQ ID NO: 660831 - RNA, 22 nt, Human
cggcuucaaagggagcgagauc

SEQ ID NO: 660832 - RNA, 22 nt, Human
ucuaugcuugagacagaugggg

SEQ ID NO: 660833 - RNA, 22 nt, Human
aacagcuaguggucuagacuuu

SEQ ID NO: 660834 - RNA, 22 nt, Human
acaaugcaccuauuuuaaaacu

SEQ ID NO: 660835 - RNA, 22 nt, Human
uguccuggguggaugcuucauu

SEQ ID NO: 660836 - RNA, 22 nt, Human
cagcuucuggcguggagccuga

SEQ ID NO: 660837 - RNA, 21 nt, Human
ucacuuauaauguauuugcug

SEQ ID NO: 660838 - RNA, 22 nt, Human
gcuuuuucaaaugaaagcuggu

SEQ ID NO: 660839 - RNA, 22 nt, Human
acaugauuaaaagauuuuaaag

SEQ ID NO: 660840 - RNA, 20 nt, Human
ugcugucguguuuucugcuu

SEQ ID NO: 660841 - RNA, 22 nt, Human
aggcauggcauggggcagaugu

SEQ ID NO: 660842 - RNA, 22 nt, Human
uccugagugagagcugggaggu

SEQ ID NO: 660843 - RNA, 22 nt, Human
ccaagcaugggguucaguagga

SEQ ID NO: 660844 - RNA, 22 nt, Human
uuuugugaauaguuuaucuaag

SEQ ID NO: 660845 - RNA, 22 nt, Human
ggcaggagggcggacaaugacc

SEQ ID NO: 660846 - RNA, 22 nt, Human
caagggaauugugugugagagg

SEQ ID NO: 660847 - RNA, 22 nt, Human
ugcuggccaauggcagaggcgg

SEQ ID NO: 660848 - RNA, 22 nt, Human
uucaaaggaaaggcagugucaa

SEQ ID NO: 660849 - RNA, 22 nt, Human
cagugaggaagcugucuggacc

SEQ ID NO: 660850 - RNA, 22 nt, Human
aggaaaggccucagcagaaacc

SEQ ID NO: 660851 - RNA, 22 nt, Human
uauacuuuccugcaacuuugau

SEQ ID NO: 660852 - RNA, 22 nt, Human
gauggcuuugaggaauuugaau

SEQ ID NO: 660853 - RNA, 22 nt, Human
ccuggaccaaacacuggccugg

SEQ ID NO: 660854 - RNA, 22 nt, Human
aggcagcuuuaacugguaguag

SEQ ID NO: 660855 - RNA, 23 nt, Human
auggaaauagcaugugucauuua

SEQ ID NO: 660856 - RNA, 22 nt, Human
cuccagucucuuucggagacac

SEQ ID NO: 660857 - RNA, 21 nt, Human
ugcagccauucagcccuaugc

SEQ ID NO: 660858 - RNA, 22 nt, Human
cugucuguggagcuucugaugu

SEQ ID NO: 660859 - RNA, 22 nt, Human
cugaagccaguuugcugcccuu

SEQ ID NO: 660860 - RNA, 21 nt, Human
ucugugcuuuuuuggcuccua

SEQ ID NO: 660861 - RNA, 22 nt, Human
uagugcuugguggagauggaga

SEQ ID NO: 660862 - RNA, 22 nt, Human
caugcucuccauuggacacaga

SEQ ID NO: 660863 - RNA, 22 nt, Human
uaguguaaugacauuuagacga

SEQ ID NO: 660864 - RNA, 20 nt, Human
agcagcuguguuuucauccu

SEQ ID NO: 660865 - RNA, 22 nt, Human
uugcugagagcgugucaacaag

SEQ ID NO: 660866 - RNA, 22 nt, Human
acauuuagcuguacaaucuaug

SEQ ID NO: 660867 - RNA, 22 nt, Human
aaggcacugacugugcagggga

SEQ ID NO: 660868 - RNA, 22 nt, Human
agcgcaggaacacgucugccuu

SEQ ID NO: 660869 - RNA, 22 nt, Human
uuucauaugggcauuggcaaua

SEQ ID NO: 660870 - RNA, 22 nt, Human
gcugggucccaagccuggggag

SEQ ID NO: 660871 - RNA, 22 nt, Human
cacugaagccugggaguaagac

SEQ ID NO: 660872 - RNA, 22 nt, Human
agagcuguuuauugaugucaca

SEQ ID NO: 660873 - RNA, 22 nt, Human
auucacugucagcuugcauggg

SEQ ID NO: 660874 - RNA, 22 nt, Human
gaugauggacaaagcauuggug

SEQ ID NO: 660875 - RNA, 22 nt, Human
gcagcugggucugugugggcug

SEQ ID NO: 660876 - RNA, 22 nt, Human
ugcuuucuuuagcuccugaguc

SEQ ID NO: 660877 - RNA, 22 nt, Human
gagauucuauguuguugauuau

SEQ ID NO: 660878 - RNA, 22 nt, Human
gggcuucucuuaugcuaacugg

SEQ ID NO: 660879 - RNA, 22 nt, Human
aguucucuggcuccuuuccaga

SEQ ID NO: 660880 - RNA, 22 nt, Human
uggagcauacuaacccacucug

SEQ ID NO: 660881 - RNA, 22 nt, Human
uguuuugcuucucuguuuccca

SEQ ID NO: 660882 - RNA, 22 nt, Human
uccaggcccacucagcugaaau

SEQ ID NO: 660883 - RNA, 22 nt, Human
uucacugugaacucauauucag

SEQ ID NO: 660884 - RNA, 22 nt, Human
cagaugaaguaggugacgagca

SEQ ID NO: 660885 - RNA, 21 nt, Human
uugcauuuuaaguuuacugcu

SEQ ID NO: 660886 - RNA, 22 nt, Human
acagagcaugauggaagaucga

SEQ ID NO: 660887 - RNA, 22 nt, Human
acaguguucuugauauuacagu

SEQ ID NO: 660888 - RNA, 22 nt, Human
uuucuaagaaaguaaugguuau

SEQ ID NO: 660889 - RNA, 22 nt, Human
caaaugaagaaccuucucaccu

SEQ ID NO: 660890 - RNA, 22 nt, Human
aguuugauuguauggguuuuaa

SEQ ID NO: 660891 - RNA, 22 nt, Human
aucaaaguaauuaacacugaga

SEQ ID NO: 660892 - RNA, 22 nt, Human
uacuguacugucuuuuuugcug

SEQ ID NO: 660893 - RNA, 22 nt, Human
ggaaggagucuuuaacacccau

SEQ ID NO: 660894 - RNA, 22 nt, Human
auucuaagcacgcugaagucuu

SEQ ID NO: 660895 - RNA, 22 nt, Human
caugaauauacauccugauggc

SEQ ID NO: 660896 - RNA, 22 nt, Human
uuuacaaggaucaagggaucuc

SEQ ID NO: 660897 - RNA, 22 nt, Human
caggaaauaaaaaguaucuucu

SEQ ID NO: 660898 - RNA, 18 nt, Human
auggcuccagugucuucc

SEQ ID NO: 660899 - RNA, 22 nt, Human
gaauacaaagcagaacucauac

SEQ ID NO: 660900 - RNA, 22 nt, Human
aucugguuuggggauccuugug

SEQ ID NO: 660901 - RNA, 22 nt, Human
uccugcagacauuuacaccuuu

SEQ ID NO: 660902 - RNA, 20 nt, Human
ggggggcuucagggccugug

SEQ ID NO: 660903 - RNA, 22 nt, Human
uggcugaguuucaugcaucaug

SEQ ID NO: 660904 - RNA, 22 nt, Human
ggucagaggucacaagcuggca

SEQ ID NO: 660905 - RNA, 22 nt, Human
gcugucuccauagcuguguguc

SEQ ID NO: 660906 - RNA, 22 nt, Human
cagcuucugagcaagccagggg

SEQ ID NO: 660907 - RNA, 22 nt, Human
uaagacacauuggaguagauga

SEQ ID NO: 660908 - RNA, 22 nt, Human
uugcaaaucagaaguauagauu

SEQ ID NO: 660909 - RNA, 22 nt, Human
aagaggaguagaugugguuggu

SEQ ID NO: 660910 - RNA, 22 nt, Human
uagagacaccaguaccauucug

SEQ ID NO: 660911 - RNA, 22 nt, Human
uccaguggugguuugaagggca

SEQ ID NO: 660912 - RNA, 22 nt, Human
auugacaaauggauguugacau

SEQ ID NO: 660913 - RNA, 22 nt, Human
uguuuaauaauucuaugauagu

SEQ ID NO: 660914 - RNA, 22 nt, Human
cagggcugaaaucaagguguag

SEQ ID NO: 660915 - RNA, 22 nt, Human
augcauauggcuugagggaaua

SEQ ID NO: 660916 - RNA, 22 nt, Human
aaggaggccuggcagaugaaga

SEQ ID NO: 660917 - RNA, 22 nt, Human
gaagaacacuucaugauucauu

SEQ ID NO: 660918 - RNA, 22 nt, Human
cauggaggacccucagggagcu

SEQ ID NO: 660919 - RNA, 22 nt, Human
guuucucuuaacacauaaagua

SEQ ID NO: 660920 - RNA, 22 nt, Human
agguucuuggugagcauuuggu

SEQ ID NO: 660921 - RNA, 22 nt, Human
aaguacuucuagauggauaauc

SEQ ID NO: 660922 - RNA, 22 nt, Human
ucaaugaugcugaagguagcgu

SEQ ID NO: 660923 - RNA, 22 nt, Human
ccugaggggcugcaggccagcu

SEQ ID NO: 660924 - RNA, 22 nt, Human
uucuucuucaagugcugcauuc

SEQ ID NO: 660925 - RNA, 22 nt, Human
cucccaggcagggcugcccacu

SEQ ID NO: 660926 - RNA, 22 nt, Human
cuugagaagcauuaagagguag

SEQ ID NO: 660927 - RNA, 23 nt, Human
cugcuguguuggucucgauggga

SEQ ID NO: 660928 - RNA, 22 nt, Human
ugauacagucagcucacaauug

SEQ ID NO: 660929 - RNA, 22 nt, Human
aaaauucauuccucagacugcc

SEQ ID NO: 660930 - RNA, 22 nt, Human
acugggcucauaaugucauaga

SEQ ID NO: 660931 - RNA, 22 nt, Human
agcagcagcucaguucucagcu

SEQ ID NO: 660932 - RNA, 22 nt, Human
ugggccucaugcccagccaccc

SEQ ID NO: 660933 - RNA, 22 nt, Human
ugggauagauugauggauagag

SEQ ID NO: 660934 - RNA, 22 nt, Human
ccuggagcaucaggaggaaggg

SEQ ID NO: 660935 - RNA, 22 nt, Human
guaaauauuaaaggcugcuaga

SEQ ID NO: 660936 - RNA, 21 nt, Human
uagggcucuauuuuuauuuca

SEQ ID NO: 660937 - RNA, 22 nt, Human
agaugugguaguugaagggaag

SEQ ID NO: 660938 - RNA, 20 nt, Human
guauaagauuucacacauua

SEQ ID NO: 660939 - RNA, 22 nt, Human
uuuucuaagggaaacguccucc

SEQ ID NO: 660940 - RNA, 22 nt, Human
caugcaaagcguuuugaccagc

SEQ ID NO: 660941 - RNA, 22 nt, Human
ugccagugcuugugucugagca

SEQ ID NO: 660942 - RNA, 22 nt, Human
gucuuauugcguauguauacaa

SEQ ID NO: 660943 - RNA, 22 nt, Human
agugagggaugaagaacugcgg

SEQ ID NO: 660944 - RNA, 20 nt, Human
ucuucagaugcuuuuggagu

SEQ ID NO: 660945 - RNA, 20 nt, Human
agcccuguuuccuggagaga

SEQ ID NO: 660946 - RNA, 22 nt, Human
gcaagaccuaucuaguugcugu

SEQ ID NO: 660947 - RNA, 22 nt, Human
aaggucuguauuagaguuucau

SEQ ID NO: 660948 - RNA, 23 nt, Human
accugcuccaugucaccuucacu

SEQ ID NO: 660949 - RNA, 22 nt, Human
uaacuuuaguguaugagguaag

SEQ ID NO: 660950 - RNA, 22 nt, Human
acaguuuaggaugagagaacac

SEQ ID NO: 660951 - RNA, 22 nt, Human
agccucugaugaucacaggggg

SEQ ID NO: 660952 - RNA, 22 nt, Human
aggaggggcauagaaauguaau

SEQ ID NO: 660953 - RNA, 22 nt, Human
caggaacccccacucucagcuc

SEQ ID NO: 660954 - RNA, 22 nt, Human
uaggguccugccuacagagaca

SEQ ID NO: 660955 - RNA, 22 nt, Human
cugcaggacagggaggagcaag

SEQ ID NO: 660956 - RNA, 22 nt, Human
uagcagggagggccagugucaa

SEQ ID NO: 660957 - RNA, 22 nt, Human
gugcauuuggugacucucaccc

SEQ ID NO: 660958 - RNA, 22 nt, Human
cagagaaagacuugcccuuagu

SEQ ID NO: 660959 - RNA, 22 nt, Human
gcuucucgggccugaugucguc

SEQ ID NO: 660960 - RNA, 22 nt, Human
agccugucugucuccaaagcug

SEQ ID NO: 660961 - RNA, 22 nt, Human
ggcagccauggacacuggcuag

SEQ ID NO: 660962 - RNA, 22 nt, Human
uuaguucacugcuauaucauca

SEQ ID NO: 660963 - RNA, 17 nt, Human
cgggcauggagggcagg

SEQ ID NO: 660964 - RNA, 22 nt, Human
gucacaguguaucucuucagcu

SEQ ID NO: 660965 - RNA, 22 nt, Human
ggcuccagaaaucauagagcag

SEQ ID NO: 660966 - RNA, 22 nt, Human
ugucacaccucguuuagcauuc

SEQ ID NO: 660967 - RNA, 22 nt, Human
uugcagcauauugaucuccugu

SEQ ID NO: 660968 - RNA, 22 nt, Human
uaccuugggcuauuaucuuuga

SEQ ID NO: 660969 - RNA, 22 nt, Human
gcugaagauaagugaagaggcu

SEQ ID NO: 660970 - RNA, 22 nt, Human
ggcagguggacgugcuaaagcu

SEQ ID NO: 660971 - RNA, 22 nt, Human
cagaggaagggugcugcgaaag

SEQ ID NO: 660972 - RNA, 22 nt, Human
guucaaaucucaggacuucaga

SEQ ID NO: 660973 - RNA, 22 nt, Human
agcccaagcuaugaggugaccu

SEQ ID NO: 660974 - RNA, 22 nt, Human
cucagacuugcuuuuuauggaa

SEQ ID NO: 660975 - RNA, 22 nt, Human
ucuguaguagguuguaguucuu

SEQ ID NO: 660976 - RNA, 21 nt, Human
ucccuugggaaacuuucuuga

SEQ ID NO: 660977 - RNA, 22 nt, Human
acucaggcuagggaaaaagugg

SEQ ID NO: 660978 - RNA, 22 nt, Human
caggagguugguagcaguagau

SEQ ID NO: 660979 - RNA, 22 nt, Human
ggagggagagugacccuaccaa

SEQ ID NO: 660980 - RNA, 22 nt, Human
cuggccagcauggcugaaguac

SEQ ID NO: 660981 - RNA, 22 nt, Human
caguagaauuauuauaaaacau

SEQ ID NO: 660982 - RNA, 21 nt, Human
ucuuccugcuccacacucccc

SEQ ID NO: 660983 - RNA, 22 nt, Human
ccacuggcaguuggcuagccuu

SEQ ID NO: 660984 - RNA, 18 nt, Human
ucuguccuuccauucuuc

SEQ ID NO: 660985 - RNA, 22 nt, Human
uaauugcuguauagauugucau

SEQ ID NO: 660986 - RNA, 22 nt, Human
auguuucuaguuguaugucacu

SEQ ID NO: 660987 - RNA, 17 nt, Human
uauguguguuugcagca

SEQ ID NO: 660988 - RNA, 22 nt, Human
uuucuaaucugauucuccuacc

SEQ ID NO: 660989 - RNA, 22 nt, Human
cugaaggaagcagguggccugu

SEQ ID NO: 660990 - RNA, 22 nt, Human
uucuuacaaguauuccaggucc

SEQ ID NO: 660991 - RNA, 21 nt, Human
uucuaacugggugggccuuga

SEQ ID NO: 660992 - RNA, 22 nt, Human
ucuggagaggggccuagaauuu

SEQ ID NO: 660993 - RNA, 22 nt, Human
uuacauguauuuuggaaaaagu

SEQ ID NO: 660994 - RNA, 22 nt, Human
gguggcugaaucaaaucaggcc

SEQ ID NO: 660995 - RNA, 22 nt, Human
ucuguugcaaugugcaugguga

SEQ ID NO: 660996 - RNA, 22 nt, Human
aacucaguuacauauuagaaua

SEQ ID NO: 660997 - RNA, 22 nt, Human
gucaggacaggcucuggacuga

SEQ ID NO: 660998 - RNA, 22 nt, Human
aaaggcuggauucagagaggug

SEQ ID NO: 660999 - RNA, 23 nt, Human
uauuccugguaagccugucacug

SEQ ID NO: 661000 - RNA, 22 nt, Human
guggccaggccgacugccaggc

SEQ ID NO: 661001 - RNA, 22 nt, Human
aagagguuauuguucccagcuu

SEQ ID NO: 661002 - RNA, 21 nt, Human
agacaacugugacuauucccu

SEQ ID NO: 661003 - RNA, 22 nt, Human
uccuggaguaggccuuagccau

SEQ ID NO: 661004 - RNA, 22 nt, Human
gcagggcugggauuugagccca

SEQ ID NO: 661005 - RNA, 19 nt, Human
agcucaggcccaucguccc

SEQ ID NO: 661006 - RNA, 22 nt, Human
uuauucuuuucuccagaauccc

SEQ ID NO: 661007 - RNA, 22 nt, Human
gauauuuucgcagggagaauuc

SEQ ID NO: 661008 - RNA, 22 nt, Human
agcugaaaggguguuggagugu

SEQ ID NO: 661009 - RNA, 22 nt, Human
ccuggcugccgagugugcagcg

SEQ ID NO: 661010 - RNA, 22 nt, Human
uucaguauucaaauaugucuua

SEQ ID NO: 661011 - RNA, 22 nt, Human
cuccccacacacuaggccugau

SEQ ID NO: 661012 - RNA, 18 nt, Human
cugccccuucucugagau

SEQ ID NO: 661013 - RNA, 22 nt, Human
ucauccauccucgccuuugcuu

SEQ ID NO: 661014 - RNA, 22 nt, Human
auacagcagugaauaagauaaa

SEQ ID NO: 661015 - RNA, 22 nt, Human
gaaguuaccgaaccucuccaug

SEQ ID NO: 661016 - RNA, 22 nt, Human
ugucaccacuggcugaaacacc

SEQ ID NO: 661017 - RNA, 19 nt, Human
uugaaauuguuugauaugg

SEQ ID NO: 661018 - RNA, 22 nt, Human
gccagcauccugguggugguug

SEQ ID NO: 661019 - RNA, 22 nt, Human
caagggaaggcuaagggcaaca

SEQ ID NO: 661020 - RNA, 22 nt, Human
augacacuguccuaguaaggaa

SEQ ID NO: 661021 - RNA, 22 nt, Human
ccagcuuuuagugggcuuauua

SEQ ID NO: 661022 - RNA, 22 nt, Human
gaauuuuagaauaugugggcuu

SEQ ID NO: 661023 - RNA, 22 nt, Human
uugaaacagacaaguaaauguc

SEQ ID NO: 661024 - RNA, 22 nt, Human
cagagagggcggcccuggcuuc

SEQ ID NO: 661025 - RNA, 22 nt, Human
auucaguuaaaaacuguacuuc

SEQ ID NO: 661026 - RNA, 22 nt, Human
uacaaugauuagcuaacuugcc

SEQ ID NO: 661027 - RNA, 22 nt, Human
gacauaaaugaaguuugacuau

SEQ ID NO: 661028 - RNA, 22 nt, Human
gaagggcuuucugggagaagag

SEQ ID NO: 661029 - RNA, 22 nt, Human
aucucuucccaacuccacauuc

SEQ ID NO: 661030 - RNA, 22 nt, Human
ucugagagccucuagccuaagu

SEQ ID NO: 661031 - RNA, 18 nt, Human
cugggucuccaggcugcc

SEQ ID NO: 661032 - RNA, 22 nt, Human
ggcccaguguggguggauguug

SEQ ID NO: 661033 - RNA, 22 nt, Human
ugcuugcaagagaugcaaugac

SEQ ID NO: 661034 - RNA, 22 nt, Human
uuuacuucugcauuuccccuag

SEQ ID NO: 661035 - RNA, 22 nt, Human
ugcaggcauuggugagagaagc

SEQ ID NO: 661036 - RNA, 19 nt, Human
auacaugcauuuacaugcu

SEQ ID NO: 661037 - RNA, 22 nt, Human
gaaagugcagucagacaaggca

SEQ ID NO: 661038 - RNA, 22 nt, Human
uauuucugaggcccaggaagug

SEQ ID NO: 661039 - RNA, 22 nt, Human
ucaaacaggacuacauucucau

SEQ ID NO: 661040 - RNA, 22 nt, Human
caaugauucugcaacugugugc

SEQ ID NO: 661041 - RNA, 22 nt, Human
cagccacuugugaugcugggga

SEQ ID NO: 661042 - RNA, 20 nt, Human
uccugcuuccaccagagcac

SEQ ID NO: 661043 - RNA, 22 nt, Human
ccugccuggggacaaaggaggg

SEQ ID NO: 661044 - RNA, 22 nt, Human
uucacaacugccauagccagug

SEQ ID NO: 661045 - RNA, 22 nt, Human
cccugcuaguccuuccuuggcu

SEQ ID NO: 661046 - RNA, 22 nt, Human
gcagcagcaggcgcucggccgu

SEQ ID NO: 661047 - RNA, 22 nt, Human
gagugucuguauuuugggcaag

SEQ ID NO: 661048 - RNA, 22 nt, Human
ucuccucuacugggucugcaga

SEQ ID NO: 661049 - RNA, 20 nt, Human
uuucacaaugaacaugucuc

SEQ ID NO: 661050 - RNA, 22 nt, Human
cacaagauggucacauaagugc

SEQ ID NO: 661051 - RNA, 22 nt, Human
cugagccagcuggcaugugcua

SEQ ID NO: 661052 - RNA, 22 nt, Human
uaguacaguuuuggcacaugga

SEQ ID NO: 661053 - RNA, 22 nt, Human
ucaggcaguagaauugcuugaa

SEQ ID NO: 661054 - RNA, 22 nt, Human
uagaugcuguagaaauacuuau

SEQ ID NO: 661055 - RNA, 22 nt, Human
uaaaugaguaauauagcuguuu

SEQ ID NO: 661056 - RNA, 22 nt, Human
uucagcucugcuagcucugugc

SEQ ID NO: 661057 - RNA, 22 nt, Human
agauacuaagcauuuccagcac

SEQ ID NO: 661058 - RNA, 22 nt, Human
uacauuagcucaucuauuuauu

SEQ ID NO: 661059 - RNA, 22 nt, Human
uaggaaaucagagaaagaggug

SEQ ID NO: 661060 - RNA, 22 nt, Human
ccacagggauaggaauggggcu

SEQ ID NO: 661061 - RNA, 22 nt, Human
gcuccucccugugcagacccag

SEQ ID NO: 661062 - RNA, 22 nt, Human
aggcugugauuccaccacucuc

SEQ ID NO: 661063 - RNA, 22 nt, Human
acuucaguaggugauaugugca

SEQ ID NO: 661064 - RNA, 23 nt, Human
aagaguuuagagucuugcagagu

SEQ ID NO: 661065 - RNA, 22 nt, Human
gcuccagggacccaagagaaaa

SEQ ID NO: 661066 - RNA, 21 nt, Human
uuugaaagcuacaucuauagc

SEQ ID NO: 661067 - RNA, 22 nt, Human
guggaugaugagugacuacaga

SEQ ID NO: 661068 - RNA, 22 nt, Human
cauucacaucuuguuccaucac

SEQ ID NO: 661069 - RNA, 22 nt, Human
cagcugaguuuccaagucugcc

SEQ ID NO: 661070 - RNA, 22 nt, Human
cacuguacccauuuaaauaaau

SEQ ID NO: 661071 - RNA, 22 nt, Human
gucagcuaugucuguuguugag

SEQ ID NO: 661072 - RNA, 22 nt, Human
gcuguggucccucuguccucau

SEQ ID NO: 661073 - RNA, 22 nt, Human
aaaaucaguacacuuuauuuug

SEQ ID NO: 661074 - RNA, 22 nt, Human
agaggaggcuggguccagauaa

SEQ ID NO: 661075 - RNA, 22 nt, Human
cacugcuuucacaguuuguucc

SEQ ID NO: 661076 - RNA, 22 nt, Human
gccacccccaaguagguggucu

SEQ ID NO: 661077 - RNA, 22 nt, Human
ccuucucucugaagaccccaaa

SEQ ID NO: 661078 - RNA, 22 nt, Human
auuugcauaauagugauuugua

SEQ ID NO: 661079 - RNA, 22 nt, Human
gggccugacugagagcuccuca

SEQ ID NO: 661080 - RNA, 22 nt, Human
agggaaggaggccauguguccc

SEQ ID NO: 661081 - RNA, 22 nt, Human
aguggggucuccuccagccccc

SEQ ID NO: 661082 - RNA, 23 nt, Human
agguucaggagauggaggaacaa

SEQ ID NO: 661083 - RNA, 19 nt, Human
uuacaucugcaacacuggu

SEQ ID NO: 661084 - RNA, 22 nt, Human
cgacccuacagacagugcugag

SEQ ID NO: 661085 - RNA, 22 nt, Human
uaaacucuucuguagaaucaga

SEQ ID NO: 661086 - RNA, 22 nt, Human
uguggggguacacguacacaug

SEQ ID NO: 661087 - RNA, 22 nt, Human
aaagacucuuaacucccuagcg

SEQ ID NO: 661088 - RNA, 22 nt, Human
uggccacuuggcaugugugcca

SEQ ID NO: 661089 - RNA, 22 nt, Human
aaucacaaauuuagacagagcu

SEQ ID NO: 661090 - RNA, 22 nt, Human
uugucugacuucuuuaguuacu

SEQ ID NO: 661091 - RNA, 22 nt, Human
gggcagcuggccagguauucug

SEQ ID NO: 661092 - RNA, 22 nt, Human
auguggcuuucugcguuuucuc

SEQ ID NO: 661093 - RNA, 22 nt, Human
cugcccaaauccuucuuccucu

SEQ ID NO: 661094 - RNA, 23 nt, Human
uuggaagccagacagcugugcag

SEQ ID NO: 661095 - RNA, 22 nt, Human
aagcugccuuccaugugaggaa

SEQ ID NO: 661096 - RNA, 22 nt, Human
uuuaucaaacaaauuauccagc

SEQ ID NO: 661097 - RNA, 22 nt, Human
gcccaugggccugaggcccuag

SEQ ID NO: 661098 - RNA, 22 nt, Human
gaauaagugaaguuggcagcuu

SEQ ID NO: 661099 - RNA, 22 nt, Human
uauccuuguacuauaguauuua

SEQ ID NO: 661100 - RNA, 22 nt, Human
accuagaauuuaaaacauugcu

SEQ ID NO: 661101 - RNA, 22 nt, Human
acaguagaguaaaugguuagau

SEQ ID NO: 661102 - RNA, 22 nt, Human
gcagcugucacuuucacaaugc

SEQ ID NO: 661103 - RNA, 22 nt, Human
gucuggaaccaagacguguagc

SEQ ID NO: 661104 - RNA, 22 nt, Human
gcccaagcuggacugcaguggc

SEQ ID NO: 661105 - RNA, 22 nt, Human
ccuucagccuagaacuugagag

SEQ ID NO: 661106 - RNA, 22 nt, Human
agggcucauugacauggaaaag

SEQ ID NO: 661107 - RNA, 22 nt, Human
ccugucugaggaggugcucuuu

SEQ ID NO: 661108 - RNA, 22 nt, Human
cuggagguaauguuauuuuugu

SEQ ID NO: 661109 - RNA, 22 nt, Human
ggccucuguuuggagccaggau

SEQ ID NO: 661110 - RNA, 22 nt, Human
uccaggagggauugggcugugg

SEQ ID NO: 661111 - RNA, 22 nt, Human
uaagugaauauuuucuucugua

SEQ ID NO: 661112 - RNA, 22 nt, Human
ugguggggccagacuucagcuc

SEQ ID NO: 661113 - RNA, 22 nt, Human
cccagacuccucuggcuggugg

SEQ ID NO: 661114 - RNA, 22 nt, Human
aggcagguguuaccucugguuu

SEQ ID NO: 661115 - RNA, 22 nt, Human
acucacuucuuuuacuauaaaa

SEQ ID NO: 661116 - RNA, 22 nt, Human
cgggggaguugaggcacauggg

SEQ ID NO: 661117 - RNA, 22 nt, Human
caugggcuuuggaggcuggagg

SEQ ID NO: 661118 - RNA, 21 nt, Human
cccagggaagccgcagucacc

SEQ ID NO: 661119 - RNA, 22 nt, Human
uugauucauuuauugagugccu

SEQ ID NO: 661120 - RNA, 23 nt, Human
cuguggcaaguccugcaccugcc

SEQ ID NO: 661121 - RNA, 22 nt, Human
caugcauagcuuuggagcuagg

SEQ ID NO: 661122 - RNA, 22 nt, Human
uuuggaguuuaacaacuugaag

SEQ ID NO: 661123 - RNA, 22 nt, Human
acaaggcugcugugauugggaa

SEQ ID NO: 661124 - RNA, 22 nt, Human
gggcuuuaaucuuguuaacuag

SEQ ID NO: 661125 - RNA, 22 nt, Human
uguagcacagagcuuugacacu

SEQ ID NO: 661126 - RNA, 22 nt, Human
acacuaaugagaaaggaauuaa

SEQ ID NO: 661127 - RNA, 22 nt, Human
ugcauaaaauaugagaaaugua

SEQ ID NO: 661128 - RNA, 22 nt, Human
caggcucccacccuccugcagc

SEQ ID NO: 661129 - RNA, 22 nt, Human
ugagguggccgaggagcaggac

SEQ ID NO: 661130 - RNA, 22 nt, Human
aucuaggauuugaaugcacagu

SEQ ID NO: 661131 - RNA, 22 nt, Human
ccugggcuugcaucugugcugg

SEQ ID NO: 661132 - RNA, 22 nt, Human
aggcuggcuuggcucuccugug

SEQ ID NO: 661133 - RNA, 22 nt, Human
acacagcaacuugcaguaugga

SEQ ID NO: 661134 - RNA, 18 nt, Human
ggaaggugcuggagugca

SEQ ID NO: 661135 - RNA, 22 nt, Human
cagggucugaugguccucacuu

SEQ ID NO: 661136 - RNA, 22 nt, Human
aaauuguccuuuuaagaaacag

SEQ ID NO: 661137 - RNA, 22 nt, Human
cauguacaugccuacuaucaau

SEQ ID NO: 661138 - RNA, 22 nt, Human
uagguucaaguucaggcucuau

SEQ ID NO: 661139 - RNA, 22 nt, Human
aaguaggaauccgaaugaguag

SEQ ID NO: 661140 - RNA, 22 nt, Human
uuauaucagaaggugagauuga

SEQ ID NO: 661141 - RNA, 22 nt, Human
cugcuccacaccguccauacuc

SEQ ID NO: 661142 - RNA, 22 nt, Human
gaaccuguaaguauagaugugg

SEQ ID NO: 661143 - RNA, 22 nt, Human
cucuaggcugcccaggagcuga

SEQ ID NO: 661144 - RNA, 22 nt, Human
uccacagcacaaagccagugug

SEQ ID NO: 661145 - RNA, 22 nt, Human
ugagcugugauuaacucugaga

SEQ ID NO: 661146 - RNA, 22 nt, Human
ucaugucagcuguugaugugca

SEQ ID NO: 661147 - RNA, 22 nt, Human
aaacucuguugagauaauauuu

SEQ ID NO: 661148 - RNA, 22 nt, Human
gcugcucugggucugcccagcu

SEQ ID NO: 661149 - RNA, 22 nt, Human
uaggccaguggcagguugugug

SEQ ID NO: 661150 - RNA, 22 nt, Human
ugggaagggagaguguccugga

SEQ ID NO: 661151 - RNA, 22 nt, Human
agccaaggcagcuagagcucug

SEQ ID NO: 661152 - RNA, 18 nt, Human
gucauugcaacauacugu

SEQ ID NO: 661153 - RNA, 22 nt, Human
ugaaugugaugcuaaacauaug

SEQ ID NO: 661154 - RNA, 22 nt, Human
gagguggucgaggagggguacc

SEQ ID NO: 661155 - RNA, 22 nt, Human
uggcuacagauuugcugacaau

SEQ ID NO: 661156 - RNA, 22 nt, Human
ugucuccugggucccuuccacc

SEQ ID NO: 661157 - RNA, 22 nt, Human
uugagguccaggugugggcagg

SEQ ID NO: 661158 - RNA, 20 nt, Human
uuggcucaugcaacaccuac

SEQ ID NO: 661159 - RNA, 22 nt, Human
caguuaacuucauaugaucauu

SEQ ID NO: 661160 - RNA, 22 nt, Human
uaacaggcaaggucacaccuug

SEQ ID NO: 661161 - RNA, 22 nt, Human
ucacaauucagaaaccaaguag

SEQ ID NO: 661162 - RNA, 22 nt, Human
aggucugggauugaagacauca

SEQ ID NO: 661163 - RNA, 21 nt, Human
gacaggggccauggguuucua

SEQ ID NO: 661164 - RNA, 22 nt, Human
uccagcauauauagagaaugag

SEQ ID NO: 661165 - RNA, 22 nt, Human
caggcagagaacucauccguga

SEQ ID NO: 661166 - RNA, 22 nt, Human
guggcaguguggagggaggagu

SEQ ID NO: 661167 - RNA, 22 nt, Human
uacaguaucuucuggcaagcau

SEQ ID NO: 661168 - RNA, 22 nt, Human
aggcccugcccagagcuccucg

SEQ ID NO: 661169 - RNA, 22 nt, Human
gucuacuuuuuaaucuuggcag

SEQ ID NO: 661170 - RNA, 22 nt, Human
ucugauaaugugcuucgugacc

SEQ ID NO: 661171 - RNA, 22 nt, Human
cuuuuucugauguuccaugauu

SEQ ID NO: 661172 - RNA, 22 nt, Human
caguaugagaguugaaucaagg

SEQ ID NO: 661173 - RNA, 22 nt, Human
cagggagccugaauguuccagg

SEQ ID NO: 661174 - RNA, 21 nt, Human
cagcagaagcaucuauggaag

SEQ ID NO: 661175 - RNA, 22 nt, Human
uuucacagcugggaagagauau

SEQ ID NO: 661176 - RNA, 22 nt, Human
uuaguuaguggggcugucaguc

SEQ ID NO: 661177 - RNA, 22 nt, Human
uccugccugcaaucccagcacu

SEQ ID NO: 661178 - RNA, 22 nt, Human
ccagaugugagcagagccuuga

SEQ ID NO: 661179 - RNA, 20 nt, Human
cccagagguugcggcaggag

SEQ ID NO: 661180 - RNA, 18 nt, Human
ccucuggguuuuguuccc

SEQ ID NO: 661181 - RNA, 22 nt, Human
ugcugccuuugggaccuggccu

SEQ ID NO: 661182 - RNA, 22 nt, Human
caggacuggcucgcagugggug

SEQ ID NO: 661183 - RNA, 22 nt, Human
agaugacaaaucaggggacggg

SEQ ID NO: 661184 - RNA, 20 nt, Human
acaggagaucugaggaaagg

SEQ ID NO: 661185 - RNA, 22 nt, Human
ggaugggcccgggacggcgcug

SEQ ID NO: 661186 - RNA, 22 nt, Human
acagaggucaccuuuguaucuu

SEQ ID NO: 661187 - RNA, 22 nt, Human
aaucaggcacagcgacugcagc

SEQ ID NO: 661188 - RNA, 21 nt, Human
augggccagggauacagagag

SEQ ID NO: 661189 - RNA, 22 nt, Human
aaugaguucugacacuucacga

SEQ ID NO: 661190 - RNA, 19 nt, Human
uggcaugaugauggauggg

SEQ ID NO: 661191 - RNA, 22 nt, Human
aggcccaguagugcugccuuua

SEQ ID NO: 661192 - RNA, 17 nt, Human
ugaguuaaguuuagauc

SEQ ID NO: 661193 - RNA, 17 nt, Human
uccuccccgcaguugca

SEQ ID NO: 661194 - RNA, 22 nt, Human
ucccaggcuggcaggcagcagu

SEQ ID NO: 661195 - RNA, 22 nt, Human
cccucugccugggaccaagucc

SEQ ID NO: 661196 - RNA, 22 nt, Human
ggggaggcaagaugaagugagg

SEQ ID NO: 661197 - RNA, 22 nt, Human
ccaggagagcucuaaauggcug

SEQ ID NO: 661198 - RNA, 21 nt, Human
uaugugucuguggaaaacuag

SEQ ID NO: 661199 - RNA, 22 nt, Human
ggcuucgcagcucggcagccgc

SEQ ID NO: 661200 - RNA, 22 nt, Human
auccaaagcccuaaguuaacug

SEQ ID NO: 661201 - RNA, 22 nt, Human
cuuguauuaugguucgcuuagu

SEQ ID NO: 661202 - RNA, 22 nt, Human
uggugcaagucucugaggaggg

SEQ ID NO: 661203 - RNA, 22 nt, Human
ugccuuggauugcagggaaccu

SEQ ID NO: 661204 - RNA, 22 nt, Human
acuuuugaggacuuuauuguau

SEQ ID NO: 661205 - RNA, 19 nt, Human
agcagggacauggaacuuu

SEQ ID NO: 661206 - RNA, 22 nt, Human
aacuaaaggcuguugcagggaa

SEQ ID NO: 661207 - RNA, 22 nt, Human
ccuggagacgaggcuggaccau

SEQ ID NO: 661208 - RNA, 22 nt, Human
auguggcuuggcagggaauaug

SEQ ID NO: 661209 - RNA, 22 nt, Human
aaguccaguuucauuugagguc

SEQ ID NO: 661210 - RNA, 22 nt, Human
gaagagcuggaauccagucugg

SEQ ID NO: 661211 - RNA, 22 nt, Human
cucagacaucugaaauggguua

SEQ ID NO: 661212 - RNA, 23 nt, Human
gaggcagcuccugcagugcccug

SEQ ID NO: 661213 - RNA, 22 nt, Human
uuugggcaauucagugggaccu

SEQ ID NO: 661214 - RNA, 22 nt, Human
uguguauagguugugcuaauag

SEQ ID NO: 661215 - RNA, 22 nt, Human
guuucuguguuagaugagucuu

SEQ ID NO: 661216 - RNA, 23 nt, Human
ucucuguacagaugaggacacac

SEQ ID NO: 661217 - RNA, 22 nt, Human
cacagggcagguacucucagag

SEQ ID NO: 661218 - RNA, 23 nt, Human
agcaaugcugggagacucuguaa

SEQ ID NO: 661219 - RNA, 22 nt, Human
uuccaaaacaauauucugugaa

SEQ ID NO: 661220 - RNA, 22 nt, Human
uacaguagacaauguuaguaug

SEQ ID NO: 661221 - RNA, 22 nt, Human
cucugagaagccuugaugggga

SEQ ID NO: 661222 - RNA, 22 nt, Human
aauaacaggcucaucagaugcu

SEQ ID NO: 661223 - RNA, 22 nt, Human
uccuguggaagacaguguuggg

SEQ ID NO: 661224 - RNA, 22 nt, Human
ucaacacuauccaggcaaucuu

SEQ ID NO: 661225 - RNA, 22 nt, Human
auucuauuaauauuucuaggaa

SEQ ID NO: 661226 - RNA, 22 nt, Human
ugcaguggugguaaagaugcuc

SEQ ID NO: 661227 - RNA, 22 nt, Human
ccagagacaaggagcuggaguc

SEQ ID NO: 661228 - RNA, 22 nt, Human
ucagagucaacuguugccuguu

SEQ ID NO: 661229 - RNA, 22 nt, Human
guuuuguugcugcagagcucaa

SEQ ID NO: 661230 - RNA, 22 nt, Human
aguggguggcgcagaggaggaa

SEQ ID NO: 661231 - RNA, 22 nt, Human
caaacuuugcaaaacuuacagu

SEQ ID NO: 661232 - RNA, 22 nt, Human
gcauguggugcugaggcugucg

SEQ ID NO: 661233 - RNA, 22 nt, Human
uucaacaucuuggagcuggaac

SEQ ID NO: 661234 - RNA, 22 nt, Human
uuauggaagugcaaauugugug

SEQ ID NO: 661235 - RNA, 21 nt, Human
auguagugacuucauuccuuc

SEQ ID NO: 661236 - RNA, 22 nt, Human
ugacauuugagagagauauaca

SEQ ID NO: 661237 - RNA, 22 nt, Human
cauggacucugguuuggggagc

SEQ ID NO: 661238 - RNA, 22 nt, Human
cuauacaucccaauuucagaga

SEQ ID NO: 661239 - RNA, 22 nt, Human
gcucugugccccugccguggac

SEQ ID NO: 661240 - RNA, 22 nt, Human
ugggggucaggaugaggccuug

SEQ ID NO: 661241 - RNA, 22 nt, Human
gggcuggagccuggcggugguu

SEQ ID NO: 661242 - RNA, 21 nt, Human
aagggagauaggaaucaggcc

SEQ ID NO: 661243 - RNA, 22 nt, Human
gacuuuauuauaguggcaauag

SEQ ID NO: 661244 - RNA, 22 nt, Human
aaagucaugcaguugaacuuuu

SEQ ID NO: 661245 - RNA, 22 nt, Human
cuuuggcaaggguuuuaauugu

SEQ ID NO: 661246 - RNA, 22 nt, Human
gacccaggagugcagagagugg

SEQ ID NO: 661247 - RNA, 22 nt, Human
caggcucccacuuggcuuaaag

SEQ ID NO: 661248 - RNA, 22 nt, Human
uuccagauuucuacacaagacc

SEQ ID NO: 661249 - RNA, 22 nt, Human
gagcucuggcagggcaggucug

SEQ ID NO: 661250 - RNA, 22 nt, Human
gaacaacucuucuugagagaug

SEQ ID NO: 661251 - RNA, 22 nt, Human
auggccagcccuucccgcagcu

SEQ ID NO: 661252 - RNA, 22 nt, Human
gagcaacuucaauaguacuauu

SEQ ID NO: 661253 - RNA, 22 nt, Human
auucaaacaggaagaaaucauu

SEQ ID NO: 661254 - RNA, 22 nt, Human
uccuggccgcuggccccugaga

SEQ ID NO: 661255 - RNA, 22 nt, Human
cugagcuuggcuuaucuccagc

SEQ ID NO: 661256 - RNA, 22 nt, Human
acaaagcuuagaccuaagagau

SEQ ID NO: 661257 - RNA, 22 nt, Human
gagaccuggaggauguggaugg

SEQ ID NO: 661258 - RNA, 22 nt, Human
aaaugugacagaugcaguacag

SEQ ID NO: 661259 - RNA, 22 nt, Human
acaggaguucagaggacacccc

SEQ ID NO: 661260 - RNA, 22 nt, Human
accccuuuuauagaagaacaga

SEQ ID NO: 661261 - RNA, 22 nt, Human
acagugaugagccggcugaggc

SEQ ID NO: 661262 - RNA, 22 nt, Human
guuuaugaaugugucagacaua

SEQ ID NO: 661263 - RNA, 22 nt, Human
gccuuuggauauauucagggau

SEQ ID NO: 661264 - RNA, 22 nt, Human
aaaguguugggauuacaggugu

SEQ ID NO: 661265 - RNA, 17 nt, Human
gcccugccugcugcccu

SEQ ID NO: 661266 - RNA, 23 nt, Human
agggaagaaacaugaagggcugu

SEQ ID NO: 661267 - RNA, 21 nt, Human
ugaaugaucugguugccuuuu

SEQ ID NO: 661268 - RNA, 22 nt, Human
cccuguacagucucuguggcac

SEQ ID NO: 661269 - RNA, 22 nt, Human
aacacuuagauuuuuaagguuu

SEQ ID NO: 661270 - RNA, 22 nt, Human
ucucuguggcaagcaugcugcu

SEQ ID NO: 661271 - RNA, 22 nt, Human
uauguauagagucuuuuaaauu

SEQ ID NO: 661272 - RNA, 22 nt, Human
ggaggcucuugagaggggagua

SEQ ID NO: 661273 - RNA, 22 nt, Human
acagauaaggcaguuaagaguu

SEQ ID NO: 661274 - RNA, 22 nt, Human
uaccuuggguugaguucauucu

SEQ ID NO: 661275 - RNA, 22 nt, Human
gauuacauucuccuuguauuag

SEQ ID NO: 661276 - RNA, 22 nt, Human
aaggcaguuaauuuggcuagaa

SEQ ID NO: 661277 - RNA, 22 nt, Human
ggccugagucccaccuggcugu

SEQ ID NO: 661278 - RNA, 22 nt, Human
cucuggcuaucuguuucuaugu

SEQ ID NO: 661279 - RNA, 22 nt, Human
augugucauuauccagaauaac

SEQ ID NO: 661280 - RNA, 22 nt, Human
agggcccacaguuccuauggcc

SEQ ID NO: 661281 - RNA, 22 nt, Human
auuucuuaaaacuucagggaga

SEQ ID NO: 661282 - RNA, 22 nt, Human
gauacaaaauauaaauggagag

SEQ ID NO: 661283 - RNA, 21 nt, Human
aggaaaauugaggguuguugu

SEQ ID NO: 661284 - RNA, 20 nt, Human
ucagaacaguagaggagcua

SEQ ID NO: 661285 - RNA, 22 nt, Human
cugggagucaccaggagcaagg

SEQ ID NO: 661286 - RNA, 22 nt, Human
agacugaaauagugcacaccaa

SEQ ID NO: 661287 - RNA, 17 nt, Human
uggagcugcguguguuc

SEQ ID NO: 661288 - RNA, 22 nt, Human
acugaacagaccauuuuguccu

SEQ ID NO: 661289 - RNA, 22 nt, Human
augccaguaagucucagcuagg

SEQ ID NO: 661290 - RNA, 22 nt, Human
uugauaucucugcuguguuagg

SEQ ID NO: 661291 - RNA, 22 nt, Human
aagaggagacuucagcaacuug

SEQ ID NO: 661292 - RNA, 22 nt, Human
ucagccugcuccaagugcugcc

SEQ ID NO: 661293 - RNA, 22 nt, Human
gcugcuguuaugauguuacuuu

SEQ ID NO: 661294 - RNA, 22 nt, Human
cagcuuuggagugugagugcug

SEQ ID NO: 661295 - RNA, 22 nt, Human
uuucagaugcaauuaauuuuca

SEQ ID NO: 661296 - RNA, 22 nt, Human
guucugaguccuccuuugaagg

SEQ ID NO: 661297 - RNA, 22 nt, Human
ucuuugaauacaggaagcauga

SEQ ID NO: 661298 - RNA, 22 nt, Human
uguauuuuuaggaaugcgcuau

SEQ ID NO: 661299 - RNA, 22 nt, Human
uucagugugcuucaggacguua

SEQ ID NO: 661300 - RNA, 22 nt, Human
gaaguuaucaggauuaaaguug

SEQ ID NO: 661301 - RNA, 22 nt, Human
ggagccuuccagacugcccaca

SEQ ID NO: 661302 - RNA, 22 nt, Human
auuagaauuaugcuugcuaaug

SEQ ID NO: 661303 - RNA, 22 nt, Human
ucaaggaaugacuauaugagga

SEQ ID NO: 661304 - RNA, 22 nt, Human
gcaccugggacccagaggcacc

SEQ ID NO: 661305 - RNA, 22 nt, Human
aaacaguuuugccaaaaggaca

SEQ ID NO: 661306 - RNA, 22 nt, Human
uagaucauggguacugcauaug

SEQ ID NO: 661307 - RNA, 22 nt, Human
agccacaggccaugagauacca

SEQ ID NO: 661308 - RNA, 22 nt, Human
auguagaagugggcauuauaga

SEQ ID NO: 661309 - RNA, 22 nt, Human
uucacaguuugcugggacagga

SEQ ID NO: 661310 - RNA, 22 nt, Human
gagggggaaagucccuggaguc

SEQ ID NO: 661311 - RNA, 22 nt, Human
uaacauguguauugguuuccua

SEQ ID NO: 661312 - RNA, 22 nt, Human
cccagaggguggagguugcagu

SEQ ID NO: 661313 - RNA, 22 nt, Human
acagccagugacugcagacccu

SEQ ID NO: 661314 - RNA, 18 nt, Human
aggagaaagggaccaggg

SEQ ID NO: 661315 - RNA, 22 nt, Human
ucacugauuaugaaaaugaagg

SEQ ID NO: 661316 - RNA, 22 nt, Human
uagugaaaguauuaaacagcug

SEQ ID NO: 661317 - RNA, 22 nt, Human
uuaauugucugugaguaccuga

SEQ ID NO: 661318 - RNA, 22 nt, Human
ugcauguuucuguauguuaaug

SEQ ID NO: 661319 - RNA, 22 nt, Human
agcuggugugcucuggaauccu

SEQ ID NO: 661320 - RNA, 22 nt, Human
uucuggggacauaacaguaagc

SEQ ID NO: 661321 - RNA, 22 nt, Human
ggacagugaauguggggaugca

SEQ ID NO: 661322 - RNA, 17 nt, Human
gacaggcucagugacga

SEQ ID NO: 661323 - RNA, 22 nt, Human
uuggcucaccuggagccuguug

SEQ ID NO: 661324 - RNA, 20 nt, Human
acuuaguguaggguuccuag

SEQ ID NO: 661325 - RNA, 22 nt, Human
augaaaugagucaaugcgacua

SEQ ID NO: 661326 - RNA, 22 nt, Human
agugucauuuuguccaucuucu

SEQ ID NO: 661327 - RNA, 20 nt, Human
aggcacuguugucuguaucc

SEQ ID NO: 661328 - RNA, 22 nt, Human
gcccugugccagucacgcugug

SEQ ID NO: 661329 - RNA, 22 nt, Human
cugccaaucugaagagcuucuu

SEQ ID NO: 661330 - RNA, 22 nt, Human
guggccaaacaccaguuuagga

SEQ ID NO: 661331 - RNA, 22 nt, Human
gagagcccucacuccuucccug

SEQ ID NO: 661332 - RNA, 23 nt, Human
uggggcucuggcaggccugaggu

SEQ ID NO: 661333 - RNA, 22 nt, Human
aaggcuuugauuccauugcccu

SEQ ID NO: 661334 - RNA, 22 nt, Human
uagaauucauguuacuguuagc

SEQ ID NO: 661335 - RNA, 22 nt, Human
augaagacaaacuggguagaaa

SEQ ID NO: 661336 - RNA, 22 nt, Human
uugcuuuuaaucuuuguacauc

SEQ ID NO: 661337 - RNA, 22 nt, Human
cugcugggccuggucucugagg

SEQ ID NO: 661338 - RNA, 22 nt, Human
gaggggaguguccuccgggccc

SEQ ID NO: 661339 - RNA, 22 nt, Human
caggcuucagggaacgcagucu

SEQ ID NO: 661340 - RNA, 22 nt, Human
aaagugacaaccagcaggacuu

SEQ ID NO: 661341 - RNA, 22 nt, Human
cucagaguccccacaucugggu

SEQ ID NO: 661342 - RNA, 22 nt, Human
ugcuggagcaucugagagcauc

SEQ ID NO: 661343 - RNA, 22 nt, Human
ucucucauagagaaaaauauau

SEQ ID NO: 661344 - RNA, 22 nt, Human
ugguaauuuacgcauuucugua

SEQ ID NO: 661345 - RNA, 22 nt, Human
uugcuuuauuggguuuacugcc

SEQ ID NO: 661346 - RNA, 22 nt, Human
ccaagggcugagauacaucuag

SEQ ID NO: 661347 - RNA, 22 nt, Human
ccugccugcagaaaguaucucc

SEQ ID NO: 661348 - RNA, 22 nt, Human
gcugagcugaggcagggcuggg

SEQ ID NO: 661349 - RNA, 22 nt, Human
uacugcaucgaaaugcuuuuau

SEQ ID NO: 661350 - RNA, 22 nt, Human
gcccagcagcugguggagaagg

SEQ ID NO: 661351 - RNA, 22 nt, Human
ugugaacuuuggaugguucuga

SEQ ID NO: 661352 - RNA, 22 nt, Human
uaagugucccuauugugauuuu

SEQ ID NO: 661353 - RNA, 22 nt, Human
gguguugggcucacugguccuu

SEQ ID NO: 661354 - RNA, 22 nt, Human
uacugcugagcuggguagaagg

SEQ ID NO: 661355 - RNA, 22 nt, Human
ugccugggggacuaaggccaaa

SEQ ID NO: 661356 - RNA, 22 nt, Human
gagcggaggcuuggaggccagc

SEQ ID NO: 661357 - RNA, 22 nt, Human
agcagagcgccugcucagaggg

SEQ ID NO: 661358 - RNA, 22 nt, Human
auggcuuccucuggauuggauu

SEQ ID NO: 661359 - RNA, 22 nt, Human
uguauuugggucacaagauggg

SEQ ID NO: 661360 - RNA, 22 nt, Human
guuacaguggguuuggggccca

SEQ ID NO: 661361 - RNA, 22 nt, Human
uugcagcaugcauagacacugc

SEQ ID NO: 661362 - RNA, 22 nt, Human
accuucaccuccacaccuuggg

SEQ ID NO: 661363 - RNA, 22 nt, Human
acagugcagggugggaagaagg

SEQ ID NO: 661364 - RNA, 22 nt, Human
uugcagagugguugugaggauu

SEQ ID NO: 661365 - RNA, 22 nt, Human
guauauuuugaucacccucuau

SEQ ID NO: 661366 - RNA, 22 nt, Human
gggcagaggcucuggcccaucc

SEQ ID NO: 661367 - RNA, 22 nt, Human
gagagcugggggacuguggaug

SEQ ID NO: 661368 - RNA, 22 nt, Human
gccaccagcagaaaaggggcca

SEQ ID NO: 661369 - RNA, 22 nt, Human
cuguacaaauggcaguugaguu

SEQ ID NO: 661370 - RNA, 22 nt, Human
ggaccaggcugagcaccugccu

SEQ ID NO: 661371 - RNA, 22 nt, Human
cugcgugucuccuuggggcaga

SEQ ID NO: 661372 - RNA, 22 nt, Human
ggcuagggagacagagggcaug

SEQ ID NO: 661373 - RNA, 22 nt, Human
ccauggcagccaugggagccac

SEQ ID NO: 661374 - RNA, 22 nt, Human
uuuccuuugcccaauacauguc

SEQ ID NO: 661375 - RNA, 22 nt, Human
gcccagggugcuuagaacccau

SEQ ID NO: 661376 - RNA, 22 nt, Human
cuacagaagccguggucaggaa

SEQ ID NO: 661377 - RNA, 22 nt, Human
auuagggaaggauuuggccuga

SEQ ID NO: 661378 - RNA, 22 nt, Human
augaaaugugaaugcuuuucau

SEQ ID NO: 661379 - RNA, 22 nt, Human
uaaagucaucuuuaaacaugcc

SEQ ID NO: 661380 - RNA, 22 nt, Human
gucuguggcaggggagaaguuu

SEQ ID NO: 661381 - RNA, 22 nt, Human
ugcaggagcaccagcucacccu

SEQ ID NO: 661382 - RNA, 16 nt, Human
gagcagccugggccuu

SEQ ID NO: 661383 - RNA, 22 nt, Human
ggaagcuguugugagugcagca

SEQ ID NO: 661384 - RNA, 22 nt, Human
agacacuggugaagaaaucagg

SEQ ID NO: 661385 - RNA, 22 nt, Human
gggcuccacgcacgcgagaggu

SEQ ID NO: 661386 - RNA, 19 nt, Human
aagcaucuuugaaacuggg

SEQ ID NO: 661387 - RNA, 20 nt, Human
ccucugccuuucuagucuga

SEQ ID NO: 661388 - RNA, 22 nt, Human
uuucacauucuucugaaucuac

SEQ ID NO: 661389 - RNA, 22 nt, Human
ccuggagcacucucccuggcug

SEQ ID NO: 661390 - RNA, 22 nt, Human
agcuggucugcugcauggagug

SEQ ID NO: 661391 - RNA, 22 nt, Human
gggguccuggaggccagcugga

SEQ ID NO: 661392 - RNA, 22 nt, Human
gcugugucagaaacucugggga

SEQ ID NO: 661393 - RNA, 22 nt, Human
cuguuggacuuuucaaggucug

SEQ ID NO: 661394 - RNA, 21 nt, Human
cagaggucauccugaggacaa

SEQ ID NO: 661395 - RNA, 22 nt, Human
cugggccaugggccagcgaggc

SEQ ID NO: 661396 - RNA, 22 nt, Human
uaggcagggauuaggguugauu

SEQ ID NO: 661397 - RNA, 22 nt, Human
gccaggcugguuauuuaaugag

SEQ ID NO: 661398 - RNA, 22 nt, Human
ccuuagcaacugucauagagca

SEQ ID NO: 661399 - RNA, 22 nt, Human
ugggccugaaggagcugcgccc

SEQ ID NO: 661400 - RNA, 22 nt, Human
cuggcucauccagguguugcuc

SEQ ID NO: 661401 - RNA, 22 nt, Human
agcuggcugggugccagucucc

SEQ ID NO: 661402 - RNA, 22 nt, Human
cacucaggguacaauggagggc

SEQ ID NO: 661403 - RNA, 22 nt, Human
cuguggcuuuuccggggagccu

SEQ ID NO: 661404 - RNA, 23 nt, Human
uugggcucaguggcaggaagagu

SEQ ID NO: 661405 - RNA, 19 nt, Human
acauggcaucccaggaggu

SEQ ID NO: 661406 - RNA, 22 nt, Human
auaaggcagaaaugauucuagu

SEQ ID NO: 661407 - RNA, 22 nt, Human
ucauugcucuagguuccuugga

SEQ ID NO: 661408 - RNA, 22 nt, Human
auacauguuugcuggauaaaca

SEQ ID NO: 661409 - RNA, 22 nt, Human
ggcaaaaaccgcaauaacuucu

SEQ ID NO: 661410 - RNA, 22 nt, Human
ugugaggaguaggcugagggug

SEQ ID NO: 661411 - RNA, 22 nt, Human
uagggcugcuuuguauucugcu

SEQ ID NO: 661412 - RNA, 22 nt, Human
uuuagcagugaagugaagugaa

SEQ ID NO: 661413 - RNA, 22 nt, Human
cagggcuugguuggaaccaccc

SEQ ID NO: 661414 - RNA, 22 nt, Human
gcugcagcaagcccuccagggg

SEQ ID NO: 661415 - RNA, 22 nt, Human
cugagucauugcagauguggag

SEQ ID NO: 661416 - RNA, 19 nt, Human
acagccuguugguggggcu

SEQ ID NO: 661417 - RNA, 18 nt, Human
ccugaggugggaggaagg

SEQ ID NO: 661418 - RNA, 22 nt, Human
cuagcuucaaguccuggcugug

SEQ ID NO: 661419 - RNA, 17 nt, Human
aucucucuaaggcaggc

SEQ ID NO: 661420 - RNA, 22 nt, Human
cucuuuggauagaauuacaaag

SEQ ID NO: 661421 - RNA, 22 nt, Human
uucaggaagccuuucuuggucu

SEQ ID NO: 661422 - RNA, 22 nt, Human
aagacucaaggaacaacacagu

SEQ ID NO: 661423 - RNA, 22 nt, Human
ggucugaaaauggugaccacca

SEQ ID NO: 661424 - RNA, 22 nt, Human
aguuuucauuaccaugcugcaa

SEQ ID NO: 661425 - RNA, 22 nt, Human
ggcucuggcaaggggaggcuac

SEQ ID NO: 661426 - RNA, 19 nt, Human
ucaggcaguuauucacaaa

SEQ ID NO: 661427 - RNA, 22 nt, Human
uggagacugugcuaagggaguu

SEQ ID NO: 661428 - RNA, 22 nt, Human
aggcuggugucucuguccuguc

SEQ ID NO: 661429 - RNA, 22 nt, Human
cuucacagaugcugagagggcu

SEQ ID NO: 661430 - RNA, 22 nt, Human
cuuggagaccagugacauugcu

SEQ ID NO: 661431 - RNA, 22 nt, Human
aaguaugacauuuaagacaauu

SEQ ID NO: 661432 - RNA, 22 nt, Human
cucccucuguccgaggccggcu

SEQ ID NO: 661433 - RNA, 22 nt, Human
uucugcauugacuuuuauuucc

SEQ ID NO: 661434 - RNA, 22 nt, Human
ucacaggcucuagggauuaaga

SEQ ID NO: 661435 - RNA, 22 nt, Human
agcagggcuuugcagacuuggg

SEQ ID NO: 661436 - RNA, 22 nt, Human
gcucuggcucaaaccaccggcu

SEQ ID NO: 661437 - RNA, 22 nt, Human
ucauuugugugagugauuugac

SEQ ID NO: 661438 - RNA, 22 nt, Human
auccccacugcugcugguguag

SEQ ID NO: 661439 - RNA, 22 nt, Human
cuggcaccaggcaugcugggag

SEQ ID NO: 661440 - RNA, 22 nt, Human
caguggcaaugggacagagcac

SEQ ID NO: 661441 - RNA, 22 nt, Human
aggaaccagagguugagcaacu

SEQ ID NO: 661442 - RNA, 22 nt, Human
aagucagaaauuauucaggaau

SEQ ID NO: 661443 - RNA, 22 nt, Human
uggaauagaggugcugauauua

SEQ ID NO: 661444 - RNA, 22 nt, Human
acagugugacaauugugucaga

SEQ ID NO: 661445 - RNA, 20 nt, Human
uggggucuaguuggccuggg

SEQ ID NO: 661446 - RNA, 22 nt, Human
agaaaagaggcuuucuaagcau

SEQ ID NO: 661447 - RNA, 22 nt, Human
uuuguuaaaaugcagauucugu

SEQ ID NO: 661448 - RNA, 22 nt, Human
uuccauaacugaccgaaugcau

SEQ ID NO: 661449 - RNA, 22 nt, Human
cugaacucuuuaugacagcuug

SEQ ID NO: 661450 - RNA, 22 nt, Human
acagaauagucagcuguaggcc

SEQ ID NO: 661451 - RNA, 22 nt, Human
cuugggaggagaacaaagcucc

SEQ ID NO: 661452 - RNA, 22 nt, Human
gccuuccuuuuaccaccagcca

SEQ ID NO: 661453 - RNA, 22 nt, Human
ugggccaccugcucuguuucua

SEQ ID NO: 661454 - RNA, 22 nt, Human
auggaaauguuaagucaguccg

SEQ ID NO: 661455 - RNA, 22 nt, Human
uuugaaaacuuaauuuggucgu

SEQ ID NO: 661456 - RNA, 22 nt, Human
cugaggggauaaagguuugggu

SEQ ID NO: 661457 - RNA, 22 nt, Human
ucccagccacaguuuccaccug

SEQ ID NO: 661458 - RNA, 22 nt, Human
agagucaguuaugucaagugcu

SEQ ID NO: 661459 - RNA, 22 nt, Human
gcugccuucccaggccuuugcu

SEQ ID NO: 661460 - RNA, 23 nt, Human
acugugggcaccacagagagugu

SEQ ID NO: 661461 - RNA, 22 nt, Human
guggaacagccugugcaaaccu

SEQ ID NO: 661462 - RNA, 22 nt, Human
ggaggagacccugugucaguuu

SEQ ID NO: 661463 - RNA, 22 nt, Human
uucccuggcaugaguguaagau

SEQ ID NO: 661464 - RNA, 22 nt, Human
uuauaaagguuugugcauauuu

SEQ ID NO: 661465 - RNA, 22 nt, Human
gcucccugguauugcugccacu

SEQ ID NO: 661466 - RNA, 22 nt, Human
uggggacugacagccaggccuc

SEQ ID NO: 661467 - RNA, 22 nt, Human
cucucuccuuagcugcagacca

SEQ ID NO: 661468 - RNA, 22 nt, Human
uaagcauaacuaaaaaugauuu

SEQ ID NO: 661469 - RNA, 22 nt, Human
gguggcagcauggucccagugu

SEQ ID NO: 661470 - RNA, 22 nt, Human
acagcacaggaguugaaugggc

SEQ ID NO: 661471 - RNA, 22 nt, Human
agucacugaauaccuuaauguu

SEQ ID NO: 661472 - RNA, 22 nt, Human
cugcagaccucugagguccaug

SEQ ID NO: 661473 - RNA, 22 nt, Human
ugagguaauguguacguuaauu

SEQ ID NO: 661474 - RNA, 22 nt, Human
caggggcucugagauugucuaa

SEQ ID NO: 661475 - RNA, 22 nt, Human
ugcuggcaucuuaauguucugu

SEQ ID NO: 661476 - RNA, 22 nt, Human
gacccaggaagcuacuucuggu

SEQ ID NO: 661477 - RNA, 22 nt, Human
agccagcucccuccccugcagg

SEQ ID NO: 661478 - RNA, 22 nt, Human
cagagcacacaugcauagagug

SEQ ID NO: 661479 - RNA, 22 nt, Human
ggagcucaguggggggacugug

SEQ ID NO: 661480 - RNA, 22 nt, Human
auggccaguuagaaaucaaaaa

SEQ ID NO: 661481 - RNA, 22 nt, Human
agcugggcuggagcuccaagcg

SEQ ID NO: 661482 - RNA, 22 nt, Human
uuugugaacacugcgcagaacu

SEQ ID NO: 661483 - RNA, 22 nt, Human
aacauucuuuagcucuuccugc

SEQ ID NO: 661484 - RNA, 22 nt, Human
uuauacacugcagaaccagcau

SEQ ID NO: 661485 - RNA, 22 nt, Human
ucaguuuugauuccugguucuc

SEQ ID NO: 661486 - RNA, 22 nt, Human
gcugggaagagaugcacaugau

SEQ ID NO: 661487 - RNA, 22 nt, Human
acacacuugcagagaggaggga

SEQ ID NO: 661488 - RNA, 22 nt, Human
auaugagaguaaaugccgaucu

SEQ ID NO: 661489 - RNA, 17 nt, Human
uccaugagacaugaaga

SEQ ID NO: 661490 - RNA, 20 nt, Human
acaaagacuggaaaagcaag

SEQ ID NO: 661491 - RNA, 22 nt, Human
gaggaggaguauauauuagaau

SEQ ID NO: 661492 - RNA, 19 nt, Human
ugugggcaagggauggcag

SEQ ID NO: 661493 - RNA, 22 nt, Human
cucuccaggagagcacuuugag

SEQ ID NO: 661494 - RNA, 22 nt, Human
aaacaccagcacuguuuacaaa

SEQ ID NO: 661495 - RNA, 19 nt, Human
cagaggccagaagcacagg

SEQ ID NO: 661496 - RNA, 22 nt, Human
cauggcuugcuaguggcccaag

SEQ ID NO: 661497 - RNA, 22 nt, Human
ggcacacagcggaauuugcucu

SEQ ID NO: 661498 - RNA, 22 nt, Human
uuuagagaggcucuguaaaaug

SEQ ID NO: 661499 - RNA, 22 nt, Human
ugaggcaggaguuaaugugcuc

SEQ ID NO: 661500 - RNA, 22 nt, Human
ccaaggcaacguuggugucagg

SEQ ID NO: 661501 - RNA, 22 nt, Human
aagcaucuguaaagacccuuau

SEQ ID NO: 661502 - RNA, 20 nt, Human
cuucuucagccuaugcuuca

SEQ ID NO: 661503 - RNA, 22 nt, Human
agaggguugaaccuauaaacua

SEQ ID NO: 661504 - RNA, 21 nt, Human
cacacagcugcccuuagguag

SEQ ID NO: 661505 - RNA, 22 nt, Human
ggagucugucaccuguuucucu

SEQ ID NO: 661506 - RNA, 22 nt, Human
aagccaguggcuucucccugcu

SEQ ID NO: 661507 - RNA, 22 nt, Human
ucagcagggcugugguguggcu

SEQ ID NO: 661508 - RNA, 22 nt, Human
uuccaguuggagccugccuuua

SEQ ID NO: 661509 - RNA, 22 nt, Human
aaagcaugauuagauagaugau

SEQ ID NO: 661510 - RNA, 22 nt, Human
acacuguuccugaaauuguuau

SEQ ID NO: 661511 - RNA, 22 nt, Human
agucaauuaucucuaggucauc

SEQ ID NO: 661512 - RNA, 22 nt, Human
cucuucuugaaagaggaauuca

SEQ ID NO: 661513 - RNA, 20 nt, Human
uaggugagggcagauagagg

SEQ ID NO: 661514 - RNA, 22 nt, Human
gugugcaggugucagugcagcu

SEQ ID NO: 661515 - RNA, 22 nt, Human
aagaggccuuggucugaccuga

SEQ ID NO: 661516 - RNA, 22 nt, Human
auuccauuguguaaggauaucg

SEQ ID NO: 661517 - RNA, 22 nt, Human
gccagcugcucgcguaggguag

SEQ ID NO: 661518 - RNA, 22 nt, Human
gcucuggaagcaucugagagga

SEQ ID NO: 661519 - RNA, 22 nt, Human
acugugcuuucucuggaggcau

SEQ ID NO: 661520 - RNA, 22 nt, Human
aaacuaaaccuggcuuaguaag

SEQ ID NO: 661521 - RNA, 22 nt, Human
ugucauguuucauguuuguagg

SEQ ID NO: 661522 - RNA, 22 nt, Human
cacagggcagugauuguccaca

SEQ ID NO: 661523 - RNA, 22 nt, Human
aucucuggccuuccuuuuccaa

SEQ ID NO: 661524 - RNA, 22 nt, Human
cagagcuucugacagcugcugc

SEQ ID NO: 661525 - RNA, 22 nt, Human
agaacagucguggugagagaaa

SEQ ID NO: 661526 - RNA, 22 nt, Human
ccaggcacaggugggccucaga

SEQ ID NO: 661527 - RNA, 22 nt, Human
uaaaguucagugcaugaaugug

SEQ ID NO: 661528 - RNA, 17 nt, Human
caggucugaggccaggc

SEQ ID NO: 661529 - RNA, 22 nt, Human
aagcagcugcagguucaaagga

SEQ ID NO: 661530 - RNA, 22 nt, Human
ccuucccaggcuagaccaacau

SEQ ID NO: 661531 - RNA, 22 nt, Human
uuaacugugacaguuucucaga

SEQ ID NO: 661532 - RNA, 22 nt, Human
ggcuucaaauggagcaaccaga

SEQ ID NO: 661533 - RNA, 22 nt, Human
uaucuauaaguacuaacauggu

SEQ ID NO: 661534 - RNA, 19 nt, Human
uguggcugagcacuccuua

SEQ ID NO: 661535 - RNA, 22 nt, Human
uagaggaaccaggcaggcugag

SEQ ID NO: 661536 - RNA, 23 nt, Human
aguggcuggacagacuuuccugg

SEQ ID NO: 661537 - RNA, 21 nt, Human
cagggcaaccaaguccagaga

SEQ ID NO: 661538 - RNA, 22 nt, Human
cugagaggcggagguugcagug

SEQ ID NO: 661539 - RNA, 22 nt, Human
agcaagcuaccuagauagucua

SEQ ID NO: 661540 - RNA, 22 nt, Human
gugccucucauuggcugagccc

SEQ ID NO: 661541 - RNA, 22 nt, Human
acucugcuaaauguaaguuggu

SEQ ID NO: 661542 - RNA, 22 nt, Human
acuccacaccacgggggccgcc

SEQ ID NO: 661543 - RNA, 22 nt, Human
ugguuggauggcucuuguggcu

SEQ ID NO: 661544 - RNA, 22 nt, Human
uccagaaaugcaagccaggugu

SEQ ID NO: 661545 - RNA, 22 nt, Human
agggggugaaugucugucuaca

SEQ ID NO: 661546 - RNA, 22 nt, Human
caucaauaggguuugaaagcaa

SEQ ID NO: 661547 - RNA, 22 nt, Human
uagaauaaguugaugauauaug

SEQ ID NO: 661548 - RNA, 22 nt, Human
acaggggcaagggcucacggcc

SEQ ID NO: 661549 - RNA, 22 nt, Human
ugggccaguagcuacucgcaag

SEQ ID NO: 661550 - RNA, 22 nt, Human
uuuguucugaaaaucuucccuu

SEQ ID NO: 661551 - RNA, 22 nt, Human
gccugggugcccaaugaugaga

SEQ ID NO: 661552 - RNA, 22 nt, Human
aguauauuuaccauuggguggg

SEQ ID NO: 661553 - RNA, 18 nt, Human
ggcaggauuucaacuuuc

SEQ ID NO: 661554 - RNA, 22 nt, Human
ccuggcacugaccaggcacuga

SEQ ID NO: 661555 - RNA, 22 nt, Human
ugagcccaggaguuggaggcug

SEQ ID NO: 661556 - RNA, 22 nt, Human
agugaaaucagguuuugacugc

SEQ ID NO: 661557 - RNA, 22 nt, Human
aaauuauuuucagaauggagaa

SEQ ID NO: 661558 - RNA, 22 nt, Human
ggagcugagacccaguggcuga

SEQ ID NO: 661559 - RNA, 22 nt, Human
auacacacauaugugaguuuug

SEQ ID NO: 661560 - RNA, 22 nt, Human
ugcccucaagcaacagagagga

SEQ ID NO: 661561 - RNA, 22 nt, Human
agccaccaccacugaaagguua

SEQ ID NO: 661562 - RNA, 22 nt, Human
ucccagccuggacccugccagu

SEQ ID NO: 661563 - RNA, 22 nt, Human
ugcagugguguccagguguacu

SEQ ID NO: 661564 - RNA, 17 nt, Human
acugucuuuuacacccu

SEQ ID NO: 661565 - RNA, 22 nt, Human
ugcaggugugggcaggggagca

SEQ ID NO: 661566 - RNA, 22 nt, Human
ucagggccaucuuuugccucaa

SEQ ID NO: 661567 - RNA, 22 nt, Human
gcuacaguagauaaggacgguc

SEQ ID NO: 661568 - RNA, 22 nt, Human
uaugcuuugguagagaguugug

SEQ ID NO: 661569 - RNA, 22 nt, Human
cacuguuauuacuacuauacau

SEQ ID NO: 661570 - RNA, 22 nt, Human
aagcagaggccacagagugggc

SEQ ID NO: 661571 - RNA, 22 nt, Human
agugcccggacaacuggacaga

SEQ ID NO: 661572 - RNA, 17 nt, Human
cuucuagaaggcaaacu

SEQ ID NO: 661573 - RNA, 22 nt, Human
ucagugcagggugggagagaga

SEQ ID NO: 661574 - RNA, 22 nt, Human
uauaucaccaaaaacaguucug

SEQ ID NO: 661575 - RNA, 22 nt, Human
agcugcuguuucuugcacguau

SEQ ID NO: 661576 - RNA, 22 nt, Human
agguagcuggugcugggcuccu

SEQ ID NO: 661577 - RNA, 22 nt, Human
aggccagguggucaugcuugcu

SEQ ID NO: 661578 - RNA, 22 nt, Human
cugggacccccacugcguagcu

SEQ ID NO: 661579 - RNA, 22 nt, Human
augcccugcaucaagugacacu

SEQ ID NO: 661580 - RNA, 22 nt, Human
cacagucccauucgagaguaau

SEQ ID NO: 661581 - RNA, 22 nt, Human
gccugggacccuuagcucuugg

SEQ ID NO: 661582 - RNA, 22 nt, Human
uggugguuaugcgcuuuguggg

SEQ ID NO: 661583 - RNA, 22 nt, Human
aagccagggucaggggccuccu

SEQ ID NO: 661584 - RNA, 22 nt, Human
gcugaggcucaagucauggguc

SEQ ID NO: 661585 - RNA, 21 nt, Human
gcugucuccuccuugcaccag

SEQ ID NO: 661586 - RNA, 22 nt, Human
aggagaggcucuaacucugugu

SEQ ID NO: 661587 - RNA, 22 nt, Human
auaacuucaguuucuguguccu

SEQ ID NO: 661588 - RNA, 22 nt, Human
gcagaaggucuggcacuucagg

SEQ ID NO: 661589 - RNA, 22 nt, Human
aggcucagccccugggaggaga

SEQ ID NO: 661590 - RNA, 22 nt, Human
uaugagaagguauggugacuug

SEQ ID NO: 661591 - RNA, 22 nt, Human
uucagugcuuacagguuucuuu

SEQ ID NO: 661592 - RNA, 22 nt, Human
ucacauacacuaggauauuuuu

SEQ ID NO: 661593 - RNA, 22 nt, Human
auccacagucagaacgggccua

SEQ ID NO: 661594 - RNA, 22 nt, Human
agaggccacuuugccugugaug

SEQ ID NO: 661595 - RNA, 23 nt, Human
auugaugacuugauuacacuuuu

SEQ ID NO: 661596 - RNA, 22 nt, Human
cugauggagacuccacugugau

SEQ ID NO: 661597 - RNA, 22 nt, Human
uuauucuguuugccgaccagua

SEQ ID NO: 661598 - RNA, 22 nt, Human
ucacauuucugauuauaccaaa

SEQ ID NO: 661599 - RNA, 22 nt, Human
cagcuuauucaguaagcacaua

SEQ ID NO: 661600 - RNA, 22 nt, Human
auuugcuucugugaaaucaagu

SEQ ID NO: 661601 - RNA, 21 nt, Human
gccugggauaguggccuccgg

SEQ ID NO: 661602 - RNA, 22 nt, Human
ggcuugaagacuaugacauuuc

SEQ ID NO: 661603 - RNA, 22 nt, Human
gcagcugcaggcaggcuugcug

SEQ ID NO: 661604 - RNA, 20 nt, Human
gaaauucucguauuaguuua

SEQ ID NO: 661605 - RNA, 22 nt, Human
uuuguguuuaugaaguuauucu

SEQ ID NO: 661606 - RNA, 22 nt, Human
uucuacagguacugaaguacau

SEQ ID NO: 661607 - RNA, 19 nt, Human
uagaaagccagaaaacaga

SEQ ID NO: 661608 - RNA, 22 nt, Human
ccucccugcgcuccugcggcgg

SEQ ID NO: 661609 - RNA, 22 nt, Human
gccaccucucucuugacucgag

SEQ ID NO: 661610 - RNA, 22 nt, Human
ccucagagacugcaucuucccu

SEQ ID NO: 661611 - RNA, 22 nt, Human
agaggcucuugcccuucccaca

SEQ ID NO: 661612 - RNA, 23 nt, Human
aucaagauaauccagaugaccua

SEQ ID NO: 661613 - RNA, 22 nt, Human
aaagugcagcugaaaacauccu

SEQ ID NO: 661614 - RNA, 22 nt, Human
acuuacaaguucccuuucucag

SEQ ID NO: 661615 - RNA, 22 nt, Human
uagagcuggaauuugcagcaag

SEQ ID NO: 661616 - RNA, 22 nt, Human
uacaagaaggaaaacuagcaau

SEQ ID NO: 661617 - RNA, 22 nt, Human
uggcagcagacaaaaggccauu

SEQ ID NO: 661618 - RNA, 22 nt, Human
uuauuuguaaggcagggccagu

SEQ ID NO: 661619 - RNA, 22 nt, Human
ugugguagagggcagaugggca

SEQ ID NO: 661620 - RNA, 22 nt, Human
aauuuguguuaguccacguuca

SEQ ID NO: 661621 - RNA, 22 nt, Human
aucaggaugacaacugcugggu

SEQ ID NO: 661622 - RNA, 22 nt, Human
uuuggagauggagagagggcau

SEQ ID NO: 661623 - RNA, 22 nt, Human
gcaaaacagucgaugccuccca

SEQ ID NO: 661624 - RNA, 22 nt, Human
aucuuuuaugagcguucugaca

SEQ ID NO: 661625 - RNA, 22 nt, Human
ccuacaguuauauucuugauug

SEQ ID NO: 661626 - RNA, 20 nt, Human
gauucugggcagucaguguc

SEQ ID NO: 661627 - RNA, 16 nt, Human
uggagcaggcaggaug

SEQ ID NO: 661628 - RNA, 22 nt, Human
ugggucagagcagaccucugga

SEQ ID NO: 661629 - RNA, 19 nt, Human
ggcuuuaacucuuguagcu

SEQ ID NO: 661630 - RNA, 22 nt, Human
aaaauuauucauggcuuuugga

SEQ ID NO: 661631 - RNA, 22 nt, Human
acucuucaccgcuacugaaaua

SEQ ID NO: 661632 - RNA, 22 nt, Human
ucugagcccagugagucucgca

SEQ ID NO: 661633 - RNA, 22 nt, Human
uauggcuuuaaacuuuucauuu

SEQ ID NO: 661634 - RNA, 22 nt, Human
acaugaaaguuauucugaguug

SEQ ID NO: 661635 - RNA, 22 nt, Human
aacagugaguugaugacugaau

SEQ ID NO: 661636 - RNA, 22 nt, Human
gccagagcuugguuuuuauuua

SEQ ID NO: 661637 - RNA, 22 nt, Human
aagacagaccacgugacagggc

SEQ ID NO: 661638 - RNA, 22 nt, Human
cacaugcaggagccaauguaca

SEQ ID NO: 661639 - RNA, 18 nt, Human
gaaaauacucugggcuca

SEQ ID NO: 661640 - RNA, 22 nt, Human
ccaucagcuccaguaucuucug

SEQ ID NO: 661641 - RNA, 22 nt, Human
ccagcuuucugggugguuucug

SEQ ID NO: 661642 - RNA, 22 nt, Human
uuccuggggggauagauuucac

SEQ ID NO: 661643 - RNA, 22 nt, Human
agggcucuguccccagaggccc

SEQ ID NO: 661644 - RNA, 22 nt, Human
gaucuuuucagguuucucuagu

SEQ ID NO: 661645 - RNA, 19 nt, Human
uagaagcacuaggcaaacu

SEQ ID NO: 661646 - RNA, 22 nt, Human
ccaggcuuuuagcugcauggca

SEQ ID NO: 661647 - RNA, 22 nt, Human
uaagaugagguagguaagacuu

SEQ ID NO: 661648 - RNA, 22 nt, Human
ugguccugaggcuuguuuccac

SEQ ID NO: 661649 - RNA, 16 nt, Human
uugcaaggcguuuaua

SEQ ID NO: 661650 - RNA, 19 nt, Human
gccucugagggcaggacac

SEQ ID NO: 661651 - RNA, 22 nt, Human
ugcuucugggccugguguuccc

SEQ ID NO: 661652 - RNA, 21 nt, Human
cugggcucaagcaauccuuuc

SEQ ID NO: 661653 - RNA, 22 nt, Human
uucacaauaggagcaugcaaau

SEQ ID NO: 661654 - RNA, 22 nt, Human
aggcuguggcauuaaacguuug

SEQ ID NO: 661655 - RNA, 22 nt, Human
gaaaaggccacuccuaggagcu

SEQ ID NO: 661656 - RNA, 22 nt, Human
caaggccuaaucauacugcuaa

SEQ ID NO: 661657 - RNA, 22 nt, Human
agauggcuccaguguccagagg

SEQ ID NO: 661658 - RNA, 22 nt, Human
ucuuggagaauggcagagaagc

SEQ ID NO: 661659 - RNA, 19 nt, Human
uagcuucacguggucuaga

SEQ ID NO: 661660 - RNA, 22 nt, Human
gcaguggggcaaucauagcuca

SEQ ID NO: 661661 - RNA, 22 nt, Human
uaguuucuucaccuguaaaaug

SEQ ID NO: 661662 - RNA, 22 nt, Human
gaaugucccugcaguugcugcc

SEQ ID NO: 661663 - RNA, 22 nt, Human
aggccaguguggcuggagcaca

SEQ ID NO: 661664 - RNA, 22 nt, Human
ccagucagagaaaauguccacu

SEQ ID NO: 661665 - RNA, 22 nt, Human
gggcagggguagcauuccaagu

SEQ ID NO: 661666 - RNA, 22 nt, Human
auugucuucugucuuauaguuc

SEQ ID NO: 661667 - RNA, 22 nt, Human
uuccagagucagccacugggag

SEQ ID NO: 661668 - RNA, 22 nt, Human
gggcuuggaguaggcugaugaa

SEQ ID NO: 661669 - RNA, 22 nt, Human
gucugaaaauaugauuuugccu

SEQ ID NO: 661670 - RNA, 22 nt, Human
ggguccaguuucaucugagguu

SEQ ID NO: 661671 - RNA, 22 nt, Human
ggagagcugguagcuggcucca

SEQ ID NO: 661672 - RNA, 22 nt, Human
ugugagacguguuagaacagug

SEQ ID NO: 661673 - RNA, 22 nt, Human
aaagcaauaguaaugguaauag

SEQ ID NO: 661674 - RNA, 22 nt, Human
aagacaauguuucugauagaua

SEQ ID NO: 661675 - RNA, 22 nt, Human
acaugcaauauugagacuuucu

SEQ ID NO: 661676 - RNA, 22 nt, Human
uccagaccauggauggcugcaa

SEQ ID NO: 661677 - RNA, 22 nt, Human
cauugagaggcugccugccuga

SEQ ID NO: 661678 - RNA, 19 nt, Human
aggcagcaggccagggaug

SEQ ID NO: 661679 - RNA, 22 nt, Human
uuccuuaauaucccuuuuggaa

SEQ ID NO: 661680 - RNA, 22 nt, Human
ucccagagucagagguggggcc

SEQ ID NO: 661681 - RNA, 21 nt, Human
agcugagguaaggcaagagag

SEQ ID NO: 661682 - RNA, 22 nt, Human
ucuguuggagccuaggaugaca

SEQ ID NO: 661683 - RNA, 22 nt, Human
ugccucuuggagccuuuccucu

SEQ ID NO: 661684 - RNA, 22 nt, Human
ggcagugacuguucagacgucc

SEQ ID NO: 661685 - RNA, 22 nt, Human
aaauuagugcaccagguugaag

SEQ ID NO: 661686 - RNA, 22 nt, Human
uguguguguuuauaaaucuaaa

SEQ ID NO: 661687 - RNA, 22 nt, Human
ucuucaugucuugccugauaua

SEQ ID NO: 661688 - RNA, 19 nt, Human
cagaggcacuuucucuuag

SEQ ID NO: 661689 - RNA, 21 nt, Human
guuuuucagcccugaggugag

SEQ ID NO: 661690 - RNA, 22 nt, Human
ggucagaggucccagaagaagc

SEQ ID NO: 661691 - RNA, 22 nt, Human
ccuuggugcucugcugggaugg

SEQ ID NO: 661692 - RNA, 22 nt, Human
auagugugacugaggaguugaa

SEQ ID NO: 661693 - RNA, 22 nt, Human
ugcugcuuuaaaaagugcugau

SEQ ID NO: 661694 - RNA, 22 nt, Human
ucaggguugcugugaucagucc

SEQ ID NO: 661695 - RNA, 22 nt, Human
ucccaagugucuuggaccaggg

SEQ ID NO: 661696 - RNA, 22 nt, Human
uggcucagauuuuuguaggcuu

SEQ ID NO: 661697 - RNA, 22 nt, Human
gccaucucggagcuaucaaagg

SEQ ID NO: 661698 - RNA, 22 nt, Human
ucugugcugucucagagaaagc

SEQ ID NO: 661699 - RNA, 22 nt, Human
uuugaaagggaaauaaacuccu

SEQ ID NO: 661700 - RNA, 22 nt, Human
cuucucugcccauaggaaaugc

SEQ ID NO: 661701 - RNA, 22 nt, Human
cucaaauagaacugaucuauaa

SEQ ID NO: 661702 - RNA, 21 nt, Human
gccaccucaaucuucuagcgc

SEQ ID NO: 661703 - RNA, 22 nt, Human
agaaguuucacaauggguuuua

SEQ ID NO: 661704 - RNA, 22 nt, Human
agccacacagcuuaaugacaga

SEQ ID NO: 661705 - RNA, 22 nt, Human
uuuauuggauauuuacaagaua

SEQ ID NO: 661706 - RNA, 22 nt, Human
aagcagaaagaacaacugagug

SEQ ID NO: 661707 - RNA, 21 nt, Human
gcaaggcaaugccaugauuuc

SEQ ID NO: 661708 - RNA, 22 nt, Human
ucacugcucugaaaguacaggg

SEQ ID NO: 661709 - RNA, 22 nt, Human
uauuccaugccagaguuuauug

SEQ ID NO: 661710 - RNA, 22 nt, Human
uccucagugcuagccaacugcc

SEQ ID NO: 661711 - RNA, 23 nt, Human
uuauuuugucagaagggacuuuu

SEQ ID NO: 661712 - RNA, 22 nt, Human
aaaugcauggcuguuuuaaagc

SEQ ID NO: 661713 - RNA, 22 nt, Human
uagccagugagacccagaaaua

SEQ ID NO: 661714 - RNA, 18 nt, Human
uccuagugaaaugccugu

SEQ ID NO: 661715 - RNA, 22 nt, Human
aaauccuaccaagaaauucccu

SEQ ID NO: 661716 - RNA, 22 nt, Human
uggccucaaucuguccuccagc

SEQ ID NO: 661717 - RNA, 22 nt, Human
cagacaacuggacuaagaucac

SEQ ID NO: 661718 - RNA, 22 nt, Human
uaugcccuuacaaugagcacaa

SEQ ID NO: 661719 - RNA, 22 nt, Human
gagggaggggagcuccacccuc

SEQ ID NO: 661720 - RNA, 22 nt, Human
ugaguggacaccugcuucuuua

SEQ ID NO: 661721 - RNA, 22 nt, Human
gcacagaaguaaaauacaaguc

SEQ ID NO: 661722 - RNA, 22 nt, Human
ugggcacagggguaggaaugag

SEQ ID NO: 661723 - RNA, 23 nt, Human
ucaggauauugugugccaaggug

SEQ ID NO: 661724 - RNA, 22 nt, Human
gcaggugguuaaggucccaugu

SEQ ID NO: 661725 - RNA, 23 nt, Human
acugucugauauguuuuccauca

SEQ ID NO: 661726 - RNA, 22 nt, Human
cagcacccuuuccacugccuug

SEQ ID NO: 661727 - RNA, 22 nt, Human
ugcucuccugcuccucagccca

SEQ ID NO: 661728 - RNA, 22 nt, Human
cacagccuccuucagagagcau

SEQ ID NO: 661729 - RNA, 22 nt, Human
auacagguaauuugaauaauag

SEQ ID NO: 661730 - RNA, 22 nt, Human
cuguggaaggccuguccugaaa

SEQ ID NO: 661731 - RNA, 22 nt, Human
guucuucagaggggaaagaacc

SEQ ID NO: 661732 - RNA, 22 nt, Human
gaugcuuuccaagaaauccuca

SEQ ID NO: 661733 - RNA, 22 nt, Human
ucagggcauggcugcacuuggc

SEQ ID NO: 661734 - RNA, 22 nt, Human
agagccuggagguucugcugaa

SEQ ID NO: 661735 - RNA, 22 nt, Human
ugccugccaugcagaaagcuga

SEQ ID NO: 661736 - RNA, 22 nt, Human
agagugcccaagccuggcaggg

SEQ ID NO: 661737 - RNA, 22 nt, Human
gcuggccagcccucuuccucca

SEQ ID NO: 661738 - RNA, 18 nt, Human
ugcaggcuguugaaacug

SEQ ID NO: 661739 - RNA, 22 nt, Human
ggggacugccuuccacagacac

SEQ ID NO: 661740 - RNA, 23 nt, Human
cagggccaggcagcagcugucac

SEQ ID NO: 661741 - RNA, 22 nt, Human
augcaaaucuuaaguaugugug

SEQ ID NO: 661742 - RNA, 22 nt, Human
gaggguggcuccucccugggcc

SEQ ID NO: 661743 - RNA, 17 nt, Human
uggcaugaggguguggg

SEQ ID NO: 661744 - RNA, 23 nt, Human
uguuaauacaucugccacucauu

SEQ ID NO: 661745 - RNA, 22 nt, Human
aaguauacugaagguauccagg

SEQ ID NO: 661746 - RNA, 22 nt, Human
cuagagaggugguguugggugg

SEQ ID NO: 661747 - RNA, 22 nt, Human
auggacaggaacucccuuggca

SEQ ID NO: 661748 - RNA, 19 nt, Human
cagugcccgacgcaggucu

SEQ ID NO: 661749 - RNA, 22 nt, Human
uucuguacccaacauuuuuacu

SEQ ID NO: 661750 - RNA, 22 nt, Human
aaaaugaagcaaaggcauucag

SEQ ID NO: 661751 - RNA, 22 nt, Human
uguucuaaguguuuuguucaug

SEQ ID NO: 661752 - RNA, 22 nt, Human
gaagcagcuagcccacuaguca

SEQ ID NO: 661753 - RNA, 22 nt, Human
caucuuuaacagaauggauuug

SEQ ID NO: 661754 - RNA, 22 nt, Human
agugggaggaaguggugauauu

SEQ ID NO: 661755 - RNA, 22 nt, Human
gcgagaaacuaagugcccuuug

SEQ ID NO: 661756 - RNA, 18 nt, Human
augcuccuaucucugagc

SEQ ID NO: 661757 - RNA, 22 nt, Human
cccaggagacauauagaaggac

SEQ ID NO: 661758 - RNA, 22 nt, Human
cugccccaggccucgggaggag

SEQ ID NO: 661759 - RNA, 22 nt, Human
cuucuucagcacaauauugaug

SEQ ID NO: 661760 - RNA, 22 nt, Human
aauuuucugguguguaaugaag

SEQ ID NO: 661761 - RNA, 22 nt, Human
gcuggggagcuagaccucagca

SEQ ID NO: 661762 - RNA, 22 nt, Human
agucucugcacaguaagaagca

SEQ ID NO: 661763 - RNA, 22 nt, Human
gggcuguguacuaugaggaggg

SEQ ID NO: 661764 - RNA, 22 nt, Human
uguccccagguccucugccguc

SEQ ID NO: 661765 - RNA, 22 nt, Human
cuucuuugaaaaaggcagucag

SEQ ID NO: 661766 - RNA, 22 nt, Human
gaaauugucagcuucuuucagu

SEQ ID NO: 661767 - RNA, 22 nt, Human
uggcagaguggaccauacucaa

SEQ ID NO: 661768 - RNA, 20 nt, Human
gacaggugcuaaagaggggc

SEQ ID NO: 661769 - RNA, 22 nt, Human
aacugcaauuacuuuugcacca

SEQ ID NO: 661770 - RNA, 22 nt, Human
accugcuagaagcaaaugucug

SEQ ID NO: 661771 - RNA, 22 nt, Human
gcgucucaaggcccccaggcca

SEQ ID NO: 661772 - RNA, 22 nt, Human
acagcaaucugagagacauagu

SEQ ID NO: 661773 - RNA, 22 nt, Human
ucugggaagugagaugcugugu

SEQ ID NO: 661774 - RNA, 21 nt, Human
augucuguucugauuggugcg

SEQ ID NO: 661775 - RNA, 19 nt, Human
caggucuucuuggaggacu

SEQ ID NO: 661776 - RNA, 22 nt, Human
uauuucacauaccacagagugu

SEQ ID NO: 661777 - RNA, 22 nt, Human
aauccauagguuuuuccaagag

SEQ ID NO: 661778 - RNA, 22 nt, Human
ccagcaucagcacccaaggagc

SEQ ID NO: 661779 - RNA, 22 nt, Human
ccugggugacagagugagaccu

SEQ ID NO: 661780 - RNA, 22 nt, Human
uggagaauucuauguugagggg

SEQ ID NO: 661781 - RNA, 22 nt, Human
uagaggguuauuaggacagaag

SEQ ID NO: 661782 - RNA, 22 nt, Human
ugcaggcagcuaaaccauguaa

SEQ ID NO: 661783 - RNA, 22 nt, Human
cugaacaucccgcagugcacga

SEQ ID NO: 661784 - RNA, 22 nt, Human
cuggaagggagcacuguagaga

SEQ ID NO: 661785 - RNA, 22 nt, Human
gggugggccugucuggccaugu

SEQ ID NO: 661786 - RNA, 22 nt, Human
uuuucccagagcuguccucaag

SEQ ID NO: 661787 - RNA, 22 nt, Human
acuguaauuaucugaacgugca

SEQ ID NO: 661788 - RNA, 22 nt, Human
cccuucagugcgugagaaugag

SEQ ID NO: 661789 - RNA, 22 nt, Human
augaaaguggcuugauuaaaug

SEQ ID NO: 661790 - RNA, 22 nt, Human
augcuuggcagaguucuuuuuc

SEQ ID NO: 661791 - RNA, 22 nt, Human
uggggcugucccgguuuggcga

SEQ ID NO: 661792 - RNA, 22 nt, Human
agugguccugcaaacccgugug

SEQ ID NO: 661793 - RNA, 22 nt, Human
ggcacagcacaguggacccagg

SEQ ID NO: 661794 - RNA, 22 nt, Human
acguguguuuaacaaaccugca

SEQ ID NO: 661795 - RNA, 19 nt, Human
gggaucagcccagggcucu

SEQ ID NO: 661796 - RNA, 20 nt, Human
agcauacaucauaagaaacc

SEQ ID NO: 661797 - RNA, 21 nt, Human
cugugggaccaagcacuggga

SEQ ID NO: 661798 - RNA, 22 nt, Human
gagagaauguacaugcuagggg

SEQ ID NO: 661799 - RNA, 19 nt, Human
aggcaaccaaugaggcaaa

SEQ ID NO: 661800 - RNA, 22 nt, Human
cgaaaucagcaucuugaggcaa

SEQ ID NO: 661801 - RNA, 22 nt, Human
ugaaagcaaccuguaacaguga

SEQ ID NO: 661802 - RNA, 22 nt, Human
cacauuaaaauccuaacuucca

SEQ ID NO: 661803 - RNA, 22 nt, Human
ggaggggcuccuguucgccccc

SEQ ID NO: 661804 - RNA, 22 nt, Human
ccucaggcucugggugccuacc

SEQ ID NO: 661805 - RNA, 22 nt, Human
auucugggacuccuuccucccc

SEQ ID NO: 661806 - RNA, 22 nt, Human
ugcuuaaaguguuaacccuguu

SEQ ID NO: 661807 - RNA, 22 nt, Human
gcaggcucacucuguuuggcuc

SEQ ID NO: 661808 - RNA, 22 nt, Human
cuuagaaauuguuacucauuca

SEQ ID NO: 661809 - RNA, 22 nt, Human
gcuguuagucaguggaugcccc

SEQ ID NO: 661810 - RNA, 22 nt, Human
ugcugggggcuuucuggauacc

SEQ ID NO: 661811 - RNA, 22 nt, Human
cacuuuauaaaauuggugugag

SEQ ID NO: 661812 - RNA, 22 nt, Human
ggacccagaggggagucuggca

SEQ ID NO: 661813 - RNA, 22 nt, Human
gucccagaugucuggaacuccc

SEQ ID NO: 661814 - RNA, 21 nt, Human
gccagccuguuuaccuguggu

SEQ ID NO: 661815 - RNA, 22 nt, Human
guagaaaaagcaguaagucuca

SEQ ID NO: 661816 - RNA, 22 nt, Human
cccagcuguggcagaggccggg

SEQ ID NO: 661817 - RNA, 22 nt, Human
aagcauuuuguuuuaagaauga

SEQ ID NO: 661818 - RNA, 22 nt, Human
ccugccccucaaggccuggugc

SEQ ID NO: 661819 - RNA, 22 nt, Human
ugguaaaguguacugaauauga

SEQ ID NO: 661820 - RNA, 22 nt, Human
gaggaaagaaccccagucaaua

SEQ ID NO: 661821 - RNA, 20 nt, Human
cucugcuuuaggagagucag

SEQ ID NO: 661822 - RNA, 22 nt, Human
gcaagcaaaaugggagauuccc

SEQ ID NO: 661823 - RNA, 22 nt, Human
acaggugaccugcucauaugaa

SEQ ID NO: 661824 - RNA, 22 nt, Human
cugggagaauuuguugaaggau

SEQ ID NO: 661825 - RNA, 22 nt, Human
cuggguccccucagugacacug

SEQ ID NO: 661826 - RNA, 22 nt, Human
caagucaacucaaauuguuauc

SEQ ID NO: 661827 - RNA, 22 nt, Human
ucagauuuugcacgagguuuug

SEQ ID NO: 661828 - RNA, 22 nt, Human
agagccccugguggagugagaa

SEQ ID NO: 661829 - RNA, 22 nt, Human
ccugagucccauaauguugcca

SEQ ID NO: 661830 - RNA, 22 nt, Human
uguagaugagucagggugcacc

SEQ ID NO: 661831 - RNA, 22 nt, Human
uccuuuccaugcuucuagaggc

SEQ ID NO: 661832 - RNA, 19 nt, Human
gcuugcuuuaugaaggggg

SEQ ID NO: 661833 - RNA, 17 nt, Human
uuuauaauuggccucuu

SEQ ID NO: 661834 - RNA, 23 nt, Human
ucugugcucgggggagcucucug

SEQ ID NO: 661835 - RNA, 22 nt, Human
cacggguggaaucagggacucc

SEQ ID NO: 661836 - RNA, 22 nt, Human
gaaauacaggaaugccacacag

SEQ ID NO: 661837 - RNA, 22 nt, Human
guuucauaugcaguuaacagca

SEQ ID NO: 661838 - RNA, 22 nt, Human
cuuguagcugacuaucuuguuc

SEQ ID NO: 661839 - RNA, 22 nt, Human
acacuuuagaaaaaagaauggu

SEQ ID NO: 661840 - RNA, 22 nt, Human
ugugccucauguaucuggauga

SEQ ID NO: 661841 - RNA, 22 nt, Human
uggggagacuggccgagauccu

SEQ ID NO: 661842 - RNA, 22 nt, Human
auguggcugguaguugacaacu

SEQ ID NO: 661843 - RNA, 22 nt, Human
aaaugguauuuacucuguauua

SEQ ID NO: 661844 - RNA, 22 nt, Human
auggacagcaacuggaagcuuc

SEQ ID NO: 661845 - RNA, 22 nt, Human
cuagagaaacagugcucugaac

SEQ ID NO: 661846 - RNA, 22 nt, Human
gcaggccagcugugcagauggg

SEQ ID NO: 661847 - RNA, 22 nt, Human
ugugucugcacugaguccucac

SEQ ID NO: 661848 - RNA, 22 nt, Human
gaggaguggguuagugcuuauu

SEQ ID NO: 661849 - RNA, 22 nt, Human
ggcagguacuggggagugaaga

SEQ ID NO: 661850 - RNA, 22 nt, Human
gggcucuuuucugagcuucacu

SEQ ID NO: 661851 - RNA, 22 nt, Human
ucagagugugacuuggucauga

SEQ ID NO: 661852 - RNA, 22 nt, Human
aacuagucagugauucucagaa

SEQ ID NO: 661853 - RNA, 22 nt, Human
gugagaauaccagcagugagaa

SEQ ID NO: 661854 - RNA, 22 nt, Human
ccaggccuggaccaugccaggg

SEQ ID NO: 661855 - RNA, 22 nt, Human
aagauaaugugucugucuuugc

SEQ ID NO: 661856 - RNA, 22 nt, Human
gcugagugagguccagagcuug

SEQ ID NO: 661857 - RNA, 17 nt, Human
agugaaauuuacauugc

SEQ ID NO: 661858 - RNA, 22 nt, Human
cuggcuggccaugcagcgccag

SEQ ID NO: 661859 - RNA, 22 nt, Human
gagcccuggcagucugggaugg

SEQ ID NO: 661860 - RNA, 22 nt, Human
aucauuuuauggcugagaggac

SEQ ID NO: 661861 - RNA, 22 nt, Human
ugagaaaagguugagaugauaa

SEQ ID NO: 661862 - RNA, 22 nt, Human
auauguuucaguauucaaguca

SEQ ID NO: 661863 - RNA, 22 nt, Human
uucaccccaaauucccagugga

SEQ ID NO: 661864 - RNA, 22 nt, Human
uuugauaauuaaaaauuguagu

SEQ ID NO: 661865 - RNA, 23 nt, Human
caggaaaucaauucuuccagcau

SEQ ID NO: 661866 - RNA, 22 nt, Human
acuaguguccuuauauaagagg

SEQ ID NO: 661867 - RNA, 22 nt, Human
ggaggggucucuagcgaggaga

SEQ ID NO: 661868 - RNA, 22 nt, Human
ugguuucucugaacucuacgac

SEQ ID NO: 661869 - RNA, 22 nt, Human
gcucaggauuucauccaugugu

SEQ ID NO: 661870 - RNA, 22 nt, Human
cucugaaagaguuuaguauuau

SEQ ID NO: 661871 - RNA, 22 nt, Human
caagauaagaucauuuacacua

SEQ ID NO: 661872 - RNA, 22 nt, Human
uucuaugaagguaagauguacg

SEQ ID NO: 661873 - RNA, 16 nt, Human
gcaggcagaucacaug

SEQ ID NO: 661874 - RNA, 22 nt, Human
uaggaagcauuuaaagagaugg

SEQ ID NO: 661875 - RNA, 22 nt, Human
agaagcuguugcauuccuggcg

SEQ ID NO: 661876 - RNA, 22 nt, Human
ugcugccagagagacagggacu

SEQ ID NO: 661877 - RNA, 22 nt, Human
gacaggaacauaaauguaggag

SEQ ID NO: 661878 - RNA, 22 nt, Human
agcagcaaaagagaauaguuug

SEQ ID NO: 661879 - RNA, 22 nt, Human
accacaguuuaguccaaugaca

SEQ ID NO: 661880 - RNA, 22 nt, Human
ucugggcuuuaagaacucuguu

SEQ ID NO: 661881 - RNA, 22 nt, Human
uuugcugugggauauccaugug

SEQ ID NO: 661882 - RNA, 22 nt, Human
aguggcggggauuagcaguguu

SEQ ID NO: 661883 - RNA, 22 nt, Human
gucuuuuuuacaccuuacauca

SEQ ID NO: 661884 - RNA, 22 nt, Human
ucagguggcuucggggaguggc

SEQ ID NO: 661885 - RNA, 23 nt, Human
ccuggcucaccccuuauguccag

SEQ ID NO: 661886 - RNA, 22 nt, Human
cccaggcaguagaaagaagagg

SEQ ID NO: 661887 - RNA, 22 nt, Human
cagaggcagaggucaucucugg

SEQ ID NO: 661888 - RNA, 22 nt, Human
gcugaggugucaccuugcuggg

SEQ ID NO: 661889 - RNA, 22 nt, Human
ucccuggcacaagaaggcuguc

SEQ ID NO: 661890 - RNA, 22 nt, Human
gaauagcuguaggcuagugucu

SEQ ID NO: 661891 - RNA, 22 nt, Human
caccagggcucugagcucugaa

SEQ ID NO: 661892 - RNA, 22 nt, Human
uacugacacaaagccaaucccu

SEQ ID NO: 661893 - RNA, 22 nt, Human
acagagagaauuggguuuacag

SEQ ID NO: 661894 - RNA, 22 nt, Human
agaaggccaagaagaagccuau

SEQ ID NO: 661895 - RNA, 22 nt, Human
ugauuaaaauuuaacuuaguua

SEQ ID NO: 661896 - RNA, 22 nt, Human
auaugcuauugcuguaauuuaa

SEQ ID NO: 661897 - RNA, 17 nt, Human
gcacaaaucaauuacua

SEQ ID NO: 661898 - RNA, 22 nt, Human
uuacagauguuucaggaauacu

SEQ ID NO: 661899 - RNA, 19 nt, Human
aggcaggugcagagguccc

SEQ ID NO: 661900 - RNA, 22 nt, Human
aaaagcaucucaaaggagcuuc

SEQ ID NO: 661901 - RNA, 22 nt, Human
uucuucagacuacugaugauug

SEQ ID NO: 661902 - RNA, 22 nt, Human
uacagcacugugcauagugguu

SEQ ID NO: 661903 - RNA, 22 nt, Human
gccuuggcugaugugcgaauga

SEQ ID NO: 661904 - RNA, 22 nt, Human
aauguguauacuggcaauuaag

SEQ ID NO: 661905 - RNA, 22 nt, Human
auacaugacucacacauucugc

SEQ ID NO: 661906 - RNA, 22 nt, Human
uucagcaaauggcuugagauaa

SEQ ID NO: 661907 - RNA, 22 nt, Human
ggcugagcuuauauaugugcug

SEQ ID NO: 661908 - RNA, 22 nt, Human
uccccugcagaugagggcagug

SEQ ID NO: 661909 - RNA, 22 nt, Human
cagcugagaguagaaauggagg

SEQ ID NO: 661910 - RNA, 22 nt, Human
cuguucuggagacacugaugaa

SEQ ID NO: 661911 - RNA, 22 nt, Human
ugauauuuuucacuggccucug

SEQ ID NO: 661912 - RNA, 22 nt, Human
ucaccagaugauuuuucuucag

SEQ ID NO: 661913 - RNA, 22 nt, Human
gggugguggcggaggcuccagg

SEQ ID NO: 661914 - RNA, 22 nt, Human
agaaacugaauuauuucugagg

SEQ ID NO: 661915 - RNA, 22 nt, Human
ucagcuggugccacucagucaa

SEQ ID NO: 661916 - RNA, 22 nt, Human
uuugaaugacaugauucaggca

SEQ ID NO: 661917 - RNA, 22 nt, Human
ugcuguuauacuuagcugguua

SEQ ID NO: 661918 - RNA, 22 nt, Human
uagcacagacagaauggucaua

SEQ ID NO: 661919 - RNA, 20 nt, Human
caguagcaauaauuagaagc

SEQ ID NO: 661920 - RNA, 22 nt, Human
cacagcugaaguagccaugugg

SEQ ID NO: 661921 - RNA, 22 nt, Human
uuacuuuguucucaagauaugu

SEQ ID NO: 661922 - RNA, 20 nt, Human
guauucuguauucugcucag

SEQ ID NO: 661923 - RNA, 20 nt, Human
accugggguugccugugcuc

SEQ ID NO: 661924 - RNA, 22 nt, Human
gcuuccagaucccaugcucuua

SEQ ID NO: 661925 - RNA, 22 nt, Human
ggcagguguuuuuauauuaaag

SEQ ID NO: 661926 - RNA, 22 nt, Human
cugcaucaguggauaugauggu

SEQ ID NO: 661927 - RNA, 22 nt, Human
uucccuaaugucuaacgcuauu

SEQ ID NO: 661928 - RNA, 22 nt, Human
ugcagcaggugacaacgagugg

SEQ ID NO: 661929 - RNA, 22 nt, Human
ugaaagcagcaccaauaccauu

SEQ ID NO: 661930 - RNA, 22 nt, Human
cugagagguaagcagcgcagug

SEQ ID NO: 661931 - RNA, 22 nt, Human
uugaaguucuaagccccaguac

SEQ ID NO: 661932 - RNA, 22 nt, Human
uguagaaagaauauguuucaua

SEQ ID NO: 661933 - RNA, 22 nt, Human
guggggaguguucugugauugg

SEQ ID NO: 661934 - RNA, 22 nt, Human
aggagaaguaaggcuagaugau

SEQ ID NO: 661935 - RNA, 22 nt, Human
acuuuacaagcuuauagccuag

SEQ ID NO: 661936 - RNA, 22 nt, Human
uucucagugaaguuuagaacau

SEQ ID NO: 661937 - RNA, 20 nt, Human
aacacugaggccuacucuuc

SEQ ID NO: 661938 - RNA, 22 nt, Human
ccaggaggaucauccuguuuuc

SEQ ID NO: 661939 - RNA, 22 nt, Human
caaauuccucagaaucagaaaa

SEQ ID NO: 661940 - RNA, 22 nt, Human
uaaccucuauuuuuauaaaagu

SEQ ID NO: 661941 - RNA, 22 nt, Human
uacagagauuuauugcuaaggc

SEQ ID NO: 661942 - RNA, 22 nt, Human
aaacuuuuccugcucuuguccu

SEQ ID NO: 661943 - RNA, 19 nt, Human
ggacaucacucuaagccuu

SEQ ID NO: 661944 - RNA, 22 nt, Human
gggcagguggccucuuguacua

SEQ ID NO: 661945 - RNA, 18 nt, Human
uuuauuccugcccccagc

SEQ ID NO: 661946 - RNA, 18 nt, Human
cuagagaagguuacuaug

SEQ ID NO: 661947 - RNA, 22 nt, Human
cugaguucuaggcugccaccuu

SEQ ID NO: 661948 - RNA, 22 nt, Human
auuguugagugcuucagcugua

SEQ ID NO: 661949 - RNA, 22 nt, Human
uaugggucuggaaaauggcuug

SEQ ID NO: 661950 - RNA, 22 nt, Human
agucucagaaaauaugcuuuuu

SEQ ID NO: 661951 - RNA, 22 nt, Human
gcaacaaguguaaacaugcauu

SEQ ID NO: 661952 - RNA, 22 nt, Human
aauauuuauauuucucuucccu

SEQ ID NO: 661953 - RNA, 22 nt, Human
uaaugucaaggucauucuagag

SEQ ID NO: 661954 - RNA, 19 nt, Human
gcaggcaguggcauucgga

SEQ ID NO: 661955 - RNA, 22 nt, Human
cagauggcugccuucuugcugu

SEQ ID NO: 661956 - RNA, 22 nt, Human
agcagcucuggcacuguagcau

SEQ ID NO: 661957 - RNA, 22 nt, Human
caugcagugacucagacacagg

SEQ ID NO: 661958 - RNA, 17 nt, Human
gaccaggagaaaccagg

SEQ ID NO: 661959 - RNA, 22 nt, Human
gcuuguuucuauuuaucaagua

SEQ ID NO: 661960 - RNA, 22 nt, Human
uucucuucaucucaguaaaugu

SEQ ID NO: 661961 - RNA, 22 nt, Human
ucugguccucucugugaugcua

SEQ ID NO: 661962 - RNA, 22 nt, Human
aaguucuugauaaguccacugu

SEQ ID NO: 661963 - RNA, 22 nt, Human
aaagauugaucaugaauugaca

SEQ ID NO: 661964 - RNA, 22 nt, Human
aggggccauuguucugcccgcu

SEQ ID NO: 661965 - RNA, 20 nt, Human
agugucugggccucaggccc

SEQ ID NO: 661966 - RNA, 22 nt, Human
uuauuuacaacucuucucuucc

SEQ ID NO: 661967 - RNA, 22 nt, Human
uacagugugaauaagcaggcau

SEQ ID NO: 661968 - RNA, 22 nt, Human
caugcuuucuguccaaauguua

SEQ ID NO: 661969 - RNA, 22 nt, Human
ucugagccaauuucugugucca

SEQ ID NO: 661970 - RNA, 22 nt, Human
ugugggacagggacagcaagag

SEQ ID NO: 661971 - RNA, 22 nt, Human
acacucuguaaugucacacucc

SEQ ID NO: 661972 - RNA, 22 nt, Human
aggaagggagcaguuuguuguu

SEQ ID NO: 661973 - RNA, 22 nt, Human
cugaggccagagugggccucuu

SEQ ID NO: 661974 - RNA, 22 nt, Human
agacauuuuacauucuuccauu

SEQ ID NO: 661975 - RNA, 23 nt, Human
ugagagccuggcagccuggguuc

SEQ ID NO: 661976 - RNA, 20 nt, Human
cugcuguguuauuguagaac

SEQ ID NO: 661977 - RNA, 22 nt, Human
cccauuuaaacacaagcuuuca

SEQ ID NO: 661978 - RNA, 22 nt, Human
caggaugcuucuggggccaggc

SEQ ID NO: 661979 - RNA, 22 nt, Human
auguaauuugcccucaaguuaa

SEQ ID NO: 661980 - RNA, 22 nt, Human
ggcuuccuggggccuccugcaa

SEQ ID NO: 661981 - RNA, 22 nt, Human
ccacuggaagaugcugagguca

SEQ ID NO: 661982 - RNA, 18 nt, Human
uggcuggcucugucaucu

SEQ ID NO: 661983 - RNA, 22 nt, Human
ggugugaaauguucaguguuac

SEQ ID NO: 661984 - RNA, 22 nt, Human
aaauucaguuuuaauaaucacu

SEQ ID NO: 661985 - RNA, 22 nt, Human
gcagccugaggcccuuucuggc

SEQ ID NO: 661986 - RNA, 22 nt, Human
caucagaagauggcucuggaaa

SEQ ID NO: 661987 - RNA, 22 nt, Human
agggaugaucaggguagaggcu

SEQ ID NO: 661988 - RNA, 22 nt, Human
cacauuaagaauaaugagacua

SEQ ID NO: 661989 - RNA, 22 nt, Human
agagugggacacgggcgcuguc

SEQ ID NO: 661990 - RNA, 22 nt, Human
uguccugcaagcccuaaugaau

SEQ ID NO: 661991 - RNA, 22 nt, Human
cuggcagauagccacgccuguc

SEQ ID NO: 661992 - RNA, 22 nt, Human
cagaggaagagauacaagcccu

SEQ ID NO: 661993 - RNA, 22 nt, Human
ugggccuggacaucuguauuuu

SEQ ID NO: 661994 - RNA, 22 nt, Human
aaaaucuugacuguuuuuagaa

SEQ ID NO: 661995 - RNA, 22 nt, Human
gcaguguugagccagcuggggg

SEQ ID NO: 661996 - RNA, 22 nt, Human
aaguuauuuuucaagauccuuu

SEQ ID NO: 661997 - RNA, 22 nt, Human
gacagggcugugggaggagcag

SEQ ID NO: 661998 - RNA, 22 nt, Human
aucuagcaguguuauaauugga

SEQ ID NO: 661999 - RNA, 22 nt, Human
ucuauacaaguuucacuuugac

SEQ ID NO: 662000 - RNA, 22 nt, Human
gugggcaggccccaaagcaggg

SEQ ID NO: 662001 - RNA, 22 nt, Human
ccauagugccaagucuucagca

SEQ ID NO: 662002 - RNA, 22 nt, Human
ugggcuagcagggaagagagac

SEQ ID NO: 662003 - RNA, 22 nt, Human
agugucuuugucucucaagcac

SEQ ID NO: 662004 - RNA, 22 nt, Human
agcccuaaauuaucuuuauuuu

SEQ ID NO: 662005 - RNA, 22 nt, Human
ccggcgaccgcugucggaggcg

SEQ ID NO: 662006 - RNA, 22 nt, Human
ggacugggaaucagggagaugc

SEQ ID NO: 662007 - RNA, 22 nt, Human
agugaugugggagaguauagcu

SEQ ID NO: 662008 - RNA, 22 nt, Human
uggucaggcugcucugcggcgu

SEQ ID NO: 662009 - RNA, 22 nt, Human
uuaagacauucagauauuucua

SEQ ID NO: 662010 - RNA, 20 nt, Human
uccaagcccuccuuccauuc

SEQ ID NO: 662011 - RNA, 22 nt, Human
uagaugaauuagcaauuaucuu

SEQ ID NO: 662012 - RNA, 20 nt, Human
uggcuccucuuggcuguggc

SEQ ID NO: 662013 - RNA, 22 nt, Human
ucugcgugaauuugcauugugg

SEQ ID NO: 662014 - RNA, 22 nt, Human
ggcugccaggagaagcucagug

SEQ ID NO: 662015 - RNA, 18 nt, Human
agacaaacuucuucugcc

SEQ ID NO: 662016 - RNA, 23 nt, Human
uuuaaugaccaauagaaggaaca

SEQ ID NO: 662017 - RNA, 22 nt, Human
uccugggcagcgggacgcucag

SEQ ID NO: 662018 - RNA, 22 nt, Human
uugcaaaugugguuagggcuuu

SEQ ID NO: 662019 - RNA, 22 nt, Human
uccagggcagugacuacagcgg

SEQ ID NO: 662020 - RNA, 22 nt, Human
uaccaaguguauuaugcuuugu

SEQ ID NO: 662021 - RNA, 22 nt, Human
cuccaggcccacggccgcggcc

SEQ ID NO: 662022 - RNA, 22 nt, Human
uucugcaugauauuaaauguaa

SEQ ID NO: 662023 - RNA, 22 nt, Human
ucucucacuggugccucuguug

SEQ ID NO: 662024 - RNA, 22 nt, Human
gagucuggaaugaugaagaccu

SEQ ID NO: 662025 - RNA, 22 nt, Human
uaugugcaaaaugcuagacuag

SEQ ID NO: 662026 - RNA, 22 nt, Human
guguggcuugggugaggcgccu

SEQ ID NO: 662027 - RNA, 22 nt, Human
ucaaaugcugccuuugugugcc

SEQ ID NO: 662028 - RNA, 17 nt, Human
cugggauguggacucuu

SEQ ID NO: 662029 - RNA, 22 nt, Human
caggcacaaauuucuagauaag

SEQ ID NO: 662030 - RNA, 22 nt, Human
caaagucauggggaugcagguc

SEQ ID NO: 662031 - RNA, 22 nt, Human
ugcagaagcugcaggucagugg

SEQ ID NO: 662032 - RNA, 22 nt, Human
augcaugugcauggcucuaucu

SEQ ID NO: 662033 - RNA, 22 nt, Human
auggaucuaccuucaggcucug

SEQ ID NO: 662034 - RNA, 22 nt, Human
gaacauucuuggaggaaauaac

SEQ ID NO: 662035 - RNA, 22 nt, Human
cugucugccaauaaucuauggc

SEQ ID NO: 662036 - RNA, 18 nt, Human
augagaggugucagaaga

SEQ ID NO: 662037 - RNA, 22 nt, Human
uagaaauguuagauguauugag

SEQ ID NO: 662038 - RNA, 22 nt, Human
uuacauaacuuuaaaaugccgu

SEQ ID NO: 662039 - RNA, 22 nt, Human
uggcacuggaaucguagccuug

SEQ ID NO: 662040 - RNA, 22 nt, Human
uggggcaagaagugcccugaag

SEQ ID NO: 662041 - RNA, 22 nt, Human
ccuaagauuggugugcacugug

SEQ ID NO: 662042 - RNA, 22 nt, Human
cagaaguaagauuacugugagu

SEQ ID NO: 662043 - RNA, 22 nt, Human
aggcugugcacagggcaccugc

SEQ ID NO: 662044 - RNA, 22 nt, Human
ggaguucacugugcaggcucug

SEQ ID NO: 662045 - RNA, 22 nt, Human
aggcuccuugcucacaggcuca

SEQ ID NO: 662046 - RNA, 22 nt, Human
cuuggaaagguuuuacaaagcg

SEQ ID NO: 662047 - RNA, 22 nt, Human
acagcaguuaacgaucagacuc

SEQ ID NO: 662048 - RNA, 22 nt, Human
agcucugggguggagcccagga

SEQ ID NO: 662049 - RNA, 22 nt, Human
agacucaagcagauaggaauua

SEQ ID NO: 662050 - RNA, 22 nt, Human
gcucugcuggaaguucucugga

SEQ ID NO: 662051 - RNA, 22 nt, Human
ugaauaguucuacuacuugaca

SEQ ID NO: 662052 - RNA, 22 nt, Human
uaaaagacauauaacuguagga

SEQ ID NO: 662053 - RNA, 22 nt, Human
agcuucuuaguucacuuuuaau

SEQ ID NO: 662054 - RNA, 22 nt, Human
ucccaggauguuggcggcaggu

SEQ ID NO: 662055 - RNA, 22 nt, Human
agcugccagcaucccggaaggg

SEQ ID NO: 662056 - RNA, 22 nt, Human
ugccccucuccugugauccaag

SEQ ID NO: 662057 - RNA, 22 nt, Human
augaagacuaaugugaauggga

SEQ ID NO: 662058 - RNA, 22 nt, Human
cuggcuguaacauuuugccaua

SEQ ID NO: 662059 - RNA, 22 nt, Human
agggcuguuuuucaguguguga

SEQ ID NO: 662060 - RNA, 22 nt, Human
guggcaugacagugaaugggca

SEQ ID NO: 662061 - RNA, 22 nt, Human
cagcugcugccucauccacuuu

SEQ ID NO: 662062 - RNA, 22 nt, Human
gccacagcaacaauaaugcagc

SEQ ID NO: 662063 - RNA, 17 nt, Human
ugagcaguagaagaugc

SEQ ID NO: 662064 - RNA, 22 nt, Human
uuuacacuuuccugggaacauc

SEQ ID NO: 662065 - RNA, 22 nt, Human
aacauuucagcaaauaagaaca

SEQ ID NO: 662066 - RNA, 22 nt, Human
uccagcaugacuaguuccccau

SEQ ID NO: 662067 - RNA, 22 nt, Human
ucccagcccagacuucuccagu

SEQ ID NO: 662068 - RNA, 22 nt, Human
caccaggcuggagugcagaggu

SEQ ID NO: 662069 - RNA, 23 nt, Human
aagacuaauucuuaauugcuuag

SEQ ID NO: 662070 - RNA, 22 nt, Human
gggugcaggcagcccaggcagg

SEQ ID NO: 662071 - RNA, 22 nt, Human
acagccagaggagccaggcugg

SEQ ID NO: 662072 - RNA, 22 nt, Human
gccagcagcucuugggcgggca

SEQ ID NO: 662073 - RNA, 22 nt, Human
gacaguuuugcugaaauugagc

SEQ ID NO: 662074 - RNA, 22 nt, Human
gcuggaguuggcaaggcaugua

SEQ ID NO: 662075 - RNA, 22 nt, Human
agaaaguuuguuuuuauccaua

SEQ ID NO: 662076 - RNA, 22 nt, Human
ucagugcuugacagcucuggga

SEQ ID NO: 662077 - RNA, 22 nt, Human
aaagcacuauagccaaauagcc

SEQ ID NO: 662078 - RNA, 19 nt, Human
agucucaguguacagaggc

SEQ ID NO: 662079 - RNA, 22 nt, Human
gaucuguuuuuucuuagacagu

SEQ ID NO: 662080 - RNA, 22 nt, Human
auuacaacuacauaaucucaga

SEQ ID NO: 662081 - RNA, 22 nt, Human
cauggcuuggagcaggaugaga

SEQ ID NO: 662082 - RNA, 22 nt, Human
ccugggccucacccagcucuug

SEQ ID NO: 662083 - RNA, 22 nt, Human
cugacucagcagcugaugaucc

SEQ ID NO: 662084 - RNA, 20 nt, Human
gcaggcccucucucuagucu

SEQ ID NO: 662085 - RNA, 22 nt, Human
ucagagugguagccuauuuucu

SEQ ID NO: 662086 - RNA, 22 nt, Human
uuaacauuucuuuuccacucau

SEQ ID NO: 662087 - RNA, 22 nt, Human
gccaguggcaugcggcagggac

SEQ ID NO: 662088 - RNA, 22 nt, Human
uuuguacagugaaagcgagguu

SEQ ID NO: 662089 - RNA, 22 nt, Human
auagucuuuacugcugaauuga

SEQ ID NO: 662090 - RNA, 22 nt, Human
ccagugcacaauggaacaacuc

SEQ ID NO: 662091 - RNA, 22 nt, Human
ucaacacuuuugucuuuguccc

SEQ ID NO: 662092 - RNA, 18 nt, Human
uuacuacagcacuuucuu

SEQ ID NO: 662093 - RNA, 22 nt, Human
uguuuauaauaugcagugagca

SEQ ID NO: 662094 - RNA, 22 nt, Human
ucaguucuuaguaaugcagucu

SEQ ID NO: 662095 - RNA, 22 nt, Human
cugugcccaggcuggagugcag

SEQ ID NO: 662096 - RNA, 22 nt, Human
cuggcuccaggucaugcacuca

SEQ ID NO: 662097 - RNA, 19 nt, Human
ugucucagugucccuuccu

SEQ ID NO: 662098 - RNA, 19 nt, Human
ugucaggggugugcugugc

SEQ ID NO: 662099 - RNA, 22 nt, Human
uucaauuuugcagaggaaugca

SEQ ID NO: 662100 - RNA, 22 nt, Human
auggccaggguggcacuguggu

SEQ ID NO: 662101 - RNA, 22 nt, Human
ggucuucagcuuugcaugucuu

SEQ ID NO: 662102 - RNA, 22 nt, Human
gaauaauauugacuuugcaggc

SEQ ID NO: 662103 - RNA, 22 nt, Human
agggcuggcuccguuaccuuga

SEQ ID NO: 662104 - RNA, 22 nt, Human
ugggagauauugcuguggcugu

SEQ ID NO: 662105 - RNA, 22 nt, Human
ucuguggcaugguaucuggagg

SEQ ID NO: 662106 - RNA, 22 nt, Human
acugcacacacagaauuuaggg

SEQ ID NO: 662107 - RNA, 22 nt, Human
aaugucugccagaacugaucau

SEQ ID NO: 662108 - RNA, 22 nt, Human
uacuuuuccagggcuggcugag

SEQ ID NO: 662109 - RNA, 22 nt, Human
aagagaaggcccugacccaccc

SEQ ID NO: 662110 - RNA, 22 nt, Human
caaacuuuuccuggaaaagauu

SEQ ID NO: 662111 - RNA, 22 nt, Human
uucuuuucugcagcugguauuu

SEQ ID NO: 662112 - RNA, 22 nt, Human
gaagauuuauaaggaccuuauu

SEQ ID NO: 662113 - RNA, 22 nt, Human
cagcagcugacuccaagagagc

SEQ ID NO: 662114 - RNA, 22 nt, Human
gugaacagauaauagaaaugaa

SEQ ID NO: 662115 - RNA, 22 nt, Human
agggacugagcuaggaucuagu

SEQ ID NO: 662116 - RNA, 22 nt, Human
aaaggauuaaauaaaugugcug

SEQ ID NO: 662117 - RNA, 22 nt, Human
aggcacagagaaguaaaguauc

SEQ ID NO: 662118 - RNA, 19 nt, Human
ucuucugacuucaagaaac

SEQ ID NO: 662119 - RNA, 22 nt, Human
agacagaauuugucagauaaau

SEQ ID NO: 662120 - RNA, 22 nt, Human
aggaggcugguucaggccauau

SEQ ID NO: 662121 - RNA, 22 nt, Human
acucccuuuucccguaaucuau

SEQ ID NO: 662122 - RNA, 22 nt, Human
ugaagacacauacaagggaaug

SEQ ID NO: 662123 - RNA, 22 nt, Human
agccaugggagacugugggaga

SEQ ID NO: 662124 - RNA, 22 nt, Human
ugcugcagcuaaggugaggugc

SEQ ID NO: 662125 - RNA, 19 nt, Human
aucuuacagagcagaguac

SEQ ID NO: 662126 - RNA, 22 nt, Human
cacuacagggguccacagcuga

SEQ ID NO: 662127 - RNA, 22 nt, Human
uuugaaugugugaguuaacuuu

SEQ ID NO: 662128 - RNA, 22 nt, Human
cccaggaggcagagguuggagc

SEQ ID NO: 662129 - RNA, 22 nt, Human
aggaaugauucaagacuuggcu

SEQ ID NO: 662130 - RNA, 17 nt, Human
agcacuugaaaauuucu

SEQ ID NO: 662131 - RNA, 22 nt, Human
uuucuuguuucauggugucuca

SEQ ID NO: 662132 - RNA, 18 nt, Human
caugagcugccccuagac

SEQ ID NO: 662133 - RNA, 22 nt, Human
uggccugguccuugucaaggca

SEQ ID NO: 662134 - RNA, 22 nt, Human
cugugcauuguugaguguuuag

SEQ ID NO: 662135 - RNA, 22 nt, Human
uuuggcagagucauuucagaaa

SEQ ID NO: 662136 - RNA, 22 nt, Human
gccaaggccucugcaggaugag

SEQ ID NO: 662137 - RNA, 22 nt, Human
agggccagcugaugagaaugag

SEQ ID NO: 662138 - RNA, 19 nt, Human
ucaggaguuaguugugcuc

SEQ ID NO: 662139 - RNA, 22 nt, Human
gagagggcaagguagaugcuac

SEQ ID NO: 662140 - RNA, 22 nt, Human
aacaggagaguaaauauaugau

SEQ ID NO: 662141 - RNA, 22 nt, Human
agaaaucucaguaucucaggga

SEQ ID NO: 662142 - RNA, 22 nt, Human
augggaucuugcccugagggcu

SEQ ID NO: 662143 - RNA, 22 nt, Human
ucugagagauacaaggaggcaa

SEQ ID NO: 662144 - RNA, 23 nt, Human
cccaggaguuucacugcaaaggu

SEQ ID NO: 662145 - RNA, 20 nt, Human
uauucaacuuuaaaaacuua

SEQ ID NO: 662146 - RNA, 22 nt, Human
ucugagaaggugcaucagcugc

SEQ ID NO: 662147 - RNA, 22 nt, Human
gucauucaacugcacauuaggu

SEQ ID NO: 662148 - RNA, 19 nt, Human
cagauguuuucaguucauu

SEQ ID NO: 662149 - RNA, 20 nt, Human
ucuuccagcuucugguagaa

SEQ ID NO: 662150 - RNA, 18 nt, Human
cugcccagagcacuugug

SEQ ID NO: 662151 - RNA, 22 nt, Human
caggaaggggcucacucuggcc

SEQ ID NO: 662152 - RNA, 22 nt, Human
aggcccuggccugacucaaugu

SEQ ID NO: 662153 - RNA, 22 nt, Human
uccugcagagucccacugauuu

SEQ ID NO: 662154 - RNA, 22 nt, Human
ggcucugcugcacccuuggcuc

SEQ ID NO: 662155 - RNA, 22 nt, Human
acucccuccaaaucugcacagu

SEQ ID NO: 662156 - RNA, 22 nt, Human
ucacugugguauauauguauca

SEQ ID NO: 662157 - RNA, 22 nt, Human
ccaaaguuuuuauaguuagcau

SEQ ID NO: 662158 - RNA, 22 nt, Human
aggcuaaggagugugaugcuca

SEQ ID NO: 662159 - RNA, 20 nt, Human
agggccuggaguacagcagg

SEQ ID NO: 662160 - RNA, 21 nt, Human
gaaaagcaagggaguagaaca

SEQ ID NO: 662161 - RNA, 22 nt, Human
gcaggaguucaauugcccauga

SEQ ID NO: 662162 - RNA, 22 nt, Human
ucuggagaccugcauuuauauu

SEQ ID NO: 662163 - RNA, 22 nt, Human
agauacaaguuaagagaaagga

SEQ ID NO: 662164 - RNA, 22 nt, Human
accccacagcauacaaaggcac

SEQ ID NO: 662165 - RNA, 22 nt, Human
gugauggguaacuguuuaggga

SEQ ID NO: 662166 - RNA, 22 nt, Human
uggagcuugggacucuugguag

SEQ ID NO: 662167 - RNA, 22 nt, Human
gagcagugacuggagcaugaga

SEQ ID NO: 662168 - RNA, 22 nt, Human
cggcaggaccucauuuccuucu

SEQ ID NO: 662169 - RNA, 22 nt, Human
ucccagcaagaaaggggguggc

SEQ ID NO: 662170 - RNA, 22 nt, Human
ggcagguggcacugcugcuccc

SEQ ID NO: 662171 - RNA, 22 nt, Human
ugaaggccagggauuugcagcc

SEQ ID NO: 662172 - RNA, 21 nt, Human
ucuauaacuauagugacagau

SEQ ID NO: 662173 - RNA, 18 nt, Human
auaaagugcuaauaaugg

SEQ ID NO: 662174 - RNA, 22 nt, Human
acaacauuuaaggaggcacuga

SEQ ID NO: 662175 - RNA, 22 nt, Human
ugcuggaauuuuucuaggauuu

SEQ ID NO: 662176 - RNA, 22 nt, Human
gggcacuggugcugccaucuug

SEQ ID NO: 662177 - RNA, 22 nt, Human
cccacccagcugagccgcucac

SEQ ID NO: 662178 - RNA, 21 nt, Human
gcccccuggacuccucaucca

SEQ ID NO: 662179 - RNA, 22 nt, Human
gccugcagccagggaguucucu

SEQ ID NO: 662180 - RNA, 22 nt, Human
uuuccucuucuggcaggcaggg

SEQ ID NO: 662181 - RNA, 22 nt, Human
uuacaagcagcuacauaucaca

SEQ ID NO: 662182 - RNA, 21 nt, Human
uguuuauggaaaagagacaaa

SEQ ID NO: 662183 - RNA, 22 nt, Human
acucagcuugcacacaucaaug

SEQ ID NO: 662184 - RNA, 22 nt, Human
gggagucugggcuagacuccuu

SEQ ID NO: 662185 - RNA, 22 nt, Human
uucccuccgaaccucagugcug

SEQ ID NO: 662186 - RNA, 22 nt, Human
cugcagcugcucauguuacuug

SEQ ID NO: 662187 - RNA, 19 nt, Human
uaagauggcaagugucucu

SEQ ID NO: 662188 - RNA, 19 nt, Human
gggcauggaugagcuuacc

SEQ ID NO: 662189 - RNA, 22 nt, Human
aaucagaaaggcuaaggaagca

SEQ ID NO: 662190 - RNA, 22 nt, Human
uucuuuuaauguucugaaguuu

SEQ ID NO: 662191 - RNA, 22 nt, Human
uucuuacaaacaagaucauuga

SEQ ID NO: 662192 - RNA, 22 nt, Human
agucucagcuacuugggaggcu

SEQ ID NO: 662193 - RNA, 22 nt, Human
uauuuauauucugccuucugcu

SEQ ID NO: 662194 - RNA, 22 nt, Human
gagauucuaagucguugguuag

SEQ ID NO: 662195 - RNA, 22 nt, Human
cacugagaaagugaccugccaa

SEQ ID NO: 662196 - RNA, 22 nt, Human
cacauucagcucauuaaugguc

SEQ ID NO: 662197 - RNA, 22 nt, Human
cugaauaauguucucuuguaug

SEQ ID NO: 662198 - RNA, 22 nt, Human
uaaucacaucaggguaaauggg

SEQ ID NO: 662199 - RNA, 22 nt, Human
acauucaaaauuagguuaguug

SEQ ID NO: 662200 - RNA, 22 nt, Human
uaugagaaagucguaugucucc

SEQ ID NO: 662201 - RNA, 22 nt, Human
uugcugaauugaauccuuuggu

SEQ ID NO: 662202 - RNA, 22 nt, Human
ugcguugcgcuccugcagcagg

SEQ ID NO: 662203 - RNA, 22 nt, Human
cacuguggugccaaaccuggag

SEQ ID NO: 662204 - RNA, 22 nt, Human
gucaggacucugacccgucccg

SEQ ID NO: 662205 - RNA, 21 nt, Human
cucugcugucuaccagcuguu

SEQ ID NO: 662206 - RNA, 22 nt, Human
caggccagugggaaauagggau

SEQ ID NO: 662207 - RNA, 22 nt, Human
ugagcccaggaguuggagaccg

SEQ ID NO: 662208 - RNA, 22 nt, Human
uagaaacagagcagguggccca

SEQ ID NO: 662209 - RNA, 22 nt, Human
ccagccaguccagcauuggugu

SEQ ID NO: 662210 - RNA, 22 nt, Human
aacuguaaagguugagugguaa

SEQ ID NO: 662211 - RNA, 22 nt, Human
agacagugugaguucagggugg

SEQ ID NO: 662212 - RNA, 22 nt, Human
uuucuaacagcaaauguuuauc

SEQ ID NO: 662213 - RNA, 22 nt, Human
acaucauucagggccucguugg

SEQ ID NO: 662214 - RNA, 22 nt, Human
aggcacagggaugcggagccag

SEQ ID NO: 662215 - RNA, 22 nt, Human
uguacauacauagauauacaca

SEQ ID NO: 662216 - RNA, 22 nt, Human
ccucucucuuguagucccugcc

SEQ ID NO: 662217 - RNA, 22 nt, Human
gcugggagugggcaagaugaga

SEQ ID NO: 662218 - RNA, 20 nt, Human
cugcuugggacacugccaga

SEQ ID NO: 662219 - RNA, 22 nt, Human
agccugagcugccugccgccuc

SEQ ID NO: 662220 - RNA, 22 nt, Human
aaacuuuucuuggggaccugcc

SEQ ID NO: 662221 - RNA, 22 nt, Human
gauuuucauuugcacucuagaa

SEQ ID NO: 662222 - RNA, 22 nt, Human
ggaguagcugcauuccgagcac

SEQ ID NO: 662223 - RNA, 22 nt, Human
uccugcuucuucgagcuucugg

SEQ ID NO: 662224 - RNA, 22 nt, Human
uuucaaagguggaagagugaau

SEQ ID NO: 662225 - RNA, 22 nt, Human
ucuggcucccagccugcucuca

SEQ ID NO: 662226 - RNA, 22 nt, Human
uuguacaaguauuaugugaaca

SEQ ID NO: 662227 - RNA, 22 nt, Human
aaugauuuccccuacacagaag

SEQ ID NO: 662228 - RNA, 22 nt, Human
gccaggcagagccccgugcagc

SEQ ID NO: 662229 - RNA, 22 nt, Human
agggcucagagcaaaagggcac

SEQ ID NO: 662230 - RNA, 22 nt, Human
aauuucaauuacuuuugcacca

SEQ ID NO: 662231 - RNA, 22 nt, Human
gauggcagguaguggucucauc

SEQ ID NO: 662232 - RNA, 22 nt, Human
cacacaucuuaucccaguuauu

SEQ ID NO: 662233 - RNA, 22 nt, Human
ccacaguagcauccaaacagua

SEQ ID NO: 662234 - RNA, 22 nt, Human
uuuauugcugagaaggauucca

SEQ ID NO: 662235 - RNA, 20 nt, Human
auauaggcauaguaaaauga

SEQ ID NO: 662236 - RNA, 22 nt, Human
gaaaguaacauuucuugaauua

SEQ ID NO: 662237 - RNA, 22 nt, Human
gucacacagguugaaaugcagu

SEQ ID NO: 662238 - RNA, 22 nt, Human
caugcucugcagcagaccugug

SEQ ID NO: 662239 - RNA, 22 nt, Human
aguguauggaauuagcucccuu

SEQ ID NO: 662240 - RNA, 22 nt, Human
ggaucaggcgccaugggaagug

SEQ ID NO: 662241 - RNA, 22 nt, Human
uguuuacaaaaccgugguacug

SEQ ID NO: 662242 - RNA, 22 nt, Human
ugucaagugauuagccauaaug

SEQ ID NO: 662243 - RNA, 22 nt, Human
caugaacagcuaacauuuuggg

SEQ ID NO: 662244 - RNA, 22 nt, Human
aucacgugcugagaguguuauu

SEQ ID NO: 662245 - RNA, 22 nt, Human
cuggagcauuuucugcuucugc

SEQ ID NO: 662246 - RNA, 22 nt, Human
gucuggggguccgggugccugc

SEQ ID NO: 662247 - RNA, 22 nt, Human
uacaaaggcagguuucccagga

SEQ ID NO: 662248 - RNA, 22 nt, Human
caucacaaaaugauuauucccu

SEQ ID NO: 662249 - RNA, 22 nt, Human
ugcugggcuugaaagcugcuaa

SEQ ID NO: 662250 - RNA, 22 nt, Human
acaagagugagauuaucaugua

SEQ ID NO: 662251 - RNA, 22 nt, Human
aggugggaacccagcagggccc

SEQ ID NO: 662252 - RNA, 22 nt, Human
gggcucagccccauugaaccag

SEQ ID NO: 662253 - RNA, 22 nt, Human
agcugccuaguagauugauugg

SEQ ID NO: 662254 - RNA, 22 nt, Human
uuggacugguuuacauuucaag

SEQ ID NO: 662255 - RNA, 22 nt, Human
cugggucaguggcaagcugggu

SEQ ID NO: 662256 - RNA, 22 nt, Human
acugaggcgcaguccggcuguc

SEQ ID NO: 662257 - RNA, 22 nt, Human
uccagggcagggugcgcauggg

SEQ ID NO: 662258 - RNA, 22 nt, Human
agggucaaaugggcaggaagag

SEQ ID NO: 662259 - RNA, 22 nt, Human
uaaacuguggaauguucucuuu

SEQ ID NO: 662260 - RNA, 22 nt, Human
aagauguuaaaucuguagaauu

SEQ ID NO: 662261 - RNA, 22 nt, Human
cacuggaaccaagacccagggc

SEQ ID NO: 662262 - RNA, 22 nt, Human
gauggugcaggugaagugcugg

SEQ ID NO: 662263 - RNA, 22 nt, Human
ucucuguaaaauguggaugaua

SEQ ID NO: 662264 - RNA, 22 nt, Human
acaguagagcauuuguuuugau

SEQ ID NO: 662265 - RNA, 22 nt, Human
aaucaugaaauaucaguucuuu

SEQ ID NO: 662266 - RNA, 22 nt, Human
cuguagcugacaggaucacuua

SEQ ID NO: 662267 - RNA, 23 nt, Human
uggggagggaagucauuucugua

SEQ ID NO: 662268 - RNA, 22 nt, Human
auuuacauaauagacuuuaggu

SEQ ID NO: 662269 - RNA, 22 nt, Human
caggcccugggcaggcacagag

SEQ ID NO: 662270 - RNA, 22 nt, Human
ugagcaucuucgugaaagcuuc

SEQ ID NO: 662271 - RNA, 22 nt, Human
uucuuaaucuguguggguucga

SEQ ID NO: 662272 - RNA, 22 nt, Human
uggucagugugacauuuuuuaa

SEQ ID NO: 662273 - RNA, 22 nt, Human
uuuucaugugaugugacauuuc

SEQ ID NO: 662274 - RNA, 22 nt, Human
caggaauguccuugucauuuca

SEQ ID NO: 662275 - RNA, 22 nt, Human
gugcauuugacgaauacucacu

SEQ ID NO: 662276 - RNA, 22 nt, Human
aaccaugaauggguucuggugu

SEQ ID NO: 662277 - RNA, 22 nt, Human
ggcagcugcacguugucccguc

SEQ ID NO: 662278 - RNA, 22 nt, Human
agcugaugccauguggaacagu

SEQ ID NO: 662279 - RNA, 22 nt, Human
aaagaacuaaugugcaagguuu

SEQ ID NO: 662280 - RNA, 22 nt, Human
gcccaggggcagcgcauagugg

SEQ ID NO: 662281 - RNA, 22 nt, Human
cagagguagaaggcaugcagug

SEQ ID NO: 662282 - RNA, 22 nt, Human
uacacagugaguccucucugcc

SEQ ID NO: 662283 - RNA, 22 nt, Human
caggagcccguugcuccggcgg

SEQ ID NO: 662284 - RNA, 22 nt, Human
augaucauacagagcccuggua

SEQ ID NO: 662285 - RNA, 22 nt, Human
auuucucauguacaaaaacacu

SEQ ID NO: 662286 - RNA, 22 nt, Human
agaauucuuggugguuagaaua

SEQ ID NO: 662287 - RNA, 22 nt, Human
ugaggcccggguggaggaaugc

SEQ ID NO: 662288 - RNA, 22 nt, Human
ucagugcauggacagauuuaga

SEQ ID NO: 662289 - RNA, 22 nt, Human
uguaggaauuccagugacuuca

SEQ ID NO: 662290 - RNA, 20 nt, Human
aacacugugcgugguaggug

SEQ ID NO: 662291 - RNA, 22 nt, Human
uccagcugacacuuaaggggag

SEQ ID NO: 662292 - RNA, 22 nt, Human
cccugaguuaguacaguugagu

SEQ ID NO: 662293 - RNA, 23 nt, Human
gcaguggaaugucucuguuugga

SEQ ID NO: 662294 - RNA, 22 nt, Human
uagaaacccaggauuuguauuu

SEQ ID NO: 662295 - RNA, 22 nt, Human
gcuagaaaucgacuucagaauu

SEQ ID NO: 662296 - RNA, 22 nt, Human
ugaagcuuuccuguggucagga

SEQ ID NO: 662297 - RNA, 22 nt, Human
gauugaaaggaaaaccagagug

SEQ ID NO: 662298 - RNA, 22 nt, Human
aagaugcuggcaggaauagcua

SEQ ID NO: 662299 - RNA, 19 nt, Human
ugagugggccccugcagac

SEQ ID NO: 662300 - RNA, 22 nt, Human
ugguauuucagcuuuuguaucu

SEQ ID NO: 662301 - RNA, 22 nt, Human
agagcacagcagaucucugaug

SEQ ID NO: 662302 - RNA, 22 nt, Human
gccacccugcaaaugcccagga

SEQ ID NO: 662303 - RNA, 19 nt, Human
cauuuuaagcauccccagu

SEQ ID NO: 662304 - RNA, 22 nt, Human
acuggcaggcugcuggccggcg

SEQ ID NO: 662305 - RNA, 22 nt, Human
ggcucuucacacagugauguca

SEQ ID NO: 662306 - RNA, 22 nt, Human
aggucucuaaaauagucaaacu

SEQ ID NO: 662307 - RNA, 22 nt, Human
guggcuuuauaggaagaggaac

SEQ ID NO: 662308 - RNA, 22 nt, Human
ccacacagucaguuuccaagaa

SEQ ID NO: 662309 - RNA, 22 nt, Human
uccugggucucuuccuuaguuc

SEQ ID NO: 662310 - RNA, 22 nt, Human
aggugcugaacuggugaggucu

SEQ ID NO: 662311 - RNA, 22 nt, Human
auacaaugauugguucucaccc

SEQ ID NO: 662312 - RNA, 22 nt, Human
gauucuuuggccuuuauugaca

SEQ ID NO: 662313 - RNA, 22 nt, Human
agcauccacucacugggagagg

SEQ ID NO: 662314 - RNA, 22 nt, Human
caugaaggaccauuucacgguc

SEQ ID NO: 662315 - RNA, 23 nt, Human
cuaggcaggauuguaggcgggua

SEQ ID NO: 662316 - RNA, 22 nt, Human
accauuugacucucuaaggaua

SEQ ID NO: 662317 - RNA, 22 nt, Human
uuacuucuuuggccuucagcca

SEQ ID NO: 662318 - RNA, 22 nt, Human
acauugaugaucccacuuacag

SEQ ID NO: 662319 - RNA, 22 nt, Human
aaguuacaguuauuauuuaaaa

SEQ ID NO: 662320 - RNA, 22 nt, Human
aaacuguaaguuugaggggaaa

SEQ ID NO: 662321 - RNA, 22 nt, Human
gagaggcaggcgcugcaauggu

SEQ ID NO: 662322 - RNA, 22 nt, Human
aaagguuaauguugucauguua

SEQ ID NO: 662323 - RNA, 22 nt, Human
agucauaugacccuucacaaac

SEQ ID NO: 662324 - RNA, 16 nt, Human
uggagguguuucuagu

SEQ ID NO: 662325 - RNA, 22 nt, Human
ccuggaguaccguggccaucca

SEQ ID NO: 662326 - RNA, 22 nt, Human
uagcagcauguaagugaguaga

SEQ ID NO: 662327 - RNA, 21 nt, Human
ugguuaaaguugugucauccc

SEQ ID NO: 662328 - RNA, 22 nt, Human
cucacagcagccagucugccuu

SEQ ID NO: 662329 - RNA, 20 nt, Human
cuguuccugucccaugaagc

SEQ ID NO: 662330 - RNA, 22 nt, Human
uauugcuuauaauuuguugcaa

SEQ ID NO: 662331 - RNA, 22 nt, Human
agggcugaccuaagcuccacuu

SEQ ID NO: 662332 - RNA, 22 nt, Human
gccuccuggccuuugcuccuca

SEQ ID NO: 662333 - RNA, 22 nt, Human
aauacagauggcaugugaagau

SEQ ID NO: 662334 - RNA, 22 nt, Human
ggacagagcccugguggccuaa

SEQ ID NO: 662335 - RNA, 22 nt, Human
uaaagauggagaugaccuagga

SEQ ID NO: 662336 - RNA, 23 nt, Human
uuugaaguugacugccuuccaga

SEQ ID NO: 662337 - RNA, 22 nt, Human
auccaggcauucugacuucaag

SEQ ID NO: 662338 - RNA, 22 nt, Human
cugagcaccccaggaccugcgc

SEQ ID NO: 662339 - RNA, 22 nt, Human
ggcucuuguucguaccauggcu

SEQ ID NO: 662340 - RNA, 22 nt, Human
gguagaaggggaagagguccau

SEQ ID NO: 662341 - RNA, 22 nt, Human
guggcccuugaagcagcuucau

SEQ ID NO: 662342 - RNA, 22 nt, Human
auugucuuuccacugagaaguu

SEQ ID NO: 662343 - RNA, 22 nt, Human
gucagcuagaggaugugacauu

SEQ ID NO: 662344 - RNA, 22 nt, Human
acugggcugcuugagugccuuc

SEQ ID NO: 662345 - RNA, 22 nt, Human
gaauuauaaacuagugacuuca

SEQ ID NO: 662346 - RNA, 22 nt, Human
aaaucucaauuugaauuguagc

SEQ ID NO: 662347 - RNA, 22 nt, Human
cugcugaaaacaauaaugauga

SEQ ID NO: 662348 - RNA, 22 nt, Human
aggccagcacgacagccgcagg

SEQ ID NO: 662349 - RNA, 22 nt, Human
gcaggcccuuagccuugguggg

SEQ ID NO: 662350 - RNA, 22 nt, Human
uuguuuccauugcagacugugu

SEQ ID NO: 662351 - RNA, 22 nt, Human
aauucccacuauaugccaagca

SEQ ID NO: 662352 - RNA, 22 nt, Human
aacaucuuguccuuagauuaaa

SEQ ID NO: 662353 - RNA, 22 nt, Human
acacaguaaauauugucuccuc

SEQ ID NO: 662354 - RNA, 22 nt, Human
uuccacagaugaaaauuaaguu

SEQ ID NO: 662355 - RNA, 22 nt, Human
gagcucuuccccaucuuacauc

SEQ ID NO: 662356 - RNA, 22 nt, Human
acacagggucuagaguuaggcc

SEQ ID NO: 662357 - RNA, 22 nt, Human
gaguccuuuucauagcaguggg

SEQ ID NO: 662358 - RNA, 22 nt, Human
cuccagggaggagcacggguuc

SEQ ID NO: 662359 - RNA, 20 nt, Human
cugagcugagcuccaugggu

SEQ ID NO: 662360 - RNA, 22 nt, Human
ugucaugccaggaaauaguccc

SEQ ID NO: 662361 - RNA, 20 nt, Human
caggccagagguuugauggc

SEQ ID NO: 662362 - RNA, 22 nt, Human
ggggcaggagcccuucuucagc

SEQ ID NO: 662363 - RNA, 22 nt, Human
aaauauagcaauuaugccuacu

SEQ ID NO: 662364 - RNA, 22 nt, Human
ucugccaggagccaugagcaag

SEQ ID NO: 662365 - RNA, 22 nt, Human
auucauuuagagggauuaagca

SEQ ID NO: 662366 - RNA, 22 nt, Human
cuuuauguguacuuuccauuuu

SEQ ID NO: 662367 - RNA, 22 nt, Human
ggggccccuguggcuugaugcc

SEQ ID NO: 662368 - RNA, 23 nt, Human
ugaggaccucucaggggccaggc

SEQ ID NO: 662369 - RNA, 22 nt, Human
caaaaugaugugauuuuauugu

SEQ ID NO: 662370 - RNA, 22 nt, Human
agcccugcaggaggugggagag

SEQ ID NO: 662371 - RNA, 22 nt, Human
uggccuggccacauccagcagg

SEQ ID NO: 662372 - RNA, 22 nt, Human
uagaacauaagucauucauuug

SEQ ID NO: 662373 - RNA, 22 nt, Human
aaaacaguuuuugcuaacugcu

SEQ ID NO: 662374 - RNA, 21 nt, Human
acagagaaagagcagccuccu

SEQ ID NO: 662375 - RNA, 20 nt, Human
uggagccaaggugugucugg

SEQ ID NO: 662376 - RNA, 22 nt, Human
uuuccuaagauagauacuucag

SEQ ID NO: 662377 - RNA, 22 nt, Human
ggugcaugguggaggugacccu

SEQ ID NO: 662378 - RNA, 22 nt, Human
ggucagguggcuucuguccucu

SEQ ID NO: 662379 - RNA, 22 nt, Human
agagggggcagcggaccaguga

SEQ ID NO: 662380 - RNA, 22 nt, Human
uccgcuggagagggggcugcca

SEQ ID NO: 662381 - RNA, 22 nt, Human
acaguacagcugaaacuuuagu

SEQ ID NO: 662382 - RNA, 22 nt, Human
ugggcacagagucccaucugcc

SEQ ID NO: 662383 - RNA, 22 nt, Human
acauuaacaccauaaguguguu

SEQ ID NO: 662384 - RNA, 22 nt, Human
ggagcucagaagugagugaguu

SEQ ID NO: 662385 - RNA, 22 nt, Human
ugggaggaaugucacugagcca

SEQ ID NO: 662386 - RNA, 22 nt, Human
ugggacuuaauaugcccuugau

SEQ ID NO: 662387 - RNA, 22 nt, Human
cuuauucagauacagacucuug

SEQ ID NO: 662388 - RNA, 17 nt, Human
acagagcacaucaagau

SEQ ID NO: 662389 - RNA, 22 nt, Human
ugcauuauaacugaauguuguu

SEQ ID NO: 662390 - RNA, 22 nt, Human
cagggccuccuaaggcaucuaa

SEQ ID NO: 662391 - RNA, 22 nt, Human
auucuucagaauaucuggcacu

SEQ ID NO: 662392 - RNA, 22 nt, Human
uuuauauuaccuggaauagcuu

SEQ ID NO: 662393 - RNA, 22 nt, Human
aaacauguaauucugcuuaaga

SEQ ID NO: 662394 - RNA, 22 nt, Human
cccagugccaggcacaggcagc

SEQ ID NO: 662395 - RNA, 22 nt, Human
cuuuuucuucuaggugugccug

SEQ ID NO: 662396 - RNA, 22 nt, Human
gagcccagggugaaauagcagc

SEQ ID NO: 662397 - RNA, 22 nt, Human
ugaagcaggguggccagauugu

SEQ ID NO: 662398 - RNA, 22 nt, Human
acauuucucccugcaugccugc

SEQ ID NO: 662399 - RNA, 22 nt, Human
ugagcuggucuugaguguagcu

SEQ ID NO: 662400 - RNA, 22 nt, Human
gaggcugaacagguucucauga

SEQ ID NO: 662401 - RNA, 23 nt, Human
gccaucugguauuuccugacuuc

SEQ ID NO: 662402 - RNA, 22 nt, Human
ccugagcuuuaaaagccaugua

SEQ ID NO: 662403 - RNA, 22 nt, Human
acugccugcuccuggcuccaca

SEQ ID NO: 662404 - RNA, 22 nt, Human
uguuucagucccuguguucaau

SEQ ID NO: 662405 - RNA, 22 nt, Human
uauaucauggagauuaacauuc

SEQ ID NO: 662406 - RNA, 22 nt, Human
agggccuggcuucacuuucuca

SEQ ID NO: 662407 - RNA, 22 nt, Human
cuguacauaaaggaauaggugu

SEQ ID NO: 662408 - RNA, 22 nt, Human
aaagucauacauggugcuuacu

SEQ ID NO: 662409 - RNA, 22 nt, Human
ugauucauauguaacaucccug

SEQ ID NO: 662410 - RNA, 22 nt, Human
cagagcaguagaaaacagccuu

SEQ ID NO: 662411 - RNA, 22 nt, Human
ugggagcacccugaggagcuuc

SEQ ID NO: 662412 - RNA, 22 nt, Human
auuucucugcaguguucggaau

SEQ ID NO: 662413 - RNA, 22 nt, Human
gccugcccacggggcuggcaua

SEQ ID NO: 662414 - RNA, 22 nt, Human
uuuaaggauguaaaggaagaag

SEQ ID NO: 662415 - RNA, 22 nt, Human
gcaccugggguacacagcuaca

SEQ ID NO: 662416 - RNA, 22 nt, Human
auuucuuccucugucaguaacu

SEQ ID NO: 662417 - RNA, 20 nt, Human
agucacaguaucagucuuag

SEQ ID NO: 662418 - RNA, 22 nt, Human
cucugugauuuugugagccaga

SEQ ID NO: 662419 - RNA, 22 nt, Human
uguuuaauugggccaacagcgg

SEQ ID NO: 662420 - RNA, 22 nt, Human
uggagaaucuggaaacuguuga

SEQ ID NO: 662421 - RNA, 22 nt, Human
ccugagucuguguuuuccuaag

SEQ ID NO: 662422 - RNA, 22 nt, Human
uucucucaguuaaacuuuguga

SEQ ID NO: 662423 - RNA, 22 nt, Human
uggacaggaucugagacugaga

SEQ ID NO: 662424 - RNA, 22 nt, Human
ggcucauguuucagaaagugga

SEQ ID NO: 662425 - RNA, 22 nt, Human
ggcaccugcucaucuggacuca

SEQ ID NO: 662426 - RNA, 22 nt, Human
agagggcuaacugggaagcagg

SEQ ID NO: 662427 - RNA, 22 nt, Human
cucugggcugaauggcugaacc

SEQ ID NO: 662428 - RNA, 22 nt, Human
gugggcagagcaagggaacuca

SEQ ID NO: 662429 - RNA, 22 nt, Human
agugauaaugugguaauuauuu

SEQ ID NO: 662430 - RNA, 22 nt, Human
gugcagagagguggagggacuu

SEQ ID NO: 662431 - RNA, 22 nt, Human
cagcuuuuaggacugugagaaa

SEQ ID NO: 662432 - RNA, 22 nt, Human
gaagucucacagacagaucaga

SEQ ID NO: 662433 - RNA, 22 nt, Human
cuuuacagauaggaacuacuca

SEQ ID NO: 662434 - RNA, 22 nt, Human
caaggacacucccugcugggca

SEQ ID NO: 662435 - RNA, 22 nt, Human
acccuucauagaggagaagcug

SEQ ID NO: 662436 - RNA, 22 nt, Human
gaaggagcuaaagggagcccug

SEQ ID NO: 662437 - RNA, 22 nt, Human
ugggccccagcacgucugggga

SEQ ID NO: 662438 - RNA, 22 nt, Human
ccugucuggaacauggccuguu

SEQ ID NO: 662439 - RNA, 19 nt, Human
ccucugccagcccgccucu

SEQ ID NO: 662440 - RNA, 17 nt, Human
uacagaaggcaccacaa

SEQ ID NO: 662441 - RNA, 22 nt, Human
ucccagaauccucacucuauca

SEQ ID NO: 662442 - RNA, 17 nt, Human
ugggguccccgauggug

SEQ ID NO: 662443 - RNA, 22 nt, Human
gcuuuucuagcuagaacauccg

SEQ ID NO: 662444 - RNA, 22 nt, Human
guggcagucucaucuguggcuc

SEQ ID NO: 662445 - RNA, 22 nt, Human
agggcuuuaaugauuauuuucu

SEQ ID NO: 662446 - RNA, 22 nt, Human
ucuagaaauuuugccuuguauu

SEQ ID NO: 662447 - RNA, 22 nt, Human
agcaguggaccucagugcuauu

SEQ ID NO: 662448 - RNA, 20 nt, Human
auguccagugacuggaccau

SEQ ID NO: 662449 - RNA, 22 nt, Human
ugucaacacaccuaucucaauu

SEQ ID NO: 662450 - RNA, 20 nt, Human
uagcaagcaggaggugcaga

SEQ ID NO: 662451 - RNA, 22 nt, Human
aaaccugaaggaugauacaaca

SEQ ID NO: 662452 - RNA, 22 nt, Human
aucuuugggcaaugaugaggga

SEQ ID NO: 662453 - RNA, 20 nt, Human
ucccaucacgccugugccag

SEQ ID NO: 662454 - RNA, 22 nt, Human
caugcacacacaguucuaauua

SEQ ID NO: 662455 - RNA, 22 nt, Human
gcagagaaggauugaaaccaga

SEQ ID NO: 662456 - RNA, 22 nt, Human
gaaugcugagucuuaucucuua

SEQ ID NO: 662457 - RNA, 22 nt, Human
cugggccucaugcacagagaug

SEQ ID NO: 662458 - RNA, 22 nt, Human
guggcagaaacuggcagaggag

SEQ ID NO: 662459 - RNA, 22 nt, Human
agaagaaaugugaaggccacug

SEQ ID NO: 662460 - RNA, 22 nt, Human
augagggcagcuauguaagugu

SEQ ID NO: 662461 - RNA, 22 nt, Human
ucuucaaagaauuuuaguaauu

SEQ ID NO: 662462 - RNA, 21 nt, Human
aguggggucucuguggaggcc

SEQ ID NO: 662463 - RNA, 22 nt, Human
ucuuucaaagcuguaguagauu

SEQ ID NO: 662464 - RNA, 22 nt, Human
gccugguggacacugggcauca

SEQ ID NO: 662465 - RNA, 22 nt, Human
caaggagauaaaauguugagcu

SEQ ID NO: 662466 - RNA, 22 nt, Human
auggaaauguaacuucugauuc

SEQ ID NO: 662467 - RNA, 22 nt, Human
auguggggacaaaaugauggcc

SEQ ID NO: 662468 - RNA, 22 nt, Human
ugcagccauuuucugccaaugc

SEQ ID NO: 662469 - RNA, 20 nt, Human
ccacagaggacagggcugug

SEQ ID NO: 662470 - RNA, 19 nt, Human
auuguacauugaguuuggc

SEQ ID NO: 662471 - RNA, 22 nt, Human
aauagcuuggacccauugcuuu

SEQ ID NO: 662472 - RNA, 22 nt, Human
gccuccuggaagucacauguuu

SEQ ID NO: 662473 - RNA, 22 nt, Human
ugcccuguuccugccuccagcu

SEQ ID NO: 662474 - RNA, 22 nt, Human
cuucuuauuaauccuucucugu

SEQ ID NO: 662475 - RNA, 22 nt, Human
gcuuuacauaaacauuuauuau

SEQ ID NO: 662476 - RNA, 22 nt, Human
uggagccauaacccuuucguac

SEQ ID NO: 662477 - RNA, 22 nt, Human
cuggcuggaaguuagagaacuu

SEQ ID NO: 662478 - RNA, 22 nt, Human
agcccuggguuagggugggagc

SEQ ID NO: 662479 - RNA, 22 nt, Human
cuggucaaaaauuaugcuuacu

SEQ ID NO: 662480 - RNA, 22 nt, Human
aguggcagaacuaccuuuuuau

SEQ ID NO: 662481 - RNA, 22 nt, Human
ggcugggcuccgggagcaugcg

SEQ ID NO: 662482 - RNA, 22 nt, Human
aguagaaaguugcaggaggaau

SEQ ID NO: 662483 - RNA, 22 nt, Human
ugggcuccaauuuguccuuuca

SEQ ID NO: 662484 - RNA, 22 nt, Human
ggcuuauguuugucaagcaauc

SEQ ID NO: 662485 - RNA, 22 nt, Human
aaauccgucauuggccugguug

SEQ ID NO: 662486 - RNA, 22 nt, Human
agagcaauuagcuuagguaaaa

SEQ ID NO: 662487 - RNA, 22 nt, Human
aauucauccaugaacaauucca

SEQ ID NO: 662488 - RNA, 22 nt, Human
cuuuagauuucuauguaucacu

SEQ ID NO: 662489 - RNA, 18 nt, Human
uccagcgugcuccagggc

SEQ ID NO: 662490 - RNA, 22 nt, Human
ccaguguuuccccagaagagag

SEQ ID NO: 662491 - RNA, 22 nt, Human
ucucaguggcuuccucacuuuu

SEQ ID NO: 662492 - RNA, 22 nt, Human
cauacuuuugcccugacauucu

SEQ ID NO: 662493 - RNA, 22 nt, Human
ugcuucagugugucauuauuua

SEQ ID NO: 662494 - RNA, 22 nt, Human
auaugcuauguauguaaaugag

SEQ ID NO: 662495 - RNA, 22 nt, Human
gcagagcagugcuugcccagcg

SEQ ID NO: 662496 - RNA, 22 nt, Human
uucacauuguuuuaaugugaau

SEQ ID NO: 662497 - RNA, 22 nt, Human
augcuuccaugaacguucuugu

SEQ ID NO: 662498 - RNA, 19 nt, Human
cagagcagugguuccugaa

SEQ ID NO: 662499 - RNA, 22 nt, Human
uucuuacagaguuuacagagcc

SEQ ID NO: 662500 - RNA, 22 nt, Human
gagccuggauugaagugggugg

SEQ ID NO: 662501 - RNA, 22 nt, Human
cucagugugaaugcucaguaaa

SEQ ID NO: 662502 - RNA, 22 nt, Human
aagcccagaugugagaacugag

SEQ ID NO: 662503 - RNA, 22 nt, Human
ugugccugucccgcauucuggu

SEQ ID NO: 662504 - RNA, 22 nt, Human
ucugccuggcggacucccggaa

SEQ ID NO: 662505 - RNA, 22 nt, Human
ggcagagaguucuccaccucuc

SEQ ID NO: 662506 - RNA, 21 nt, Human
cagggccaauccugaccucua

SEQ ID NO: 662507 - RNA, 22 nt, Human
aaggccaaggcugcagugagcc

SEQ ID NO: 662508 - RNA, 22 nt, Human
ucuagcagggaaagcagagaau

SEQ ID NO: 662509 - RNA, 22 nt, Human
cuuguugggucgugaauucugu

SEQ ID NO: 662510 - RNA, 22 nt, Human
aagacacuuucuaaauagaagu

SEQ ID NO: 662511 - RNA, 22 nt, Human
cuuuggcacagucucauuugau

SEQ ID NO: 662512 - RNA, 22 nt, Human
ccaguguauuauuugagaaauu

SEQ ID NO: 662513 - RNA, 22 nt, Human
caugaaauguuagaauuagaca

SEQ ID NO: 662514 - RNA, 22 nt, Human
auuguccuaucucagugccaug

SEQ ID NO: 662515 - RNA, 22 nt, Human
aagccaagguuuuggucacagc

SEQ ID NO: 662516 - RNA, 22 nt, Human
ucucuucccggauaaaguaagu

SEQ ID NO: 662517 - RNA, 22 nt, Human
uccagcuggggccgaaguggau

SEQ ID NO: 662518 - RNA, 22 nt, Human
acaguguucacuaagguuagcu

SEQ ID NO: 662519 - RNA, 22 nt, Human
gcaugauaccauagguuuugcc

SEQ ID NO: 662520 - RNA, 22 nt, Human
gcacacuggagccuggaagauu

SEQ ID NO: 662521 - RNA, 21 nt, Human
ugagagccuccaaccggcuac

SEQ ID NO: 662522 - RNA, 22 nt, Human
ugcacagugaccccuggugacu

SEQ ID NO: 662523 - RNA, 22 nt, Human
cuuuacaauucaagggaacucu

SEQ ID NO: 662524 - RNA, 22 nt, Human
cucauauugcugguggucuaag

SEQ ID NO: 662525 - RNA, 22 nt, Human
ucuuuaauaucugccccagagc

SEQ ID NO: 662526 - RNA, 22 nt, Human
ucaaauacauggucaaucaacu

SEQ ID NO: 662527 - RNA, 22 nt, Human
gcaugggcuuucucagaguucu

SEQ ID NO: 662528 - RNA, 22 nt, Human
uucugaaagccaauucauugaa

SEQ ID NO: 662529 - RNA, 22 nt, Human
auagucuuagaaucuugagugu

SEQ ID NO: 662530 - RNA, 22 nt, Human
cuguggccccacccucuuggcc

SEQ ID NO: 662531 - RNA, 22 nt, Human
gcagugggccugaggaagggug

SEQ ID NO: 662532 - RNA, 22 nt, Human
uauuucaggcuauauuucuugu

SEQ ID NO: 662533 - RNA, 22 nt, Human
agagcugcaggguggacccagg

SEQ ID NO: 662534 - RNA, 22 nt, Human
aaugcugcucucauaauuauag

SEQ ID NO: 662535 - RNA, 22 nt, Human
aauagcuuucucaugacuucac

SEQ ID NO: 662536 - RNA, 22 nt, Human
caggacaggaguggggucaaag

SEQ ID NO: 662537 - RNA, 22 nt, Human
aagcacagggacuuuaggaaua

SEQ ID NO: 662538 - RNA, 22 nt, Human
gcacaaagguggaaggaggaag

SEQ ID NO: 662539 - RNA, 22 nt, Human
cagaguccugcaccagcuccag

SEQ ID NO: 662540 - RNA, 22 nt, Human
caaugucuaguuucccaaaucc

SEQ ID NO: 662541 - RNA, 22 nt, Human
gagaggcuaugagguucugugu

SEQ ID NO: 662542 - RNA, 22 nt, Human
uagcauuucccaaaugcauuug

SEQ ID NO: 662543 - RNA, 22 nt, Human
aggcacaggccucagcacccag

SEQ ID NO: 662544 - RNA, 22 nt, Human
uucaagaucuggguuuucagcu

SEQ ID NO: 662545 - RNA, 17 nt, Human
ugaaagaaucagggaga

SEQ ID NO: 662546 - RNA, 22 nt, Human
guugucagguaaaacaguaugg

SEQ ID NO: 662547 - RNA, 22 nt, Human
acauguuaaacaucauggaaug

SEQ ID NO: 662548 - RNA, 22 nt, Human
ccuucuugagguagcacauucu

SEQ ID NO: 662549 - RNA, 20 nt, Human
auucuaaagcucugcucuuu

SEQ ID NO: 662550 - RNA, 22 nt, Human
ucaggagaguguucaguggagg

SEQ ID NO: 662551 - RNA, 22 nt, Human
agguucuuuuggccaaccucau

SEQ ID NO: 662552 - RNA, 22 nt, Human
cucggguaccaugcuaggcacu

SEQ ID NO: 662553 - RNA, 22 nt, Human
aggcucugguuggcaaguaaag

SEQ ID NO: 662554 - RNA, 22 nt, Human
auuaacuuuugaucaguguggu

SEQ ID NO: 662555 - RNA, 18 nt, Human
uaagucauuuugccagca

SEQ ID NO: 662556 - RNA, 22 nt, Human
ugaaauguuugaagaccacuga

SEQ ID NO: 662557 - RNA, 22 nt, Human
gucccuggaauggacucugcgc

SEQ ID NO: 662558 - RNA, 22 nt, Human
ucacauuucuuuauguagucuu

SEQ ID NO: 662559 - RNA, 22 nt, Human
ucagcccaggucacguaaucaa

SEQ ID NO: 662560 - RNA, 22 nt, Human
ugagggacuugcuaguucucug

SEQ ID NO: 662561 - RNA, 22 nt, Human
uauagaaguaagcauugugaug

SEQ ID NO: 662562 - RNA, 22 nt, Human
ucagaggcuuucaauguguuuu

SEQ ID NO: 662563 - RNA, 22 nt, Human
uagggacccucccugcucuaac

SEQ ID NO: 662564 - RNA, 22 nt, Human
auaguguguaaagugcagugau

SEQ ID NO: 662565 - RNA, 22 nt, Human
aaagaagguagggcuggugacu

SEQ ID NO: 662566 - RNA, 22 nt, Human
aaaguguaaaagcauguuaggg

SEQ ID NO: 662567 - RNA, 22 nt, Human
caggcagcugggucaccguccc

SEQ ID NO: 662568 - RNA, 22 nt, Human
agagaacaaauuaaaggugguu

SEQ ID NO: 662569 - RNA, 22 nt, Human
ucagcacuuugaagcagaagga

SEQ ID NO: 662570 - RNA, 22 nt, Human
guggggacgggauggcucacug

SEQ ID NO: 662571 - RNA, 22 nt, Human
uuucaagagaaaacuaaccuau

SEQ ID NO: 662572 - RNA, 22 nt, Human
ucugugugguaguuucagugaa

SEQ ID NO: 662573 - RNA, 22 nt, Human
ucaggaaauuaaacacuugaaa

SEQ ID NO: 662574 - RNA, 22 nt, Human
gucucaguuacucucccuggua

SEQ ID NO: 662575 - RNA, 22 nt, Human
cugaaccacuaauauuuugauu

SEQ ID NO: 662576 - RNA, 22 nt, Human
aaggcugugguucuauacagaa

SEQ ID NO: 662577 - RNA, 22 nt, Human
agcagcagccguagccuuauua

SEQ ID NO: 662578 - RNA, 22 nt, Human
uuuaugucacuuugaaagagag

SEQ ID NO: 662579 - RNA, 22 nt, Human
gugugagugaaaguaguuugau

SEQ ID NO: 662580 - RNA, 22 nt, Human
uuggcucaggcuuucauuguaa

SEQ ID NO: 662581 - RNA, 19 nt, Human
ccagggcuuuaaguugagg

SEQ ID NO: 662582 - RNA, 22 nt, Human
cugcaucauuuucagacaaugg

SEQ ID NO: 662583 - RNA, 22 nt, Human
aggaaaaaccuguuaaugguag

SEQ ID NO: 662584 - RNA, 22 nt, Human
guucauauuuaacuaagauagg

SEQ ID NO: 662585 - RNA, 22 nt, Human
agguaaggcuguaagcuaagcc

SEQ ID NO: 662586 - RNA, 22 nt, Human
agguggcagcagaaucagggag

SEQ ID NO: 662587 - RNA, 22 nt, Human
ucugagccguauggcuuggcua

SEQ ID NO: 662588 - RNA, 22 nt, Human
agaggccaccagagguggugcc

SEQ ID NO: 662589 - RNA, 22 nt, Human
agcagccagugggagugauaca

SEQ ID NO: 662590 - RNA, 22 nt, Human
uuucuagcaagaaagaggugga

SEQ ID NO: 662591 - RNA, 22 nt, Human
uccagagcugagggucaguaga

SEQ ID NO: 662592 - RNA, 22 nt, Human
agccucugcacgggcacgggug

SEQ ID NO: 662593 - RNA, 22 nt, Human
cacaguguaguuaaugugacau

SEQ ID NO: 662594 - RNA, 22 nt, Human
agcacagagagcucuagguaaa

SEQ ID NO: 662595 - RNA, 22 nt, Human
ugucuccuauuuccugcuaagg

SEQ ID NO: 662596 - RNA, 22 nt, Human
gaccacacuuuggaaaucacga

SEQ ID NO: 662597 - RNA, 22 nt, Human
uccugccuaccuugcggaggug

SEQ ID NO: 662598 - RNA, 22 nt, Human
cagcccuggccucuucgcuuuc

SEQ ID NO: 662599 - RNA, 22 nt, Human
cgguuaguuauuuuucagauau

SEQ ID NO: 662600 - RNA, 22 nt, Human
ccauuuuucacaagacucacuu

SEQ ID NO: 662601 - RNA, 22 nt, Human
cugccagcacugccuccugagg

SEQ ID NO: 662602 - RNA, 22 nt, Human
uuugagcagagaaaggacauga

SEQ ID NO: 662603 - RNA, 23 nt, Human
cagagcuggcucagagcugccug

SEQ ID NO: 662604 - RNA, 22 nt, Human
uaaagcauguguuagaagugca

SEQ ID NO: 662605 - RNA, 22 nt, Human
uuugaaguggaaaaggauuuaa

SEQ ID NO: 662606 - RNA, 22 nt, Human
gauaaaguagauuuguucuaga

SEQ ID NO: 662607 - RNA, 22 nt, Human
uggcauguuugcuugugcauau

SEQ ID NO: 662608 - RNA, 20 nt, Human
uaugcuuuuuauaagauuga

SEQ ID NO: 662609 - RNA, 22 nt, Human
cacccagcauuggcuaagagag

SEQ ID NO: 662610 - RNA, 21 nt, Human
auucaguuugacaucuagcag

SEQ ID NO: 662611 - RNA, 22 nt, Human
gaaggauuugagauuauccuag

SEQ ID NO: 662612 - RNA, 22 nt, Human
acacaguaguuugucauugcua

SEQ ID NO: 662613 - RNA, 22 nt, Human
aggcuaggcugaugccucuucc

SEQ ID NO: 662614 - RNA, 22 nt, Human
uguagauauagaaaaagacuga

SEQ ID NO: 662615 - RNA, 22 nt, Human
agggcugacaguaaaaguauga

SEQ ID NO: 662616 - RNA, 22 nt, Human
ccugcagcuccggauuucuggg

SEQ ID NO: 662617 - RNA, 22 nt, Human
aguuagcagcuuauuagaaaca

SEQ ID NO: 662618 - RNA, 22 nt, Human
ucugagcuuucuugugcucaag

SEQ ID NO: 662619 - RNA, 22 nt, Human
ucuggccugggccugccggugc

SEQ ID NO: 662620 - RNA, 22 nt, Human
uuggaauugugaacuaagugau

SEQ ID NO: 662621 - RNA, 22 nt, Human
aagcugcccucauucccagugc

SEQ ID NO: 662622 - RNA, 22 nt, Human
agucuguggauggacuggcaga

SEQ ID NO: 662623 - RNA, 22 nt, Human
aagauacauaaagguagagucu

SEQ ID NO: 662624 - RNA, 22 nt, Human
cagcugagaagugauagcugca

SEQ ID NO: 662625 - RNA, 22 nt, Human
uuucacaaugcaauccuacuuc

SEQ ID NO: 662626 - RNA, 22 nt, Human
agguaagggucacaguucauau

SEQ ID NO: 662627 - RNA, 22 nt, Human
gugaagcauaugcuucucugcc

SEQ ID NO: 662628 - RNA, 16 nt, Human
ccacagggcaaggggc

SEQ ID NO: 662629 - RNA, 22 nt, Human
gaucucugaaucugaagccuuc

SEQ ID NO: 662630 - RNA, 22 nt, Human
cagagcugcucaugguggccag

SEQ ID NO: 662631 - RNA, 22 nt, Human
uuuguacaccuaccuaauacag

SEQ ID NO: 662632 - RNA, 22 nt, Human
gagcuuuaccuuagguucuguu

SEQ ID NO: 662633 - RNA, 22 nt, Human
aagccaguccucuacugggcac

SEQ ID NO: 662634 - RNA, 22 nt, Human
uuguuucugaguuuucauguau

SEQ ID NO: 662635 - RNA, 22 nt, Human
aggcagguguugggagacacca

SEQ ID NO: 662636 - RNA, 22 nt, Human
uucauauaaauggaaucagaau

SEQ ID NO: 662637 - RNA, 19 nt, Human
gggugaggaagagcguugc

SEQ ID NO: 662638 - RNA, 20 nt, Human
auaggaaagggaggggcuuu

SEQ ID NO: 662639 - RNA, 20 nt, Human
augcuuccagggugugucug

SEQ ID NO: 662640 - RNA, 22 nt, Human
aaagugcugggauuacaagcgu

SEQ ID NO: 662641 - RNA, 22 nt, Human
accguuuacaccacuaccgcuu

SEQ ID NO: 662642 - RNA, 22 nt, Human
gggagcugugggauugguugag

SEQ ID NO: 662643 - RNA, 22 nt, Human
uucccacacccauauugugauu

SEQ ID NO: 662644 - RNA, 19 nt, Human
aggcagaggcuuggcuagc

SEQ ID NO: 662645 - RNA, 22 nt, Human
ucagauuugaauauuccuuucg

SEQ ID NO: 662646 - RNA, 22 nt, Human
agggguagagauugcuggugua

SEQ ID NO: 662647 - RNA, 22 nt, Human
ugggcuccucgucacucgcugu

SEQ ID NO: 662648 - RNA, 22 nt, Human
auuuucucacaaugcagaagga

SEQ ID NO: 662649 - RNA, 22 nt, Human
caggcagaguuagugauuuagg

SEQ ID NO: 662650 - RNA, 22 nt, Human
uuuucuaacuuuacacucgaaa

SEQ ID NO: 662651 - RNA, 22 nt, Human
ugaaugcagagacugugggaaa

SEQ ID NO: 662652 - RNA, 22 nt, Human
gagcugagauuugaagcaaguu

SEQ ID NO: 662653 - RNA, 22 nt, Human
uggcugcagaucaagggcaggc

SEQ ID NO: 662654 - RNA, 22 nt, Human
aguggcugaagcaucaaaggca

SEQ ID NO: 662655 - RNA, 23 nt, Human
cuggaagugcuuuuauagcuuug

SEQ ID NO: 662656 - RNA, 22 nt, Human
cuggggggcuacugacagagga

SEQ ID NO: 662657 - RNA, 22 nt, Human
ucacaugacuuuuugguggccu

SEQ ID NO: 662658 - RNA, 22 nt, Human
accaucuuuuccucugccuccu

SEQ ID NO: 662659 - RNA, 22 nt, Human
gucugugugcacagagcuuugg

SEQ ID NO: 662660 - RNA, 22 nt, Human
ccagccuggacugggucuugug

SEQ ID NO: 662661 - RNA, 22 nt, Human
uuuauuguugggucuuaagcug

SEQ ID NO: 662662 - RNA, 22 nt, Human
uuguacaaaggauuuggaagag

SEQ ID NO: 662663 - RNA, 22 nt, Human
agaugaaauuuguguugaguug

SEQ ID NO: 662664 - RNA, 17 nt, Human
agagagaaaagggccau

SEQ ID NO: 662665 - RNA, 22 nt, Human
cugcaggaaucugugcuaggug

SEQ ID NO: 662666 - RNA, 22 nt, Human
acugagcucuagguuuugaacc

SEQ ID NO: 662667 - RNA, 22 nt, Human
ugcaugcagcuggugauaagaa

SEQ ID NO: 662668 - RNA, 22 nt, Human
ucagaggcuucugcucaccuca

SEQ ID NO: 662669 - RNA, 22 nt, Human
gugucaugggagucagaaguga

SEQ ID NO: 662670 - RNA, 22 nt, Human
uccaggagugauaaggccacug

SEQ ID NO: 662671 - RNA, 22 nt, Human
aggucauuguuaagucaccaua

SEQ ID NO: 662672 - RNA, 22 nt, Human
gcugucaggaacaugccuuggu

SEQ ID NO: 662673 - RNA, 22 nt, Human
ucccaaggccaggcaucuagaa

SEQ ID NO: 662674 - RNA, 22 nt, Human
cucagggacggaggcuugcgga

SEQ ID NO: 662675 - RNA, 22 nt, Human
gaucuuuauacuguaauaauga

SEQ ID NO: 662676 - RNA, 22 nt, Human
cagcugaggaauacuagaugua

SEQ ID NO: 662677 - RNA, 22 nt, Human
gcucugggcugaaucauuuauc

SEQ ID NO: 662678 - RNA, 22 nt, Human
ucagagcuaaggggagagcaaa

SEQ ID NO: 662679 - RNA, 22 nt, Human
cucugcugcaggaaggcgugca

SEQ ID NO: 662680 - RNA, 22 nt, Human
cugggccacaucagaugaagac

SEQ ID NO: 662681 - RNA, 22 nt, Human
cugggccucauccccagaguuu

SEQ ID NO: 662682 - RNA, 22 nt, Human
cuguggucaucucagaguggcc

SEQ ID NO: 662683 - RNA, 22 nt, Human
auuaaggaauguaggcaagaag

SEQ ID NO: 662684 - RNA, 22 nt, Human
uaggaacaguccuagaaaucug

SEQ ID NO: 662685 - RNA, 22 nt, Human
gguuuaauuaccugcaucucaa

SEQ ID NO: 662686 - RNA, 22 nt, Human
cccaguaaucggagaguacuua

SEQ ID NO: 662687 - RNA, 22 nt, Human
aaaaguucccugguuagaaaag

SEQ ID NO: 662688 - RNA, 22 nt, Human
augcauauguacuugcauaugu

SEQ ID NO: 662689 - RNA, 18 nt, Human
guuggcugcuguggcugg

SEQ ID NO: 662690 - RNA, 22 nt, Human
aaauaaguaguuuaguguugug

SEQ ID NO: 662691 - RNA, 22 nt, Human
cauuugucaucacugagcugcc

SEQ ID NO: 662692 - RNA, 22 nt, Human
caggguaguaauuuaauacaag

SEQ ID NO: 662693 - RNA, 22 nt, Human
uagcagcuaccuggcuaagagu

SEQ ID NO: 662694 - RNA, 22 nt, Human
agugaguggacccugcaaggaa

SEQ ID NO: 662695 - RNA, 22 nt, Human
ugagacaaccuaauuaaacacc

SEQ ID NO: 662696 - RNA, 22 nt, Human
caggcacucauucagagaggug

SEQ ID NO: 662697 - RNA, 22 nt, Human
ccagggcuuugccaaaguccag

SEQ ID NO: 662698 - RNA, 22 nt, Human
uuccaaguguugagauuagagg

SEQ ID NO: 662699 - RNA, 22 nt, Human
gucuugaucuccugaccuugug

SEQ ID NO: 662700 - RNA, 22 nt, Human
cagguggagcugacugagggca

SEQ ID NO: 662701 - RNA, 22 nt, Human
gugcuuaauacaugucaauaac

SEQ ID NO: 662702 - RNA, 22 nt, Human
cagcacuuugagggcucuuaau

SEQ ID NO: 662703 - RNA, 22 nt, Human
ucacaaaugaggaaaucgagca

SEQ ID NO: 662704 - RNA, 22 nt, Human
cuguggcuaauaauuaguauuu

SEQ ID NO: 662705 - RNA, 22 nt, Human
cagggagcugacaaccaaggag

SEQ ID NO: 662706 - RNA, 22 nt, Human
gcgcgcuaccgccagggcugca

SEQ ID NO: 662707 - RNA, 22 nt, Human
gugcccucacaaaguggaaaga

SEQ ID NO: 662708 - RNA, 22 nt, Human
uucaugugauaaaugugugacu

SEQ ID NO: 662709 - RNA, 22 nt, Human
ggggaaggaaaguuauuagcag

SEQ ID NO: 662710 - RNA, 22 nt, Human
caggaagccacaggacagguag

SEQ ID NO: 662711 - RNA, 22 nt, Human
aagcuggagaguuaggugaaua

SEQ ID NO: 662712 - RNA, 21 nt, Human
aauggcugggcaaggucucuc

SEQ ID NO: 662713 - RNA, 22 nt, Human
aggcuucaauuccuuacccagu

SEQ ID NO: 662714 - RNA, 22 nt, Human
acuuuugguucuguaacuguga

SEQ ID NO: 662715 - RNA, 22 nt, Human
guguuccauguuugagguaguu

SEQ ID NO: 662716 - RNA, 22 nt, Human
uacuaggcaauuauguaaauaa

SEQ ID NO: 662717 - RNA, 22 nt, Human
uagaccauuuuacaauagugug

SEQ ID NO: 662718 - RNA, 19 nt, Human
acucaggcaaugagaaaca

SEQ ID NO: 662719 - RNA, 19 nt, Human
ugaggccaaggucacagau

SEQ ID NO: 662720 - RNA, 22 nt, Human
ugggcuggagcuuguugcuucc

SEQ ID NO: 662721 - RNA, 23 nt, Human
gcaauacaagacuggucaugagc

SEQ ID NO: 662722 - RNA, 22 nt, Human
uauggcuucucagucaugaaaa

SEQ ID NO: 662723 - RNA, 22 nt, Human
uagaaacagagagauaugcccc

SEQ ID NO: 662724 - RNA, 22 nt, Human
ucugagcauaugcagcaccugg

SEQ ID NO: 662725 - RNA, 22 nt, Human
cccgaggaaccagagguagcuc

SEQ ID NO: 662726 - RNA, 22 nt, Human
uuagcacugucugguuaucuug

SEQ ID NO: 662727 - RNA, 22 nt, Human
cacuauaauccuguuuuagaac

SEQ ID NO: 662728 - RNA, 22 nt, Human
ccagggcaacgcugucucagag

SEQ ID NO: 662729 - RNA, 16 nt, Human
ucucccuugucaccug

SEQ ID NO: 662730 - RNA, 22 nt, Human
gcugccuggaauaacggcuggc

SEQ ID NO: 662731 - RNA, 22 nt, Human
gcaggcagagucaauuugaucc

SEQ ID NO: 662732 - RNA, 22 nt, Human
auaucacagaugcagaaagaga

SEQ ID NO: 662733 - RNA, 22 nt, Human
uauuauuaugcauagcaugaaa

SEQ ID NO: 662734 - RNA, 22 nt, Human
ccucccuccauugccaucgucu

SEQ ID NO: 662735 - RNA, 22 nt, Human
ccaggagggugguuacucaauc

SEQ ID NO: 662736 - RNA, 22 nt, Human
ugugucauugccaugaaaaggc

SEQ ID NO: 662737 - RNA, 21 nt, Human
auuuucauuuccaggggagga

SEQ ID NO: 662738 - RNA, 22 nt, Human
guccugacggcugauuggccug

SEQ ID NO: 662739 - RNA, 22 nt, Human
gagcugccaagauuacaaucag

SEQ ID NO: 662740 - RNA, 22 nt, Human
cccugagcccauaguugacauu

SEQ ID NO: 662741 - RNA, 22 nt, Human
aaauauaauuucugccucaaua

SEQ ID NO: 662742 - RNA, 22 nt, Human
uucaaacaguguagaauauaug

SEQ ID NO: 662743 - RNA, 19 nt, Human
gcagcaguggaaggaaaaa

SEQ ID NO: 662744 - RNA, 22 nt, Human
augaguaaaaccacuauuuaca

SEQ ID NO: 662745 - RNA, 22 nt, Human
gguuugguuuuggccaucuucc

SEQ ID NO: 662746 - RNA, 22 nt, Human
ggagacuaccuagcaggcuguu

SEQ ID NO: 662747 - RNA, 22 nt, Human
gugccgcgacgcagucggugcc

SEQ ID NO: 662748 - RNA, 22 nt, Human
gagaguuccaguaaguggauuc

SEQ ID NO: 662749 - RNA, 20 nt, Human
acagcagauaccacaacuau

SEQ ID NO: 662750 - RNA, 22 nt, Human
gccaaggccugcagcaccucau

SEQ ID NO: 662751 - RNA, 22 nt, Human
gucuggacaggacuauuucuaa

SEQ ID NO: 662752 - RNA, 20 nt, Human
guccugggagccacagcaca

SEQ ID NO: 662753 - RNA, 22 nt, Human
aggaaggaagagacaccauuug

SEQ ID NO: 662754 - RNA, 22 nt, Human
aagagaaggauucugagccugg

SEQ ID NO: 662755 - RNA, 22 nt, Human
gaacccaguccaggugcagccu

SEQ ID NO: 662756 - RNA, 22 nt, Human
gccugggauuguguaagugaau

SEQ ID NO: 662757 - RNA, 22 nt, Human
cuccucagggcugguuacaugg

SEQ ID NO: 662758 - RNA, 22 nt, Human
ugggaagggucaguuucuucau

SEQ ID NO: 662759 - RNA, 22 nt, Human
uuagacuagaagcuuccacuuu

SEQ ID NO: 662760 - RNA, 22 nt, Human
caguucaggccggcugacucag

SEQ ID NO: 662761 - RNA, 22 nt, Human
ucaggaagaaagaagggagugu

SEQ ID NO: 662762 - RNA, 22 nt, Human
uggugugggcguggcaggcaag

SEQ ID NO: 662763 - RNA, 22 nt, Human
cagccugcucucagauguugag

SEQ ID NO: 662764 - RNA, 22 nt, Human
aaaaggauguuuucaugaaaca

SEQ ID NO: 662765 - RNA, 22 nt, Human
uggcucagcaagacauugaccu

SEQ ID NO: 662766 - RNA, 22 nt, Human
guuuacaacaugccaacugggc

SEQ ID NO: 662767 - RNA, 22 nt, Human
agaugacaaugaaggaaaaugu

SEQ ID NO: 662768 - RNA, 22 nt, Human
ugcucccuugccagaggggaag

SEQ ID NO: 662769 - RNA, 22 nt, Human
gcuucagcccaucccaguacau

SEQ ID NO: 662770 - RNA, 22 nt, Human
auguucuuuggaauuuaugaaa

SEQ ID NO: 662771 - RNA, 22 nt, Human
gcaaacagccaggcgcagaagu

SEQ ID NO: 662772 - RNA, 22 nt, Human
ggagcuguuauggcauaagcau

SEQ ID NO: 662773 - RNA, 22 nt, Human
cugccucaugcugccugcagcc

SEQ ID NO: 662774 - RNA, 22 nt, Human
ucuguucuuuagccugcuugag

SEQ ID NO: 662775 - RNA, 22 nt, Human
accuucugaccaguuaucuuga

SEQ ID NO: 662776 - RNA, 22 nt, Human
cauuggaaaaugcaugcuuuuu

SEQ ID NO: 662777 - RNA, 22 nt, Human
ugugaacuuaagauuccuuauc

SEQ ID NO: 662778 - RNA, 22 nt, Human
cuggccuggggccucagcugcu

SEQ ID NO: 662779 - RNA, 17 nt, Human
uagagcugguucaggag

SEQ ID NO: 662780 - RNA, 18 nt, Human
acaaaggaucaugaggga

SEQ ID NO: 662781 - RNA, 22 nt, Human
acagagcauuugggacagagag

SEQ ID NO: 662782 - RNA, 22 nt, Human
aagucacuucuuaggaaaggag

SEQ ID NO: 662783 - RNA, 21 nt, Human
ugggcacugagggugcugcuc

SEQ ID NO: 662784 - RNA, 18 nt, Human
acacaguggaugccuggu

SEQ ID NO: 662785 - RNA, 22 nt, Human
gccugggauucucaaaggggug

SEQ ID NO: 662786 - RNA, 22 nt, Human
accagggcagccgagguguguc

SEQ ID NO: 662787 - RNA, 22 nt, Human
gggcugggcaugguguucccuc

SEQ ID NO: 662788 - RNA, 22 nt, Human
uuggcagacuggguccugggga

SEQ ID NO: 662789 - RNA, 22 nt, Human
ccccuccuggccacacugucag

SEQ ID NO: 662790 - RNA, 22 nt, Human
acucucagggcuccagggaaag

SEQ ID NO: 662791 - RNA, 22 nt, Human
acuggcagcuguaggaugcaug

SEQ ID NO: 662792 - RNA, 22 nt, Human
gcucugggugaaggguaccauu

SEQ ID NO: 662793 - RNA, 22 nt, Human
ggacggggagcuggaaagggga

SEQ ID NO: 662794 - RNA, 22 nt, Human
ccacucugauuggucaccucug

SEQ ID NO: 662795 - RNA, 22 nt, Human
ugucgauucagcucuucagaga

SEQ ID NO: 662796 - RNA, 22 nt, Human
gacugagggauagaggugcuuc

SEQ ID NO: 662797 - RNA, 22 nt, Human
gccucugcugacaagauggaca

SEQ ID NO: 662798 - RNA, 22 nt, Human
aaguuuagggaagucugagcgc

SEQ ID NO: 662799 - RNA, 21 nt, Human
cuacagaagcucuccuaucca

SEQ ID NO: 662800 - RNA, 22 nt, Human
cuggugugauugagcccaggug

SEQ ID NO: 662801 - RNA, 22 nt, Human
agcacauuaagugaguucaugu

SEQ ID NO: 662802 - RNA, 22 nt, Human
cuuuggagaagaaugcauccuu

SEQ ID NO: 662803 - RNA, 22 nt, Human
auuaaggagggcugggcaugau

SEQ ID NO: 662804 - RNA, 23 nt, Human
gccucagagaaacagcugcacac

SEQ ID NO: 662805 - RNA, 22 nt, Human
gccaggcuggaaagaacagaca

SEQ ID NO: 662806 - RNA, 22 nt, Human
uguacaauguggccaguguuaa

SEQ ID NO: 662807 - RNA, 22 nt, Human
uuuccucaacugucaaaugggg

SEQ ID NO: 662808 - RNA, 22 nt, Human
cagagccaaaugcugugguuau

SEQ ID NO: 662809 - RNA, 22 nt, Human
acaguggcucaugccugucauc

SEQ ID NO: 662810 - RNA, 22 nt, Human
ugcuuuaaaguauuucucgcaa

SEQ ID NO: 662811 - RNA, 22 nt, Human
aaagcucuuggauuuuagacuc

SEQ ID NO: 662812 - RNA, 22 nt, Human
cugggcaggagaggugguugga

SEQ ID NO: 662813 - RNA, 22 nt, Human
acuacaauacucuuaguaaaag

SEQ ID NO: 662814 - RNA, 22 nt, Human
aggccaggaccauuagcccaga

SEQ ID NO: 662815 - RNA, 20 nt, Human
cucugcagcaaggccugggu

SEQ ID NO: 662816 - RNA, 22 nt, Human
gucuuguuugggauguggaugg

SEQ ID NO: 662817 - RNA, 22 nt, Human
ugucugaaucucgguuuccuca

SEQ ID NO: 662818 - RNA, 22 nt, Human
aaacucuguagcuaaacauaau

SEQ ID NO: 662819 - RNA, 22 nt, Human
guuucuuauuucaacuggaaca

SEQ ID NO: 662820 - RNA, 22 nt, Human
ccuacucugagcgccuccgcau

SEQ ID NO: 662821 - RNA, 22 nt, Human
aagaggcagcccgcugaggcug

SEQ ID NO: 662822 - RNA, 20 nt, Human
aggguggggacguucugacu

SEQ ID NO: 662823 - RNA, 19 nt, Human
caguggccuggaggucucu

SEQ ID NO: 662824 - RNA, 22 nt, Human
ucaggaggccgugugcucagug

SEQ ID NO: 662825 - RNA, 22 nt, Human
uaugccugauaacugugucucu

SEQ ID NO: 662826 - RNA, 22 nt, Human
agucccagcucagaaccacuag

SEQ ID NO: 662827 - RNA, 22 nt, Human
cacagagacagaagcacuuaug

SEQ ID NO: 662828 - RNA, 22 nt, Human
gcucuguguauguggcaggugc

SEQ ID NO: 662829 - RNA, 22 nt, Human
uaguggauguucagagauuuga

SEQ ID NO: 662830 - RNA, 22 nt, Human
cuuguccagauguuuguuaggu

SEQ ID NO: 662831 - RNA, 22 nt, Human
uggugcaguccaaagggagcag

SEQ ID NO: 662832 - RNA, 22 nt, Human
ccagcccuguuuaugugucacu

SEQ ID NO: 662833 - RNA, 22 nt, Human
gcacagggccuggcacauaaga

SEQ ID NO: 662834 - RNA, 21 nt, Human
uuuaguucaaguacagaacca

SEQ ID NO: 662835 - RNA, 22 nt, Human
agucacccuccaacucuccacu

SEQ ID NO: 662836 - RNA, 22 nt, Human
ugcccugugcuggaaucuuccc

SEQ ID NO: 662837 - RNA, 22 nt, Human
agcuuucucuucuuuagaaagu

SEQ ID NO: 662838 - RNA, 22 nt, Human
gugucccaaagauuagaaauca

SEQ ID NO: 662839 - RNA, 22 nt, Human
gaagacgagauaaaaugguguc

SEQ ID NO: 662840 - RNA, 22 nt, Human
uguagaacugacauuuuggacu

SEQ ID NO: 662841 - RNA, 22 nt, Human
ugagagcacacagaaauauuuu

SEQ ID NO: 662842 - RNA, 22 nt, Human
cagggccacccucugcugggug

SEQ ID NO: 662843 - RNA, 22 nt, Human
auucugcacuuccuuugcuucc

SEQ ID NO: 662844 - RNA, 19 nt, Human
agggcugcucuggccuggg

SEQ ID NO: 662845 - RNA, 22 nt, Human
gugaaguucaagcuugccaucu

SEQ ID NO: 662846 - RNA, 22 nt, Human
gccuagguaccagcagagagcc

SEQ ID NO: 662847 - RNA, 22 nt, Human
gauuugucacgguugagagcca

SEQ ID NO: 662848 - RNA, 22 nt, Human
gugcacacucuuggggcacuuu

SEQ ID NO: 662849 - RNA, 22 nt, Human
acagucaaugagugagugaaug

SEQ ID NO: 662850 - RNA, 22 nt, Human
cacccugcucugcugugcggcc

SEQ ID NO: 662851 - RNA, 22 nt, Human
ucucaagagggaggcaaucaug

SEQ ID NO: 662852 - RNA, 22 nt, Human
ucuuccuuucauucauguguua

SEQ ID NO: 662853 - RNA, 22 nt, Human
aggugagguuugggagguguca

SEQ ID NO: 662854 - RNA, 22 nt, Human
uucaaguuuugacuuaguccuu

SEQ ID NO: 662855 - RNA, 22 nt, Human
agcaauaaccacucuaauuuau

SEQ ID NO: 662856 - RNA, 22 nt, Human
ugggcacuggaagccugcugug

SEQ ID NO: 662857 - RNA, 22 nt, Human
uuauucugugaacaugguuaau

SEQ ID NO: 662858 - RNA, 22 nt, Human
acugagagucaagauagcaugg

SEQ ID NO: 662859 - RNA, 22 nt, Human
caugaaugcuggguucauguaa

SEQ ID NO: 662860 - RNA, 22 nt, Human
acucacaggacucugcauauag

SEQ ID NO: 662861 - RNA, 22 nt, Human
ugggccagauccauggcaauaa

SEQ ID NO: 662862 - RNA, 22 nt, Human
cuuccaaguugcucugcugacc

SEQ ID NO: 662863 - RNA, 22 nt, Human
ccucaggcugucuuccuucugg

SEQ ID NO: 662864 - RNA, 22 nt, Human
aggcagauauuucaguucacau

SEQ ID NO: 662865 - RNA, 22 nt, Human
gcagaugccagaucaugcaggg

SEQ ID NO: 662866 - RNA, 22 nt, Human
agcuucuggaagccuggcagca

SEQ ID NO: 662867 - RNA, 22 nt, Human
ggggccagcaauguugaggaau

SEQ ID NO: 662868 - RNA, 22 nt, Human
gcaguuuuagagcuuuaagaug

SEQ ID NO: 662869 - RNA, 22 nt, Human
cccaggaaaugggcucuugccu

SEQ ID NO: 662870 - RNA, 22 nt, Human
uugaucucauuguucuccucag

SEQ ID NO: 662871 - RNA, 22 nt, Human
ccuguguggaaaccgcaugacg

SEQ ID NO: 662872 - RNA, 22 nt, Human
cuaggccagagagaccucauga

SEQ ID NO: 662873 - RNA, 22 nt, Human
accagcuggcccaugagcacgu

SEQ ID NO: 662874 - RNA, 22 nt, Human
agcacagauggauguauucauu

SEQ ID NO: 662875 - RNA, 22 nt, Human
aaaugacuaaugauccugggca

SEQ ID NO: 662876 - RNA, 22 nt, Human
uggcagaauuucuagcagauuc

SEQ ID NO: 662877 - RNA, 22 nt, Human
agagggcugggaugugcugugu

SEQ ID NO: 662878 - RNA, 22 nt, Human
auucugcugccuaguuuaugaa

SEQ ID NO: 662879 - RNA, 22 nt, Human
cuuuccuccacucccuaggcuu

SEQ ID NO: 662880 - RNA, 22 nt, Human
gggagggucugagagcugcacc

SEQ ID NO: 662881 - RNA, 22 nt, Human
uuuaauugcauuuaaagaugga

SEQ ID NO: 662882 - RNA, 19 nt, Human
gcagagugggguggagggu

SEQ ID NO: 662883 - RNA, 23 nt, Human
acugaagaugucuuaguggcccu

SEQ ID NO: 662884 - RNA, 22 nt, Human
gugaauauucuuugugcaguau

SEQ ID NO: 662885 - RNA, 22 nt, Human
auucagaaaggguugccugguu

SEQ ID NO: 662886 - RNA, 22 nt, Human
ugucugaaaggcuuuuucucac

SEQ ID NO: 662887 - RNA, 22 nt, Human
guagggacuguucucaccugag

SEQ ID NO: 662888 - RNA, 22 nt, Human
gcagugacauaccuggagggca

SEQ ID NO: 662889 - RNA, 22 nt, Human
cuugccagcacuuggccagcug

SEQ ID NO: 662890 - RNA, 20 nt, Human
cagcuucaaugucagcuuga

SEQ ID NO: 662891 - RNA, 22 nt, Human
acuuuggaucugauguaaucag

SEQ ID NO: 662892 - RNA, 22 nt, Human
caaggccaguccauuuuggaag

SEQ ID NO: 662893 - RNA, 22 nt, Human
cugauacaaugucugcuuuaua

SEQ ID NO: 662894 - RNA, 22 nt, Human
aaguuucugauauuguuaaagc

SEQ ID NO: 662895 - RNA, 22 nt, Human
uguccagcggccuggcugcuga

SEQ ID NO: 662896 - RNA, 23 nt, Human
uauccuaaaggcaacaggaaguc

SEQ ID NO: 662897 - RNA, 22 nt, Human
aauuuuacuaaucugaguguga

SEQ ID NO: 662898 - RNA, 22 nt, Human
ucuuacauauacgucauuuagu

SEQ ID NO: 662899 - RNA, 22 nt, Human
ucccagggcagcuguccagaag

SEQ ID NO: 662900 - RNA, 22 nt, Human
guuucaaagcacagcucacauu

SEQ ID NO: 662901 - RNA, 21 nt, Human
auguccuggcuaccagcgcag

SEQ ID NO: 662902 - RNA, 22 nt, Human
uggucugauucuugcuccccaa

SEQ ID NO: 662903 - RNA, 22 nt, Human
cagucccuaguggagcucacag

SEQ ID NO: 662904 - RNA, 22 nt, Human
ugcaauuuuaauacauuagagg

SEQ ID NO: 662905 - RNA, 22 nt, Human
aaggcugcuuuuaacaugcaua

SEQ ID NO: 662906 - RNA, 22 nt, Human
caaaggcaggugcugaauauuc

SEQ ID NO: 662907 - RNA, 22 nt, Human
auacagaucccacagcauguga

SEQ ID NO: 662908 - RNA, 22 nt, Human
aguaaagcagaguugcaguaca

SEQ ID NO: 662909 - RNA, 22 nt, Human
caggggccaaggguccagaccu

SEQ ID NO: 662910 - RNA, 22 nt, Human
ggccucagugggccgcugcagg

SEQ ID NO: 662911 - RNA, 22 nt, Human
uggcuccaucauccaugcaaga

SEQ ID NO: 662912 - RNA, 22 nt, Human
ugggugguuuaugaguggguuu

SEQ ID NO: 662913 - RNA, 22 nt, Human
gcuucaugggugugcaaccugu

SEQ ID NO: 662914 - RNA, 22 nt, Human
acagauauuuggggaaagacgu

SEQ ID NO: 662915 - RNA, 22 nt, Human
gagauuagaguuguuucauugu

SEQ ID NO: 662916 - RNA, 20 nt, Human
cagauaaacgggaaagaagc

SEQ ID NO: 662917 - RNA, 22 nt, Human
ucucaaauggcaaauguggguc

SEQ ID NO: 662918 - RNA, 22 nt, Human
gcagguguggaguggggugagc

SEQ ID NO: 662919 - RNA, 22 nt, Human
ugaguaggugguuaagcaugga

SEQ ID NO: 662920 - RNA, 22 nt, Human
gaggcuaaguaacuguccaugg

SEQ ID NO: 662921 - RNA, 22 nt, Human
uagucauucuccuuacaaagcc

SEQ ID NO: 662922 - RNA, 22 nt, Human
gaauaauagcagaaauuagcag

SEQ ID NO: 662923 - RNA, 22 nt, Human
aggcaggcugcuauggaguaga

SEQ ID NO: 662924 - RNA, 22 nt, Human
uuuauugaacacuugcacuggc

SEQ ID NO: 662925 - RNA, 22 nt, Human
gcacacccucucaccagcacug

SEQ ID NO: 662926 - RNA, 22 nt, Human
acaaguuucauuguuuagaacc

SEQ ID NO: 662927 - RNA, 22 nt, Human
uauuuauaccaggugaucggag

SEQ ID NO: 662928 - RNA, 22 nt, Human
uugugcuugcccuggaggugcg

SEQ ID NO: 662929 - RNA, 22 nt, Human
acacacacaagcagguugugga

SEQ ID NO: 662930 - RNA, 22 nt, Human
guagcugauauuagcaaugagu

SEQ ID NO: 662931 - RNA, 22 nt, Human
gaaaugaacugauuaucauugc

SEQ ID NO: 662932 - RNA, 22 nt, Human
uuuaauacuauggggaugaaca

SEQ ID NO: 662933 - RNA, 22 nt, Human
gaagagcuccaaaaacagugag

SEQ ID NO: 662934 - RNA, 18 nt, Human
gagcagcaggaucaagaa

SEQ ID NO: 662935 - RNA, 22 nt, Human
ugagcaccaucuguuugugugc

SEQ ID NO: 662936 - RNA, 22 nt, Human
agggggcccuugcaggugagcg

SEQ ID NO: 662937 - RNA, 22 nt, Human
cccuuucuucuugacugaaaac

SEQ ID NO: 662938 - RNA, 22 nt, Human
aggcuggagacccgccaagaaa

SEQ ID NO: 662939 - RNA, 22 nt, Human
uaaugcacaugacugaacuauu

SEQ ID NO: 662940 - RNA, 22 nt, Human
acugucaugugcuaacugucca

SEQ ID NO: 662941 - RNA, 22 nt, Human
gcuuugcugaggucugaggauu

SEQ ID NO: 662942 - RNA, 22 nt, Human
uccaccacuuccugcagccauu

SEQ ID NO: 662943 - RNA, 22 nt, Human
gacugggcuccaagagggagag

SEQ ID NO: 662944 - RNA, 22 nt, Human
ugcagggauuauguagggguug

SEQ ID NO: 662945 - RNA, 22 nt, Human
gcagugugucucuuggcuuccu

SEQ ID NO: 662946 - RNA, 22 nt, Human
uccuggucuacacugcauuggg

SEQ ID NO: 662947 - RNA, 22 nt, Human
aucugaauaaauuucuuuuagu

SEQ ID NO: 662948 - RNA, 22 nt, Human
cuugccuucagugucccuuugc

SEQ ID NO: 662949 - RNA, 22 nt, Human
agcagagaggagguggcccugu

SEQ ID NO: 662950 - RNA, 22 nt, Human
uuggcugcuggucuuuggauau

SEQ ID NO: 662951 - RNA, 22 nt, Human
uccuuucuucuucugcccaugg

SEQ ID NO: 662952 - RNA, 22 nt, Human
ugggcagaaugugggauccaga

SEQ ID NO: 662953 - RNA, 22 nt, Human
gauuuucauuauagcuaguuuc

SEQ ID NO: 662954 - RNA, 22 nt, Human
gucuccacagcccagcugccac

SEQ ID NO: 662955 - RNA, 22 nt, Human
gacagggaggagcagagcuucu

SEQ ID NO: 662956 - RNA, 22 nt, Human
cccuggaggcuggaggcaguag

SEQ ID NO: 662957 - RNA, 23 nt, Human
gccauggcugccccacaggccuc

SEQ ID NO: 662958 - RNA, 22 nt, Human
uagcaaaguuuuguggugauua

SEQ ID NO: 662959 - RNA, 22 nt, Human
uggcgucucucauaaguaugug

SEQ ID NO: 662960 - RNA, 22 nt, Human
ggaaggggugucgcccauggau

SEQ ID NO: 662961 - RNA, 22 nt, Human
aauaccagagacaguguuuacc

SEQ ID NO: 662962 - RNA, 22 nt, Human
ugggccugccccaggcuucagc

SEQ ID NO: 662963 - RNA, 22 nt, Human
auuauuugcuuggcucaucuaa

SEQ ID NO: 662964 - RNA, 22 nt, Human
ucuuauaugcacauacauuggg

SEQ ID NO: 662965 - RNA, 22 nt, Human
acugggcuguggacacccagcg

SEQ ID NO: 662966 - RNA, 22 nt, Human
agaucugaaucucauccgagga

SEQ ID NO: 662967 - RNA, 22 nt, Human
uggccgggccgggcgccuccac

SEQ ID NO: 662968 - RNA, 22 nt, Human
cccaagaucuuucgugcacuaa

SEQ ID NO: 662969 - RNA, 22 nt, Human
augggcaguuaggaggccagga

SEQ ID NO: 662970 - RNA, 19 nt, Human
augaaugagcugugagguu

SEQ ID NO: 662971 - RNA, 22 nt, Human
acaauguucugucugacuuguc

SEQ ID NO: 662972 - RNA, 22 nt, Human
cucaagucuauugauaagugca

SEQ ID NO: 662973 - RNA, 22 nt, Human
uucuuaacuggaaaaugucaga

SEQ ID NO: 662974 - RNA, 22 nt, Human
ggaugucgaggaugggguagca

SEQ ID NO: 662975 - RNA, 19 nt, Human
aaauaucagagagaugaua

SEQ ID NO: 662976 - RNA, 22 nt, Human
gagccaggcccguacuugcugu

SEQ ID NO: 662977 - RNA, 22 nt, Human
uagggcucgggcacaggacagg

SEQ ID NO: 662978 - RNA, 22 nt, Human
ggagggagguuagauucaagcu

SEQ ID NO: 662979 - RNA, 22 nt, Human
accagagaaaacacagcaggcu

SEQ ID NO: 662980 - RNA, 22 nt, Human
auacacuuguacauuuuuuaau

SEQ ID NO: 662981 - RNA, 22 nt, Human
aagcacauacauaauaaagucc

SEQ ID NO: 662982 - RNA, 22 nt, Human
gaauucuagucacacacauuca

SEQ ID NO: 662983 - RNA, 22 nt, Human
ugacaacagccaucacuuuuag

SEQ ID NO: 662984 - RNA, 22 nt, Human
agggucaccugcuugccagggc

SEQ ID NO: 662985 - RNA, 22 nt, Human
cauagcaagaucacauucugua

SEQ ID NO: 662986 - RNA, 22 nt, Human
cuguguuucugagaagugggga

SEQ ID NO: 662987 - RNA, 22 nt, Human
uuccccagggaagcuccugcgc

SEQ ID NO: 662988 - RNA, 19 nt, Human
aggucccucccucgaggcu

SEQ ID NO: 662989 - RNA, 22 nt, Human
uggcuggcaguaggcuaguggc

SEQ ID NO: 662990 - RNA, 22 nt, Human
ccagaugguuugcaugggaggg

SEQ ID NO: 662991 - RNA, 22 nt, Human
ccugagggcucagcccccagcc

SEQ ID NO: 662992 - RNA, 22 nt, Human
gagcacaguaaagcagugucac

SEQ ID NO: 662993 - RNA, 22 nt, Human
ugggcccagguccugggagaag

SEQ ID NO: 662994 - RNA, 22 nt, Human
uaucagcaccgcggacagcauc

SEQ ID NO: 662995 - RNA, 22 nt, Human
cucccaggggaacuaucaagua

SEQ ID NO: 662996 - RNA, 22 nt, Human
acuaacauguuaaucaaaagaa

SEQ ID NO: 662997 - RNA, 23 nt, Human
cccuggagcuagucugagcgggg

SEQ ID NO: 662998 - RNA, 22 nt, Human
acugaucacagauauguauauu

SEQ ID NO: 662999 - RNA, 22 nt, Human
ugcacagcuggcucuccuuuuc

SEQ ID NO: 663000 - RNA, 22 nt, Human
cuuaagagucuuucuguguuua

SEQ ID NO: 663001 - RNA, 22 nt, Human
gaaguucaggugggaauugagc

SEQ ID NO: 663002 - RNA, 22 nt, Human
gcaaagaaugcagauuugccuc

SEQ ID NO: 663003 - RNA, 22 nt, Human
aggcuucacauuuucuaggccu

SEQ ID NO: 663004 - RNA, 19 nt, Human
uucacauuggaagaaguag

SEQ ID NO: 663005 - RNA, 22 nt, Human
ugcucuguaggggaaagagagc

SEQ ID NO: 663006 - RNA, 22 nt, Human
uguacuugaacuugacuguaga

SEQ ID NO: 663007 - RNA, 22 nt, Human
aaggcgacacaggcagcaggcc

SEQ ID NO: 663008 - RNA, 22 nt, Human
acacaagauuguguauugaauu

SEQ ID NO: 663009 - RNA, 22 nt, Human
acaauagaguucucauaggaca

SEQ ID NO: 663010 - RNA, 22 nt, Human
acuugggauuucagaugcugug

SEQ ID NO: 663011 - RNA, 22 nt, Human
aggaagugggguucucucacug

SEQ ID NO: 663012 - RNA, 22 nt, Human
agauacagccugccagguucuu

SEQ ID NO: 663013 - RNA, 22 nt, Human
agcagcaaggaacagaauggac

SEQ ID NO: 663014 - RNA, 22 nt, Human
uaacuuucacaucacacugacu

SEQ ID NO: 663015 - RNA, 22 nt, Human
auugggaagauuuagauccacu

SEQ ID NO: 663016 - RNA, 22 nt, Human
cugggccugguagggcuugaaa

SEQ ID NO: 663017 - RNA, 22 nt, Human
agagcuggccagggaucacucu

SEQ ID NO: 663018 - RNA, 22 nt, Human
cucugugugguccucuguauug

SEQ ID NO: 663019 - RNA, 22 nt, Human
aaaugcauguagaauaauagag

SEQ ID NO: 663020 - RNA, 22 nt, Human
cuguaacuuagcaugguuacua

SEQ ID NO: 663021 - RNA, 22 nt, Human
uucuuacagcccuauuacuaaa

SEQ ID NO: 663022 - RNA, 22 nt, Human
gggcccugccccguggcucuga

SEQ ID NO: 663023 - RNA, 22 nt, Human
caucagcuuuggcgcugagcau

SEQ ID NO: 663024 - RNA, 22 nt, Human
uggcagcaauuugugauguuga

SEQ ID NO: 663025 - RNA, 22 nt, Human
uggcauuuaguugcguauugca

SEQ ID NO: 663026 - RNA, 21 nt, Human
ugcucaugcaaugcaugucca

SEQ ID NO: 663027 - RNA, 22 nt, Human
acagaugaggaagagucagcca

SEQ ID NO: 663028 - RNA, 22 nt, Human
gaagccuugaacugcaaacccc

SEQ ID NO: 663029 - RNA, 22 nt, Human
uuaaacauuuuugaugaucgau

SEQ ID NO: 663030 - RNA, 20 nt, Human
ugcuggaaauuguucuagga

SEQ ID NO: 663031 - RNA, 20 nt, Human
ucuaaacaguuggcaugggg

SEQ ID NO: 663032 - RNA, 22 nt, Human
agggagcaaagguuucaggguu

SEQ ID NO: 663033 - RNA, 22 nt, Human
acauuucucauucuccccuaac

SEQ ID NO: 663034 - RNA, 22 nt, Human
aagccaagaguuaacuauuugu

SEQ ID NO: 663035 - RNA, 22 nt, Human
gcauucuucacaguauuccucc

SEQ ID NO: 663036 - RNA, 22 nt, Human
uuuucagaauuagcauaccauu

SEQ ID NO: 663037 - RNA, 22 nt, Human
uggcaggcauugaugcgaguuc

SEQ ID NO: 663038 - RNA, 22 nt, Human
acaauugcuaaugcuucuguug

SEQ ID NO: 663039 - RNA, 20 nt, Human
uucuuaguagagcauguauu

SEQ ID NO: 663040 - RNA, 22 nt, Human
ucccagaaaaaggaggcuauga

SEQ ID NO: 663041 - RNA, 23 nt, Human
aaacuacaacgccaggcacugag

SEQ ID NO: 663042 - RNA, 21 nt, Human
auucugaguugucagucuuca

SEQ ID NO: 663043 - RNA, 22 nt, Human
caucuguuuccuaaucuguagc

SEQ ID NO: 663044 - RNA, 22 nt, Human
cagggccacugcaugagguuca

SEQ ID NO: 663045 - RNA, 21 nt, Human
uuugccuucacgaagcauccu

SEQ ID NO: 663046 - RNA, 20 nt, Human
gcauccagacacccagcugc

SEQ ID NO: 663047 - RNA, 22 nt, Human
uuccuuucccucacagccucgg

SEQ ID NO: 663048 - RNA, 22 nt, Human
auuuaauuguucuucuggcuau

SEQ ID NO: 663049 - RNA, 18 nt, Human
gcuggcugcacuucugcu

SEQ ID NO: 663050 - RNA, 22 nt, Human
auuauuaggacuacugggguug

SEQ ID NO: 663051 - RNA, 19 nt, Human
gcuggggaauggauauuga

SEQ ID NO: 663052 - RNA, 22 nt, Human
ugugaggauguuaaggggauga

SEQ ID NO: 663053 - RNA, 22 nt, Human
uuuccuuuuauaaggcuugagg

SEQ ID NO: 663054 - RNA, 22 nt, Human
ugauugaauauucccuugggcc

SEQ ID NO: 663055 - RNA, 22 nt, Human
uagcaaccagaacagcacucua

SEQ ID NO: 663056 - RNA, 22 nt, Human
uaugagaauaaucugguaaaua

SEQ ID NO: 663057 - RNA, 22 nt, Human
auuauguagguuaggugguugu

SEQ ID NO: 663058 - RNA, 22 nt, Human
aauguguacaugacagauagaa

SEQ ID NO: 663059 - RNA, 22 nt, Human
ugucuccaacucacuguauacu

SEQ ID NO: 663060 - RNA, 22 nt, Human
aaggcccuucggcuuccucagc

SEQ ID NO: 663061 - RNA, 18 nt, Human
gucuuuggaguggaggua

SEQ ID NO: 663062 - RNA, 20 nt, Human
augugucugccucuguguuc

SEQ ID NO: 663063 - RNA, 23 nt, Human
ucugggcugagcucgaguguaga

SEQ ID NO: 663064 - RNA, 22 nt, Human
agacagcuaauaaaugagugug

SEQ ID NO: 663065 - RNA, 22 nt, Human
aucagacucugcauugcagucu

SEQ ID NO: 663066 - RNA, 22 nt, Human
ugucacaaacauacauuauaga

SEQ ID NO: 663067 - RNA, 22 nt, Human
gcauucaucuuccuccaugcag

SEQ ID NO: 663068 - RNA, 22 nt, Human
aagcuucaucugaugccgaacu

SEQ ID NO: 663069 - RNA, 22 nt, Human
ugcugagggcagaugaauuaga

SEQ ID NO: 663070 - RNA, 20 nt, Human
acaguggaaauugaugucug

SEQ ID NO: 663071 - RNA, 22 nt, Human
ugaggcugagauaucagggagg

SEQ ID NO: 663072 - RNA, 22 nt, Human
gauuucuaguucauuaucuauu

SEQ ID NO: 663073 - RNA, 23 nt, Human
uugaauuucucuugcaauauuua

SEQ ID NO: 663074 - RNA, 21 nt, Human
uauuuauuaauuuguaaggcu

SEQ ID NO: 663075 - RNA, 22 nt, Human
cacauacuuguguguacauaug

SEQ ID NO: 663076 - RNA, 22 nt, Human
ggaagggaauccaucugguuag

SEQ ID NO: 663077 - RNA, 22 nt, Human
cugugaauuuaaagcacacauc

SEQ ID NO: 663078 - RNA, 22 nt, Human
cugugccauccuagggcugcug

SEQ ID NO: 663079 - RNA, 22 nt, Human
acaugcuacacagagcuccucg

SEQ ID NO: 663080 - RNA, 22 nt, Human
auuccaaagcacaucagaacua

SEQ ID NO: 663081 - RNA, 22 nt, Human
acacaguaugcaucuagaaauu

SEQ ID NO: 663082 - RNA, 22 nt, Human
ucaguaacuuacuuauucaccu

SEQ ID NO: 663083 - RNA, 22 nt, Human
gcagagaugggccagugacgca

SEQ ID NO: 663084 - RNA, 22 nt, Human
aggcucauucuugccucugagc

SEQ ID NO: 663085 - RNA, 19 nt, Human
auuugaaagcugugcuugc

SEQ ID NO: 663086 - RNA, 22 nt, Human
ugacagaaagaauaugucaauc

SEQ ID NO: 663087 - RNA, 22 nt, Human
cauuuauugguuaggccagcag

SEQ ID NO: 663088 - RNA, 22 nt, Human
uccaggucagacuucugugccc

SEQ ID NO: 663089 - RNA, 20 nt, Human
gagggcacauuguuccgugc

SEQ ID NO: 663090 - RNA, 22 nt, Human
ccucagugcguacugaacagug

SEQ ID NO: 663091 - RNA, 22 nt, Human
gaggucuggaccaagucgcccc

SEQ ID NO: 663092 - RNA, 22 nt, Human
uagcugagagcucacuugagga

SEQ ID NO: 663093 - RNA, 22 nt, Human
ugugcuauuugacuguuugcua

SEQ ID NO: 663094 - RNA, 19 nt, Human
uucauucucuuauuguugu

SEQ ID NO: 663095 - RNA, 22 nt, Human
gaagcuuuauugcaagugaggc

SEQ ID NO: 663096 - RNA, 22 nt, Human
uugcaaauaauagccugaaacu

SEQ ID NO: 663097 - RNA, 22 nt, Human
ugggaccaagucauuucuuuag

SEQ ID NO: 663098 - RNA, 22 nt, Human
gccuggcaggccuguuggggcu

SEQ ID NO: 663099 - RNA, 22 nt, Human
ucccaggcaaaggcagcucauu

SEQ ID NO: 663100 - RNA, 22 nt, Human
ucagagguaguagcagaguuga

SEQ ID NO: 663101 - RNA, 22 nt, Human
ccaggcuggauuuugcaguuca

SEQ ID NO: 663102 - RNA, 22 nt, Human
ggcagugugcaucuguguggcc

SEQ ID NO: 663103 - RNA, 22 nt, Human
ggagcucauaacaagguagcca

SEQ ID NO: 663104 - RNA, 20 nt, Human
cagagccaagagcagcaucu

SEQ ID NO: 663105 - RNA, 22 nt, Human
gaagaacuuauaggaaugucau

SEQ ID NO: 663106 - RNA, 22 nt, Human
ucuggccauggcaagccgagug

SEQ ID NO: 663107 - RNA, 22 nt, Human
auggucauaugcuaauucagga

SEQ ID NO: 663108 - RNA, 22 nt, Human
ucacuugaaccugggaggcaga

SEQ ID NO: 663109 - RNA, 22 nt, Human
cagcugccugcaacacaagcuu

SEQ ID NO: 663110 - RNA, 22 nt, Human
aagggagcuuaggagaucaggc

SEQ ID NO: 663111 - RNA, 22 nt, Human
cacacaugacccacuuuuaccg

SEQ ID NO: 663112 - RNA, 22 nt, Human
ggguuuuaugguucacuugcaa

SEQ ID NO: 663113 - RNA, 21 nt, Human
caggaaacugaggccaugggg

SEQ ID NO: 663114 - RNA, 22 nt, Human
auacagguucucuagggaacag

SEQ ID NO: 663115 - RNA, 22 nt, Human
acauuaaaauggagaauuuuga

SEQ ID NO: 663116 - RNA, 22 nt, Human
uuggcucacaugauuauggagg

SEQ ID NO: 663117 - RNA, 22 nt, Human
agaggcccugggcuggugugcu

SEQ ID NO: 663118 - RNA, 23 nt, Human
acugagcaauguuuacauacuug

SEQ ID NO: 663119 - RNA, 22 nt, Human
uaucuuuugaguucucaagaug

SEQ ID NO: 663120 - RNA, 22 nt, Human
accagagcagacuacuggaggu

SEQ ID NO: 663121 - RNA, 22 nt, Human
caaaacuaucaggcucaaagcu

SEQ ID NO: 663122 - RNA, 22 nt, Human
gaucuucucuuuaguagaaaca

SEQ ID NO: 663123 - RNA, 22 nt, Human
agaguucagcuacugcaaaugu

SEQ ID NO: 663124 - RNA, 22 nt, Human
aggagccaagcagaacuaagga

SEQ ID NO: 663125 - RNA, 22 nt, Human
acacugaguauugaguagggua

SEQ ID NO: 663126 - RNA, 22 nt, Human
augcccgauaccuaguuaacuc

SEQ ID NO: 663127 - RNA, 22 nt, Human
gagggguggcguuggcauuuag

SEQ ID NO: 663128 - RNA, 21 nt, Human
acagcuggaaauuacuugccc

SEQ ID NO: 663129 - RNA, 22 nt, Human
aaagcaggguccaaggagaugu

SEQ ID NO: 663130 - RNA, 19 nt, Human
gcuggggccugaccagaca

SEQ ID NO: 663131 - RNA, 22 nt, Human
ugcccugggaacacagaugcca

SEQ ID NO: 663132 - RNA, 22 nt, Human
agaacacugcuaguauaaucac

SEQ ID NO: 663133 - RNA, 22 nt, Human
gauucuggauugucugcuugaa

SEQ ID NO: 663134 - RNA, 22 nt, Human
agcugccugccaugccgcuggu

SEQ ID NO: 663135 - RNA, 23 nt, Human
agcuccagaacauagcacaggaa

SEQ ID NO: 663136 - RNA, 22 nt, Human
guguguguguaaaaauccagag

SEQ ID NO: 663137 - RNA, 22 nt, Human
ugcucaggccagccggacagag

SEQ ID NO: 663138 - RNA, 22 nt, Human
uuuuguguugccauguuaagca

SEQ ID NO: 663139 - RNA, 22 nt, Human
acugagaagauucucacucuua

SEQ ID NO: 663140 - RNA, 22 nt, Human
ucuucuccauaaucaacacucu

SEQ ID NO: 663141 - RNA, 22 nt, Human
caaauguauucucacuucaggg

SEQ ID NO: 663142 - RNA, 22 nt, Human
ucagcuucacccagaguuguag

SEQ ID NO: 663143 - RNA, 22 nt, Human
ccagaugagaccacacugcugg

SEQ ID NO: 663144 - RNA, 22 nt, Human
aagcacaugagcuauucaugcu

SEQ ID NO: 663145 - RNA, 22 nt, Human
cuccucuagaagcugaccugga

SEQ ID NO: 663146 - RNA, 22 nt, Human
aucacauuguuagcauagacug

SEQ ID NO: 663147 - RNA, 21 nt, Human
aacaugauauguguauggauu

SEQ ID NO: 663148 - RNA, 22 nt, Human
agagugacagccacugcaguaa

SEQ ID NO: 663149 - RNA, 22 nt, Human
cagaaagaccugauuggcaguu

SEQ ID NO: 663150 - RNA, 22 nt, Human
auccaugauugcccagaggugu

SEQ ID NO: 663151 - RNA, 22 nt, Human
ugcaggagaaaguacggagcgu

SEQ ID NO: 663152 - RNA, 22 nt, Human
auucuucacauggauaggaucu

SEQ ID NO: 663153 - RNA, 22 nt, Human
ggcuggcuacauuggaggaagg

SEQ ID NO: 663154 - RNA, 22 nt, Human
ucugcaacauuccucuccccac

SEQ ID NO: 663155 - RNA, 22 nt, Human
augaggaacagacuugcuggau

SEQ ID NO: 663156 - RNA, 22 nt, Human
cauccugacuggguaaagcuua

SEQ ID NO: 663157 - RNA, 22 nt, Human
uggcugcugcuuggucuucuuc

SEQ ID NO: 663158 - RNA, 20 nt, Human
ccaggccugggccugcucua

SEQ ID NO: 663159 - RNA, 22 nt, Human
gagaggcugacuggcuguccug

SEQ ID NO: 663160 - RNA, 20 nt, Human
cucuccuugccgacuuggca

SEQ ID NO: 663161 - RNA, 22 nt, Human
gaacagcucugaagcaguaaau

SEQ ID NO: 663162 - RNA, 22 nt, Human
cuagauaaggauuucucaacuu

SEQ ID NO: 663163 - RNA, 22 nt, Human
cuuaggaaauauauacuaaacu

SEQ ID NO: 663164 - RNA, 22 nt, Human
gggcacagcccagugggguccc

SEQ ID NO: 663165 - RNA, 22 nt, Human
cugauggagagugugauuuggg

SEQ ID NO: 663166 - RNA, 22 nt, Human
uacuuuaauauaugugaaguuc

SEQ ID NO: 663167 - RNA, 22 nt, Human
ugccacuggacccagaacucuu

SEQ ID NO: 663168 - RNA, 22 nt, Human
aaaguugcuggcuuugguucau

SEQ ID NO: 663169 - RNA, 22 nt, Human
acccugggugagaggcaaacag

SEQ ID NO: 663170 - RNA, 22 nt, Human
uuccuguauuuugcgaauuuuc

SEQ ID NO: 663171 - RNA, 22 nt, Human
aaaugcuauuugggaacaacau

SEQ ID NO: 663172 - RNA, 22 nt, Human
acacccagauuaugcacacaaa

SEQ ID NO: 663173 - RNA, 22 nt, Human
ugcaucuuuagucuuaugucug

SEQ ID NO: 663174 - RNA, 22 nt, Human
acagcacaaucugagucccaga

SEQ ID NO: 663175 - RNA, 22 nt, Human
guaaaacauguuuuaacuagga

SEQ ID NO: 663176 - RNA, 22 nt, Human
ucugcccucaggguaaugauca

SEQ ID NO: 663177 - RNA, 22 nt, Human
uggaugaguucaaugaggcaga

SEQ ID NO: 663178 - RNA, 22 nt, Human
aggguagcuacccaacuccaga

SEQ ID NO: 663179 - RNA, 22 nt, Human
acugucacuaacuaagucuagu

SEQ ID NO: 663180 - RNA, 22 nt, Human
ucugugcucuucucaguaucac

SEQ ID NO: 663181 - RNA, 22 nt, Human
gacacuuuaggauuuaaaaguc

SEQ ID NO: 663182 - RNA, 22 nt, Human
gccugagcagcuauacacacag

SEQ ID NO: 663183 - RNA, 22 nt, Human
auggcucuugaauugauacucu

SEQ ID NO: 663184 - RNA, 22 nt, Human
cucaggauggaagccuacagga

SEQ ID NO: 663185 - RNA, 22 nt, Human
guccagggcuaaaucagguucc

SEQ ID NO: 663186 - RNA, 22 nt, Human
cugugucuucacauuugugugc

SEQ ID NO: 663187 - RNA, 22 nt, Human
ugcuucuaaucuacugcauuag

SEQ ID NO: 663188 - RNA, 22 nt, Human
auauaggcuucaugacagaggg

SEQ ID NO: 663189 - RNA, 22 nt, Human
agccuuggccguaagguaugcu

SEQ ID NO: 663190 - RNA, 22 nt, Human
uacaaagauaguguuagaguaa

SEQ ID NO: 663191 - RNA, 22 nt, Human
uuccugugugacucaagugguu

SEQ ID NO: 663192 - RNA, 22 nt, Human
ugucuuuguguacaggaucgcc

SEQ ID NO: 663193 - RNA, 22 nt, Human
ucaagcaaagauacaaauggaa

SEQ ID NO: 663194 - RNA, 22 nt, Human
gaaaugcaggcuuggauucagc

SEQ ID NO: 663195 - RNA, 22 nt, Human
ucuuagaaguucauguuccagc

SEQ ID NO: 663196 - RNA, 22 nt, Human
uggcagaguaggauggcccugu

SEQ ID NO: 663197 - RNA, 22 nt, Human
aauguggacucuuguauuuuuc

SEQ ID NO: 663198 - RNA, 22 nt, Human
uccugggaagcgccggccugcg

SEQ ID NO: 663199 - RNA, 22 nt, Human
uuuucugcggugugaauggccu

SEQ ID NO: 663200 - RNA, 22 nt, Human
cucucugggggccaugccaaga

SEQ ID NO: 663201 - RNA, 22 nt, Human
ccugagguuuuuggauaguugu

SEQ ID NO: 663202 - RNA, 19 nt, Human
ugcagccacgugagagacu

SEQ ID NO: 663203 - RNA, 22 nt, Human
uuugauaauacacaagagaaag

SEQ ID NO: 663204 - RNA, 22 nt, Human
aagaauauagauuuuuugaagu

SEQ ID NO: 663205 - RNA, 22 nt, Human
caggaaggaccguccagaucag

SEQ ID NO: 663206 - RNA, 22 nt, Human
acaucaguaacuguaaaacagg

SEQ ID NO: 663207 - RNA, 22 nt, Human
aguagcaguuuggcugaauuua

SEQ ID NO: 663208 - RNA, 21 nt, Human
agagcacagguggacaaugcu

SEQ ID NO: 663209 - RNA, 23 nt, Human
auaauaacgucugucuugucucu

SEQ ID NO: 663210 - RNA, 22 nt, Human
caggcugcuguccacaaagcau

SEQ ID NO: 663211 - RNA, 22 nt, Human
gugauuucuaaucaucugaaug

SEQ ID NO: 663212 - RNA, 22 nt, Human
auuucucucauuguuagcuagg

SEQ ID NO: 663213 - RNA, 22 nt, Human
auguaacuguuauauuuuguug

SEQ ID NO: 663214 - RNA, 22 nt, Human
ccugccuuccagccuugggcuc

SEQ ID NO: 663215 - RNA, 22 nt, Human
acucuggcuauucacuauaaua

SEQ ID NO: 663216 - RNA, 19 nt, Human
aauugccugucucugccag

SEQ ID NO: 663217 - RNA, 19 nt, Human
uacauccggguuacuuaag

SEQ ID NO: 663218 - RNA, 22 nt, Human
ucagaguggugguuuugccuuc

SEQ ID NO: 663219 - RNA, 22 nt, Human
agcuuccugacuggugcucuua

SEQ ID NO: 663220 - RNA, 22 nt, Human
ugcugagguuucugacuaugga

SEQ ID NO: 663221 - RNA, 22 nt, Human
ugauuaaguucaaaauauagaa

SEQ ID NO: 663222 - RNA, 22 nt, Human
acaaaaagcuccauuacugucc

SEQ ID NO: 663223 - RNA, 21 nt, Human
uaaaagaugacaagacagcuc

SEQ ID NO: 663224 - RNA, 22 nt, Human
cugucuguuaucucaccagucc

SEQ ID NO: 663225 - RNA, 22 nt, Human
ugucugagucaugcagagauau

SEQ ID NO: 663226 - RNA, 22 nt, Human
uaaugccacggcagggaacagc

SEQ ID NO: 663227 - RNA, 22 nt, Human
uaguacagagacacuggaggaa

SEQ ID NO: 663228 - RNA, 22 nt, Human
agauuuuaguuuggggaggugc

SEQ ID NO: 663229 - RNA, 22 nt, Human
aggcuccaaauuaccaagcucu

SEQ ID NO: 663230 - RNA, 22 nt, Human
uugccugugaacgcugaguccu

SEQ ID NO: 663231 - RNA, 22 nt, Human
guucuaauauuuuaaaagccaa

SEQ ID NO: 663232 - RNA, 22 nt, Human
agcugucuuuggagagggagag

SEQ ID NO: 663233 - RNA, 22 nt, Human
gcucaggcaccauaugaugugu

SEQ ID NO: 663234 - RNA, 22 nt, Human
ccaggagaugggaaaguagcag

SEQ ID NO: 663235 - RNA, 22 nt, Human
cuggcucugggcuaagcuccca

SEQ ID NO: 663236 - RNA, 22 nt, Human
gagaguccuuaguuugcaggua

SEQ ID NO: 663237 - RNA, 22 nt, Human
aggcugaggggcgagggacccu

SEQ ID NO: 663238 - RNA, 22 nt, Human
ugucugcuaaauuacuauuaca

SEQ ID NO: 663239 - RNA, 22 nt, Human
cugcagcuuuggaaaccuguuu

SEQ ID NO: 663240 - RNA, 22 nt, Human
uaaguacauuugggaccaccug

SEQ ID NO: 663241 - RNA, 21 nt, Human
acugucauuugcuuagggagg

SEQ ID NO: 663242 - RNA, 22 nt, Human
gauccguuccaccagucuuuau

SEQ ID NO: 663243 - RNA, 22 nt, Human
cagcagugacaagacuaagaag

SEQ ID NO: 663244 - RNA, 22 nt, Human
ccucuguggccuuggaccagcu

SEQ ID NO: 663245 - RNA, 22 nt, Human
acuggcuugaaguagauucaaa

SEQ ID NO: 663246 - RNA, 22 nt, Human
gugugauaacagggcaugacgg

SEQ ID NO: 663247 - RNA, 22 nt, Human
acuucuuucacaauguuucuag

SEQ ID NO: 663248 - RNA, 22 nt, Human
aaacuuuuucuuagguaugucu

SEQ ID NO: 663249 - RNA, 22 nt, Human
gaucagugaacuauacugccuc

SEQ ID NO: 663250 - RNA, 22 nt, Human
aaucauuguugucguuccuaga

SEQ ID NO: 663251 - RNA, 22 nt, Human
gcuccuggucuggagcuucaag

SEQ ID NO: 663252 - RNA, 22 nt, Human
ucccggcgcugggagguggguc

SEQ ID NO: 663253 - RNA, 22 nt, Human
aggaagcugggguguucuucau

SEQ ID NO: 663254 - RNA, 22 nt, Human
ucuguuagagagguaguucuug

SEQ ID NO: 663255 - RNA, 22 nt, Human
agggagcugacuggcugccauu

SEQ ID NO: 663256 - RNA, 22 nt, Human
cacccacugagcucauguccca

SEQ ID NO: 663257 - RNA, 22 nt, Human
acauucaugcaccuuccuaucc

SEQ ID NO: 663258 - RNA, 22 nt, Human
uuacaaucaucuaggauaaaga

SEQ ID NO: 663259 - RNA, 22 nt, Human
gccaccuccuuauuccaccugu

SEQ ID NO: 663260 - RNA, 22 nt, Human
caauaauauccugugcuguuug

SEQ ID NO: 663261 - RNA, 22 nt, Human
cugguggagggacaggcuuagc

SEQ ID NO: 663262 - RNA, 22 nt, Human
ucucagggcaauucucagcgac

SEQ ID NO: 663263 - RNA, 22 nt, Human
cuccagugagcgcggggcaugg

SEQ ID NO: 663264 - RNA, 22 nt, Human
ccagcccuuagauaaaccuggc

SEQ ID NO: 663265 - RNA, 19 nt, Human
uggcuuccugacucucauc

SEQ ID NO: 663266 - RNA, 22 nt, Human
cacacaugugagcagagaggcg

SEQ ID NO: 663267 - RNA, 22 nt, Human
ugcagguaaauuuguggaggau

SEQ ID NO: 663268 - RNA, 22 nt, Human
ugcucacugaacucuugcuguc

SEQ ID NO: 663269 - RNA, 22 nt, Human
cuauuuauuguggguauccagg

SEQ ID NO: 663270 - RNA, 22 nt, Human
ccuuggcuguguugccugcccu

SEQ ID NO: 663271 - RNA, 22 nt, Human
uccagcugacaucuccugaggg

SEQ ID NO: 663272 - RNA, 22 nt, Human
acacaagucccuccauacucuc

SEQ ID NO: 663273 - RNA, 22 nt, Human
uuucaaagcaacugaaaaggaa

SEQ ID NO: 663274 - RNA, 22 nt, Human
cugucaguaggcucccaucauu

SEQ ID NO: 663275 - RNA, 22 nt, Human
uucaacuagauuuauacaauuc

SEQ ID NO: 663276 - RNA, 19 nt, Human
uuuagacauugucugguau

SEQ ID NO: 663277 - RNA, 22 nt, Human
cacauuguauuguggaaaguua

SEQ ID NO: 663278 - RNA, 22 nt, Human
uggcugccuucccugcuggagg

SEQ ID NO: 663279 - RNA, 22 nt, Human
uaggaugugccaggaaagaaag

SEQ ID NO: 663280 - RNA, 22 nt, Human
gugcaaaaugauauccugaagc

SEQ ID NO: 663281 - RNA, 22 nt, Human
ucagcucucacagaucucaacc

SEQ ID NO: 663282 - RNA, 22 nt, Human
aaagagcucuuacucuagugua

SEQ ID NO: 663283 - RNA, 22 nt, Human
aggaaugucauagaauaaucau

SEQ ID NO: 663284 - RNA, 22 nt, Human
uggcagcugaggggaggcuuug

SEQ ID NO: 663285 - RNA, 22 nt, Human
gacuggaaucccaggcucugug

SEQ ID NO: 663286 - RNA, 22 nt, Human
aaugcuuuuugcgaaaugugca

SEQ ID NO: 663287 - RNA, 22 nt, Human
uaaaugauaauaaugcuagugu

SEQ ID NO: 663288 - RNA, 22 nt, Human
gccuggagaauuaaaaggaagg

SEQ ID NO: 663289 - RNA, 22 nt, Human
ggcuccaggaaccuccucuccu

SEQ ID NO: 663290 - RNA, 22 nt, Human
auucagcauucauuaugcgcca

SEQ ID NO: 663291 - RNA, 21 nt, Human
aggaggagagcuuggccuacc

SEQ ID NO: 663292 - RNA, 22 nt, Human
aagaaucauccugcaagagucu

SEQ ID NO: 663293 - RNA, 22 nt, Human
cuguccagucagaacgucauua

SEQ ID NO: 663294 - RNA, 22 nt, Human
ucagccagcauuaccccugacu

SEQ ID NO: 663295 - RNA, 22 nt, Human
gcuuucuugguucugcaggggc

SEQ ID NO: 663296 - RNA, 22 nt, Human
gccuucaggugcugccaggcua

SEQ ID NO: 663297 - RNA, 22 nt, Human
aauggcuuuggcaggaauuuca

SEQ ID NO: 663298 - RNA, 19 nt, Human
ggcucuggcggcuguagcc

SEQ ID NO: 663299 - RNA, 22 nt, Human
cucagucaugacgcucaggacc

SEQ ID NO: 663300 - RNA, 22 nt, Human
cagugugacuucugagcugcca

SEQ ID NO: 663301 - RNA, 22 nt, Human
gauuucaaguaucuugggcgag

SEQ ID NO: 663302 - RNA, 22 nt, Human
cagcucucuaaggucuugcuuu

SEQ ID NO: 663303 - RNA, 22 nt, Human
ucagggcaaugucccucagaag

SEQ ID NO: 663304 - RNA, 22 nt, Human
ccugagagugcgugccuccuua

SEQ ID NO: 663305 - RNA, 22 nt, Human
uggcuggagggacccacucaga

SEQ ID NO: 663306 - RNA, 22 nt, Human
cuucugggagagcuuuugcuuc

SEQ ID NO: 663307 - RNA, 22 nt, Human
aaggcuuuuguuccuauuuagu

SEQ ID NO: 663308 - RNA, 22 nt, Human
ggaggaccugcuggcccugcaa

SEQ ID NO: 663309 - RNA, 22 nt, Human
acugccugcucauaacauugcu

SEQ ID NO: 663310 - RNA, 22 nt, Human
gagguggcccuugcucagccuu

SEQ ID NO: 663311 - RNA, 22 nt, Human
guggcagucaucaaggacagau

SEQ ID NO: 663312 - RNA, 21 nt, Human
cucuccagugguuccugauuc

SEQ ID NO: 663313 - RNA, 22 nt, Human
ccugagugcuuccagagucaug

SEQ ID NO: 663314 - RNA, 22 nt, Human
aggcuuguggauuggagcgagu

SEQ ID NO: 663315 - RNA, 22 nt, Human
cugggacuggguccucaggaca

SEQ ID NO: 663316 - RNA, 22 nt, Human
gaagcugaggucaggugggugg

SEQ ID NO: 663317 - RNA, 22 nt, Human
aggacccugagcgggcaugccg

SEQ ID NO: 663318 - RNA, 22 nt, Human
cccucacuucacgcucugcaga

SEQ ID NO: 663319 - RNA, 22 nt, Human
uuccugcuccauuugcugagcu

SEQ ID NO: 663320 - RNA, 19 nt, Human
aaaaagaggcuauaauauu

SEQ ID NO: 663321 - RNA, 22 nt, Human
cagcucugugcaggccugggga

SEQ ID NO: 663322 - RNA, 22 nt, Human
agggaaauuaaugugagcaaug

SEQ ID NO: 663323 - RNA, 22 nt, Human
gccuggcucugagggagcuccu

SEQ ID NO: 663324 - RNA, 22 nt, Human
auguccaauuucagagucucau

SEQ ID NO: 663325 - RNA, 22 nt, Human
ugcagggaaucuguggcuggac

SEQ ID NO: 663326 - RNA, 22 nt, Human
gcagcccacaccacucugcuca

SEQ ID NO: 663327 - RNA, 18 nt, Human
cuuccucaucgcucuccc

SEQ ID NO: 663328 - RNA, 22 nt, Human
agcagaagugccuuagcaauca

SEQ ID NO: 663329 - RNA, 22 nt, Human
aagguacagaaauuaacaagga

SEQ ID NO: 663330 - RNA, 22 nt, Human
uaguagugagucuuuauaaaua

SEQ ID NO: 663331 - RNA, 22 nt, Human
uuagcuuucuuuggcagacgug

SEQ ID NO: 663332 - RNA, 19 nt, Human
agcuacagcauggcgaggu

SEQ ID NO: 663333 - RNA, 22 nt, Human
agcuguuuucuucuaggaagac

SEQ ID NO: 663334 - RNA, 21 nt, Human
ucacugcaaugcuaggagaaa

SEQ ID NO: 663335 - RNA, 22 nt, Human
auguacauacugcauuuucaaa

SEQ ID NO: 663336 - RNA, 23 nt, Human
acucagcuuugggagaugacuca

SEQ ID NO: 663337 - RNA, 22 nt, Human
cuccucuuuggggauuuacaca

SEQ ID NO: 663338 - RNA, 22 nt, Human
ggucucagcccucgccagcagc

SEQ ID NO: 663339 - RNA, 22 nt, Human
gcugcaggcagaaucucccaau

SEQ ID NO: 663340 - RNA, 22 nt, Human
gacaugcaguucucaaggguag

SEQ ID NO: 663341 - RNA, 22 nt, Human
ugaggaggucagagucuggcug

SEQ ID NO: 663342 - RNA, 22 nt, Human
cagauguaauuacucaagucaa

SEQ ID NO: 663343 - RNA, 21 nt, Human
uuuacugagcacuuacuaugu

SEQ ID NO: 663344 - RNA, 22 nt, Human
ggacugaaaucuuuccauguca

SEQ ID NO: 663345 - RNA, 22 nt, Human
caguggccucuggcuuugcugu

SEQ ID NO: 663346 - RNA, 21 nt, Human
gugcugggacacagccaggcu

SEQ ID NO: 663347 - RNA, 22 nt, Human
gagaggagaagccugcgcuuca

SEQ ID NO: 663348 - RNA, 18 nt, Human
ucuguguucugucauugc

SEQ ID NO: 663349 - RNA, 22 nt, Human
ucaggaagcugaauuacaaaaa

SEQ ID NO: 663350 - RNA, 22 nt, Human
augaugcuguuuaucauauacu

SEQ ID NO: 663351 - RNA, 22 nt, Human
gaaugaaagauuugcauucuau

SEQ ID NO: 663352 - RNA, 22 nt, Human
aucaccauugaaaaacagguuu

SEQ ID NO: 663353 - RNA, 22 nt, Human
ucuagaaucuaaacuauaguuu

SEQ ID NO: 663354 - RNA, 22 nt, Human
ucauggcuaaccaaggccugau

SEQ ID NO: 663355 - RNA, 22 nt, Human
ucccacacagcccgcucaccgg

SEQ ID NO: 663356 - RNA, 22 nt, Human
ugcuucugcugauauuuuguga

SEQ ID NO: 663357 - RNA, 22 nt, Human
gcacaguuaaagggucauguga

SEQ ID NO: 663358 - RNA, 22 nt, Human
guuugaaaugucugcaagggaa

SEQ ID NO: 663359 - RNA, 22 nt, Human
ugaggcacauccaggccagcuc

SEQ ID NO: 663360 - RNA, 22 nt, Human
cacaaauaccaguuuccuaaca

SEQ ID NO: 663361 - RNA, 22 nt, Human
uaaacagaauucaggcaagaua

SEQ ID NO: 663362 - RNA, 22 nt, Human
ucugagauuaagcagagaugga

SEQ ID NO: 663363 - RNA, 20 nt, Human
caggccucugggggcccugg

SEQ ID NO: 663364 - RNA, 22 nt, Human
aggaguuauggcagaaucaaau

SEQ ID NO: 663365 - RNA, 19 nt, Human
ccuggagucgcgcugccuc

SEQ ID NO: 663366 - RNA, 22 nt, Human
uaagcuaacguccauggaaaug

SEQ ID NO: 663367 - RNA, 22 nt, Human
aacuacagcucuugucuuucug

SEQ ID NO: 663368 - RNA, 21 nt, Human
aaaaggaggcaggugaacagc

SEQ ID NO: 663369 - RNA, 22 nt, Human
uacuuucaugucuauacauauu

SEQ ID NO: 663370 - RNA, 22 nt, Human
agucacauagaaguggguuuaa

SEQ ID NO: 663371 - RNA, 22 nt, Human
auggaagguccuacagagcgca

SEQ ID NO: 663372 - RNA, 22 nt, Human
gugugguggcccuccuucaggc

SEQ ID NO: 663373 - RNA, 22 nt, Human
agugcuuugaacgaaaggcuga

SEQ ID NO: 663374 - RNA, 18 nt, Human
ggucuuuaggucaguguc

SEQ ID NO: 663375 - RNA, 22 nt, Human
aggccuggccccaguugcuagg

SEQ ID NO: 663376 - RNA, 22 nt, Human
gauaaacacaaggugauuucau

SEQ ID NO: 663377 - RNA, 22 nt, Human
aaauuaucaugauuauugugua

SEQ ID NO: 663378 - RNA, 22 nt, Human
gcugguuuccuuaucuauaaag

SEQ ID NO: 663379 - RNA, 22 nt, Human
gguccaaggcucgguggcgggg

SEQ ID NO: 663380 - RNA, 22 nt, Human
aaggcagauaagaauucagcaa

SEQ ID NO: 663381 - RNA, 23 nt, Human
cauaaaauauuaguaugguagca

SEQ ID NO: 663382 - RNA, 22 nt, Human
ucucucucagccauuacagaac

SEQ ID NO: 663383 - RNA, 19 nt, Human
gcagaugaugaggcugguc

SEQ ID NO: 663384 - RNA, 22 nt, Human
ucuccucuccuuucauguuguu

SEQ ID NO: 663385 - RNA, 22 nt, Human
gugagcuggaauaguggagaaa

SEQ ID NO: 663386 - RNA, 22 nt, Human
uugauucuaaaauaggaggaaa

SEQ ID NO: 663387 - RNA, 22 nt, Human
gccagcagggcccaaaugcugg

SEQ ID NO: 663388 - RNA, 22 nt, Human
uggcagacacugucgaagccua

SEQ ID NO: 663389 - RNA, 23 nt, Human
auguggcuagugagaccaagaaa

SEQ ID NO: 663390 - RNA, 18 nt, Human
cucugaaagacacaccag

SEQ ID NO: 663391 - RNA, 22 nt, Human
cuuuaugaaccuguucagcuug

SEQ ID NO: 663392 - RNA, 22 nt, Human
gccuuucagugccuucuguuca

SEQ ID NO: 663393 - RNA, 22 nt, Human
uucugagauuguuaggcacuaa

SEQ ID NO: 663394 - RNA, 22 nt, Human
uuccugguuuauaccuguauca

SEQ ID NO: 663395 - RNA, 22 nt, Human
uacacacugugauaaugaagca

SEQ ID NO: 663396 - RNA, 22 nt, Human
gugccuccuuaaauucugcacc

SEQ ID NO: 663397 - RNA, 22 nt, Human
ccagcaucgacuuccugccuga

SEQ ID NO: 663398 - RNA, 22 nt, Human
cccagagcucagugugcaaggu

SEQ ID NO: 663399 - RNA, 22 nt, Human
uggguggagcuccacaaccugu

SEQ ID NO: 663400 - RNA, 21 nt, Human
auuuagaaggaaauuuugcaa

SEQ ID NO: 663401 - RNA, 22 nt, Human
ucaucacucauuggacaacaga

SEQ ID NO: 663402 - RNA, 22 nt, Human
ggcucuggagauguccgaccug

SEQ ID NO: 663403 - RNA, 20 nt, Human
auagauaucaucuuuagaag

SEQ ID NO: 663404 - RNA, 22 nt, Human
aguguuuaaacugaagugauga

SEQ ID NO: 663405 - RNA, 22 nt, Human
cucagaaaaccucuuucuugau

SEQ ID NO: 663406 - RNA, 22 nt, Human
ucagcugccuuucccaugcuag

SEQ ID NO: 663407 - RNA, 22 nt, Human
acaguaaugcauacaaguuagu

SEQ ID NO: 663408 - RNA, 22 nt, Human
ugugugugaguccuggcuuucc

SEQ ID NO: 663409 - RNA, 22 nt, Human
ccugggguauauaggugaauau

SEQ ID NO: 663410 - RNA, 22 nt, Human
acacaugaguucucaucuugug

SEQ ID NO: 663411 - RNA, 22 nt, Human
acagagcuucccagccugagca

SEQ ID NO: 663412 - RNA, 22 nt, Human
gugcuuuucugcaggguccuau

SEQ ID NO: 663413 - RNA, 22 nt, Human
acugucaggauggcagcuuguu

SEQ ID NO: 663414 - RNA, 21 nt, Human
ugcaagcagcagagauauggg

SEQ ID NO: 663415 - RNA, 22 nt, Human
agggcugacaaauggcagugac

SEQ ID NO: 663416 - RNA, 22 nt, Human
ugggaguguucuuggcuugcuu

SEQ ID NO: 663417 - RNA, 18 nt, Human
auggcucaggaauggcuu

SEQ ID NO: 663418 - RNA, 22 nt, Human
acagccugacuuuuguugucac

SEQ ID NO: 663419 - RNA, 22 nt, Human
agcuuacaccccccaagauucu

SEQ ID NO: 663420 - RNA, 22 nt, Human
gguuuauuaaugugaacuguau

SEQ ID NO: 663421 - RNA, 22 nt, Human
cagggucaagagacuccagcag

SEQ ID NO: 663422 - RNA, 22 nt, Human
ucucugccacagcuucugccuu

SEQ ID NO: 663423 - RNA, 22 nt, Human
aucuuaaucgaguccaugaaaa

SEQ ID NO: 663424 - RNA, 22 nt, Human
ggcagcugugaagugccucaca

SEQ ID NO: 663425 - RNA, 22 nt, Human
aaaugguccauccuaaagaagu

SEQ ID NO: 663426 - RNA, 22 nt, Human
gcagugacagggcugcugccuu

SEQ ID NO: 663427 - RNA, 21 nt, Human
auuauuauuucuguguccagc

SEQ ID NO: 663428 - RNA, 22 nt, Human
aaguguaaauucacagacuuca

SEQ ID NO: 663429 - RNA, 22 nt, Human
aguuuuccuuuauugaguacca

SEQ ID NO: 663430 - RNA, 22 nt, Human
gaacaugaaaagucuuacacgc

SEQ ID NO: 663431 - RNA, 22 nt, Human
auccuugaacuuagacacuagg

SEQ ID NO: 663432 - RNA, 22 nt, Human
cucaagucagaaauaaaagcau

SEQ ID NO: 663433 - RNA, 22 nt, Human
uaucaacaaaggccuuguguuu

SEQ ID NO: 663434 - RNA, 22 nt, Human
aacaugauaguauuuugaggug

SEQ ID NO: 663435 - RNA, 22 nt, Human
aggggaugccuaguggagucuc

SEQ ID NO: 663436 - RNA, 22 nt, Human
gugcuuuauauguggguaucca

SEQ ID NO: 663437 - RNA, 20 nt, Human
cuacacaggguucgcugggc

SEQ ID NO: 663438 - RNA, 22 nt, Human
agccugccuugggcugcuugag

SEQ ID NO: 663439 - RNA, 19 nt, Human
acuugaaagcagagaguuu

SEQ ID NO: 663440 - RNA, 22 nt, Human
ugacugagagagaacucagcuu

SEQ ID NO: 663441 - RNA, 22 nt, Human
ucaugcccagagcaguaaauua

SEQ ID NO: 663442 - RNA, 22 nt, Human
uuugcauuuccagaguagcaga

SEQ ID NO: 663443 - RNA, 22 nt, Human
auuccuuggaacagaugcgaag

SEQ ID NO: 663444 - RNA, 22 nt, Human
gguggcucucugucagugacag

SEQ ID NO: 663445 - RNA, 22 nt, Human
augcaaauugccauaaaguggg

SEQ ID NO: 663446 - RNA, 22 nt, Human
aagaauuuuccagcaugucagu

SEQ ID NO: 663447 - RNA, 22 nt, Human
aaaaaagauugaugguggaugc

SEQ ID NO: 663448 - RNA, 22 nt, Human
gugguuguuuaggucguggauc

SEQ ID NO: 663449 - RNA, 22 nt, Human
cuccugacuugugagccccucc

SEQ ID NO: 663450 - RNA, 22 nt, Human
aguuucacaugcauggaugugu

SEQ ID NO: 663451 - RNA, 22 nt, Human
aggaggccugcagcugccauuc

SEQ ID NO: 663452 - RNA, 22 nt, Human
cugccuccugccgugcagcuuc

SEQ ID NO: 663453 - RNA, 22 nt, Human
gaggcccugaagacagcugggg

SEQ ID NO: 663454 - RNA, 22 nt, Human
uggcaucuccgacagucuugau

SEQ ID NO: 663455 - RNA, 22 nt, Human
aacaugugucuugcauuucuug

SEQ ID NO: 663456 - RNA, 22 nt, Human
aggagaccuuuugagugugaga

SEQ ID NO: 663457 - RNA, 22 nt, Human
uguccucuuccagugcuccuuc

SEQ ID NO: 663458 - RNA, 21 nt, Human
uggaaaacauuuaaauagcaa

SEQ ID NO: 663459 - RNA, 22 nt, Human
ucauauuuggggguguguguuu

SEQ ID NO: 663460 - RNA, 22 nt, Human
ugaggugguuuguaucacuggg

SEQ ID NO: 663461 - RNA, 22 nt, Human
uguggagacuauagccauaaca

SEQ ID NO: 663462 - RNA, 22 nt, Human
ugagcccucuucccauuuuauu

SEQ ID NO: 663463 - RNA, 22 nt, Human
acuguccauaauauuggugaac

SEQ ID NO: 663464 - RNA, 22 nt, Human
cagaaguggcaucauucaagag

SEQ ID NO: 663465 - RNA, 22 nt, Human
uuggcaucaguguaggaccugu

SEQ ID NO: 663466 - RNA, 22 nt, Human
gagcccugagaguugugaggcc

SEQ ID NO: 663467 - RNA, 22 nt, Human
uucuaaagccuguccuaucaga

SEQ ID NO: 663468 - RNA, 22 nt, Human
uguaaggugcucauguauuucu

SEQ ID NO: 663469 - RNA, 22 nt, Human
ggaggacugagacacuccuggc

SEQ ID NO: 663470 - RNA, 22 nt, Human
gcccagcuccucugcagacccu

SEQ ID NO: 663471 - RNA, 22 nt, Human
aguaugaauacagauuuucucu

SEQ ID NO: 663472 - RNA, 22 nt, Human
agcuaagguguccuggaggccc

SEQ ID NO: 663473 - RNA, 22 nt, Human
acuuucaagcccucuagagaca

SEQ ID NO: 663474 - RNA, 22 nt, Human
ccaggcacucagagacugggac

SEQ ID NO: 663475 - RNA, 23 nt, Human
cagcugguugugggaguggcugc

SEQ ID NO: 663476 - RNA, 23 nt, Human
uuacaacaguguccauauuugua

SEQ ID NO: 663477 - RNA, 22 nt, Human
cccaagggagugccuggucaac

SEQ ID NO: 663478 - RNA, 20 nt, Human
ugggagcuggugaggucuca

SEQ ID NO: 663479 - RNA, 22 nt, Human
agggcaauggacuacaaaaggu

SEQ ID NO: 663480 - RNA, 22 nt, Human
uagugggugauuugaugaggaa

SEQ ID NO: 663481 - RNA, 22 nt, Human
cauaacauguacauauaaaugc

SEQ ID NO: 663482 - RNA, 20 nt, Human
cuucaggacccauccucccc

SEQ ID NO: 663483 - RNA, 22 nt, Human
ucaggccuccagguuaccauuu

SEQ ID NO: 663484 - RNA, 18 nt, Human
uccagagcuacuguggug

SEQ ID NO: 663485 - RNA, 19 nt, Human
ucugucagugcaucaccuc

SEQ ID NO: 663486 - RNA, 22 nt, Human
gcccuccauggugauccaggcc

SEQ ID NO: 663487 - RNA, 22 nt, Human
uuucugauaauuuugugaaauc

SEQ ID NO: 663488 - RNA, 22 nt, Human
uccccacagcagaagaucugag

SEQ ID NO: 663489 - RNA, 22 nt, Human
acacaguaugacauuggcagag

SEQ ID NO: 663490 - RNA, 20 nt, Human
cucauguggcaccaggcacu

SEQ ID NO: 663491 - RNA, 22 nt, Human
ugcuggaagaauuccaugcugg

SEQ ID NO: 663492 - RNA, 22 nt, Human
cugggggugagcagcagcgacg

SEQ ID NO: 663493 - RNA, 22 nt, Human
uaggguccauauggaugaaugg

SEQ ID NO: 663494 - RNA, 22 nt, Human
gaaccacaaugugaagaaggag

SEQ ID NO: 663495 - RNA, 22 nt, Human
gugucugugucauuacuaauag

SEQ ID NO: 663496 - RNA, 22 nt, Human
ggacaagccucagacaaaacuc

SEQ ID NO: 663497 - RNA, 22 nt, Human
aggccaggggugagcacuucug

SEQ ID NO: 663498 - RNA, 22 nt, Human
cacauuuaggagguggggaagc

SEQ ID NO: 663499 - RNA, 22 nt, Human
ggcaugggagugagcaaccuua

SEQ ID NO: 663500 - RNA, 22 nt, Human
caaagucagcugccagucccaa

SEQ ID NO: 663501 - RNA, 22 nt, Human
cuggcuucccugucuuauggaa

SEQ ID NO: 663502 - RNA, 22 nt, Human
agggccuggcgcguggccgccg

SEQ ID NO: 663503 - RNA, 22 nt, Human
cacagaggaugcccaagcgauc

SEQ ID NO: 663504 - RNA, 22 nt, Human
ucuccugucuucucagcacccc

SEQ ID NO: 663505 - RNA, 22 nt, Human
gaaacguuggcauaaguuuaug

SEQ ID NO: 663506 - RNA, 22 nt, Human
caggcaaggagcuggcucaagu

SEQ ID NO: 663507 - RNA, 22 nt, Human
cuaaagcaacugagacacauag

SEQ ID NO: 663508 - RNA, 22 nt, Human
acaaaauuguguuaaacuuuau

SEQ ID NO: 663509 - RNA, 22 nt, Human
cccagugucaccaacaggacac

SEQ ID NO: 663510 - RNA, 22 nt, Human
aacccaggucuuuggcuuccag

SEQ ID NO: 663511 - RNA, 19 nt, Human
caggaaacaccuacugcua

SEQ ID NO: 663512 - RNA, 22 nt, Human
agugauggugagugagaagcuc

SEQ ID NO: 663513 - RNA, 16 nt, Human
acuuccaggggagccc

SEQ ID NO: 663514 - RNA, 22 nt, Human
uaggaauugcccgugggguccu

SEQ ID NO: 663515 - RNA, 22 nt, Human
gcuggccucuggagaagggcuu

SEQ ID NO: 663516 - RNA, 22 nt, Human
guggccaggagaccuugggcau

SEQ ID NO: 663517 - RNA, 22 nt, Human
uaugaguguguguagaagguac

SEQ ID NO: 663518 - RNA, 22 nt, Human
uacugugguaacauuuuaaauu

SEQ ID NO: 663519 - RNA, 22 nt, Human
uuagccagugaaauggagaaau

SEQ ID NO: 663520 - RNA, 22 nt, Human
uuagggaaacaaacauuuucuu

SEQ ID NO: 663521 - RNA, 22 nt, Human
cuuuggaggucauagccaagag

SEQ ID NO: 663522 - RNA, 22 nt, Human
uucugcauggagaaacugaguc

SEQ ID NO: 663523 - RNA, 22 nt, Human
auagaagcuuuuaaauaacagg

SEQ ID NO: 663524 - RNA, 22 nt, Human
cuucucagcaugguuacuguga

SEQ ID NO: 663525 - RNA, 22 nt, Human
gcaaugauugcauuagaagaug

SEQ ID NO: 663526 - RNA, 22 nt, Human
uaacacuugggggcauccuuag

SEQ ID NO: 663527 - RNA, 22 nt, Human
uucugaaagucuuuuuaaguua

SEQ ID NO: 663528 - RNA, 22 nt, Human
aaaugcacagaggccagagagg

SEQ ID NO: 663529 - RNA, 22 nt, Human
guuuuauaugucucugcugaca

SEQ ID NO: 663530 - RNA, 22 nt, Human
acagggaccuuggaagcuggaa

SEQ ID NO: 663531 - RNA, 22 nt, Human
ccaggaggcagagguuacagug

SEQ ID NO: 663532 - RNA, 22 nt, Human
ucugccugagcagagggaggcc

SEQ ID NO: 663533 - RNA, 22 nt, Human
acacuggagcuucuagcccacg

SEQ ID NO: 663534 - RNA, 22 nt, Human
uccuucaaucacccagugggga

SEQ ID NO: 663535 - RNA, 22 nt, Human
uuucuagacucaaagaggauau

SEQ ID NO: 663536 - RNA, 22 nt, Human
cuuuagguuuugccugagaucu

SEQ ID NO: 663537 - RNA, 22 nt, Human
auaagguuaacaucaucaguga

SEQ ID NO: 663538 - RNA, 22 nt, Human
ugcaagaggaauucuagaagca

SEQ ID NO: 663539 - RNA, 17 nt, Human
acacugacaugccacac

SEQ ID NO: 663540 - RNA, 22 nt, Human
agcauaaaggcacuagaaagag

SEQ ID NO: 663541 - RNA, 23 nt, Human
agcugaggcagaggggcauucuc

SEQ ID NO: 663542 - RNA, 22 nt, Human
aagggcaggcagagaucauaua

SEQ ID NO: 663543 - RNA, 22 nt, Human
aaguaaauaucuguuuauagca

SEQ ID NO: 663544 - RNA, 22 nt, Human
uuuauaguagcaugauuuauag

SEQ ID NO: 663545 - RNA, 22 nt, Human
ggugggcagcucuuggcaggca

SEQ ID NO: 663546 - RNA, 23 nt, Human
gcugucaguuguuuuugucucua

SEQ ID NO: 663547 - RNA, 22 nt, Human
cuagggacugggaccuuaguua

SEQ ID NO: 663548 - RNA, 22 nt, Human
aauuccagucucugcucuauuu

SEQ ID NO: 663549 - RNA, 22 nt, Human
cucccuggggcuccuccuauuu

SEQ ID NO: 663550 - RNA, 21 nt, Human
guccacagggguuuguccugg

SEQ ID NO: 663551 - RNA, 22 nt, Human
caagagcucaccggagagcauu

SEQ ID NO: 663552 - RNA, 22 nt, Human
ccugccucaggacucugcauau

SEQ ID NO: 663553 - RNA, 22 nt, Human
uccaggacagcggcaggcagau

SEQ ID NO: 663554 - RNA, 22 nt, Human
cccaugcacccucuaagaagga

SEQ ID NO: 663555 - RNA, 22 nt, Human
guucuaauuuggggcuccuuag

SEQ ID NO: 663556 - RNA, 22 nt, Human
acaggaaguuuggaaagccuca

SEQ ID NO: 663557 - RNA, 22 nt, Human
agcuggggguagugagaaauaa

SEQ ID NO: 663558 - RNA, 22 nt, Human
uuuguucauaauggcaaagaga

SEQ ID NO: 663559 - RNA, 22 nt, Human
gugcugaagugaaauucaucaa

SEQ ID NO: 663560 - RNA, 22 nt, Human
uguuucaugaagucuggauauc

SEQ ID NO: 663561 - RNA, 22 nt, Human
cagcuucaacugcacagucaac

SEQ ID NO: 663562 - RNA, 22 nt, Human
aggcucugagucuggugucugc

SEQ ID NO: 663563 - RNA, 22 nt, Human
augugaagcuugugcuaacaua

SEQ ID NO: 663564 - RNA, 22 nt, Human
ugggagaugguucugagacuuu

SEQ ID NO: 663565 - RNA, 22 nt, Human
gcuuuggaaggggcugguggag

SEQ ID NO: 663566 - RNA, 22 nt, Human
ugaaagcauuagucuaagguag

SEQ ID NO: 663567 - RNA, 22 nt, Human
auuguagcccaugcauaaaccg

SEQ ID NO: 663568 - RNA, 23 nt, Human
agaucacaugcugauggaaaaug

SEQ ID NO: 663569 - RNA, 22 nt, Human
ucccucucuggcuggggugcgg

SEQ ID NO: 663570 - RNA, 22 nt, Human
uguccccugcccagggauggga

SEQ ID NO: 663571 - RNA, 18 nt, Human
gagguggcugggccaucu

SEQ ID NO: 663572 - RNA, 22 nt, Human
uccauccacauuaacagauacg

SEQ ID NO: 663573 - RNA, 22 nt, Human
ugcagcauuugcugaagcagga

SEQ ID NO: 663574 - RNA, 22 nt, Human
gagguccucuguguccgcgggc

SEQ ID NO: 663575 - RNA, 22 nt, Human
uaaagguagcaugaaacugcaa

SEQ ID NO: 663576 - RNA, 22 nt, Human
gcagaaacuuggagaagccagg

SEQ ID NO: 663577 - RNA, 22 nt, Human
uguccaccgguccugugauggg

SEQ ID NO: 663578 - RNA, 18 nt, Human
uacaguauuuucucgccu

SEQ ID NO: 663579 - RNA, 22 nt, Human
acagauuuuugguaaauaauuu

SEQ ID NO: 663580 - RNA, 22 nt, Human
uggccugccugggagcagcagg

SEQ ID NO: 663581 - RNA, 22 nt, Human
ugccaggccaauucuauuugac

SEQ ID NO: 663582 - RNA, 22 nt, Human
ucagagagugcaaaauauagcu

SEQ ID NO: 663583 - RNA, 22 nt, Human
aacccauguuggaagcuuauca

SEQ ID NO: 663584 - RNA, 22 nt, Human
ucauuuccucaaauucaagguu

SEQ ID NO: 663585 - RNA, 22 nt, Human
uuuaacaugugaauuuuggaag

SEQ ID NO: 663586 - RNA, 22 nt, Human
gcuggagcgugauccuugaucu

SEQ ID NO: 663587 - RNA, 22 nt, Human
ccugaagaaaauuccacgagaa

SEQ ID NO: 663588 - RNA, 22 nt, Human
cagcagguccugggcguggccu

SEQ ID NO: 663589 - RNA, 18 nt, Human
guguaaacagccauugag

SEQ ID NO: 663590 - RNA, 22 nt, Human
uccugggaaguggcuggcugag

SEQ ID NO: 663591 - RNA, 22 nt, Human
gaagacacucugcagaguuauc

SEQ ID NO: 663592 - RNA, 22 nt, Human
aguccuggguucugguguuuug

SEQ ID NO: 663593 - RNA, 17 nt, Human
cagugaggccuuuccuc

SEQ ID NO: 663594 - RNA, 19 nt, Human
cccuggaggaguguuggcu

SEQ ID NO: 663595 - RNA, 22 nt, Human
acagugcuggcuacaacccugg

SEQ ID NO: 663596 - RNA, 22 nt, Human
uccagccaagccuugguagcug

SEQ ID NO: 663597 - RNA, 21 nt, Human
uccaaaaaggagcguccuucu

SEQ ID NO: 663598 - RNA, 22 nt, Human
gugaagagcuguugcagagauu

SEQ ID NO: 663599 - RNA, 22 nt, Human
cccagcucugcagaccugcccu

SEQ ID NO: 663600 - RNA, 22 nt, Human
cgaggcaggcaggcggaggaua

SEQ ID NO: 663601 - RNA, 22 nt, Human
augcagagcuuccaguggccug

SEQ ID NO: 663602 - RNA, 22 nt, Human
gcaaaaguacagccggauuucu

SEQ ID NO: 663603 - RNA, 22 nt, Human
ucaaagucauggcaggcucaga

SEQ ID NO: 663604 - RNA, 22 nt, Human
ccaguccauauuuauacugccg

SEQ ID NO: 663605 - RNA, 22 nt, Human
cugccugccuggagacagaugg

SEQ ID NO: 663606 - RNA, 22 nt, Human
ggccaggaagggaagaucagca

SEQ ID NO: 663607 - RNA, 22 nt, Human
ggcaaggccuugcccagcauuc

SEQ ID NO: 663608 - RNA, 22 nt, Human
ucauuuauauuguauucuguag

SEQ ID NO: 663609 - RNA, 22 nt, Human
uggcagcacauugacccgggcu

SEQ ID NO: 663610 - RNA, 22 nt, Human
uccuccagggggaucuucagcc

SEQ ID NO: 663611 - RNA, 22 nt, Human
guucugcugugucucagcaggu

SEQ ID NO: 663612 - RNA, 16 nt, Human
uagagagggcagggag

SEQ ID NO: 663613 - RNA, 22 nt, Human
agccuggauccauguggcuacc

SEQ ID NO: 663614 - RNA, 22 nt, Human
agcuguaauauaagcaaugaaa

SEQ ID NO: 663615 - RNA, 22 nt, Human
uaccuggaauuuauauagcuau

SEQ ID NO: 663616 - RNA, 22 nt, Human
caucacaugccuaucaugagcu

SEQ ID NO: 663617 - RNA, 23 nt, Human
uuuaugcugugauucacccagcc

SEQ ID NO: 663618 - RNA, 19 nt, Human
acuagauacaacaugcaga

SEQ ID NO: 663619 - RNA, 22 nt, Human
aaacuguaaauacuaguaagug

SEQ ID NO: 663620 - RNA, 20 nt, Human
agccaggccucaaguuaagu

SEQ ID NO: 663621 - RNA, 22 nt, Human
aaguccauucuuccagccagcu

SEQ ID NO: 663622 - RNA, 22 nt, Human
gcagugcaggaacauagcuucu

SEQ ID NO: 663623 - RNA, 22 nt, Human
cacagcaaaggcuucggcugau

SEQ ID NO: 663624 - RNA, 20 nt, Human
aguuuauuccaggagaacug

SEQ ID NO: 663625 - RNA, 22 nt, Human
cugcagagcuuucugaaugaag

SEQ ID NO: 663626 - RNA, 21 nt, Human
aaguggagaagaaaagcugga

SEQ ID NO: 663627 - RNA, 22 nt, Human
ugcuguguuccucaguuucaug

SEQ ID NO: 663628 - RNA, 20 nt, Human
caucauuuuaaaaucucucc

SEQ ID NO: 663629 - RNA, 22 nt, Human
ggcucagguuuccuucccagcu

SEQ ID NO: 663630 - RNA, 22 nt, Human
ggaugcaggacggcauggaugu

SEQ ID NO: 663631 - RNA, 22 nt, Human
uggagcuggaauuucugggccu

SEQ ID NO: 663632 - RNA, 23 nt, Human
ggucccaguggagaggccucacc

SEQ ID NO: 663633 - RNA, 22 nt, Human
ugggcagaggcucugaagucca

SEQ ID NO: 663634 - RNA, 22 nt, Human
uguuugguuccagagggccucu

SEQ ID NO: 663635 - RNA, 22 nt, Human
ugcaucaaccuaauaucagcuc

SEQ ID NO: 663636 - RNA, 22 nt, Human
cuuauggaagaaaccucagaga

SEQ ID NO: 663637 - RNA, 22 nt, Human
gacaagacugguuuauuuaagg

SEQ ID NO: 663638 - RNA, 22 nt, Human
uucagcuugaaucuggcuuuga

SEQ ID NO: 663639 - RNA, 22 nt, Human
uagagucuaguguauacaaagu

SEQ ID NO: 663640 - RNA, 20 nt, Human
uccuggagucugguuuggcu

SEQ ID NO: 663641 - RNA, 22 nt, Human
gcuguguuuuauguuagguuaa

SEQ ID NO: 663642 - RNA, 22 nt, Human
uuccagagucugguuccauggu

SEQ ID NO: 663643 - RNA, 22 nt, Human
uaaacagcuacugugucaaagg

SEQ ID NO: 663644 - RNA, 22 nt, Human
auuucacucuuaauugcuuccu

SEQ ID NO: 663645 - RNA, 22 nt, Human
cccaggucuccugcuucccagg

SEQ ID NO: 663646 - RNA, 20 nt, Human
aaugaucagcauagcaagga

SEQ ID NO: 663647 - RNA, 22 nt, Human
uggagacugacugccuguauuu

SEQ ID NO: 663648 - RNA, 22 nt, Human
gagguggcuggcucagagccag

SEQ ID NO: 663649 - RNA, 22 nt, Human
caacauucuuaucacuauaagc

SEQ ID NO: 663650 - RNA, 22 nt, Human
agugucuuucucucuccaagug

SEQ ID NO: 663651 - RNA, 22 nt, Human
ucagcugcucuguugagcugaa

SEQ ID NO: 663652 - RNA, 22 nt, Human
cccagcaggaggagguugcagu

SEQ ID NO: 663653 - RNA, 20 nt, Human
ucugccacugcacucugccc

SEQ ID NO: 663654 - RNA, 22 nt, Human
uugagcuugaggaguuauuuga

SEQ ID NO: 663655 - RNA, 22 nt, Human
uugacaaaggaccuugcuauuu

SEQ ID NO: 663656 - RNA, 22 nt, Human
ucugcgugaugagggugcagca

SEQ ID NO: 663657 - RNA, 22 nt, Human
uugcuuuugugugcucucugga

SEQ ID NO: 663658 - RNA, 22 nt, Human
aagauuuaccacuuuauucaag

SEQ ID NO: 663659 - RNA, 22 nt, Human
cuuguggccaauguuuguuaua

SEQ ID NO: 663660 - RNA, 22 nt, Human
auggaguggggacugcagugga

SEQ ID NO: 663661 - RNA, 22 nt, Human
auuugcuaguggaauuuuccug

SEQ ID NO: 663662 - RNA, 22 nt, Human
acauagcacgucucaauuugga

SEQ ID NO: 663663 - RNA, 22 nt, Human
guguggcuaggauggcuuugcu

SEQ ID NO: 663664 - RNA, 22 nt, Human
uuuagaaguucacacauuuaaa

SEQ ID NO: 663665 - RNA, 20 nt, Human
uagauccuggggauuuauug

SEQ ID NO: 663666 - RNA, 22 nt, Human
cuguugucuucauugucauauc

SEQ ID NO: 663667 - RNA, 22 nt, Human
ugcaauaauguaugucacuccc

SEQ ID NO: 663668 - RNA, 22 nt, Human
ugcuggaagagauuggagccuc

SEQ ID NO: 663669 - RNA, 22 nt, Human
gccaggcuggugucacaacucu

SEQ ID NO: 663670 - RNA, 22 nt, Human
cacgaggccaucuccuucugga

SEQ ID NO: 663671 - RNA, 20 nt, Human
uccaggccuuguucucagau

SEQ ID NO: 663672 - RNA, 22 nt, Human
ggagaugcuauguaguuugguu

SEQ ID NO: 663673 - RNA, 22 nt, Human
uagguagauacauguguuggcu

SEQ ID NO: 663674 - RNA, 22 nt, Human
gcaauacagaagaguggcaagg

SEQ ID NO: 663675 - RNA, 22 nt, Human
agcaccugcuuaaugugcagug

SEQ ID NO: 663676 - RNA, 22 nt, Human
acauaucugugagguuuuguug

SEQ ID NO: 663677 - RNA, 22 nt, Human
agaucuggaacugagguuuauu

SEQ ID NO: 663678 - RNA, 22 nt, Human
agggcugacaguggcguggcgu

SEQ ID NO: 663679 - RNA, 23 nt, Human
cugcuguuuucuguaccugaagc

SEQ ID NO: 663680 - RNA, 22 nt, Human
uguuaaacagauauugcccaca

SEQ ID NO: 663681 - RNA, 22 nt, Human
cgagcagaagccugguggucug

SEQ ID NO: 663682 - RNA, 20 nt, Human
aagauucugauuuguagcgu

SEQ ID NO: 663683 - RNA, 22 nt, Human
acugcacacauguuuaagugga

SEQ ID NO: 663684 - RNA, 17 nt, Human
gaacagcagaggggaca

SEQ ID NO: 663685 - RNA, 22 nt, Human
agaucauuuggcagaagcaacg

SEQ ID NO: 663686 - RNA, 22 nt, Human
ugaggccugaagccugaaguga

SEQ ID NO: 663687 - RNA, 22 nt, Human
ugcugugcuccauugucuucac

SEQ ID NO: 663688 - RNA, 22 nt, Human
acagauggagcuacuagguaaa

SEQ ID NO: 663689 - RNA, 22 nt, Human
cacauuuaaaaaauccacgauc

SEQ ID NO: 663690 - RNA, 22 nt, Human
ugggucuccugugccugggagg

SEQ ID NO: 663691 - RNA, 22 nt, Human
agaggccaguggcugugcuguc

SEQ ID NO: 663692 - RNA, 22 nt, Human
agcuacaguugcccucagcagg

SEQ ID NO: 663693 - RNA, 22 nt, Human
gagucuccaauccaugccuguc

SEQ ID NO: 663694 - RNA, 22 nt, Human
cagcagcucaggcuccuuccca

SEQ ID NO: 663695 - RNA, 22 nt, Human
ugugcaaaguguacaaauuaau

SEQ ID NO: 663696 - RNA, 22 nt, Human
auccacucggagggaauguuua

SEQ ID NO: 663697 - RNA, 22 nt, Human
agccccaguaagggagggccug

SEQ ID NO: 663698 - RNA, 22 nt, Human
aagaaaugcagaaaugugcugg

SEQ ID NO: 663699 - RNA, 22 nt, Human
uggcucaucuaucagaaagucc

SEQ ID NO: 663700 - RNA, 18 nt, Human
auguuucucuuggcucug

SEQ ID NO: 663701 - RNA, 22 nt, Human
cuuccuccgaagaaguugcugg

SEQ ID NO: 663702 - RNA, 22 nt, Human
auacaagugauauaauuguuuc

SEQ ID NO: 663703 - RNA, 22 nt, Human
aguauuuccuggcuuaucugcu

SEQ ID NO: 663704 - RNA, 22 nt, Human
uccucccuaaauccuagacugu

SEQ ID NO: 663705 - RNA, 22 nt, Human
ggucuggaguagaugagucaug

SEQ ID NO: 663706 - RNA, 16 nt, Human
aucuuccaaaguuauu

SEQ ID NO: 663707 - RNA, 22 nt, Human
uagcacaugccgggagugaucu

SEQ ID NO: 663708 - RNA, 23 nt, Human
gcucagaugcccuaggagguggc

SEQ ID NO: 663709 - RNA, 22 nt, Human
gacaggcuuccuaagugccaga

SEQ ID NO: 663710 - RNA, 22 nt, Human
ccuggggaaaagcaggcauuua

SEQ ID NO: 663711 - RNA, 21 nt, Human
ucugaacaacauacgaaucuu

SEQ ID NO: 663712 - RNA, 22 nt, Human
agcucuuaucucuaagcacagc

SEQ ID NO: 663713 - RNA, 22 nt, Human
ucuuccagcaaugugaaaucac

SEQ ID NO: 663714 - RNA, 22 nt, Human
gcccuguucuggacaggcacaa

SEQ ID NO: 663715 - RNA, 22 nt, Human
uuggcucugauggggaucagga

SEQ ID NO: 663716 - RNA, 22 nt, Human
ggacgcagcgagggaagcagcc

SEQ ID NO: 663717 - RNA, 22 nt, Human
ggcuggcugauaaaggguugag

SEQ ID NO: 663718 - RNA, 22 nt, Human
agaaucaggaagacagccuggc

SEQ ID NO: 663719 - RNA, 22 nt, Human
guucuucagucacaucacagaa

SEQ ID NO: 663720 - RNA, 22 nt, Human
acacaucaugccaaguuucacc

SEQ ID NO: 663721 - RNA, 22 nt, Human
augaauaaacaggugccucuuc

SEQ ID NO: 663722 - RNA, 20 nt, Human
uccagcccagguccugccug

SEQ ID NO: 663723 - RNA, 22 nt, Human
agcugggcaccccgcugcgucu

SEQ ID NO: 663724 - RNA, 22 nt, Human
ugucugucugcaagccagaaag

SEQ ID NO: 663725 - RNA, 22 nt, Human
agucaaauaagacugucauaag

SEQ ID NO: 663726 - RNA, 22 nt, Human
cuugagaaucuucucugaagag

SEQ ID NO: 663727 - RNA, 22 nt, Human
uauauugggacuucaggacuuu

SEQ ID NO: 663728 - RNA, 22 nt, Human
cugacccuuaaugagcaaguaa

SEQ ID NO: 663729 - RNA, 22 nt, Human
gaaagguuuaaguaggauuugu

SEQ ID NO: 663730 - RNA, 21 nt, Human
agcagccuugugugccaggca

SEQ ID NO: 663731 - RNA, 22 nt, Human
uggcauguauuuguggugaauu

SEQ ID NO: 663732 - RNA, 22 nt, Human
cagauuccggucaucucuccuu

SEQ ID NO: 663733 - RNA, 21 nt, Human
ucagcccaggugucuuugccc

SEQ ID NO: 663734 - RNA, 22 nt, Human
cuggcucugugggaccuggccu

SEQ ID NO: 663735 - RNA, 22 nt, Human
uccaggagcauccaggugaagc

SEQ ID NO: 663736 - RNA, 20 nt, Human
uuuccuaagugguuugcuga

SEQ ID NO: 663737 - RNA, 22 nt, Human
gcugcuuuagaauugaaacaga

SEQ ID NO: 663738 - RNA, 22 nt, Human
ugcagcagacugaguaugagaa

SEQ ID NO: 663739 - RNA, 22 nt, Human
cugagggaacuugggcaagucu

SEQ ID NO: 663740 - RNA, 22 nt, Human
augcaacaggguugggaggcgg

SEQ ID NO: 663741 - RNA, 22 nt, Human
acauaacaugucaaucacccga

SEQ ID NO: 663742 - RNA, 22 nt, Human
ggucacaugguugagcuugauc

SEQ ID NO: 663743 - RNA, 22 nt, Human
cuucucagcauuuugucagucu

SEQ ID NO: 663744 - RNA, 22 nt, Human
augaacaaucuguugacuucug

SEQ ID NO: 663745 - RNA, 22 nt, Human
cagagcagugaggaguugugua

SEQ ID NO: 663746 - RNA, 22 nt, Human
uuucuaguccucaugcaucauu

SEQ ID NO: 663747 - RNA, 22 nt, Human
uaggucuccuggccuagagauu

SEQ ID NO: 663748 - RNA, 22 nt, Human
aguguuuagcaugaaguucauu

SEQ ID NO: 663749 - RNA, 22 nt, Human
ggcggguggcgaggcuucucgg

SEQ ID NO: 663750 - RNA, 19 nt, Human
ugggugugaccaucucugc

SEQ ID NO: 663751 - RNA, 22 nt, Human
uuuucaucucugcuuuguaccu

SEQ ID NO: 663752 - RNA, 22 nt, Human
gcagagccaggcuggggcaggu

SEQ ID NO: 663753 - RNA, 19 nt, Human
uccaggggcuccaccuccu

SEQ ID NO: 663754 - RNA, 22 nt, Human
ccugugggaggggccuggcgcg

SEQ ID NO: 663755 - RNA, 23 nt, Human
ucacaguaucucuggagccauag

SEQ ID NO: 663756 - RNA, 22 nt, Human
gauggcuuugccugcugugagg

SEQ ID NO: 663757 - RNA, 22 nt, Human
agucuucuugaucuuuucagug

SEQ ID NO: 663758 - RNA, 22 nt, Human
acuucauauuguuuccacuaga

SEQ ID NO: 663759 - RNA, 22 nt, Human
uaugaacauguucauugacuua

SEQ ID NO: 663760 - RNA, 22 nt, Human
aaugucuuuauuucagguuuac

SEQ ID NO: 663761 - RNA, 22 nt, Human
auggagggugguaagacagaga

SEQ ID NO: 663762 - RNA, 19 nt, Human
acucaggcuuccucugagg

SEQ ID NO: 663763 - RNA, 22 nt, Human
ugccucugguuaucugguaccu

SEQ ID NO: 663764 - RNA, 22 nt, Human
auccuuuaucuuuccuaggaau

SEQ ID NO: 663765 - RNA, 22 nt, Human
cuuugaaaaaugguuuccuaga

SEQ ID NO: 663766 - RNA, 22 nt, Human
auguguauguguauacacacag

SEQ ID NO: 663767 - RNA, 22 nt, Human
aagccaaucgugugaacuuagu

SEQ ID NO: 663768 - RNA, 22 nt, Human
uuaacaaagcucuguuccuuuu

SEQ ID NO: 663769 - RNA, 22 nt, Human
ggagugggcagcacugcccugu

SEQ ID NO: 663770 - RNA, 22 nt, Human
accacugcccauggugaaaacu

SEQ ID NO: 663771 - RNA, 22 nt, Human
cugguccuccuugccuucagau

SEQ ID NO: 663772 - RNA, 22 nt, Human
uuucacagagaaauauaacagg

SEQ ID NO: 663773 - RNA, 22 nt, Human
ugcaggcugaggcuggcucaac

SEQ ID NO: 663774 - RNA, 22 nt, Human
augugucaauuuucaaaugcuu

SEQ ID NO: 663775 - RNA, 22 nt, Human
ucugcugugauucuacuagugu

SEQ ID NO: 663776 - RNA, 22 nt, Human
aagaaagcauuagacaggcauu

SEQ ID NO: 663777 - RNA, 22 nt, Human
uggcagucuuguaggcaucucc

SEQ ID NO: 663778 - RNA, 22 nt, Human
uguguacacaaugauugcagag

SEQ ID NO: 663779 - RNA, 22 nt, Human
ucacuguaugucuuuuuuugau

SEQ ID NO: 663780 - RNA, 22 nt, Human
uuacacaggcacuuaaaaugca

SEQ ID NO: 663781 - RNA, 22 nt, Human
agcuugggugugccugcgagcu

SEQ ID NO: 663782 - RNA, 22 nt, Human
cuggguaaaggcugcuuuucua

SEQ ID NO: 663783 - RNA, 22 nt, Human
agccugagagccaagcugugca

SEQ ID NO: 663784 - RNA, 22 nt, Human
gccagcuggagacuggcagggg

SEQ ID NO: 663785 - RNA, 22 nt, Human
ugagggaauccucacaucaauc

SEQ ID NO: 663786 - RNA, 22 nt, Human
ugccuguccugaggaugagggu

SEQ ID NO: 663787 - RNA, 22 nt, Human
ugccacccagccaggaguggga

SEQ ID NO: 663788 - RNA, 21 nt, Human
aauuacagauggaauuacaga

SEQ ID NO: 663789 - RNA, 22 nt, Human
cuuaacuugaugucucucugcu

SEQ ID NO: 663790 - RNA, 22 nt, Human
caggagguuguaagagcaggcc

SEQ ID NO: 663791 - RNA, 19 nt, Human
ggcugcugguuacagaggc

SEQ ID NO: 663792 - RNA, 22 nt, Human
ucacuaaguuacauuuaguauu

SEQ ID NO: 663793 - RNA, 22 nt, Human
agaauaguggcaaugacugcac

SEQ ID NO: 663794 - RNA, 22 nt, Human
auuucagagugagagugcucaa

SEQ ID NO: 663795 - RNA, 22 nt, Human
ucauaaaucauacuccauuugc

SEQ ID NO: 663796 - RNA, 22 nt, Human
ccccaaaguguuggauaauuga

SEQ ID NO: 663797 - RNA, 22 nt, Human
uugcagcuucuaccacuguuuc

SEQ ID NO: 663798 - RNA, 22 nt, Human
cugagggcagugaugaagguga

SEQ ID NO: 663799 - RNA, 22 nt, Human
cugccuguuuucugauagauuu

SEQ ID NO: 663800 - RNA, 17 nt, Human
uuuaaacuacuacaagg

SEQ ID NO: 663801 - RNA, 22 nt, Human
aggugcaugaugcagagugcag

SEQ ID NO: 663802 - RNA, 21 nt, Human
agggccugugcucuccagguc

SEQ ID NO: 663803 - RNA, 22 nt, Human
caggaaccaggagagucccuga

SEQ ID NO: 663804 - RNA, 19 nt, Human
gucucugcuccagggucuc

SEQ ID NO: 663805 - RNA, 22 nt, Human
ggucucugcucagaugccacuu

SEQ ID NO: 663806 - RNA, 20 nt, Human
cgcuccagucgcuggugugu

SEQ ID NO: 663807 - RNA, 22 nt, Human
aagugcaauuugaaauucugca

SEQ ID NO: 663808 - RNA, 20 nt, Human
gugaccagaagacagugggu

SEQ ID NO: 663809 - RNA, 22 nt, Human
gcugcccuaauaucacauguua

SEQ ID NO: 663810 - RNA, 22 nt, Human
gucacugccucuuaacuuuuuc

SEQ ID NO: 663811 - RNA, 22 nt, Human
ugcuuucacauguaugcacaaa

SEQ ID NO: 663812 - RNA, 22 nt, Human
gauacuuucucauuuacccaag

SEQ ID NO: 663813 - RNA, 22 nt, Human
uuggcuuccugcacuugaguuu

SEQ ID NO: 663814 - RNA, 22 nt, Human
acucaggagggaucagcuauca

SEQ ID NO: 663815 - RNA, 22 nt, Human
uggagaagucaaagugaacagg

SEQ ID NO: 663816 - RNA, 22 nt, Human
uguguauauguaaauauaguug

SEQ ID NO: 663817 - RNA, 22 nt, Human
uccaccccugggaaugucaaua

SEQ ID NO: 663818 - RNA, 22 nt, Human
cagggccucauggccggggugc

SEQ ID NO: 663819 - RNA, 22 nt, Human
ugcaauuuaugugcaagugguu

SEQ ID NO: 663820 - RNA, 22 nt, Human
caagaacaguuugccaaauugg

SEQ ID NO: 663821 - RNA, 23 nt, Human
uaugagaauuaagugcgagugcc

SEQ ID NO: 663822 - RNA, 20 nt, Human
ucacaugagcuggggcaggc

SEQ ID NO: 663823 - RNA, 22 nt, Human
uucugaaaacacacuuugcagc

SEQ ID NO: 663824 - RNA, 22 nt, Human
ugugaaagagucuuauaguuuc

SEQ ID NO: 663825 - RNA, 22 nt, Human
acucugccuuaguccuggggcu

SEQ ID NO: 663826 - RNA, 22 nt, Human
auuaaaacuaaaaugccugauu

SEQ ID NO: 663827 - RNA, 22 nt, Human
acauuuaacccucagguuucug

SEQ ID NO: 663828 - RNA, 22 nt, Human
uucugggcuaccuucccggcag

SEQ ID NO: 663829 - RNA, 22 nt, Human
auuuauuaugggauuuggcaca

SEQ ID NO: 663830 - RNA, 22 nt, Human
ucuuuaagaguaauuauuuugg

SEQ ID NO: 663831 - RNA, 22 nt, Human
ucuacagacuccuauguaacac

SEQ ID NO: 663832 - RNA, 22 nt, Human
ggaauugucuaguacucacggc

SEQ ID NO: 663833 - RNA, 19 nt, Human
cacagcgaagacaaggugg

SEQ ID NO: 663834 - RNA, 22 nt, Human
aaaagagagcugaggagcucca

SEQ ID NO: 663835 - RNA, 22 nt, Human
ccaguccucagauggucugugc

SEQ ID NO: 663836 - RNA, 18 nt, Human
uggcaggaaaugcacuuu

SEQ ID NO: 663837 - RNA, 22 nt, Human
ccacuuccugcagguaaggagc

SEQ ID NO: 663838 - RNA, 22 nt, Human
cugccaggcacgugcagcauca

SEQ ID NO: 663839 - RNA, 22 nt, Human
gccaccaguagcuaacaacagu

SEQ ID NO: 663840 - RNA, 22 nt, Human
cagcagccuacaaugcacagaa

SEQ ID NO: 663841 - RNA, 22 nt, Human
aagcugcagcacagagaggugg

SEQ ID NO: 663842 - RNA, 22 nt, Human
cuauuugggguagaagauggau

SEQ ID NO: 663843 - RNA, 22 nt, Human
ggucacaugcggggcuguagcc

SEQ ID NO: 663844 - RNA, 22 nt, Human
caggccucaccagcggagcugc

SEQ ID NO: 663845 - RNA, 19 nt, Human
accucugcagagauguuua

SEQ ID NO: 663846 - RNA, 22 nt, Human
cacugaggcuuccuuaggcaau

SEQ ID NO: 663847 - RNA, 22 nt, Human
uaaaggaaucaguuuuagagau

SEQ ID NO: 663848 - RNA, 16 nt, Human
cgccucccucccucgc

SEQ ID NO: 663849 - RNA, 22 nt, Human
aguuucuaacauauagcauugg

SEQ ID NO: 663850 - RNA, 22 nt, Human
agggagaagguuuagcugugag

SEQ ID NO: 663851 - RNA, 22 nt, Human
cacugaaggaaggacuacugca

SEQ ID NO: 663852 - RNA, 22 nt, Human
guucuacaugacacucaacauu

SEQ ID NO: 663853 - RNA, 22 nt, Human
uauuacagaaucaggcauaacu

SEQ ID NO: 663854 - RNA, 22 nt, Human
cggcugagacggccauagacac

SEQ ID NO: 663855 - RNA, 22 nt, Human
gcaauguuguguuggcauucua

SEQ ID NO: 663856 - RNA, 22 nt, Human
ucccacccccuccaaggaggaa

SEQ ID NO: 663857 - RNA, 22 nt, Human
ucucucccuuuccuuaucaguu

SEQ ID NO: 663858 - RNA, 22 nt, Human
uuucucugcagagccccaagga

SEQ ID NO: 663859 - RNA, 22 nt, Human
ccuuagcaacacuuagcaacug

SEQ ID NO: 663860 - RNA, 22 nt, Human
ugugauauuugaguauugucaa

SEQ ID NO: 663861 - RNA, 22 nt, Human
cagcccaggucucucuuccagu

SEQ ID NO: 663862 - RNA, 22 nt, Human
cucagccagugaucuuuccuuu

SEQ ID NO: 663863 - RNA, 22 nt, Human
ucaggcugcuguacugugaaug

SEQ ID NO: 663864 - RNA, 22 nt, Human
caugugggaagaggccagcugg

SEQ ID NO: 663865 - RNA, 22 nt, Human
gagccugccucuagucucuaga

SEQ ID NO: 663866 - RNA, 22 nt, Human
ggugcugccuauagucugaaac

SEQ ID NO: 663867 - RNA, 21 nt, Human
aguaucauaaugaauaguucu

SEQ ID NO: 663868 - RNA, 22 nt, Human
ugaugaaacugagguuccaaga

SEQ ID NO: 663869 - RNA, 22 nt, Human
agacacagcagugccugccuca

SEQ ID NO: 663870 - RNA, 22 nt, Human
cuguuacaagagagagacauga

SEQ ID NO: 663871 - RNA, 20 nt, Human
ucugaggcugagcucuacuu

SEQ ID NO: 663872 - RNA, 22 nt, Human
acaugcuuuucccacaauuaua

SEQ ID NO: 663873 - RNA, 22 nt, Human
gggaaccagccgcuuccgccuc

SEQ ID NO: 663874 - RNA, 23 nt, Human
ugcagacuucgaggagggggaua

SEQ ID NO: 663875 - RNA, 22 nt, Human
uuauucuuuaaacauauauguu

SEQ ID NO: 663876 - RNA, 21 nt, Human
ccagauccugcuuccucaccc

SEQ ID NO: 663877 - RNA, 21 nt, Human
gccuggcagguggaagggcuc

SEQ ID NO: 663878 - RNA, 22 nt, Human
cuugcugugugccaucagggcu

SEQ ID NO: 663879 - RNA, 22 nt, Human
augcacagauccuggcacuuag

SEQ ID NO: 663880 - RNA, 22 nt, Human
agaaguuguagguuugcauauu

SEQ ID NO: 663881 - RNA, 22 nt, Human
auacaacagaaaaugauuauuc

SEQ ID NO: 663882 - RNA, 22 nt, Human
acauuaagaaacgagagagcaa

SEQ ID NO: 663883 - RNA, 19 nt, Human
auucauuuuugccuucuaa

SEQ ID NO: 663884 - RNA, 22 nt, Human
gcaccaggcuuagagccccagg

SEQ ID NO: 663885 - RNA, 22 nt, Human
cugcugcauuacucuucucaag

SEQ ID NO: 663886 - RNA, 20 nt, Human
agcccaucucccacagcuac

SEQ ID NO: 663887 - RNA, 22 nt, Human
cauaauuuuuuuaagucagaac

SEQ ID NO: 663888 - RNA, 22 nt, Human
uggauaaaugugcagaugacau

SEQ ID NO: 663889 - RNA, 22 nt, Human
guugcagacggggugcacugaa

SEQ ID NO: 663890 - RNA, 22 nt, Human
augcuguuaagaaucucuuccu

SEQ ID NO: 663891 - RNA, 22 nt, Human
acaucgauggucagccgaggag

SEQ ID NO: 663892 - RNA, 22 nt, Human
ugcccaggguggagugcagcgg

SEQ ID NO: 663893 - RNA, 22 nt, Human
ucugagagucucugaggcagau

SEQ ID NO: 663894 - RNA, 22 nt, Human
ugaacaacugcaaaaaucucca

SEQ ID NO: 663895 - RNA, 22 nt, Human
acccgcccucagccuuaccgug

SEQ ID NO: 663896 - RNA, 22 nt, Human
uauggcuuucuccauagggcag

SEQ ID NO: 663897 - RNA, 22 nt, Human
ucugcagaaacugugacuaugu

SEQ ID NO: 663898 - RNA, 22 nt, Human
cugccugcuucugagccagagg

SEQ ID NO: 663899 - RNA, 22 nt, Human
ccugccagggccagaggccagc

SEQ ID NO: 663900 - RNA, 22 nt, Human
augaagucugcacaugcaugug

SEQ ID NO: 663901 - RNA, 22 nt, Human
ggcuuaaaaggaaaaugagagu

SEQ ID NO: 663902 - RNA, 22 nt, Human
uaacacaugucugggaugugaa

SEQ ID NO: 663903 - RNA, 22 nt, Human
cuacauuucauccagggagagc

SEQ ID NO: 663904 - RNA, 22 nt, Human
ugagccuggggccugggcagcg

SEQ ID NO: 663905 - RNA, 22 nt, Human
uccuggagggaggcggugcuac

SEQ ID NO: 663906 - RNA, 22 nt, Human
uauuuccagaggaguauagaag

SEQ ID NO: 663907 - RNA, 22 nt, Human
auguguaugauaccuuugcuga

SEQ ID NO: 663908 - RNA, 22 nt, Human
ugcacagggagggggccagcuc

SEQ ID NO: 663909 - RNA, 22 nt, Human
auucaguuguaaucuuuguuag

SEQ ID NO: 663910 - RNA, 22 nt, Human
ggugaaauauuuuugauauguu

SEQ ID NO: 663911 - RNA, 22 nt, Human
ugaaggccagcucuuuaucagc

SEQ ID NO: 663912 - RNA, 22 nt, Human
aaacuguaggagggaaaggaag

SEQ ID NO: 663913 - RNA, 22 nt, Human
uaaagcaaaaaugaacugccau

SEQ ID NO: 663914 - RNA, 22 nt, Human
uugugauacugagcuuggcauu

SEQ ID NO: 663915 - RNA, 22 nt, Human
augugaaaccugugaguagagu

SEQ ID NO: 663916 - RNA, 19 nt, Human
ucaacaguggugcugugga

SEQ ID NO: 663917 - RNA, 22 nt, Human
ccagccagcaagcucccaguuc

SEQ ID NO: 663918 - RNA, 22 nt, Human
acaagggauuguugaguagucu

SEQ ID NO: 663919 - RNA, 22 nt, Human
acccugagggguauagcagaag

SEQ ID NO: 663920 - RNA, 22 nt, Human
aaaaggaucagauuuugagcag

SEQ ID NO: 663921 - RNA, 22 nt, Human
gcuuuaaaccucuacucugucc

SEQ ID NO: 663922 - RNA, 22 nt, Human
cagaaacuguggauucauuaaa

SEQ ID NO: 663923 - RNA, 22 nt, Human
uuaaugcuugucuagaucuucu

SEQ ID NO: 663924 - RNA, 22 nt, Human
acucagagugcaucuccuauuu

SEQ ID NO: 663925 - RNA, 22 nt, Human
ucaaugcaugugacaaagagua

SEQ ID NO: 663926 - RNA, 23 nt, Human
gaauacaaagcagaugguccagc

SEQ ID NO: 663927 - RNA, 22 nt, Human
gugauauuucaagaguggggca

SEQ ID NO: 663928 - RNA, 22 nt, Human
ggaagaggcugaggccaugcug

SEQ ID NO: 663929 - RNA, 22 nt, Human
auucucugaagucuuucagggc

SEQ ID NO: 663930 - RNA, 22 nt, Human
uauguguacaucugguugagca

SEQ ID NO: 663931 - RNA, 22 nt, Human
cagcuccuguuggucuugagga

SEQ ID NO: 663932 - RNA, 22 nt, Human
cauuuauuaguuaguucgaugu

SEQ ID NO: 663933 - RNA, 22 nt, Human
ugauugcugaauuuuaggaacu

SEQ ID NO: 663934 - RNA, 22 nt, Human
accugcccacauauauauguau

SEQ ID NO: 663935 - RNA, 22 nt, Human
caguuucucucaauaagcaucg

SEQ ID NO: 663936 - RNA, 22 nt, Human
uuauuaugccauuaccucccug

SEQ ID NO: 663937 - RNA, 22 nt, Human
ccugcacagccggaccccugcu

SEQ ID NO: 663938 - RNA, 22 nt, Human
uaauuauagcauuggaguggcc

SEQ ID NO: 663939 - RNA, 16 nt, Human
aggagcuggguaggag

SEQ ID NO: 663940 - RNA, 22 nt, Human
gcuuggcccugccgccuggguc

SEQ ID NO: 663941 - RNA, 22 nt, Human
gaggagcuggcugucgggaggc

SEQ ID NO: 663942 - RNA, 22 nt, Human
aagcaaagugaauuuugccaag

SEQ ID NO: 663943 - RNA, 22 nt, Human
acaugcuuucuagguccuucug

SEQ ID NO: 663944 - RNA, 22 nt, Human
uccagcuggcuucggaagugga

SEQ ID NO: 663945 - RNA, 22 nt, Human
auguggcuugucgauauuagca

SEQ ID NO: 663946 - RNA, 22 nt, Human
uuacagauuaaaaugcugaggu

SEQ ID NO: 663947 - RNA, 22 nt, Human
uucuaagugauucuagcuggac

SEQ ID NO: 663948 - RNA, 22 nt, Human
gccccagguugccugucccagg

SEQ ID NO: 663949 - RNA, 22 nt, Human
ggucugggcuugaguccuuuug

SEQ ID NO: 663950 - RNA, 21 nt, Human
uaucacaguagaauaggaucu

SEQ ID NO: 663951 - RNA, 22 nt, Human
acuugcugguggcauuuacagu

SEQ ID NO: 663952 - RNA, 22 nt, Human
auuuucaagggagaggccucug

SEQ ID NO: 663953 - RNA, 22 nt, Human
ugcaccauacccauuccccucu

SEQ ID NO: 663954 - RNA, 22 nt, Human
uaugcaguguacgauguuuagu

SEQ ID NO: 663955 - RNA, 22 nt, Human
ccagugcagucccccugaacug

SEQ ID NO: 663956 - RNA, 20 nt, Human
agucacaggccuggaacaug

SEQ ID NO: 663957 - RNA, 22 nt, Human
gugggcuuuugacagugccugg

SEQ ID NO: 663958 - RNA, 22 nt, Human
uuccauccaugucccguuucug

SEQ ID NO: 663959 - RNA, 22 nt, Human
aggcuucuaggguuggcagcgg

SEQ ID NO: 663960 - RNA, 22 nt, Human
uucagauguggcuuugucaggc

SEQ ID NO: 663961 - RNA, 22 nt, Human
gaacaaagacauggaggaggau

SEQ ID NO: 663962 - RNA, 22 nt, Human
gagaccugcagcuguagucugc

SEQ ID NO: 663963 - RNA, 22 nt, Human
uuucacaacugcuuauuugaga

SEQ ID NO: 663964 - RNA, 22 nt, Human
cacagucaccuuaucaggaugu

SEQ ID NO: 663965 - RNA, 22 nt, Human
gcuuugugugaaguccauggcg

SEQ ID NO: 663966 - RNA, 19 nt, Human
auagucuuuccaauuauac

SEQ ID NO: 663967 - RNA, 22 nt, Human
ucugcuugugucuguccagccu

SEQ ID NO: 663968 - RNA, 22 nt, Human
aaggcugaauucaaggguaggc

SEQ ID NO: 663969 - RNA, 22 nt, Human
uucaaacagaugacucugcucu

SEQ ID NO: 663970 - RNA, 22 nt, Human
uucaggauaugugauaucugaa

SEQ ID NO: 663971 - RNA, 22 nt, Human
uugcucugucagggccucaguc

SEQ ID NO: 663972 - RNA, 22 nt, Human
gaucugagaucuaaaccagagg

SEQ ID NO: 663973 - RNA, 22 nt, Human
cagggacugagauccagacugu

SEQ ID NO: 663974 - RNA, 22 nt, Human
uacuuguguucuacuagagaaa

SEQ ID NO: 663975 - RNA, 19 nt, Human
ugcuuugccuugauuagcu

SEQ ID NO: 663976 - RNA, 22 nt, Human
gagaaggaugaggaaaugguau

SEQ ID NO: 663977 - RNA, 22 nt, Human
cuuacauacugagaaaauaucc

SEQ ID NO: 663978 - RNA, 22 nt, Human
cauuaaaucuuccagaccucac

SEQ ID NO: 663979 - RNA, 22 nt, Human
uguacaguacauguguagugau

SEQ ID NO: 663980 - RNA, 22 nt, Human
gccagagguaucaaagauagua

SEQ ID NO: 663981 - RNA, 22 nt, Human
agaaacuauuaugguaaacaaa

SEQ ID NO: 663982 - RNA, 22 nt, Human
cugguuggugccacaugguggc

SEQ ID NO: 663983 - RNA, 22 nt, Human
ugacaugcuuguuuuccuugaa

SEQ ID NO: 663984 - RNA, 22 nt, Human
ccucucugucacaccaguggcc

SEQ ID NO: 663985 - RNA, 22 nt, Human
cugucuguuuuaccuucuccag

SEQ ID NO: 663986 - RNA, 22 nt, Human
aagccacuauuaaauaaugauu

SEQ ID NO: 663987 - RNA, 22 nt, Human
cagaggagaauugcgggaucau

SEQ ID NO: 663988 - RNA, 21 nt, Human
ccccagcaccuugccagccug

SEQ ID NO: 663989 - RNA, 22 nt, Human
gggcuuuaacacccagucaggg

SEQ ID NO: 663990 - RNA, 22 nt, Human
ucaauacacaugccgcuguucu

SEQ ID NO: 663991 - RNA, 22 nt, Human
gucugaaugaugagugggacuc

SEQ ID NO: 663992 - RNA, 22 nt, Human
uaaugcuugcaaauuaugggac

SEQ ID NO: 663993 - RNA, 22 nt, Human
cccaggagacugagcuguaacc

SEQ ID NO: 663994 - RNA, 22 nt, Human
gcugggcugagcuagacuuggc

SEQ ID NO: 663995 - RNA, 21 nt, Human
gcacccagccgguucucccag

SEQ ID NO: 663996 - RNA, 22 nt, Human
agucaguauuuauuacuuagcu

SEQ ID NO: 663997 - RNA, 22 nt, Human
ucuggaaggaacccuuagagga

SEQ ID NO: 663998 - RNA, 22 nt, Human
auucuuuacauuggcuucuucc

SEQ ID NO: 663999 - RNA, 22 nt, Human
gccacuggacccagaaagggaa

SEQ ID NO: 664000 - RNA, 19 nt, Human
uuucuguuugcuucugguu

SEQ ID NO: 664001 - RNA, 22 nt, Human
acagugcauuauugcugaaugc

SEQ ID NO: 664002 - RNA, 22 nt, Human
uaggaacuuagaugaacacaug

SEQ ID NO: 664003 - RNA, 23 nt, Human
caaaccuguucuccccacaugca

SEQ ID NO: 664004 - RNA, 22 nt, Human
ugucuguggcaauuguggguaa

SEQ ID NO: 664005 - RNA, 22 nt, Human
uugagcaaaucagaaguuuaga

SEQ ID NO: 664006 - RNA, 22 nt, Human
ucagcauauguuuggagugucc

SEQ ID NO: 664007 - RNA, 22 nt, Human
cagugaggugcccagccugccc

SEQ ID NO: 664008 - RNA, 22 nt, Human
agcacuuuaagcaacagaucaa

SEQ ID NO: 664009 - RNA, 22 nt, Human
gggcucuggaguucuagaaaga

SEQ ID NO: 664010 - RNA, 22 nt, Human
ggcugaggggcccagaggaaca

SEQ ID NO: 664011 - RNA, 22 nt, Human
ucuuugaacucuguguauuaac

SEQ ID NO: 664012 - RNA, 22 nt, Human
gccuuguuucauuacacguggu

SEQ ID NO: 664013 - RNA, 22 nt, Human
aagccaguguuuuugagaguug

SEQ ID NO: 664014 - RNA, 22 nt, Human
uguguacaagaguguuuacugu

SEQ ID NO: 664015 - RNA, 22 nt, Human
aggcaguggagcuggaauaggc

SEQ ID NO: 664016 - RNA, 22 nt, Human
auguucuucuaucuuuauuaaa

SEQ ID NO: 664017 - RNA, 22 nt, Human
uuuauuauucuguucucucuac

SEQ ID NO: 664018 - RNA, 22 nt, Human
cuguaugaacccauauacuuau

SEQ ID NO: 664019 - RNA, 21 nt, Human
gcaggguuugugcugugaguu

SEQ ID NO: 664020 - RNA, 22 nt, Human
gugaauaaucacccuucuggau

SEQ ID NO: 664021 - RNA, 22 nt, Human
gaggaagaauugguuauuggag

SEQ ID NO: 664022 - RNA, 22 nt, Human
cacugugggguuuggcuggaac

SEQ ID NO: 664023 - RNA, 22 nt, Human
caaggcugcuucagacuaguga

SEQ ID NO: 664024 - RNA, 22 nt, Human
guggagggugauugccggcugu

SEQ ID NO: 664025 - RNA, 22 nt, Human
auuuccaugaaggcagauuuua

SEQ ID NO: 664026 - RNA, 22 nt, Human
uuuguaaaggccugaauuucag

SEQ ID NO: 664027 - RNA, 20 nt, Human
cugggucacuuggcugcucu

SEQ ID NO: 664028 - RNA, 22 nt, Human
aaaugcacaaagauuuugcacu

SEQ ID NO: 664029 - RNA, 22 nt, Human
ugccuacccaugguuagacaua

SEQ ID NO: 664030 - RNA, 22 nt, Human
ccaggcagagggauccccaucc

SEQ ID NO: 664031 - RNA, 22 nt, Human
augcauaugccguagaauaagu

SEQ ID NO: 664032 - RNA, 22 nt, Human
aucauucagugaccacuuccca

SEQ ID NO: 664033 - RNA, 22 nt, Human
gaggcugaguagcuuugugcuc

SEQ ID NO: 664034 - RNA, 21 nt, Human
uuuucccacugaaagcuccca

SEQ ID NO: 664035 - RNA, 22 nt, Human
caggaccccauauucacugaac

SEQ ID NO: 664036 - RNA, 22 nt, Human
gugggccaggccggagugcaga

SEQ ID NO: 664037 - RNA, 21 nt, Human
guugugguuggggcugcagcu

SEQ ID NO: 664038 - RNA, 19 nt, Human
uuagccauccacagugaaa

SEQ ID NO: 664039 - RNA, 22 nt, Human
ucagcagugugcccagaggcug

SEQ ID NO: 664040 - RNA, 22 nt, Human
uuucacagcugucuuccgucuc

SEQ ID NO: 664041 - RNA, 22 nt, Human
cucacugugaccucagcagaca

SEQ ID NO: 664042 - RNA, 22 nt, Human
gagagaagggacuucuacacuu

SEQ ID NO: 664043 - RNA, 22 nt, Human
cuaaaggcucagcauucuuuuc

SEQ ID NO: 664044 - RNA, 22 nt, Human
ucauuuugccugccauuugagu

SEQ ID NO: 664045 - RNA, 22 nt, Human
uagaaaugcccagauucugcua

SEQ ID NO: 664046 - RNA, 23 nt, Human
aggcagguuugggcucuucuugu

SEQ ID NO: 664047 - RNA, 22 nt, Human
gaauacaagccugccaccugga

SEQ ID NO: 664048 - RNA, 22 nt, Human
uaggauuuggcuuuagucaggu

SEQ ID NO: 664049 - RNA, 22 nt, Human
ucacccaggcuggacugcagug

SEQ ID NO: 664050 - RNA, 23 nt, Human
gacaucuguuuugucccugugcu

SEQ ID NO: 664051 - RNA, 22 nt, Human
aaagacuagcauuuauauguac

SEQ ID NO: 664052 - RNA, 22 nt, Human
uuuacaacuuucuguucuguau

SEQ ID NO: 664053 - RNA, 22 nt, Human
uauguucaugcuuaugcagaau

SEQ ID NO: 664054 - RNA, 22 nt, Human
guacaacaugauuuuacucucu

SEQ ID NO: 664055 - RNA, 22 nt, Human
ggaggaggggcgcuuugucuau

SEQ ID NO: 664056 - RNA, 22 nt, Human
aaagcugcaagcuccugaggaa

SEQ ID NO: 664057 - RNA, 22 nt, Human
cagggagcagccccuagaagua

SEQ ID NO: 664058 - RNA, 22 nt, Human
uugaaguugguguggaaaguag

SEQ ID NO: 664059 - RNA, 22 nt, Human
cuucccacagaauucaaucagu

SEQ ID NO: 664060 - RNA, 22 nt, Human
agcagcugaccagugaguccug

SEQ ID NO: 664061 - RNA, 22 nt, Human
ggccagagcucaaacagucgca

SEQ ID NO: 664062 - RNA, 22 nt, Human
uaauuuugucacagugacaugc

SEQ ID NO: 664063 - RNA, 22 nt, Human
uaaaucuccuguuuuucaucua

SEQ ID NO: 664064 - RNA, 22 nt, Human
ggaggccucaguaccuugcuuu

SEQ ID NO: 664065 - RNA, 22 nt, Human
ugcugucugcaacaguacuaca

SEQ ID NO: 664066 - RNA, 22 nt, Human
ggggaagauggcccuccaugug

SEQ ID NO: 664067 - RNA, 22 nt, Human
agcuugccucccccucuuagga

SEQ ID NO: 664068 - RNA, 22 nt, Human
cuuuuagcuguuuccauggcaa

SEQ ID NO: 664069 - RNA, 22 nt, Human
uauuagcaguuguaugugucug

SEQ ID NO: 664070 - RNA, 22 nt, Human
aggggagacuggaaucuaacau

SEQ ID NO: 664071 - RNA, 22 nt, Human
aacaauuacuaccaaggccugu

SEQ ID NO: 664072 - RNA, 22 nt, Human
gcagggacaucuuugucuagua

SEQ ID NO: 664073 - RNA, 22 nt, Human
uuagugaucaaaaucaaaauug

SEQ ID NO: 664074 - RNA, 22 nt, Human
aaggacaaguaguauuugcauc

SEQ ID NO: 664075 - RNA, 22 nt, Human
cauuaugugagugauuaauuca

SEQ ID NO: 664076 - RNA, 22 nt, Human
aaagagaaaaugaucuguacau

SEQ ID NO: 664077 - RNA, 21 nt, Human
uguuuaaguacuccuuucugg

SEQ ID NO: 664078 - RNA, 22 nt, Human
ccaggaggcucugacuggaccc

SEQ ID NO: 664079 - RNA, 22 nt, Human
guccugagucaagugugggcag

SEQ ID NO: 664080 - RNA, 22 nt, Human
auuaccacuuaaucaacauaug

SEQ ID NO: 664081 - RNA, 21 nt, Human
uacaagauagagguaauauau

SEQ ID NO: 664082 - RNA, 22 nt, Human
ccugcucuuauagcuguuucca

SEQ ID NO: 664083 - RNA, 22 nt, Human
cuuuacagaauaagaauacugg

SEQ ID NO: 664084 - RNA, 22 nt, Human
uucagagacagcaaccaggaca

SEQ ID NO: 664085 - RNA, 22 nt, Human
gcugagggcuguaacagcagag

SEQ ID NO: 664086 - RNA, 22 nt, Human
ugaaaucuucacuaagucucuu

SEQ ID NO: 664087 - RNA, 20 nt, Human
cugaacacagaauaagcaca

SEQ ID NO: 664088 - RNA, 22 nt, Human
acagaggccaugagcugccacc

SEQ ID NO: 664089 - RNA, 23 nt, Human
uuccuuaacuguuaagauugucu

SEQ ID NO: 664090 - RNA, 22 nt, Human
ccugggaagaccggcagugggg

SEQ ID NO: 664091 - RNA, 22 nt, Human
acaguaguccuuuauuuugguu

SEQ ID NO: 664092 - RNA, 22 nt, Human
guuucacagggccauggaggaa

SEQ ID NO: 664093 - RNA, 22 nt, Human
cuguaugauauccaaauugaua

SEQ ID NO: 664094 - RNA, 22 nt, Human
agaagugagacucaguugauga

SEQ ID NO: 664095 - RNA, 22 nt, Human
agucugucugucacuucugcag

SEQ ID NO: 664096 - RNA, 22 nt, Human
acagagguguuccagaccuagg

SEQ ID NO: 664097 - RNA, 22 nt, Human
uaugacauuuucccagauuuau

SEQ ID NO: 664098 - RNA, 22 nt, Human
aacaaugauauagggauuggca

SEQ ID NO: 664099 - RNA, 22 nt, Human
agcauguaaagcucuuagcacc

SEQ ID NO: 664100 - RNA, 22 nt, Human
gagguuccccauuguacuggcu

SEQ ID NO: 664101 - RNA, 22 nt, Human
guuuccugaugugggagaucuu

SEQ ID NO: 664102 - RNA, 22 nt, Human
gagagacugggcagggccggca

SEQ ID NO: 664103 - RNA, 22 nt, Human
uggcuggaagucagaaauggga

SEQ ID NO: 664104 - RNA, 22 nt, Human
uagggugguuagaaggaguaug

SEQ ID NO: 664105 - RNA, 22 nt, Human
uuggcuucuucgcacagcagua

SEQ ID NO: 664106 - RNA, 22 nt, Human
gaguccaguucuuuccagcagu

SEQ ID NO: 664107 - RNA, 21 nt, Human
ugauuucugccaaguucacua

SEQ ID NO: 664108 - RNA, 22 nt, Human
aacucacuuuguggcuucugaa

SEQ ID NO: 664109 - RNA, 22 nt, Human
acauccagaucucagcauggcu

SEQ ID NO: 664110 - RNA, 22 nt, Human
ugugauuagcugaauacacugg

SEQ ID NO: 664111 - RNA, 22 nt, Human
ugcuuaaaaagcuccaucaaua

SEQ ID NO: 664112 - RNA, 22 nt, Human
uuggaaucugcaauuuaacaaa

SEQ ID NO: 664113 - RNA, 22 nt, Human
aggacagggauucaaacuccca

SEQ ID NO: 664114 - RNA, 22 nt, Human
ugucuucaggaguaaauaucau

SEQ ID NO: 664115 - RNA, 21 nt, Human
gcugccaccgcgugcuccagg

SEQ ID NO: 664116 - RNA, 22 nt, Human
aacagguagggacucuaacuug

SEQ ID NO: 664117 - RNA, 22 nt, Human
ggucagaagugcaaaaucaguu

SEQ ID NO: 664118 - RNA, 19 nt, Human
ggccuggauuuagggcucc

SEQ ID NO: 664119 - RNA, 22 nt, Human
ggcuuugcaaaaucggcuucug

SEQ ID NO: 664120 - RNA, 18 nt, Human
cauccuuauagcugagaa

SEQ ID NO: 664121 - RNA, 22 nt, Human
uggcuuccuguuucccagaaag

SEQ ID NO: 664122 - RNA, 22 nt, Human
auucuacagaugaaagcggcug

SEQ ID NO: 664123 - RNA, 22 nt, Human
agugaaauuccuggucuuuguu

SEQ ID NO: 664124 - RNA, 22 nt, Human
uccaguaucaaaguccuagucc

SEQ ID NO: 664125 - RNA, 22 nt, Human
augugggagauuucaggaggug

SEQ ID NO: 664126 - RNA, 22 nt, Human
agaaacaagguguagguugacc

SEQ ID NO: 664127 - RNA, 22 nt, Human
ugggacuugccucgagggcugc

SEQ ID NO: 664128 - RNA, 22 nt, Human
guucucagggauaacuuccccc

SEQ ID NO: 664129 - RNA, 22 nt, Human
cuguuauuaaaaagcucaggcu

SEQ ID NO: 664130 - RNA, 22 nt, Human
uacuagaaccucacaacaaucc

SEQ ID NO: 664131 - RNA, 22 nt, Human
aaccacauggcucaguggacau

SEQ ID NO: 664132 - RNA, 22 nt, Human
uaaccuguuaagggcugaccca

SEQ ID NO: 664133 - RNA, 22 nt, Human
acagaggcugaucuucaagccc

SEQ ID NO: 664134 - RNA, 22 nt, Human
agacaaagacagcaucucaggu

SEQ ID NO: 664135 - RNA, 22 nt, Human
cugaggucaauuaaucaacaac

SEQ ID NO: 664136 - RNA, 21 nt, Human
accagcaggagaucagaagga

SEQ ID NO: 664137 - RNA, 23 nt, Human
ugacagaccuucccagacaguca

SEQ ID NO: 664138 - RNA, 22 nt, Human
ugccugggcucgguagccaucg

SEQ ID NO: 664139 - RNA, 22 nt, Human
augggcugcuucuccagcaccu

SEQ ID NO: 664140 - RNA, 22 nt, Human
gaaauugccagaucuaguagau

SEQ ID NO: 664141 - RNA, 22 nt, Human
gagagugaggcaucaggggcag

SEQ ID NO: 664142 - RNA, 22 nt, Human
ugcugcuguugacggcugucca

SEQ ID NO: 664143 - RNA, 22 nt, Human
ccuguggcugccccgcuguugg

SEQ ID NO: 664144 - RNA, 22 nt, Human
acagccuuauugcgagcaaggc

SEQ ID NO: 664145 - RNA, 22 nt, Human
cuugggaacugccuugccuuug

SEQ ID NO: 664146 - RNA, 21 nt, Human
gcugcugccccuagugaggcc

SEQ ID NO: 664147 - RNA, 23 nt, Human
gcucccugugcuccaggagaugc

SEQ ID NO: 664148 - RNA, 22 nt, Human
cccuccaccaagcagggcgcca

SEQ ID NO: 664149 - RNA, 22 nt, Human
gggccagugaacaaugagggaa

SEQ ID NO: 664150 - RNA, 22 nt, Human
augcauaugugugcacacgugu

SEQ ID NO: 664151 - RNA, 22 nt, Human
uuaauuuuaaccuguuuguguc

SEQ ID NO: 664152 - RNA, 22 nt, Human
ucaggagggugacaggcccugg

SEQ ID NO: 664153 - RNA, 22 nt, Human
uguuucuuacguuuuuagaggc

SEQ ID NO: 664154 - RNA, 18 nt, Human
gugccaggaggcgcagcc

SEQ ID NO: 664155 - RNA, 22 nt, Human
uuccuuggaguuaagacccugg

SEQ ID NO: 664156 - RNA, 22 nt, Human
cauaacaguggcuucagcaagu

SEQ ID NO: 664157 - RNA, 22 nt, Human
uaucuacaggugucagguaaga

SEQ ID NO: 664158 - RNA, 22 nt, Human
ugcccacuucaaaaucuucauu

SEQ ID NO: 664159 - RNA, 22 nt, Human
ugcuucugaaaugcaggucuuc

SEQ ID NO: 664160 - RNA, 22 nt, Human
uccagagccccaauucaccucu

SEQ ID NO: 664161 - RNA, 23 nt, Human
aauuuccccugucucugauuugg

SEQ ID NO: 664162 - RNA, 22 nt, Human
cagcagcugcgugcccaggccg

SEQ ID NO: 664163 - RNA, 22 nt, Human
gcagcuuugucacggagugucg

SEQ ID NO: 664164 - RNA, 22 nt, Human
ucuaugaaaagucuauucauuc

SEQ ID NO: 664165 - RNA, 22 nt, Human
agucagcuacaaguucauucac

SEQ ID NO: 664166 - RNA, 20 nt, Human
uccaggagaacugggagccg

SEQ ID NO: 664167 - RNA, 22 nt, Human
agcagccacacgccuccuucuc

SEQ ID NO: 664168 - RNA, 22 nt, Human
caggaguccagagugucauuuu

SEQ ID NO: 664169 - RNA, 22 nt, Human
cugaaagguauaaauaagacuu

SEQ ID NO: 664170 - RNA, 22 nt, Human
auauuaugcuaagggaaauaag

SEQ ID NO: 664171 - RNA, 22 nt, Human
agcaaagccgagacagccagug

SEQ ID NO: 664172 - RNA, 22 nt, Human
cagguuuaguuccacacagcuc

SEQ ID NO: 664173 - RNA, 22 nt, Human
ggggaagggaguccaaguguua

SEQ ID NO: 664174 - RNA, 22 nt, Human
ggcgcacaaugugcagguuugu

SEQ ID NO: 664175 - RNA, 22 nt, Human
gggcuggauuacugaacugagu

SEQ ID NO: 664176 - RNA, 22 nt, Human
augcaugauccugagcaaccca

SEQ ID NO: 664177 - RNA, 22 nt, Human
aagcacaguaaaagcagauuuu

SEQ ID NO: 664178 - RNA, 22 nt, Human
guggggugcagcaguacugugu

SEQ ID NO: 664179 - RNA, 22 nt, Human
agcauuaauaagaaauggcucc

SEQ ID NO: 664180 - RNA, 22 nt, Human
gcagaggaggacccaggaauua

SEQ ID NO: 664181 - RNA, 17 nt, Human
gccucugcuugugucau

SEQ ID NO: 664182 - RNA, 22 nt, Human
gaaaucuuuauggaaauaacaa

SEQ ID NO: 664183 - RNA, 23 nt, Human
agggugagcaagcuauggagacc

SEQ ID NO: 664184 - RNA, 22 nt, Human
uagugaaaugauaacagagcag

SEQ ID NO: 664185 - RNA, 22 nt, Human
uuuggaaaguguacaaauuuga

SEQ ID NO: 664186 - RNA, 22 nt, Human
caggccugagacaucugagaua

SEQ ID NO: 664187 - RNA, 22 nt, Human
augugaaagagguguucagugg

SEQ ID NO: 664188 - RNA, 22 nt, Human
gcucagucuuugugggguacgg

SEQ ID NO: 664189 - RNA, 22 nt, Human
ugacauuuaagccucugauuuc

SEQ ID NO: 664190 - RNA, 22 nt, Human
cucugguguccuuuagaauuua

SEQ ID NO: 664191 - RNA, 22 nt, Human
acaggcagggaccucuugaguu

SEQ ID NO: 664192 - RNA, 22 nt, Human
cacagaaucugugacuccaaga

SEQ ID NO: 664193 - RNA, 22 nt, Human
ccuuggcccuagccucaggcaa

SEQ ID NO: 664194 - RNA, 22 nt, Human
ugccugcaagaguuggggcuac

SEQ ID NO: 664195 - RNA, 22 nt, Human
ucacuuugcccuguaccuuggg

SEQ ID NO: 664196 - RNA, 22 nt, Human
uacaguauuugaagaauaugag

SEQ ID NO: 664197 - RNA, 22 nt, Human
aucauguuguauguaaucuuuu

SEQ ID NO: 664198 - RNA, 22 nt, Human
aauuuguuuucaagucacugga

SEQ ID NO: 664199 - RNA, 22 nt, Human
gcuggcuuccaucagaggguga

SEQ ID NO: 664200 - RNA, 22 nt, Human
cuuacaaauacacuuaggagag

SEQ ID NO: 664201 - RNA, 22 nt, Human
acugaauagcccuucugucucc

SEQ ID NO: 664202 - RNA, 22 nt, Human
uaauugcuuguaaagcccugaa

SEQ ID NO: 664203 - RNA, 22 nt, Human
auuccacuuauaugaaguaacg

SEQ ID NO: 664204 - RNA, 22 nt, Human
ugcccaggauugugaggucagg

SEQ ID NO: 664205 - RNA, 22 nt, Human
aggagggagcuuaagccaggca

SEQ ID NO: 664206 - RNA, 22 nt, Human
ugaugaauuaguaacaaaugag

SEQ ID NO: 664207 - RNA, 22 nt, Human
uaggauuuaggcuuuaacaucu

SEQ ID NO: 664208 - RNA, 22 nt, Human
caucauaauaacccagacacag

SEQ ID NO: 664209 - RNA, 22 nt, Human
uucuccucuguuggccuucccu

SEQ ID NO: 664210 - RNA, 22 nt, Human
ugacauuugagcauacauguaa

SEQ ID NO: 664211 - RNA, 22 nt, Human
agauaaaguccaaacuguguag

SEQ ID NO: 664212 - RNA, 22 nt, Human
cagaugugagcuggggagagug

SEQ ID NO: 664213 - RNA, 22 nt, Human
agguaugugcuauuguuauauu

SEQ ID NO: 664214 - RNA, 22 nt, Human
auuuagcaagaguacaaaauaa

SEQ ID NO: 664215 - RNA, 22 nt, Human
aagcucauuaauuagaagcuaa

SEQ ID NO: 664216 - RNA, 22 nt, Human
uaugcagcaccacucacugcag

SEQ ID NO: 664217 - RNA, 22 nt, Human
aaugugguuaacccauuuaaga

SEQ ID NO: 664218 - RNA, 22 nt, Human
uagcuugacuauucuaugaugu

SEQ ID NO: 664219 - RNA, 19 nt, Human
cccaggagucuggcugguu

SEQ ID NO: 664220 - RNA, 22 nt, Human
uauguauucucagauuuacuaa

SEQ ID NO: 664221 - RNA, 22 nt, Human
ggauggcaggacaaggacccag

SEQ ID NO: 664222 - RNA, 22 nt, Human
cguauacaugaagacauugcug

SEQ ID NO: 664223 - RNA, 22 nt, Human
cugccagugaaauugugucagu

SEQ ID NO: 664224 - RNA, 22 nt, Human
uauugaccagacugacacacau

SEQ ID NO: 664225 - RNA, 22 nt, Human
cuuuucaugccagcccaucaca

SEQ ID NO: 664226 - RNA, 22 nt, Human
guuuacaaauauuuuaaauggu

SEQ ID NO: 664227 - RNA, 23 nt, Human
gccaucacguucaaccaaagccu

SEQ ID NO: 664228 - RNA, 22 nt, Human
uucagcacaagacuagacaggu

SEQ ID NO: 664229 - RNA, 22 nt, Human
aaguuucaaauguugauuaugc

SEQ ID NO: 664230 - RNA, 22 nt, Human
uagcacuguucuagcauguuuu

SEQ ID NO: 664231 - RNA, 22 nt, Human
auaaggcaucucucaguuagca

SEQ ID NO: 664232 - RNA, 22 nt, Human
ccagugcauugccgugucuagg

SEQ ID NO: 664233 - RNA, 22 nt, Human
ucuuggccacuaccaccuggag

SEQ ID NO: 664234 - RNA, 19 nt, Human
agccagugagccucugggu

SEQ ID NO: 664235 - RNA, 22 nt, Human
acugagcaucagggcugggaac

SEQ ID NO: 664236 - RNA, 22 nt, Human
cccuggcagugcuccuuuagac

SEQ ID NO: 664237 - RNA, 22 nt, Human
ccuggcugcucugaugagcgcc

SEQ ID NO: 664238 - RNA, 20 nt, Human
uauuucacucuccagauggc

SEQ ID NO: 664239 - RNA, 22 nt, Human
aggaccagaccgaacuagcuaa

SEQ ID NO: 664240 - RNA, 22 nt, Human
auaaacacuucuagggcacaca

SEQ ID NO: 664241 - RNA, 22 nt, Human
acagcagagcaccagggccacu

SEQ ID NO: 664242 - RNA, 22 nt, Human
cuccccauccaggcagcaggug

SEQ ID NO: 664243 - RNA, 22 nt, Human
agcaccaucacagcuguauguc

SEQ ID NO: 664244 - RNA, 22 nt, Human
uguuugaaacuuugaucacuaa

SEQ ID NO: 664245 - RNA, 22 nt, Human
cuguccugugucagccugaaau

SEQ ID NO: 664246 - RNA, 22 nt, Human
acuaaauacacacauuuguuca

SEQ ID NO: 664247 - RNA, 19 nt, Human
cuuauacagauuuucucau

SEQ ID NO: 664248 - RNA, 22 nt, Human
uucuuauuuuccugaggaagaa

SEQ ID NO: 664249 - RNA, 21 nt, Human
aguucauacugaguaacaaaa

SEQ ID NO: 664250 - RNA, 22 nt, Human
cacaggcucuccagggccugga

SEQ ID NO: 664251 - RNA, 22 nt, Human
uuguccugauuuugcaacuucu

SEQ ID NO: 664252 - RNA, 22 nt, Human
ucccacagcaugaguaacucuc

SEQ ID NO: 664253 - RNA, 22 nt, Human
ucuugauuuuguuaaaauuaga

SEQ ID NO: 664254 - RNA, 22 nt, Human
uggaaggcauuucacacaggau

SEQ ID NO: 664255 - RNA, 22 nt, Human
uucuacagaauaaauguuuaca

SEQ ID NO: 664256 - RNA, 22 nt, Human
ucgccagggaugcuguaaggaa

SEQ ID NO: 664257 - RNA, 22 nt, Human
uucugaagggcuaagugucuau

SEQ ID NO: 664258 - RNA, 22 nt, Human
ccagggacuuugcauuguuuau

SEQ ID NO: 664259 - RNA, 22 nt, Human
ccauggccaggaaagccaaggu

SEQ ID NO: 664260 - RNA, 22 nt, Human
uugcuauuuugagagucauagu

SEQ ID NO: 664261 - RNA, 22 nt, Human
ucuggcuguuaggccugaccuu

SEQ ID NO: 664262 - RNA, 22 nt, Human
uagggcaggggaggaaucugaa

SEQ ID NO: 664263 - RNA, 22 nt, Human
cagaccugaggagcacugagcc

SEQ ID NO: 664264 - RNA, 22 nt, Human
gugcuacagacugaguacacuu

SEQ ID NO: 664265 - RNA, 22 nt, Human
aggcagugagcagggugucaug

SEQ ID NO: 664266 - RNA, 22 nt, Human
uaggccuauuguauucuuaucu

SEQ ID NO: 664267 - RNA, 22 nt, Human
gaggccacccuaugggucccag

SEQ ID NO: 664268 - RNA, 23 nt, Human
uggccucuccccaccuggcagaa

SEQ ID NO: 664269 - RNA, 22 nt, Human
agguccagcuguugcagccucc

SEQ ID NO: 664270 - RNA, 22 nt, Human
gcuguagauggacuggcaucca

SEQ ID NO: 664271 - RNA, 22 nt, Human
aggcugagucgggaggaucacu

SEQ ID NO: 664272 - RNA, 22 nt, Human
ucccuuugaucacuaacagaac

SEQ ID NO: 664273 - RNA, 22 nt, Human
aaacccauggcugauaucacua

SEQ ID NO: 664274 - RNA, 22 nt, Human
aggaccuggaucacagagaucu

SEQ ID NO: 664275 - RNA, 22 nt, Human
acugugggggagccagucccau

SEQ ID NO: 664276 - RNA, 22 nt, Human
uucuauuuuuguggaacuguag

SEQ ID NO: 664277 - RNA, 22 nt, Human
uauaggcagaucugagaauauu

SEQ ID NO: 664278 - RNA, 22 nt, Human
accuccccgggagcagccuccu

SEQ ID NO: 664279 - RNA, 22 nt, Human
caggugucaaaauacuaagugg

SEQ ID NO: 664280 - RNA, 22 nt, Human
cucugucccagacccaccucuc

SEQ ID NO: 664281 - RNA, 22 nt, Human
uguguucagaauuugcugcuuu

SEQ ID NO: 664282 - RNA, 22 nt, Human
ucuggcuucaagucccagcucu

SEQ ID NO: 664283 - RNA, 22 nt, Human
ggcaggcaagucugcucuguga

SEQ ID NO: 664284 - RNA, 22 nt, Human
agguaucugguaagaggcagac

SEQ ID NO: 664285 - RNA, 22 nt, Human
uaccucagauugcugccuuggg

SEQ ID NO: 664286 - RNA, 22 nt, Human
uccaagcuacugaagguuuggg

SEQ ID NO: 664287 - RNA, 19 nt, Human
ucuguggagcucagaguag

SEQ ID NO: 664288 - RNA, 22 nt, Human
gacuuugaacaguguaucagua

SEQ ID NO: 664289 - RNA, 22 nt, Human
ccaggccuuccaguacgcagaa

SEQ ID NO: 664290 - RNA, 22 nt, Human
cuguacagcaaguucaccuugg

SEQ ID NO: 664291 - RNA, 22 nt, Human
gagucaggaguuaugcuccacc

SEQ ID NO: 664292 - RNA, 23 nt, Human
acacugucucauggauagacugc

SEQ ID NO: 664293 - RNA, 22 nt, Human
agccaugauuuucucauuuuca

SEQ ID NO: 664294 - RNA, 22 nt, Human
cauaucauuugcuuauaaaucu

SEQ ID NO: 664295 - RNA, 22 nt, Human
agagccugaggaugucccagcu

SEQ ID NO: 664296 - RNA, 22 nt, Human
gcacaugaguuaagcuggggca

SEQ ID NO: 664297 - RNA, 22 nt, Human
aaacaugagcauuucuguuuaa

SEQ ID NO: 664298 - RNA, 22 nt, Human
ggcacagagcuuugucccaguu

SEQ ID NO: 664299 - RNA, 22 nt, Human
ucagaagagcuggugcugccug

SEQ ID NO: 664300 - RNA, 22 nt, Human
aaggcccuagaaucuauauugc

SEQ ID NO: 664301 - RNA, 22 nt, Human
ucagugcaaucaagguauguuu

SEQ ID NO: 664302 - RNA, 22 nt, Human
caggcucccgaaaucacccaug

SEQ ID NO: 664303 - RNA, 22 nt, Human
acacagcaaggucugacuuugg

SEQ ID NO: 664304 - RNA, 22 nt, Human
uccagcucugcuucacagucuc

SEQ ID NO: 664305 - RNA, 22 nt, Human
gagcacaguguguugugauuuc

SEQ ID NO: 664306 - RNA, 22 nt, Human
acagcugggaaucagcugggga

SEQ ID NO: 664307 - RNA, 22 nt, Human
agugcagacugaaaugaccuuc

SEQ ID NO: 664308 - RNA, 22 nt, Human
cucagcuaguaacguacauguc

SEQ ID NO: 664309 - RNA, 22 nt, Human
uuuguagaauaauaucuuucug

SEQ ID NO: 664310 - RNA, 22 nt, Human
cuggcuuuuagugugaagacuu

SEQ ID NO: 664311 - RNA, 22 nt, Human
agcaaagaaggguucuucauua

SEQ ID NO: 664312 - RNA, 22 nt, Human
gcagaggcauuucugacgcugc

SEQ ID NO: 664313 - RNA, 21 nt, Human
cacuuuaaaaauaucuuuaua

SEQ ID NO: 664314 - RNA, 22 nt, Human
cagcagagaaauuaaacuucug

SEQ ID NO: 664315 - RNA, 22 nt, Human
gggcagguggcaaagccagagg

SEQ ID NO: 664316 - RNA, 22 nt, Human
ucugcaaacccccaucuaucau

SEQ ID NO: 664317 - RNA, 22 nt, Human
agguaaaugucagagccuuuaa

SEQ ID NO: 664318 - RNA, 17 nt, Human
uuauugcagugcugaag

SEQ ID NO: 664319 - RNA, 22 nt, Human
uuacacuuggguguggauuuua

SEQ ID NO: 664320 - RNA, 20 nt, Human
ucaaaggcaaaggugggugu

SEQ ID NO: 664321 - RNA, 22 nt, Human
uccaagaaguuucguuaaaugu

SEQ ID NO: 664322 - RNA, 22 nt, Human
uacugccuggagcauuggugcu

SEQ ID NO: 664323 - RNA, 22 nt, Human
cuggaucuucagagaucaccag

SEQ ID NO: 664324 - RNA, 22 nt, Human
auacauuagaaucugguacuca

SEQ ID NO: 664325 - RNA, 22 nt, Human
aauguuguuuuucugcaugucu

SEQ ID NO: 664326 - RNA, 22 nt, Human
ccagcugguguuccuuaggacc

SEQ ID NO: 664327 - RNA, 22 nt, Human
acucaaauuugucaacugaagc

SEQ ID NO: 664328 - RNA, 22 nt, Human
uuuccuuccagguuccuaaggc

SEQ ID NO: 664329 - RNA, 22 nt, Human
uuccuaacaaacuucagugaau

SEQ ID NO: 664330 - RNA, 22 nt, Human
uguacucagcucagaucucagg

SEQ ID NO: 664331 - RNA, 22 nt, Human
cuuuuuacaaagccugucuucu

SEQ ID NO: 664332 - RNA, 22 nt, Human
ccaggccugauugggaaucuug

SEQ ID NO: 664333 - RNA, 22 nt, Human
agggggugggaagucuagaauc

SEQ ID NO: 664334 - RNA, 22 nt, Human
ccagccuucugggacucucauc

SEQ ID NO: 664335 - RNA, 22 nt, Human
ucugggcuuuuccaugccugug

SEQ ID NO: 664336 - RNA, 22 nt, Human
auugcugugaugauguucugag

SEQ ID NO: 664337 - RNA, 23 nt, Human
cccaggagccugaguccucucug

SEQ ID NO: 664338 - RNA, 22 nt, Human
gaguccagcucauugucuggga

SEQ ID NO: 664339 - RNA, 22 nt, Human
auugcacuccagcccugcugac

SEQ ID NO: 664340 - RNA, 22 nt, Human
uuguggauucuauuucccagaa

SEQ ID NO: 664341 - RNA, 22 nt, Human
guucccacuagacugcuacuua

SEQ ID NO: 664342 - RNA, 22 nt, Human
uuuccuucaucaucugagagcu

SEQ ID NO: 664343 - RNA, 22 nt, Human
cacaggcuugucagcaugaggc

SEQ ID NO: 664344 - RNA, 22 nt, Human
agucccagaugacccagcuacu

SEQ ID NO: 664345 - RNA, 22 nt, Human
guacauguaugagauaugugua

SEQ ID NO: 664346 - RNA, 22 nt, Human
ugaggccagcuucagcagugga

SEQ ID NO: 664347 - RNA, 22 nt, Human
auguguauuuccaucgaucagc

SEQ ID NO: 664348 - RNA, 22 nt, Human
gccugccuuugugaggaagcgg

SEQ ID NO: 664349 - RNA, 22 nt, Human
gggggugguucuaaguccuaua

SEQ ID NO: 664350 - RNA, 22 nt, Human
uuuucucccgcuggcugcucuu

SEQ ID NO: 664351 - RNA, 22 nt, Human
uccagcccaucccuagccuggg

SEQ ID NO: 664352 - RNA, 22 nt, Human
ugcuggaauaauuucauguuaa

SEQ ID NO: 664353 - RNA, 22 nt, Human
uauguacaccggggaagguggg

SEQ ID NO: 664354 - RNA, 22 nt, Human
aggccucauaguagaccugccc

SEQ ID NO: 664355 - RNA, 22 nt, Human
ucucuugggaggaaagagagaa

SEQ ID NO: 664356 - RNA, 22 nt, Human
aaaggcaugauuaauucugugu

SEQ ID NO: 664357 - RNA, 22 nt, Human
ucuucacaccgggcagcaggaa

SEQ ID NO: 664358 - RNA, 22 nt, Human
acauuucugcuagaauagguga

SEQ ID NO: 664359 - RNA, 22 nt, Human
gcaggagaacaaagcaagcugc

SEQ ID NO: 664360 - RNA, 22 nt, Human
gguguccucaugauuuucuaga

SEQ ID NO: 664361 - RNA, 22 nt, Human
uucaucuggaaguucccaaggc

SEQ ID NO: 664362 - RNA, 22 nt, Human
uuugaagagccacagugaaauu

SEQ ID NO: 664363 - RNA, 22 nt, Human
ugaaacuuuugagguucuucca

SEQ ID NO: 664364 - RNA, 22 nt, Human
uuuauuacaccagguuaacuca

SEQ ID NO: 664365 - RNA, 22 nt, Human
aaugaacuggagaacaaugacc

SEQ ID NO: 664366 - RNA, 22 nt, Human
uuuuauagcugaauaguauucc

SEQ ID NO: 664367 - RNA, 22 nt, Human
uccucuggggucagggcacuac

SEQ ID NO: 664368 - RNA, 22 nt, Human
caaagugcugggauuauaggca

SEQ ID NO: 664369 - RNA, 22 nt, Human
cauaauuagagaauucauguua

SEQ ID NO: 664370 - RNA, 22 nt, Human
cuuguccuuuacuugagacuca

SEQ ID NO: 664371 - RNA, 22 nt, Human
uccuguuaguguuagacuuccc

SEQ ID NO: 664372 - RNA, 22 nt, Human
cugcccagauuuuaccaccugc

SEQ ID NO: 664373 - RNA, 22 nt, Human
aguaaaaucaccaucucuuugu

SEQ ID NO: 664374 - RNA, 21 nt, Human
ucuaaugacauccucugacaa

SEQ ID NO: 664375 - RNA, 22 nt, Human
ccugccucaucaacuugucgug

SEQ ID NO: 664376 - RNA, 22 nt, Human
uuagcugagauuaagugaacuu

SEQ ID NO: 664377 - RNA, 22 nt, Human
ugucacauguuuaauguggacu

SEQ ID NO: 664378 - RNA, 22 nt, Human
gaggagcugucaccgugacuca

SEQ ID NO: 664379 - RNA, 22 nt, Human
cuuggcugucauaagguccugg

SEQ ID NO: 664380 - RNA, 22 nt, Human
uaauuauaacaugcuuucuggc

SEQ ID NO: 664381 - RNA, 22 nt, Human
agagcccucucauuggcuuauu

SEQ ID NO: 664382 - RNA, 22 nt, Human
ucaggaugaccacgagccucua

SEQ ID NO: 664383 - RNA, 22 nt, Human
uagggcagcugcaucaggcacu

SEQ ID NO: 664384 - RNA, 22 nt, Human
uaguacaguacugggcucuagu

SEQ ID NO: 664385 - RNA, 22 nt, Human
aauugcuuacuguuuuucaccu

SEQ ID NO: 664386 - RNA, 22 nt, Human
aacaaagucguugccuagaaga

SEQ ID NO: 664387 - RNA, 22 nt, Human
ggcugccucuauuuaggaucaa

SEQ ID NO: 664388 - RNA, 22 nt, Human
uucuaaagugcaaucugacaga

SEQ ID NO: 664389 - RNA, 22 nt, Human
cacacacugacaccuuaucuug

SEQ ID NO: 664390 - RNA, 22 nt, Human
uuuccacuccuauugcaucuca

SEQ ID NO: 664391 - RNA, 22 nt, Human
cucagagaaaaggagcaagggu

SEQ ID NO: 664392 - RNA, 22 nt, Human
cacagagacaugaugucauugc

SEQ ID NO: 664393 - RNA, 22 nt, Human
acuuagcaauuugauuaaaaga

SEQ ID NO: 664394 - RNA, 22 nt, Human
acagaggggucacagccugaag

SEQ ID NO: 664395 - RNA, 22 nt, Human
ucucaguuuccucauauguaaa

SEQ ID NO: 664396 - RNA, 22 nt, Human
uuccuacaucaccagggggagu

SEQ ID NO: 664397 - RNA, 22 nt, Human
guauuuauaggggaaugagagu

SEQ ID NO: 664398 - RNA, 22 nt, Human
acacuuuuguuugaagucucca

SEQ ID NO: 664399 - RNA, 22 nt, Human
gaaacugaguaggcuagagcac

SEQ ID NO: 664400 - RNA, 22 nt, Human
auguuuuacccuuugcacaaac

SEQ ID NO: 664401 - RNA, 22 nt, Human
ccugcccauacugaccucuaau

SEQ ID NO: 664402 - RNA, 22 nt, Human
ccagaaagaaugaacugaaccc

SEQ ID NO: 664403 - RNA, 22 nt, Human
ucacagaaacagaauggcacag

SEQ ID NO: 664404 - RNA, 22 nt, Human
gacagggcgagacucagucuca

SEQ ID NO: 664405 - RNA, 22 nt, Human
gccaccccaaccucccuaaguu

SEQ ID NO: 664406 - RNA, 22 nt, Human
agugacauuugcaccagcugcu

SEQ ID NO: 664407 - RNA, 22 nt, Human
cagaagucacccucagaauaac

SEQ ID NO: 664408 - RNA, 22 nt, Human
ucuccaggccuuucccaucuua

SEQ ID NO: 664409 - RNA, 22 nt, Human
cuggcuccaaauucugauguuc

SEQ ID NO: 664410 - RNA, 22 nt, Human
acuguggcgucaggaagaaauu

SEQ ID NO: 664411 - RNA, 22 nt, Human
ucugaagguugagaagggcuga

SEQ ID NO: 664412 - RNA, 22 nt, Human
uggagccugagucagcggaggc

SEQ ID NO: 664413 - RNA, 22 nt, Human
gccugggagauuaauuaggaag

SEQ ID NO: 664414 - RNA, 22 nt, Human
uccugccucuuuucuuauucca

SEQ ID NO: 664415 - RNA, 22 nt, Human
cuggaagacguuugaagccaug

SEQ ID NO: 664416 - RNA, 22 nt, Human
uugcaacaucugaacauuuauc

SEQ ID NO: 664417 - RNA, 22 nt, Human
ggucugugcucuggagccucug

SEQ ID NO: 664418 - RNA, 22 nt, Human
gcccagcugucuggcagggaug

SEQ ID NO: 664419 - RNA, 22 nt, Human
aggcccugcaggaagcaggaug

SEQ ID NO: 664420 - RNA, 22 nt, Human
ggcuggcgggugggugaaagac

SEQ ID NO: 664421 - RNA, 22 nt, Human
ucuuugcaacucccauuuccau

SEQ ID NO: 664422 - RNA, 22 nt, Human
uauguacauaacaugaaaugca

SEQ ID NO: 664423 - RNA, 22 nt, Human
gaggcagcaucuauggugggaa

SEQ ID NO: 664424 - RNA, 22 nt, Human
gcccaggcuggagugcaguagc

SEQ ID NO: 664425 - RNA, 19 nt, Human
uaccauguugacuuuccug

SEQ ID NO: 664426 - RNA, 22 nt, Human
gaaaugucuuugacaagagagg

SEQ ID NO: 664427 - RNA, 22 nt, Human
ugugugccagccuacgaggagc

SEQ ID NO: 664428 - RNA, 22 nt, Human
gacaagacauugguaaagauau

SEQ ID NO: 664429 - RNA, 22 nt, Human
uuucacagaacucacuaaggag

SEQ ID NO: 664430 - RNA, 22 nt, Human
cuauucagccucuaagacaagu

SEQ ID NO: 664431 - RNA, 22 nt, Human
uggcuggauuauuggcuaguac

SEQ ID NO: 664432 - RNA, 22 nt, Human
cugaggcagaaaaagcaagggu

SEQ ID NO: 664433 - RNA, 22 nt, Human
augcaccugaacuccaucagcu

SEQ ID NO: 664434 - RNA, 22 nt, Human
uccaugagagguaacuuuacaa

SEQ ID NO: 664435 - RNA, 22 nt, Human
ugagcacuuuaaaauauuccca

SEQ ID NO: 664436 - RNA, 22 nt, Human
cucacagagccucugugucuuc

SEQ ID NO: 664437 - RNA, 22 nt, Human
caucucaguguacagggagucu

SEQ ID NO: 664438 - RNA, 22 nt, Human
uugcuucauuuccucaggcuuu

SEQ ID NO: 664439 - RNA, 22 nt, Human
uccugaauuccucuuugcaucc

SEQ ID NO: 664440 - RNA, 22 nt, Human
cuguaguugaugauuucugaua

SEQ ID NO: 664441 - RNA, 23 nt, Human
agugcaugcuugacuuagcaagc

SEQ ID NO: 664442 - RNA, 22 nt, Human
aucuucaaagcacaucguuugu

SEQ ID NO: 664443 - RNA, 22 nt, Human
aacaaucaaguuucuaaaugac

SEQ ID NO: 664444 - RNA, 21 nt, Human
agacaggucagggagagguga

SEQ ID NO: 664445 - RNA, 22 nt, Human
ucugggagauccaagcagaacu

SEQ ID NO: 664446 - RNA, 22 nt, Human
aaugaccugggugucauuucau

SEQ ID NO: 664447 - RNA, 22 nt, Human
ucaggaacauaaugugagucag

SEQ ID NO: 664448 - RNA, 22 nt, Human
ugcuucucaaagaagcauaaug

SEQ ID NO: 664449 - RNA, 22 nt, Human
gccuguucuccagcauccaggu

SEQ ID NO: 664450 - RNA, 22 nt, Human
aaaggauuagagauaccaugcc

SEQ ID NO: 664451 - RNA, 17 nt, Human
cuucucuggcagaagau

SEQ ID NO: 664452 - RNA, 22 nt, Human
auaguguuacccuucuuaaagu

SEQ ID NO: 664453 - RNA, 22 nt, Human
cauccacuagaaugacagaguu

SEQ ID NO: 664454 - RNA, 21 nt, Human
cagccugcugcuccagggcca

SEQ ID NO: 664455 - RNA, 22 nt, Human
cuggccuuggugcuugcagaca

SEQ ID NO: 664456 - RNA, 22 nt, Human
cucccagacaugugccuccuug

SEQ ID NO: 664457 - RNA, 22 nt, Human
uuugugcagguauaggcggaga

SEQ ID NO: 664458 - RNA, 22 nt, Human
ccccuucuggucuucaauggug

SEQ ID NO: 664459 - RNA, 22 nt, Human
uucucaaggacaaaaugacaug

SEQ ID NO: 664460 - RNA, 22 nt, Human
guccuucaaguaaccugggacc

SEQ ID NO: 664461 - RNA, 19 nt, Human
cuggccaggccaggggccc

SEQ ID NO: 664462 - RNA, 19 nt, Human
agcugccugugcgcgcccg

SEQ ID NO: 664463 - RNA, 22 nt, Human
agggcucccgugaggugacugc

SEQ ID NO: 664464 - RNA, 22 nt, Human
uuugaacuucuaccugucauau

SEQ ID NO: 664465 - RNA, 22 nt, Human
ggacccagguagggaggaagau

SEQ ID NO: 664466 - RNA, 22 nt, Human
ugcuucuggggacaggcugccu

SEQ ID NO: 664467 - RNA, 22 nt, Human
cauggccaaggaugcucaacca

SEQ ID NO: 664468 - RNA, 22 nt, Human
ccagggucuuggagaggagugc

SEQ ID NO: 664469 - RNA, 22 nt, Human
gaggggcucuugggcaugaagg

SEQ ID NO: 664470 - RNA, 22 nt, Human
cuguaaaacugcuuaaguaugc

SEQ ID NO: 664471 - RNA, 22 nt, Human
accaggcagcugggggugaugu

SEQ ID NO: 664472 - RNA, 22 nt, Human
aauucuaaauguaauuuagaau

SEQ ID NO: 664473 - RNA, 22 nt, Human
acuucacauuagcuaaaaggga

SEQ ID NO: 664474 - RNA, 22 nt, Human
accacugggcgggcagccugcu

SEQ ID NO: 664475 - RNA, 22 nt, Human
aaagauaugucuccaaagagau

SEQ ID NO: 664476 - RNA, 22 nt, Human
caguccuuaaggaaacauuugu

SEQ ID NO: 664477 - RNA, 19 nt, Human
ugcugacugagcugcaaaa

SEQ ID NO: 664478 - RNA, 22 nt, Human
gcauucaucuaguaucacucug

SEQ ID NO: 664479 - RNA, 22 nt, Human
auuaaggcugcacuggccuuaa

SEQ ID NO: 664480 - RNA, 22 nt, Human
uuuuaaugugcucugcaaugau

SEQ ID NO: 664481 - RNA, 22 nt, Human
agcagcaggcuguguggacuga

SEQ ID NO: 664482 - RNA, 22 nt, Human
gcggggggcagcagucgcucag

SEQ ID NO: 664483 - RNA, 22 nt, Human
cccaggagagaggccaguuggc

SEQ ID NO: 664484 - RNA, 22 nt, Human
ucaaagucacaacucucuaauu

SEQ ID NO: 664485 - RNA, 23 nt, Human
ucugcagacgcuguucuauuguc

SEQ ID NO: 664486 - RNA, 22 nt, Human
ucaggaagugguaaaggauguu

SEQ ID NO: 664487 - RNA, 19 nt, Human
ggagaggcuggagggaugc

SEQ ID NO: 664488 - RNA, 22 nt, Human
uccuagaauaaguaacaggaca

SEQ ID NO: 664489 - RNA, 17 nt, Human
uguauuuaucaugucag

SEQ ID NO: 664490 - RNA, 22 nt, Human
ugcugggcuucacccccacagu

SEQ ID NO: 664491 - RNA, 22 nt, Human
gcacauacauauuagugucaca

SEQ ID NO: 664492 - RNA, 22 nt, Human
ucuucagauaaagggagaguau

SEQ ID NO: 664493 - RNA, 22 nt, Human
cuacauaaucuggauuugucug

SEQ ID NO: 664494 - RNA, 22 nt, Human
uuccuucuaauuuuacaccuga

SEQ ID NO: 664495 - RNA, 20 nt, Human
cccucugcuacacugggagc

SEQ ID NO: 664496 - RNA, 22 nt, Human
uaagcaaauagcuagaucagag

SEQ ID NO: 664497 - RNA, 22 nt, Human
aaaaaugaauucuucaguggca

SEQ ID NO: 664498 - RNA, 22 nt, Human
aauaaugaacauuuaaaaccug

SEQ ID NO: 664499 - RNA, 22 nt, Human
cccaguggcuguccccaugggc

SEQ ID NO: 664500 - RNA, 22 nt, Human
gaggagaaauuauccuuggugu

SEQ ID NO: 664501 - RNA, 22 nt, Human
uggcagauggccuggaaccaaa

SEQ ID NO: 664502 - RNA, 22 nt, Human
cugcccugugcacaggaaacug

SEQ ID NO: 664503 - RNA, 22 nt, Human
agagccugcaucuagccucaga

SEQ ID NO: 664504 - RNA, 22 nt, Human
uggccugccccgagauccuggc

SEQ ID NO: 664505 - RNA, 22 nt, Human
gugugcagaggcaggaggugcu

SEQ ID NO: 664506 - RNA, 22 nt, Human
uguaaacagccccauggagagc

SEQ ID NO: 664507 - RNA, 22 nt, Human
cagagugagggccugcaccugc

SEQ ID NO: 664508 - RNA, 22 nt, Human
cgucacuggcgugaagugagga

SEQ ID NO: 664509 - RNA, 22 nt, Human
ugacauuuuuaaaaccacuagu

SEQ ID NO: 664510 - RNA, 22 nt, Human
uccuagaaugcaccucugcugu

SEQ ID NO: 664511 - RNA, 22 nt, Human
uagcuguuucagugcagcagaa

SEQ ID NO: 664512 - RNA, 22 nt, Human
gccuggugaaaggcagagagcg

SEQ ID NO: 664513 - RNA, 22 nt, Human
gcccggcagucacacacccagg

SEQ ID NO: 664514 - RNA, 22 nt, Human
ucacagcauucgcaauggacag

SEQ ID NO: 664515 - RNA, 22 nt, Human
gccagcagcgagaguuuaaccu

SEQ ID NO: 664516 - RNA, 22 nt, Human
guucuguccuccuaccaggcau

SEQ ID NO: 664517 - RNA, 22 nt, Human
aaaggccauuacuugcuuuuag

SEQ ID NO: 664518 - RNA, 22 nt, Human
gagcugccuacauugccaagag

SEQ ID NO: 664519 - RNA, 22 nt, Human
accaaagggcagaacaugagca

SEQ ID NO: 664520 - RNA, 22 nt, Human
ggccaguccccuaauccagggc

SEQ ID NO: 664521 - RNA, 22 nt, Human
aaugaaguucuauucauuuucu

SEQ ID NO: 664522 - RNA, 22 nt, Human
ugggagacacuggugggagcuu

SEQ ID NO: 664523 - RNA, 18 nt, Human
gcuuucuguagaaaaggg

SEQ ID NO: 664524 - RNA, 22 nt, Human
uuuuagauaguuuaacugcacu

SEQ ID NO: 664525 - RNA, 22 nt, Human
aaaguuagaaugauaucaacga

SEQ ID NO: 664526 - RNA, 22 nt, Human
cagcugagaaauggggaaaggg

SEQ ID NO: 664527 - RNA, 22 nt, Human
ucuuugaaaagauauuccuccu

SEQ ID NO: 664528 - RNA, 22 nt, Human
aagcugcccuguguuagaguuc

SEQ ID NO: 664529 - RNA, 22 nt, Human
ucagggacugcagagggaagcu

SEQ ID NO: 664530 - RNA, 22 nt, Human
aguguggagccacugaguggcu

SEQ ID NO: 664531 - RNA, 22 nt, Human
ucuggcucauaggaaggccauu

SEQ ID NO: 664532 - RNA, 22 nt, Human
auccaggcuuaaugggagccac

SEQ ID NO: 664533 - RNA, 19 nt, Human
ugugccucuauagcaugug

SEQ ID NO: 664534 - RNA, 22 nt, Human
agugaacuguggcccgugaacu

SEQ ID NO: 664535 - RNA, 22 nt, Human
guccagcaggaugcaagugcca

SEQ ID NO: 664536 - RNA, 22 nt, Human
ugaaggcagcaugcacacuagu

SEQ ID NO: 664537 - RNA, 22 nt, Human
gcuguguguucaauaaugugau

SEQ ID NO: 664538 - RNA, 22 nt, Human
uauacaguuaaguuucuucagu

SEQ ID NO: 664539 - RNA, 22 nt, Human
ggccacuccgcugcuacuggaa

SEQ ID NO: 664540 - RNA, 22 nt, Human
uuguuucagcuguaugcuaugu

SEQ ID NO: 664541 - RNA, 22 nt, Human
uuagacauagaauauugucuag

SEQ ID NO: 664542 - RNA, 17 nt, Human
agccccucagcgucacc

SEQ ID NO: 664543 - RNA, 22 nt, Human
ucucauuuugagucagacacua

SEQ ID NO: 664544 - RNA, 22 nt, Human
ucuccaagcagggcugcaaggc

SEQ ID NO: 664545 - RNA, 23 nt, Human
ugauuuuaaaaaguaaguuauca

SEQ ID NO: 664546 - RNA, 22 nt, Human
ggaaggaagaggaccgagcugg

SEQ ID NO: 664547 - RNA, 22 nt, Human
aaggaucauaguaaacauugau

SEQ ID NO: 664548 - RNA, 22 nt, Human
agccucagcacgcagcucugug

SEQ ID NO: 664549 - RNA, 22 nt, Human
uuauuuguggcauccauguugg

SEQ ID NO: 664550 - RNA, 22 nt, Human
ucugccugcggcugcagguggc

SEQ ID NO: 664551 - RNA, 22 nt, Human
agugucuuuauagacugacaau

SEQ ID NO: 664552 - RNA, 22 nt, Human
gaaaugcauaaucuuaguagau

SEQ ID NO: 664553 - RNA, 22 nt, Human
aagccgggccugagaaaugaca

SEQ ID NO: 664554 - RNA, 22 nt, Human
gaacaguauuuccaggaauccc

SEQ ID NO: 664555 - RNA, 23 nt, Human
ugaggagcauagcugacugacag

SEQ ID NO: 664556 - RNA, 22 nt, Human
gcaggagcaaacugcagugugg

SEQ ID NO: 664557 - RNA, 22 nt, Human
gccaggcuggggggagaugucu

SEQ ID NO: 664558 - RNA, 22 nt, Human
uggggugggguuacucauucug

SEQ ID NO: 664559 - RNA, 22 nt, Human
ccugggaaggggaagagaauuc

SEQ ID NO: 664560 - RNA, 22 nt, Human
aguguuuauggaaucuuaguua

SEQ ID NO: 664561 - RNA, 22 nt, Human
uuagucucuuugcauugccaua

SEQ ID NO: 664562 - RNA, 22 nt, Human
ccaguugguuucaaugggacag

SEQ ID NO: 664563 - RNA, 22 nt, Human
uggaaagagaaacucuugcuaa

SEQ ID NO: 664564 - RNA, 22 nt, Human
ugggccucggggaagcccgugu

SEQ ID NO: 664565 - RNA, 22 nt, Human
guacaggaccgcggcccccugg

SEQ ID NO: 664566 - RNA, 22 nt, Human
uggguccacggaagacuuaggg

SEQ ID NO: 664567 - RNA, 22 nt, Human
agggcagagagaugaaugggau

SEQ ID NO: 664568 - RNA, 22 nt, Human
ccuggcaggcaagaggaaggga

SEQ ID NO: 664569 - RNA, 22 nt, Human
uuaaaucaguaggcuacuccuu

SEQ ID NO: 664570 - RNA, 18 nt, Human
acauugauggcuuuaagc

SEQ ID NO: 664571 - RNA, 22 nt, Human
acuucuucuucagcugggggau

SEQ ID NO: 664572 - RNA, 22 nt, Human
aacgugcauuaggaccucucca

SEQ ID NO: 664573 - RNA, 22 nt, Human
uccaauaacaucuaaaaacuua

SEQ ID NO: 664574 - RNA, 22 nt, Human
gaugauuuuguuggugauucaa

SEQ ID NO: 664575 - RNA, 22 nt, Human
aagugcaugguauggucuccau

SEQ ID NO: 664576 - RNA, 22 nt, Human
agcuccagccucuucuggaggu

SEQ ID NO: 664577 - RNA, 22 nt, Human
cauuaaguauuucaguuacugu

SEQ ID NO: 664578 - RNA, 20 nt, Human
gaugacauacucacuuaggg

SEQ ID NO: 664579 - RNA, 22 nt, Human
uccucugaauguacuucauaau

SEQ ID NO: 664580 - RNA, 22 nt, Human
uacaacauguaaagugguuuaa

SEQ ID NO: 664581 - RNA, 22 nt, Human
gccagcugcccucugcuggucc

SEQ ID NO: 664582 - RNA, 22 nt, Human
accucucugggccugcuuccug

SEQ ID NO: 664583 - RNA, 20 nt, Human
ccacuccaggugauucugau

SEQ ID NO: 664584 - RNA, 19 nt, Human
augcuuuauguuauuucuu

SEQ ID NO: 664585 - RNA, 22 nt, Human
uguacaaagaguauagcuuuga

SEQ ID NO: 664586 - RNA, 18 nt, Human
cagaaguccuucaaggcc

SEQ ID NO: 664587 - RNA, 22 nt, Human
ugagcacauuucacaugacagg

SEQ ID NO: 664588 - RNA, 22 nt, Human
aucucccacaggcugcuacuuc

SEQ ID NO: 664589 - RNA, 22 nt, Human
uuucuacagcuggugcaacuuu

SEQ ID NO: 664590 - RNA, 22 nt, Human
guccugggagaugggacccuga

SEQ ID NO: 664591 - RNA, 22 nt, Human
cuuuauguucaguacaaugcuu

SEQ ID NO: 664592 - RNA, 22 nt, Human
uucauucugggcucuaaggaac

SEQ ID NO: 664593 - RNA, 22 nt, Human
cacauacaaugguguuauuugg

SEQ ID NO: 664594 - RNA, 22 nt, Human
uggcuggaggaaggaacugagg

SEQ ID NO: 664595 - RNA, 20 nt, Human
cacagacuguaugggcacca

SEQ ID NO: 664596 - RNA, 22 nt, Human
gcucagagcaucccagugaaug

SEQ ID NO: 664597 - RNA, 18 nt, Human
ccucaggggaccuggcag

SEQ ID NO: 664598 - RNA, 22 nt, Human
uaacagaaaagaacugaguuug

SEQ ID NO: 664599 - RNA, 22 nt, Human
gaagaagggagugacaaaugca

SEQ ID NO: 664600 - RNA, 20 nt, Human
guggccuguccuguuguggg

SEQ ID NO: 664601 - RNA, 22 nt, Human
acugaauauauuccauugcaug

SEQ ID NO: 664602 - RNA, 21 nt, Human
uuuagggaccaggucauaggc

SEQ ID NO: 664603 - RNA, 22 nt, Human
acugggaaccugugcuaggagg

SEQ ID NO: 664604 - RNA, 18 nt, Human
ugcuccaggcccaugggc

SEQ ID NO: 664605 - RNA, 22 nt, Human
cugcugugagugguucuugccu

SEQ ID NO: 664606 - RNA, 22 nt, Human
agcccugagccagccuggucag

SEQ ID NO: 664607 - RNA, 22 nt, Human
uguaggaauguuuuuaaguugg

SEQ ID NO: 664608 - RNA, 22 nt, Human
ggagcugagcagcgauggcgga

SEQ ID NO: 664609 - RNA, 22 nt, Human
ugggcagucaucagcacaccgg

SEQ ID NO: 664610 - RNA, 22 nt, Human
cagggcuccaugcagggacucc

SEQ ID NO: 664611 - RNA, 22 nt, Human
cugggacuugaugaaaugacug

SEQ ID NO: 664612 - RNA, 22 nt, Human
ugggaagaugauaauucacagu

SEQ ID NO: 664613 - RNA, 19 nt, Human
ccugggccuccaucacccc

SEQ ID NO: 664614 - RNA, 23 nt, Human
gggagaugggaaaugaaggcucu

SEQ ID NO: 664615 - RNA, 22 nt, Human
uaaagauguucucauuucauag

SEQ ID NO: 664616 - RNA, 22 nt, Human
gaugucuuggcuugcucucugu

SEQ ID NO: 664617 - RNA, 22 nt, Human
acacauguauguuuuguauuug

SEQ ID NO: 664618 - RNA, 22 nt, Human
ucuguggccuguguccaagugc

SEQ ID NO: 664619 - RNA, 22 nt, Human
gggcauggugcugguguucaug

SEQ ID NO: 664620 - RNA, 22 nt, Human
aaguuuuaugggaagaugugca

SEQ ID NO: 664621 - RNA, 22 nt, Human
gggcagcacucauaccuauauu

SEQ ID NO: 664622 - RNA, 22 nt, Human
uucuuuguuguacuuuccuaca

SEQ ID NO: 664623 - RNA, 22 nt, Human
ugcccuggcgcugucucuaugg

SEQ ID NO: 664624 - RNA, 22 nt, Human
gacccuggugggcacuggcacc

SEQ ID NO: 664625 - RNA, 22 nt, Human
accuuuaugauucacaauguau

SEQ ID NO: 664626 - RNA, 22 nt, Human
ccaaauaauauuucagaaccau

SEQ ID NO: 664627 - RNA, 22 nt, Human
acucucccugagagggaggcau

SEQ ID NO: 664628 - RNA, 22 nt, Human
ucacuacugacagagaugugua

SEQ ID NO: 664629 - RNA, 22 nt, Human
ucuguucaucaucuggacacau

SEQ ID NO: 664630 - RNA, 19 nt, Human
uagagcugcuuccuggcag

SEQ ID NO: 664631 - RNA, 22 nt, Human
cugggcaggauacuucauggga

SEQ ID NO: 664632 - RNA, 22 nt, Human
caguagggaaugugggaggcug

SEQ ID NO: 664633 - RNA, 22 nt, Human
gaagcaguauccugacagcacc

SEQ ID NO: 664634 - RNA, 22 nt, Human
gaggcuguaaguguggagccua

SEQ ID NO: 664635 - RNA, 22 nt, Human
uguucacaagcagauguugcuu

SEQ ID NO: 664636 - RNA, 22 nt, Human
uagcagcucuuuacuaaccagu

SEQ ID NO: 664637 - RNA, 22 nt, Human
uuacaaacugucauauaguauu

SEQ ID NO: 664638 - RNA, 22 nt, Human
ggcuggaagguagaagaugagg

SEQ ID NO: 664639 - RNA, 22 nt, Human
ugcaacuaggagguucuuagcu

SEQ ID NO: 664640 - RNA, 22 nt, Human
uuucuugauuagcuguggcuca

SEQ ID NO: 664641 - RNA, 22 nt, Human
ggcugcggaucuaaggcuggga

SEQ ID NO: 664642 - RNA, 20 nt, Human
agcuggagaagggcccuucc

SEQ ID NO: 664643 - RNA, 21 nt, Human
caguagugcgucgcagaggac

SEQ ID NO: 664644 - RNA, 22 nt, Human
uaggaagagcuauaggucccca

SEQ ID NO: 664645 - RNA, 22 nt, Human
gcacagagccugguaccgagaa

SEQ ID NO: 664646 - RNA, 22 nt, Human
acauccaugcaugucugugcac

SEQ ID NO: 664647 - RNA, 22 nt, Human
uaaguuaucggaguguguuuca

SEQ ID NO: 664648 - RNA, 22 nt, Human
agucugucucugcuaaucacua

SEQ ID NO: 664649 - RNA, 19 nt, Human
uccuuugaauaucaguuga

SEQ ID NO: 664650 - RNA, 22 nt, Human
ugugcuccaucauccauaaucu

SEQ ID NO: 664651 - RNA, 22 nt, Human
acuuggauauguucacuagacc

SEQ ID NO: 664652 - RNA, 22 nt, Human
gucaggauuauuuuauuaaaag

SEQ ID NO: 664653 - RNA, 18 nt, Human
aucuuaacuugauggagu

SEQ ID NO: 664654 - RNA, 22 nt, Human
uucagcaccuggaauagcaccu

SEQ ID NO: 664655 - RNA, 17 nt, Human
aggcaaugacugugguu

SEQ ID NO: 664656 - RNA, 22 nt, Human
gagcucccaggccccagcaagg

SEQ ID NO: 664657 - RNA, 22 nt, Human
uaagcaguuuuucuuguauuaa

SEQ ID NO: 664658 - RNA, 22 nt, Human
acauucaaaauauuucugaugu

SEQ ID NO: 664659 - RNA, 22 nt, Human
auaaugcgaggagaaaaugaag

SEQ ID NO: 664660 - RNA, 22 nt, Human
uugaauaauuaauuacacucag

SEQ ID NO: 664661 - RNA, 22 nt, Human
gucagcagaaacgccacaugca

SEQ ID NO: 664662 - RNA, 22 nt, Human
cucccugaggacaggcccuguc

SEQ ID NO: 664663 - RNA, 22 nt, Human
acaggcugaggaugauugcauc

SEQ ID NO: 664664 - RNA, 21 nt, Human
acaugggaccugcgaaaggaa

SEQ ID NO: 664665 - RNA, 22 nt, Human
ucaguguguacacugagcauuu

SEQ ID NO: 664666 - RNA, 22 nt, Human
ucagugcaggaauuuccuuaga

SEQ ID NO: 664667 - RNA, 22 nt, Human
uggggcuguggauucucacgaa

SEQ ID NO: 664668 - RNA, 20 nt, Human
cuggcaggagcgagucuacc

SEQ ID NO: 664669 - RNA, 22 nt, Human
uugaaaggguuaaagugguaaa

SEQ ID NO: 664670 - RNA, 22 nt, Human
gggcugagagugacuguucugu

SEQ ID NO: 664671 - RNA, 22 nt, Human
guggcagagggugagcuggacu

SEQ ID NO: 664672 - RNA, 22 nt, Human
uuccucaggcugcuuucacaua

SEQ ID NO: 664673 - RNA, 22 nt, Human
aggaggugcuguuuguccugga

SEQ ID NO: 664674 - RNA, 22 nt, Human
gagacacagcagauauucaauc

SEQ ID NO: 664675 - RNA, 22 nt, Human
gccaggcuggucuugaacuccu

SEQ ID NO: 664676 - RNA, 22 nt, Human
cucuggccugcuuccucaggua

SEQ ID NO: 664677 - RNA, 22 nt, Human
agaggguggugaggccugguuc

SEQ ID NO: 664678 - RNA, 22 nt, Human
ucaaagucucugcuucuguaac

SEQ ID NO: 664679 - RNA, 22 nt, Human
gugcaaaaguaaaugugguuuu

SEQ ID NO: 664680 - RNA, 22 nt, Human
ugcacacauucuauggggcuga

SEQ ID NO: 664681 - RNA, 22 nt, Human
uaauacagaaguguauuaaaau

SEQ ID NO: 664682 - RNA, 22 nt, Human
uucucagaggagucgggagcug

SEQ ID NO: 664683 - RNA, 22 nt, Human
ucugggcagaagcagugcaaag

SEQ ID NO: 664684 - RNA, 23 nt, Human
acauccaugaaucaucugcuuuc

SEQ ID NO: 664685 - RNA, 22 nt, Human
ggaaagcuuuguuuuccucacc

SEQ ID NO: 664686 - RNA, 22 nt, Human
ugggcugcacccucagccucug

SEQ ID NO: 664687 - RNA, 22 nt, Human
auaaaacuuauuagaauugugu

SEQ ID NO: 664688 - RNA, 22 nt, Human
uccagguaugacaggccacucc

SEQ ID NO: 664689 - RNA, 22 nt, Human
caggaaauaucuccuggcagag

SEQ ID NO: 664690 - RNA, 22 nt, Human
acauugaauguaugugaugaaa

SEQ ID NO: 664691 - RNA, 22 nt, Human
aaccaagcucaauggucugagu

SEQ ID NO: 664692 - RNA, 22 nt, Human
aagagcacuaacagagcugaua

SEQ ID NO: 664693 - RNA, 22 nt, Human
ugcauugagucauuucaguaug

SEQ ID NO: 664694 - RNA, 22 nt, Human
gugauuaagcauuucagaauuu

SEQ ID NO: 664695 - RNA, 22 nt, Human
uaaguucugaguaaauacuguu

SEQ ID NO: 664696 - RNA, 22 nt, Human
ucagggcugcauacaggagaua

SEQ ID NO: 664697 - RNA, 22 nt, Human
ccagugccuaucuccucuggga

SEQ ID NO: 664698 - RNA, 22 nt, Human
uuuagugauaagaauuaugaaa

SEQ ID NO: 664699 - RNA, 22 nt, Human
aggcauauacucucagaaaaaa

SEQ ID NO: 664700 - RNA, 22 nt, Human
uuccuggccucucucugagcag

SEQ ID NO: 664701 - RNA, 22 nt, Human
agaggcucuaauaccagcaugg

SEQ ID NO: 664702 - RNA, 22 nt, Human
cagugggaagggcagaggcuuu

SEQ ID NO: 664703 - RNA, 22 nt, Human
agaccauggccauccuaggaaa

SEQ ID NO: 664704 - RNA, 22 nt, Human
cagggcagggagcuuagaauga

SEQ ID NO: 664705 - RNA, 22 nt, Human
cucuucccagcuccacgagagg

SEQ ID NO: 664706 - RNA, 22 nt, Human
ggcucuguucuaaauuaauaag

SEQ ID NO: 664707 - RNA, 22 nt, Human
auggcuguuuagcuucucugcu

SEQ ID NO: 664708 - RNA, 22 nt, Human
ugcauauuauguguaucugucu

SEQ ID NO: 664709 - RNA, 22 nt, Human
aggcuccuaucgcuuucagcaa

SEQ ID NO: 664710 - RNA, 22 nt, Human
agaucacagcccccagaugcca

SEQ ID NO: 664711 - RNA, 22 nt, Human
uaggaaaugcugucuuauugua

SEQ ID NO: 664712 - RNA, 22 nt, Human
gaugaaaugcugagccugaguu

SEQ ID NO: 664713 - RNA, 18 nt, Human
cagagcaguaugaauguu

SEQ ID NO: 664714 - RNA, 22 nt, Human
aggccacagagagugcaugugc

SEQ ID NO: 664715 - RNA, 22 nt, Human
gauuuagagaauguuuuguaag

SEQ ID NO: 664716 - RNA, 21 nt, Human
ugaagggguggcagugugcuu

SEQ ID NO: 664717 - RNA, 22 nt, Human
ucuguguuugccauccuugcuc

SEQ ID NO: 664718 - RNA, 22 nt, Human
uuucuuguaaaagcugugggaa

SEQ ID NO: 664719 - RNA, 22 nt, Human
caguaaguauucgagucuccau

SEQ ID NO: 664720 - RNA, 22 nt, Human
ucuggaaugaaugagguucugu

SEQ ID NO: 664721 - RNA, 22 nt, Human
uugaagcaaauucugugcagua

SEQ ID NO: 664722 - RNA, 22 nt, Human
cucuggaguucuucaagcuacu

SEQ ID NO: 664723 - RNA, 22 nt, Human
caguggccuuuccugcugcuca

SEQ ID NO: 664724 - RNA, 22 nt, Human
ccugcaagagcggagaagccag

SEQ ID NO: 664725 - RNA, 22 nt, Human
ccaggguugcuguauggcacuu

SEQ ID NO: 664726 - RNA, 20 nt, Human
uacagccccugcuucuguug

SEQ ID NO: 664727 - RNA, 22 nt, Human
aggaacccggucugucacugug

SEQ ID NO: 664728 - RNA, 22 nt, Human
accaaaggcagagcugaacacu

SEQ ID NO: 664729 - RNA, 22 nt, Human
ggagcucuccugaugugaagau

SEQ ID NO: 664730 - RNA, 22 nt, Human
cuguguagagcggcugcgagcg

SEQ ID NO: 664731 - RNA, 22 nt, Human
aaacauguuuagaaagcagcug

SEQ ID NO: 664732 - RNA, 22 nt, Human
uccuggaggggacagcaugggc

SEQ ID NO: 664733 - RNA, 22 nt, Human
aagauuuccauuucuagcucau

SEQ ID NO: 664734 - RNA, 22 nt, Human
cccaggcuggauuucgguggca

SEQ ID NO: 664735 - RNA, 22 nt, Human
agagggggugucagcacugcag

SEQ ID NO: 664736 - RNA, 22 nt, Human
aaacaguggccaauucuggaga

SEQ ID NO: 664737 - RNA, 22 nt, Human
ucaggcaggcagagggcaaaug

SEQ ID NO: 664738 - RNA, 22 nt, Human
ggagaggggaacuuguugcuug

SEQ ID NO: 664739 - RNA, 22 nt, Human
aucugaguguuggauuuauugu

SEQ ID NO: 664740 - RNA, 22 nt, Human
gcccugggcucccugcuccaca

SEQ ID NO: 664741 - RNA, 22 nt, Human
aggaaggugcaguagggugugc

SEQ ID NO: 664742 - RNA, 22 nt, Human
uguguccugcagacagacucag

SEQ ID NO: 664743 - RNA, 22 nt, Human
aggacccugaggucuccuguga

SEQ ID NO: 664744 - RNA, 22 nt, Human
guggaugauugacucuguagac

SEQ ID NO: 664745 - RNA, 22 nt, Human
uaggcagaauucauugugcugc

SEQ ID NO: 664746 - RNA, 22 nt, Human
cagaggggcugacacccuuggc

SEQ ID NO: 664747 - RNA, 22 nt, Human
cugaggcauguuacaggacaua

SEQ ID NO: 664748 - RNA, 22 nt, Human
cuggaauaaacgaucuucagca

SEQ ID NO: 664749 - RNA, 22 nt, Human
cugggcuguaauguggcacuga

SEQ ID NO: 664750 - RNA, 17 nt, Human
uuacagcagcaauagag

SEQ ID NO: 664751 - RNA, 22 nt, Human
ucgcugugaaaaccuuggacaa

SEQ ID NO: 664752 - RNA, 22 nt, Human
uugauuugauuguaauggcucu

SEQ ID NO: 664753 - RNA, 22 nt, Human
cacagaaucggccgauggugcu

SEQ ID NO: 664754 - RNA, 22 nt, Human
auggaguuuggggucaaauacu

SEQ ID NO: 664755 - RNA, 22 nt, Human
agaaaaguuuucugagacugac

SEQ ID NO: 664756 - RNA, 22 nt, Human
aggcagguccccuggaaggcac

SEQ ID NO: 664757 - RNA, 22 nt, Human
cagccucuaagcacagccucuc

SEQ ID NO: 664758 - RNA, 18 nt, Human
aggcaggugcuggaaguc

SEQ ID NO: 664759 - RNA, 22 nt, Human
ucaguuuuuacggucacaggga

SEQ ID NO: 664760 - RNA, 22 nt, Human
agacccccuuuaauggaagugc

SEQ ID NO: 664761 - RNA, 21 nt, Human
aggccucuucauggccaugau

SEQ ID NO: 664762 - RNA, 22 nt, Human
auacaucuaugccuuucugaca

SEQ ID NO: 664763 - RNA, 22 nt, Human
gauaacauuuugaagugcuagu

SEQ ID NO: 664764 - RNA, 22 nt, Human
agcuuuauuaacucuccaggug

SEQ ID NO: 664765 - RNA, 22 nt, Human
caguuaaaaugugcuauaagaa

SEQ ID NO: 664766 - RNA, 22 nt, Human
gcuggggugugguggauaagcu

SEQ ID NO: 664767 - RNA, 22 nt, Human
acauacauggugcuuucuuggu

SEQ ID NO: 664768 - RNA, 21 nt, Human
aagucagucaguucuauacua

SEQ ID NO: 664769 - RNA, 22 nt, Human
ugcagggcacggugcgcguggg

SEQ ID NO: 664770 - RNA, 22 nt, Human
auuuccauuuucagccauuacu

SEQ ID NO: 664771 - RNA, 22 nt, Human
aaacaucauaggcaugcaugau

SEQ ID NO: 664772 - RNA, 22 nt, Human
agcagcuguggggacaagggua

SEQ ID NO: 664773 - RNA, 22 nt, Human
ugcaggacucaaggguagcagg

SEQ ID NO: 664774 - RNA, 22 nt, Human
agccccccaagggccuucucuu

SEQ ID NO: 664775 - RNA, 22 nt, Human
uuacuguguuuggcuuuagaug

SEQ ID NO: 664776 - RNA, 22 nt, Human
agggccaggaacaccugaaggg

SEQ ID NO: 664777 - RNA, 22 nt, Human
uuuccucuaaacgcauuugcuu

SEQ ID NO: 664778 - RNA, 22 nt, Human
uccucaggaucuaggagugcuu

SEQ ID NO: 664779 - RNA, 22 nt, Human
cuucaauugccaccagcuagca

SEQ ID NO: 664780 - RNA, 22 nt, Human
auguucuauaucauuauuguga

SEQ ID NO: 664781 - RNA, 22 nt, Human
uuuacauggaauauugucuugu

SEQ ID NO: 664782 - RNA, 22 nt, Human
gucuggaagggagugcauuuuc

SEQ ID NO: 664783 - RNA, 22 nt, Human
ugacacauuaaaugcucacaaa

SEQ ID NO: 664784 - RNA, 22 nt, Human
auguguuuauaauuacucaauc

SEQ ID NO: 664785 - RNA, 22 nt, Human
guggccuuucuugggcuacaga

SEQ ID NO: 664786 - RNA, 21 nt, Human
ugcauuuaacagaaacaggaa

SEQ ID NO: 664787 - RNA, 22 nt, Human
ugugggaggauucagaauuggg

SEQ ID NO: 664788 - RNA, 22 nt, Human
ccauuguaaauucuguggaagu

SEQ ID NO: 664789 - RNA, 22 nt, Human
uccaggagguugagugaguucc

SEQ ID NO: 664790 - RNA, 22 nt, Human
aaagguuuucuaggguugaggg

SEQ ID NO: 664791 - RNA, 22 nt, Human
gcauuuguguggcggaaggauu

SEQ ID NO: 664792 - RNA, 22 nt, Human
gcaaauugggaaauuucucuag

SEQ ID NO: 664793 - RNA, 22 nt, Human
cucagcuucuaccuccugagug

SEQ ID NO: 664794 - RNA, 22 nt, Human
ucuguccagaacguacaucuug

SEQ ID NO: 664795 - RNA, 22 nt, Human
cugggcuggcgcauccgacacg

SEQ ID NO: 664796 - RNA, 22 nt, Human
augcaguacauacaaacacuga

SEQ ID NO: 664797 - RNA, 22 nt, Human
gucaguucauuagcacuuccaa

SEQ ID NO: 664798 - RNA, 19 nt, Human
cacaugagggcugagggac

SEQ ID NO: 664799 - RNA, 22 nt, Human
uucucuuuuagaggcuccauga

SEQ ID NO: 664800 - RNA, 19 nt, Human
uguggggagucagggggcu

SEQ ID NO: 664801 - RNA, 22 nt, Human
ugaaugaucuccgauuaguccu

SEQ ID NO: 664802 - RNA, 22 nt, Human
uacacuguguaaaaugcacuuu

SEQ ID NO: 664803 - RNA, 22 nt, Human
cagcgaggugaaggguacaagc

SEQ ID NO: 664804 - RNA, 22 nt, Human
uucucaguaguuagcauuugug

SEQ ID NO: 664805 - RNA, 22 nt, Human
cauggcuuguaauaaauuuaua

SEQ ID NO: 664806 - RNA, 22 nt, Human
aauguuuucccagugcagacga

SEQ ID NO: 664807 - RNA, 22 nt, Human
cagccuccugggacacucaccg

SEQ ID NO: 664808 - RNA, 22 nt, Human
agagggcuggacgcagguugga

SEQ ID NO: 664809 - RNA, 22 nt, Human
uugguuuagagagugugguuac

SEQ ID NO: 664810 - RNA, 22 nt, Human
ugucuucauucuguauguccag

SEQ ID NO: 664811 - RNA, 22 nt, Human
uucaaaaguaaucaguauuaga

SEQ ID NO: 664812 - RNA, 22 nt, Human
auguaugcaugcuacaguuuuc

SEQ ID NO: 664813 - RNA, 18 nt, Human
auccauuuaaugccugga

SEQ ID NO: 664814 - RNA, 22 nt, Human
uaaagaugcuauagugaaggag

SEQ ID NO: 664815 - RNA, 22 nt, Human
gacauucacaguuuccgauggu

SEQ ID NO: 664816 - RNA, 22 nt, Human
gaauuccacuuuggcuuuuggg

SEQ ID NO: 664817 - RNA, 22 nt, Human
uauauucacuuguguccaacca

SEQ ID NO: 664818 - RNA, 22 nt, Human
cuccgcagcgggccaauccgga

SEQ ID NO: 664819 - RNA, 22 nt, Human
caggagcaugcugaugccagaa

SEQ ID NO: 664820 - RNA, 22 nt, Human
accaucagagcacaguccgugc

SEQ ID NO: 664821 - RNA, 22 nt, Human
gcagcugccgugagcucacgcc

SEQ ID NO: 664822 - RNA, 22 nt, Human
cguggcuggggcgacuccacgg

SEQ ID NO: 664823 - RNA, 22 nt, Human
uugggcuuuaauuccagagagg

SEQ ID NO: 664824 - RNA, 22 nt, Human
gcccagggcgauggucggggcc

SEQ ID NO: 664825 - RNA, 22 nt, Human
augcauuuguaaaauauaaucg

SEQ ID NO: 664826 - RNA, 22 nt, Human
ggcuuugcuucuccagaugcuu

SEQ ID NO: 664827 - RNA, 22 nt, Human
ggccuggacaccugaggucuua

SEQ ID NO: 664828 - RNA, 22 nt, Human
auuacuccuuuucuagcaggug

SEQ ID NO: 664829 - RNA, 22 nt, Human
agcugaagcagucaguucagcu

SEQ ID NO: 664830 - RNA, 22 nt, Human
ggccugaggcgucccagcugug

SEQ ID NO: 664831 - RNA, 22 nt, Human
acaggcacaccuuccugcaggc

SEQ ID NO: 664832 - RNA, 22 nt, Human
gcugccaauccagcugugggag

SEQ ID NO: 664833 - RNA, 22 nt, Human
uccccacacuuucacuccuggc

SEQ ID NO: 664834 - RNA, 22 nt, Human
cucuccagagcccuuccggccc

SEQ ID NO: 664835 - RNA, 22 nt, Human
gcaguggcagcugaggggguau

SEQ ID NO: 664836 - RNA, 23 nt, Human
gugcuuuaugaucugcugucccu

SEQ ID NO: 664837 - RNA, 20 nt, Human
auagaaguauuauguaaugu

SEQ ID NO: 664838 - RNA, 16 nt, Human
uucucugggguugugc

SEQ ID NO: 664839 - RNA, 17 nt, Human
gagccacccugugcgag

SEQ ID NO: 664840 - RNA, 22 nt, Human
guacucucuugaaggccuuucu

SEQ ID NO: 664841 - RNA, 19 nt, Human
ugagccagggaggccaugc

SEQ ID NO: 664842 - RNA, 22 nt, Human
cuaacuuugucaucuucccuuu

SEQ ID NO: 664843 - RNA, 22 nt, Human
aggcucugggaagcagugaguu

SEQ ID NO: 664844 - RNA, 22 nt, Human
uagcagcuguggaggggcugug

SEQ ID NO: 664845 - RNA, 22 nt, Human
ggaucaggcugaagcuaggacu

SEQ ID NO: 664846 - RNA, 23 nt, Human
gucagggcuggggucagagugac

SEQ ID NO: 664847 - RNA, 20 nt, Human
agaguuuggggucauuuugg

SEQ ID NO: 664848 - RNA, 22 nt, Human
uuuagcaaauuagcaccucuaa

SEQ ID NO: 664849 - RNA, 22 nt, Human
acagugucugacacauuguagc

SEQ ID NO: 664850 - RNA, 23 nt, Human
ggacacaggccuugucugcgccu

SEQ ID NO: 664851 - RNA, 22 nt, Human
ucucugaagaaucgaugauucu

SEQ ID NO: 664852 - RNA, 22 nt, Human
uugcugaucugugaaucagcca

SEQ ID NO: 664853 - RNA, 22 nt, Human
agccuggacagcuacggagaac

SEQ ID NO: 664854 - RNA, 22 nt, Human
cucugugcccuacugcucagcu

SEQ ID NO: 664855 - RNA, 22 nt, Human
cuuaacauccugcauuuuucuu

SEQ ID NO: 664856 - RNA, 22 nt, Human
uagcaaagaagauauuauugca

SEQ ID NO: 664857 - RNA, 22 nt, Human
ugcagggaaaguguuggcagca

SEQ ID NO: 664858 - RNA, 22 nt, Human
cugcccaccccgaggcaggaag

SEQ ID NO: 664859 - RNA, 22 nt, Human
cugggguggauggguccaaguu

SEQ ID NO: 664860 - RNA, 22 nt, Human
uggccuggcucacagugagauu

SEQ ID NO: 664861 - RNA, 22 nt, Human
ucacagugacuuacagagauug

SEQ ID NO: 664862 - RNA, 22 nt, Human
aggcuguggaugcuuaacaaau

SEQ ID NO: 664863 - RNA, 22 nt, Human
ugcuggcccaguauggacugca

SEQ ID NO: 664864 - RNA, 22 nt, Human
aguacaauuuaaugaagauagc

SEQ ID NO: 664865 - RNA, 22 nt, Human
cugcagggcagaagggcauaga

SEQ ID NO: 664866 - RNA, 22 nt, Human
cucccguggauguucuucaguc

SEQ ID NO: 664867 - RNA, 22 nt, Human
uagaaaucuacuuagacuuucu

SEQ ID NO: 664868 - RNA, 22 nt, Human
cauguaaaccauugugagcauc

SEQ ID NO: 664869 - RNA, 22 nt, Human
ccacuuugaaccacugaggugg

SEQ ID NO: 664870 - RNA, 19 nt, Human
agccaggguccagacaugu

SEQ ID NO: 664871 - RNA, 22 nt, Human
caggacacaggguguggcugau

SEQ ID NO: 664872 - RNA, 22 nt, Human
ccugaccauuugccacaugggu

SEQ ID NO: 664873 - RNA, 22 nt, Human
auggcccuggcccagaccccac

SEQ ID NO: 664874 - RNA, 22 nt, Human
gaucaucuuuuccugcuuccag

SEQ ID NO: 664875 - RNA, 22 nt, Human
uaauggcagagucaugcuuucu

SEQ ID NO: 664876 - RNA, 22 nt, Human
guggagacuucuacuagagacc

SEQ ID NO: 664877 - RNA, 21 nt, Human
ggugucaguuuuggucauuag

SEQ ID NO: 664878 - RNA, 22 nt, Human
ucagggagagugacccauccac

SEQ ID NO: 664879 - RNA, 22 nt, Human
cagggcugaacugagcuuguga

SEQ ID NO: 664880 - RNA, 22 nt, Human
cagcuguguaugagagcaugcu

SEQ ID NO: 664881 - RNA, 20 nt, Human
acugggccuaggggaggcau

SEQ ID NO: 664882 - RNA, 22 nt, Human
gaagucuggcugacgagaguua

SEQ ID NO: 664883 - RNA, 18 nt, Human
ucuccuuccaaaucuuca

SEQ ID NO: 664884 - RNA, 22 nt, Human
uggaaauauacaaugugucucu

SEQ ID NO: 664885 - RNA, 21 nt, Human
cugcuguggcccccgacaugc

SEQ ID NO: 664886 - RNA, 22 nt, Human
aaagucaaaaugcucuccuguc

SEQ ID NO: 664887 - RNA, 21 nt, Human
agucacauuggggguuuaggg

SEQ ID NO: 664888 - RNA, 22 nt, Human
cagcugccugucuggaggcaau

SEQ ID NO: 664889 - RNA, 22 nt, Human
agugauggggcccugcacugau

SEQ ID NO: 664890 - RNA, 22 nt, Human
uucucucuuccaguucccacuu

SEQ ID NO: 664891 - RNA, 22 nt, Human
uuguguggauaauauuacuuga

SEQ ID NO: 664892 - RNA, 19 nt, Human
auucuucucaaauauccau

SEQ ID NO: 664893 - RNA, 19 nt, Human
ugcuuucuaaacacaugca

SEQ ID NO: 664894 - RNA, 22 nt, Human
agcugguggggaagcugcaggu

SEQ ID NO: 664895 - RNA, 22 nt, Human
uuguaacuuugcauacuccugu

SEQ ID NO: 664896 - RNA, 22 nt, Human
gcugcuucucugauggagucca

SEQ ID NO: 664897 - RNA, 22 nt, Human
ggcccaaggugccaaggccucc

SEQ ID NO: 664898 - RNA, 22 nt, Human
aggacacuuggcuauuguucca

SEQ ID NO: 664899 - RNA, 21 nt, Human
ucugggaaauugggaaagaag

SEQ ID NO: 664900 - RNA, 22 nt, Human
gccagcucuugaugggugggua

SEQ ID NO: 664901 - RNA, 22 nt, Human
cggggaagcgguucuggcggua

SEQ ID NO: 664902 - RNA, 22 nt, Human
aacaguuugagcuuugaauuuc

SEQ ID NO: 664903 - RNA, 22 nt, Human
augcuucucagcucaaggcaaa

SEQ ID NO: 664904 - RNA, 22 nt, Human
ucagccaggcagcccccugguc

SEQ ID NO: 664905 - RNA, 22 nt, Human
uaaacacugccuugguggguca

SEQ ID NO: 664906 - RNA, 22 nt, Human
uuaggaggucuauggacauccu

SEQ ID NO: 664907 - RNA, 20 nt, Human
uucugggaauuggguagcug

SEQ ID NO: 664908 - RNA, 22 nt, Human
aagaggcuuauagucuuccugu

SEQ ID NO: 664909 - RNA, 22 nt, Human
cagugcaauuacaagcuaauuc

SEQ ID NO: 664910 - RNA, 22 nt, Human
gaggggccuggcacugagcugg

SEQ ID NO: 664911 - RNA, 22 nt, Human
cugcuggugcagaguggggcug

SEQ ID NO: 664912 - RNA, 22 nt, Human
ccaggcucaggccugcucguug

SEQ ID NO: 664913 - RNA, 22 nt, Human
guaguucugcagugucaccuga

SEQ ID NO: 664914 - RNA, 22 nt, Human
ucuccagggugagcuaggccag

SEQ ID NO: 664915 - RNA, 22 nt, Human
aacuuuaaagaggaggcuuggg

SEQ ID NO: 664916 - RNA, 22 nt, Human
acauccaucuucugccugugaa

SEQ ID NO: 664917 - RNA, 22 nt, Human
acagcuguauccccagagcuca

SEQ ID NO: 664918 - RNA, 22 nt, Human
ucaggagugauaccauuuguca

SEQ ID NO: 664919 - RNA, 18 nt, Human
uccugccugugccccagg

SEQ ID NO: 664920 - RNA, 22 nt, Human
uugagaagaggcuuuguaggaa

SEQ ID NO: 664921 - RNA, 22 nt, Human
ucuccaggagcaagucacccag

SEQ ID NO: 664922 - RNA, 22 nt, Human
aggagcucagccugcagggagc

SEQ ID NO: 664923 - RNA, 21 nt, Human
gagcuguuacucucucuggag

SEQ ID NO: 664924 - RNA, 22 nt, Human
agcucuuuugcucuccaaguuu

SEQ ID NO: 664925 - RNA, 22 nt, Human
ugcaauaaagugcuauaaaucc

SEQ ID NO: 664926 - RNA, 22 nt, Human
cuggcuuucuauuuggugcuau

SEQ ID NO: 664927 - RNA, 22 nt, Human
auagcaauggcaacaacuaagc

SEQ ID NO: 664928 - RNA, 22 nt, Human
gaccacagacuggaaagagggc

SEQ ID NO: 664929 - RNA, 22 nt, Human
aggaaaugcugaugcuccugga

SEQ ID NO: 664930 - RNA, 22 nt, Human
ccaggcuguuuucaaacuuggg

SEQ ID NO: 664931 - RNA, 22 nt, Human
agaagcagaaggaagcagggcc

SEQ ID NO: 664932 - RNA, 22 nt, Human
uguaaaucacugaacuaaauga

SEQ ID NO: 664933 - RNA, 22 nt, Human
ugaaggugucuuugugaacauc

SEQ ID NO: 664934 - RNA, 22 nt, Human
cucaggagaugacagaagguau

SEQ ID NO: 664935 - RNA, 22 nt, Human
ugauggucaggaugcauggaga

SEQ ID NO: 664936 - RNA, 22 nt, Human
gauaaagggggaccaaaugacu

SEQ ID NO: 664937 - RNA, 22 nt, Human
gcucagggcgcgagggacgugg

SEQ ID NO: 664938 - RNA, 23 nt, Human
ggcuagaguggaggggaacugca

SEQ ID NO: 664939 - RNA, 18 nt, Human
aggggcagcuugugugga

SEQ ID NO: 664940 - RNA, 22 nt, Human
gcugggcagcugaggccucuca

SEQ ID NO: 664941 - RNA, 22 nt, Human
agagguggccaugggcgcugga

SEQ ID NO: 664942 - RNA, 22 nt, Human
gcagggcagcuuagucccuguc

SEQ ID NO: 664943 - RNA, 22 nt, Human
cagaguguaucuguguaagcau

SEQ ID NO: 664944 - RNA, 22 nt, Human
cauguguguccaugugacuaag

SEQ ID NO: 664945 - RNA, 22 nt, Human
gugcugaggugggugggcagcc

SEQ ID NO: 664946 - RNA, 22 nt, Human
ggcucccuagggagagugggag

SEQ ID NO: 664947 - RNA, 22 nt, Human
cacagcuucuccccgcugcggc

SEQ ID NO: 664948 - RNA, 22 nt, Human
acaguccuguacaggccauauc

SEQ ID NO: 664949 - RNA, 22 nt, Human
uggcucaguagcagugugguca

SEQ ID NO: 664950 - RNA, 21 nt, Human
ggauuuuaaaaacugcaccug

SEQ ID NO: 664951 - RNA, 22 nt, Human
gccucccugagucacccaagca

SEQ ID NO: 664952 - RNA, 22 nt, Human
gugaaauauuuuguuuauguca

SEQ ID NO: 664953 - RNA, 22 nt, Human
uggaacaccuugcuccagaaag

SEQ ID NO: 664954 - RNA, 22 nt, Human
gagcuacugaaauauugauuuu

SEQ ID NO: 664955 - RNA, 22 nt, Human
guaaccugucggaaagccuugu

SEQ ID NO: 664956 - RNA, 22 nt, Human
gaugccucuuuuggcugaauua

SEQ ID NO: 664957 - RNA, 22 nt, Human
aauggcuugcaaauggguccau

SEQ ID NO: 664958 - RNA, 22 nt, Human
agauuuguaugucuaaauguaa

SEQ ID NO: 664959 - RNA, 22 nt, Human
gcucuggccagacccucagugg

SEQ ID NO: 664960 - RNA, 22 nt, Human
gugaaacugcuuuguaaacugu

SEQ ID NO: 664961 - RNA, 22 nt, Human
uuucuuaugugcagagugagua

SEQ ID NO: 664962 - RNA, 22 nt, Human
augugucuucuguggguuugaa

SEQ ID NO: 664963 - RNA, 22 nt, Human
agcugggucuugggccaggaga

SEQ ID NO: 664964 - RNA, 22 nt, Human
uuauagcagcaugauuuacaau

SEQ ID NO: 664965 - RNA, 22 nt, Human
guuuuucuagaaaucuccuccu

SEQ ID NO: 664966 - RNA, 22 nt, Human
ugugccuggcccagugguguca

SEQ ID NO: 664967 - RNA, 20 nt, Human
uacaggaaucaagacugcau

SEQ ID NO: 664968 - RNA, 22 nt, Human
ggcuucuuaaucaugagaguga

SEQ ID NO: 664969 - RNA, 22 nt, Human
aaaagagugacugauaaguaua

SEQ ID NO: 664970 - RNA, 18 nt, Human
ugguggugacagggucau

SEQ ID NO: 664971 - RNA, 19 nt, Human
uggaacaaacugcaaugac

SEQ ID NO: 664972 - RNA, 22 nt, Human
guuuacaguggcuucauuggau

SEQ ID NO: 664973 - RNA, 22 nt, Human
agaaaacucuacaucuguaugu

SEQ ID NO: 664974 - RNA, 22 nt, Human
ccucccaccauuuagagagagc

SEQ ID NO: 664975 - RNA, 22 nt, Human
aaacuccugcauacucagaagc

SEQ ID NO: 664976 - RNA, 22 nt, Human
uacaguuuuuauucaugacaag

SEQ ID NO: 664977 - RNA, 22 nt, Human
ugaaaucaugagauagugucac

SEQ ID NO: 664978 - RNA, 22 nt, Human
cuggccgguauuugccucuggg

SEQ ID NO: 664979 - RNA, 22 nt, Human
aaauaacuuucuguguauaguc

SEQ ID NO: 664980 - RNA, 22 nt, Human
uucaggaucaaguugccaguag

SEQ ID NO: 664981 - RNA, 22 nt, Human
aaggacugacaaaugucuuccu

SEQ ID NO: 664982 - RNA, 22 nt, Human
ugcauuaugcuugugcuguaua

SEQ ID NO: 664983 - RNA, 22 nt, Human
aagagucuauuggaacuagaca

SEQ ID NO: 664984 - RNA, 23 nt, Human
cugggcuguccugaggucaccuc

SEQ ID NO: 664985 - RNA, 22 nt, Human
uuguucagaaguuuaaagaauu

SEQ ID NO: 664986 - RNA, 22 nt, Human
uguccuuuuggcugucuauggu

SEQ ID NO: 664987 - RNA, 20 nt, Human
ucaaagcacugccugucauc

SEQ ID NO: 664988 - RNA, 22 nt, Human
ucagaaguauuaugcuaaagga

SEQ ID NO: 664989 - RNA, 22 nt, Human
gcacagcagcugcucaguugcu

SEQ ID NO: 664990 - RNA, 22 nt, Human
ucucugugguacugagagucua

SEQ ID NO: 664991 - RNA, 22 nt, Human
ucuggcaguugccgcuucaguc

SEQ ID NO: 664992 - RNA, 22 nt, Human
uggggaaggcggagcuugcagc

SEQ ID NO: 664993 - RNA, 22 nt, Human
ucuuauuuuguuagaugcugua

SEQ ID NO: 664994 - RNA, 22 nt, Human
uccugggaggaacauuuaccua

SEQ ID NO: 664995 - RNA, 22 nt, Human
ggagagagaugccgccuugcuc

SEQ ID NO: 664996 - RNA, 22 nt, Human
ugugcauguaccuuauucugga

SEQ ID NO: 664997 - RNA, 22 nt, Human
auucacagaauaguuuuaccag

SEQ ID NO: 664998 - RNA, 22 nt, Human
guucuucaucuuaaccaucugu

SEQ ID NO: 664999 - RNA, 22 nt, Human
gcugauuauuacaugucugugg

SEQ ID NO: 665000 - RNA, 23 nt, Human
agcuucugguucaggucaagcag

SEQ ID NO: 665001 - RNA, 22 nt, Human
uaaauuguccucccccugguau

SEQ ID NO: 665002 - RNA, 22 nt, Human
aucuuauugcuguugccagaua

SEQ ID NO: 665003 - RNA, 22 nt, Human
aguaaaauuucugcugaggaga

SEQ ID NO: 665004 - RNA, 22 nt, Human
ucuggcagaagugcugucagua

SEQ ID NO: 665005 - RNA, 23 nt, Human
uggggcugauggagacggaccag

SEQ ID NO: 665006 - RNA, 22 nt, Human
gucauugauuuucaguuugucc

SEQ ID NO: 665007 - RNA, 22 nt, Human
auuucaugaguuauuauagugg

SEQ ID NO: 665008 - RNA, 23 nt, Human
guauuucagcauucucaguuaaa

SEQ ID NO: 665009 - RNA, 22 nt, Human
ugacuuugugcaagugaauuau

SEQ ID NO: 665010 - RNA, 22 nt, Human
uccaguggcaggcggugagguc

SEQ ID NO: 665011 - RNA, 22 nt, Human
auuaggauguguauauuguguu

SEQ ID NO: 665012 - RNA, 22 nt, Human
auggcaguuuuagaacuuuuca

SEQ ID NO: 665013 - RNA, 22 nt, Human
caugauuuacuaaaauuuguuu

SEQ ID NO: 665014 - RNA, 22 nt, Human
uauuuaauaaaacuauggcaug

SEQ ID NO: 665015 - RNA, 22 nt, Human
ucugcccugcagggagcaguaa

SEQ ID NO: 665016 - RNA, 22 nt, Human
ugugaauagucagcauuuuguu

SEQ ID NO: 665017 - RNA, 22 nt, Human
agcaggugaauuccuggaugug

SEQ ID NO: 665018 - RNA, 22 nt, Human
aaaucagucccucuuggaauuu

SEQ ID NO: 665019 - RNA, 22 nt, Human
aggggcgucuguaggcaguggg

SEQ ID NO: 665020 - RNA, 22 nt, Human
cccagagucacaugggguguuc

SEQ ID NO: 665021 - RNA, 22 nt, Human
agugauucccagacuuccuggg

SEQ ID NO: 665022 - RNA, 22 nt, Human
uucuggaagcuggaaaaggcaa

SEQ ID NO: 665023 - RNA, 22 nt, Human
cugggccuuggauugacacugu

SEQ ID NO: 665024 - RNA, 22 nt, Human
ucuauaaaacucaagagcaauu

SEQ ID NO: 665025 - RNA, 22 nt, Human
uuucugcauuuacaaaaugagg

SEQ ID NO: 665026 - RNA, 22 nt, Human
cccuggcugcuaccagguagcu

SEQ ID NO: 665027 - RNA, 22 nt, Human
gcagagaggaaugaagccaucc

SEQ ID NO: 665028 - RNA, 22 nt, Human
cagcagaguaggugcuacuucu

SEQ ID NO: 665029 - RNA, 19 nt, Human
uuagaaacuguugacacug

SEQ ID NO: 665030 - RNA, 22 nt, Human
ugaaagcaugcuugccaagcuu

SEQ ID NO: 665031 - RNA, 22 nt, Human
cuguguuuuuggucugaucuau

SEQ ID NO: 665032 - RNA, 22 nt, Human
uccccugagaccccucagcacu

SEQ ID NO: 665033 - RNA, 22 nt, Human
ucacaugagucacuaucuuaau

SEQ ID NO: 665034 - RNA, 22 nt, Human
ucagaacagaagcuggcuauaa

SEQ ID NO: 665035 - RNA, 22 nt, Human
gcagggcuguuuagugaauagg

SEQ ID NO: 665036 - RNA, 22 nt, Human
ugcauggagauauacuauuuga

SEQ ID NO: 665037 - RNA, 22 nt, Human
uguggccagggggccauguccc

SEQ ID NO: 665038 - RNA, 22 nt, Human
uggcagcagacaucugaggucu

SEQ ID NO: 665039 - RNA, 22 nt, Human
ccagccagccuugaucugagua

SEQ ID NO: 665040 - RNA, 22 nt, Human
gcaauaguauuuauuaaaguag

SEQ ID NO: 665041 - RNA, 22 nt, Human
ggguggucuggcaggcuggaaa

SEQ ID NO: 665042 - RNA, 22 nt, Human
uaaacuguagcucucguaauuc

SEQ ID NO: 665043 - RNA, 22 nt, Human
ugugaagaauuaaugugaauca

SEQ ID NO: 665044 - RNA, 22 nt, Human
gugggggcuggcucguccugug

SEQ ID NO: 665045 - RNA, 22 nt, Human
agcugccuucccucucauuagg

SEQ ID NO: 665046 - RNA, 22 nt, Human
ugacagcagcauagugagcaau

SEQ ID NO: 665047 - RNA, 22 nt, Human
uggcagugugggaggaagguac

SEQ ID NO: 665048 - RNA, 22 nt, Human
agggaugggucuaacccagaac

SEQ ID NO: 665049 - RNA, 22 nt, Human
cacaugcuccauacagaauggg

SEQ ID NO: 665050 - RNA, 22 nt, Human
uuucacaaaugucuuuaacuug

SEQ ID NO: 665051 - RNA, 22 nt, Human
uggagcagggcaucacugugcg

SEQ ID NO: 665052 - RNA, 22 nt, Human
agacauagggaggcauauaaau

SEQ ID NO: 665053 - RNA, 22 nt, Human
cagccagcuggugcggcagagc

SEQ ID NO: 665054 - RNA, 21 nt, Human
auccuugaucagaagagugcu

SEQ ID NO: 665055 - RNA, 22 nt, Human
aaaucgguugguucaagguaau

SEQ ID NO: 665056 - RNA, 22 nt, Human
ugucuacuugggcucuacagca

SEQ ID NO: 665057 - RNA, 22 nt, Human
guucaaccccuugaugguacag

SEQ ID NO: 665058 - RNA, 22 nt, Human
ccugcccagagccccuuucacu

SEQ ID NO: 665059 - RNA, 22 nt, Human
cagcauucuacuuugugaacug

SEQ ID NO: 665060 - RNA, 22 nt, Human
acucuucaguacaauaauaucu

SEQ ID NO: 665061 - RNA, 18 nt, Human
cucaguguuugcugaaaa

SEQ ID NO: 665062 - RNA, 22 nt, Human
auuaauacauuauagggauugu

SEQ ID NO: 665063 - RNA, 22 nt, Human
uauacacauauacguuugugug

SEQ ID NO: 665064 - RNA, 22 nt, Human
ugucacaugacacaaauaucua

SEQ ID NO: 665065 - RNA, 22 nt, Human
ggugcccagagccaggaaugag

SEQ ID NO: 665066 - RNA, 22 nt, Human
uggcagcuauggucuaagggcc

SEQ ID NO: 665067 - RNA, 22 nt, Human
caaauguuugguggcauuuugu

SEQ ID NO: 665068 - RNA, 22 nt, Human
gcagaugcaacugcaggugagu

SEQ ID NO: 665069 - RNA, 22 nt, Human
ugauuuccaaaaggcuucuaag

SEQ ID NO: 665070 - RNA, 22 nt, Human
acagcuaacuuaaacuaaccua

SEQ ID NO: 665071 - RNA, 22 nt, Human
auggguaaggcugaaggaaagu

SEQ ID NO: 665072 - RNA, 22 nt, Human
ugggccuguuucccuucagggc

SEQ ID NO: 665073 - RNA, 22 nt, Human
cugauguguuuuaguuugguaa

SEQ ID NO: 665074 - RNA, 22 nt, Human
gaaauagacacuuucuaugaau

SEQ ID NO: 665075 - RNA, 22 nt, Human
aaucacaucucauucaacagcc

SEQ ID NO: 665076 - RNA, 22 nt, Human
uacagcuuuagcaaauuaccua

SEQ ID NO: 665077 - RNA, 22 nt, Human
uuacugaaaauucuucaggauu

SEQ ID NO: 665078 - RNA, 22 nt, Human
guggaaggugcuagaacaagga

SEQ ID NO: 665079 - RNA, 18 nt, Human
ggcaggcucucuggguca

SEQ ID NO: 665080 - RNA, 19 nt, Human
ucaagauggauggcuccca

SEQ ID NO: 665081 - RNA, 22 nt, Human
uauguguuugacacccugcaag

SEQ ID NO: 665082 - RNA, 22 nt, Human
auucuacauuuggagugauguc

SEQ ID NO: 665083 - RNA, 22 nt, Human
ugaaaugauuauaugguguuug

SEQ ID NO: 665084 - RNA, 22 nt, Human
aguggagugaguggcagaagga

SEQ ID NO: 665085 - RNA, 22 nt, Human
ccaggccugcaucugcugcgca

SEQ ID NO: 665086 - RNA, 22 nt, Human
uaaggcaguuuugccugagaua

SEQ ID NO: 665087 - RNA, 22 nt, Human
uuuacacugccauucugaauac

SEQ ID NO: 665088 - RNA, 22 nt, Human
caaagcugauacucagcaagua

SEQ ID NO: 665089 - RNA, 22 nt, Human
ucccaaggcacagggcagggac

SEQ ID NO: 665090 - RNA, 22 nt, Human
guuacaaagcacuucaagugaa

SEQ ID NO: 665091 - RNA, 22 nt, Human
ucaaaucccagcucagccucuc

SEQ ID NO: 665092 - RNA, 22 nt, Human
ucaugcaaaagacuugaacuuu

SEQ ID NO: 665093 - RNA, 22 nt, Human
ccagggcuucaguuagugguga

SEQ ID NO: 665094 - RNA, 22 nt, Human
cauuaacaaugacugcuugacu

SEQ ID NO: 665095 - RNA, 21 nt, Human
ugcuugggggcuucaggagcu

SEQ ID NO: 665096 - RNA, 22 nt, Human
ucugugcccucggugcugggcc

SEQ ID NO: 665097 - RNA, 22 nt, Human
agcaaucagcuucuuuguguuu

SEQ ID NO: 665098 - RNA, 22 nt, Human
accuuuggauaauuugaguuug

SEQ ID NO: 665099 - RNA, 22 nt, Human
cugaggcugggcugaggguaua

SEQ ID NO: 665100 - RNA, 22 nt, Human
uuauuauaaugagggauaaaaa

SEQ ID NO: 665101 - RNA, 22 nt, Human
gucuaaacuuuggcccagauuu

SEQ ID NO: 665102 - RNA, 22 nt, Human
caccacugcuuccugccaucug

SEQ ID NO: 665103 - RNA, 22 nt, Human
aucugcuugcaggcuggcccuu

SEQ ID NO: 665104 - RNA, 22 nt, Human
uagauucaugcaguaugcuagu

SEQ ID NO: 665105 - RNA, 22 nt, Human
cccugaggagagcgcuucccga

SEQ ID NO: 665106 - RNA, 22 nt, Human
gcaugcugcaccagagccucuc

SEQ ID NO: 665107 - RNA, 22 nt, Human
aagauugccccauuuacacugc

SEQ ID NO: 665108 - RNA, 22 nt, Human
uguuuaaugaagaugguuuuuc

SEQ ID NO: 665109 - RNA, 22 nt, Human
uuggaagaguagaguugaauaa

SEQ ID NO: 665110 - RNA, 22 nt, Human
cuccugaguaguagcauuguca

SEQ ID NO: 665111 - RNA, 23 nt, Human
ucagaacaaugccuuaggggcau

SEQ ID NO: 665112 - RNA, 22 nt, Human
uguaucuuagugugaaaauauu

SEQ ID NO: 665113 - RNA, 22 nt, Human
gguucugaaguggucccauucc

SEQ ID NO: 665114 - RNA, 22 nt, Human
aguguccccuccaagggccugg

SEQ ID NO: 665115 - RNA, 22 nt, Human
acagcuugcaauggcuuucaac

SEQ ID NO: 665116 - RNA, 22 nt, Human
gcccaggauaaugcugucccug

SEQ ID NO: 665117 - RNA, 22 nt, Human
auguuuacaaaaaggaggcuug

SEQ ID NO: 665118 - RNA, 22 nt, Human
cuucuucuucccccuucagggg

SEQ ID NO: 665119 - RNA, 22 nt, Human
aguggcagguguuucguggugc

SEQ ID NO: 665120 - RNA, 22 nt, Human
ccugcccuucuuuccccagcau

SEQ ID NO: 665121 - RNA, 23 nt, Human
aguucucaaaaccagcuugacaa

SEQ ID NO: 665122 - RNA, 22 nt, Human
aacaaacaguuaaguguggaug

SEQ ID NO: 665123 - RNA, 22 nt, Human
aguuuuaaaugauggugguggu

SEQ ID NO: 665124 - RNA, 22 nt, Human
uuuuccugccuuugcucaggga

SEQ ID NO: 665125 - RNA, 22 nt, Human
uacagauuuugugaagaagugu

SEQ ID NO: 665126 - RNA, 22 nt, Human
cacucugagcccaagcaggcug

SEQ ID NO: 665127 - RNA, 22 nt, Human
ccaggagagcaaaggucacucu

SEQ ID NO: 665128 - RNA, 22 nt, Human
ucuuggcugugcaugcaucuuc

SEQ ID NO: 665129 - RNA, 20 nt, Human
cucugggcugcguugcaaac

SEQ ID NO: 665130 - RNA, 22 nt, Human
auguuuaaucggcugccuuucc

SEQ ID NO: 665131 - RNA, 22 nt, Human
cugaggucagaguuuagucugg

SEQ ID NO: 665132 - RNA, 22 nt, Human
ugcauauuuucugauucagaag

SEQ ID NO: 665133 - RNA, 22 nt, Human
auuguucuaaggguuuaauuaa

SEQ ID NO: 665134 - RNA, 20 nt, Human
auugucagccuucagaggag

SEQ ID NO: 665135 - RNA, 20 nt, Human
aacauuguuuguaaaagcag

SEQ ID NO: 665136 - RNA, 22 nt, Human
aaaguuuuuaagcaagacccuu

SEQ ID NO: 665137 - RNA, 21 nt, Human
gccuggcuagaagcuccuagc

SEQ ID NO: 665138 - RNA, 22 nt, Human
acuggcuuugagggaauagcua

SEQ ID NO: 665139 - RNA, 22 nt, Human
uacaggcaugaaugaaaucugu

SEQ ID NO: 665140 - RNA, 22 nt, Human
uucugccuuacgauauuuucaa

SEQ ID NO: 665141 - RNA, 22 nt, Human
ggcagcucugaugaugcucugg

SEQ ID NO: 665142 - RNA, 22 nt, Human
guaguuagaguugugcuggaga

SEQ ID NO: 665143 - RNA, 20 nt, Human
aggcucugccauugucccug

SEQ ID NO: 665144 - RNA, 22 nt, Human
uucucugggaucuggcaaaagg

SEQ ID NO: 665145 - RNA, 22 nt, Human
cgugaguggguagcuuauucuu

SEQ ID NO: 665146 - RNA, 22 nt, Human
aaagcagcugaucucagagccu

SEQ ID NO: 665147 - RNA, 22 nt, Human
ugcaggcuccaggugcacauau

SEQ ID NO: 665148 - RNA, 22 nt, Human
aauuccucuaucuuucuucaag

SEQ ID NO: 665149 - RNA, 22 nt, Human
aagauucugaaagggguggggc

SEQ ID NO: 665150 - RNA, 22 nt, Human
cuggcugugucuuggaggagcu

SEQ ID NO: 665151 - RNA, 20 nt, Human
cugaaaggagucgggauguc

SEQ ID NO: 665152 - RNA, 22 nt, Human
cucucagaaguagcacgugggc

SEQ ID NO: 665153 - RNA, 22 nt, Human
ugcaaagaugaaauauuaaagg

SEQ ID NO: 665154 - RNA, 22 nt, Human
gcccuagggcuuuugggccugu

SEQ ID NO: 665155 - RNA, 22 nt, Human
uucaugugaucacagauuguaa

SEQ ID NO: 665156 - RNA, 23 nt, Human
caucauuguuaugggugcuacua

SEQ ID NO: 665157 - RNA, 22 nt, Human
ggcugagccacugcgccuggcu

SEQ ID NO: 665158 - RNA, 22 nt, Human
cuuuauuagauguagacuuucu

SEQ ID NO: 665159 - RNA, 22 nt, Human
ucagccagcucuuggacucuga

SEQ ID NO: 665160 - RNA, 22 nt, Human
cacugagcugauagaauuccag

SEQ ID NO: 665161 - RNA, 22 nt, Human
gaaccucucagcagccaugauc

SEQ ID NO: 665162 - RNA, 22 nt, Human
agcagaaccacagcacuguuga

SEQ ID NO: 665163 - RNA, 22 nt, Human
agcucagaagggaggaaaugag

SEQ ID NO: 665164 - RNA, 22 nt, Human
uucaacuuuaggcaaagaaaac

SEQ ID NO: 665165 - RNA, 22 nt, Human
uggcagcuggagggcaauggcc

SEQ ID NO: 665166 - RNA, 22 nt, Human
ccagccacugggccacugccag

SEQ ID NO: 665167 - RNA, 22 nt, Human
aacagauauaggcagaacuuug

SEQ ID NO: 665168 - RNA, 22 nt, Human
agauucaugggaaagcuuuagg

SEQ ID NO: 665169 - RNA, 20 nt, Human
accagagaccugaaucaguu

SEQ ID NO: 665170 - RNA, 22 nt, Human
acagaacaggcugagaaaaaca

SEQ ID NO: 665171 - RNA, 22 nt, Human
cagggccaagccccuuuggcug

SEQ ID NO: 665172 - RNA, 22 nt, Human
acuuugaaauguguaagagaga

SEQ ID NO: 665173 - RNA, 22 nt, Human
aucaggauagugguuaccuggg

SEQ ID NO: 665174 - RNA, 22 nt, Human
acugggcuagaguggaagcugg

SEQ ID NO: 665175 - RNA, 21 nt, Human
ucuuggcucugccacuuauua

SEQ ID NO: 665176 - RNA, 22 nt, Human
uaaagucaucuuuacaucuuug

SEQ ID NO: 665177 - RNA, 22 nt, Human
cagcucccgccaucgggaggca

SEQ ID NO: 665178 - RNA, 22 nt, Human
cuguggagcuuguggcaguggg

SEQ ID NO: 665179 - RNA, 22 nt, Human
acauugaagggcuauccaauag

SEQ ID NO: 665180 - RNA, 22 nt, Human
gagggcagugaauuuugaagcu

SEQ ID NO: 665181 - RNA, 20 nt, Human
agcugggcaauuaugacuau

SEQ ID NO: 665182 - RNA, 22 nt, Human
uuaauaacauuguguaucaccc

SEQ ID NO: 665183 - RNA, 22 nt, Human
ucuguuuccucuuguguaaagu

SEQ ID NO: 665184 - RNA, 22 nt, Human
ucuggccacuugcuucacacug

SEQ ID NO: 665185 - RNA, 22 nt, Human
caucagcugagggugagcagaa

SEQ ID NO: 665186 - RNA, 23 nt, Human
auugauucccucuuggaagggau

SEQ ID NO: 665187 - RNA, 22 nt, Human
aguggcagcugucaugcccuag

SEQ ID NO: 665188 - RNA, 22 nt, Human
agcugugugaccuagggcaagc

SEQ ID NO: 665189 - RNA, 22 nt, Human
ugcuguguaaaaggugauugaa

SEQ ID NO: 665190 - RNA, 23 nt, Human
agcccugcugagacccagcuccc

SEQ ID NO: 665191 - RNA, 22 nt, Human
ccuagcaauaaagauaucauuu

SEQ ID NO: 665192 - RNA, 22 nt, Human
uguggcagacaagauucuaugu

SEQ ID NO: 665193 - RNA, 22 nt, Human
ucaccagggagcuuguccucug

SEQ ID NO: 665194 - RNA, 22 nt, Human
agugcauucuccaucaucuagg

SEQ ID NO: 665195 - RNA, 22 nt, Human
acccagaggugucuagcaagcu

SEQ ID NO: 665196 - RNA, 22 nt, Human
aaucagucauuagcucugaccu

SEQ ID NO: 665197 - RNA, 22 nt, Human
ugucuuaaguagauuacagccu

SEQ ID NO: 665198 - RNA, 22 nt, Human
uggcgagccccgacugaguguu

SEQ ID NO: 665199 - RNA, 22 nt, Human
aauccaucucuccgagaaguuu

SEQ ID NO: 665200 - RNA, 22 nt, Human
uccccagggucccugcuuccau

SEQ ID NO: 665201 - RNA, 22 nt, Human
gagcuuaaauggcuaaauauaa

SEQ ID NO: 665202 - RNA, 22 nt, Human
cagagguauuuugauaaacgcc

SEQ ID NO: 665203 - RNA, 20 nt, Human
uacagucagggcacaggcag

SEQ ID NO: 665204 - RNA, 22 nt, Human
cagaauguagaucaucaucaag

SEQ ID NO: 665205 - RNA, 22 nt, Human
gagguucacaggcuaucacagu

SEQ ID NO: 665206 - RNA, 22 nt, Human
gcugaauaggcacagagggcau

SEQ ID NO: 665207 - RNA, 22 nt, Human
cuccucuuuacccgcauggucu

SEQ ID NO: 665208 - RNA, 20 nt, Human
gcuuucaagcuugucauugu

SEQ ID NO: 665209 - RNA, 22 nt, Human
aggaaugaacucgagugaucug

SEQ ID NO: 665210 - RNA, 22 nt, Human
uggguccuugcugauugcugag

SEQ ID NO: 665211 - RNA, 22 nt, Human
aggauguggguuuucacauugu

SEQ ID NO: 665212 - RNA, 22 nt, Human
cugagaaggaagccuccacucu

SEQ ID NO: 665213 - RNA, 22 nt, Human
gccuggaggggacagucucugg

SEQ ID NO: 665214 - RNA, 22 nt, Human
gugaggugggcuggccagagac

SEQ ID NO: 665215 - RNA, 22 nt, Human
ucaugugucugcugcagcuguu

SEQ ID NO: 665216 - RNA, 22 nt, Human
uuaguguuagggccuguuaccu

SEQ ID NO: 665217 - RNA, 22 nt, Human
ggcuccaggagggccuuggcca

SEQ ID NO: 665218 - RNA, 22 nt, Human
uagaacuagaacaaggauuuga

SEQ ID NO: 665219 - RNA, 19 nt, Human
ucacagcaucugucugaac

SEQ ID NO: 665220 - RNA, 22 nt, Human
cuaggaaucaccaagauucuag

SEQ ID NO: 665221 - RNA, 22 nt, Human
gccucaaauguggagcacuauu

SEQ ID NO: 665222 - RNA, 22 nt, Human
aguaaacagaaagcaagaugau

SEQ ID NO: 665223 - RNA, 22 nt, Human
agaccagcugccucccagggcc

SEQ ID NO: 665224 - RNA, 22 nt, Human
aaaucucugcaggcaaauguga

SEQ ID NO: 665225 - RNA, 23 nt, Human
ucccugagcuggagagacugcac

SEQ ID NO: 665226 - RNA, 22 nt, Human
guacuucccugggaggcaagca

SEQ ID NO: 665227 - RNA, 22 nt, Human
ugaggauggucccgaggacacu

SEQ ID NO: 665228 - RNA, 22 nt, Human
uaccaccucaaccucaucugac

SEQ ID NO: 665229 - RNA, 22 nt, Human
cccagcuccuuggaugggcagg

SEQ ID NO: 665230 - RNA, 22 nt, Human
ugccuguguggucugcgcauua

SEQ ID NO: 665231 - RNA, 22 nt, Human
gucauuuaucuucagaauuucu

SEQ ID NO: 665232 - RNA, 22 nt, Human
gaguccaguuguucacagaggc

SEQ ID NO: 665233 - RNA, 22 nt, Human
cuaguauuacauuuuugugugu

SEQ ID NO: 665234 - RNA, 22 nt, Human
cagccucugagccuuggcagau

SEQ ID NO: 665235 - RNA, 22 nt, Human
uaccuggacaucagagagacac

SEQ ID NO: 665236 - RNA, 22 nt, Human
cuuuacuucagcaagcuuuccu

SEQ ID NO: 665237 - RNA, 22 nt, Human
ccagcccugauuagagaauguc

SEQ ID NO: 665238 - RNA, 18 nt, Human
uuguuuuaagacucuguc

SEQ ID NO: 665239 - RNA, 22 nt, Human
ucagcuggagaugagaaccgaa

SEQ ID NO: 665240 - RNA, 22 nt, Human
augaagacaggucucaucacca

SEQ ID NO: 665241 - RNA, 22 nt, Human
gaaucaaaucaaguucuuuuga

SEQ ID NO: 665242 - RNA, 22 nt, Human
ggugcaggagcggggugcucgg

SEQ ID NO: 665243 - RNA, 22 nt, Human
gacaaugcauugugauugugac

SEQ ID NO: 665244 - RNA, 22 nt, Human
uugauaaaaugaugaaaucacu

SEQ ID NO: 665245 - RNA, 17 nt, Human
ucugagaaaggagaauc

SEQ ID NO: 665246 - RNA, 20 nt, Human
gggcagccucgggagugggu

SEQ ID NO: 665247 - RNA, 22 nt, Human
aaguccuuaggaagcagucguu

SEQ ID NO: 665248 - RNA, 22 nt, Human
gaggaugccugggucggggaag

SEQ ID NO: 665249 - RNA, 22 nt, Human
ucagcuuugcaaguuagaaaau

SEQ ID NO: 665250 - RNA, 22 nt, Human
auuaaagaaacccagcauguga

SEQ ID NO: 665251 - RNA, 22 nt, Human
agcuuuaccugccuuggggcac

SEQ ID NO: 665252 - RNA, 22 nt, Human
gcaggggaguggcaggcccgga

SEQ ID NO: 665253 - RNA, 22 nt, Human
agcccugggaggccagcuugua

SEQ ID NO: 665254 - RNA, 22 nt, Human
agcagauggagaauggagucag

SEQ ID NO: 665255 - RNA, 22 nt, Human
cucuggaccucagcuacagacu

SEQ ID NO: 665256 - RNA, 20 nt, Human
aagcacauuucuacaauaau

SEQ ID NO: 665257 - RNA, 22 nt, Human
agcuggccuucggugucacugg

SEQ ID NO: 665258 - RNA, 22 nt, Human
gcuguggaguacagagcugguu

SEQ ID NO: 665259 - RNA, 22 nt, Human
guaguacaugaagcacuuggca

SEQ ID NO: 665260 - RNA, 21 nt, Human
aucacauuggcuguuauuauu

SEQ ID NO: 665261 - RNA, 22 nt, Human
ccuggcucuguccucgcgcaaa

SEQ ID NO: 665262 - RNA, 22 nt, Human
aaaugcauaucaaagacuugaa

SEQ ID NO: 665263 - RNA, 22 nt, Human
auuucucaaccaggucaaaaag

SEQ ID NO: 665264 - RNA, 22 nt, Human
gaagaauauucuugaucuuaga

SEQ ID NO: 665265 - RNA, 22 nt, Human
ucuuaaugcuagccaauagaga

SEQ ID NO: 665266 - RNA, 22 nt, Human
gcagauggaucaccugaggucg

SEQ ID NO: 665267 - RNA, 22 nt, Human
uucuucuucuggcugcaccugg

SEQ ID NO: 665268 - RNA, 22 nt, Human
aaacaaugaaauucauucuuca

SEQ ID NO: 665269 - RNA, 22 nt, Human
ucaguuuuucuauacuuuguag

SEQ ID NO: 665270 - RNA, 22 nt, Human
ugagauaauaaauagcuuucuu

SEQ ID NO: 665271 - RNA, 22 nt, Human
augcacagacccaaaggccauc

SEQ ID NO: 665272 - RNA, 22 nt, Human
agucugaguuaguggaaaugua

SEQ ID NO: 665273 - RNA, 22 nt, Human
agcuucaaagcuaggaagaucu

SEQ ID NO: 665274 - RNA, 22 nt, Human
aagauaugaggucaccugcugg

SEQ ID NO: 665275 - RNA, 22 nt, Human
uuugacaugcaaagcacuuuag

SEQ ID NO: 665276 - RNA, 22 nt, Human
cuuugucauuuugucucucagu

SEQ ID NO: 665277 - RNA, 22 nt, Human
gcaguguugacuaugguaugag

SEQ ID NO: 665278 - RNA, 22 nt, Human
caguucuggaggauagaagucu

SEQ ID NO: 665279 - RNA, 23 nt, Human
ugggauagaauuucauggcugcu

SEQ ID NO: 665280 - RNA, 21 nt, Human
gcacagugccaggcacacagu

SEQ ID NO: 665281 - RNA, 21 nt, Human
aagugguuuagguuaccgggg

SEQ ID NO: 665282 - RNA, 20 nt, Human
ccuggcaggcggguuacuua

SEQ ID NO: 665283 - RNA, 22 nt, Human
uagcucugaggccaucuccggu

SEQ ID NO: 665284 - RNA, 22 nt, Human
uaucaacauuaauauuuucugg

SEQ ID NO: 665285 - RNA, 19 nt, Human
gugagacccugcauagggc

SEQ ID NO: 665286 - RNA, 22 nt, Human
gcugaggaaaggcuggaaggga

SEQ ID NO: 665287 - RNA, 22 nt, Human
ccucaguguguggauguuagag

SEQ ID NO: 665288 - RNA, 22 nt, Human
aaucagcaaaugcuuacucagg

SEQ ID NO: 665289 - RNA, 22 nt, Human
ugggggugguucuugccuccag

SEQ ID NO: 665290 - RNA, 22 nt, Human
cagcacuggggccacuggaguu

SEQ ID NO: 665291 - RNA, 22 nt, Human
cagagccaggugguguuggggc

SEQ ID NO: 665292 - RNA, 22 nt, Human
agcaccagcgugggggccguug

SEQ ID NO: 665293 - RNA, 22 nt, Human
aucagaacaaaagaacaguuua

SEQ ID NO: 665294 - RNA, 22 nt, Human
acauggcucagucucaugacag

SEQ ID NO: 665295 - RNA, 22 nt, Human
uuucucucuacaguacuuucau

SEQ ID NO: 665296 - RNA, 22 nt, Human
ucugucccugagagcucaggag

SEQ ID NO: 665297 - RNA, 22 nt, Human
ugggauauaguaaaacaugaau

SEQ ID NO: 665298 - RNA, 22 nt, Human
agggagcuuccgaacuacagcu

SEQ ID NO: 665299 - RNA, 23 nt, Human
gccagagcugccugcccuugcug

SEQ ID NO: 665300 - RNA, 22 nt, Human
aaaccauggaguaaguucacau

SEQ ID NO: 665301 - RNA, 22 nt, Human
ucagagcagacuuugaaggagg

SEQ ID NO: 665302 - RNA, 22 nt, Human
cuuuucaaacgcugaugucagu

SEQ ID NO: 665303 - RNA, 22 nt, Human
ccugagguugaaguauaaauug

SEQ ID NO: 665304 - RNA, 22 nt, Human
acuugucuuuguaaaauagaaa

SEQ ID NO: 665305 - RNA, 22 nt, Human
ggcuguggcauuaggugaggcc

SEQ ID NO: 665306 - RNA, 22 nt, Human
auuccuuguauaucuacaugca

SEQ ID NO: 665307 - RNA, 22 nt, Human
cagccaccauacagcagaagcu

SEQ ID NO: 665308 - RNA, 22 nt, Human
aaacagaaggguagguaaacau

SEQ ID NO: 665309 - RNA, 22 nt, Human
auggaacaugaauuaauauggu

SEQ ID NO: 665310 - RNA, 22 nt, Human
acaugcauguuguguagggggg

SEQ ID NO: 665311 - RNA, 22 nt, Human
cugggccaaaagaaguguucuu

SEQ ID NO: 665312 - RNA, 22 nt, Human
aagaaggaaguguggacaucac

SEQ ID NO: 665313 - RNA, 22 nt, Human
uaacacaugaaagcaccuucuu

SEQ ID NO: 665314 - RNA, 22 nt, Human
ucauuuacacuucacaaaugga

SEQ ID NO: 665315 - RNA, 21 nt, Human
ucacguggucacaugagcuuu

SEQ ID NO: 665316 - RNA, 17 nt, Human
uacauguguaucugauu

SEQ ID NO: 665317 - RNA, 22 nt, Human
cagacuuuugacauuaauacag

SEQ ID NO: 665318 - RNA, 22 nt, Human
gcacuugaaaagaucaggugca

SEQ ID NO: 665319 - RNA, 22 nt, Human
ugccaagagguccaggugggaa

SEQ ID NO: 665320 - RNA, 22 nt, Human
uugaaagaacucuucagagaua

SEQ ID NO: 665321 - RNA, 23 nt, Human
acucaaauuucgcuuggaguuca

SEQ ID NO: 665322 - RNA, 22 nt, Human
ggcccagcuuucauuccuugcu

SEQ ID NO: 665323 - RNA, 21 nt, Human
acucugccagucuccugcacu

SEQ ID NO: 665324 - RNA, 22 nt, Human
gacaucauguucugcuaauagu

SEQ ID NO: 665325 - RNA, 22 nt, Human
agcaacuucuacagauauagca

SEQ ID NO: 665326 - RNA, 22 nt, Human
aaugcaaauuaucaggcuucuc

SEQ ID NO: 665327 - RNA, 23 nt, Human
ggaugggcaagccuagugccuac

SEQ ID NO: 665328 - RNA, 22 nt, Human
gugggccaggacccgcuguccg

SEQ ID NO: 665329 - RNA, 22 nt, Human
gggaaggacauucugggcucag

SEQ ID NO: 665330 - RNA, 22 nt, Human
aucuuuuacauuacugcccaga

SEQ ID NO: 665331 - RNA, 22 nt, Human
cauuaagauuuuuuucuacugg

SEQ ID NO: 665332 - RNA, 20 nt, Human
uagauucugucuguccaaac

SEQ ID NO: 665333 - RNA, 22 nt, Human
acagauaguauguaaauuaagc

SEQ ID NO: 665334 - RNA, 22 nt, Human
gagcagcuggacaggccucccu

SEQ ID NO: 665335 - RNA, 22 nt, Human
accagagcuggcucugagcacc

SEQ ID NO: 665336 - RNA, 22 nt, Human
uucauuguagcuugacuaauua

SEQ ID NO: 665337 - RNA, 22 nt, Human
agcuccuugaaggcaguagcug

SEQ ID NO: 665338 - RNA, 22 nt, Human
acccaggacacagagaugaccc

SEQ ID NO: 665339 - RNA, 22 nt, Human
aagcugucagugucaggcuaaa

SEQ ID NO: 665340 - RNA, 22 nt, Human
ugcuuuuauuuaauaucuugca

SEQ ID NO: 665341 - RNA, 22 nt, Human
ucuaaguuuggugauuaccaau

SEQ ID NO: 665342 - RNA, 22 nt, Human
cccaggcuggggcuccuccagc

SEQ ID NO: 665343 - RNA, 22 nt, Human
uucuuuuacauuaagauuucag

SEQ ID NO: 665344 - RNA, 22 nt, Human
ggcucuggcggcucuuucaaua

SEQ ID NO: 665345 - RNA, 22 nt, Human
agugaaccaggcugcgucccug

SEQ ID NO: 665346 - RNA, 22 nt, Human
ucugccugagggagcugaggaa

SEQ ID NO: 665347 - RNA, 22 nt, Human
gacuuggggauuuaucucacag

SEQ ID NO: 665348 - RNA, 22 nt, Human
aaggcucuugaguggugauagu

SEQ ID NO: 665349 - RNA, 22 nt, Human
ugcaggaauauugaugaacuua

SEQ ID NO: 665350 - RNA, 22 nt, Human
agagacuguaaugagagguaca

SEQ ID NO: 665351 - RNA, 22 nt, Human
aaucuuuuucacaagaaagcac

SEQ ID NO: 665352 - RNA, 22 nt, Human
caaaguauauuggauugaaugg

SEQ ID NO: 665353 - RNA, 22 nt, Human
gcugaaggucucuggagagguc

SEQ ID NO: 665354 - RNA, 22 nt, Human
gaggggagaaggcacuaaccag

SEQ ID NO: 665355 - RNA, 22 nt, Human
cagcccagcacuaaguagauuu

SEQ ID NO: 665356 - RNA, 22 nt, Human
cuugcaggcccagccuuacaag

SEQ ID NO: 665357 - RNA, 23 nt, Human
agaggcacuaauuauucagagau

SEQ ID NO: 665358 - RNA, 22 nt, Human
gccuccuggauuuuagugccau

SEQ ID NO: 665359 - RNA, 22 nt, Human
agauguguuucuaguuccugca

SEQ ID NO: 665360 - RNA, 22 nt, Human
acuaggaacgggguuugcacuc

SEQ ID NO: 665361 - RNA, 22 nt, Human
uggagcagccaugaugacagag

SEQ ID NO: 665362 - RNA, 22 nt, Human
aagagcauaugguucucaaagc

SEQ ID NO: 665363 - RNA, 22 nt, Human
gcuuccugagacaacauugagu

SEQ ID NO: 665364 - RNA, 22 nt, Human
agggcccuggggugcacugaca

SEQ ID NO: 665365 - RNA, 22 nt, Human
caggcaugcuucugucugggca

SEQ ID NO: 665366 - RNA, 22 nt, Human
gucauuuuucacugcauauaga

SEQ ID NO: 665367 - RNA, 21 nt, Human
cagcccagcuucuuccccagu

SEQ ID NO: 665368 - RNA, 22 nt, Human
ugaggcaauguccuucauccuu

SEQ ID NO: 665369 - RNA, 22 nt, Human
caccccuguggagcaugguggc

SEQ ID NO: 665370 - RNA, 22 nt, Human
cugcagcaaauguuaagugacu

SEQ ID NO: 665371 - RNA, 22 nt, Human
ugugggaggaacacagccagaa

SEQ ID NO: 665372 - RNA, 22 nt, Human
aguguuucaagugaugcuuugg

SEQ ID NO: 665373 - RNA, 22 nt, Human
aggggcagccucacaauccucu

SEQ ID NO: 665374 - RNA, 22 nt, Human
aauggcugggaguguauuuugg

SEQ ID NO: 665375 - RNA, 22 nt, Human
aaagguuuccgagcuuuaauuu

SEQ ID NO: 665376 - RNA, 22 nt, Human
gcucaggaaacagcagggcuug

SEQ ID NO: 665377 - RNA, 22 nt, Human
aacuaguuuagcuuuuuaagac

SEQ ID NO: 665378 - RNA, 16 nt, Human
accuccagucaagggu

SEQ ID NO: 665379 - RNA, 22 nt, Human
caauagaaggcacagauaggua

SEQ ID NO: 665380 - RNA, 22 nt, Human
cagauuuagaguggggcuugga

SEQ ID NO: 665381 - RNA, 22 nt, Human
aagagggaagucaccuggaggu

SEQ ID NO: 665382 - RNA, 22 nt, Human
acagauugaucuugagaauuau

SEQ ID NO: 665383 - RNA, 17 nt, Human
cugggccuccccugucc

SEQ ID NO: 665384 - RNA, 22 nt, Human
uucauuccuucuguaccuugcc

SEQ ID NO: 665385 - RNA, 17 nt, Human
gcuacugguuaccucua

SEQ ID NO: 665386 - RNA, 22 nt, Human
acaugggggcugcugccagcga

SEQ ID NO: 665387 - RNA, 22 nt, Human
ccaguguuuccgucaguacacg

SEQ ID NO: 665388 - RNA, 22 nt, Human
ggacagggaucauuaucugagc

SEQ ID NO: 665389 - RNA, 22 nt, Human
agcuuuagagagccaagacuca

SEQ ID NO: 665390 - RNA, 22 nt, Human
cucuuaauguuuuauagauuga

SEQ ID NO: 665391 - RNA, 22 nt, Human
gguuuaaaagccaugcaugggg

SEQ ID NO: 665392 - RNA, 22 nt, Human
aggccucuucagggagcaugga

SEQ ID NO: 665393 - RNA, 22 nt, Human
ugaaggagcucaggagauaguc

SEQ ID NO: 665394 - RNA, 22 nt, Human
uuugaaauuaagauauugucca

SEQ ID NO: 665395 - RNA, 22 nt, Human
agaugggccuucgagcaugccc

SEQ ID NO: 665396 - RNA, 22 nt, Human
uggugcaguucccagggccggg

SEQ ID NO: 665397 - RNA, 22 nt, Human
gccagaggcccaaggacagcug

SEQ ID NO: 665398 - RNA, 22 nt, Human
ucacacagugguaaaacccuga

SEQ ID NO: 665399 - RNA, 17 nt, Human
aggcuggcucacaggga

SEQ ID NO: 665400 - RNA, 22 nt, Human
augaaauguaugagucuggguu

SEQ ID NO: 665401 - RNA, 22 nt, Human
uggggaaggaucaccacaaucu

SEQ ID NO: 665402 - RNA, 17 nt, Human
ggaggcaacagacaggg

SEQ ID NO: 665403 - RNA, 22 nt, Human
uagcugggagugucugaugggu

SEQ ID NO: 665404 - RNA, 22 nt, Human
ucaggcuacacucuuuucaugg

SEQ ID NO: 665405 - RNA, 22 nt, Human
uauauugagauuugagcauugu

SEQ ID NO: 665406 - RNA, 22 nt, Human
cugagguggcgccucucuuuaa

SEQ ID NO: 665407 - RNA, 22 nt, Human
cagaggcuaagaugagugggug

SEQ ID NO: 665408 - RNA, 22 nt, Human
agacagacguagugugagagua

SEQ ID NO: 665409 - RNA, 22 nt, Human
ucuucucccaucggccgcaggg

SEQ ID NO: 665410 - RNA, 19 nt, Human
augggaagcggccagcgga

SEQ ID NO: 665411 - RNA, 22 nt, Human
aaaagcagguacucagcuuggg

SEQ ID NO: 665412 - RNA, 22 nt, Human
agcuccagcggauggucuuaua

SEQ ID NO: 665413 - RNA, 22 nt, Human
acagaacugagaauucucuauc

SEQ ID NO: 665414 - RNA, 22 nt, Human
auggacaggcuuauaacagcaa

SEQ ID NO: 665415 - RNA, 22 nt, Human
cacaggaaguggucagugccag

SEQ ID NO: 665416 - RNA, 22 nt, Human
ugcagagaaaacuccuggguac

SEQ ID NO: 665417 - RNA, 22 nt, Human
aggagucuguugaaaugucuau

SEQ ID NO: 665418 - RNA, 22 nt, Human
agagccuggggauuggcaaggg

SEQ ID NO: 665419 - RNA, 22 nt, Human
caccagcuccaccagggcaggu

SEQ ID NO: 665420 - RNA, 22 nt, Human
aaggcagcaccgccuccugaaa

SEQ ID NO: 665421 - RNA, 22 nt, Human
gacagugugaacaucuaauagu

SEQ ID NO: 665422 - RNA, 22 nt, Human
aaauugcuguugggugacucuu

SEQ ID NO: 665423 - RNA, 22 nt, Human
uuuggcacucacuuaucauugg

SEQ ID NO: 665424 - RNA, 20 nt, Human
uaggcagagcugugcagccu

SEQ ID NO: 665425 - RNA, 22 nt, Human
uagcucugucacauacacugca

SEQ ID NO: 665426 - RNA, 22 nt, Human
cagaggguugucaggcgccuug

SEQ ID NO: 665427 - RNA, 20 nt, Human
uuccagagaucugcauuuua

SEQ ID NO: 665428 - RNA, 22 nt, Human
agagacuucugccuuagcaaga

SEQ ID NO: 665429 - RNA, 22 nt, Human
cgcauccagggcgcaggaucug

SEQ ID NO: 665430 - RNA, 19 nt, Human
aaauuggcaugcugaccuc

SEQ ID NO: 665431 - RNA, 22 nt, Human
aauauucuaauaaaugcccauc

SEQ ID NO: 665432 - RNA, 22 nt, Human
aagcuucauauaugugugaguc

SEQ ID NO: 665433 - RNA, 22 nt, Human
aauugcuuaucuuguugaauag

SEQ ID NO: 665434 - RNA, 22 nt, Human
uguacaaugcugagguuugggg

SEQ ID NO: 665435 - RNA, 22 nt, Human
cggucugaucuggaaauagggc

SEQ ID NO: 665436 - RNA, 22 nt, Human
ugugaagcauagauucuguaga

SEQ ID NO: 665437 - RNA, 22 nt, Human
auuuuugcccugcaguacauaa

SEQ ID NO: 665438 - RNA, 22 nt, Human
uucauagcagucccuuucuggg

SEQ ID NO: 665439 - RNA, 22 nt, Human
agcuguguaggaucauaacacg

SEQ ID NO: 665440 - RNA, 22 nt, Human
caacugcugacaccaucacucc

SEQ ID NO: 665441 - RNA, 22 nt, Human
ugucuuuuaccuaaugagcugg

SEQ ID NO: 665442 - RNA, 22 nt, Human
aaucuucaacagaaugguagga

SEQ ID NO: 665443 - RNA, 22 nt, Human
auauaggcuaacaacuauugag

SEQ ID NO: 665444 - RNA, 22 nt, Human
uggagccacucacuaucugagu

SEQ ID NO: 665445 - RNA, 22 nt, Human
ucuuuuagagcauuucugauuc

SEQ ID NO: 665446 - RNA, 22 nt, Human
guguucucuagagcuguacaaa

SEQ ID NO: 665447 - RNA, 22 nt, Human
caccacagcauccacuagaagg

SEQ ID NO: 665448 - RNA, 22 nt, Human
ccagagagguagcuuacccucu

SEQ ID NO: 665449 - RNA, 22 nt, Human
agccaagguaucaugagaggca

SEQ ID NO: 665450 - RNA, 22 nt, Human
uugauucauggacaggccaggu

SEQ ID NO: 665451 - RNA, 22 nt, Human
uuuauuggaacacagccaugac

SEQ ID NO: 665452 - RNA, 22 nt, Human
acucauuugcaugaugugcuau

SEQ ID NO: 665453 - RNA, 22 nt, Human
uccagagaucacacugggcagg

SEQ ID NO: 665454 - RNA, 22 nt, Human
uuucuccugugaggucagaagu

SEQ ID NO: 665455 - RNA, 22 nt, Human
uaggagaagagucagggccuaa

SEQ ID NO: 665456 - RNA, 19 nt, Human
ggcauccacgaaugcagag

SEQ ID NO: 665457 - RNA, 22 nt, Human
agcccuggagcaaaggugucuu

SEQ ID NO: 665458 - RNA, 18 nt, Human
acagacaaaauggaaaug

SEQ ID NO: 665459 - RNA, 22 nt, Human
guuuucucuguguuuggaugau

SEQ ID NO: 665460 - RNA, 22 nt, Human
cccuccagagccuggacauucu

SEQ ID NO: 665461 - RNA, 22 nt, Human
gagaggagucccuaucacaguu

SEQ ID NO: 665462 - RNA, 18 nt, Human
gccugcucugcucucccc

SEQ ID NO: 665463 - RNA, 22 nt, Human
gccugccugaaggcuguaccag

SEQ ID NO: 665464 - RNA, 22 nt, Human
auacagagaagggguagaggau

SEQ ID NO: 665465 - RNA, 22 nt, Human
caguguggugugcacagcuuag

SEQ ID NO: 665466 - RNA, 22 nt, Human
agucccagccuguaggauuggg

SEQ ID NO: 665467 - RNA, 22 nt, Human
ccaggcacuucaucauuagggu

SEQ ID NO: 665468 - RNA, 22 nt, Human
agaagaauacuugauguucaug

SEQ ID NO: 665469 - RNA, 22 nt, Human
uauuucuucgggauucaagcua

SEQ ID NO: 665470 - RNA, 22 nt, Human
uugaggcacacacagguugcau

SEQ ID NO: 665471 - RNA, 22 nt, Human
auacuuuagagcuagauugccu

SEQ ID NO: 665472 - RNA, 22 nt, Human
acaaaugcaaguuuuaugucaa

SEQ ID NO: 665473 - RNA, 22 nt, Human
ucagccaguuaagucaagaaau

SEQ ID NO: 665474 - RNA, 22 nt, Human
gccugugaugcccccauaagua

SEQ ID NO: 665475 - RNA, 22 nt, Human
acagauuuggcccagccaaugc

SEQ ID NO: 665476 - RNA, 23 nt, Human
cccagaggagcagggcgugagau

SEQ ID NO: 665477 - RNA, 22 nt, Human
agagugggugaucucuguuguc

SEQ ID NO: 665478 - RNA, 22 nt, Human
ccaguguuuaggaauaaaaugu

SEQ ID NO: 665479 - RNA, 22 nt, Human
gucugcugugccuuggggaaaa

SEQ ID NO: 665480 - RNA, 22 nt, Human
ggucacuggucucugcuuccau

SEQ ID NO: 665481 - RNA, 21 nt, Human
gcuuuuuguauggcccaggaa

SEQ ID NO: 665482 - RNA, 23 nt, Human
ugaaacauuuaggguagaauuuc

SEQ ID NO: 665483 - RNA, 22 nt, Human
uuuaccauccucuuuuagaauu

SEQ ID NO: 665484 - RNA, 22 nt, Human
ccaagggcucuggacagagugg

SEQ ID NO: 665485 - RNA, 22 nt, Human
ugggccucggagcacaggagac

SEQ ID NO: 665486 - RNA, 22 nt, Human
aaacuucaagauucaagccugg

SEQ ID NO: 665487 - RNA, 22 nt, Human
gaaguuuuuguagagacagggu

SEQ ID NO: 665488 - RNA, 22 nt, Human
augcugacuucucucugcagug

SEQ ID NO: 665489 - RNA, 22 nt, Human
ugagaagcagcuuacagguguc

SEQ ID NO: 665490 - RNA, 22 nt, Human
uuucacuguuaggaguaugcua

SEQ ID NO: 665491 - RNA, 22 nt, Human
caagcccaggauuccccaguua

SEQ ID NO: 665492 - RNA, 22 nt, Human
uaucuguuaaaacaagcuuuaa

SEQ ID NO: 665493 - RNA, 17 nt, Human
uacaggagagcaggaac

SEQ ID NO: 665494 - RNA, 22 nt, Human
uguaacaauuucuuacuauugu

SEQ ID NO: 665495 - RNA, 20 nt, Human
uggaggcaccuguggagauc

SEQ ID NO: 665496 - RNA, 22 nt, Human
ugaaugagugaguucagaccuc

SEQ ID NO: 665497 - RNA, 22 nt, Human
agaugguugguccauaggccua

SEQ ID NO: 665498 - RNA, 22 nt, Human
agaauuguaagcaauuugauua

SEQ ID NO: 665499 - RNA, 19 nt, Human
ucugugcugggaggcagca

SEQ ID NO: 665500 - RNA, 22 nt, Human
ggcugccugaggcugaggcccg

SEQ ID NO: 665501 - RNA, 22 nt, Human
ucagauauucucuaagaacaau

SEQ ID NO: 665502 - RNA, 22 nt, Human
gagagggguuugccauccuaug

SEQ ID NO: 665503 - RNA, 22 nt, Human
augugcuuuagguuuguuuaca

SEQ ID NO: 665504 - RNA, 22 nt, Human
ugggcagauguggcucuccuug

SEQ ID NO: 665505 - RNA, 22 nt, Human
ccaucccugggccauguccccu

SEQ ID NO: 665506 - RNA, 22 nt, Human
gcugccuugaacuuggccuggg

SEQ ID NO: 665507 - RNA, 22 nt, Human
ggugggagagcucugucuccag

SEQ ID NO: 665508 - RNA, 21 nt, Human
ugggccaguagaaaggaaggc

SEQ ID NO: 665509 - RNA, 22 nt, Human
uugcucaggcuuagagcuacua

SEQ ID NO: 665510 - RNA, 22 nt, Human
ugcagccauuugaaaagcaguu

SEQ ID NO: 665511 - RNA, 22 nt, Human
ucagguguuagaagaaauuuca

SEQ ID NO: 665512 - RNA, 22 nt, Human
gucacaaagcgcgguggucggu

SEQ ID NO: 665513 - RNA, 22 nt, Human
uuacagagauaaacuguaagug

SEQ ID NO: 665514 - RNA, 22 nt, Human
caguuuccuuguuuaccuacug

SEQ ID NO: 665515 - RNA, 23 nt, Human
accuuggacuucccagcuuccag

SEQ ID NO: 665516 - RNA, 22 nt, Human
aaguacacaucguuggccccga

SEQ ID NO: 665517 - RNA, 22 nt, Human
aguggcagggcuggcugcugca

SEQ ID NO: 665518 - RNA, 22 nt, Human
cacaugcaguuuacgucacuga

SEQ ID NO: 665519 - RNA, 22 nt, Human
uccuuuaacuaguuaccauguu

SEQ ID NO: 665520 - RNA, 22 nt, Human
aggacccacgcacaggaacccc

SEQ ID NO: 665521 - RNA, 22 nt, Human
caggaccuggaaugcuugugaa

SEQ ID NO: 665522 - RNA, 22 nt, Human
uggcuuccuaggagcccgugcu

SEQ ID NO: 665523 - RNA, 22 nt, Human
aggccacaggauugcacagcau

SEQ ID NO: 665524 - RNA, 22 nt, Human
aguccaguguguucuggcagca

SEQ ID NO: 665525 - RNA, 20 nt, Human
ucccuccugcagauagagaa

SEQ ID NO: 665526 - RNA, 20 nt, Human
caggaggcaaggucaagguc

SEQ ID NO: 665527 - RNA, 22 nt, Human
gcuggcucugcacccaggccuc

SEQ ID NO: 665528 - RNA, 22 nt, Human
aaaggucaaaaucgugacauug

SEQ ID NO: 665529 - RNA, 22 nt, Human
guugaaaauacagauuccuagg

SEQ ID NO: 665530 - RNA, 21 nt, Human
ucaagacagcauauuuaagaa

SEQ ID NO: 665531 - RNA, 22 nt, Human
cuggagggaggaggcugcuauu

SEQ ID NO: 665532 - RNA, 22 nt, Human
gagggugacaguucuggucucu

SEQ ID NO: 665533 - RNA, 22 nt, Human
gaggaugguaugaggcaagcaa

SEQ ID NO: 665534 - RNA, 22 nt, Human
uugggggaagaggauagacagu

SEQ ID NO: 665535 - RNA, 22 nt, Human
uuuguaacugagugcucagagc

SEQ ID NO: 665536 - RNA, 22 nt, Human
cagcuggaucugccucgagcca

SEQ ID NO: 665537 - RNA, 22 nt, Human
gcuuuaaugcuucguggggcca

SEQ ID NO: 665538 - RNA, 22 nt, Human
acaggacauggcuucugugacg

SEQ ID NO: 665539 - RNA, 22 nt, Human
accugcccacacuuccuuccca

SEQ ID NO: 665540 - RNA, 22 nt, Human
ucugggaaaugcuguuccuugu

SEQ ID NO: 665541 - RNA, 18 nt, Human
uuccuucugauguauaug

SEQ ID NO: 665542 - RNA, 22 nt, Human
agcauugccugccuauugcuaa

SEQ ID NO: 665543 - RNA, 22 nt, Human
aggguggcaguuacuggagcaa

SEQ ID NO: 665544 - RNA, 22 nt, Human
agguggcaaggggcgccucucu

SEQ ID NO: 665545 - RNA, 22 nt, Human
gagcugaguagaggcugcuccc

SEQ ID NO: 665546 - RNA, 22 nt, Human
uuuccucuccggggccuccagg

SEQ ID NO: 665547 - RNA, 22 nt, Human
uucugcuauacuuaugaauaca

SEQ ID NO: 665548 - RNA, 19 nt, Human
agucacagggaagaggaac

SEQ ID NO: 665549 - RNA, 23 nt, Human
aguucaaaaucaaccaggacacu

SEQ ID NO: 665550 - RNA, 22 nt, Human
caucagagucagagcucuuucu

SEQ ID NO: 665551 - RNA, 22 nt, Human
uucugcaugaaaagaacugaac

SEQ ID NO: 665552 - RNA, 22 nt, Human
uauucucagcaacacacaugga

SEQ ID NO: 665553 - RNA, 22 nt, Human
gcaaucaaugauuuauauuugu

SEQ ID NO: 665554 - RNA, 22 nt, Human
aaacuuuaggaaggaauuuaca

SEQ ID NO: 665555 - RNA, 22 nt, Human
acuucaaacaauuaacagagaa

SEQ ID NO: 665556 - RNA, 22 nt, Human
ugguggcacaagggagagaauc

SEQ ID NO: 665557 - RNA, 22 nt, Human
agugccucuugucuacgguuuu

SEQ ID NO: 665558 - RNA, 22 nt, Human
uuucuacuaagaaaguugauua

SEQ ID NO: 665559 - RNA, 22 nt, Human
ucucagucaguuuggacugugu

SEQ ID NO: 665560 - RNA, 22 nt, Human
aucuuuuuacuaacacugcuua

SEQ ID NO: 665561 - RNA, 22 nt, Human
cauaucauaggucuuggauaau

SEQ ID NO: 665562 - RNA, 22 nt, Human
uaagguuucuucagauacuagu

SEQ ID NO: 665563 - RNA, 22 nt, Human
caaaccuuguaaaugccaaacu

SEQ ID NO: 665564 - RNA, 22 nt, Human
cugaaggauguguggugggagu

SEQ ID NO: 665565 - RNA, 22 nt, Human
ugccuugggagccagcaugcca

SEQ ID NO: 665566 - RNA, 22 nt, Human
cauacaguuuucccuagaugug

SEQ ID NO: 665567 - RNA, 19 nt, Human
auggcucugggaucacugc

SEQ ID NO: 665568 - RNA, 22 nt, Human
auacagaacaagccucaccucc

SEQ ID NO: 665569 - RNA, 22 nt, Human
aagggcagagggaaucccacau

SEQ ID NO: 665570 - RNA, 22 nt, Human
agugucugaaccaccggggcau

SEQ ID NO: 665571 - RNA, 22 nt, Human
caccaucuauagagguauuugg

SEQ ID NO: 665572 - RNA, 22 nt, Human
cauucaaaagcuccauguuugu

SEQ ID NO: 665573 - RNA, 22 nt, Human
ggucagugcgauuucccacucc

SEQ ID NO: 665574 - RNA, 22 nt, Human
guguccacggcugagaaugauu

SEQ ID NO: 665575 - RNA, 22 nt, Human
aucugcuugaguuugaagucag

SEQ ID NO: 665576 - RNA, 22 nt, Human
acagagcaugcucaguguguga

SEQ ID NO: 665577 - RNA, 22 nt, Human
uaauugcagaacuuugggaggc

SEQ ID NO: 665578 - RNA, 22 nt, Human
agcuaacacauuccagcuauuu

SEQ ID NO: 665579 - RNA, 22 nt, Human
aggugaguccugggcacaggua

SEQ ID NO: 665580 - RNA, 22 nt, Human
ugaaugaccuuugaggauggaa

SEQ ID NO: 665581 - RNA, 22 nt, Human
agaugguugucgcaaaugaaug

SEQ ID NO: 665582 - RNA, 22 nt, Human
uucugacaugugagauuuuguu

SEQ ID NO: 665583 - RNA, 22 nt, Human
gugaagacuuggagaaguuaag

SEQ ID NO: 665584 - RNA, 22 nt, Human
cugaaauucugccucugcacaa

SEQ ID NO: 665585 - RNA, 22 nt, Human
ucuccuggcucaccaggcugga

SEQ ID NO: 665586 - RNA, 22 nt, Human
ucaguccagcuccucauuuccc

SEQ ID NO: 665587 - RNA, 22 nt, Human
uuuguucauuaguacaguugua

SEQ ID NO: 665588 - RNA, 22 nt, Human
ucucccuggagcccugaagcau

SEQ ID NO: 665589 - RNA, 22 nt, Human
ugcagaguccucuggagggacu

SEQ ID NO: 665590 - RNA, 22 nt, Human
aucuccaguuagcaguacugau

SEQ ID NO: 665591 - RNA, 22 nt, Human
gccacaggcuuaggagggaggu

SEQ ID NO: 665592 - RNA, 22 nt, Human
agucuguguacuggguuucugu

SEQ ID NO: 665593 - RNA, 22 nt, Human
cugaggaaggaguuaggcaguu

SEQ ID NO: 665594 - RNA, 22 nt, Human
caguggcgugaucucugcucac

SEQ ID NO: 665595 - RNA, 22 nt, Human
cuccugucagaagcauccugag

SEQ ID NO: 665596 - RNA, 22 nt, Human
ggccccaguucacuccuggccg

SEQ ID NO: 665597 - RNA, 22 nt, Human
aucuuugaaucaaugaaucagu

SEQ ID NO: 665598 - RNA, 22 nt, Human
cucugagaauauaagacuauuu

SEQ ID NO: 665599 - RNA, 22 nt, Human
caaggaauauuuaagaacguca

SEQ ID NO: 665600 - RNA, 22 nt, Human
ccagagguccugcucacuggug

SEQ ID NO: 665601 - RNA, 20 nt, Human
aggguggcaaguuagugaca

SEQ ID NO: 665602 - RNA, 22 nt, Human
caauagcaggucuacagagaga

SEQ ID NO: 665603 - RNA, 22 nt, Human
ucuuagcagacuuggcuacugu

SEQ ID NO: 665604 - RNA, 22 nt, Human
ucuuacagaaaauagauaacau

SEQ ID NO: 665605 - RNA, 22 nt, Human
acccugggcacaccauuucccc

SEQ ID NO: 665606 - RNA, 22 nt, Human
aaaauagcauauugcuuucuuu

SEQ ID NO: 665607 - RNA, 22 nt, Human
uuggagagugauauucagaugc

SEQ ID NO: 665608 - RNA, 22 nt, Human
gcuucaugaaaaucacugguca

SEQ ID NO: 665609 - RNA, 22 nt, Human
cugcccugcuggagaucacagu

SEQ ID NO: 665610 - RNA, 22 nt, Human
uuucuuucucguaaacuuaguu

SEQ ID NO: 665611 - RNA, 22 nt, Human
aggcuggcucggcuuuucuguc

SEQ ID NO: 665612 - RNA, 22 nt, Human
aaucuucuuucuuaacaguaca

SEQ ID NO: 665613 - RNA, 19 nt, Human
cccuugguagacagcugca

SEQ ID NO: 665614 - RNA, 22 nt, Human
cugcuuccacacaagcaaagcu

SEQ ID NO: 665615 - RNA, 22 nt, Human
aaaagcacuacaauuucgcuuc

SEQ ID NO: 665616 - RNA, 22 nt, Human
uggcccagcaguucugccccag

SEQ ID NO: 665617 - RNA, 22 nt, Human
cccagcuccuuguuugcaucuc

SEQ ID NO: 665618 - RNA, 22 nt, Human
uugaaaguccuucuugaguuac

SEQ ID NO: 665619 - RNA, 22 nt, Human
gguuuaaugggugaaggcauga

SEQ ID NO: 665620 - RNA, 22 nt, Human
gaacuucuucuuuaagagacuc

SEQ ID NO: 665621 - RNA, 22 nt, Human
cugcuucagcaaagcuauuugc

SEQ ID NO: 665622 - RNA, 22 nt, Human
uccuggaagaucucugugagau

SEQ ID NO: 665623 - RNA, 22 nt, Human
caggccugugaguugaggcccc

SEQ ID NO: 665624 - RNA, 22 nt, Human
ucucuuucuauaugugagucuu

SEQ ID NO: 665625 - RNA, 22 nt, Human
uguucucaguaauucuauuuua

SEQ ID NO: 665626 - RNA, 22 nt, Human
uguucuuacggaacuuaucuuu

SEQ ID NO: 665627 - RNA, 17 nt, Human
aauguggaaguacaugc

SEQ ID NO: 665628 - RNA, 22 nt, Human
uagcugacgcuaaauaaauguu

SEQ ID NO: 665629 - RNA, 18 nt, Human
aguccuggagaucaccaa

SEQ ID NO: 665630 - RNA, 22 nt, Human
caggaggcagcgcucucaggac

SEQ ID NO: 665631 - RNA, 21 nt, Human
cugcaggaugcugaagccagg

SEQ ID NO: 665632 - RNA, 22 nt, Human
agucacuguucugucaugucaa

SEQ ID NO: 665633 - RNA, 22 nt, Human
auguagcagauauuugugcaca

SEQ ID NO: 665634 - RNA, 20 nt, Human
uuucuuguacuuggagaagg

SEQ ID NO: 665635 - RNA, 22 nt, Human
auagucuucagcacuuugauca

SEQ ID NO: 665636 - RNA, 22 nt, Human
aggagccagaauccagacucgg

SEQ ID NO: 665637 - RNA, 22 nt, Human
ccucccucuuucagucccacag

SEQ ID NO: 665638 - RNA, 22 nt, Human
gguuucaaauuaaagucuuaag

SEQ ID NO: 665639 - RNA, 22 nt, Human
aaaacauuuuacugccaucuca

SEQ ID NO: 665640 - RNA, 22 nt, Human
accaaggagaaggugcaagcuu

SEQ ID NO: 665641 - RNA, 21 nt, Human
gggugggaggacacagcaggc

SEQ ID NO: 665642 - RNA, 21 nt, Human
uggauaaaggcacuuuucauc

SEQ ID NO: 665643 - RNA, 22 nt, Human
ggcagucaagagggagucugaa

SEQ ID NO: 665644 - RNA, 21 nt, Human
ggcagagaagcuggaaguugg

SEQ ID NO: 665645 - RNA, 22 nt, Human
caaauguaucagcccagggauu

SEQ ID NO: 665646 - RNA, 22 nt, Human
gcagcuuggauuucuguaguuu

SEQ ID NO: 665647 - RNA, 22 nt, Human
uggaaugaaggagauggccuuu

SEQ ID NO: 665648 - RNA, 22 nt, Human
ccacaggcggaguggcgggcag

SEQ ID NO: 665649 - RNA, 22 nt, Human
uggcagcugucuguggggucuc

SEQ ID NO: 665650 - RNA, 22 nt, Human
uuugcugcuguauauggagccc

SEQ ID NO: 665651 - RNA, 22 nt, Human
agcuccuguggcugaaagagga

SEQ ID NO: 665652 - RNA, 22 nt, Human
aaggcaguaggaucuuccacag

SEQ ID NO: 665653 - RNA, 22 nt, Human
agauacacagcccugccaucac

SEQ ID NO: 665654 - RNA, 22 nt, Human
cucugagcucgugcaguacuuc

SEQ ID NO: 665655 - RNA, 22 nt, Human
ucuuuauuuuaugcuugugcaa

SEQ ID NO: 665656 - RNA, 22 nt, Human
ugcugccuuuguggggucacug

SEQ ID NO: 665657 - RNA, 23 nt, Human
uugugucuacuuccuaucuaggg

SEQ ID NO: 665658 - RNA, 22 nt, Human
agaagcacuacgauaggugguc

SEQ ID NO: 665659 - RNA, 18 nt, Human
augugagagaaucuucuu

SEQ ID NO: 665660 - RNA, 22 nt, Human
aggauagaagccccauguucuu

SEQ ID NO: 665661 - RNA, 22 nt, Human
agggaggauaguagucaguuua

SEQ ID NO: 665662 - RNA, 22 nt, Human
agugcccaguuagguuggagca

SEQ ID NO: 665663 - RNA, 22 nt, Human
gcauugguuaagagcuuugggg

SEQ ID NO: 665664 - RNA, 22 nt, Human
ccucacagagcccagaugucua

SEQ ID NO: 665665 - RNA, 22 nt, Human
uccaggccccagcaccuuggga

SEQ ID NO: 665666 - RNA, 22 nt, Human
ugcacgugugagcauucacaug

SEQ ID NO: 665667 - RNA, 22 nt, Human
acaggcuuacaggcugcaagua

SEQ ID NO: 665668 - RNA, 22 nt, Human
ucuccagguagauaugucagga

SEQ ID NO: 665669 - RNA, 23 nt, Human
ggggacaguucccacuggggucu

SEQ ID NO: 665670 - RNA, 22 nt, Human
gcugagggcauguguggcgacu

SEQ ID NO: 665671 - RNA, 22 nt, Human
ucaauucaacacaugcacauug

SEQ ID NO: 665672 - RNA, 23 nt, Human
agcuguuucauuauuacaacacc

SEQ ID NO: 665673 - RNA, 22 nt, Human
ucacccagauagugagcauagu

SEQ ID NO: 665674 - RNA, 22 nt, Human
auuuggauucuuauuuagcacu

SEQ ID NO: 665675 - RNA, 22 nt, Human
aaacucuguauuugcugugggu

SEQ ID NO: 665676 - RNA, 22 nt, Human
cugaagaugucugagaugcuca

SEQ ID NO: 665677 - RNA, 22 nt, Human
gccgugcgugcgcaggugcugu

SEQ ID NO: 665678 - RNA, 22 nt, Human
gcugcagccaaauucauuguca

SEQ ID NO: 665679 - RNA, 22 nt, Human
ucugagcugggucuugacagcu

SEQ ID NO: 665680 - RNA, 22 nt, Human
ugggucagaggaccucguggcc

SEQ ID NO: 665681 - RNA, 22 nt, Human
uggaagacagugacugguugug

SEQ ID NO: 665682 - RNA, 22 nt, Human
aaacuucaacuggaaugggcua

SEQ ID NO: 665683 - RNA, 22 nt, Human
ucugcuuuagaauccaguagcu

SEQ ID NO: 665684 - RNA, 22 nt, Human
cucaggauguacuacagaaggc

SEQ ID NO: 665685 - RNA, 22 nt, Human
uuccugagacccucacagugau

SEQ ID NO: 665686 - RNA, 19 nt, Human
gaggaacuggcuugguucc

SEQ ID NO: 665687 - RNA, 18 nt, Human
gcugccugcauuccucac

SEQ ID NO: 665688 - RNA, 22 nt, Human
auugaaguccuaaucuccagua

SEQ ID NO: 665689 - RNA, 22 nt, Human
gagcaaggaugggucuauagua

SEQ ID NO: 665690 - RNA, 20 nt, Human
uuugcuaugcauaucugacc

SEQ ID NO: 665691 - RNA, 22 nt, Human
ugggugguccaggcucagcaga

SEQ ID NO: 665692 - RNA, 22 nt, Human
acuuccagugucugcugcuagc

SEQ ID NO: 665693 - RNA, 22 nt, Human
ugauauuuuaugagcuuucaua

SEQ ID NO: 665694 - RNA, 22 nt, Human
uagcuguuggcuuacaucuguu

SEQ ID NO: 665695 - RNA, 22 nt, Human
cucaggaaaggccaugcaaggg

SEQ ID NO: 665696 - RNA, 22 nt, Human
uaggcuccaguguguggcgagu

SEQ ID NO: 665697 - RNA, 22 nt, Human
uggcacuggcgcaggauggcgg

SEQ ID NO: 665698 - RNA, 22 nt, Human
ggcauagauuucuuuagguuua

SEQ ID NO: 665699 - RNA, 22 nt, Human
cgcugggcgcgcuccgaacccg

SEQ ID NO: 665700 - RNA, 22 nt, Human
uaucagcaagauggcaguauag

SEQ ID NO: 665701 - RNA, 18 nt, Human
cuguccaguagacucugc

SEQ ID NO: 665702 - RNA, 22 nt, Human
cucuggccgcagcucagcucug

SEQ ID NO: 665703 - RNA, 22 nt, Human
gggagggccagugcucucuaga

SEQ ID NO: 665704 - RNA, 22 nt, Human
gcagcuggcucagagagguggg

SEQ ID NO: 665705 - RNA, 22 nt, Human
caggugcugcagggcuggcguc

SEQ ID NO: 665706 - RNA, 22 nt, Human
agggggucguccggaagaccug

SEQ ID NO: 665707 - RNA, 22 nt, Human
cuuggagacauugaucuuuugc

SEQ ID NO: 665708 - RNA, 22 nt, Human
agggccuggugaccuggguccu

SEQ ID NO: 665709 - RNA, 22 nt, Human
gcuguacaguuuacuagguggg

SEQ ID NO: 665710 - RNA, 22 nt, Human
uuucaaaccacugagguucuga

SEQ ID NO: 665711 - RNA, 22 nt, Human
aaggauacuuuuagagccugag

SEQ ID NO: 665712 - RNA, 22 nt, Human
ucacuagucaucaacuuccauu

SEQ ID NO: 665713 - RNA, 22 nt, Human
uccaaagggaagcgcuuucugu

SEQ ID NO: 665714 - RNA, 22 nt, Human
uaaguguuauuauucucacuuu

SEQ ID NO: 665715 - RNA, 22 nt, Human
uggaaaauauuuaggugaauga

SEQ ID NO: 665716 - RNA, 22 nt, Human
agagugcucagaugcaugucuu

SEQ ID NO: 665717 - RNA, 22 nt, Human
aguccuucccaucugacacccu

SEQ ID NO: 665718 - RNA, 22 nt, Human
aaagaggcucaaggugggccag

SEQ ID NO: 665719 - RNA, 22 nt, Human
uggcuuuaagaagacugacagc

SEQ ID NO: 665720 - RNA, 22 nt, Human
gccaggggugcccacccaagga

SEQ ID NO: 665721 - RNA, 22 nt, Human
caggggccuggcugucuaggaa

SEQ ID NO: 665722 - RNA, 22 nt, Human
aaguuuagucuugucuuaguaa

SEQ ID NO: 665723 - RNA, 22 nt, Human
uaaagcaaggaauagaguaguc

SEQ ID NO: 665724 - RNA, 22 nt, Human
uguguuuuacaaauucucuuaa

SEQ ID NO: 665725 - RNA, 22 nt, Human
cagaggcccagugagagggcug

SEQ ID NO: 665726 - RNA, 20 nt, Human
ugcaggcuucgcucuaggag

SEQ ID NO: 665727 - RNA, 22 nt, Human
uucucauguaaaugccaucauc

SEQ ID NO: 665728 - RNA, 20 nt, Human
uguguguguacuucuaaaua

SEQ ID NO: 665729 - RNA, 21 nt, Human
ugaaacauuugaucaaagcac

SEQ ID NO: 665730 - RNA, 22 nt, Human
gcuucucucucagacugcaagc

SEQ ID NO: 665731 - RNA, 22 nt, Human
cucuggaaaaccacuagcagga

SEQ ID NO: 665732 - RNA, 22 nt, Human
aaguagaaaaccgcacuggacu

SEQ ID NO: 665733 - RNA, 22 nt, Human
uccagguaucuuuaugaaacuu

SEQ ID NO: 665734 - RNA, 22 nt, Human
gauuuccucacuaacauccauc

SEQ ID NO: 665735 - RNA, 22 nt, Human
gaacaucugggaucauugcugu

SEQ ID NO: 665736 - RNA, 22 nt, Human
uggcugggggugcuauagcugc

SEQ ID NO: 665737 - RNA, 22 nt, Human
aauguuugucaucacacagaua

SEQ ID NO: 665738 - RNA, 22 nt, Human
gugggccacugggaggcaaggg

SEQ ID NO: 665739 - RNA, 22 nt, Human
aaguccaguuuuuccagguggu

SEQ ID NO: 665740 - RNA, 22 nt, Human
aauguguuauuucagaauccag

SEQ ID NO: 665741 - RNA, 22 nt, Human
gccuggagaagauggaacuagc

SEQ ID NO: 665742 - RNA, 22 nt, Human
caugcuuacuugucucagcaga

SEQ ID NO: 665743 - RNA, 22 nt, Human
uuauaguuaugaaagacugagg

SEQ ID NO: 665744 - RNA, 22 nt, Human
ugccuggcaaugccagaagcca

SEQ ID NO: 665745 - RNA, 22 nt, Human
uggcuggauaauauucuguugu

SEQ ID NO: 665746 - RNA, 22 nt, Human
aagccagauuccuuaagcacag

SEQ ID NO: 665747 - RNA, 22 nt, Human
cagcaguuaugaguagaauagu

SEQ ID NO: 665748 - RNA, 22 nt, Human
cagugguuuugagauucagggu

SEQ ID NO: 665749 - RNA, 22 nt, Human
auacuucaugcuucaugucugu

SEQ ID NO: 665750 - RNA, 22 nt, Human
uuaaagcaguuuguauacaugg

SEQ ID NO: 665751 - RNA, 22 nt, Human
cagcccugcacgcugccuccgc

SEQ ID NO: 665752 - RNA, 22 nt, Human
cccucugcugccuggcuggguc

SEQ ID NO: 665753 - RNA, 22 nt, Human
acugccaggauggcacuagagg

SEQ ID NO: 665754 - RNA, 22 nt, Human
auuagaaugaaguauaggauuu

SEQ ID NO: 665755 - RNA, 22 nt, Human
gagggagggccaggucccaacc

SEQ ID NO: 665756 - RNA, 22 nt, Human
aaccagcuaacauguggaauga

SEQ ID NO: 665757 - RNA, 22 nt, Human
uuuccucugaugcugacuugga

SEQ ID NO: 665758 - RNA, 22 nt, Human
agacugggccauuuccccagcu

SEQ ID NO: 665759 - RNA, 22 nt, Human
agcaguguuuugauucugggag

SEQ ID NO: 665760 - RNA, 22 nt, Human
cagucuaaucuguuacucauua

SEQ ID NO: 665761 - RNA, 22 nt, Human
uugccugugaggauucugguug

SEQ ID NO: 665762 - RNA, 22 nt, Human
gggcugcuacgagaacugaaua

SEQ ID NO: 665763 - RNA, 22 nt, Human
cuggccuggcagggagggcaug

SEQ ID NO: 665764 - RNA, 19 nt, Human
ccacauggcuggaugacag

SEQ ID NO: 665765 - RNA, 22 nt, Human
aagagcuggaagugaagauaac

SEQ ID NO: 665766 - RNA, 22 nt, Human
uucucagguagugcugaugcug

SEQ ID NO: 665767 - RNA, 22 nt, Human
gcaguguugugauccaggucuu

SEQ ID NO: 665768 - RNA, 22 nt, Human
auguguaaaaggcauguuuuau

SEQ ID NO: 665769 - RNA, 22 nt, Human
acacaugauaagaaaguuuaaa

SEQ ID NO: 665770 - RNA, 22 nt, Human
ucaguccaggggcugugauguc

SEQ ID NO: 665771 - RNA, 22 nt, Human
uaaagugcaugcggggccagau

SEQ ID NO: 665772 - RNA, 22 nt, Human
aauggcucugauguuguuguga

SEQ ID NO: 665773 - RNA, 22 nt, Human
aaauaaucaauuuuuguagaua

SEQ ID NO: 665774 - RNA, 22 nt, Human
ccaguacaccucacuucccuuu

SEQ ID NO: 665775 - RNA, 22 nt, Human
augcacaaacccacaauuaguc

SEQ ID NO: 665776 - RNA, 22 nt, Human
uuuuccuuuggaagaugcauau

SEQ ID NO: 665777 - RNA, 19 nt, Human
ggucagcugggcuagaggc

SEQ ID NO: 665778 - RNA, 22 nt, Human
uggaaaauuaguagugaaaggc

SEQ ID NO: 665779 - RNA, 22 nt, Human
ugcccucccacauuauggcugu

SEQ ID NO: 665780 - RNA, 22 nt, Human
ggcaccuggauguagcagugaa

SEQ ID NO: 665781 - RNA, 22 nt, Human
caucauaaaauugagauaacug

SEQ ID NO: 665782 - RNA, 22 nt, Human
ugugucagaaggcaauggggau

SEQ ID NO: 665783 - RNA, 22 nt, Human
gauggaggaaaaguuggaaugc

SEQ ID NO: 665784 - RNA, 20 nt, Human
augcauugugauucuguuuu

SEQ ID NO: 665785 - RNA, 22 nt, Human
uuuaacuuaaucugcuugauga

SEQ ID NO: 665786 - RNA, 23 nt, Human
uccucaguauauaaaggcagaug

SEQ ID NO: 665787 - RNA, 22 nt, Human
cucaggcuccagacuuccgucc

SEQ ID NO: 665788 - RNA, 22 nt, Human
uuaagucauuucugauuauaga

SEQ ID NO: 665789 - RNA, 22 nt, Human
ggagcugugcagugacuacaga

SEQ ID NO: 665790 - RNA, 22 nt, Human
cuuguuaaaaugccgauucuga

SEQ ID NO: 665791 - RNA, 22 nt, Human
uucugcauguguuucaaauacu

SEQ ID NO: 665792 - RNA, 22 nt, Human
gaccucugaaggcagagcaggg

SEQ ID NO: 665793 - RNA, 22 nt, Human
aagggcucugggcuacgcacug

SEQ ID NO: 665794 - RNA, 22 nt, Human
cugaacaguacuuggccaguuu

SEQ ID NO: 665795 - RNA, 22 nt, Human
uugaagaucuuugcauugcagg

SEQ ID NO: 665796 - RNA, 22 nt, Human
ccaggccucuggcugcuuaguc

SEQ ID NO: 665797 - RNA, 22 nt, Human
agcagugggugguuuuugagca

SEQ ID NO: 665798 - RNA, 22 nt, Human
ggagagaacuggcuccuucuag

SEQ ID NO: 665799 - RNA, 22 nt, Human
cauuccaaguauauacaugaua

SEQ ID NO: 665800 - RNA, 22 nt, Human
aggacaggauugagcugaacug

SEQ ID NO: 665801 - RNA, 22 nt, Human
gcucaggccucggacacacaau

SEQ ID NO: 665802 - RNA, 22 nt, Human
accugucuauaaaagugaauac

SEQ ID NO: 665803 - RNA, 22 nt, Human
ucacacuuagagcgaauuguuu

SEQ ID NO: 665804 - RNA, 22 nt, Human
gugguuuucuccaacccagaac

SEQ ID NO: 665805 - RNA, 22 nt, Human
agucccagccuaggcugugcug

SEQ ID NO: 665806 - RNA, 22 nt, Human
ucacuuuagaggaaacauugag

SEQ ID NO: 665807 - RNA, 22 nt, Human
uacauuauuucaucagucaucu

SEQ ID NO: 665808 - RNA, 23 nt, Human
acagccuucuggggcuucugggc

SEQ ID NO: 665809 - RNA, 22 nt, Human
ugagcuggagucuguggcuccu

SEQ ID NO: 665810 - RNA, 22 nt, Human
ggguccuggaaucugcauuuua

SEQ ID NO: 665811 - RNA, 22 nt, Human
aaaggcuuuaaaauguacauau

SEQ ID NO: 665812 - RNA, 22 nt, Human
ggucauugaaaucagaaggguu

SEQ ID NO: 665813 - RNA, 22 nt, Human
agcaggugaugugagucuggaa

SEQ ID NO: 665814 - RNA, 22 nt, Human
aggccaggcgagacacccggcu

SEQ ID NO: 665815 - RNA, 22 nt, Human
caucugcuguuccuuggacuca

SEQ ID NO: 665816 - RNA, 22 nt, Human
agcuguguguuuccacugagcu

SEQ ID NO: 665817 - RNA, 22 nt, Human
auagcaaaacccacugcauuac

SEQ ID NO: 665818 - RNA, 18 nt, Human
aagggcuggccuuuggag

SEQ ID NO: 665819 - RNA, 22 nt, Human
ccagacugagggucccugagcu

SEQ ID NO: 665820 - RNA, 22 nt, Human
uacugaaacucuuguaaauauc

SEQ ID NO: 665821 - RNA, 22 nt, Human
agcaacaguguauaucauaggc

SEQ ID NO: 665822 - RNA, 19 nt, Human
aggcagucauuggaauaua

SEQ ID NO: 665823 - RNA, 22 nt, Human
uauguguaaccuugugauuuau

SEQ ID NO: 665824 - RNA, 22 nt, Human
cagucagaggucuucuaaaaca

SEQ ID NO: 665825 - RNA, 22 nt, Human
auggaaaagggucuuucauuuc

SEQ ID NO: 665826 - RNA, 22 nt, Human
uuagauauguuuuugcuaaugc

SEQ ID NO: 665827 - RNA, 22 nt, Human
gccaaaggauucuauggagaua

SEQ ID NO: 665828 - RNA, 22 nt, Human
uuucauucagcacccugaggug

SEQ ID NO: 665829 - RNA, 22 nt, Human
agcagcagcucauucuuccugu

SEQ ID NO: 665830 - RNA, 22 nt, Human
uuauucaggcucucuuuggcua

SEQ ID NO: 665831 - RNA, 22 nt, Human
agaagcacaccugaccucuagc

SEQ ID NO: 665832 - RNA, 22 nt, Human
ugcugucuuuucccaauccugg

SEQ ID NO: 665833 - RNA, 22 nt, Human
auguccuuaaucugaauguuag

SEQ ID NO: 665834 - RNA, 22 nt, Human
acaaauagagauucaaauaaag

SEQ ID NO: 665835 - RNA, 22 nt, Human
ugggaagauggagugacaggca

SEQ ID NO: 665836 - RNA, 22 nt, Human
ccugaaauuugaagaccugaau

SEQ ID NO: 665837 - RNA, 22 nt, Human
ucugacuuggugcuaccagcca

SEQ ID NO: 665838 - RNA, 22 nt, Human
uccuccacgauggcacaccugg

SEQ ID NO: 665839 - RNA, 22 nt, Human
aguucacaagugcauuucagga

SEQ ID NO: 665840 - RNA, 22 nt, Human
guauuaggagguggagccuuug

SEQ ID NO: 665841 - RNA, 22 nt, Human
gcucaggcuucuucuauaaaga

SEQ ID NO: 665842 - RNA, 22 nt, Human
uaaucacuuuucauuaguaccu

SEQ ID NO: 665843 - RNA, 22 nt, Human
uacauuccacuagugacuggcg

SEQ ID NO: 665844 - RNA, 22 nt, Human
acagccuggacuggcucucugc

SEQ ID NO: 665845 - RNA, 22 nt, Human
uucagagcaucucuaaagccag

SEQ ID NO: 665846 - RNA, 22 nt, Human
agcuggcagcucucagggguac

SEQ ID NO: 665847 - RNA, 22 nt, Human
cucucccccacagcagccuucu

SEQ ID NO: 665848 - RNA, 22 nt, Human
aggcccugauccgaauccagau

SEQ ID NO: 665849 - RNA, 22 nt, Human
agccuggccacucagggccuga

SEQ ID NO: 665850 - RNA, 22 nt, Human
uggcaggagacacauggcauag

SEQ ID NO: 665851 - RNA, 22 nt, Human
ucagugguaugcgugggagcug

SEQ ID NO: 665852 - RNA, 22 nt, Human
cuuccugggacaccuaacucua

SEQ ID NO: 665853 - RNA, 22 nt, Human
acaaagagggaccagugacuug

SEQ ID NO: 665854 - RNA, 22 nt, Human
uagaaagcaguugugggggcuc

SEQ ID NO: 665855 - RNA, 19 nt, Human
aaucagaaauaucgaggcc

SEQ ID NO: 665856 - RNA, 22 nt, Human
caaccugaugaauugaauuuaa

SEQ ID NO: 665857 - RNA, 18 nt, Human
uggaggcagaguucuggc

SEQ ID NO: 665858 - RNA, 22 nt, Human
agugggcugagcuugcugggug

SEQ ID NO: 665859 - RNA, 22 nt, Human
cugucugugccucuucucccag

SEQ ID NO: 665860 - RNA, 22 nt, Human
uggcaaaguaucugucccagcu

SEQ ID NO: 665861 - RNA, 22 nt, Human
agcuagccauguggcuccugug

SEQ ID NO: 665862 - RNA, 22 nt, Human
ugugaaggagaugaagggagug

SEQ ID NO: 665863 - RNA, 22 nt, Human
cucaggccugaguggcaguccc

SEQ ID NO: 665864 - RNA, 22 nt, Human
aguuacuugagacguuuaugaa

SEQ ID NO: 665865 - RNA, 22 nt, Human
uuccaaagcugcuuuauuuagu

SEQ ID NO: 665866 - RNA, 22 nt, Human
gcucugggccauccuggccggg

SEQ ID NO: 665867 - RNA, 22 nt, Human
aguucacuauagaagacagugu

SEQ ID NO: 665868 - RNA, 22 nt, Human
accuuggaaaugcccauugccu

SEQ ID NO: 665869 - RNA, 22 nt, Human
ucccaaauauaaugcaagagac

SEQ ID NO: 665870 - RNA, 22 nt, Human
uguggcuguggaugcuuuccag

SEQ ID NO: 665871 - RNA, 22 nt, Human
uuuuaacacucagcacuaucuc

SEQ ID NO: 665872 - RNA, 22 nt, Human
uacacuguagguggcaggcagc

SEQ ID NO: 665873 - RNA, 22 nt, Human
ucugucacuuauuaagauggau

SEQ ID NO: 665874 - RNA, 20 nt, Human
auguuguuuacucauagcau

SEQ ID NO: 665875 - RNA, 19 nt, Human
accuucagaguggcacaaa

SEQ ID NO: 665876 - RNA, 22 nt, Human
agcuggcuccagaaggagucgu

SEQ ID NO: 665877 - RNA, 22 nt, Human
caggaagucuuugcccaggcca

SEQ ID NO: 665878 - RNA, 22 nt, Human
uaagauuacagugagaaauaaa

SEQ ID NO: 665879 - RNA, 22 nt, Human
ggaaggguucaggugggccugc

SEQ ID NO: 665880 - RNA, 22 nt, Human
aggaccugcuaaugugccaagu

SEQ ID NO: 665881 - RNA, 23 nt, Human
ugaagguauuaccugagaugcuc

SEQ ID NO: 665882 - RNA, 22 nt, Human
cuucuaugaggagagacaugca

SEQ ID NO: 665883 - RNA, 22 nt, Human
acaguaaaaagccuuagaauuu

SEQ ID NO: 665884 - RNA, 22 nt, Human
aauuucucacucucuugaucac

SEQ ID NO: 665885 - RNA, 22 nt, Human
cagcuuggcuucacauucugua

SEQ ID NO: 665886 - RNA, 22 nt, Human
uuuucucuacaaaauaaccagc

SEQ ID NO: 665887 - RNA, 22 nt, Human
agggcuuuguuuaggugaccac

SEQ ID NO: 665888 - RNA, 19 nt, Human
ccagcccugucacuucuug

SEQ ID NO: 665889 - RNA, 22 nt, Human
agacacagcugcaggagguggg

SEQ ID NO: 665890 - RNA, 22 nt, Human
uuccagagaguuauuccccugg

SEQ ID NO: 665891 - RNA, 22 nt, Human
gcuguguaucagaugccacggg

SEQ ID NO: 665892 - RNA, 22 nt, Human
uggaauuaauaggggauauaca

SEQ ID NO: 665893 - RNA, 20 nt, Human
gcuccccuucucugggccuc

SEQ ID NO: 665894 - RNA, 22 nt, Human
guuauuuuaacuucucaguaau

SEQ ID NO: 665895 - RNA, 22 nt, Human
agguuucugcaauguguguaca

SEQ ID NO: 665896 - RNA, 22 nt, Human
aggagagaauuacuggguguca

SEQ ID NO: 665897 - RNA, 22 nt, Human
agcuccugugugcccaccugcu

SEQ ID NO: 665898 - RNA, 22 nt, Human
acacuuggagcaacacuuaugg

SEQ ID NO: 665899 - RNA, 22 nt, Human
acauguaaaaauuaagguaaga

SEQ ID NO: 665900 - RNA, 20 nt, Human
gagcacaguaaugacugcua

SEQ ID NO: 665901 - RNA, 20 nt, Human
cacagcuugccuuuuaugac

SEQ ID NO: 665902 - RNA, 22 nt, Human
ugucuccauagaagagacugca

SEQ ID NO: 665903 - RNA, 22 nt, Human
ugcugguaccgcgccuccgcca

SEQ ID NO: 665904 - RNA, 22 nt, Human
ucuccugggaggacaaggaagg

SEQ ID NO: 665905 - RNA, 22 nt, Human
uacauuuucuaggggaccaaga

SEQ ID NO: 665906 - RNA, 22 nt, Human
gcugauagacugaauguuggga

SEQ ID NO: 665907 - RNA, 22 nt, Human
aggggcuguggaaaccaacucu

SEQ ID NO: 665908 - RNA, 22 nt, Human
agguccaggcauuuggguuggg

SEQ ID NO: 665909 - RNA, 22 nt, Human
cacagcauugccuuccaaaagg

SEQ ID NO: 665910 - RNA, 22 nt, Human
acucugggcccacccucagagu

SEQ ID NO: 665911 - RNA, 22 nt, Human
ugaaaugcuguagagacuguau

SEQ ID NO: 665912 - RNA, 22 nt, Human
ccaaggugggcagaucacgagg

SEQ ID NO: 665913 - RNA, 22 nt, Human
uuuaccaagauagcaucugguu

SEQ ID NO: 665914 - RNA, 22 nt, Human
ucggggucuuugacacgcucug

SEQ ID NO: 665915 - RNA, 21 nt, Human
ucuaagaacaugauucucccu

SEQ ID NO: 665916 - RNA, 23 nt, Human
aucucucugguggucacagucag

SEQ ID NO: 665917 - RNA, 22 nt, Human
gccacugauuauucagcagaca

SEQ ID NO: 665918 - RNA, 22 nt, Human
ggcuggacugccucccagaguc

SEQ ID NO: 665919 - RNA, 22 nt, Human
ccugcaagacuauuuaguucca

SEQ ID NO: 665920 - RNA, 22 nt, Human
uaugucuuuuccaaugcugucu

SEQ ID NO: 665921 - RNA, 22 nt, Human
agcuaccuggcuuaucacuguc

SEQ ID NO: 665922 - RNA, 22 nt, Human
ucucugagguuguuuccagcac

SEQ ID NO: 665923 - RNA, 22 nt, Human
gaaugcacacgugugugcaugc

SEQ ID NO: 665924 - RNA, 22 nt, Human
ucuguguugauaauuuuggaga

SEQ ID NO: 665925 - RNA, 21 nt, Human
cucaggaucuuauauauuagu

SEQ ID NO: 665926 - RNA, 22 nt, Human
ucuggguguagggccuggcaac

SEQ ID NO: 665927 - RNA, 22 nt, Human
uacagagaguacagcauccaca

SEQ ID NO: 665928 - RNA, 18 nt, Human
uguaaugcagcggguggc

SEQ ID NO: 665929 - RNA, 22 nt, Human
cagaccaucuugaagcaaacug

SEQ ID NO: 665930 - RNA, 21 nt, Human
ucauuuauugagaaaugacug

SEQ ID NO: 665931 - RNA, 22 nt, Human
cuugaaauccagauuucagagg

SEQ ID NO: 665932 - RNA, 23 nt, Human
ccuguugggacagcuuuaccaga

SEQ ID NO: 665933 - RNA, 18 nt, Human
acuguuaucugauaaggc

SEQ ID NO: 665934 - RNA, 22 nt, Human
ucacuucugaagguaguuggca

SEQ ID NO: 665935 - RNA, 22 nt, Human
uuggcucaugcuguuuugugca

SEQ ID NO: 665936 - RNA, 18 nt, Human
uaucacugcugaacaaga

SEQ ID NO: 665937 - RNA, 19 nt, Human
ugucucugaaagaugagcu

SEQ ID NO: 665938 - RNA, 22 nt, Human
gcuuccuccagggaggggccug

SEQ ID NO: 665939 - RNA, 22 nt, Human
gggcugaaagcucucacagucu

SEQ ID NO: 665940 - RNA, 22 nt, Human
acaguucccgucuugcacagcu

SEQ ID NO: 665941 - RNA, 22 nt, Human
agggugccuggaagccacucac

SEQ ID NO: 665942 - RNA, 22 nt, Human
acaugcauacguguguuuaaaa

SEQ ID NO: 665943 - RNA, 22 nt, Human
cuuaagauuugcgauaccuaau

SEQ ID NO: 665944 - RNA, 22 nt, Human
uugccaucccuuaccucaguca

SEQ ID NO: 665945 - RNA, 22 nt, Human
uuuagugugacaguccccagua

SEQ ID NO: 665946 - RNA, 22 nt, Human
uaaugaacaucuuaaucugaaa

SEQ ID NO: 665947 - RNA, 22 nt, Human
gagcucugccauggcucccacc

SEQ ID NO: 665948 - RNA, 22 nt, Human
cuagucacucagcacugacaaa

SEQ ID NO: 665949 - RNA, 22 nt, Human
uagcaucuggagaaacaagucc

SEQ ID NO: 665950 - RNA, 22 nt, Human
aacuaaaagugugucucuugua

SEQ ID NO: 665951 - RNA, 22 nt, Human
uaucaauacauguuaucagugu

SEQ ID NO: 665952 - RNA, 22 nt, Human
uacagccaucauguauguauau

SEQ ID NO: 665953 - RNA, 20 nt, Human
acuuuggggucuuucucaga

SEQ ID NO: 665954 - RNA, 22 nt, Human
gaagguagcugcugagaugaca

SEQ ID NO: 665955 - RNA, 22 nt, Human
agaaaucaauaucuauauguug

SEQ ID NO: 665956 - RNA, 22 nt, Human
ccugccugcaaaaugggacaag

SEQ ID NO: 665957 - RNA, 22 nt, Human
caaagacacgggaaacaacguu

SEQ ID NO: 665958 - RNA, 22 nt, Human
uaugaugggaggaauggaauuu

SEQ ID NO: 665959 - RNA, 22 nt, Human
auagagugauguaagguaugug

SEQ ID NO: 665960 - RNA, 22 nt, Human
ccaagagguaucuugccauaaa

SEQ ID NO: 665961 - RNA, 22 nt, Human
gaguguccgugcagccccagac

SEQ ID NO: 665962 - RNA, 22 nt, Human
aggccacaaccacccugugccc

SEQ ID NO: 665963 - RNA, 22 nt, Human
uucccacagugacuccagagaa

SEQ ID NO: 665964 - RNA, 22 nt, Human
gugcuuuccauccucccugcug

SEQ ID NO: 665965 - RNA, 19 nt, Human
uuagggguaugaaguggua

SEQ ID NO: 665966 - RNA, 22 nt, Human
gccucugcaggugcgguuaucc

SEQ ID NO: 665967 - RNA, 22 nt, Human
uaugccuggggugcucaggcca

SEQ ID NO: 665968 - RNA, 22 nt, Human
aguggcuggacgacaaggguga

SEQ ID NO: 665969 - RNA, 22 nt, Human
augggcaggcacuggcucucag

SEQ ID NO: 665970 - RNA, 22 nt, Human
ugaaaucaucugccaauaaguu

SEQ ID NO: 665971 - RNA, 23 nt, Human
ucauugugacugugccacauaac

SEQ ID NO: 665972 - RNA, 22 nt, Human
agcaaauacuugaauaaaaaga

SEQ ID NO: 665973 - RNA, 22 nt, Human
acuauaaaaggauaaaccagaa

SEQ ID NO: 665974 - RNA, 22 nt, Human
aagggggcacagucacuguaau

SEQ ID NO: 665975 - RNA, 22 nt, Human
auucuucacaccuguuccuguu

SEQ ID NO: 665976 - RNA, 20 nt, Human
gucaggauuaguaaacucug

SEQ ID NO: 665977 - RNA, 22 nt, Human
cugggccaguuaugucucaucu

SEQ ID NO: 665978 - RNA, 22 nt, Human
agaccuggaguggggccucagg

SEQ ID NO: 665979 - RNA, 22 nt, Human
uagcagcaagaaugggaugugu

SEQ ID NO: 665980 - RNA, 22 nt, Human
gaaguucuuuauagcaguguga

SEQ ID NO: 665981 - RNA, 23 nt, Human
ccucucucccuguuuggcaaaua

SEQ ID NO: 665982 - RNA, 22 nt, Human
ucaggaaaguguucucagagga

SEQ ID NO: 665983 - RNA, 22 nt, Human
uggcuucccaggaaaggagaag

SEQ ID NO: 665984 - RNA, 22 nt, Human
agagguucagagaaggcgaucu

SEQ ID NO: 665985 - RNA, 22 nt, Human
ugucuucacucaagucucuugg

SEQ ID NO: 665986 - RNA, 22 nt, Human
ugucucugucuuccagggcugu

SEQ ID NO: 665987 - RNA, 22 nt, Human
uggucucuguaggcuaccccau

SEQ ID NO: 665988 - RNA, 22 nt, Human
ugagcugguucuugaggcauga

SEQ ID NO: 665989 - RNA, 22 nt, Human
ugcagcugaugauacccccaug

SEQ ID NO: 665990 - RNA, 22 nt, Human
acauuacagcaaguuuacguua

SEQ ID NO: 665991 - RNA, 22 nt, Human
gcagcucccuugaacuucuccu

SEQ ID NO: 665992 - RNA, 22 nt, Human
ugucaccaugcgaggcuaauuu

SEQ ID NO: 665993 - RNA, 22 nt, Human
auguauuugcuuguuauggauu

SEQ ID NO: 665994 - RNA, 22 nt, Human
acaguguuuugucuggcagggc

SEQ ID NO: 665995 - RNA, 22 nt, Human
ugggcacauaguuuuaugguca

SEQ ID NO: 665996 - RNA, 22 nt, Human
agagaaacaggucagcugggag

SEQ ID NO: 665997 - RNA, 22 nt, Human
caagaugacaaggcuggaggcu

SEQ ID NO: 665998 - RNA, 22 nt, Human
ucugcucagccgaucugcuccg

SEQ ID NO: 665999 - RNA, 22 nt, Human
auugcaaagcauugugagcgca

SEQ ID NO: 666000 - RNA, 22 nt, Human
ucacaggcaaagaagauuggug

SEQ ID NO: 666001 - RNA, 22 nt, Human
ugaagcaaugauagcagaauga

SEQ ID NO: 666002 - RNA, 22 nt, Human
gacagcagcauaauacaugaac

SEQ ID NO: 666003 - RNA, 22 nt, Human
augaauccagcaaacagugagg

SEQ ID NO: 666004 - RNA, 22 nt, Human
gucccagggcaaggcuguuucu

SEQ ID NO: 666005 - RNA, 22 nt, Human
cucccucugucuuguccagaaa

SEQ ID NO: 666006 - RNA, 22 nt, Human
uggaggauuaaucuggaaagau

SEQ ID NO: 666007 - RNA, 22 nt, Human
agguccugaugaucucugagag

SEQ ID NO: 666008 - RNA, 22 nt, Human
aggaaagccaaucucucuugac

SEQ ID NO: 666009 - RNA, 22 nt, Human
acauuggucacugaagaaugag

SEQ ID NO: 666010 - RNA, 22 nt, Human
uauguucaucuggugcaucagu

SEQ ID NO: 666011 - RNA, 22 nt, Human
uccugagaugagacagugcugc

SEQ ID NO: 666012 - RNA, 22 nt, Human
aaugacagagauagaagggaug

SEQ ID NO: 666013 - RNA, 22 nt, Human
agcugagagccccugcccugug

SEQ ID NO: 666014 - RNA, 22 nt, Human
aaguaaugguuaaauaauucua

SEQ ID NO: 666015 - RNA, 22 nt, Human
aggucugggcaccacuggcugc

SEQ ID NO: 666016 - RNA, 22 nt, Human
gaaugacauugaaaagacauug

SEQ ID NO: 666017 - RNA, 21 nt, Human
aagagcuggaucaaggauaag

SEQ ID NO: 666018 - RNA, 21 nt, Human
cacagaggcgcuguauggcug

SEQ ID NO: 666019 - RNA, 22 nt, Human
acucuuuacuuaaacucuaagu

SEQ ID NO: 666020 - RNA, 22 nt, Human
auauacacauguguauacauuu

SEQ ID NO: 666021 - RNA, 22 nt, Human
agaaaugaauauguagugguua

SEQ ID NO: 666022 - RNA, 22 nt, Human
uagauucugugagagucaaagu

SEQ ID NO: 666023 - RNA, 22 nt, Human
cugcacguauaaucagucuguu

SEQ ID NO: 666024 - RNA, 22 nt, Human
accaggcuugaugauuugcuua

SEQ ID NO: 666025 - RNA, 22 nt, Human
ucucuggguauucacugccuuc

SEQ ID NO: 666026 - RNA, 22 nt, Human
uccaguccuaucugcccuugga

SEQ ID NO: 666027 - RNA, 22 nt, Human
uccuggagagaggccuggaaga

SEQ ID NO: 666028 - RNA, 22 nt, Human
ggaacauacuguguagacuuug

SEQ ID NO: 666029 - RNA, 22 nt, Human
aauaaugagacagcuuauuuaa

SEQ ID NO: 666030 - RNA, 22 nt, Human
agcucccugcacgacccugccc

SEQ ID NO: 666031 - RNA, 22 nt, Human
cuaggcagauggagaaguggcu

SEQ ID NO: 666032 - RNA, 18 nt, Human
uccuggccacacuaccuu

SEQ ID NO: 666033 - RNA, 22 nt, Human
ugcaaggcacccacucugcuuu

SEQ ID NO: 666034 - RNA, 22 nt, Human
aagugugucuugggaagggagg

SEQ ID NO: 666035 - RNA, 22 nt, Human
gauucccauccucagcagcagc

SEQ ID NO: 666036 - RNA, 22 nt, Human
cuuggaauggggcagaaaaugg

SEQ ID NO: 666037 - RNA, 22 nt, Human
ucagccccacggggucagccaa

SEQ ID NO: 666038 - RNA, 18 nt, Human
uggcuuccugcgggcugc

SEQ ID NO: 666039 - RNA, 22 nt, Human
gcuccacuugcagcuaggcuug

SEQ ID NO: 666040 - RNA, 22 nt, Human
ucugggucuggcugcuggugca

SEQ ID NO: 666041 - RNA, 22 nt, Human
cuccagaaauuuggaugcagca

SEQ ID NO: 666042 - RNA, 22 nt, Human
cucaacagcucugccauacucc

SEQ ID NO: 666043 - RNA, 21 nt, Human
aggcagcgugagggccacuca

SEQ ID NO: 666044 - RNA, 20 nt, Human
cagcagagacccauggggag

SEQ ID NO: 666045 - RNA, 22 nt, Human
gacccugccaugagugacaggg

SEQ ID NO: 666046 - RNA, 22 nt, Human
cccuggagcaucucugcugucu

SEQ ID NO: 666047 - RNA, 22 nt, Human
gcugcugggggaacaguuaaaa

SEQ ID NO: 666048 - RNA, 22 nt, Human
uggaaaaaaauuggcuagcuuc

SEQ ID NO: 666049 - RNA, 22 nt, Human
agcaggaaguagucuguaagca

SEQ ID NO: 666050 - RNA, 22 nt, Human
cuggcacagccacugcaggcag

SEQ ID NO: 666051 - RNA, 22 nt, Human
gcacagggagcaggucucuggu

SEQ ID NO: 666052 - RNA, 22 nt, Human
uuucagacaguggguccaucca

SEQ ID NO: 666053 - RNA, 22 nt, Human
aggaaacagagugaagcuuggg

SEQ ID NO: 666054 - RNA, 22 nt, Human
auuuauugguuugcauggugaa

SEQ ID NO: 666055 - RNA, 21 nt, Human
gucugaugcuugaugcaguug

SEQ ID NO: 666056 - RNA, 22 nt, Human
uucccacaaucugcguguguau

SEQ ID NO: 666057 - RNA, 22 nt, Human
cacacacuggagcaaggagaug

SEQ ID NO: 666058 - RNA, 22 nt, Human
aaguucuuucuggaaggucugc

SEQ ID NO: 666059 - RNA, 16 nt, Human
uuuuauugugacagcc

SEQ ID NO: 666060 - RNA, 22 nt, Human
gagcugggagcugggauuugga

SEQ ID NO: 666061 - RNA, 22 nt, Human
guuauugacauguauuaagcac

SEQ ID NO: 666062 - RNA, 22 nt, Human
uacagccugauuuggagccacu

SEQ ID NO: 666063 - RNA, 22 nt, Human
agccacccauucccgagcccua

SEQ ID NO: 666064 - RNA, 22 nt, Human
uauguggccuuuuaugucugac

SEQ ID NO: 666065 - RNA, 23 nt, Human
agagagcucacuauauagcauug

SEQ ID NO: 666066 - RNA, 22 nt, Human
agacauuuuggaaaguauuacu

SEQ ID NO: 666067 - RNA, 22 nt, Human
guuucuuucuauugacugaaca

SEQ ID NO: 666068 - RNA, 22 nt, Human
aggcuccauaccaucuccggag

SEQ ID NO: 666069 - RNA, 22 nt, Human
uacaauguugguaaaguaucau

SEQ ID NO: 666070 - RNA, 22 nt, Human
cagugggaagaaugcagccucc

SEQ ID NO: 666071 - RNA, 22 nt, Human
uagcccaggagaauugucuuuc

SEQ ID NO: 666072 - RNA, 22 nt, Human
gcauuuuucuaaucauuggcau

SEQ ID NO: 666073 - RNA, 22 nt, Human
ucaauguucaaguaugacaaug

SEQ ID NO: 666074 - RNA, 22 nt, Human
caggugaggcugaacagaugaa

SEQ ID NO: 666075 - RNA, 22 nt, Human
aguuucuuauucuuaguuaugu

SEQ ID NO: 666076 - RNA, 20 nt, Human
cacugcccuccagccugagc

SEQ ID NO: 666077 - RNA, 22 nt, Human
cagaagguuuacacuggacugu

SEQ ID NO: 666078 - RNA, 22 nt, Human
uccucagauaccuggcagauca

SEQ ID NO: 666079 - RNA, 22 nt, Human
cagaggcaggauaagaacugcg

SEQ ID NO: 666080 - RNA, 22 nt, Human
ugacagggggcagagguggcug

SEQ ID NO: 666081 - RNA, 22 nt, Human
ggguaugauagggaggugaaau

SEQ ID NO: 666082 - RNA, 22 nt, Human
ccagcucuggcuucuugcuggg

SEQ ID NO: 666083 - RNA, 22 nt, Human
aucaagucugccugucuggagg

SEQ ID NO: 666084 - RNA, 22 nt, Human
uaaauguggagacucaggaguc

SEQ ID NO: 666085 - RNA, 22 nt, Human
ccuuugcauucuagauguuuag

SEQ ID NO: 666086 - RNA, 22 nt, Human
uccugagauccuuuuagggauc

SEQ ID NO: 666087 - RNA, 22 nt, Human
ggaagggcaauaaaaucucagg

SEQ ID NO: 666088 - RNA, 22 nt, Human
ccugcuggcugguagaguuccg

SEQ ID NO: 666089 - RNA, 22 nt, Human
caugcacauuauucaaagccca

SEQ ID NO: 666090 - RNA, 22 nt, Human
uacaguaaaugugguagaaacu

SEQ ID NO: 666091 - RNA, 22 nt, Human
aguuuuaucuguaagcuguuca

SEQ ID NO: 666092 - RNA, 22 nt, Human
ugcuggcuuauuuaguaaaugu

SEQ ID NO: 666093 - RNA, 22 nt, Human
gaaucauuggaaccacauccaa

SEQ ID NO: 666094 - RNA, 22 nt, Human
uggccaauggcuccggccucau

SEQ ID NO: 666095 - RNA, 22 nt, Human
ugccaaguuucucucagggacu

SEQ ID NO: 666096 - RNA, 22 nt, Human
caggaaugccuucuucagccau

SEQ ID NO: 666097 - RNA, 22 nt, Human
cauauacuuuucuauagcuuuc

SEQ ID NO: 666098 - RNA, 22 nt, Human
ccaggaggaaauucuaaaggua

SEQ ID NO: 666099 - RNA, 22 nt, Human
caguuuuaugaaugcuuauuag

SEQ ID NO: 666100 - RNA, 22 nt, Human
ccccaccugugcgucugccgca

SEQ ID NO: 666101 - RNA, 22 nt, Human
uucggaguauugacaugugaag

SEQ ID NO: 666102 - RNA, 15 nt, Human
ucccugggagauggu

SEQ ID NO: 666103 - RNA, 22 nt, Human
aauauugagaaccagcauguuu

SEQ ID NO: 666104 - RNA, 22 nt, Human
uguggagcccccaggagugggg

SEQ ID NO: 666105 - RNA, 22 nt, Human
ccucacuggccagccaggggug

SEQ ID NO: 666106 - RNA, 22 nt, Human
caccaggagccaucaggagucc

SEQ ID NO: 666107 - RNA, 22 nt, Human
uuccuaaucacgaacauuauuu

SEQ ID NO: 666108 - RNA, 22 nt, Human
aguuuaugucuuuacuucagcu

SEQ ID NO: 666109 - RNA, 19 nt, Human
uccauaagcuuguguucau

SEQ ID NO: 666110 - RNA, 21 nt, Human
gggguuggcaagagcagagac

SEQ ID NO: 666111 - RNA, 22 nt, Human
uuagucccauuauaugacuucu

SEQ ID NO: 666112 - RNA, 22 nt, Human
agcugacuucuugauccaauga

SEQ ID NO: 666113 - RNA, 16 nt, Human
agggccagaagcauca

SEQ ID NO: 666114 - RNA, 21 nt, Human
ucucacugucugcuuuguuua

SEQ ID NO: 666115 - RNA, 22 nt, Human
cagaggauuauggagauggucu

SEQ ID NO: 666116 - RNA, 22 nt, Human
gcaucuaaacuugcaucauugu

SEQ ID NO: 666117 - RNA, 22 nt, Human
aucuggcucacuuagucuagga

SEQ ID NO: 666118 - RNA, 22 nt, Human
ccagcucugcauguuucccuug

SEQ ID NO: 666119 - RNA, 22 nt, Human
gagccuucaucgcagccuuguu

SEQ ID NO: 666120 - RNA, 22 nt, Human
uccuucuacacugccucugaga

SEQ ID NO: 666121 - RNA, 22 nt, Human
cgagagauggguuggcaggggc

SEQ ID NO: 666122 - RNA, 22 nt, Human
aaagcaaucagauucagauguc

SEQ ID NO: 666123 - RNA, 22 nt, Human
ucucuuaauucagaggcaguua

SEQ ID NO: 666124 - RNA, 22 nt, Human
gcucuguccagcgugcacagaa

SEQ ID NO: 666125 - RNA, 22 nt, Human
uccuggaguauuucuguggugu

SEQ ID NO: 666126 - RNA, 22 nt, Human
cacauuccccagagcuggggcu

SEQ ID NO: 666127 - RNA, 23 nt, Human
ugagaagccauuagagcaggugg

SEQ ID NO: 666128 - RNA, 22 nt, Human
cagggugcuuccguggagcugu

SEQ ID NO: 666129 - RNA, 22 nt, Human
agcuagaaguccuagauaaagg

SEQ ID NO: 666130 - RNA, 22 nt, Human
caggcugauaggguccaaaguu

SEQ ID NO: 666131 - RNA, 22 nt, Human
acaugcagacgggauccuggca

SEQ ID NO: 666132 - RNA, 22 nt, Human
ucauuucucugagucugauaau

SEQ ID NO: 666133 - RNA, 22 nt, Human
agucacaguucugcugucugag

SEQ ID NO: 666134 - RNA, 22 nt, Human
uuuauugcccuguaguacagga

SEQ ID NO: 666135 - RNA, 22 nt, Human
guacuucuggccaggcuggcca

SEQ ID NO: 666136 - RNA, 22 nt, Human
acucccagguugccuggcaggc

SEQ ID NO: 666137 - RNA, 22 nt, Human
ggugugccuggggcuuagcugc

SEQ ID NO: 666138 - RNA, 22 nt, Human
acagaaauugggcaaauggaag

SEQ ID NO: 666139 - RNA, 22 nt, Human
cccaggcacacugaagugacau

SEQ ID NO: 666140 - RNA, 22 nt, Human
ucacaguuaauuguuggaaugu

SEQ ID NO: 666141 - RNA, 22 nt, Human
uuccaggagccacacaggggcg

SEQ ID NO: 666142 - RNA, 22 nt, Human
gcuggagaaacaggaggaggaa

SEQ ID NO: 666143 - RNA, 22 nt, Human
ggccuuugcguccacgccgcuu

SEQ ID NO: 666144 - RNA, 22 nt, Human
aggacagcauuuucagcaucuc

SEQ ID NO: 666145 - RNA, 22 nt, Human
aggccaggaauccuugucccag

SEQ ID NO: 666146 - RNA, 22 nt, Human
caggcagcugcuggguucagcc

SEQ ID NO: 666147 - RNA, 22 nt, Human
augcauaucacagucuccaugu

SEQ ID NO: 666148 - RNA, 22 nt, Human
ugggagaaucuugcucugcuac

SEQ ID NO: 666149 - RNA, 22 nt, Human
cagaggcuaaggguagcuuggg

SEQ ID NO: 666150 - RNA, 23 nt, Human
acaugggagggacauggaggcug

SEQ ID NO: 666151 - RNA, 22 nt, Human
cuccuaggugcucacugggguc

SEQ ID NO: 666152 - RNA, 22 nt, Human
accaggcuguugggcccagugu

SEQ ID NO: 666153 - RNA, 22 nt, Human
ggagcgugcacuccaggcccuu

SEQ ID NO: 666154 - RNA, 22 nt, Human
uguggcuuaagaaugccuuuaa

SEQ ID NO: 666155 - RNA, 22 nt, Human
acacaauggcgugugccacaga

SEQ ID NO: 666156 - RNA, 22 nt, Human
gaguacaucuuaauuugacuaa

SEQ ID NO: 666157 - RNA, 22 nt, Human
uuugcuugacccuugugcugaa

SEQ ID NO: 666158 - RNA, 22 nt, Human
ugugggugaugaauuuguucuu

SEQ ID NO: 666159 - RNA, 22 nt, Human
uggcucagucauggaugaguaa

SEQ ID NO: 666160 - RNA, 22 nt, Human
gaggcuggucagcccuaagauc

SEQ ID NO: 666161 - RNA, 22 nt, Human
ugcugccugguuucuucuugcu

SEQ ID NO: 666162 - RNA, 22 nt, Human
cuggcucacaggugagaugcau

SEQ ID NO: 666163 - RNA, 22 nt, Human
gcucccagacugaccagaggug

SEQ ID NO: 666164 - RNA, 22 nt, Human
ucuuucuuauuagccauuguuc

SEQ ID NO: 666165 - RNA, 22 nt, Human
ugaaagaugcucaaugaauggu

SEQ ID NO: 666166 - RNA, 22 nt, Human
acaauguuuugaaacaucuagg

SEQ ID NO: 666167 - RNA, 22 nt, Human
uuccuaauggcaaaacauguuu

SEQ ID NO: 666168 - RNA, 22 nt, Human
auggauaaugucucuguuuccc

SEQ ID NO: 666169 - RNA, 22 nt, Human
aagauguuuagauuuauacaau

SEQ ID NO: 666170 - RNA, 22 nt, Human
ugccuuccuggagcugaaggcu

SEQ ID NO: 666171 - RNA, 22 nt, Human
aggcucugugcagccugcaucu

SEQ ID NO: 666172 - RNA, 22 nt, Human
uacuauuuugacaugaaauuga

SEQ ID NO: 666173 - RNA, 22 nt, Human
caucugaauaucccaggcauau

SEQ ID NO: 666174 - RNA, 22 nt, Human
ugaugagggaacugguucauac

SEQ ID NO: 666175 - RNA, 22 nt, Human
agagaaaguccugaucucucua

SEQ ID NO: 666176 - RNA, 22 nt, Human
agucugccuuuccaaucccgug

SEQ ID NO: 666177 - RNA, 22 nt, Human
ugagguaugcugaacucuguuu

SEQ ID NO: 666178 - RNA, 22 nt, Human
cagguaggaggcucccuagucc

SEQ ID NO: 666179 - RNA, 22 nt, Human
ugugaggaggcggccagaagag

SEQ ID NO: 666180 - RNA, 22 nt, Human
agcagccuauucuucucuugga

SEQ ID NO: 666181 - RNA, 22 nt, Human
acauguguacuuuuaaggaugu

SEQ ID NO: 666182 - RNA, 20 nt, Human
guggcccuuaaagagggaag

SEQ ID NO: 666183 - RNA, 22 nt, Human
gcucaggccuccagaggggcaa

SEQ ID NO: 666184 - RNA, 22 nt, Human
acagagauggcacagagaaggu

SEQ ID NO: 666185 - RNA, 22 nt, Human
caugugugacaaacugccugca

SEQ ID NO: 666186 - RNA, 22 nt, Human
aaaccuguagcaguuuguuaca

SEQ ID NO: 666187 - RNA, 18 nt, Human
uuggggugaggccaggaa

SEQ ID NO: 666188 - RNA, 22 nt, Human
agggaagaaucacugggauguu

SEQ ID NO: 666189 - RNA, 22 nt, Human
uggcuccuucauucuccugcca

SEQ ID NO: 666190 - RNA, 22 nt, Human
agggcaugcuggaggagagaca

SEQ ID NO: 666191 - RNA, 22 nt, Human
aaauauguaagauuagcacuag

SEQ ID NO: 666192 - RNA, 21 nt, Human
augugaaaccuuccacgcuga

SEQ ID NO: 666193 - RNA, 22 nt, Human
guaaugaauagaugguggcagg

SEQ ID NO: 666194 - RNA, 20 nt, Human
gcaaaauaggcucuguuggu

SEQ ID NO: 666195 - RNA, 22 nt, Human
ggaagcugaauccagagacagg

SEQ ID NO: 666196 - RNA, 22 nt, Human
agggugcauguuugcaagagug

SEQ ID NO: 666197 - RNA, 22 nt, Human
cuucagaaccagccagaagagg

SEQ ID NO: 666198 - RNA, 22 nt, Human
caagaauauaaauacuuucaaa

SEQ ID NO: 666199 - RNA, 22 nt, Human
aggaccuuuggcaaggcugcuc

SEQ ID NO: 666200 - RNA, 22 nt, Human
cugggaagauggugacagaauu

SEQ ID NO: 666201 - RNA, 22 nt, Human
caggugcucccagagaagugcu

SEQ ID NO: 666202 - RNA, 23 nt, Human
ggcuccuggauucaaauccugcc

SEQ ID NO: 666203 - RNA, 22 nt, Human
ucccugccucucagacuuccuu

SEQ ID NO: 666204 - RNA, 22 nt, Human
ucagcugcugugguauguacau

SEQ ID NO: 666205 - RNA, 22 nt, Human
acaugcuaauggagaugccaag

SEQ ID NO: 666206 - RNA, 19 nt, Human
aggguccaggcccugugga

SEQ ID NO: 666207 - RNA, 22 nt, Human
ggcgcaggccuuggauccuggu

SEQ ID NO: 666208 - RNA, 22 nt, Human
auguggcugucacagcauaaug

SEQ ID NO: 666209 - RNA, 18 nt, Human
ucuggcuuuguuccuugu

SEQ ID NO: 666210 - RNA, 22 nt, Human
ugauuacaauugucuuagauuu

SEQ ID NO: 666211 - RNA, 22 nt, Human
agucauaaagccagugggaggc

SEQ ID NO: 666212 - RNA, 22 nt, Human
gugggaguggggaagcagagug

SEQ ID NO: 666213 - RNA, 22 nt, Human
gcuuugcugggugcuucaugua

SEQ ID NO: 666214 - RNA, 22 nt, Human
cuuuuucauuggcuuuaggaca

SEQ ID NO: 666215 - RNA, 22 nt, Human
cacauugauaauuaaggccucc

SEQ ID NO: 666216 - RNA, 22 nt, Human
gccaccagccccaugcgcugug

SEQ ID NO: 666217 - RNA, 22 nt, Human
gcaguguucuaaauugggugug

SEQ ID NO: 666218 - RNA, 22 nt, Human
gggagagguuacccgagcaacu

SEQ ID NO: 666219 - RNA, 22 nt, Human
aaagucaguuggccagaucacu

SEQ ID NO: 666220 - RNA, 22 nt, Human
uggaaaggacaguugcugauag

SEQ ID NO: 666221 - RNA, 22 nt, Human
cuuccaggguccaggaagagcc

SEQ ID NO: 666222 - RNA, 21 nt, Human
uagcauuuuuguauugcugaa

SEQ ID NO: 666223 - RNA, 19 nt, Human
gccaggagggcucuggcug

SEQ ID NO: 666224 - RNA, 22 nt, Human
cauacaaucaaguucuuuauua

SEQ ID NO: 666225 - RNA, 22 nt, Human
uuacagaugggguugcaauaaa

SEQ ID NO: 666226 - RNA, 22 nt, Human
cgccaggcuugguagcucaugc

SEQ ID NO: 666227 - RNA, 22 nt, Human
ucuuguauguguauuuugcugu

SEQ ID NO: 666228 - RNA, 22 nt, Human
agugcccggggugccagacaca

SEQ ID NO: 666229 - RNA, 22 nt, Human
cagagccaaaaccguaacagcc

SEQ ID NO: 666230 - RNA, 22 nt, Human
aaacacuaauaacaguggcugg

SEQ ID NO: 666231 - RNA, 22 nt, Human
ucaggacagccagggugcagac

SEQ ID NO: 666232 - RNA, 22 nt, Human
aaaaagcuuaaaugagcaguuc

SEQ ID NO: 666233 - RNA, 22 nt, Human
cacuguaauagcauuauaagug

SEQ ID NO: 666234 - RNA, 23 nt, Human
gccaauuuaguaaaggcaguggg

SEQ ID NO: 666235 - RNA, 22 nt, Human
uuggaggaugcaaugagggagu

SEQ ID NO: 666236 - RNA, 22 nt, Human
aaagguuuauuuguugcucaca

SEQ ID NO: 666237 - RNA, 22 nt, Human
caaauacuaaacauaagauuuu

SEQ ID NO: 666238 - RNA, 22 nt, Human
gccagcugucuaagagaguaaa

SEQ ID NO: 666239 - RNA, 22 nt, Human
agcacagaauggcuuggaagcc

SEQ ID NO: 666240 - RNA, 22 nt, Human
cuuuccuagauggccaucuuuc

SEQ ID NO: 666241 - RNA, 23 nt, Human
agcuuugugaaagcagacauggg

SEQ ID NO: 666242 - RNA, 20 nt, Human
acuggcacugguaggugugg

SEQ ID NO: 666243 - RNA, 22 nt, Human
agccagcagggcuuagaggaca

SEQ ID NO: 666244 - RNA, 22 nt, Human
aacaugucuggguauucacaag

SEQ ID NO: 666245 - RNA, 22 nt, Human
cugucuguugaccauaguuugc

SEQ ID NO: 666246 - RNA, 22 nt, Human
cauguuaaugaauuuuugcagu

SEQ ID NO: 666247 - RNA, 22 nt, Human
aaaagcaagaggcuggauuaaa

SEQ ID NO: 666248 - RNA, 22 nt, Human
cagaugaggacagaugacuggg

SEQ ID NO: 666249 - RNA, 22 nt, Human
acagugaugagggaauuuugug

SEQ ID NO: 666250 - RNA, 22 nt, Human
cugcaggggcuggaguuggcuu

SEQ ID NO: 666251 - RNA, 22 nt, Human
uuuguagacgucagaaguuacu

SEQ ID NO: 666252 - RNA, 22 nt, Human
ucuguaaaacuucuuuguaaau

SEQ ID NO: 666253 - RNA, 22 nt, Human
cugacagauuagaugugcauau

SEQ ID NO: 666254 - RNA, 22 nt, Human
cagaggauauaugguuuguaug

SEQ ID NO: 666255 - RNA, 22 nt, Human
cugugaggcccugggugcugga

SEQ ID NO: 666256 - RNA, 22 nt, Human
auggcuuggcaccaucuccuug

SEQ ID NO: 666257 - RNA, 22 nt, Human
agcaggugggcaugaaagcuga

SEQ ID NO: 666258 - RNA, 22 nt, Human
ugcucccagggacucuggcugg

SEQ ID NO: 666259 - RNA, 22 nt, Human
acagaacugcaggaggaaaagc

SEQ ID NO: 666260 - RNA, 22 nt, Human
uguaaaauaccauuccuuguca

SEQ ID NO: 666261 - RNA, 22 nt, Human
gucugccucuauugccuaccug

SEQ ID NO: 666262 - RNA, 22 nt, Human
ucaauguucuugguauauccuu

SEQ ID NO: 666263 - RNA, 22 nt, Human
uuucucucuuaaggaguuuaaa

SEQ ID NO: 666264 - RNA, 19 nt, Human
ccagugccggcgcugggga

SEQ ID NO: 666265 - RNA, 22 nt, Human
aaugucuucaguguauacaugg

SEQ ID NO: 666266 - RNA, 22 nt, Human
agcuguugaaaaugguguccua

SEQ ID NO: 666267 - RNA, 22 nt, Human
guuuccagagugagggcacuug

SEQ ID NO: 666268 - RNA, 22 nt, Human
agccaguuuccagauauuaacu

SEQ ID NO: 666269 - RNA, 22 nt, Human
auuucuuccuucuccuagaaga

SEQ ID NO: 666270 - RNA, 22 nt, Human
ucuccuggccgggcuguccccu

SEQ ID NO: 666271 - RNA, 22 nt, Human
uggcuuggcuaagaucuaagcu

SEQ ID NO: 666272 - RNA, 22 nt, Human
ugucauguggcaauuaaagcag

SEQ ID NO: 666273 - RNA, 22 nt, Human
uaccuggggcugggcuuugauu

SEQ ID NO: 666274 - RNA, 22 nt, Human
aagcauuucagguagagauauu

SEQ ID NO: 666275 - RNA, 22 nt, Human
ugcaggugagugcaggggcuca

SEQ ID NO: 666276 - RNA, 22 nt, Human
cucuggcggccaugcucguggu

SEQ ID NO: 666277 - RNA, 21 nt, Human
cugggcuuucucucaaagaca

SEQ ID NO: 666278 - RNA, 19 nt, Human
cccugcccuggugacuggg

SEQ ID NO: 666279 - RNA, 22 nt, Human
uuucaaggauguuauauaaaug

SEQ ID NO: 666280 - RNA, 22 nt, Human
augguacaaaauguauaaaguc

SEQ ID NO: 666281 - RNA, 22 nt, Human
uuuguacagugauguuguaugc

SEQ ID NO: 666282 - RNA, 22 nt, Human
aagcacaggaucuugaggagcg

SEQ ID NO: 666283 - RNA, 22 nt, Human
uaauugcucgagaaauaaccuc

SEQ ID NO: 666284 - RNA, 22 nt, Human
uaauuucaauagcuugcauaau

SEQ ID NO: 666285 - RNA, 17 nt, Human
ucugaagccagucugcu

SEQ ID NO: 666286 - RNA, 22 nt, Human
gauuuuacaaacugcaggaccc

SEQ ID NO: 666287 - RNA, 22 nt, Human
uugggcccauggggcuaagcua

SEQ ID NO: 666288 - RNA, 22 nt, Human
cucugcaccuuguaggaggcaa

SEQ ID NO: 666289 - RNA, 20 nt, Human
gaaccuggggaaggaguagg

SEQ ID NO: 666290 - RNA, 22 nt, Human
aggccagcccucaccuguguuc

SEQ ID NO: 666291 - RNA, 22 nt, Human
gugaggaucaaaugaaauagca

SEQ ID NO: 666292 - RNA, 22 nt, Human
cccugauggcacaguggcaggc

SEQ ID NO: 666293 - RNA, 22 nt, Human
agaggcuuccugccaccugaga

SEQ ID NO: 666294 - RNA, 22 nt, Human
agaaguuugguccuuuucaagg

SEQ ID NO: 666295 - RNA, 22 nt, Human
auauuuugaaguuaauaaugug

SEQ ID NO: 666296 - RNA, 22 nt, Human
uugauacagcagccugugaucc

SEQ ID NO: 666297 - RNA, 21 nt, Human
ggcccugguuacgccuccucu

SEQ ID NO: 666298 - RNA, 22 nt, Human
caugagaagguuuuggcauaua

SEQ ID NO: 666299 - RNA, 22 nt, Human
ccaggagauuuuuccauagcac

SEQ ID NO: 666300 - RNA, 22 nt, Human
cacaguuugguuuugcuguaau

SEQ ID NO: 666301 - RNA, 21 nt, Human
caguucucuuagauuuccagu

SEQ ID NO: 666302 - RNA, 23 nt, Human
caggagauggcugcugugucagc

SEQ ID NO: 666303 - RNA, 22 nt, Human
ucugugcaaguauuugacauuu

SEQ ID NO: 666304 - RNA, 22 nt, Human
aggcagcaaagaaaugaugcug

SEQ ID NO: 666305 - RNA, 22 nt, Human
agggcuuuugcaauccaagucu

SEQ ID NO: 666306 - RNA, 22 nt, Human
uggcucaguaaucgagucuccu

SEQ ID NO: 666307 - RNA, 22 nt, Human
gaggccaaucaauagggcaaua

SEQ ID NO: 666308 - RNA, 19 nt, Human
ugcucauggggacuucucc

SEQ ID NO: 666309 - RNA, 22 nt, Human
gaaggaggcuccccaaagucug

SEQ ID NO: 666310 - RNA, 22 nt, Human
ucggagaguucaugaagacccg

SEQ ID NO: 666311 - RNA, 20 nt, Human
cugggucuccuucugcuuaa

SEQ ID NO: 666312 - RNA, 22 nt, Human
uuuccaggagaaagagagccuu

SEQ ID NO: 666313 - RNA, 22 nt, Human
aguaaggcauuuuucauguuua

SEQ ID NO: 666314 - RNA, 22 nt, Human
uuugaaacucugaacauguuuc

SEQ ID NO: 666315 - RNA, 22 nt, Human
ugugccuggucccugagucgag

SEQ ID NO: 666316 - RNA, 22 nt, Human
gaaucccaaucuguuauugaca

SEQ ID NO: 666317 - RNA, 22 nt, Human
ccagggcauguccaagacuuag

SEQ ID NO: 666318 - RNA, 22 nt, Human
ccagggcuucccacgugcccug

SEQ ID NO: 666319 - RNA, 23 nt, Human
ugcuggaguuuacucaggccagc

SEQ ID NO: 666320 - RNA, 22 nt, Human
aaagaacuuauccuagaauuug

SEQ ID NO: 666321 - RNA, 22 nt, Human
aggcuggaugugccucaccgag

SEQ ID NO: 666322 - RNA, 22 nt, Human
gcagggcuuagaaaugguggcu

SEQ ID NO: 666323 - RNA, 22 nt, Human
acuuuccuagacuucagugaca

SEQ ID NO: 666324 - RNA, 22 nt, Human
ccucgcggcacucgggccggau

SEQ ID NO: 666325 - RNA, 22 nt, Human
aagacauuuauuugaaucaauu

SEQ ID NO: 666326 - RNA, 22 nt, Human
uauaugcaauuuuuuagugcaa

SEQ ID NO: 666327 - RNA, 22 nt, Human
cugcaucucugcuagucaguca

SEQ ID NO: 666328 - RNA, 22 nt, Human
cagcccugggucccugcccugg

SEQ ID NO: 666329 - RNA, 22 nt, Human
ugugaaggagcaugcagagggg

SEQ ID NO: 666330 - RNA, 22 nt, Human
uugccagggccagugggggugu

SEQ ID NO: 666331 - RNA, 22 nt, Human
acugucaccaucagagcgggaa

SEQ ID NO: 666332 - RNA, 20 nt, Human
agugaggcaguucagugggc

SEQ ID NO: 666333 - RNA, 22 nt, Human
uuucuaagaauauugcucuuaa

SEQ ID NO: 666334 - RNA, 22 nt, Human
agcugggugaaggcagauggcu

SEQ ID NO: 666335 - RNA, 22 nt, Human
ccuuaaaagaacuaucucuucu

SEQ ID NO: 666336 - RNA, 22 nt, Human
auggcugggauuuccuuugcgu

SEQ ID NO: 666337 - RNA, 22 nt, Human
acacauguaaaacacuuagcaa

SEQ ID NO: 666338 - RNA, 22 nt, Human
gccuggcccagggcucuuguug

SEQ ID NO: 666339 - RNA, 22 nt, Human
ugcaguggaaucuggagagcag

SEQ ID NO: 666340 - RNA, 22 nt, Human
aauugcuugucuucuucccuac

SEQ ID NO: 666341 - RNA, 22 nt, Human
cacuugcagacuuugccugguu

SEQ ID NO: 666342 - RNA, 22 nt, Human
augcauucagcggaaugcuuag

SEQ ID NO: 666343 - RNA, 22 nt, Human
aguguuuacauugaagcuugua

SEQ ID NO: 666344 - RNA, 22 nt, Human
cuucuuaaugacagauuaaaau

SEQ ID NO: 666345 - RNA, 22 nt, Human
uuguucauaaagacaguucaga

SEQ ID NO: 666346 - RNA, 22 nt, Human
gggacgugagugaagaaggucu

SEQ ID NO: 666347 - RNA, 21 nt, Human
guguuggcauauggugguuga

SEQ ID NO: 666348 - RNA, 22 nt, Human
gcuggcaggauaacuucuaagc

SEQ ID NO: 666349 - RNA, 22 nt, Human
uccugaggcucacuuugaaugu

SEQ ID NO: 666350 - RNA, 22 nt, Human
cugagccuuauucaccagcccu

SEQ ID NO: 666351 - RNA, 22 nt, Human
uucuucagugccccucuaguag

SEQ ID NO: 666352 - RNA, 22 nt, Human
auucugcauaauuuccuggcag

SEQ ID NO: 666353 - RNA, 22 nt, Human
cucugaccauucccuugauuuu

SEQ ID NO: 666354 - RNA, 22 nt, Human
ggcucaggaugagccuucucau

SEQ ID NO: 666355 - RNA, 22 nt, Human
auugcaaauaacuguacugaau

SEQ ID NO: 666356 - RNA, 22 nt, Human
gcugagagcaguguggccuuaa

SEQ ID NO: 666357 - RNA, 22 nt, Human
gugugcaggcuugaggauuagg

SEQ ID NO: 666358 - RNA, 22 nt, Human
ucugacaauuagccuaguccug

SEQ ID NO: 666359 - RNA, 22 nt, Human
uucuuuccaaccagauauuggu

SEQ ID NO: 666360 - RNA, 22 nt, Human
caggagcaguuagaagcccacu

SEQ ID NO: 666361 - RNA, 22 nt, Human
uuucacagagaauauugccuug

SEQ ID NO: 666362 - RNA, 18 nt, Human
gugcugaauaacuacuuu

SEQ ID NO: 666363 - RNA, 22 nt, Human
gacuucaaagcgugauaaagau

SEQ ID NO: 666364 - RNA, 20 nt, Human
gacagcuuggggugucaccu

SEQ ID NO: 666365 - RNA, 22 nt, Human
acuagaaagcaaaagccauuuc

SEQ ID NO: 666366 - RNA, 22 nt, Human
auguaaguauucaaaauauuuc

SEQ ID NO: 666367 - RNA, 22 nt, Human
aucaggaaugaauacuuuugga

SEQ ID NO: 666368 - RNA, 22 nt, Human
uggggagguucgggaaucuugu

SEQ ID NO: 666369 - RNA, 22 nt, Human
uccacugguauccacagugggg

SEQ ID NO: 666370 - RNA, 22 nt, Human
acugccuggccuggccucacug

SEQ ID NO: 666371 - RNA, 20 nt, Human
aguuugugugucuaugcgcu

SEQ ID NO: 666372 - RNA, 22 nt, Human
uugagauagguggaaucucuuu

SEQ ID NO: 666373 - RNA, 22 nt, Human
gauuucaaccuaacaguaugac

SEQ ID NO: 666374 - RNA, 22 nt, Human
gaaaaguucaucauauauucag

SEQ ID NO: 666375 - RNA, 22 nt, Human
uuccucaugggguuccuucaga

SEQ ID NO: 666376 - RNA, 22 nt, Human
ccaccaugggaagagagacuaa

SEQ ID NO: 666377 - RNA, 22 nt, Human
gcugagguggagauugcaguga

SEQ ID NO: 666378 - RNA, 20 nt, Human
ucugcagauaagggaaagac

SEQ ID NO: 666379 - RNA, 22 nt, Human
gcccuuggaacagccuccugcu

SEQ ID NO: 666380 - RNA, 22 nt, Human
gacaggaaauauggggguuguu

SEQ ID NO: 666381 - RNA, 20 nt, Human
ugcguguguauuuauuuucu

SEQ ID NO: 666382 - RNA, 22 nt, Human
cuggccuuggaagggagcccgu

SEQ ID NO: 666383 - RNA, 22 nt, Human
agcagaugcgucugagugggag

SEQ ID NO: 666384 - RNA, 22 nt, Human
cugucuggaugugagucaccua

SEQ ID NO: 666385 - RNA, 22 nt, Human
gugagacacgugugugaccugg

SEQ ID NO: 666386 - RNA, 22 nt, Human
gaacaaacauuuuuggcaguau

SEQ ID NO: 666387 - RNA, 22 nt, Human
uccagcucaggguuggcucaag

SEQ ID NO: 666388 - RNA, 22 nt, Human
uuacaaagguaguuuugucuau

SEQ ID NO: 666389 - RNA, 22 nt, Human
auuaaggauuauacucuccuuu

SEQ ID NO: 666390 - RNA, 22 nt, Human
uucacagugccagggggcaggc

SEQ ID NO: 666391 - RNA, 22 nt, Human
caagggcagaggcagggccccg

SEQ ID NO: 666392 - RNA, 22 nt, Human
gggcuucaauagcagaggcgug

SEQ ID NO: 666393 - RNA, 22 nt, Human
aaaguguggagauugaacuaaa

SEQ ID NO: 666394 - RNA, 22 nt, Human
ugcuggaagagaauacuggugg

SEQ ID NO: 666395 - RNA, 23 nt, Human
ggcucccuccuagcuuucccaau

SEQ ID NO: 666396 - RNA, 22 nt, Human
uaacacauuaguucuccuagau

SEQ ID NO: 666397 - RNA, 22 nt, Human
gccagccauaggccagcacugg

SEQ ID NO: 666398 - RNA, 23 nt, Human
cagcacaguacauuuccugucuc

SEQ ID NO: 666399 - RNA, 22 nt, Human
ggcuucucccauucuucagggg

SEQ ID NO: 666400 - RNA, 22 nt, Human
aggagcugagggagcgcccuug

SEQ ID NO: 666401 - RNA, 22 nt, Human
ccagugcaccauuucccucugu

SEQ ID NO: 666402 - RNA, 22 nt, Human
uuucacaagacagcuacuguug

SEQ ID NO: 666403 - RNA, 22 nt, Human
uaggcugagcuaagagagcuua

SEQ ID NO: 666404 - RNA, 22 nt, Human
uggcauccucucuucugagugc

SEQ ID NO: 666405 - RNA, 22 nt, Human
gggaggagcuuggagauucacu

SEQ ID NO: 666406 - RNA, 22 nt, Human
cugagccagagggagucggguc

SEQ ID NO: 666407 - RNA, 21 nt, Human
guucuacaguuuuagaauucc

SEQ ID NO: 666408 - RNA, 22 nt, Human
agaucugguuggaguccugaca

SEQ ID NO: 666409 - RNA, 22 nt, Human
ucugaagcuggaggaagcuuug

SEQ ID NO: 666410 - RNA, 22 nt, Human
gacagaggagaagaugcugugg

SEQ ID NO: 666411 - RNA, 22 nt, Human
ggagagaauuccauggacaugu

SEQ ID NO: 666412 - RNA, 22 nt, Human
cuagggaaauaaacugaguggu

SEQ ID NO: 666413 - RNA, 22 nt, Human
uugcaggugagggaaaugacug

SEQ ID NO: 666414 - RNA, 22 nt, Human
gaacagugccagcacacaauaa

SEQ ID NO: 666415 - RNA, 22 nt, Human
gcacagcucaguacucccucug

SEQ ID NO: 666416 - RNA, 22 nt, Human
ucuccugaugaugguacuggca

SEQ ID NO: 666417 - RNA, 22 nt, Human
ugaccacagacccaaugacuac

SEQ ID NO: 666418 - RNA, 22 nt, Human
uaauuuaauuccauggauucua

SEQ ID NO: 666419 - RNA, 22 nt, Human
auucucaauggcuacuuucaua

SEQ ID NO: 666420 - RNA, 22 nt, Human
caacagucucuauagcuccuug

SEQ ID NO: 666421 - RNA, 22 nt, Human
gaaggccuaggaaggaagccuu

SEQ ID NO: 666422 - RNA, 22 nt, Human
ggcugcagauagccagccacca

SEQ ID NO: 666423 - RNA, 22 nt, Human
uucacaucuauaacuuagauaa

SEQ ID NO: 666424 - RNA, 22 nt, Human
auacagaauuugcccuuuucau

SEQ ID NO: 666425 - RNA, 22 nt, Human
gcucccugaagagauuuggucu

SEQ ID NO: 666426 - RNA, 22 nt, Human
ugguaaaaaccgcaauuacauu

SEQ ID NO: 666427 - RNA, 22 nt, Human
aggaggguacaauggguggaaa

SEQ ID NO: 666428 - RNA, 22 nt, Human
aaucaggacccacucuacaguu

SEQ ID NO: 666429 - RNA, 22 nt, Human
uaugugcaugcugacuugagga

SEQ ID NO: 666430 - RNA, 23 nt, Human
ugggcccuggagucgccagucug

SEQ ID NO: 666431 - RNA, 22 nt, Human
agagccugcuguguaagucaca

SEQ ID NO: 666432 - RNA, 22 nt, Human
gagaggcucagggacuugcuga

SEQ ID NO: 666433 - RNA, 23 nt, Human
uugggcuggcucucgaugccucu

SEQ ID NO: 666434 - RNA, 22 nt, Human
uuucacagguauccacgggucu

SEQ ID NO: 666435 - RNA, 23 nt, Human
ggugguggugagucacgggcuca

SEQ ID NO: 666436 - RNA, 22 nt, Human
uacaguauggaaaauguauagu

SEQ ID NO: 666437 - RNA, 22 nt, Human
gauuucuugaccccugucucag

SEQ ID NO: 666438 - RNA, 22 nt, Human
gcacuuaggguauguacugggc

SEQ ID NO: 666439 - RNA, 22 nt, Human
ugcuucugcauucaauguugga

SEQ ID NO: 666440 - RNA, 22 nt, Human
cugcuucuccaaaguaggacuu

SEQ ID NO: 666441 - RNA, 22 nt, Human
auagacgcggccgcugaugcag

SEQ ID NO: 666442 - RNA, 22 nt, Human
ggaggggccggcugccugccac

SEQ ID NO: 666443 - RNA, 21 nt, Human
uggguggaagcgggaggccgc

SEQ ID NO: 666444 - RNA, 22 nt, Human
aaaugcagauuuugaugcagca

SEQ ID NO: 666445 - RNA, 22 nt, Human
cauuuaguuauacuaaaacauu

SEQ ID NO: 666446 - RNA, 22 nt, Human
ugaccuuucucugggugcuugg

SEQ ID NO: 666447 - RNA, 21 nt, Human
uguggcaucauugaucuguga

SEQ ID NO: 666448 - RNA, 22 nt, Human
agcccuagagaaccagccugug

SEQ ID NO: 666449 - RNA, 20 nt, Human
ucccaggcuccacccuagac

SEQ ID NO: 666450 - RNA, 22 nt, Human
cugcaccuacagccacauuuac

SEQ ID NO: 666451 - RNA, 22 nt, Human
cugaggcuggcguuugaggaag

SEQ ID NO: 666452 - RNA, 22 nt, Human
uuuuuugucccagagagccugg

SEQ ID NO: 666453 - RNA, 22 nt, Human
cccugcagagccagcccugacc

SEQ ID NO: 666454 - RNA, 22 nt, Human
uuggcauucaugggacaacaaa

SEQ ID NO: 666455 - RNA, 22 nt, Human
ugccugugguuccaguuuuuuc

SEQ ID NO: 666456 - RNA, 22 nt, Human
auggugaagcuucauggguguu

SEQ ID NO: 666457 - RNA, 22 nt, Human
ccuggggcuccagagcagcgga

SEQ ID NO: 666458 - RNA, 22 nt, Human
uccaguuuauuuuuggcagggu

SEQ ID NO: 666459 - RNA, 23 nt, Human
ggacacauuuauuucagaauuca

SEQ ID NO: 666460 - RNA, 22 nt, Human
auuuucuagauagaugaugcau

SEQ ID NO: 666461 - RNA, 22 nt, Human
ucacauuuuauaucucugguuu

SEQ ID NO: 666462 - RNA, 22 nt, Human
acaagauguguuuauacaagcu

SEQ ID NO: 666463 - RNA, 22 nt, Human
ggccaugguuggggaagacaug

SEQ ID NO: 666464 - RNA, 22 nt, Human
guuaaagugaucuugucagguu

SEQ ID NO: 666465 - RNA, 22 nt, Human
gaucuucuagcagaaguaauuu

SEQ ID NO: 666466 - RNA, 22 nt, Human
cagaggccauauuucuucacuc

SEQ ID NO: 666467 - RNA, 22 nt, Human
uacaauuuaguggugugugguu

SEQ ID NO: 666468 - RNA, 22 nt, Human
uccaggauugcaggugcacaac

SEQ ID NO: 666469 - RNA, 22 nt, Human
gcccuguguauccccugugcuu

SEQ ID NO: 666470 - RNA, 22 nt, Human
ggggcagcuaccggaaguaggg

SEQ ID NO: 666471 - RNA, 22 nt, Human
aggcuucccaagcagcugcaaa

SEQ ID NO: 666472 - RNA, 19 nt, Human
agcauuuggaauucuacac

SEQ ID NO: 666473 - RNA, 22 nt, Human
uuuacauguaauguuauacaaa

SEQ ID NO: 666474 - RNA, 23 nt, Human
accccaggcaucgcauuccucuu

SEQ ID NO: 666475 - RNA, 22 nt, Human
aauaucuuggcccaacuccaga

SEQ ID NO: 666476 - RNA, 22 nt, Human
cuuauuugcccauguuucuuua

SEQ ID NO: 666477 - RNA, 22 nt, Human
gucagacacauuucuuucagug

SEQ ID NO: 666478 - RNA, 22 nt, Human
acagcugugaaaauccacagga

SEQ ID NO: 666479 - RNA, 22 nt, Human
guuuugugaggcacccacaggu

SEQ ID NO: 666480 - RNA, 22 nt, Human
gccuguccuauacaggcggcug

SEQ ID NO: 666481 - RNA, 22 nt, Human
uuuauuucuuaguuugccacag

SEQ ID NO: 666482 - RNA, 22 nt, Human
ucaggaagccacuccacagaga

SEQ ID NO: 666483 - RNA, 22 nt, Human
ggcuagggaaaaugauuggaua

SEQ ID NO: 666484 - RNA, 22 nt, Human
uuugcauuguuucaaaagugaa

SEQ ID NO: 666485 - RNA, 22 nt, Human
ccauuuuauuagugacauuuag

SEQ ID NO: 666486 - RNA, 22 nt, Human
ugcuugcuggaggcagacagaa

SEQ ID NO: 666487 - RNA, 22 nt, Human
uacacacaugcauuugccuuau

SEQ ID NO: 666488 - RNA, 23 nt, Human
cugcagucgccggccugggugcc

SEQ ID NO: 666489 - RNA, 22 nt, Human
auucuggguucaugagugagcu

SEQ ID NO: 666490 - RNA, 22 nt, Human
uccagccacuugcacaguuaaa

SEQ ID NO: 666491 - RNA, 22 nt, Human
aagggcugagcacagugagcca

SEQ ID NO: 666492 - RNA, 22 nt, Human
gccaggaaugcauaaaugaccu

SEQ ID NO: 666493 - RNA, 22 nt, Human
aagggcugaaugaaggguugaa

SEQ ID NO: 666494 - RNA, 22 nt, Human
agaaggggcccaaggaugucag

SEQ ID NO: 666495 - RNA, 22 nt, Human
cagagguagcaugcuguggcuu

SEQ ID NO: 666496 - RNA, 22 nt, Human
cugagacacggagaggcugugu

SEQ ID NO: 666497 - RNA, 22 nt, Human
auuucucaguuccuacuguuua

SEQ ID NO: 666498 - RNA, 22 nt, Human
caaaugugguuucucagcauuc

SEQ ID NO: 666499 - RNA, 22 nt, Human
cagguccucgggggaggccggc

SEQ ID NO: 666500 - RNA, 22 nt, Human
uuuauagaugucuguauuauaa

SEQ ID NO: 666501 - RNA, 22 nt, Human
uccugagauucugcauuucuaa

SEQ ID NO: 666502 - RNA, 22 nt, Human
gccugagagucugcauuucuaa

SEQ ID NO: 666503 - RNA, 22 nt, Human
acugugccacaauucaccaggg

SEQ ID NO: 666504 - RNA, 22 nt, Human
uuuugugagcuccuuggaggua

SEQ ID NO: 666505 - RNA, 19 nt, Human
uaguggagugacaaguucu

SEQ ID NO: 666506 - RNA, 22 nt, Human
ggcagcaacucggagagaagag

SEQ ID NO: 666507 - RNA, 22 nt, Human
uggagaagcuguagguggacuc

SEQ ID NO: 666508 - RNA, 22 nt, Human
gaaauauuguacuggagauguu

SEQ ID NO: 666509 - RNA, 22 nt, Human
uuguauuagcuguaaauuuucu

SEQ ID NO: 666510 - RNA, 22 nt, Human
cauccaaagcaaauaucuuaaa

SEQ ID NO: 666511 - RNA, 20 nt, Human
acacaugucaagcuaaaggc

SEQ ID NO: 666512 - RNA, 22 nt, Human
aaguacauuuuuaacuuacagc

SEQ ID NO: 666513 - RNA, 22 nt, Human
aaauuacuuuacacuuucaucu

SEQ ID NO: 666514 - RNA, 19 nt, Human
agagaaggauccuaugguu

SEQ ID NO: 666515 - RNA, 20 nt, Human
acaggcuuucugaggcuggc

SEQ ID NO: 666516 - RNA, 20 nt, Human
uggagugcuguguugagaag

SEQ ID NO: 666517 - RNA, 22 nt, Human
gaggcugagacucugaauuuuu

SEQ ID NO: 666518 - RNA, 22 nt, Human
gugagagcugcuagacuguuau

SEQ ID NO: 666519 - RNA, 22 nt, Human
gcaggcuuguugaaguaaaaua

SEQ ID NO: 666520 - RNA, 22 nt, Human
aauguuugaccaaaaaacugca

SEQ ID NO: 666521 - RNA, 21 nt, Human
uuaaucagucucccugucucc

SEQ ID NO: 666522 - RNA, 22 nt, Human
acuugaaacaucuuuaaaugua

SEQ ID NO: 666523 - RNA, 22 nt, Human
gacccuggcagauaccgucaca

SEQ ID NO: 666524 - RNA, 22 nt, Human
gcuuugccuguagcauuggccu

SEQ ID NO: 666525 - RNA, 22 nt, Human
gacuuuauuuccuuauuuguga

SEQ ID NO: 666526 - RNA, 22 nt, Human
cuugaaugguaugagaguaauu

SEQ ID NO: 666527 - RNA, 22 nt, Human
gcaggauggguguagcccagca

SEQ ID NO: 666528 - RNA, 21 nt, Human
ccacuguagacucauucugag

SEQ ID NO: 666529 - RNA, 17 nt, Human
agcaaaaguaucaaagc

SEQ ID NO: 666530 - RNA, 22 nt, Human
augaacucauuuauuuuccucu

SEQ ID NO: 666531 - RNA, 22 nt, Human
ucagcaagaagcugugggcuuc

SEQ ID NO: 666532 - RNA, 22 nt, Human
ggaucugggguagagcaguggg

SEQ ID NO: 666533 - RNA, 22 nt, Human
ugaccugacaugaauuaaaaac

SEQ ID NO: 666534 - RNA, 22 nt, Human
aggaauuuuaauaugcuugucu

SEQ ID NO: 666535 - RNA, 23 nt, Human
ccagcugugccuggcccaggagc

SEQ ID NO: 666536 - RNA, 22 nt, Human
agcuggguacugaugucuucag

SEQ ID NO: 666537 - RNA, 22 nt, Human
uggaagggaacagguggguguu

SEQ ID NO: 666538 - RNA, 22 nt, Human
gaggucccccauggcugugacu

SEQ ID NO: 666539 - RNA, 22 nt, Human
aaaugugcuugugaucagcugu

SEQ ID NO: 666540 - RNA, 21 nt, Human
aggugggcagguggaguggcc

SEQ ID NO: 666541 - RNA, 22 nt, Human
gauuaugguaacaaugauuaaa

SEQ ID NO: 666542 - RNA, 21 nt, Human
aucugaaguuugagaggaaag

SEQ ID NO: 666543 - RNA, 22 nt, Human
ucugugugauuucagggaaguc

SEQ ID NO: 666544 - RNA, 22 nt, Human
uguggccaggccccugauggug

SEQ ID NO: 666545 - RNA, 22 nt, Human
gcaggcagucaucuuucauauu

SEQ ID NO: 666546 - RNA, 22 nt, Human
ucugugcuuaacuacucacccc

SEQ ID NO: 666547 - RNA, 22 nt, Human
aggcagaugguaacugugauau

SEQ ID NO: 666548 - RNA, 22 nt, Human
agcaccagcucaaggugcaccu

SEQ ID NO: 666549 - RNA, 21 nt, Human
gaugauggcaggcagcacugg

SEQ ID NO: 666550 - RNA, 23 nt, Human
uagagcagggaaaucugucagag

SEQ ID NO: 666551 - RNA, 19 nt, Human
uugcauuucauguuugauu

SEQ ID NO: 666552 - RNA, 22 nt, Human
cuaaaugauauuuugguuuccu

SEQ ID NO: 666553 - RNA, 22 nt, Human
agggacagaugaaugacugagu

SEQ ID NO: 666554 - RNA, 22 nt, Human
gagucuggacuauucuggucuu

SEQ ID NO: 666555 - RNA, 22 nt, Human
uggagcaggaaacaucuagagg

SEQ ID NO: 666556 - RNA, 22 nt, Human
ggucccaagugcuuuuccugca

SEQ ID NO: 666557 - RNA, 22 nt, Human
accacagaggaauuugaagagg

SEQ ID NO: 666558 - RNA, 17 nt, Human
uggaagugaggacacug

SEQ ID NO: 666559 - RNA, 22 nt, Human
ccacaguaaagaaacaacuucg

SEQ ID NO: 666560 - RNA, 22 nt, Human
cagguaggauggaagggcucaa

SEQ ID NO: 666561 - RNA, 22 nt, Human
uugaaaugcucuuuggaaucua

SEQ ID NO: 666562 - RNA, 22 nt, Human
uuugcucaguucucuguauuuu

SEQ ID NO: 666563 - RNA, 22 nt, Human
uccaggcaguuuuccagguugu

SEQ ID NO: 666564 - RNA, 20 nt, Human
gggcuagguagccauuuggc

SEQ ID NO: 666565 - RNA, 22 nt, Human
gcugcucucagagcucaugcug

SEQ ID NO: 666566 - RNA, 22 nt, Human
acgugcgugugcgcacacauac

SEQ ID NO: 666567 - RNA, 22 nt, Human
uggcagccaucagagcaggggu

SEQ ID NO: 666568 - RNA, 22 nt, Human
cuucucucccuggcacucagac

SEQ ID NO: 666569 - RNA, 22 nt, Human
ccagcuccuucugucuguggag

SEQ ID NO: 666570 - RNA, 22 nt, Human
ugagaacugccuguauuuaucu

SEQ ID NO: 666571 - RNA, 22 nt, Human
gucaggcccuggcagccgugac

SEQ ID NO: 666572 - RNA, 22 nt, Human
ccaggguuauaaaugcaucugu

SEQ ID NO: 666573 - RNA, 22 nt, Human
caauauauaggaacaacuuagg

SEQ ID NO: 666574 - RNA, 18 nt, Human
ggaaggaguggaccccag

SEQ ID NO: 666575 - RNA, 22 nt, Human
augccaagcucuaucccugacc

SEQ ID NO: 666576 - RNA, 22 nt, Human
uguuaaucaaucaacaguauua

SEQ ID NO: 666577 - RNA, 22 nt, Human
aaauauaccaguugccugcauc

SEQ ID NO: 666578 - RNA, 22 nt, Human
auaacucuguuuuuuucaugca

SEQ ID NO: 666579 - RNA, 22 nt, Human
ugucuauucaauauccauuucu

SEQ ID NO: 666580 - RNA, 20 nt, Human
uucauuugggaaaaucugcg

SEQ ID NO: 666581 - RNA, 22 nt, Human
gccccagcguggcuguguuagg

SEQ ID NO: 666582 - RNA, 22 nt, Human
augaaucaaaguucauuugauc

SEQ ID NO: 666583 - RNA, 22 nt, Human
ggagugguggucaggccauggc

SEQ ID NO: 666584 - RNA, 22 nt, Human
caauagcagaccuagaaagcaa

SEQ ID NO: 666585 - RNA, 22 nt, Human
agagccugucaauuguaaagag

SEQ ID NO: 666586 - RNA, 22 nt, Human
ugaaaacagaauccuuguuuuc

SEQ ID NO: 666587 - RNA, 22 nt, Human
cucuccuacauuucauucacaa

SEQ ID NO: 666588 - RNA, 22 nt, Human
caguguggcugagacagaggcu

SEQ ID NO: 666589 - RNA, 22 nt, Human
caccagcuuugcccacugccca

SEQ ID NO: 666590 - RNA, 22 nt, Human
ucacagacaccuuggccacagu

SEQ ID NO: 666591 - RNA, 22 nt, Human
uucuuuguuugauaaguaugcu

SEQ ID NO: 666592 - RNA, 23 nt, Human
cuguggcccugcuucaugcagcc

SEQ ID NO: 666593 - RNA, 22 nt, Human
ucaggaugagcucauaacuaug

SEQ ID NO: 666594 - RNA, 22 nt, Human
gucuccuggcugcagcuaagac

SEQ ID NO: 666595 - RNA, 22 nt, Human
ucuggggagucaaagagaccug

SEQ ID NO: 666596 - RNA, 22 nt, Human
cagcagaagcaacauucaggcu

SEQ ID NO: 666597 - RNA, 22 nt, Human
gcucuguguaaauguagggucc

SEQ ID NO: 666598 - RNA, 22 nt, Human
ccuugggcuugggcauagcuuu

SEQ ID NO: 666599 - RNA, 22 nt, Human
ucacugucccuguccucuuauc

SEQ ID NO: 666600 - RNA, 21 nt, Human
uguguuugagacuauguuucc

SEQ ID NO: 666601 - RNA, 22 nt, Human
gccagagacacuuggagguaga

SEQ ID NO: 666602 - RNA, 22 nt, Human
guucuguccucacugcaggccu

SEQ ID NO: 666603 - RNA, 22 nt, Human
cuccaugggggcuggccugugu

SEQ ID NO: 666604 - RNA, 22 nt, Human
ugcagcucugggcaagugccuu

SEQ ID NO: 666605 - RNA, 22 nt, Human
caggcacugugcugagcucugc

SEQ ID NO: 666606 - RNA, 22 nt, Human
uaauuauuugaagacauuagag

SEQ ID NO: 666607 - RNA, 22 nt, Human
gccugcccugaaagaggugaag

SEQ ID NO: 666608 - RNA, 22 nt, Human
ucagcuucgccugagguauggg

SEQ ID NO: 666609 - RNA, 22 nt, Human
gcauugauuuaaacaucucucu

SEQ ID NO: 666610 - RNA, 18 nt, Human
uugcuuuguaagcuugca

SEQ ID NO: 666611 - RNA, 22 nt, Human
agugaccaaucacugaaugauu

SEQ ID NO: 666612 - RNA, 22 nt, Human
aacuuucuugugacauuugggg

SEQ ID NO: 666613 - RNA, 22 nt, Human
uacaugcauuggauggcaauag

SEQ ID NO: 666614 - RNA, 22 nt, Human
acuucauguacuguucaaggcc

SEQ ID NO: 666615 - RNA, 22 nt, Human
uaaagguacgaagugagggauu

SEQ ID NO: 666616 - RNA, 22 nt, Human
augcugggaaacugaaaggaau

SEQ ID NO: 666617 - RNA, 22 nt, Human
aagaugugcugucuugccacuc

SEQ ID NO: 666618 - RNA, 22 nt, Human
uccuuuggaacugacuccguua

SEQ ID NO: 666619 - RNA, 22 nt, Human
ggagccuguggccgucacgacu

SEQ ID NO: 666620 - RNA, 22 nt, Human
uuaugaaguuccuguuacagug

SEQ ID NO: 666621 - RNA, 22 nt, Human
acaaagauaagucagaaaguca

SEQ ID NO: 666622 - RNA, 22 nt, Human
acugucugcaaaacucauacuc

SEQ ID NO: 666623 - RNA, 22 nt, Human
uccaagaguucaaggcuacagu

SEQ ID NO: 666624 - RNA, 22 nt, Human
aauaaucuugacuacugaauca

SEQ ID NO: 666625 - RNA, 22 nt, Human
ggagucagccugucagagugua

SEQ ID NO: 666626 - RNA, 22 nt, Human
gauuaacauuucuaagaugcca

SEQ ID NO: 666627 - RNA, 22 nt, Human
uugcuuuccgucaugugcuaau

SEQ ID NO: 666628 - RNA, 22 nt, Human
ccagcugcugugaggaccacag

SEQ ID NO: 666629 - RNA, 22 nt, Human
aagagacuaagaaagggcaaua

SEQ ID NO: 666630 - RNA, 22 nt, Human
aacaucagcacacaauagcaag

SEQ ID NO: 666631 - RNA, 22 nt, Human
guaaugcuuuugauacagggac

SEQ ID NO: 666632 - RNA, 22 nt, Human
auuccuugggaauuauugaaug

SEQ ID NO: 666633 - RNA, 22 nt, Human
ugugacaugugucaucuuuucu

SEQ ID NO: 666634 - RNA, 22 nt, Human
aaaugacagaguaagcuguuua

SEQ ID NO: 666635 - RNA, 22 nt, Human
uccaggccugacuauaaaugua

SEQ ID NO: 666636 - RNA, 22 nt, Human
agcuuacaguucaaugacaaag

SEQ ID NO: 666637 - RNA, 22 nt, Human
uucuuuaucaguuacucauagg

SEQ ID NO: 666638 - RNA, 22 nt, Human
ggacugugaggucugggugagg

SEQ ID NO: 666639 - RNA, 22 nt, Human
uacagauauuguacaguuauag

SEQ ID NO: 666640 - RNA, 22 nt, Human
aucagaggaccuaguugggcag

SEQ ID NO: 666641 - RNA, 22 nt, Human
uccaggaccucccaggcuagag

SEQ ID NO: 666642 - RNA, 17 nt, Human
uuaaaggaugcucucuc

SEQ ID NO: 666643 - RNA, 22 nt, Human
ucaaagagcuauucaguugugg

SEQ ID NO: 666644 - RNA, 22 nt, Human
aguauuucugcucaugaaagag

SEQ ID NO: 666645 - RNA, 22 nt, Human
cuccugggagcuguggcagagc

SEQ ID NO: 666646 - RNA, 22 nt, Human
uggccuugggcagguggccugc

SEQ ID NO: 666647 - RNA, 22 nt, Human
gcugccuuugugagccaagggg

SEQ ID NO: 666648 - RNA, 22 nt, Human
gcugaggcaaauaguuuuaagu

SEQ ID NO: 666649 - RNA, 22 nt, Human
caugucuguguacacaugcaca

SEQ ID NO: 666650 - RNA, 22 nt, Human
uugucaagauugagagaugacu

SEQ ID NO: 666651 - RNA, 18 nt, Human
uagcagcacuggccgcuu

SEQ ID NO: 666652 - RNA, 22 nt, Human
acuggggccuccuccaugcucu

SEQ ID NO: 666653 - RNA, 22 nt, Human
uccagagacuugcaugugcuug

SEQ ID NO: 666654 - RNA, 22 nt, Human
ggugggugaaaucuaggugugu

SEQ ID NO: 666655 - RNA, 22 nt, Human
ucugcagauuuaucagcagcug

SEQ ID NO: 666656 - RNA, 22 nt, Human
gagcaacacuccacauugcuag

SEQ ID NO: 666657 - RNA, 21 nt, Human
uuuaggaaguuuaaggcaggu

SEQ ID NO: 666658 - RNA, 22 nt, Human
cucaaauauguggucagaaagc

SEQ ID NO: 666659 - RNA, 22 nt, Human
caggcugcggucggcucugguc

SEQ ID NO: 666660 - RNA, 22 nt, Human
aggguccauguuuccaguuaau

SEQ ID NO: 666661 - RNA, 22 nt, Human
cagcugccacaggacuuucuga

SEQ ID NO: 666662 - RNA, 22 nt, Human
cagcacagcugaggggcugucu

SEQ ID NO: 666663 - RNA, 22 nt, Human
guuucccagucugcagaguucu

SEQ ID NO: 666664 - RNA, 22 nt, Human
uaagauagaacucugaggcuac

SEQ ID NO: 666665 - RNA, 22 nt, Human
acacauauaugucgaaguccuc

SEQ ID NO: 666666 - RNA, 22 nt, Human
cauugcaacuucaaacuccugg

SEQ ID NO: 666667 - RNA, 19 nt, Human
ccugggaggcggagguugc

SEQ ID NO: 666668 - RNA, 22 nt, Human
gugcuuuagguguuuggcugaa

SEQ ID NO: 666669 - RNA, 22 nt, Human
aggacuaaaaagaugcucuccc

SEQ ID NO: 666670 - RNA, 22 nt, Human
aagccaggggcugcuuaggaga

SEQ ID NO: 666671 - RNA, 21 nt, Human
agauuugucccuucccauuua

SEQ ID NO: 666672 - RNA, 22 nt, Human
gcugagcuagcuaucucagucu

SEQ ID NO: 666673 - RNA, 22 nt, Human
ucuucucaguuucucuaggaug

SEQ ID NO: 666674 - RNA, 22 nt, Human
gcuuugauucuuggcuuaucag

SEQ ID NO: 666675 - RNA, 22 nt, Human
cuuuuauuuugaauuaagggcu

SEQ ID NO: 666676 - RNA, 22 nt, Human
uuucuaaggcuaggucuuaagg

SEQ ID NO: 666677 - RNA, 22 nt, Human
gggcugucaugugucagugacc

SEQ ID NO: 666678 - RNA, 22 nt, Human
ugcuuaaaaugaugauuauuuu

SEQ ID NO: 666679 - RNA, 22 nt, Human
uucagcacuuuguuuugcucau

SEQ ID NO: 666680 - RNA, 22 nt, Human
accuucagacaucaacuaucuc

SEQ ID NO: 666681 - RNA, 22 nt, Human
cagaaauuggaauagagaaaua

SEQ ID NO: 666682 - RNA, 22 nt, Human
ccugcucugguuuagucagucu

SEQ ID NO: 666683 - RNA, 22 nt, Human
cccagcucugccaucuacccac

SEQ ID NO: 666684 - RNA, 22 nt, Human
uagaaacaugagagaaacucuu

SEQ ID NO: 666685 - RNA, 22 nt, Human
ucacugcagagaccucuaguca

SEQ ID NO: 666686 - RNA, 22 nt, Human
aauaauguuaugucauucuucu

SEQ ID NO: 666687 - RNA, 22 nt, Human
acuggcaucccacugguacagg

SEQ ID NO: 666688 - RNA, 22 nt, Human
caacauguguuagacaauagac

SEQ ID NO: 666689 - RNA, 22 nt, Human
caagcaaugcuauacucauuau

SEQ ID NO: 666690 - RNA, 22 nt, Human
agaacacacugggggaaacaag

SEQ ID NO: 666691 - RNA, 22 nt, Human
uguuuguucccucucuuuccug

SEQ ID NO: 666692 - RNA, 22 nt, Human
uugaauaauaugcuucguucuc

SEQ ID NO: 666693 - RNA, 22 nt, Human
uacagagagagggguuaccagg

SEQ ID NO: 666694 - RNA, 22 nt, Human
cacagggaacaacuagaacaaa

SEQ ID NO: 666695 - RNA, 22 nt, Human
gauuucuguaacacuucagaua

SEQ ID NO: 666696 - RNA, 20 nt, Human
agaaacauuucuugagaacu

SEQ ID NO: 666697 - RNA, 22 nt, Human
agaaauguugaauacaucagga

SEQ ID NO: 666698 - RNA, 22 nt, Human
aaguuacauuuuggucuaauug

SEQ ID NO: 666699 - RNA, 22 nt, Human
ucugcagagccucaggagaaca

SEQ ID NO: 666700 - RNA, 22 nt, Human
gagcaccaaggcucugccaugg

SEQ ID NO: 666701 - RNA, 22 nt, Human
uccucccaacuuuuccaucuca

SEQ ID NO: 666702 - RNA, 22 nt, Human
acaacaucagcugagaccuuca

SEQ ID NO: 666703 - RNA, 22 nt, Human
agacagacagagaauuuaaaua

SEQ ID NO: 666704 - RNA, 22 nt, Human
agcaggcuaaauaauaauacau

SEQ ID NO: 666705 - RNA, 22 nt, Human
ggagccaguauuuaguggucuu

SEQ ID NO: 666706 - RNA, 22 nt, Human
cagcuucaauaauggcugaugg

SEQ ID NO: 666707 - RNA, 22 nt, Human
uuguuaacggaaaacuguuuuc

SEQ ID NO: 666708 - RNA, 23 nt, Human
cccaggucaaaauucacaggccu

SEQ ID NO: 666709 - RNA, 22 nt, Human
auuucagcuaaaauucuuaauu

SEQ ID NO: 666710 - RNA, 22 nt, Human
cuguuuauagcagagcaagccu

SEQ ID NO: 666711 - RNA, 22 nt, Human
cccagugucucuugugccuuuc

SEQ ID NO: 666712 - RNA, 22 nt, Human
ccagcuggucugugcucauguu

SEQ ID NO: 666713 - RNA, 22 nt, Human
gacuuuauccugccugaccacg

SEQ ID NO: 666714 - RNA, 22 nt, Human
accauucuuuacaucagcacag

SEQ ID NO: 666715 - RNA, 22 nt, Human
aaggagagguuguccguguugu

SEQ ID NO: 666716 - RNA, 19 nt, Human
uguuuucaagugggauuau

SEQ ID NO: 666717 - RNA, 22 nt, Human
gcugccccgagccauccuucag

SEQ ID NO: 666718 - RNA, 22 nt, Human
cagagccuggcgaugucaugga

SEQ ID NO: 666719 - RNA, 22 nt, Human
uccagccuccuauuuacccuaa

SEQ ID NO: 666720 - RNA, 23 nt, Human
cugugcccggggcuccaccugau

SEQ ID NO: 666721 - RNA, 21 nt, Human
ccaggcaugacugcagagagc

SEQ ID NO: 666722 - RNA, 22 nt, Human
gcaguguugagugguggcugaa

SEQ ID NO: 666723 - RNA, 22 nt, Human
uuucuucucgacaccuuauccc

SEQ ID NO: 666724 - RNA, 22 nt, Human
gucacuggggccacaugcagaa

SEQ ID NO: 666725 - RNA, 22 nt, Human
aucuacagugcacaggacagcc

SEQ ID NO: 666726 - RNA, 22 nt, Human
caggagugucgggucacuaggu

SEQ ID NO: 666727 - RNA, 22 nt, Human
auuaagacuauugauauuuaca

SEQ ID NO: 666728 - RNA, 22 nt, Human
ugggaaguuaggaugccaggga

SEQ ID NO: 666729 - RNA, 22 nt, Human
gauccguuuuaacaaugggagu

SEQ ID NO: 666730 - RNA, 22 nt, Human
uuucaagacucauugaguauug

SEQ ID NO: 666731 - RNA, 22 nt, Human
acaggcaaggccagugagaaau

SEQ ID NO: 666732 - RNA, 22 nt, Human
uguuauccucagcucaccucua

SEQ ID NO: 666733 - RNA, 22 nt, Human
ucuacuucuccuucauuuccca

SEQ ID NO: 666734 - RNA, 22 nt, Human
gaaaugugugacaaguuucaau

SEQ ID NO: 666735 - RNA, 22 nt, Human
uuggccuuaaccucucugugcc

SEQ ID NO: 666736 - RNA, 22 nt, Human
acucugggagaggacaaacaaa

SEQ ID NO: 666737 - RNA, 22 nt, Human
acuuuagaaguaaggaugaguu

SEQ ID NO: 666738 - RNA, 22 nt, Human
ucccaguguggcaggccaugga

SEQ ID NO: 666739 - RNA, 23 nt, Human
ggcuccugcuucaugucccaccu

SEQ ID NO: 666740 - RNA, 22 nt, Human
ccaggccucccuuuuccagcca

SEQ ID NO: 666741 - RNA, 22 nt, Human
ggcuccaagucucagagugaag

SEQ ID NO: 666742 - RNA, 19 nt, Human
uuaugaaggcuggggggag

SEQ ID NO: 666743 - RNA, 22 nt, Human
cugugugugaacacagcccagc

SEQ ID NO: 666744 - RNA, 22 nt, Human
aaauguguuugauaggaauauu

SEQ ID NO: 666745 - RNA, 22 nt, Human
gucccuggagcugagcagugcu

SEQ ID NO: 666746 - RNA, 22 nt, Human
cuuaggaacacuuacugguacu

SEQ ID NO: 666747 - RNA, 22 nt, Human
uuccaaacugccaauucagaag

SEQ ID NO: 666748 - RNA, 22 nt, Human
gcagcuggagccagccagacac

SEQ ID NO: 666749 - RNA, 22 nt, Human
auaacagagagcuacugaacug

SEQ ID NO: 666750 - RNA, 22 nt, Human
caggccucaggggcucaggcug

SEQ ID NO: 666751 - RNA, 22 nt, Human
uucaagaugucuucacaauagu

SEQ ID NO: 666752 - RNA, 22 nt, Human
aagcacauuguacauuugugcu

SEQ ID NO: 666753 - RNA, 22 nt, Human
uuucaagaagcaaauuaaaguc

SEQ ID NO: 666754 - RNA, 22 nt, Human
aggaaaggugagagcggccgcg

SEQ ID NO: 666755 - RNA, 22 nt, Human
gagauggcuugcucucacgugg

SEQ ID NO: 666756 - RNA, 22 nt, Human
uaaggcagugaaacuauucugu

SEQ ID NO: 666757 - RNA, 22 nt, Human
agccauccucccaccucagccu

SEQ ID NO: 666758 - RNA, 23 nt, Human
cugccccaauuauaaaagaagau

SEQ ID NO: 666759 - RNA, 22 nt, Human
agcaguuaucgaagaaucaggu

SEQ ID NO: 666760 - RNA, 22 nt, Human
uucucauucugacucaguguag

SEQ ID NO: 666761 - RNA, 22 nt, Human
aaacuuggccgcauccaccggg

SEQ ID NO: 666762 - RNA, 22 nt, Human
ucaauucaauugaacaguuacu

SEQ ID NO: 666763 - RNA, 22 nt, Human
caucugaauaaagacuugcaga

SEQ ID NO: 666764 - RNA, 22 nt, Human
augaauuguccgauguugugca

SEQ ID NO: 666765 - RNA, 22 nt, Human
augcaacagagaaaauauugag

SEQ ID NO: 666766 - RNA, 23 nt, Human
cuggcccuggcucugugaucaug

SEQ ID NO: 666767 - RNA, 22 nt, Human
acagugauugguuuggggguga

SEQ ID NO: 666768 - RNA, 22 nt, Human
cuguauauggcuuacuuuauau

SEQ ID NO: 666769 - RNA, 22 nt, Human
agucugggaggcuuauaaacag

SEQ ID NO: 666770 - RNA, 22 nt, Human
aaguuuagauauagguauucug

SEQ ID NO: 666771 - RNA, 22 nt, Human
auguagcaucuauccugauaaa

SEQ ID NO: 666772 - RNA, 22 nt, Human
cugguuccagaauugccugugg

SEQ ID NO: 666773 - RNA, 22 nt, Human
guucugcuccuguggcaaucua

SEQ ID NO: 666774 - RNA, 21 nt, Human
gaggcugucugcugcuggccu

SEQ ID NO: 666775 - RNA, 22 nt, Human
acaggcucucagccaguuggca

SEQ ID NO: 666776 - RNA, 22 nt, Human
gccuuauuuuacuuggauucug

SEQ ID NO: 666777 - RNA, 22 nt, Human
uguguacauaucuauccuagau

SEQ ID NO: 666778 - RNA, 22 nt, Human
agaaaugugaauuucauuuccu

SEQ ID NO: 666779 - RNA, 22 nt, Human
cugcuuuagcuagugcucuuag

SEQ ID NO: 666780 - RNA, 22 nt, Human
aaugcuuugccaacagcuauug

SEQ ID NO: 666781 - RNA, 22 nt, Human
acagguggagugguuagcaggc

SEQ ID NO: 666782 - RNA, 22 nt, Human
guuccacaaagauugucucucu

SEQ ID NO: 666783 - RNA, 22 nt, Human
aaucuugaguguuacucucauu

SEQ ID NO: 666784 - RNA, 21 nt, Human
auuucagagcacacaaguaaa

SEQ ID NO: 666785 - RNA, 22 nt, Human
ggcacugacacuagcauggcac

SEQ ID NO: 666786 - RNA, 22 nt, Human
uccuugaauauaauaacaguag

SEQ ID NO: 666787 - RNA, 22 nt, Human
cuggcucaguucuugguuuuca

SEQ ID NO: 666788 - RNA, 22 nt, Human
ugaugacuauauaugacuagug

SEQ ID NO: 666789 - RNA, 22 nt, Human
ugggccguggagcacucugaga

SEQ ID NO: 666790 - RNA, 22 nt, Human
gaugcauuacaaaagugauuau

SEQ ID NO: 666791 - RNA, 22 nt, Human
ccaguguucauaauuuuacacu

SEQ ID NO: 666792 - RNA, 22 nt, Human
gggacuggaacuacuggugcag

SEQ ID NO: 666793 - RNA, 22 nt, Human
ugagucucccaaguaguuggaa

SEQ ID NO: 666794 - RNA, 23 nt, Human
agaaagucauggccagguuugau

SEQ ID NO: 666795 - RNA, 22 nt, Human
ccacaugaugaggaagcugaac

SEQ ID NO: 666796 - RNA, 22 nt, Human
uuuccuuguuauuauuuguccu

SEQ ID NO: 666797 - RNA, 22 nt, Human
cugugacuguguuggaugcaca

SEQ ID NO: 666798 - RNA, 22 nt, Human
cagacagguugcaaaacuucaa

SEQ ID NO: 666799 - RNA, 22 nt, Human
auggcugugguaucagacgcag

SEQ ID NO: 666800 - RNA, 22 nt, Human
ucagguucagacuagucccagu

SEQ ID NO: 666801 - RNA, 21 nt, Human
auguuuacacugacuacugug

SEQ ID NO: 666802 - RNA, 22 nt, Human
agaugcugucacacacacuguu

SEQ ID NO: 666803 - RNA, 22 nt, Human
uccaggcuagaagucacaggcc

SEQ ID NO: 666804 - RNA, 22 nt, Human
uggcugagcucccuguguguug

SEQ ID NO: 666805 - RNA, 22 nt, Human
cuguggcauugccgaggcuggc

SEQ ID NO: 666806 - RNA, 18 nt, Human
caguggugcugggaugug

SEQ ID NO: 666807 - RNA, 22 nt, Human
aaugauuggcacuagauacaca

SEQ ID NO: 666808 - RNA, 22 nt, Human
aagacauuagaaucagccuguu

SEQ ID NO: 666809 - RNA, 22 nt, Human
agagucaaguagggcaugggcu

SEQ ID NO: 666810 - RNA, 22 nt, Human
aauauauuugaaucaggaacaa

SEQ ID NO: 666811 - RNA, 23 nt, Human
uggacccugcacaccagcucuac

SEQ ID NO: 666812 - RNA, 22 nt, Human
uagucaacuagugagcauaugg

SEQ ID NO: 666813 - RNA, 22 nt, Human
augcaguggcagcuccuggugu

SEQ ID NO: 666814 - RNA, 20 nt, Human
uaucaaucagaaagaagacu

SEQ ID NO: 666815 - RNA, 22 nt, Human
ucagguggccaaaugggagcgc

SEQ ID NO: 666816 - RNA, 22 nt, Human
ugauggaaaauaaaucuuauuc

SEQ ID NO: 666817 - RNA, 22 nt, Human
uaagguuuaacgcccugucucg

SEQ ID NO: 666818 - RNA, 22 nt, Human
gagugcuguaggacugagcccu

SEQ ID NO: 666819 - RNA, 22 nt, Human
cuugacuucuucuagaaauaag

SEQ ID NO: 666820 - RNA, 22 nt, Human
ugguuaaaugggaagagcaaca

SEQ ID NO: 666821 - RNA, 22 nt, Human
gcucugggaaggaucguaguga

SEQ ID NO: 666822 - RNA, 22 nt, Human
auuccacagaggacuccgauug

SEQ ID NO: 666823 - RNA, 22 nt, Human
ccagaggagcaggcuggcucca

SEQ ID NO: 666824 - RNA, 22 nt, Human
gagaaacuaacaucugaaggug

SEQ ID NO: 666825 - RNA, 19 nt, Human
ugagcuggcugagccucuc

SEQ ID NO: 666826 - RNA, 22 nt, Human
augacuuauuacaagucauauu

SEQ ID NO: 666827 - RNA, 22 nt, Human
ugggcagaaggaagagccaccu

SEQ ID NO: 666828 - RNA, 22 nt, Human
guuucucugucuguuacauugg

SEQ ID NO: 666829 - RNA, 22 nt, Human
ucaggcucuggguacaccugac

SEQ ID NO: 666830 - RNA, 22 nt, Human
auuuguaccauacuguuuauua

SEQ ID NO: 666831 - RNA, 22 nt, Human
auccaacacguauuugcuggcc

SEQ ID NO: 666832 - RNA, 22 nt, Human
uauuaagagauguaugaagaga

SEQ ID NO: 666833 - RNA, 22 nt, Human
cagccaggggcuggcguguuga

SEQ ID NO: 666834 - RNA, 22 nt, Human
uggcuucuccagaaaucuuggu

SEQ ID NO: 666835 - RNA, 18 nt, Human
cuggucagggcaaugggc

SEQ ID NO: 666836 - RNA, 22 nt, Human
uguuccugaaugccuggcuggc

SEQ ID NO: 666837 - RNA, 22 nt, Human
aauaccuuuucagugcacaaaa

SEQ ID NO: 666838 - RNA, 21 nt, Human
uccugggagucugagauccug

SEQ ID NO: 666839 - RNA, 22 nt, Human
ggugaggggcaccucugcccgg

SEQ ID NO: 666840 - RNA, 22 nt, Human
accacuggcucaggagcuggga

SEQ ID NO: 666841 - RNA, 22 nt, Human
augaacaaguauuugcaugagc

SEQ ID NO: 666842 - RNA, 22 nt, Human
ccuggacuugauauucucuuuc

SEQ ID NO: 666843 - RNA, 23 nt, Human
gaaaucuagucauuuuuagucug

SEQ ID NO: 666844 - RNA, 18 nt, Human
cagcagagacauucaaaa

SEQ ID NO: 666845 - RNA, 22 nt, Human
caguccuugcucugggaugaug

SEQ ID NO: 666846 - RNA, 22 nt, Human
augcaacaguucauaguuuuau

SEQ ID NO: 666847 - RNA, 19 nt, Human
gguggcagaacgugggucc

SEQ ID NO: 666848 - RNA, 22 nt, Human
uucucaagaacauauguagggu

SEQ ID NO: 666849 - RNA, 22 nt, Human
uuacaguuagguguguaguggu

SEQ ID NO: 666850 - RNA, 22 nt, Human
uaugugauagaguuacuuuaua

SEQ ID NO: 666851 - RNA, 22 nt, Human
ugggcagacugagcccuguccc

SEQ ID NO: 666852 - RNA, 22 nt, Human
ucccagagacagagccuccucc

SEQ ID NO: 666853 - RNA, 22 nt, Human
agaggcggagguugcagugagc

SEQ ID NO: 666854 - RNA, 22 nt, Human
caaagcaggaagcuccugacag

SEQ ID NO: 666855 - RNA, 22 nt, Human
ucuguucuuggugcagcuggga

SEQ ID NO: 666856 - RNA, 22 nt, Human
gcuccucuuauuucaucagggc

SEQ ID NO: 666857 - RNA, 22 nt, Human
ucugaguuuucugagaagcuua

SEQ ID NO: 666858 - RNA, 20 nt, Human
aauauaauucucugaauuua

SEQ ID NO: 666859 - RNA, 22 nt, Human
cugccugcugacauucuuuaua

SEQ ID NO: 666860 - RNA, 22 nt, Human
acacugaaugcuguuuagaaau

SEQ ID NO: 666861 - RNA, 22 nt, Human
uacagagaacucauagaaagaa

SEQ ID NO: 666862 - RNA, 22 nt, Human
gcacagaacacuggugaguccc

SEQ ID NO: 666863 - RNA, 22 nt, Human
acugugcagguagaugccuggg

SEQ ID NO: 666864 - RNA, 19 nt, Human
cauaauacaguggaucuga

SEQ ID NO: 666865 - RNA, 22 nt, Human
caggccagugugcuucccaggc

SEQ ID NO: 666866 - RNA, 18 nt, Human
acuaugcugaauaaaugg

SEQ ID NO: 666867 - RNA, 22 nt, Human
uacuuacagagcuuauaaguua

SEQ ID NO: 666868 - RNA, 22 nt, Human
gauuggagaguggaacaugcug

SEQ ID NO: 666869 - RNA, 22 nt, Human
gcaaaggccacuggggcgaugg

SEQ ID NO: 666870 - RNA, 21 nt, Human
caggaaaagcggaagucuagc

SEQ ID NO: 666871 - RNA, 21 nt, Human
ucccacucuaaauggacugaa

SEQ ID NO: 666872 - RNA, 23 nt, Human
aaaggcacagcauugucuagcag

SEQ ID NO: 666873 - RNA, 22 nt, Human
gccaaggcugaggcccugggcu

SEQ ID NO: 666874 - RNA, 22 nt, Human
acagcaacuccugcuucugagu

SEQ ID NO: 666875 - RNA, 16 nt, Human
gcuaggcaacaggcug

SEQ ID NO: 666876 - RNA, 22 nt, Human
cauuccuauuaugucccuagug

SEQ ID NO: 666877 - RNA, 22 nt, Human
accagcucauaauuuucaaaac

SEQ ID NO: 666878 - RNA, 22 nt, Human
aaguuacuaugacucuucuuuu

SEQ ID NO: 666879 - RNA, 19 nt, Human
ugugacaucacugggcagc

SEQ ID NO: 666880 - RNA, 22 nt, Human
cacagcuuccauuagaaugaga

SEQ ID NO: 666881 - RNA, 22 nt, Human
agucaugacuccauuggucaag

SEQ ID NO: 666882 - RNA, 23 nt, Human
augguuuaugucacacuuuugau

SEQ ID NO: 666883 - RNA, 22 nt, Human
ucaucugucauccacaaagcug

SEQ ID NO: 666884 - RNA, 17 nt, Human
uccaggcagcaacugag

SEQ ID NO: 666885 - RNA, 22 nt, Human
ucccagaaucuccagugcuaca

SEQ ID NO: 666886 - RNA, 22 nt, Human
auggcuguccaguuucuagaga

SEQ ID NO: 666887 - RNA, 22 nt, Human
gaugucugugagaucaaacuaa

SEQ ID NO: 666888 - RNA, 22 nt, Human
acuugguggcgaacgaggguca

SEQ ID NO: 666889 - RNA, 22 nt, Human
ccaggucugucuucuuagcuca

SEQ ID NO: 666890 - RNA, 22 nt, Human
ugagaagauugggcagagugga

SEQ ID NO: 666891 - RNA, 22 nt, Human
ccuccccacccacggcuggugg

SEQ ID NO: 666892 - RNA, 22 nt, Human
caugcagcaggaucucauuccc

SEQ ID NO: 666893 - RNA, 21 nt, Human
ucucuggaguuagcagagaga

SEQ ID NO: 666894 - RNA, 22 nt, Human
auugaacagaaaaacucagaga

SEQ ID NO: 666895 - RNA, 22 nt, Human
guuuggcucugggugccugugc

SEQ ID NO: 666896 - RNA, 22 nt, Human
cacucaggcugugucaggagga

SEQ ID NO: 666897 - RNA, 22 nt, Human
cugaguguuuucagccacggcc

SEQ ID NO: 666898 - RNA, 22 nt, Human
ucuuaaaggcacauagugucua

SEQ ID NO: 666899 - RNA, 22 nt, Human
gauuuucuugggaaacaaugag

SEQ ID NO: 666900 - RNA, 22 nt, Human
ugagacaguucugcagcugggu

SEQ ID NO: 666901 - RNA, 17 nt, Human
ggaaagguagaguaauc

SEQ ID NO: 666902 - RNA, 22 nt, Human
cagcccugggaucuuagugccu

SEQ ID NO: 666903 - RNA, 22 nt, Human
agcagcucugagaggccagcac

SEQ ID NO: 666904 - RNA, 22 nt, Human
gcuggcaccugcaccaagcagg

SEQ ID NO: 666905 - RNA, 22 nt, Human
auacaguaagugucccugaaac

SEQ ID NO: 666906 - RNA, 22 nt, Human
ugcuggccugguuagaaagggg

SEQ ID NO: 666907 - RNA, 22 nt, Human
auccugagcuacaccugcuccu

SEQ ID NO: 666908 - RNA, 22 nt, Human
gcaguggauccaaugguaucuu

SEQ ID NO: 666909 - RNA, 22 nt, Human
uaauacuuaccuugcagagucu

SEQ ID NO: 666910 - RNA, 22 nt, Human
guuacacagcuaagcuucuccu

SEQ ID NO: 666911 - RNA, 21 nt, Human
auuccaguauaagccucuuug

SEQ ID NO: 666912 - RNA, 22 nt, Human
aggcuuccucgugccuuagaua

SEQ ID NO: 666913 - RNA, 21 nt, Human
ucuggcaggcacgggcccagc

SEQ ID NO: 666914 - RNA, 22 nt, Human
uguguguguuucugcucauaca

SEQ ID NO: 666915 - RNA, 22 nt, Human
uaagaaacugucacaguacuau

SEQ ID NO: 666916 - RNA, 22 nt, Human
ugugccugagucucggcccacc

SEQ ID NO: 666917 - RNA, 22 nt, Human
uccucagcaaacacuucacucu

SEQ ID NO: 666918 - RNA, 22 nt, Human
ugggagaagcagugggacagua

SEQ ID NO: 666919 - RNA, 22 nt, Human
cucaggaaggaagcagggagcc

SEQ ID NO: 666920 - RNA, 22 nt, Human
cucccugcuuguuucccuucag

SEQ ID NO: 666921 - RNA, 22 nt, Human
uggguuuaaacucaacucuaaa

SEQ ID NO: 666922 - RNA, 22 nt, Human
uggcauccacaaaugcuuagau

SEQ ID NO: 666923 - RNA, 22 nt, Human
acagcaagaccccuagcauggu

SEQ ID NO: 666924 - RNA, 20 nt, Human
ccuggcuuugcaucugugau

SEQ ID NO: 666925 - RNA, 22 nt, Human
cauucauucacauuuugucuau

SEQ ID NO: 666926 - RNA, 22 nt, Human
cugcaguucuucuccucaaggc

SEQ ID NO: 666927 - RNA, 22 nt, Human
ugucccaguuggguauugaauu

SEQ ID NO: 666928 - RNA, 22 nt, Human
uuucucucuauuuagacaggua

SEQ ID NO: 666929 - RNA, 22 nt, Human
uauuccuauuucuaaacauaug

SEQ ID NO: 666930 - RNA, 22 nt, Human
ugaggaagggcacacggacccu

SEQ ID NO: 666931 - RNA, 22 nt, Human
ccagccuuacugcccuucagug

SEQ ID NO: 666932 - RNA, 22 nt, Human
ugggcuccggcggccucaggcu

SEQ ID NO: 666933 - RNA, 22 nt, Human
caguucucuuuccacuggaggc

SEQ ID NO: 666934 - RNA, 22 nt, Human
aagauucuacaguagguacauu

SEQ ID NO: 666935 - RNA, 22 nt, Human
aguaguggcuuccuggagugcu

SEQ ID NO: 666936 - RNA, 22 nt, Human
ugcaggcuggggaggcagacuu

SEQ ID NO: 666937 - RNA, 22 nt, Human
ucucuaaaguagaaaagacccc

SEQ ID NO: 666938 - RNA, 17 nt, Human
cccagcugcgucugagg

SEQ ID NO: 666939 - RNA, 22 nt, Human
ccacagugguuguggcaugugg

SEQ ID NO: 666940 - RNA, 22 nt, Human
gucaccagucccagcuccugaa

SEQ ID NO: 666941 - RNA, 22 nt, Human
acaggcacucucauuaaaauag

SEQ ID NO: 666942 - RNA, 22 nt, Human
ggcaguuuggcaggauggaggg

SEQ ID NO: 666943 - RNA, 22 nt, Human
agccaaagaucagugugcaagu

SEQ ID NO: 666944 - RNA, 22 nt, Human
auggcagcuggcuugggcaccu

SEQ ID NO: 666945 - RNA, 22 nt, Human
cacaggggcaaacuguagggga

SEQ ID NO: 666946 - RNA, 22 nt, Human
ucugaggaccuacugaagaguu

SEQ ID NO: 666947 - RNA, 23 nt, Human
ugggccagggaguccgguuucuu

SEQ ID NO: 666948 - RNA, 22 nt, Human
ugcugggccuuuaccuccaggg

SEQ ID NO: 666949 - RNA, 22 nt, Human
aaagugaugccaggagucuggu

SEQ ID NO: 666950 - RNA, 20 nt, Human
gucuccucuuugcauuccua

SEQ ID NO: 666951 - RNA, 22 nt, Human
ugcagaggugaaagacuagcaa

SEQ ID NO: 666952 - RNA, 22 nt, Human
ucaggcuguauaucuugcacuc

SEQ ID NO: 666953 - RNA, 22 nt, Human
aaucauguuuacgugacauguc

SEQ ID NO: 666954 - RNA, 22 nt, Human
uugacacuaagauuuccaaaca

SEQ ID NO: 666955 - RNA, 23 nt, Human
agaaaaguucauaccuuuuuaac

SEQ ID NO: 666956 - RNA, 22 nt, Human
acccugggucucaaucauccua

SEQ ID NO: 666957 - RNA, 22 nt, Human
uuuacaucucaccagauucaua

SEQ ID NO: 666958 - RNA, 22 nt, Human
ccugcucuccauacacuuucua

SEQ ID NO: 666959 - RNA, 15 nt, Human
aacaggcauuuauau

SEQ ID NO: 666960 - RNA, 17 nt, Human
aggcugcugggccaggg

SEQ ID NO: 666961 - RNA, 22 nt, Human
aguccguggccagacucaagag

SEQ ID NO: 666962 - RNA, 22 nt, Human
ugucucugagaugacucccacc

SEQ ID NO: 666963 - RNA, 22 nt, Human
gcaggccaggcuaggggcuguc

SEQ ID NO: 666964 - RNA, 22 nt, Human
ugagaugaugggauaagagggc

SEQ ID NO: 666965 - RNA, 21 nt, Human
acccugcuuuaugccguccuc

SEQ ID NO: 666966 - RNA, 22 nt, Human
ucucucuacuggggcacuagga

SEQ ID NO: 666967 - RNA, 22 nt, Human
cucugaagggagggccaagccc

SEQ ID NO: 666968 - RNA, 22 nt, Human
ucuaaggagccaggacuauuag

SEQ ID NO: 666969 - RNA, 22 nt, Human
ccagcagggaaaaacccaccaa

SEQ ID NO: 666970 - RNA, 22 nt, Human
uccaggcuccccugcgugcucc

SEQ ID NO: 666971 - RNA, 22 nt, Human
agccuggggcacuucuccaaac

SEQ ID NO: 666972 - RNA, 22 nt, Human
uaucuguucugcuugauuuuga

SEQ ID NO: 666973 - RNA, 22 nt, Human
uaaugguuuuuuggagacugcu

SEQ ID NO: 666974 - RNA, 22 nt, Human
ugaacauuggcacaaggcagca

SEQ ID NO: 666975 - RNA, 22 nt, Human
cuuuggaaggaacaggauucuc

SEQ ID NO: 666976 - RNA, 22 nt, Human
gacagacacuguguccucacuu

SEQ ID NO: 666977 - RNA, 22 nt, Human
auuucacaaagaacagaugcag

SEQ ID NO: 666978 - RNA, 17 nt, Human
uuagcaaaauagcacuu

SEQ ID NO: 666979 - RNA, 22 nt, Human
uggcuccuuccgcagcaugccu

SEQ ID NO: 666980 - RNA, 22 nt, Human
ggaggggugagaauggcugccu

SEQ ID NO: 666981 - RNA, 22 nt, Human
uuugcauuacuugacuuuaguu

SEQ ID NO: 666982 - RNA, 22 nt, Human
acagugauugggguaucugcag

SEQ ID NO: 666983 - RNA, 22 nt, Human
gcucuggggcccagggaucaca

SEQ ID NO: 666984 - RNA, 22 nt, Human
agcuucuugaccaagccuguaa

SEQ ID NO: 666985 - RNA, 22 nt, Human
gaguaggguuuccagguuagag

SEQ ID NO: 666986 - RNA, 19 nt, Human
ggaguggguaguuaguggu

SEQ ID NO: 666987 - RNA, 22 nt, Human
aagaacaacugcuuuaaaagca

SEQ ID NO: 666988 - RNA, 22 nt, Human
ccaugcaugccugaaauugcug

SEQ ID NO: 666989 - RNA, 22 nt, Human
agggacaguauccaucucacag

SEQ ID NO: 666990 - RNA, 21 nt, Human
uucacagaugggaaaacugag

SEQ ID NO: 666991 - RNA, 22 nt, Human
uuuucuguuuacagagggaccu

SEQ ID NO: 666992 - RNA, 22 nt, Human
ggggagaauaaaucagauuuua

SEQ ID NO: 666993 - RNA, 22 nt, Human
aggcaggcuagucgcuugagcc

SEQ ID NO: 666994 - RNA, 22 nt, Human
aaucagaaauugagggucuggu

SEQ ID NO: 666995 - RNA, 22 nt, Human
uacagauauagagauuuauaga

SEQ ID NO: 666996 - RNA, 22 nt, Human
gagaggugaaaggauaguuuga

SEQ ID NO: 666997 - RNA, 22 nt, Human
ggagagcugguauaugaagaca

SEQ ID NO: 666998 - RNA, 22 nt, Human
cacagcccugcgccccaguuug

SEQ ID NO: 666999 - RNA, 22 nt, Human
accaggcagcaccaaagccggu

SEQ ID NO: 667000 - RNA, 22 nt, Human
aguggcuaauaacagcuaaaca

SEQ ID NO: 667001 - RNA, 22 nt, Human
ccccagggacugguuucaugga

SEQ ID NO: 667002 - RNA, 21 nt, Human
guggagagugauuuugaugca

SEQ ID NO: 667003 - RNA, 22 nt, Human
aaggcagcccuggcucagccug

SEQ ID NO: 667004 - RNA, 22 nt, Human
uucuguccacugcuggggccuc

SEQ ID NO: 667005 - RNA, 22 nt, Human
ugggagcaguugugaagcucag

SEQ ID NO: 667006 - RNA, 20 nt, Human
guucacaggcuuccuuucag

SEQ ID NO: 667007 - RNA, 20 nt, Human
cagagcugggauuugaacac

SEQ ID NO: 667008 - RNA, 20 nt, Human
uucacagaggacucagguca

SEQ ID NO: 667009 - RNA, 22 nt, Human
aaacugcagccuugaguucagg

SEQ ID NO: 667010 - RNA, 19 nt, Human
agauggcaaaaugcaaaga

SEQ ID NO: 667011 - RNA, 22 nt, Human
auaaaccagaaguaaaagcuac

SEQ ID NO: 667012 - RNA, 22 nt, Human
aagaggcagaaauaucgcugaa

SEQ ID NO: 667013 - RNA, 22 nt, Human
acagcagucagugaauauuuaa

SEQ ID NO: 667014 - RNA, 22 nt, Human
ucucugggcucaggagcccggc

SEQ ID NO: 667015 - RNA, 22 nt, Human
uucagcaagaccaccauguacc

SEQ ID NO: 667016 - RNA, 22 nt, Human
gggugcaacuaagaagagguga

SEQ ID NO: 667017 - RNA, 22 nt, Human
ucagggucaggacccagcuguu

SEQ ID NO: 667018 - RNA, 22 nt, Human
ucagacuuuaaaggcuaacagg

SEQ ID NO: 667019 - RNA, 22 nt, Human
gagagcacaugaacauggagga

SEQ ID NO: 667020 - RNA, 22 nt, Human
gaggugucaugagggccugcuc

SEQ ID NO: 667021 - RNA, 22 nt, Human
uuaaacagucccagaggcugac

SEQ ID NO: 667022 - RNA, 22 nt, Human
cuggcaguuugccaggagcucg

SEQ ID NO: 667023 - RNA, 22 nt, Human
ugaguuauugagaaauaacugc

SEQ ID NO: 667024 - RNA, 22 nt, Human
cuggcagguggauggggacucc

SEQ ID NO: 667025 - RNA, 22 nt, Human
guggcagcuguguugcaguuuu

SEQ ID NO: 667026 - RNA, 22 nt, Human
uccucuugggaauaccuuucua

SEQ ID NO: 667027 - RNA, 22 nt, Human
uuuacagauucuggguauuagg

SEQ ID NO: 667028 - RNA, 22 nt, Human
cggagcagaaggcgccgccggc

SEQ ID NO: 667029 - RNA, 22 nt, Human
auggguggaggagaaaggcauc

SEQ ID NO: 667030 - RNA, 22 nt, Human
aaggcuguccaggagaaaauag

SEQ ID NO: 667031 - RNA, 22 nt, Human
cccagacugcagagcgggcaga

SEQ ID NO: 667032 - RNA, 22 nt, Human
agaggccaauaguagguggcau

SEQ ID NO: 667033 - RNA, 21 nt, Human
ucucugagacacucuggagcc

SEQ ID NO: 667034 - RNA, 22 nt, Human
cagggcaggaauuugacauugc

SEQ ID NO: 667035 - RNA, 22 nt, Human
agagaccaagggaauagucuca

SEQ ID NO: 667036 - RNA, 22 nt, Human
uuagauaccuuuguguuguaga

SEQ ID NO: 667037 - RNA, 22 nt, Human
gaucaauucaaacuauuuuccu

SEQ ID NO: 667038 - RNA, 22 nt, Human
aacauuuacaaauccuucugca

SEQ ID NO: 667039 - RNA, 22 nt, Human
cucugggaauucugagcaagca

SEQ ID NO: 667040 - RNA, 20 nt, Human
agacaugguagugauucagg

SEQ ID NO: 667041 - RNA, 22 nt, Human
gcuacaggagcugucacaugcu

SEQ ID NO: 667042 - RNA, 22 nt, Human
gagagcaggcucucgggggcca

SEQ ID NO: 667043 - RNA, 22 nt, Human
cucugagagagcuggugagcac

SEQ ID NO: 667044 - RNA, 22 nt, Human
cuggcagcauggagccugugcu

SEQ ID NO: 667045 - RNA, 22 nt, Human
ggguugggacugucaucuggag

SEQ ID NO: 667046 - RNA, 22 nt, Human
ccagguggcuucugcccgaugu

SEQ ID NO: 667047 - RNA, 22 nt, Human
cagggccucgaagccucugggc

SEQ ID NO: 667048 - RNA, 22 nt, Human
ucccuccagaauggugaggaag

SEQ ID NO: 667049 - RNA, 22 nt, Human
cugucauuucuauuauagagga

SEQ ID NO: 667050 - RNA, 22 nt, Human
ccaggcugcagucaaggggcau

SEQ ID NO: 667051 - RNA, 22 nt, Human
uuaccugcaacucccaugguga

SEQ ID NO: 667052 - RNA, 22 nt, Human
auuagaaugcaggguucauugu

SEQ ID NO: 667053 - RNA, 23 nt, Human
ugaaucaauuaugggauucaaug

SEQ ID NO: 667054 - RNA, 22 nt, Human
uccagucuucuugcagcuacau

SEQ ID NO: 667055 - RNA, 22 nt, Human
cauuuguuaauuacuauuaucu

SEQ ID NO: 667056 - RNA, 22 nt, Human
uacaguaaagcugcuaugaauu

SEQ ID NO: 667057 - RNA, 22 nt, Human
aauguguauaagggagagcuaa

SEQ ID NO: 667058 - RNA, 22 nt, Human
caggcugggcuccggagauaaa

SEQ ID NO: 667059 - RNA, 22 nt, Human
uggaaggcuuggaauacuucca

SEQ ID NO: 667060 - RNA, 22 nt, Human
ugcugucagacagcagugguaa

SEQ ID NO: 667061 - RNA, 23 nt, Human
uccaugagaugugggcuucuagu

SEQ ID NO: 667062 - RNA, 22 nt, Human
gacuuucuugcagaaauauucc

SEQ ID NO: 667063 - RNA, 22 nt, Human
ugcuuuauguggcugauacuca

SEQ ID NO: 667064 - RNA, 22 nt, Human
ugggccgggcacuguacugggc

SEQ ID NO: 667065 - RNA, 22 nt, Human
agguauaagucucauuucuguu

SEQ ID NO: 667066 - RNA, 20 nt, Human
acuggcagccugccugcugu

SEQ ID NO: 667067 - RNA, 22 nt, Human
accuggagucauuugaggagua

SEQ ID NO: 667068 - RNA, 22 nt, Human
uuauuuguaucaaggacgguug

SEQ ID NO: 667069 - RNA, 22 nt, Human
uaccugagccccugcuggugua

SEQ ID NO: 667070 - RNA, 22 nt, Human
uaggagggcccugaaaauggca

SEQ ID NO: 667071 - RNA, 22 nt, Human
ggcccagcuguauauuacaguu

SEQ ID NO: 667072 - RNA, 22 nt, Human
uagacaaacugauacuuggcga

SEQ ID NO: 667073 - RNA, 23 nt, Human
acagugugguggacaaggagcag

SEQ ID NO: 667074 - RNA, 22 nt, Human
uggccugauuuugcuaagagaa

SEQ ID NO: 667075 - RNA, 21 nt, Human
ccagagccugcugagcccccu

SEQ ID NO: 667076 - RNA, 22 nt, Human
cacucugcgcugggcgccagcg

SEQ ID NO: 667077 - RNA, 22 nt, Human
ucaggagguaggacauacuggu

SEQ ID NO: 667078 - RNA, 22 nt, Human
uaauccaauggcacaauguaug

SEQ ID NO: 667079 - RNA, 22 nt, Human
agagccuggaccugagcuacaa

SEQ ID NO: 667080 - RNA, 22 nt, Human
agcaccaggaaagaaggggcca

SEQ ID NO: 667081 - RNA, 22 nt, Human
auucagaaagcaagugcugggu

SEQ ID NO: 667082 - RNA, 22 nt, Human
aaugcauucucgguuugugugu

SEQ ID NO: 667083 - RNA, 22 nt, Human
gcccugaauuccucaggcugug

SEQ ID NO: 667084 - RNA, 22 nt, Human
ugucugccugcgggccggcaca

SEQ ID NO: 667085 - RNA, 22 nt, Human
gccuccagcuggggcauuucag

SEQ ID NO: 667086 - RNA, 22 nt, Human
uuccuggcugucaugcccuagu

SEQ ID NO: 667087 - RNA, 21 nt, Human
ggacagcugcgcgcagggcuc

SEQ ID NO: 667088 - RNA, 22 nt, Human
uuucacagauauaagauuucac

SEQ ID NO: 667089 - RNA, 22 nt, Human
uuaaaccacuuuguugcaagua

SEQ ID NO: 667090 - RNA, 22 nt, Human
cagcagcuucuguugaucagaa

SEQ ID NO: 667091 - RNA, 20 nt, Human
ugacacaaauugcuuucuca

SEQ ID NO: 667092 - RNA, 22 nt, Human
gauaauguggauuuauugugau

SEQ ID NO: 667093 - RNA, 22 nt, Human
auuacaguaggauuggaaagga

SEQ ID NO: 667094 - RNA, 22 nt, Human
cggggcaggagucccuguagag

SEQ ID NO: 667095 - RNA, 22 nt, Human
uuuuauucauagggauggagag

SEQ ID NO: 667096 - RNA, 22 nt, Human
aggggagaggugagcaacuucu

SEQ ID NO: 667097 - RNA, 22 nt, Human
uuuuauaagcaagaaagggaaa

SEQ ID NO: 667098 - RNA, 22 nt, Human
caucaaaauuagacauuguuga

SEQ ID NO: 667099 - RNA, 22 nt, Human
agcaggccugccaccucggggu

SEQ ID NO: 667100 - RNA, 22 nt, Human
uuccagaggcucuaggggagaa

SEQ ID NO: 667101 - RNA, 22 nt, Human
uucuuuauugagacuucauugu

SEQ ID NO: 667102 - RNA, 22 nt, Human
acccagcuguuucccgugucau

SEQ ID NO: 667103 - RNA, 22 nt, Human
ucaggcucugccaccuagauua

SEQ ID NO: 667104 - RNA, 22 nt, Human
cuggcuuucugcaaaucuccau

SEQ ID NO: 667105 - RNA, 22 nt, Human
uuugugaauagguuggcuucca

SEQ ID NO: 667106 - RNA, 22 nt, Human
gcccagucucuucuggcccugu

SEQ ID NO: 667107 - RNA, 21 nt, Human
acaucagaguugugaagguag

SEQ ID NO: 667108 - RNA, 22 nt, Human
aggcuacuucuagagggacaau

SEQ ID NO: 667109 - RNA, 22 nt, Human
ugaggcaguauucuccauucca

SEQ ID NO: 667110 - RNA, 22 nt, Human
cugugccuaagaugcaugucuc

SEQ ID NO: 667111 - RNA, 22 nt, Human
uccagacuggggccaugucugc

SEQ ID NO: 667112 - RNA, 22 nt, Human
uugggcugaaguagagggcaga

SEQ ID NO: 667113 - RNA, 22 nt, Human
gugcugccugccagcuucuggg

SEQ ID NO: 667114 - RNA, 22 nt, Human
cacacaugugggauccgcaggg

SEQ ID NO: 667115 - RNA, 22 nt, Human
ggcuggguuugacuccuggcuu

SEQ ID NO: 667116 - RNA, 22 nt, Human
caauaacugcugaggagaagca

SEQ ID NO: 667117 - RNA, 22 nt, Human
uguuaucacuuagacaugcuag

SEQ ID NO: 667118 - RNA, 22 nt, Human
ugaaaugagauagauaaucagg

SEQ ID NO: 667119 - RNA, 19 nt, Human
acugucacauaaaggaagg

SEQ ID NO: 667120 - RNA, 22 nt, Human
caaggcugcugcgggucgcacc

SEQ ID NO: 667121 - RNA, 22 nt, Human
ucuagcauuucuuuccugagga

SEQ ID NO: 667122 - RNA, 22 nt, Human
gugugucugaaguugaguagac

SEQ ID NO: 667123 - RNA, 22 nt, Human
gcuuacaaggguaggaagucua

SEQ ID NO: 667124 - RNA, 22 nt, Human
agugcuuaauagauguccagca

SEQ ID NO: 667125 - RNA, 22 nt, Human
cagagguguuggugaauggaga

SEQ ID NO: 667126 - RNA, 22 nt, Human
cucuuauugaugaaggugcuaa

SEQ ID NO: 667127 - RNA, 22 nt, Human
ggccagcucugcacagcagcug

SEQ ID NO: 667128 - RNA, 22 nt, Human
uccugguggcucuuugggaagg

SEQ ID NO: 667129 - RNA, 22 nt, Human
uuccuguguguugguggcagaa

SEQ ID NO: 667130 - RNA, 20 nt, Human
uucauucauuccacaacuuc

SEQ ID NO: 667131 - RNA, 22 nt, Human
gcugagcugggacaguccuggg

SEQ ID NO: 667132 - RNA, 22 nt, Human
aguggcuuuuuaguggcagaug

SEQ ID NO: 667133 - RNA, 22 nt, Human
auugcucugcaauccuccccaa

SEQ ID NO: 667134 - RNA, 22 nt, Human
acccagagcagagcuuggcuuc

SEQ ID NO: 667135 - RNA, 22 nt, Human
cagugccugggacccggcugug

SEQ ID NO: 667136 - RNA, 22 nt, Human
gcugagagcaaagcaugucuag

SEQ ID NO: 667137 - RNA, 22 nt, Human
gcccagagugaguccugggccc

SEQ ID NO: 667138 - RNA, 22 nt, Human
ggccaggagaggagggcacuga

SEQ ID NO: 667139 - RNA, 22 nt, Human
uguaugugcuugagaagguggg

SEQ ID NO: 667140 - RNA, 19 nt, Human
acagucagggaauaaagac

SEQ ID NO: 667141 - RNA, 22 nt, Human
acugggcaauaaauucagagaa

SEQ ID NO: 667142 - RNA, 22 nt, Human
gccaugcaauggaauaaaauca

SEQ ID NO: 667143 - RNA, 22 nt, Human
gugcugggcccugagaccaggg

SEQ ID NO: 667144 - RNA, 22 nt, Human
agguggcagcagccuggugaaa

SEQ ID NO: 667145 - RNA, 19 nt, Human
guggcagcagauuuggugu

SEQ ID NO: 667146 - RNA, 22 nt, Human
guggaauguccuugaucauaag

SEQ ID NO: 667147 - RNA, 22 nt, Human
uauuuguuucuaguggcagcaa

SEQ ID NO: 667148 - RNA, 22 nt, Human
uaagguuuugagaccagaacgu

SEQ ID NO: 667149 - RNA, 22 nt, Human
uauacacauuacaguuucagga

SEQ ID NO: 667150 - RNA, 22 nt, Human
agucccagacuccaguuuucug

SEQ ID NO: 667151 - RNA, 22 nt, Human
ucuauuuuguuuccagcucuac

SEQ ID NO: 667152 - RNA, 22 nt, Human
agcaggaguuugaugcuuuuau

SEQ ID NO: 667153 - RNA, 22 nt, Human
auuaaacaauguaaaguucuug

SEQ ID NO: 667154 - RNA, 22 nt, Human
gaguccagugauguuccugguc

SEQ ID NO: 667155 - RNA, 22 nt, Human
uuucuacacuucgugguguuuu

SEQ ID NO: 667156 - RNA, 22 nt, Human
cccugguggggccagacuugcu

SEQ ID NO: 667157 - RNA, 22 nt, Human
caucuuuagggaccauuauucu

SEQ ID NO: 667158 - RNA, 22 nt, Human
caacacauugaagcuaugauga

SEQ ID NO: 667159 - RNA, 22 nt, Human
cuacuuuaccuccaucagacug

SEQ ID NO: 667160 - RNA, 22 nt, Human
ucagucucaucaacucuauucc

SEQ ID NO: 667161 - RNA, 22 nt, Human
gcugcagagggucuuagagagg

SEQ ID NO: 667162 - RNA, 20 nt, Human
cagcagaaauggggugggaa

SEQ ID NO: 667163 - RNA, 22 nt, Human
caaccucuuugggccuugguuu

SEQ ID NO: 667164 - RNA, 22 nt, Human
cugggcaguaugaauauucaaa

SEQ ID NO: 667165 - RNA, 22 nt, Human
guggccugccgugugguauggg

SEQ ID NO: 667166 - RNA, 19 nt, Human
uccugaaaacuucuggaau

SEQ ID NO: 667167 - RNA, 22 nt, Human
uauuccaaugucaguuauauca

SEQ ID NO: 667168 - RNA, 17 nt, Human
ucuguccagggagugug

SEQ ID NO: 667169 - RNA, 22 nt, Human
aggguccugagccuggggcgca

SEQ ID NO: 667170 - RNA, 22 nt, Human
ugccaggcgugguggugcgcac

SEQ ID NO: 667171 - RNA, 22 nt, Human
ggauguagugcaaggagugaau

SEQ ID NO: 667172 - RNA, 17 nt, Human
uguuccauuugaccacc

SEQ ID NO: 667173 - RNA, 22 nt, Human
ggcuccagcccuggcucuucac

SEQ ID NO: 667174 - RNA, 22 nt, Human
uucugcaguguuaacaauguca

SEQ ID NO: 667175 - RNA, 22 nt, Human
agcugagagcugugucaagaua

SEQ ID NO: 667176 - RNA, 22 nt, Human
aacugauuguuggaugauagug

SEQ ID NO: 667177 - RNA, 22 nt, Human
gugcaggaguaggagagggcuu

SEQ ID NO: 667178 - RNA, 22 nt, Human
ugacacaugcaccagucuuuaa

SEQ ID NO: 667179 - RNA, 22 nt, Human
uuccuuccgggcaccaggcacu

SEQ ID NO: 667180 - RNA, 22 nt, Human
caguucugacuuucauaauguc

SEQ ID NO: 667181 - RNA, 21 nt, Human
cucccagggugacuguucaac

SEQ ID NO: 667182 - RNA, 22 nt, Human
agaauuagguaaguucaucuga

SEQ ID NO: 667183 - RNA, 22 nt, Human
uucuucaaaauccagcaugauu

SEQ ID NO: 667184 - RNA, 22 nt, Human
cagcagugaugugugaggguuc

SEQ ID NO: 667185 - RNA, 22 nt, Human
ugucagagagcaggcaguagaa

SEQ ID NO: 667186 - RNA, 22 nt, Human
guccugggaaggaagccaggga

SEQ ID NO: 667187 - RNA, 22 nt, Human
accagagcucuucagcacagga

SEQ ID NO: 667188 - RNA, 22 nt, Human
uuccucagagagacagaaacua

SEQ ID NO: 667189 - RNA, 22 nt, Human
gacagcaacacucaauucugca

SEQ ID NO: 667190 - RNA, 22 nt, Human
uaugaaaugguaguaggaaggg

SEQ ID NO: 667191 - RNA, 22 nt, Human
uggcucugugucucccagcagc

SEQ ID NO: 667192 - RNA, 22 nt, Human
uuucuuccuaaauaugauuucc

SEQ ID NO: 667193 - RNA, 22 nt, Human
gcccagaguggccacuuggcuc

SEQ ID NO: 667194 - RNA, 22 nt, Human
augugcuuucuuuguuucauaa

SEQ ID NO: 667195 - RNA, 22 nt, Human
caauuuuuguacuuauaguacu

SEQ ID NO: 667196 - RNA, 22 nt, Human
acagcuuuuaugggaccagcca

SEQ ID NO: 667197 - RNA, 22 nt, Human
uguacacguggccaucuuuaca

SEQ ID NO: 667198 - RNA, 22 nt, Human
agaggccugugugcuccagugg

SEQ ID NO: 667199 - RNA, 22 nt, Human
uauacagaaagaauucaagucu

SEQ ID NO: 667200 - RNA, 22 nt, Human
gacaggcaugcuuucaggacua

SEQ ID NO: 667201 - RNA, 18 nt, Human
gaugucucgaggagacua

SEQ ID NO: 667202 - RNA, 21 nt, Human
uucugagcacucaucacuguc

SEQ ID NO: 667203 - RNA, 22 nt, Human
cuccugugguacucccagggcc

SEQ ID NO: 667204 - RNA, 22 nt, Human
uagcccaugaugguggaaggca

SEQ ID NO: 667205 - RNA, 22 nt, Human
gcacuugaagaauugaacugga

SEQ ID NO: 667206 - RNA, 22 nt, Human
ucugagccagacaagacagcca

SEQ ID NO: 667207 - RNA, 22 nt, Human
ugaggcuccuuguagagagugg

SEQ ID NO: 667208 - RNA, 22 nt, Human
guacaguaaauguaaauggauu

SEQ ID NO: 667209 - RNA, 22 nt, Human
auccacccugugguggcuuucu

SEQ ID NO: 667210 - RNA, 22 nt, Human
gcugcccaggaagccugggguu

SEQ ID NO: 667211 - RNA, 19 nt, Human
agucugucugcuuucccuc

SEQ ID NO: 667212 - RNA, 22 nt, Human
auccaaacuaugacuaguguuc

SEQ ID NO: 667213 - RNA, 22 nt, Human
agggaaauaaucuauucugagg

SEQ ID NO: 667214 - RNA, 22 nt, Human
guguguauuuaaaggauaguug

SEQ ID NO: 667215 - RNA, 22 nt, Human
gggcuggcaucgguugcugaga

SEQ ID NO: 667216 - RNA, 22 nt, Human
uucugggguuaugggugauucu

SEQ ID NO: 667217 - RNA, 22 nt, Human
gauggaagaaaaaugcaugucu

SEQ ID NO: 667218 - RNA, 22 nt, Human
acaaagaucuugcuuuccuacu

SEQ ID NO: 667219 - RNA, 22 nt, Human
gcaagcaauggacggugacuuu

SEQ ID NO: 667220 - RNA, 23 nt, Human
gguccacccgagccugcagcuuc

SEQ ID NO: 667221 - RNA, 22 nt, Human
gcacaguggguggucauguaca

SEQ ID NO: 667222 - RNA, 22 nt, Human
ccagaauagaaggcagcuguca

SEQ ID NO: 667223 - RNA, 22 nt, Human
agccuucaguaaauccacugug

SEQ ID NO: 667224 - RNA, 22 nt, Human
cuggguaccucaccgcugcugc

SEQ ID NO: 667225 - RNA, 22 nt, Human
uuauugcaacuccuaaauagag

SEQ ID NO: 667226 - RNA, 22 nt, Human
agcagcaagcagugcacggguu

SEQ ID NO: 667227 - RNA, 22 nt, Human
aauaaagacucagaggcccagg

SEQ ID NO: 667228 - RNA, 22 nt, Human
aggcaggggagcuggaagggua

SEQ ID NO: 667229 - RNA, 22 nt, Human
gaacaucaugaagaaaacauau

SEQ ID NO: 667230 - RNA, 22 nt, Human
acccagggaccccgcugacgcc

SEQ ID NO: 667231 - RNA, 22 nt, Human
uaugcuuuacuuuucauuguga

SEQ ID NO: 667232 - RNA, 22 nt, Human
ugcucagugagucugugacagg

SEQ ID NO: 667233 - RNA, 22 nt, Human
agggccccaguaagauuacaug

SEQ ID NO: 667234 - RNA, 22 nt, Human
gagcacccuuugcacaucaguc

SEQ ID NO: 667235 - RNA, 22 nt, Human
aaggaagaugaaaguacugcua

SEQ ID NO: 667236 - RNA, 22 nt, Human
uauuaugguuguagguuaacaa

SEQ ID NO: 667237 - RNA, 22 nt, Human
uuucacaauuuuaaggagcaaa

SEQ ID NO: 667238 - RNA, 22 nt, Human
uaaggaaaauggacaucaaaca

SEQ ID NO: 667239 - RNA, 22 nt, Human
agucccaacagcuuacaaggaa

SEQ ID NO: 667240 - RNA, 22 nt, Human
uuuuguuguaauauaccuaucc

SEQ ID NO: 667241 - RNA, 22 nt, Human
aucuaacuuauguuuuaccaaa

SEQ ID NO: 667242 - RNA, 22 nt, Human
aucagcaagauugugucuugua

SEQ ID NO: 667243 - RNA, 22 nt, Human
aguucugaaugaggaaucuggg

SEQ ID NO: 667244 - RNA, 22 nt, Human
uauagacuagcagcagaauuua

SEQ ID NO: 667245 - RNA, 22 nt, Human
cucugggcaaagaugccucauc

SEQ ID NO: 667246 - RNA, 22 nt, Human
uucucugccucuagcuauauuc

SEQ ID NO: 667247 - RNA, 22 nt, Human
uacuuuaaagagguguaaugag

SEQ ID NO: 667248 - RNA, 22 nt, Human
ugcugagaggaaagaaugcaca

SEQ ID NO: 667249 - RNA, 22 nt, Human
cccagugcuaugccuauuacau

SEQ ID NO: 667250 - RNA, 22 nt, Human
cacagagcaggugcugggaaga

SEQ ID NO: 667251 - RNA, 19 nt, Human
uauucaggaugauggcaca

SEQ ID NO: 667252 - RNA, 22 nt, Human
ugacaauggggcacauggaaag

SEQ ID NO: 667253 - RNA, 22 nt, Human
gaguuuuaaccucagcucucug

SEQ ID NO: 667254 - RNA, 22 nt, Human
gcccagcaaggaccaagggccg

SEQ ID NO: 667255 - RNA, 22 nt, Human
aucuguuccccuaugcucucua

SEQ ID NO: 667256 - RNA, 22 nt, Human
agaagccauucccuguaggcuc

SEQ ID NO: 667257 - RNA, 22 nt, Human
ggaaaaggccacagggacacau

SEQ ID NO: 667258 - RNA, 17 nt, Human
cugccuggagucccauc

SEQ ID NO: 667259 - RNA, 22 nt, Human
uucccugaagaccucaugugac

SEQ ID NO: 667260 - RNA, 22 nt, Human
auguguaaaguuagaugucuga

SEQ ID NO: 667261 - RNA, 22 nt, Human
cucccacauggaauagcaggga

SEQ ID NO: 667262 - RNA, 20 nt, Human
caauaauuuacuucccuauu

SEQ ID NO: 667263 - RNA, 17 nt, Human
acagaggcaggagugga

SEQ ID NO: 667264 - RNA, 22 nt, Human
gugcuuucugcugcauuccucu

SEQ ID NO: 667265 - RNA, 22 nt, Human
uaauuucacugauaugaaguca

SEQ ID NO: 667266 - RNA, 22 nt, Human
uucagaaaucccucuucuaccc

SEQ ID NO: 667267 - RNA, 22 nt, Human
aaucauguuucagaugaguuuu

SEQ ID NO: 667268 - RNA, 22 nt, Human
uucacagaagaggucacauuuc

SEQ ID NO: 667269 - RNA, 22 nt, Human
augaggcaaucaugguccaguu

SEQ ID NO: 667270 - RNA, 22 nt, Human
cagcugagaccagaaugcaggu

SEQ ID NO: 667271 - RNA, 22 nt, Human
aagcauggcugagugcaauggu

SEQ ID NO: 667272 - RNA, 22 nt, Human
caggaagaaagaggugaggugu

SEQ ID NO: 667273 - RNA, 17 nt, Human
gguuuaauccuuaccug

SEQ ID NO: 667274 - RNA, 22 nt, Human
cagagaugggucgcagagaugg

SEQ ID NO: 667275 - RNA, 22 nt, Human
aacuuuucauaagggcaaauuu

SEQ ID NO: 667276 - RNA, 22 nt, Human
cagccaggacagggaaacuagu

SEQ ID NO: 667277 - RNA, 22 nt, Human
cagcugugggccugacguggca

SEQ ID NO: 667278 - RNA, 22 nt, Human
gccaucacauccaggcuaccuc

SEQ ID NO: 667279 - RNA, 22 nt, Human
ugugcaaucauauuuuaaaaug

SEQ ID NO: 667280 - RNA, 22 nt, Human
ccuuugugaauaugcagaaaau

SEQ ID NO: 667281 - RNA, 22 nt, Human
gagucaggcuagggugacaggc

SEQ ID NO: 667282 - RNA, 22 nt, Human
agguucagaguuguugauguuu

SEQ ID NO: 667283 - RNA, 22 nt, Human
cauggcagggcugugggcaggu

SEQ ID NO: 667284 - RNA, 22 nt, Human
cagggcuguggcuuugugcugu

SEQ ID NO: 667285 - RNA, 22 nt, Human
uaagcucacuguaagaacugau

SEQ ID NO: 667286 - RNA, 22 nt, Human
ggaugacaaggaaagcaaacca

SEQ ID NO: 667287 - RNA, 22 nt, Human
uucuauaagacucauauuucuu

SEQ ID NO: 667288 - RNA, 22 nt, Human
aaaucuggccccuugccuauuu

SEQ ID NO: 667289 - RNA, 21 nt, Human
ugucuucauaugagauggugu

SEQ ID NO: 667290 - RNA, 22 nt, Human
gcuggguuuccagcaggcagga

SEQ ID NO: 667291 - RNA, 22 nt, Human
ucagcuucccuaucugaccaua

SEQ ID NO: 667292 - RNA, 22 nt, Human
uccaggucaucuuggagagcug

SEQ ID NO: 667293 - RNA, 22 nt, Human
ucaaaggcuugugguucuggga

SEQ ID NO: 667294 - RNA, 22 nt, Human
ggguucagagucaggugugaua

SEQ ID NO: 667295 - RNA, 22 nt, Human
cacugcccagcgucuuaggcac

SEQ ID NO: 667296 - RNA, 22 nt, Human
gaaagacauaguugcaagaugg

SEQ ID NO: 667297 - RNA, 22 nt, Human
gcaguguguggugagggcugcc

SEQ ID NO: 667298 - RNA, 22 nt, Human
agccugagccccauccagcuga

SEQ ID NO: 667299 - RNA, 22 nt, Human
aggggcugcuggguccgccccu

SEQ ID NO: 667300 - RNA, 21 nt, Human
guucaaauggguagauucaca

SEQ ID NO: 667301 - RNA, 22 nt, Human
gagaggcaggaauccuggguga

SEQ ID NO: 667302 - RNA, 22 nt, Human
caaauggcuggcauccuucuac

SEQ ID NO: 667303 - RNA, 22 nt, Human
aagggcucccugccugaggugg

SEQ ID NO: 667304 - RNA, 22 nt, Human
gcccugguuuuagaggagcagg

SEQ ID NO: 667305 - RNA, 22 nt, Human
ugccugucuuaauaucuggaaa

SEQ ID NO: 667306 - RNA, 22 nt, Human
augaggcaucugcagucacuag

SEQ ID NO: 667307 - RNA, 22 nt, Human
auuaguugggguggagaaggau

SEQ ID NO: 667308 - RNA, 22 nt, Human
aguucuuuucuagauucuggau

SEQ ID NO: 667309 - RNA, 22 nt, Human
uaccauuuugaaacauuucauc

SEQ ID NO: 667310 - RNA, 22 nt, Human
gauacauuuuaucuccuaacag

SEQ ID NO: 667311 - RNA, 22 nt, Human
guuuauuagaguuuucugucug

SEQ ID NO: 667312 - RNA, 22 nt, Human
cuggcagcccaaccuagagucu

SEQ ID NO: 667313 - RNA, 22 nt, Human
ucugccuuggcaaccacagcuu

SEQ ID NO: 667314 - RNA, 22 nt, Human
uggguaaauauccuuugugaaa

SEQ ID NO: 667315 - RNA, 22 nt, Human
uccuccucacgcuguugcuugu

SEQ ID NO: 667316 - RNA, 22 nt, Human
ugcagcccaggcgucagguggu

SEQ ID NO: 667317 - RNA, 22 nt, Human
uugaaagauagugaagccagcc

SEQ ID NO: 667318 - RNA, 22 nt, Human
cuugcagcauccgguccucucu

SEQ ID NO: 667319 - RNA, 22 nt, Human
cuugccugcuggagcagggcuc

SEQ ID NO: 667320 - RNA, 22 nt, Human
ggagccugcgggagcucccauu

SEQ ID NO: 667321 - RNA, 22 nt, Human
ugggggaguauagucuggccuc

SEQ ID NO: 667322 - RNA, 22 nt, Human
aagagguuuaacugacucacag

SEQ ID NO: 667323 - RNA, 22 nt, Human
acaggugggcuuaagagucggc

SEQ ID NO: 667324 - RNA, 22 nt, Human
gugggacagucagaagugagca

SEQ ID NO: 667325 - RNA, 22 nt, Human
aggagcugaagucucugcacuc

SEQ ID NO: 667326 - RNA, 22 nt, Human
ucucuguggugggaggcugagu

SEQ ID NO: 667327 - RNA, 22 nt, Human
ugagauaauuaaaucaaaaccu

SEQ ID NO: 667328 - RNA, 22 nt, Human
auuauucuugagguguuuauug

SEQ ID NO: 667329 - RNA, 22 nt, Human
cccucaugccagacagcaugca

SEQ ID NO: 667330 - RNA, 22 nt, Human
acaaguggguccuacauaaagc

SEQ ID NO: 667331 - RNA, 22 nt, Human
ugcaggugcuacaagaacucac

SEQ ID NO: 667332 - RNA, 22 nt, Human
ccacuguggaaagcaguucaga

SEQ ID NO: 667333 - RNA, 22 nt, Human
ugcugccugugccaggaggguc

SEQ ID NO: 667334 - RNA, 22 nt, Human
aaugucuuuugauacaaguuac

SEQ ID NO: 667335 - RNA, 22 nt, Human
auagaauaugacuuuuagaucc

SEQ ID NO: 667336 - RNA, 22 nt, Human
aggaaacauccuuaucuauucu

SEQ ID NO: 667337 - RNA, 22 nt, Human
aaaggcacaaauucagcauuuu

SEQ ID NO: 667338 - RNA, 22 nt, Human
cagguggcagugccugcauucu

SEQ ID NO: 667339 - RNA, 22 nt, Human
aucauugaauauaagugcuauu

SEQ ID NO: 667340 - RNA, 22 nt, Human
ucaugaacuuccuagccagacu

SEQ ID NO: 667341 - RNA, 22 nt, Human
ccuccaggaggaaauggaacac

SEQ ID NO: 667342 - RNA, 22 nt, Human
cccugcagacgucuugaugccu

SEQ ID NO: 667343 - RNA, 22 nt, Human
agcaggcugccuuccaaagccu

SEQ ID NO: 667344 - RNA, 22 nt, Human
acagucuuaugcauacacuauu

SEQ ID NO: 667345 - RNA, 22 nt, Human
agagcagccugugaugaugcac

SEQ ID NO: 667346 - RNA, 20 nt, Human
agaggcuuccuugggaggag

SEQ ID NO: 667347 - RNA, 22 nt, Human
guccagccugaagagugggggc

SEQ ID NO: 667348 - RNA, 22 nt, Human
cuucaucuuucugagccucagu

SEQ ID NO: 667349 - RNA, 22 nt, Human
uauggguaagaucuuuuguauu

SEQ ID NO: 667350 - RNA, 22 nt, Human
gccaccagguuagauccagccu

SEQ ID NO: 667351 - RNA, 22 nt, Human
cuguuucaugucuuccgcagcu

SEQ ID NO: 667352 - RNA, 22 nt, Human
aggagcugggagaaggacuaaa

SEQ ID NO: 667353 - RNA, 22 nt, Human
uggcugcaguucacaggagcaa

SEQ ID NO: 667354 - RNA, 22 nt, Human
aacaguuuaugauaaauucuua

SEQ ID NO: 667355 - RNA, 22 nt, Human
uggcccugagggcucggagcca

SEQ ID NO: 667356 - RNA, 21 nt, Human
ugaaacaaucagacagagucu

SEQ ID NO: 667357 - RNA, 22 nt, Human
uggcaccagcaccuagaugggg

SEQ ID NO: 667358 - RNA, 22 nt, Human
auccuucaaaaggaauagcagg

SEQ ID NO: 667359 - RNA, 22 nt, Human
gcagccaggaaagcuggacccu

SEQ ID NO: 667360 - RNA, 17 nt, Human
ccugcccagagacagau

SEQ ID NO: 667361 - RNA, 22 nt, Human
agucauuuugccagucuucagg

SEQ ID NO: 667362 - RNA, 20 nt, Human
ucccaagggcugagaggauc

SEQ ID NO: 667363 - RNA, 22 nt, Human
gauaaauugcacuuuuucuuac

SEQ ID NO: 667364 - RNA, 22 nt, Human
ugcagggacacgaagacaaaua

SEQ ID NO: 667365 - RNA, 22 nt, Human
caggaaauugcaacagucugag

SEQ ID NO: 667366 - RNA, 22 nt, Human
uucugggacauugcagguauuc

SEQ ID NO: 667367 - RNA, 22 nt, Human
uuuagucagguaagaugcaggg

SEQ ID NO: 667368 - RNA, 22 nt, Human
uggaguuaaaaacaggaugcac

SEQ ID NO: 667369 - RNA, 22 nt, Human
aucugcugcccagccacuugcu

SEQ ID NO: 667370 - RNA, 22 nt, Human
cacugaaaggaaaccagagcau

SEQ ID NO: 667371 - RNA, 19 nt, Human
ucaguggaugaacauguuu

SEQ ID NO: 667372 - RNA, 22 nt, Human
gacaaugcagaaguacuuguuc

SEQ ID NO: 667373 - RNA, 22 nt, Human
aggccagggcacugcucuuuag

SEQ ID NO: 667374 - RNA, 22 nt, Human
ccagcugauucgguggugguug

SEQ ID NO: 667375 - RNA, 22 nt, Human
gacuucaaaggucaaacaucgc

SEQ ID NO: 667376 - RNA, 22 nt, Human
gagaggcccuguggucccagcu

SEQ ID NO: 667377 - RNA, 22 nt, Human
ucccuccuggccgucaccgcug

SEQ ID NO: 667378 - RNA, 22 nt, Human
augaggcagagggcugugccag

SEQ ID NO: 667379 - RNA, 22 nt, Human
caguguuugcuuaaguuauaug

SEQ ID NO: 667380 - RNA, 22 nt, Human
acacugguuguuaauaguaaca

SEQ ID NO: 667381 - RNA, 22 nt, Human
ggcaaggggucaggcugagaca

SEQ ID NO: 667382 - RNA, 22 nt, Human
aagauuuccuggauguaauucc

SEQ ID NO: 667383 - RNA, 22 nt, Human
uucaacauuuaucaguuuauca

SEQ ID NO: 667384 - RNA, 20 nt, Human
uuccagccgccacuuccgcc

SEQ ID NO: 667385 - RNA, 22 nt, Human
ugcaggaagacuucccaagcca

SEQ ID NO: 667386 - RNA, 22 nt, Human
ccagaggggcacaaaaguagaa

SEQ ID NO: 667387 - RNA, 22 nt, Human
accagggcccgggagagcucuc

SEQ ID NO: 667388 - RNA, 22 nt, Human
gggcaggggucaguggccccaa

SEQ ID NO: 667389 - RNA, 22 nt, Human
aaagguaacugggguuuugcca

SEQ ID NO: 667390 - RNA, 22 nt, Human
agggggagcuuggcuacuccug

SEQ ID NO: 667391 - RNA, 22 nt, Human
ggaaagccaggugcucuggugu

SEQ ID NO: 667392 - RNA, 22 nt, Human
acagaugcucugaugucugggu

SEQ ID NO: 667393 - RNA, 22 nt, Human
cuccugagaaauaagcaaguaa

SEQ ID NO: 667394 - RNA, 22 nt, Human
guaaaggcccauucaaacagcu

SEQ ID NO: 667395 - RNA, 21 nt, Human
agauaguugggcaugcagcug

SEQ ID NO: 667396 - RNA, 22 nt, Human
guggcucaucuuugggaaguaa

SEQ ID NO: 667397 - RNA, 22 nt, Human
ugaaacuucuaauaugaauagu

SEQ ID NO: 667398 - RNA, 22 nt, Human
ggucuggaagcgucccaaaggu

SEQ ID NO: 667399 - RNA, 22 nt, Human
ucccuggccauuccucuaggcc

SEQ ID NO: 667400 - RNA, 22 nt, Human
gggccucagguucuggagaagg

SEQ ID NO: 667401 - RNA, 22 nt, Human
gacagcaagagacagagcaucc

SEQ ID NO: 667402 - RNA, 22 nt, Human
gcaggugguccccguggagugg

SEQ ID NO: 667403 - RNA, 22 nt, Human
uggcuucucccgacacccuggc

SEQ ID NO: 667404 - RNA, 22 nt, Human
ucgagcucuggagccaaggaug

SEQ ID NO: 667405 - RNA, 22 nt, Human
aggggaagagcccuuuacaugg

SEQ ID NO: 667406 - RNA, 22 nt, Human
uauuaguagcuugaaauuggug

SEQ ID NO: 667407 - RNA, 22 nt, Human
aaacaguguguuucagagaggc

SEQ ID NO: 667408 - RNA, 22 nt, Human
gaaccucagugaaacuggaggu

SEQ ID NO: 667409 - RNA, 22 nt, Human
caaaguuuggcucucaugacau

SEQ ID NO: 667410 - RNA, 22 nt, Human
uacaguuucuguccuuguggag

SEQ ID NO: 667411 - RNA, 22 nt, Human
aauguuaaaaccuucagugcuu

SEQ ID NO: 667412 - RNA, 22 nt, Human
gcuuuugagguccugcucagcc

SEQ ID NO: 667413 - RNA, 22 nt, Human
ucacaagaguaaguucaugccu

SEQ ID NO: 667414 - RNA, 22 nt, Human
uagagguguucauucucuccau

SEQ ID NO: 667415 - RNA, 22 nt, Human
uagcaacauaagaaacauuuug

SEQ ID NO: 667416 - RNA, 22 nt, Human
uucuuacaucaguuuauuuugu

SEQ ID NO: 667417 - RNA, 22 nt, Human
ccaggaggcggaagguacagug

SEQ ID NO: 667418 - RNA, 22 nt, Human
uucugagaaauggguucacaua

SEQ ID NO: 667419 - RNA, 22 nt, Human
gcagaaguggauucuacaauuu

SEQ ID NO: 667420 - RNA, 22 nt, Human
aggcacugggggaugagcaagg

SEQ ID NO: 667421 - RNA, 22 nt, Human
ggccucugccucaucugggcac

SEQ ID NO: 667422 - RNA, 22 nt, Human
gcugccaccguggagaugagug

SEQ ID NO: 667423 - RNA, 22 nt, Human
uggcaccaccagacaccaggag

SEQ ID NO: 667424 - RNA, 22 nt, Human
cacaugagugagaacaugcagu

SEQ ID NO: 667425 - RNA, 22 nt, Human
cuggccaggcuugggacagaca

SEQ ID NO: 667426 - RNA, 22 nt, Human
agcagauaugauacuuaauuua

SEQ ID NO: 667427 - RNA, 22 nt, Human
ucuccuacucacucaaggcuug

SEQ ID NO: 667428 - RNA, 22 nt, Human
uuagucuucuuccuuauauguu

SEQ ID NO: 667429 - RNA, 22 nt, Human
ugucauuucacaauaucacuca

SEQ ID NO: 667430 - RNA, 22 nt, Human
acagcaucauauaguggaagaa

SEQ ID NO: 667431 - RNA, 22 nt, Human
gugcagggagcccagaaggucc

SEQ ID NO: 667432 - RNA, 22 nt, Human
ugcuggaaccaggaauuugaag

SEQ ID NO: 667433 - RNA, 22 nt, Human
agcacaauauaaagugaacgca

SEQ ID NO: 667434 - RNA, 22 nt, Human
aauguucauuguuuuccauaug

SEQ ID NO: 667435 - RNA, 22 nt, Human
aaguacaugcuuuauucagagu

SEQ ID NO: 667436 - RNA, 22 nt, Human
ggcccagcgaggccaccuacag

SEQ ID NO: 667437 - RNA, 22 nt, Human
caucucacuucccugcagcauc

SEQ ID NO: 667438 - RNA, 22 nt, Human
agcugaagggaggauauguaca

SEQ ID NO: 667439 - RNA, 22 nt, Human
gucccugcaucugcaggccaug

SEQ ID NO: 667440 - RNA, 23 nt, Human
ccugagaucuguaagggaccuug

SEQ ID NO: 667441 - RNA, 22 nt, Human
acccugggcuuggccugcucag

SEQ ID NO: 667442 - RNA, 22 nt, Human
auuauucagucuuguaaggagu

SEQ ID NO: 667443 - RNA, 22 nt, Human
acacacaugcaugcuugccauu

SEQ ID NO: 667444 - RNA, 22 nt, Human
caggcgggcaggugcggccccu

SEQ ID NO: 667445 - RNA, 22 nt, Human
agugucacaaaccugccuugua

SEQ ID NO: 667446 - RNA, 22 nt, Human
uaugcacaauaugaucuauuug

SEQ ID NO: 667447 - RNA, 22 nt, Human
uugaaacucaucuuagugaugu

SEQ ID NO: 667448 - RNA, 22 nt, Human
agugauguugauuuuaccacuu

SEQ ID NO: 667449 - RNA, 22 nt, Human
uuucauguuacaguguaaaagu

SEQ ID NO: 667450 - RNA, 22 nt, Human
ugguaaaguggcuucacagugu

SEQ ID NO: 667451 - RNA, 22 nt, Human
ccugucccccaggccuguacca

SEQ ID NO: 667452 - RNA, 22 nt, Human
aagucguggcaggcuugcacga

SEQ ID NO: 667453 - RNA, 22 nt, Human
ucuggccuguguugguggcccc

SEQ ID NO: 667454 - RNA, 22 nt, Human
ucagugccuacuuugaucaauu

SEQ ID NO: 667455 - RNA, 16 nt, Human
agaggccacagacaga

SEQ ID NO: 667456 - RNA, 22 nt, Human
uauacaagaggugagaugagca

SEQ ID NO: 667457 - RNA, 19 nt, Human
uguacauauagagcucagu

SEQ ID NO: 667458 - RNA, 22 nt, Human
uucuguggcugggagccuggcu

SEQ ID NO: 667459 - RNA, 22 nt, Human
uaaacauggauucugaucacag

SEQ ID NO: 667460 - RNA, 22 nt, Human
acaaaugucuacauugagaaua

SEQ ID NO: 667461 - RNA, 22 nt, Human
ugugagacaauugcaucagggc

SEQ ID NO: 667462 - RNA, 15 nt, Human
ggaggccaggcugug

SEQ ID NO: 667463 - RNA, 22 nt, Human
ugaacuguacaucccuaaccua

SEQ ID NO: 667464 - RNA, 22 nt, Human
uucuauguaccuagcguuguau

SEQ ID NO: 667465 - RNA, 22 nt, Human
ccagguguggggaggacucaca

SEQ ID NO: 667466 - RNA, 22 nt, Human
caaauucagaaaauugguagag

SEQ ID NO: 667467 - RNA, 22 nt, Human
caucucuugccaaaguuugacc

SEQ ID NO: 667468 - RNA, 22 nt, Human
ugucacaaguaacuggcaaugc

SEQ ID NO: 667469 - RNA, 22 nt, Human
caucccugauuccuaguacagu

SEQ ID NO: 667470 - RNA, 22 nt, Human
cucagggauggugaagcaccca

SEQ ID NO: 667471 - RNA, 22 nt, Human
acugucaaaugcaaugaacuca

SEQ ID NO: 667472 - RNA, 22 nt, Human
uagcacaucuggcgcuuauagg

SEQ ID NO: 667473 - RNA, 22 nt, Human
ugcucauuaggacugcaaauuc

SEQ ID NO: 667474 - RNA, 22 nt, Human
aaaaguaauugcaguuuuugcc

SEQ ID NO: 667475 - RNA, 22 nt, Human
aggcaggccccugagaauagac

SEQ ID NO: 667476 - RNA, 22 nt, Human
ggcuuugggauucagcaugaga

SEQ ID NO: 667477 - RNA, 22 nt, Human
aggcugucucagccugcuugca

SEQ ID NO: 667478 - RNA, 22 nt, Human
ucaugacaacuauauuauucca

SEQ ID NO: 667479 - RNA, 22 nt, Human
cacagaggagugcacacucucu

SEQ ID NO: 667480 - RNA, 22 nt, Human
uucuucagucccacuagccaca

SEQ ID NO: 667481 - RNA, 22 nt, Human
ccaggcugcuuuauuacucugu

SEQ ID NO: 667482 - RNA, 21 nt, Human
uaugagaaaacugaggugcau

SEQ ID NO: 667483 - RNA, 22 nt, Human
ccagcugggauuaagggaaaau

SEQ ID NO: 667484 - RNA, 22 nt, Human
ugaaguaggcagcaugcugaga

SEQ ID NO: 667485 - RNA, 22 nt, Human
cugagggcuuccuugucccggg

SEQ ID NO: 667486 - RNA, 22 nt, Human
aaugcacuuaguaugaaugccu

SEQ ID NO: 667487 - RNA, 22 nt, Human
gcccagggucuacaaaaauauu

SEQ ID NO: 667488 - RNA, 22 nt, Human
cuuacacuucaucucauccagg

SEQ ID NO: 667489 - RNA, 22 nt, Human
uugcccugucaguagaagugca

SEQ ID NO: 667490 - RNA, 22 nt, Human
agaggggacagccaccugcccg

SEQ ID NO: 667491 - RNA, 22 nt, Human
ccacuggagacuggucucugug

SEQ ID NO: 667492 - RNA, 22 nt, Human
cucaucugauaaaucacucuua

SEQ ID NO: 667493 - RNA, 22 nt, Human
acagaauucucucugcagaggc

SEQ ID NO: 667494 - RNA, 22 nt, Human
agugugcauuccucuccucagg

SEQ ID NO: 667495 - RNA, 22 nt, Human
gcacuuuguggauuguauuucc

SEQ ID NO: 667496 - RNA, 23 nt, Human
aaauggcuugcccucucguuugg

SEQ ID NO: 667497 - RNA, 22 nt, Human
cuguuuauacgacagguggagg

SEQ ID NO: 667498 - RNA, 22 nt, Human
aucauccaucuagcgcgggggg

SEQ ID NO: 667499 - RNA, 22 nt, Human
ucccucucccuauugccuggag

SEQ ID NO: 667500 - RNA, 22 nt, Human
auaaucugacaaagacuuaagc

SEQ ID NO: 667501 - RNA, 22 nt, Human
auguuuagucauucagcuccuu

SEQ ID NO: 667502 - RNA, 22 nt, Human
ccugauguccauaauccuguaa

SEQ ID NO: 667503 - RNA, 22 nt, Human
gaaagguucuugggaguucaca

SEQ ID NO: 667504 - RNA, 22 nt, Human
ggaaagggcauggccuuuucac

SEQ ID NO: 667505 - RNA, 22 nt, Human
gcucugagacaguagagauggc

SEQ ID NO: 667506 - RNA, 22 nt, Human
uggagcaggaagucuauggcug

SEQ ID NO: 667507 - RNA, 22 nt, Human
cagcaucuccugugcagaggga

SEQ ID NO: 667508 - RNA, 22 nt, Human
ugaagccacagagcaucugccu

SEQ ID NO: 667509 - RNA, 22 nt, Human
ggaaccaggaguuacacgaguu

SEQ ID NO: 667510 - RNA, 22 nt, Human
gcacagaagagcuuuggaauga

SEQ ID NO: 667511 - RNA, 22 nt, Human
ccucucuccaagggaaauccua

SEQ ID NO: 667512 - RNA, 22 nt, Human
gcacagagacaguccugagauc

SEQ ID NO: 667513 - RNA, 17 nt, Human
gcugagaggcagcacag

SEQ ID NO: 667514 - RNA, 22 nt, Human
cugagaggugcugguggcugca

SEQ ID NO: 667515 - RNA, 22 nt, Human
gaagugaagguuacucuagauu

SEQ ID NO: 667516 - RNA, 22 nt, Human
agcaagcuaacauaggagauug

SEQ ID NO: 667517 - RNA, 17 nt, Human
cucagcugaaccccaga

SEQ ID NO: 667518 - RNA, 22 nt, Human
ugaggggaaggcaugauaaaua

SEQ ID NO: 667519 - RNA, 19 nt, Human
caggccagugucagggggc

SEQ ID NO: 667520 - RNA, 22 nt, Human
accauuaagaaucugguuuccu

SEQ ID NO: 667521 - RNA, 22 nt, Human
cugccugaguacaagucccaga

SEQ ID NO: 667522 - RNA, 22 nt, Human
uaccuagaccaguuacaaugca

SEQ ID NO: 667523 - RNA, 20 nt, Human
caggucuucauguggcuguc

SEQ ID NO: 667524 - RNA, 22 nt, Human
gucccuggggguuuaggacuca

SEQ ID NO: 667525 - RNA, 22 nt, Human
uuucucagcucagcaucugggu

SEQ ID NO: 667526 - RNA, 22 nt, Human
aagaacagguucuagaaccauu

SEQ ID NO: 667527 - RNA, 22 nt, Human
uuuaacuugaucaguagagcau

SEQ ID NO: 667528 - RNA, 22 nt, Human
gcucccuccaugaggcagaccg

SEQ ID NO: 667529 - RNA, 22 nt, Human
guagacaagcacaggacucaga

SEQ ID NO: 667530 - RNA, 22 nt, Human
agucaguuguggagauuuaacu

SEQ ID NO: 667531 - RNA, 18 nt, Human
ccucugccauagccagca

SEQ ID NO: 667532 - RNA, 22 nt, Human
ugggcaccuagcaacccuucuc

SEQ ID NO: 667533 - RNA, 22 nt, Human
aaauucucaagugauccuguug

SEQ ID NO: 667534 - RNA, 22 nt, Human
caugaaauugcuccuuuggugc

SEQ ID NO: 667535 - RNA, 22 nt, Human
cgcaggcucgguucacagagca

SEQ ID NO: 667536 - RNA, 23 nt, Human
uauuuuccaaaugaugacuacau

SEQ ID NO: 667537 - RNA, 22 nt, Human
gucuuaaaaucagaggauauag

SEQ ID NO: 667538 - RNA, 22 nt, Human
aucaggauuauuaaaucuggau

SEQ ID NO: 667539 - RNA, 22 nt, Human
aaaccuagaaggaagggucucu

SEQ ID NO: 667540 - RNA, 22 nt, Human
auuuucucuuuguauaugcuag

SEQ ID NO: 667541 - RNA, 20 nt, Human
auucugcuuugaaaauaagg

SEQ ID NO: 667542 - RNA, 22 nt, Human
uaaccaugcaugucucuaguuu

SEQ ID NO: 667543 - RNA, 22 nt, Human
uaaugaggaaauagagggaaug

SEQ ID NO: 667544 - RNA, 22 nt, Human
gccucaggacuggcauacucau

SEQ ID NO: 667545 - RNA, 18 nt, Human
acauuuaggagagucaau

SEQ ID NO: 667546 - RNA, 22 nt, Human
uucuccaggcuugggccagguc

SEQ ID NO: 667547 - RNA, 22 nt, Human
acuguacacauucgucaagacu

SEQ ID NO: 667548 - RNA, 22 nt, Human
gcacagagcuggcccuccaggc

SEQ ID NO: 667549 - RNA, 22 nt, Human
ucucaguguuuaaaaagauuuc

SEQ ID NO: 667550 - RNA, 22 nt, Human
ugaggggguuaauuaggagagu

SEQ ID NO: 667551 - RNA, 22 nt, Human
augugagggaaaucagucagaa

SEQ ID NO: 667552 - RNA, 22 nt, Human
gagggccaggcagcaagaaggc

SEQ ID NO: 667553 - RNA, 22 nt, Human
ucacagacacagggagaagcau

SEQ ID NO: 667554 - RNA, 22 nt, Human
ugccugcgaggcaugggugaga

SEQ ID NO: 667555 - RNA, 22 nt, Human
acauuugacuguagauacuugc

SEQ ID NO: 667556 - RNA, 22 nt, Human
agccccaguucccuggaagucu

SEQ ID NO: 667557 - RNA, 22 nt, Human
gcagagccaggagagacccuug

SEQ ID NO: 667558 - RNA, 22 nt, Human
aagccacuauggugauucucaa

SEQ ID NO: 667559 - RNA, 22 nt, Human
ugggguacuuguaucaaagcac

SEQ ID NO: 667560 - RNA, 19 nt, Human
ccacagagacuagaagaca

SEQ ID NO: 667561 - RNA, 20 nt, Human
aucaggauucuugcuuuguu

SEQ ID NO: 667562 - RNA, 19 nt, Human
gaucuuugccaauuuaagc

SEQ ID NO: 667563 - RNA, 22 nt, Human
ccagcgcuucccaucagggagg

SEQ ID NO: 667564 - RNA, 22 nt, Human
uaugcacuggauuacaaagcaa

SEQ ID NO: 667565 - RNA, 22 nt, Human
gcucagggccauggaccagcag

SEQ ID NO: 667566 - RNA, 22 nt, Human
acaucgauggauagagcuugcu

SEQ ID NO: 667567 - RNA, 22 nt, Human
agcaugcacaugacuggcuuaa

SEQ ID NO: 667568 - RNA, 22 nt, Human
ucuggccaggggucccugaagg

SEQ ID NO: 667569 - RNA, 22 nt, Human
agccuuuaacacuucacauuga

SEQ ID NO: 667570 - RNA, 18 nt, Human
acugucucugagaguggu

SEQ ID NO: 667571 - RNA, 17 nt, Human
ugacuuuauuugcuugg

SEQ ID NO: 667572 - RNA, 22 nt, Human
aaaggaagaugccaggacucug

SEQ ID NO: 667573 - RNA, 22 nt, Human
ccacuucaucagugcuccauuu

SEQ ID NO: 667574 - RNA, 22 nt, Human
ucauugcagugauguuguaugu

SEQ ID NO: 667575 - RNA, 20 nt, Human
ugagggcuaaccagacucug

SEQ ID NO: 667576 - RNA, 22 nt, Human
cuccuggaucuuagccagauuc

SEQ ID NO: 667577 - RNA, 22 nt, Human
aagcagugacucucagaggcag

SEQ ID NO: 667578 - RNA, 22 nt, Human
uccaggucugugagcuaaaugg

SEQ ID NO: 667579 - RNA, 22 nt, Human
aaagaauagccuuuguccaaau

SEQ ID NO: 667580 - RNA, 23 nt, Human
agcagccauagggaagcaauaca

SEQ ID NO: 667581 - RNA, 22 nt, Human
aucuagaggagggcugcuggau

SEQ ID NO: 667582 - RNA, 22 nt, Human
uuagcacuggauuaaucaaagu

SEQ ID NO: 667583 - RNA, 18 nt, Human
gccucccuggcuacacuu

SEQ ID NO: 667584 - RNA, 22 nt, Human
ugcuggagaagcuccugggacu

SEQ ID NO: 667585 - RNA, 22 nt, Human
uaauguuugagauguuggauuu

SEQ ID NO: 667586 - RNA, 22 nt, Human
agcauccagcauccuauagaaa

SEQ ID NO: 667587 - RNA, 22 nt, Human
ggucugagagccacugaauccc

SEQ ID NO: 667588 - RNA, 22 nt, Human
aagcaauaaucccaaagugcug

SEQ ID NO: 667589 - RNA, 22 nt, Human
gugaggcagcaggagccucugu

SEQ ID NO: 667590 - RNA, 22 nt, Human
uugggguggaagugaggaucau

SEQ ID NO: 667591 - RNA, 20 nt, Human
caccaggcgcucugagaaca

SEQ ID NO: 667592 - RNA, 22 nt, Human
agccagggaagaggccuaccuc

SEQ ID NO: 667593 - RNA, 22 nt, Human
aguguuuaguuaagauuucaaa

SEQ ID NO: 667594 - RNA, 22 nt, Human
aggcuccaugcaaaggcuguuu

SEQ ID NO: 667595 - RNA, 22 nt, Human
aagagcuccaggcaaugcgguc

SEQ ID NO: 667596 - RNA, 21 nt, Human
cuuggcugcagugacaggcau

SEQ ID NO: 667597 - RNA, 22 nt, Human
uuucaucuauuugcuuugugaa

SEQ ID NO: 667598 - RNA, 22 nt, Human
agcagcauucucugguaugggg

SEQ ID NO: 667599 - RNA, 22 nt, Human
ugagccagguuuuccaucauuc

SEQ ID NO: 667600 - RNA, 22 nt, Human
gagcacagugcaguuucugcua

SEQ ID NO: 667601 - RNA, 18 nt, Human
cuucauuuguagaguucc

SEQ ID NO: 667602 - RNA, 22 nt, Human
aaaaucuugugacuuaggaagg

SEQ ID NO: 667603 - RNA, 22 nt, Human
acugugcacaauucuaaguccu

SEQ ID NO: 667604 - RNA, 22 nt, Human
aaccuggccccagauuccccau

SEQ ID NO: 667605 - RNA, 19 nt, Human
agaagcccagaucccagcc

SEQ ID NO: 667606 - RNA, 22 nt, Human
uauucagaggguugaauuuuua

SEQ ID NO: 667607 - RNA, 22 nt, Human
aguggcugucuuccaaaaucug

SEQ ID NO: 667608 - RNA, 22 nt, Human
guacccuguggccagccagcca

SEQ ID NO: 667609 - RNA, 22 nt, Human
uguguuugggggagaugcauuu

SEQ ID NO: 667610 - RNA, 22 nt, Human
cuggcagaguugggucucaaau

SEQ ID NO: 667611 - RNA, 22 nt, Human
ggaggcacuucccgucucagcc

SEQ ID NO: 667612 - RNA, 22 nt, Human
acaguacagugcagaggaagau

SEQ ID NO: 667613 - RNA, 22 nt, Human
aaagauacuuaauaguugucug

SEQ ID NO: 667614 - RNA, 20 nt, Human
accuggagagauuauuacca

SEQ ID NO: 667615 - RNA, 22 nt, Human
uucauuguacuuuaagagaugc

SEQ ID NO: 667616 - RNA, 22 nt, Human
cagugggggugaggccgaggua

SEQ ID NO: 667617 - RNA, 22 nt, Human
auguguauuacccuuucauucc

SEQ ID NO: 667618 - RNA, 22 nt, Human
uauuuccaggccccacucuaga

SEQ ID NO: 667619 - RNA, 22 nt, Human
caagucaaugauuauaagaguc

SEQ ID NO: 667620 - RNA, 22 nt, Human
auagguacagcagauauucuua

SEQ ID NO: 667621 - RNA, 22 nt, Human
uuacaaagauuauauucaguua

SEQ ID NO: 667622 - RNA, 21 nt, Human
agcucuggagcagcaaucaag

SEQ ID NO: 667623 - RNA, 23 nt, Human
ugcucugggaggcccuggagagc

SEQ ID NO: 667624 - RNA, 22 nt, Human
uuuacaguaagguggaugguac

SEQ ID NO: 667625 - RNA, 19 nt, Human
uuugggaagcccagagugu

SEQ ID NO: 667626 - RNA, 22 nt, Human
gagcuuggugcugccuguuguc

SEQ ID NO: 667627 - RNA, 22 nt, Human
auggggagcucaccaccuguuu

SEQ ID NO: 667628 - RNA, 22 nt, Human
ucagcuuggacagcuugguuga

SEQ ID NO: 667629 - RNA, 22 nt, Human
agugucuguuacgcuugcagaa

SEQ ID NO: 667630 - RNA, 22 nt, Human
ucauauuuaggccuuuaauuca

SEQ ID NO: 667631 - RNA, 22 nt, Human
gaccagaaucuggacucugauu

SEQ ID NO: 667632 - RNA, 22 nt, Human
acugugaacggacugaagccca

SEQ ID NO: 667633 - RNA, 22 nt, Human
aaauucauuuuucuuagugugc

SEQ ID NO: 667634 - RNA, 22 nt, Human
ucagaauuuaaaauguguagau

SEQ ID NO: 667635 - RNA, 22 nt, Human
acagcagagccaguggcucuag

SEQ ID NO: 667636 - RNA, 22 nt, Human
cugucuguccugaguucaacca

SEQ ID NO: 667637 - RNA, 20 nt, Human
aaggcagaguggguuggagc

SEQ ID NO: 667638 - RNA, 22 nt, Human
aaauugcuggcagccuuuauuc

SEQ ID NO: 667639 - RNA, 22 nt, Human
auuuacacauucauaagauuuc

SEQ ID NO: 667640 - RNA, 22 nt, Human
augagcaagagcuauguacaga

SEQ ID NO: 667641 - RNA, 22 nt, Human
cuuagggaaucuuagagcugga

SEQ ID NO: 667642 - RNA, 22 nt, Human
uaaccuuugaccuugcuugugc

SEQ ID NO: 667643 - RNA, 22 nt, Human
gaugaaaaucuugagaugucga

SEQ ID NO: 667644 - RNA, 22 nt, Human
gacaguguuuguauaauuccug

SEQ ID NO: 667645 - RNA, 22 nt, Human
ucccacaggcccagggcggaaa

SEQ ID NO: 667646 - RNA, 22 nt, Human
cugagcagugcuuugcaguggg

SEQ ID NO: 667647 - RNA, 22 nt, Human
aaacacaccuuuggaacuguga

SEQ ID NO: 667648 - RNA, 19 nt, Human
uggcucuguuucucuggag

SEQ ID NO: 667649 - RNA, 22 nt, Human
agucaggauuuaaacucagaca

SEQ ID NO: 667650 - RNA, 22 nt, Human
gauauuuacaaauuugccaaua

SEQ ID NO: 667651 - RNA, 21 nt, Human
caaaagagacugauucuugga

SEQ ID NO: 667652 - RNA, 22 nt, Human
gcagggguggaggcuguccugu

SEQ ID NO: 667653 - RNA, 21 nt, Human
agccuguugguuuacugcuca

SEQ ID NO: 667654 - RNA, 22 nt, Human
gaagccuggagaccagauguug

SEQ ID NO: 667655 - RNA, 22 nt, Human
ugcaguggaaagacucagacuu

SEQ ID NO: 667656 - RNA, 22 nt, Human
auugaagaucagggaaagauuc

SEQ ID NO: 667657 - RNA, 22 nt, Human
agcaguggagcgagauguuuaa

SEQ ID NO: 667658 - RNA, 22 nt, Human
gaagcugaguggacucuggcca

SEQ ID NO: 667659 - RNA, 22 nt, Human
uccuugaagcuuguaucuaaua

SEQ ID NO: 667660 - RNA, 22 nt, Human
uacacagauuucaguaucauca

SEQ ID NO: 667661 - RNA, 18 nt, Human
uccugguucuguggccac

SEQ ID NO: 667662 - RNA, 22 nt, Human
ugggggcagccaggcugucaag

SEQ ID NO: 667663 - RNA, 22 nt, Human
agccauaucaagcauucuucac

SEQ ID NO: 667664 - RNA, 22 nt, Human
ccccacccucgcuccauuucgg

SEQ ID NO: 667665 - RNA, 18 nt, Human
ggcugcucgcucuccccg

SEQ ID NO: 667666 - RNA, 22 nt, Human
ucuguacaugaguugagaauca

SEQ ID NO: 667667 - RNA, 22 nt, Human
ucuuuacaaucuaagcauaguu

SEQ ID NO: 667668 - RNA, 21 nt, Human
acagugagaaauaaauggaaa

SEQ ID NO: 667669 - RNA, 22 nt, Human
uuggagaggcagucuugcucug

SEQ ID NO: 667670 - RNA, 22 nt, Human
uggugcugauaauggcaggauu

SEQ ID NO: 667671 - RNA, 22 nt, Human
gacugaggugcccagaggugac

SEQ ID NO: 667672 - RNA, 22 nt, Human
cucuggagguugagcccagcaa

SEQ ID NO: 667673 - RNA, 22 nt, Human
uccaggacuuggcaggagauga

SEQ ID NO: 667674 - RNA, 22 nt, Human
ggaaggaucuggcugaaaucca

SEQ ID NO: 667675 - RNA, 22 nt, Human
uuccagauauuuuuauguggaa

SEQ ID NO: 667676 - RNA, 22 nt, Human
aaaagagccacuuaugaccuca

SEQ ID NO: 667677 - RNA, 22 nt, Human
ccacaguccgggcuggcaggac

SEQ ID NO: 667678 - RNA, 21 nt, Human
aggacaggaacuggcugaaua

SEQ ID NO: 667679 - RNA, 22 nt, Human
uuugguuuuuaauacaaaguac

SEQ ID NO: 667680 - RNA, 22 nt, Human
gauucaaaguuaaugaagaugc

SEQ ID NO: 667681 - RNA, 19 nt, Human
uucucagagcuugcagcac

SEQ ID NO: 667682 - RNA, 22 nt, Human
aauuauggugugugguuaaggg

SEQ ID NO: 667683 - RNA, 22 nt, Human
cuagaucagauugcuguuucua

SEQ ID NO: 667684 - RNA, 22 nt, Human
ucuuuguaaguuauauguagua

SEQ ID NO: 667685 - RNA, 22 nt, Human
gaguuuggguggaaggagggua

SEQ ID NO: 667686 - RNA, 22 nt, Human
uggcucuggagcuccugggccc

SEQ ID NO: 667687 - RNA, 22 nt, Human
ggcugggcugcugggucagagc

SEQ ID NO: 667688 - RNA, 22 nt, Human
ucacuucacacccacuaucaug

SEQ ID NO: 667689 - RNA, 22 nt, Human
aguucacauuccgagguacugg

SEQ ID NO: 667690 - RNA, 22 nt, Human
ccagaugaggucaugcuggguu

SEQ ID NO: 667691 - RNA, 22 nt, Human
gcuuggcuggagaaaguuaccu

SEQ ID NO: 667692 - RNA, 22 nt, Human
uaggccagcccuuaguccuguc

SEQ ID NO: 667693 - RNA, 22 nt, Human
auuucugugcaguaaaugguga

SEQ ID NO: 667694 - RNA, 22 nt, Human
uauguguuauuugguauacauu

SEQ ID NO: 667695 - RNA, 22 nt, Human
cccaggcugggaacgauucuag

SEQ ID NO: 667696 - RNA, 22 nt, Human
acaguauaaacuccuaaaagcc

SEQ ID NO: 667697 - RNA, 22 nt, Human
uaaaaucagccgaccauggugg

SEQ ID NO: 667698 - RNA, 22 nt, Human
agcagcagauucagcaggaaug

SEQ ID NO: 667699 - RNA, 22 nt, Human
aaguuuuucacauugcuguugu

SEQ ID NO: 667700 - RNA, 22 nt, Human
gcaggaccucuggaugcaaugc

SEQ ID NO: 667701 - RNA, 22 nt, Human
gacacuuuuuuaaagcucauua

SEQ ID NO: 667702 - RNA, 22 nt, Human
ggaagccaggcccagagaugcu

SEQ ID NO: 667703 - RNA, 22 nt, Human
uggagcccacggaugucgcuuu

SEQ ID NO: 667704 - RNA, 20 nt, Human
ggcugugcccuuccguggcc

SEQ ID NO: 667705 - RNA, 22 nt, Human
agcccagcuuccuucugucucu

SEQ ID NO: 667706 - RNA, 22 nt, Human
acagagcaguucuggagcuggc

SEQ ID NO: 667707 - RNA, 22 nt, Human
aagcccuggcggguggagggcc

SEQ ID NO: 667708 - RNA, 21 nt, Human
uggccagcuggagucuccaca

SEQ ID NO: 667709 - RNA, 22 nt, Human
caagauggagaagcagcaaggg

SEQ ID NO: 667710 - RNA, 22 nt, Human
aacagcuugcugcaccuuaaua

SEQ ID NO: 667711 - RNA, 22 nt, Human
ucaccaggauugggcuguaggc

SEQ ID NO: 667712 - RNA, 22 nt, Human
gcucacuggccugaagaggacg

SEQ ID NO: 667713 - RNA, 22 nt, Human
aguggcuguuuauaggugggua

SEQ ID NO: 667714 - RNA, 22 nt, Human
guuccuuguauuucagacauga

SEQ ID NO: 667715 - RNA, 22 nt, Human
ggcuuuauuaagcaggguaagu

SEQ ID NO: 667716 - RNA, 22 nt, Human
ugaaauuaugcauuguuguacc

SEQ ID NO: 667717 - RNA, 22 nt, Human
acagaauuuacacaucucuaaa

SEQ ID NO: 667718 - RNA, 22 nt, Human
auuccacagcuacguuuugagc

SEQ ID NO: 667719 - RNA, 22 nt, Human
ugguggcuguaagggagagaag

SEQ ID NO: 667720 - RNA, 22 nt, Human
gcugucuggcauggcguggcug

SEQ ID NO: 667721 - RNA, 18 nt, Human
cacaggcucccagugagg

SEQ ID NO: 667722 - RNA, 22 nt, Human
caugaagcccucaucagucuga

SEQ ID NO: 667723 - RNA, 22 nt, Human
agcugaaggcuagaacagcugg

SEQ ID NO: 667724 - RNA, 23 nt, Human
ugggggugcacgggccacaucuu

SEQ ID NO: 667725 - RNA, 22 nt, Human
cagaacaguaccuagcacauag

SEQ ID NO: 667726 - RNA, 22 nt, Human
ucccucgaagagcuuauucuuu

SEQ ID NO: 667727 - RNA, 22 nt, Human
gcaaaaaaugcuuguugcuuag

SEQ ID NO: 667728 - RNA, 22 nt, Human
caagugacugugcuggcaacau

SEQ ID NO: 667729 - RNA, 22 nt, Human
aagcacauugccuggcacauag

SEQ ID NO: 667730 - RNA, 22 nt, Human
aggaauuuuguauggauacugu

SEQ ID NO: 667731 - RNA, 22 nt, Human
cagaaaccucccugaauauuuu

SEQ ID NO: 667732 - RNA, 22 nt, Human
ucaggauggagggaagcacaga

SEQ ID NO: 667733 - RNA, 22 nt, Human
uggugcuguggaggggcagaag

SEQ ID NO: 667734 - RNA, 22 nt, Human
aggaaacaggcagccuuugaac

SEQ ID NO: 667735 - RNA, 22 nt, Human
uaaagugccucagguccugggu

SEQ ID NO: 667736 - RNA, 22 nt, Human
cucccagguuacaucugagccu

SEQ ID NO: 667737 - RNA, 22 nt, Human
cgaggccagcucuaagcccuac

SEQ ID NO: 667738 - RNA, 22 nt, Human
uuuggaaacugccucagcucuu

SEQ ID NO: 667739 - RNA, 22 nt, Human
aguugcugguaaauguuaucaa

SEQ ID NO: 667740 - RNA, 22 nt, Human
aggugacuacuauuuuaaaaua

SEQ ID NO: 667741 - RNA, 22 nt, Human
cugcagcagccuccagccuugg

SEQ ID NO: 667742 - RNA, 22 nt, Human
augcuaaagcuuugcuuucauu

SEQ ID NO: 667743 - RNA, 22 nt, Human
gugcuuccucagagguucccau

SEQ ID NO: 667744 - RNA, 22 nt, Human
agaucggcuuugcagaccucau

SEQ ID NO: 667745 - RNA, 22 nt, Human
ucauucauaaaaauuaguuggc

SEQ ID NO: 667746 - RNA, 22 nt, Human
uuuaucugcuaucugcugugcu

SEQ ID NO: 667747 - RNA, 22 nt, Human
aaggccacacuugcuggccagc

SEQ ID NO: 667748 - RNA, 22 nt, Human
aacauguauuuuccuuggcaac

SEQ ID NO: 667749 - RNA, 22 nt, Human
ggagugacucucggggccacua

SEQ ID NO: 667750 - RNA, 19 nt, Human
cucaccuggaggugcugau

SEQ ID NO: 667751 - RNA, 23 nt, Human
ggcugagaagucccaugauaggu

SEQ ID NO: 667752 - RNA, 22 nt, Human
ugggccugacacuuacuaggga

SEQ ID NO: 667753 - RNA, 16 nt, Human
gggcugggggauucug

SEQ ID NO: 667754 - RNA, 21 nt, Human
ucuuuuaacaccaggaauucc

SEQ ID NO: 667755 - RNA, 17 nt, Human
ucugcucugccaaucca

SEQ ID NO: 667756 - RNA, 22 nt, Human
acccagagucagacagccaugg

SEQ ID NO: 667757 - RNA, 22 nt, Human
ugucaacagaucucaaagcugg

SEQ ID NO: 667758 - RNA, 22 nt, Human
gaaagugcuuagagugugguau

SEQ ID NO: 667759 - RNA, 22 nt, Human
aaaaugagcauauugauccuuu

SEQ ID NO: 667760 - RNA, 22 nt, Human
uaaauugaaaaucuacagaaca

SEQ ID NO: 667761 - RNA, 22 nt, Human
cuucauaucucuguagaguuuu

SEQ ID NO: 667762 - RNA, 22 nt, Human
gaaaucuuccuucagugaagaa

SEQ ID NO: 667763 - RNA, 22 nt, Human
uagaauugggccuaacuuccau

SEQ ID NO: 667764 - RNA, 22 nt, Human
auuugcugaaucaaugaauuuu

SEQ ID NO: 667765 - RNA, 22 nt, Human
acagcccaggacuccagugggc

SEQ ID NO: 667766 - RNA, 22 nt, Human
uccugagggcgauucagcaggu

SEQ ID NO: 667767 - RNA, 22 nt, Human
agcaaagcuuccauaaagcagc

SEQ ID NO: 667768 - RNA, 22 nt, Human
auuuccuaggugcucgagugcu

SEQ ID NO: 667769 - RNA, 22 nt, Human
acaggaaagagcuaggcauagg

SEQ ID NO: 667770 - RNA, 18 nt, Human
aggaaagaaaggcaggug

SEQ ID NO: 667771 - RNA, 22 nt, Human
augaggcauuccacucaaacuc

SEQ ID NO: 667772 - RNA, 19 nt, Human
uaacuuguagauaugaagu

SEQ ID NO: 667773 - RNA, 22 nt, Human
aggcagagcuggguuuugaaau

SEQ ID NO: 667774 - RNA, 22 nt, Human
uucuucaauuuuccauauacug

SEQ ID NO: 667775 - RNA, 22 nt, Human
agaugcuggggccccucggaug

SEQ ID NO: 667776 - RNA, 22 nt, Human
ugugaggaugugagcgugaacc

SEQ ID NO: 667777 - RNA, 22 nt, Human
uugaaauaucaaguuauuagug

SEQ ID NO: 667778 - RNA, 22 nt, Human
caccucucagcuaggaguaagu

SEQ ID NO: 667779 - RNA, 22 nt, Human
ccugggaagcccauagcagcuu

SEQ ID NO: 667780 - RNA, 22 nt, Human
ccaggcugccgaggaaagaaag

SEQ ID NO: 667781 - RNA, 22 nt, Human
uccagcacucgcccagggcuug

SEQ ID NO: 667782 - RNA, 22 nt, Human
gcccugaguugagccuuccaaa

SEQ ID NO: 667783 - RNA, 22 nt, Human
gaugaaauccagaucacaggug

SEQ ID NO: 667784 - RNA, 22 nt, Human
cagcuguggggagcuugggcca

SEQ ID NO: 667785 - RNA, 22 nt, Human
ggaagaggcucucauugagggc

SEQ ID NO: 667786 - RNA, 22 nt, Human
accagcucuucugcucuaguug

SEQ ID NO: 667787 - RNA, 22 nt, Human
uggcagagcccagacuccaguc

SEQ ID NO: 667788 - RNA, 22 nt, Human
ccaauguuuuauacagaaguac

SEQ ID NO: 667789 - RNA, 22 nt, Human
aaauacagauucugacucagag

SEQ ID NO: 667790 - RNA, 22 nt, Human
ugcucugaaggggaagggaugg

SEQ ID NO: 667791 - RNA, 22 nt, Human
agaaacagcauuagcaucaauu

SEQ ID NO: 667792 - RNA, 22 nt, Human
gcaggcagagagggguuuccag

SEQ ID NO: 667793 - RNA, 23 nt, Human
ggcagauuugguuuguuuuaaua

SEQ ID NO: 667794 - RNA, 22 nt, Human
cagugcugacagggaggaaccu

SEQ ID NO: 667795 - RNA, 22 nt, Human
uggcccugcuuaugucucucuu

SEQ ID NO: 667796 - RNA, 22 nt, Human
augccagccucuaagcacuuua

SEQ ID NO: 667797 - RNA, 21 nt, Human
aaggcagaagcauggaaugag

SEQ ID NO: 667798 - RNA, 22 nt, Human
uuuguacuggaagaacaugcaa

SEQ ID NO: 667799 - RNA, 22 nt, Human
acugugagagagguucuuggua

SEQ ID NO: 667800 - RNA, 22 nt, Human
uuuuccuacugauaaacaguua

SEQ ID NO: 667801 - RNA, 22 nt, Human
agucugugagugauguaccugc

SEQ ID NO: 667802 - RNA, 22 nt, Human
uggccugggccugccggugcaa

SEQ ID NO: 667803 - RNA, 22 nt, Human
uccugggcgaguggugguacac

SEQ ID NO: 667804 - RNA, 22 nt, Human
aggagacauggaauagugaggc

SEQ ID NO: 667805 - RNA, 22 nt, Human
ugacucugcugugaaagcauuu

SEQ ID NO: 667806 - RNA, 22 nt, Human
uaaaaguggauaagcuguagga

SEQ ID NO: 667807 - RNA, 22 nt, Human
ggcagucacuuuugcuugugcc

SEQ ID NO: 667808 - RNA, 22 nt, Human
aagagguucuccuuggaguggg

SEQ ID NO: 667809 - RNA, 22 nt, Human
cacagguguuuguuauacucag

SEQ ID NO: 667810 - RNA, 22 nt, Human
acauaugcgaucauaggaugca

SEQ ID NO: 667811 - RNA, 18 nt, Human
ccagcccugcagcaccug

SEQ ID NO: 667812 - RNA, 20 nt, Human
ucacagaaacaaauagagaa

SEQ ID NO: 667813 - RNA, 22 nt, Human
gcagcaggagaguuuguccugc

SEQ ID NO: 667814 - RNA, 22 nt, Human
uuucucagccuccuugcuggag

SEQ ID NO: 667815 - RNA, 17 nt, Human
ucaggauccaggguucu

SEQ ID NO: 667816 - RNA, 22 nt, Human
aaaggcuucuuugcuccauguc

SEQ ID NO: 667817 - RNA, 22 nt, Human
agggcagaaauauugauacugu

SEQ ID NO: 667818 - RNA, 22 nt, Human
uuaaggcauugauauggugcua

SEQ ID NO: 667819 - RNA, 22 nt, Human
agaacuuaggaacaacagcuua

SEQ ID NO: 667820 - RNA, 22 nt, Human
aggcuugaaaugaaaucuguaa

SEQ ID NO: 667821 - RNA, 22 nt, Human
ugagcucuucuaacuaauugug

SEQ ID NO: 667822 - RNA, 22 nt, Human
gacauugaacaaguuuccugac

SEQ ID NO: 667823 - RNA, 22 nt, Human
cucugaaacuccagccccaggu

SEQ ID NO: 667824 - RNA, 22 nt, Human
uucuggagauugagaaggcauu

SEQ ID NO: 667825 - RNA, 22 nt, Human
aacaugagugauaaaauuaccu

SEQ ID NO: 667826 - RNA, 22 nt, Human
auugcuuuagaaagaaaaauau

SEQ ID NO: 667827 - RNA, 22 nt, Human
ccagcucugauuuugaccucca

SEQ ID NO: 667828 - RNA, 22 nt, Human
uuuggcuuaacuuacaugauau

SEQ ID NO: 667829 - RNA, 22 nt, Human
aucaaauaaagguaccuagcuu

SEQ ID NO: 667830 - RNA, 22 nt, Human
guccuucauuuccugaucucua

SEQ ID NO: 667831 - RNA, 22 nt, Human
caaaccuguuagaggucaucgu

SEQ ID NO: 667832 - RNA, 22 nt, Human
cugcagaguggagccucggcug

SEQ ID NO: 667833 - RNA, 22 nt, Human
accagaggaggaauuaccuucc

SEQ ID NO: 667834 - RNA, 22 nt, Human
cauccugacccaugggagggga

SEQ ID NO: 667835 - RNA, 22 nt, Human
gaguuuagauggcauuaaggua

SEQ ID NO: 667836 - RNA, 22 nt, Human
uccugaggaaugugaagagaac

SEQ ID NO: 667837 - RNA, 22 nt, Human
ccugggggccaggaagguguga

SEQ ID NO: 667838 - RNA, 18 nt, Human
uuugcugaugagcaucau

SEQ ID NO: 667839 - RNA, 22 nt, Human
gcugggccgaccugggcugcag

SEQ ID NO: 667840 - RNA, 22 nt, Human
gcagggguagugucuuccugag

SEQ ID NO: 667841 - RNA, 22 nt, Human
auuaauuuccaggcacugugcu

SEQ ID NO: 667842 - RNA, 22 nt, Human
cagagguagaacuggcccucac

SEQ ID NO: 667843 - RNA, 22 nt, Human
augcacacugaaugcuuacuuu

SEQ ID NO: 667844 - RNA, 22 nt, Human
cuccuuccugcagaucugagau

SEQ ID NO: 667845 - RNA, 22 nt, Human
ugaggccaggaucccaggcucu

SEQ ID NO: 667846 - RNA, 22 nt, Human
uccuggcaggguggcagcgggu

SEQ ID NO: 667847 - RNA, 22 nt, Human
gaauaaucaugaaauucaguga

SEQ ID NO: 667848 - RNA, 22 nt, Human
caggggacauuaaagcuccaua

SEQ ID NO: 667849 - RNA, 23 nt, Human
aguuuccacccaggguagaaggg

SEQ ID NO: 667850 - RNA, 22 nt, Human
ugcagcucauauuagagagaag

SEQ ID NO: 667851 - RNA, 22 nt, Human
ucacugaacucucauagagaaa

SEQ ID NO: 667852 - RNA, 22 nt, Human
uauuugcaggcuuuugucaugg

SEQ ID NO: 667853 - RNA, 22 nt, Human
uuacaaguauuuaagaugcugu

SEQ ID NO: 667854 - RNA, 22 nt, Human
aaaaguugcaaaauugcucuuc

SEQ ID NO: 667855 - RNA, 22 nt, Human
uauauucuuucaccuucuuccu

SEQ ID NO: 667856 - RNA, 22 nt, Human
aguauuguaaacuuccuaagga

SEQ ID NO: 667857 - RNA, 22 nt, Human
gugucugccuuuggacuaacug

SEQ ID NO: 667858 - RNA, 20 nt, Human
cugaagagacuggaggggca

SEQ ID NO: 667859 - RNA, 22 nt, Human
gaaguuaugaaauuuggacagc

SEQ ID NO: 667860 - RNA, 22 nt, Human
ccacauacaaauggggugcugu

SEQ ID NO: 667861 - RNA, 22 nt, Human
cagucuccaaaucagucugaau

SEQ ID NO: 667862 - RNA, 18 nt, Human
gcagugcaggaagaagag

SEQ ID NO: 667863 - RNA, 22 nt, Human
ugaggugggcuuguggauuugc

SEQ ID NO: 667864 - RNA, 22 nt, Human
gugccuuugugucuaaaacagc

SEQ ID NO: 667865 - RNA, 22 nt, Human
gaggccagaagugccucgggcu

SEQ ID NO: 667866 - RNA, 19 nt, Human
cugcuuccuucccucacug

SEQ ID NO: 667867 - RNA, 21 nt, Human
agcugccacccuagcuucuga

SEQ ID NO: 667868 - RNA, 22 nt, Human
gagcuuuggggaagaauacaga

SEQ ID NO: 667869 - RNA, 22 nt, Human
ccuucugcuggucaucccagug

SEQ ID NO: 667870 - RNA, 22 nt, Human
augacauugaauauguuaacua

SEQ ID NO: 667871 - RNA, 22 nt, Human
ucagaaguugauaaaguaguug

SEQ ID NO: 667872 - RNA, 22 nt, Human
aguuacaaccaugacacaagca

SEQ ID NO: 667873 - RNA, 22 nt, Human
uuccgagggcucggcggccgcc

SEQ ID NO: 667874 - RNA, 22 nt, Human
uucuccauuuaacuuccuuaug

SEQ ID NO: 667875 - RNA, 22 nt, Human
cagcauaucugaguugaaagag

SEQ ID NO: 667876 - RNA, 22 nt, Human
ugcaguggaggccgugagacag

SEQ ID NO: 667877 - RNA, 22 nt, Human
aguuauauaacuaucuagaugc

SEQ ID NO: 667878 - RNA, 22 nt, Human
uaauccagcgggugauugcaca

SEQ ID NO: 667879 - RNA, 22 nt, Human
gcucucuuucacagagguagga

SEQ ID NO: 667880 - RNA, 22 nt, Human
auacauacauguacacauaaau

SEQ ID NO: 667881 - RNA, 22 nt, Human
caaaaguaauugugguuuucac

SEQ ID NO: 667882 - RNA, 22 nt, Human
agguggcuaugaggaugcaguc

SEQ ID NO: 667883 - RNA, 22 nt, Human
uuucacaaucaaauggugaaau

SEQ ID NO: 667884 - RNA, 22 nt, Human
uguacaggagaacaaugagaaa

SEQ ID NO: 667885 - RNA, 22 nt, Human
auguuaaaugguuuauuauuaa

SEQ ID NO: 667886 - RNA, 22 nt, Human
ggugaggaauuggggacugacc

SEQ ID NO: 667887 - RNA, 22 nt, Human
augaaggcaguuaaacgucauc

SEQ ID NO: 667888 - RNA, 22 nt, Human
gaggccacuuccuacuggagga

SEQ ID NO: 667889 - RNA, 22 nt, Human
uucaaagcaagacacaauuccu

SEQ ID NO: 667890 - RNA, 20 nt, Human
agcucuuaagaagaagauga

SEQ ID NO: 667891 - RNA, 22 nt, Human
cagcaagauuaagggcagaaaa

SEQ ID NO: 667892 - RNA, 20 nt, Human
uacaggagugaguggguggg

SEQ ID NO: 667893 - RNA, 22 nt, Human
aaaugcacagaaaggaugugga

SEQ ID NO: 667894 - RNA, 22 nt, Human
ucugaggaauucugcagugaga

SEQ ID NO: 667895 - RNA, 19 nt, Human
gaaggcugaaaugaagcac

SEQ ID NO: 667896 - RNA, 22 nt, Human
ccaguucuucuugacacgaaag

SEQ ID NO: 667897 - RNA, 22 nt, Human
cugugguggcacagcgggcugg

SEQ ID NO: 667898 - RNA, 22 nt, Human
gaacaguaaauuuaugcagcac

SEQ ID NO: 667899 - RNA, 22 nt, Human
ggagguccaugugaauguggcc

SEQ ID NO: 667900 - RNA, 22 nt, Human
caagaggcuaaacugggcuauu

SEQ ID NO: 667901 - RNA, 22 nt, Human
cugccccuggugauggacgcca

SEQ ID NO: 667902 - RNA, 22 nt, Human
ugucucuugaguuuguuuuaau

SEQ ID NO: 667903 - RNA, 22 nt, Human
cauuccuuaacguggggagucu

SEQ ID NO: 667904 - RNA, 22 nt, Human
gaggcagcauucgcauagacag

SEQ ID NO: 667905 - RNA, 22 nt, Human
ucuucagacccuuagcugugau

SEQ ID NO: 667906 - RNA, 22 nt, Human
cuucacagucacccugcugugu

SEQ ID NO: 667907 - RNA, 22 nt, Human
cucaggcaaggcccgcauucuc

SEQ ID NO: 667908 - RNA, 22 nt, Human
caggcacuagcagaaugaggcu

SEQ ID NO: 667909 - RNA, 17 nt, Human
ggccacagagcuugggg

SEQ ID NO: 667910 - RNA, 22 nt, Human
uguacacaauucuuaacauaca

SEQ ID NO: 667911 - RNA, 22 nt, Human
gugcugauugggagcugggauu

SEQ ID NO: 667912 - RNA, 22 nt, Human
caugcagcagaauaaugacuau

SEQ ID NO: 667913 - RNA, 22 nt, Human
uggaacacacuucaaggagaaa

SEQ ID NO: 667914 - RNA, 22 nt, Human
cugggcuaauuaagcacagcug

SEQ ID NO: 667915 - RNA, 22 nt, Human
uucucuucccacuuucuguauu

SEQ ID NO: 667916 - RNA, 22 nt, Human
cuuugggauuucaugagagcua

SEQ ID NO: 667917 - RNA, 22 nt, Human
aaugagaaccuugaaaggaacu

SEQ ID NO: 667918 - RNA, 22 nt, Human
cuuuacuucucaaaauaaagca

SEQ ID NO: 667919 - RNA, 22 nt, Human
gcuggcucugaugggcuccagg

SEQ ID NO: 667920 - RNA, 22 nt, Human
aauguacaaaccuucuuuguag

SEQ ID NO: 667921 - RNA, 20 nt, Human
gcaauguugguuccugucac

SEQ ID NO: 667922 - RNA, 22 nt, Human
gaaaaggccuccccauaggaau

SEQ ID NO: 667923 - RNA, 22 nt, Human
caaguauuuccugauggccugu

SEQ ID NO: 667924 - RNA, 22 nt, Human
ugacaggggcugguggauaaau

SEQ ID NO: 667925 - RNA, 22 nt, Human
ugcugcagcagugcgggcagcu

SEQ ID NO: 667926 - RNA, 22 nt, Human
auagucuuacuuuucucugcua

SEQ ID NO: 667927 - RNA, 19 nt, Human
cuggccuguguccugugcu

SEQ ID NO: 667928 - RNA, 21 nt, Human
uggaaagauucaaagaccagg

SEQ ID NO: 667929 - RNA, 22 nt, Human
aaaguacaaggaaaggaucuga

SEQ ID NO: 667930 - RNA, 18 nt, Human
auuugcaggcaugcaggc

SEQ ID NO: 667931 - RNA, 22 nt, Human
aaagugcuaggauuacaagcgu

SEQ ID NO: 667932 - RNA, 22 nt, Human
ccacauuucuucacuuguccca

SEQ ID NO: 667933 - RNA, 22 nt, Human
gagcagcuugcgcugucuucac

SEQ ID NO: 667934 - RNA, 22 nt, Human
agauugugucaauuucucuuua

SEQ ID NO: 667935 - RNA, 22 nt, Human
auugguuaagacgcaucaugcu

SEQ ID NO: 667936 - RNA, 22 nt, Human
gcaggccacaguggagucucug

SEQ ID NO: 667937 - RNA, 22 nt, Human
ccaggcuugguguguggucagg

SEQ ID NO: 667938 - RNA, 22 nt, Human
acagauuugacugguaccuggc

SEQ ID NO: 667939 - RNA, 22 nt, Human
agcagaaaacuuucaugcucug

SEQ ID NO: 667940 - RNA, 22 nt, Human
ugaguucuuuccguuagguaug

SEQ ID NO: 667941 - RNA, 22 nt, Human
uugucaucaagaugcauugguc

SEQ ID NO: 667942 - RNA, 22 nt, Human
cuggagugauacucagaaugug

SEQ ID NO: 667943 - RNA, 22 nt, Human
agugaagugauaguuugccuag

SEQ ID NO: 667944 - RNA, 22 nt, Human
auguccaguuucuacacacaua

SEQ ID NO: 667945 - RNA, 22 nt, Human
cugaucuguccuccucagagcc

SEQ ID NO: 667946 - RNA, 22 nt, Human
cugggccacaagccugugugau

SEQ ID NO: 667947 - RNA, 22 nt, Human
ugcauugaggggcucucuuccu

SEQ ID NO: 667948 - RNA, 22 nt, Human
agcagguguauauaaggcugag

SEQ ID NO: 667949 - RNA, 22 nt, Human
aggcaccuggccaguugucuug

SEQ ID NO: 667950 - RNA, 22 nt, Human
ucacaugcugugggaucuguau

SEQ ID NO: 667951 - RNA, 22 nt, Human
uacugcauaacuggcauguggg

SEQ ID NO: 667952 - RNA, 22 nt, Human
gugcuggcuggacauggagcac

SEQ ID NO: 667953 - RNA, 22 nt, Human
cuccugguucagagagcugaga

SEQ ID NO: 667954 - RNA, 22 nt, Human
ggcccacacugacagcugagcu

SEQ ID NO: 667955 - RNA, 22 nt, Human
aucauguugcucaaaauuaaac

SEQ ID NO: 667956 - RNA, 22 nt, Human
uuucuucauagaccuugucuug

SEQ ID NO: 667957 - RNA, 22 nt, Human
gcuggaauuggacccagggcuc

SEQ ID NO: 667958 - RNA, 22 nt, Human
gggcucugggauucagagcaag

SEQ ID NO: 667959 - RNA, 22 nt, Human
acuuuccuuauggauggggaaa

SEQ ID NO: 667960 - RNA, 20 nt, Human
ugguccucacaugccaucuu

SEQ ID NO: 667961 - RNA, 22 nt, Human
caagaguuuaaaucaauggcca

SEQ ID NO: 667962 - RNA, 22 nt, Human
uugaggacagugcuuggggccc

SEQ ID NO: 667963 - RNA, 22 nt, Human
gucccagggaugcagacaugag

SEQ ID NO: 667964 - RNA, 22 nt, Human
auuauaaagaacaugugugugg

SEQ ID NO: 667965 - RNA, 22 nt, Human
cuguguccaauggccuuagcag

SEQ ID NO: 667966 - RNA, 22 nt, Human
agggaaaucuuucaacacuuca

SEQ ID NO: 667967 - RNA, 21 nt, Human
cagaccauugcaugagcaggu

SEQ ID NO: 667968 - RNA, 22 nt, Human
gcccaggaaagauagggccuca

SEQ ID NO: 667969 - RNA, 22 nt, Human
uggcagggaauacagauguuua

SEQ ID NO: 667970 - RNA, 22 nt, Human
agaggcucuaauccccuccaca

SEQ ID NO: 667971 - RNA, 19 nt, Human
ccagaugagcagcugagau

SEQ ID NO: 667972 - RNA, 22 nt, Human
augcacauguaugucaauauuu

SEQ ID NO: 667973 - RNA, 22 nt, Human
gcuggcaucacuggcuucggug

SEQ ID NO: 667974 - RNA, 22 nt, Human
uccaugucuucaugugucuaac

SEQ ID NO: 667975 - RNA, 22 nt, Human
gcagugugucuggaguacaugg

SEQ ID NO: 667976 - RNA, 23 nt, Human
ugcugcccgcuuggcacgcuccc

SEQ ID NO: 667977 - RNA, 22 nt, Human
ucacuguaaaguaauacuguca

SEQ ID NO: 667978 - RNA, 22 nt, Human
uuagcaaauaucuugaaacagg

SEQ ID NO: 667979 - RNA, 22 nt, Human
cucuuaauuaagcugagaucug

SEQ ID NO: 667980 - RNA, 22 nt, Human
gagugguaggcaguguuaggaa

SEQ ID NO: 667981 - RNA, 22 nt, Human
uagauucuacagcucagcuguc

SEQ ID NO: 667982 - RNA, 22 nt, Human
gcucugugccacaugcaguguu

SEQ ID NO: 667983 - RNA, 22 nt, Human
uuucauugcagagucugugugc

SEQ ID NO: 667984 - RNA, 19 nt, Human
aauacaguguuauagaauu

SEQ ID NO: 667985 - RNA, 22 nt, Human
cccaggucccgccccagcucua

SEQ ID NO: 667986 - RNA, 17 nt, Human
acagucugccugacagu

SEQ ID NO: 667987 - RNA, 22 nt, Human
guggcagcugugggacacuggu

SEQ ID NO: 667988 - RNA, 22 nt, Human
aauagcucacugauuucucuuu

SEQ ID NO: 667989 - RNA, 22 nt, Human
ggcuccacugcugaccacucca

SEQ ID NO: 667990 - RNA, 22 nt, Human
gggagcugaucagguggauuca

SEQ ID NO: 667991 - RNA, 22 nt, Human
cagagccugccucuggcugugg

SEQ ID NO: 667992 - RNA, 22 nt, Human
aaauaugagaguaggaguuugg

SEQ ID NO: 667993 - RNA, 22 nt, Human
ggaggagcacuucugagcucag

SEQ ID NO: 667994 - RNA, 22 nt, Human
agaaaacuggagccugggguug

SEQ ID NO: 667995 - RNA, 22 nt, Human
uguguucaguaugacauucaca

SEQ ID NO: 667996 - RNA, 23 nt, Human
cauuccugauauggccacaagag

SEQ ID NO: 667997 - RNA, 22 nt, Human
aguaguggggccaggguuugaa

SEQ ID NO: 667998 - RNA, 22 nt, Human
cuccaaggcucuggugcugagg

SEQ ID NO: 667999 - RNA, 22 nt, Human
acacacugaauuuuguggaaac

SEQ ID NO: 668000 - RNA, 22 nt, Human
uagacaggaaacauuaggaugg

SEQ ID NO: 668001 - RNA, 22 nt, Human
aagagagucagucugagcacca

SEQ ID NO: 668002 - RNA, 22 nt, Human
uguguacacaugacaggcaccc

SEQ ID NO: 668003 - RNA, 23 nt, Human
uuucacauuuacuguuagauggc

SEQ ID NO: 668004 - RNA, 17 nt, Human
ccagagcuacugagacu

SEQ ID NO: 668005 - RNA, 22 nt, Human
gaaaacauccagagauagaccu

SEQ ID NO: 668006 - RNA, 22 nt, Human
guuucccauaucuagggagagg

SEQ ID NO: 668007 - RNA, 22 nt, Human
auuugcuucuagucaguuccau

SEQ ID NO: 668008 - RNA, 22 nt, Human
guuacaaaggaagcuucacugc

SEQ ID NO: 668009 - RNA, 23 nt, Human
aggaacugaggccuagggaggua

SEQ ID NO: 668010 - RNA, 22 nt, Human
gcuggagaaacugcagcugagg

SEQ ID NO: 668011 - RNA, 22 nt, Human
gagcagcucaggcacuuagcca

SEQ ID NO: 668012 - RNA, 22 nt, Human
ucacugcuuugagccacugagc

SEQ ID NO: 668013 - RNA, 22 nt, Human
gcucugucauuuugcagacacu

SEQ ID NO: 668014 - RNA, 22 nt, Human
auauugaucuuggaacugauuu

SEQ ID NO: 668015 - RNA, 21 nt, Human
aaugucuuuguccaugcucug

SEQ ID NO: 668016 - RNA, 22 nt, Human
uuggggagaaaugaaaugaagu

SEQ ID NO: 668017 - RNA, 22 nt, Human
guggcagguggagccuccugca

SEQ ID NO: 668018 - RNA, 22 nt, Human
ccaggggcuggugcugagcugg

SEQ ID NO: 668019 - RNA, 22 nt, Human
acauucacuauguccaaacucu

SEQ ID NO: 668020 - RNA, 22 nt, Human
auggguaaggguguuugguuag

SEQ ID NO: 668021 - RNA, 22 nt, Human
uuuacaaguuuacagaaugaug

SEQ ID NO: 668022 - RNA, 22 nt, Human
uggccacacccaccuagaggag

SEQ ID NO: 668023 - RNA, 22 nt, Human
gcugcuugauuagguugacacu

SEQ ID NO: 668024 - RNA, 22 nt, Human
gggugcagggucuccagcagcu

SEQ ID NO: 668025 - RNA, 22 nt, Human
ccagccuugacugccccagcac

SEQ ID NO: 668026 - RNA, 22 nt, Human
cagcccaguaccaagcaguugg

SEQ ID NO: 668027 - RNA, 22 nt, Human
aagguggauguaagcggcaaug

SEQ ID NO: 668028 - RNA, 22 nt, Human
uccuuugguucucuaagaugcu

SEQ ID NO: 668029 - RNA, 22 nt, Human
uugaagcagagaaauacuugaa

SEQ ID NO: 668030 - RNA, 22 nt, Human
aaacuguauagggaaaaguaga

SEQ ID NO: 668031 - RNA, 16 nt, Human
ugcagagagcauggug

SEQ ID NO: 668032 - RNA, 22 nt, Human
uguauuuucugaagauaaucaa

SEQ ID NO: 668033 - RNA, 22 nt, Human
gggcuggugaggcugcccugca

SEQ ID NO: 668034 - RNA, 22 nt, Human
uccugcuguuuaccuacaaugg

SEQ ID NO: 668035 - RNA, 22 nt, Human
gucuggaggcccgucagcccua

SEQ ID NO: 668036 - RNA, 22 nt, Human
acacugucucauaugaggggac

SEQ ID NO: 668037 - RNA, 22 nt, Human
uuagaacuuaaacuucagaaag

SEQ ID NO: 668038 - RNA, 22 nt, Human
uuucagacauuaagugauggga

SEQ ID NO: 668039 - RNA, 22 nt, Human
cucuggguucacugaggcucug

SEQ ID NO: 668040 - RNA, 22 nt, Human
gcccaggaguugaagggcugac

SEQ ID NO: 668041 - RNA, 22 nt, Human
acugggcaucccauggcagagc

SEQ ID NO: 668042 - RNA, 22 nt, Human
gagaggggaccugugugucuag

SEQ ID NO: 668043 - RNA, 22 nt, Human
augcacaggugcugaugcacgc

SEQ ID NO: 668044 - RNA, 22 nt, Human
cuagaauaucauaugaagagac

SEQ ID NO: 668045 - RNA, 22 nt, Human
gcucuguguucccuccaggcuc

SEQ ID NO: 668046 - RNA, 22 nt, Human
uauacaggaaauuuuggaacag

SEQ ID NO: 668047 - RNA, 22 nt, Human
ucucugagcugcuucuugcaua

SEQ ID NO: 668048 - RNA, 22 nt, Human
ugucuuauuaagaccagugacu

SEQ ID NO: 668049 - RNA, 21 nt, Human
cacuauuuauauaugccagcu

SEQ ID NO: 668050 - RNA, 20 nt, Human
augauucugggcuacacugg

SEQ ID NO: 668051 - RNA, 22 nt, Human
cacugugguuauuaucacuguu

SEQ ID NO: 668052 - RNA, 22 nt, Human
uauuuggauacaaucauuugcu

SEQ ID NO: 668053 - RNA, 22 nt, Human
uucaaggagauuggagucuacu

SEQ ID NO: 668054 - RNA, 22 nt, Human
uuucacacccacuaggacuguu

SEQ ID NO: 668055 - RNA, 22 nt, Human
gcagagauccaggguauagguu

SEQ ID NO: 668056 - RNA, 22 nt, Human
gacaugcaacaauuuggcauuu

SEQ ID NO: 668057 - RNA, 20 nt, Human
ugcagagcuggcuggcuccu

SEQ ID NO: 668058 - RNA, 22 nt, Human
cuccuggcucgcccccagcuga

SEQ ID NO: 668059 - RNA, 23 nt, Human
agagccugaaagacuucuggcac

SEQ ID NO: 668060 - RNA, 22 nt, Human
cugaagcagauguggcugagau

SEQ ID NO: 668061 - RNA, 22 nt, Human
gagugcuggggugcagagaggu

SEQ ID NO: 668062 - RNA, 22 nt, Human
acagcucagacaucacugcucu

SEQ ID NO: 668063 - RNA, 22 nt, Human
ucucuguggagcaguguguuca

SEQ ID NO: 668064 - RNA, 22 nt, Human
cacagcauucacagaaagacau

SEQ ID NO: 668065 - RNA, 23 nt, Human
cucugcaggagagugggcagggc

SEQ ID NO: 668066 - RNA, 22 nt, Human
cagacagaaggcuccuugaggu

SEQ ID NO: 668067 - RNA, 22 nt, Human
aaugggagguaguaugggaggu

SEQ ID NO: 668068 - RNA, 22 nt, Human
ucuuugcaggagcccuuugaac

SEQ ID NO: 668069 - RNA, 22 nt, Human
cauuucuagacaaguccuggag

SEQ ID NO: 668070 - RNA, 22 nt, Human
ucccugcugcacucacaccuac

SEQ ID NO: 668071 - RNA, 22 nt, Human
auuagaaaauacaugggcuguc

SEQ ID NO: 668072 - RNA, 21 nt, Human
acuggaagugggucaggaagu

SEQ ID NO: 668073 - RNA, 22 nt, Human
uuccuuuucuuaaacauaugug

SEQ ID NO: 668074 - RNA, 22 nt, Human
cacaggugcaagaaguugcagu

SEQ ID NO: 668075 - RNA, 22 nt, Human
gagggccagaguccugggguca

SEQ ID NO: 668076 - RNA, 18 nt, Human
uucaccagguagauaggg

SEQ ID NO: 668077 - RNA, 22 nt, Human
ggacaggcccggggagccugga

SEQ ID NO: 668078 - RNA, 22 nt, Human
ucagauuuagggugauuaccuu

SEQ ID NO: 668079 - RNA, 22 nt, Human
ugguccaagugagguggccucu

SEQ ID NO: 668080 - RNA, 22 nt, Human
uaggagcuuuuggaguccugug

SEQ ID NO: 668081 - RNA, 22 nt, Human
aagaaaucagaaaagcauucgu

SEQ ID NO: 668082 - RNA, 22 nt, Human
aaacagucaugguugcuguuca

SEQ ID NO: 668083 - RNA, 21 nt, Human
cugagcuggggugaagguugc

SEQ ID NO: 668084 - RNA, 19 nt, Human
gguaaaagugagcuucagg

SEQ ID NO: 668085 - RNA, 22 nt, Human
aaggcagagauauucuugaucu

SEQ ID NO: 668086 - RNA, 22 nt, Human
caggcugagcucuggccugggc

SEQ ID NO: 668087 - RNA, 22 nt, Human
ucugugcaggaagucauuauga

SEQ ID NO: 668088 - RNA, 22 nt, Human
acacuugauaggucaaaucagu

SEQ ID NO: 668089 - RNA, 22 nt, Human
ccuuccagauguaagagcugau

SEQ ID NO: 668090 - RNA, 22 nt, Human
ucacagagagguuaagcaguug

SEQ ID NO: 668091 - RNA, 22 nt, Human
uccugggcuuaagugauccucc

SEQ ID NO: 668092 - RNA, 22 nt, Human
cugggccagucucggccgcucu

SEQ ID NO: 668093 - RNA, 22 nt, Human
auccaguucuuggaagcacagg

SEQ ID NO: 668094 - RNA, 22 nt, Human
auucuuggcaaggagauuuaaa

SEQ ID NO: 668095 - RNA, 22 nt, Human
ggccuugguggcuuugcugaug

SEQ ID NO: 668096 - RNA, 22 nt, Human
acacaaacugcuagaaaauugg

SEQ ID NO: 668097 - RNA, 22 nt, Human
uggaaauguauuugggcaugcc

SEQ ID NO: 668098 - RNA, 18 nt, Human
gcacagagcccaggcucu

SEQ ID NO: 668099 - RNA, 22 nt, Human
accagaaaggaauaauagaauu

SEQ ID NO: 668100 - RNA, 22 nt, Human
ugcugggggugucucaccaggc

SEQ ID NO: 668101 - RNA, 22 nt, Human
aggcuguguucugguucuuagc

SEQ ID NO: 668102 - RNA, 22 nt, Human
ccacagugaaaucuugauggag

SEQ ID NO: 668103 - RNA, 22 nt, Human
uggccaggcauucagauaagac

SEQ ID NO: 668104 - RNA, 22 nt, Human
agcuguuuaugcacuccugccu

SEQ ID NO: 668105 - RNA, 22 nt, Human
uuuccaaaggaggaaccaguuu

SEQ ID NO: 668106 - RNA, 20 nt, Human
cccugagacaaaggaggggc

SEQ ID NO: 668107 - RNA, 17 nt, Human
cucagaguugcuuuguc

SEQ ID NO: 668108 - RNA, 22 nt, Human
cugcugucaaaaaucacuccau

SEQ ID NO: 668109 - RNA, 22 nt, Human
ucagaaaagguagcugugacaa

SEQ ID NO: 668110 - RNA, 22 nt, Human
auaauaacuccuguugaagaac

SEQ ID NO: 668111 - RNA, 22 nt, Human
gccugcagauauauaggauggu

SEQ ID NO: 668112 - RNA, 22 nt, Human
uggcucauggaauuagcuauua

SEQ ID NO: 668113 - RNA, 22 nt, Human
ucaggcagaugcagggauggau

SEQ ID NO: 668114 - RNA, 20 nt, Human
auacaaucaugaggaaaaag

SEQ ID NO: 668115 - RNA, 22 nt, Human
gccaggaugacuauacaacagc

SEQ ID NO: 668116 - RNA, 22 nt, Human
uugaagcauuucuuugagcuuc

SEQ ID NO: 668117 - RNA, 22 nt, Human
guuuagaugagauuuuagaaca

SEQ ID NO: 668118 - RNA, 22 nt, Human
acaucacaguaguuaagccaga

SEQ ID NO: 668119 - RNA, 22 nt, Human
cagcccacuucccagcaccuac

SEQ ID NO: 668120 - RNA, 22 nt, Human
cuucuaauucuuauguaagcuu

SEQ ID NO: 668121 - RNA, 22 nt, Human
gccagguucuggggagguacaa

SEQ ID NO: 668122 - RNA, 22 nt, Human
aauugcuuagagaauccaggua

SEQ ID NO: 668123 - RNA, 22 nt, Human
cacagcagcguuccuccgugug

SEQ ID NO: 668124 - RNA, 22 nt, Human
uucugcaaucgcucugaccauu

SEQ ID NO: 668125 - RNA, 22 nt, Human
agaaaggguucucugaggugcu

SEQ ID NO: 668126 - RNA, 22 nt, Human
aaacacuggcaauuucaugcac

SEQ ID NO: 668127 - RNA, 22 nt, Human
uggcaaagugacuccuuggggc

SEQ ID NO: 668128 - RNA, 22 nt, Human
auucauccuuaccaguccccgg

SEQ ID NO: 668129 - RNA, 22 nt, Human
uccugagccccagggagguugg

SEQ ID NO: 668130 - RNA, 17 nt, Human
ccucagcuucuuuccuc

SEQ ID NO: 668131 - RNA, 22 nt, Human
ccucccuggccagagcagcagc

SEQ ID NO: 668132 - RNA, 21 nt, Human
ucagagaauggccuacucuca

SEQ ID NO: 668133 - RNA, 22 nt, Human
gagggccuacuggacaugucag

SEQ ID NO: 668134 - RNA, 22 nt, Human
cugugucucuccuuacaagacu

SEQ ID NO: 668135 - RNA, 22 nt, Human
ugcuuugcucugucucuagcua

SEQ ID NO: 668136 - RNA, 22 nt, Human
ucuggacuccaugcugccugga

SEQ ID NO: 668137 - RNA, 22 nt, Human
aaacugcaugaagcugauuuua

SEQ ID NO: 668138 - RNA, 22 nt, Human
ccuaaguauuuucaguguuaac

SEQ ID NO: 668139 - RNA, 21 nt, Human
aacuacaguuguuccuucauu

SEQ ID NO: 668140 - RNA, 22 nt, Human
uggagagcaggggaugcgggcg

SEQ ID NO: 668141 - RNA, 19 nt, Human
auggcugcugauuggggau

SEQ ID NO: 668142 - RNA, 22 nt, Human
cauaacuggggacacuucucua

SEQ ID NO: 668143 - RNA, 22 nt, Human
guccuguguguugccggcugaa

SEQ ID NO: 668144 - RNA, 22 nt, Human
gaaacacauaugaacaguugau

SEQ ID NO: 668145 - RNA, 22 nt, Human
uccuggcaggucagcaggagca

SEQ ID NO: 668146 - RNA, 22 nt, Human
cucugggcaaguuucuucauga

SEQ ID NO: 668147 - RNA, 22 nt, Human
ugcagggaaagggcacugggcu

SEQ ID NO: 668148 - RNA, 22 nt, Human
agagucugugcuuucaucagga

SEQ ID NO: 668149 - RNA, 22 nt, Human
agccaguuuaagcaggaggggu

SEQ ID NO: 668150 - RNA, 22 nt, Human
uaggcugagcuuguagaucgua

SEQ ID NO: 668151 - RNA, 22 nt, Human
uaucauuguguuugccagucac

SEQ ID NO: 668152 - RNA, 22 nt, Human
auuuagugaccugaacugaaac

SEQ ID NO: 668153 - RNA, 22 nt, Human
agcuaucaguaggaccauguuc

SEQ ID NO: 668154 - RNA, 22 nt, Human
cagcucugggugacaggagggc

SEQ ID NO: 668155 - RNA, 22 nt, Human
agcuggccauugugaguggccu

SEQ ID NO: 668156 - RNA, 22 nt, Human
ggcaaagagacaugcaucgggg

SEQ ID NO: 668157 - RNA, 22 nt, Human
ggcaucguccugggcauaggga

SEQ ID NO: 668158 - RNA, 22 nt, Human
uggcugaguguuccaaggagca

SEQ ID NO: 668159 - RNA, 22 nt, Human
gcucagggaaggccacgugaga

SEQ ID NO: 668160 - RNA, 22 nt, Human
gaauccgugugauguggacuag

SEQ ID NO: 668161 - RNA, 22 nt, Human
ugagagucuguuccucuugcag

SEQ ID NO: 668162 - RNA, 22 nt, Human
uaaagugcaggcuacucagaag

SEQ ID NO: 668163 - RNA, 23 nt, Human
agaauuguuguuagggaaaagua

SEQ ID NO: 668164 - RNA, 22 nt, Human
auaaagucauggcagcuagaau

SEQ ID NO: 668165 - RNA, 22 nt, Human
cugaggagaaagaugguccaag

SEQ ID NO: 668166 - RNA, 22 nt, Human
agucuucagcagccuucucagg

SEQ ID NO: 668167 - RNA, 22 nt, Human
gcucugcuguguuuguucagca

SEQ ID NO: 668168 - RNA, 22 nt, Human
auguuucaccagcaaauuaccu

SEQ ID NO: 668169 - RNA, 23 nt, Human
ggcacagaugcugagcaugugca

SEQ ID NO: 668170 - RNA, 22 nt, Human
uugcaggaaacugagugugagc

SEQ ID NO: 668171 - RNA, 22 nt, Human
uggaaagaggaagugcccagca

SEQ ID NO: 668172 - RNA, 22 nt, Human
agagaaaagaguucaggcuuug

SEQ ID NO: 668173 - RNA, 22 nt, Human
ugcacacaaguuggagaaugaa

SEQ ID NO: 668174 - RNA, 22 nt, Human
auuccacaugaaaggagcugaa

SEQ ID NO: 668175 - RNA, 22 nt, Human
aaugcauacguguuuguggcaa

SEQ ID NO: 668176 - RNA, 22 nt, Human
ugggccugacucaccugccucc

SEQ ID NO: 668177 - RNA, 20 nt, Human
caaugcacacagcugcuucu

SEQ ID NO: 668178 - RNA, 22 nt, Human
agaaauugccagaaugucaggc

SEQ ID NO: 668179 - RNA, 20 nt, Human
ugcuguguggcccagcauga

SEQ ID NO: 668180 - RNA, 22 nt, Human
agaaaaggcuugaagagguuuu

SEQ ID NO: 668181 - RNA, 22 nt, Human
agucccagugacuuggccagaa

SEQ ID NO: 668182 - RNA, 22 nt, Human
gaacccaggcuuuugaggcugu

SEQ ID NO: 668183 - RNA, 20 nt, Human
cagcaacuuuggacugaguu

SEQ ID NO: 668184 - RNA, 22 nt, Human
aaugucuugagaagagaaaucu

SEQ ID NO: 668185 - RNA, 20 nt, Human
ucaucugauuaaccucgaag

SEQ ID NO: 668186 - RNA, 22 nt, Human
uuagcuguggaagcuucagcca

SEQ ID NO: 668187 - RNA, 23 nt, Human
ccacauggcaagaugaugcauuc

SEQ ID NO: 668188 - RNA, 22 nt, Human
cacauauaaccuagacaaggcc

SEQ ID NO: 668189 - RNA, 22 nt, Human
ucuguuggcuuuuuaaaguugu

SEQ ID NO: 668190 - RNA, 22 nt, Human
gugugugcuccccaggagagcu

SEQ ID NO: 668191 - RNA, 22 nt, Human
gcacuguagugggggagaaaug

SEQ ID NO: 668192 - RNA, 22 nt, Human
guagaacucccagugguauugu

SEQ ID NO: 668193 - RNA, 22 nt, Human
ugguaccauuucccaggagugu

SEQ ID NO: 668194 - RNA, 22 nt, Human
ucaggggacuuaggagagaagu

SEQ ID NO: 668195 - RNA, 19 nt, Human
ucucucaauugcuucaauu

SEQ ID NO: 668196 - RNA, 22 nt, Human
gccuugggcacaggcagggccc

SEQ ID NO: 668197 - RNA, 22 nt, Human
cucagaaagugacaggggggug

SEQ ID NO: 668198 - RNA, 22 nt, Human
guaucuguggauuuugguaucc

SEQ ID NO: 668199 - RNA, 22 nt, Human
cuccugggcugucggcgcucug

SEQ ID NO: 668200 - RNA, 22 nt, Human
acuacagaagucuuauuagaga

SEQ ID NO: 668201 - RNA, 22 nt, Human
gugcuucccauuagaacuguga

SEQ ID NO: 668202 - RNA, 22 nt, Human
caucaguguucacuauuccuuc

SEQ ID NO: 668203 - RNA, 22 nt, Human
aaauauaguaaaugcauaguuc

SEQ ID NO: 668204 - RNA, 22 nt, Human
ggagggguggaaggagugccug

SEQ ID NO: 668205 - RNA, 22 nt, Human
ucuaugucuccaccuucgcaga

SEQ ID NO: 668206 - RNA, 22 nt, Human
ggguacuuaauauuuacggggu

SEQ ID NO: 668207 - RNA, 20 nt, Human
ucaagaugaggucauacugg

SEQ ID NO: 668208 - RNA, 22 nt, Human
uagcauuaucugucuuaucauu

SEQ ID NO: 668209 - RNA, 22 nt, Human
gcuccagguauuugcccuuuua

SEQ ID NO: 668210 - RNA, 22 nt, Human
uacauugaaagucauuuaaucc

SEQ ID NO: 668211 - RNA, 22 nt, Human
caauuucaauacaaaauacauu

SEQ ID NO: 668212 - RNA, 22 nt, Human
uucugagaagggugggucuggc

SEQ ID NO: 668213 - RNA, 22 nt, Human
ccuccagcugccucagucucuu

SEQ ID NO: 668214 - RNA, 22 nt, Human
gcaggagcucguuuccaggcug

SEQ ID NO: 668215 - RNA, 22 nt, Human
aggccagcuuccagaggggcag

SEQ ID NO: 668216 - RNA, 22 nt, Human
uugugugucuucuucacugccc

SEQ ID NO: 668217 - RNA, 22 nt, Human
auggaauuuggacuggaagucc

SEQ ID NO: 668218 - RNA, 22 nt, Human
uuacaagacagugugguaaaua

SEQ ID NO: 668219 - RNA, 22 nt, Human
ggagagccugugcagccggguu

SEQ ID NO: 668220 - RNA, 22 nt, Human
ugagccaaggccucaagaauuu

SEQ ID NO: 668221 - RNA, 22 nt, Human
aagaccucugaaguaccuggug

SEQ ID NO: 668222 - RNA, 22 nt, Human
ucccuggacaacagacuucacu

SEQ ID NO: 668223 - RNA, 22 nt, Human
ggaggggcugagcaacuuucag

SEQ ID NO: 668224 - RNA, 22 nt, Human
gcagggucugaggccacagagg

SEQ ID NO: 668225 - RNA, 22 nt, Human
gcaggaccaggcacgagggcca

SEQ ID NO: 668226 - RNA, 22 nt, Human
auccaugaagguacuucucagg

SEQ ID NO: 668227 - RNA, 22 nt, Human
uuaaagaguuuauuacuuguaa

SEQ ID NO: 668228 - RNA, 22 nt, Human
ccuuggcugaggagggagcuga

SEQ ID NO: 668229 - RNA, 22 nt, Human
uuucucucagccuguagaaacu

SEQ ID NO: 668230 - RNA, 22 nt, Human
cauccugcggggagcagagggc

SEQ ID NO: 668231 - RNA, 22 nt, Human
ucugggcuuuaguuuguuaucu

SEQ ID NO: 668232 - RNA, 22 nt, Human
gggguggauuucaggcgguguc

SEQ ID NO: 668233 - RNA, 22 nt, Human
caggccuccuaugagcacuagc

SEQ ID NO: 668234 - RNA, 18 nt, Human
uacuguggaucagggguu

SEQ ID NO: 668235 - RNA, 22 nt, Human
gugucaugcacacucaguguug

SEQ ID NO: 668236 - RNA, 22 nt, Human
ucugcugccaugcagagcagua

SEQ ID NO: 668237 - RNA, 22 nt, Human
uuucacaugguacugccuguuu

SEQ ID NO: 668238 - RNA, 22 nt, Human
uauuccagaugaaaucauucag

SEQ ID NO: 668239 - RNA, 22 nt, Human
cagcugugauaugccugccuga

SEQ ID NO: 668240 - RNA, 22 nt, Human
uucuuuuaauagagauccugug

SEQ ID NO: 668241 - RNA, 22 nt, Human
uuugguuugccugaguacccuc

SEQ ID NO: 668242 - RNA, 22 nt, Human
gugccugguauguagguagcgg

SEQ ID NO: 668243 - RNA, 22 nt, Human
gaaggcuguuucugguagugau

SEQ ID NO: 668244 - RNA, 22 nt, Human
uggagucacuuccauaugggaa

SEQ ID NO: 668245 - RNA, 22 nt, Human
ucuggagcuugaagcuuugguu

SEQ ID NO: 668246 - RNA, 22 nt, Human
ccaggcugugguuuagauagag

SEQ ID NO: 668247 - RNA, 22 nt, Human
cugccugcugcccuccagagcc

SEQ ID NO: 668248 - RNA, 22 nt, Human
ccagcaagugcagauggccaag

SEQ ID NO: 668249 - RNA, 22 nt, Human
uucucaggaacucagugucagc

SEQ ID NO: 668250 - RNA, 22 nt, Human
acagugaaugcccaagaaaagu

SEQ ID NO: 668251 - RNA, 22 nt, Human
ucccucuaaacuguaagauucu

SEQ ID NO: 668252 - RNA, 22 nt, Human
acagauuuuaaaugacacuccc

SEQ ID NO: 668253 - RNA, 22 nt, Human
cuggguguucacccgaggcgcu

SEQ ID NO: 668254 - RNA, 22 nt, Human
cagucccaguuugagacucugg

SEQ ID NO: 668255 - RNA, 22 nt, Human
gagagcaauggggacgggcagg

SEQ ID NO: 668256 - RNA, 22 nt, Human
ugacauucuguuaagucucaua

SEQ ID NO: 668257 - RNA, 22 nt, Human
ugagauaguauguagcaccuga

SEQ ID NO: 668258 - RNA, 22 nt, Human
ggcccaaggcccaggucgagcu

SEQ ID NO: 668259 - RNA, 22 nt, Human
ucuccugcucagaacagccuca

SEQ ID NO: 668260 - RNA, 22 nt, Human
gaaucucaaauuaagaauuuua

SEQ ID NO: 668261 - RNA, 22 nt, Human
gccuggaguuguggugaagcca

SEQ ID NO: 668262 - RNA, 22 nt, Human
gcagagcugggucuguauccaa

SEQ ID NO: 668263 - RNA, 22 nt, Human
uaagguuuguggggagcaaaag

SEQ ID NO: 668264 - RNA, 22 nt, Human
gccaggcuccaggcccuccuga

SEQ ID NO: 668265 - RNA, 22 nt, Human
cagacaucacacucagauugca

SEQ ID NO: 668266 - RNA, 22 nt, Human
aaaguuuucugccuucauuaga

SEQ ID NO: 668267 - RNA, 22 nt, Human
ccaguuuauaagaaagaaaacc

SEQ ID NO: 668268 - RNA, 22 nt, Human
auacuguaauaccuaaaugaac

SEQ ID NO: 668269 - RNA, 22 nt, Human
ucacagaacaagccugguggag

SEQ ID NO: 668270 - RNA, 22 nt, Human
aggaaacuaacuuaucuuuaua

SEQ ID NO: 668271 - RNA, 22 nt, Human
ucaugcagcuuuuccauucagc

SEQ ID NO: 668272 - RNA, 20 nt, Human
uccuccagaagggcagggug

SEQ ID NO: 668273 - RNA, 22 nt, Human
auuugucuuuggaccugugaga

SEQ ID NO: 668274 - RNA, 22 nt, Human
ccugggagagcugcccggguga

SEQ ID NO: 668275 - RNA, 22 nt, Human
aaugucuacaccguauguuguu

SEQ ID NO: 668276 - RNA, 22 nt, Human
cuuugcauacaauuuuuagaaa

SEQ ID NO: 668277 - RNA, 22 nt, Human
ccuuggcuggaauuacucuggg

SEQ ID NO: 668278 - RNA, 22 nt, Human
ugcagcugggucugcccuggcu

SEQ ID NO: 668279 - RNA, 22 nt, Human
gagccuggacaucucaggccca

SEQ ID NO: 668280 - RNA, 22 nt, Human
ucuugcaugauauucuguauuu

SEQ ID NO: 668281 - RNA, 22 nt, Human
caggcagaaaguauucugugua

SEQ ID NO: 668282 - RNA, 22 nt, Human
cacuacagaaucaaauacgggc

SEQ ID NO: 668283 - RNA, 22 nt, Human
auuaaagcuauccagucaugaa

SEQ ID NO: 668284 - RNA, 22 nt, Human
gucagcaugagcaagggcugac

SEQ ID NO: 668285 - RNA, 22 nt, Human
gccgugggugucauggcccaua

SEQ ID NO: 668286 - RNA, 22 nt, Human
augaugcaccauuauaagaguu

SEQ ID NO: 668287 - RNA, 20 nt, Human
gucgaaaaagauaaacaggc

SEQ ID NO: 668288 - RNA, 22 nt, Human
agaacuguccuuggaggagagu

SEQ ID NO: 668289 - RNA, 22 nt, Human
cccacagguccccaugaacucg

SEQ ID NO: 668290 - RNA, 22 nt, Human
gcagccagugggaugagaaaga

SEQ ID NO: 668291 - RNA, 22 nt, Human
aaaugcuuuggugcugguacag

SEQ ID NO: 668292 - RNA, 22 nt, Human
uccagagcagguggucagaagg

SEQ ID NO: 668293 - RNA, 22 nt, Human
guguuuuaucagacaaaguaua

SEQ ID NO: 668294 - RNA, 22 nt, Human
gcaaagggaaaguggcaggguc

SEQ ID NO: 668295 - RNA, 22 nt, Human
guaaaacugucuaaugguauau

SEQ ID NO: 668296 - RNA, 22 nt, Human
aagcaccucuaugauugcuuuu

SEQ ID NO: 668297 - RNA, 22 nt, Human
gccagagcaucgcacccuccau

SEQ ID NO: 668298 - RNA, 22 nt, Human
uuccuggccaagcagaguggaa

SEQ ID NO: 668299 - RNA, 22 nt, Human
cucuucagguuucugcucugga

SEQ ID NO: 668300 - RNA, 22 nt, Human
ccguggaguugugcugaguaug

SEQ ID NO: 668301 - RNA, 22 nt, Human
ggcccaggaugcaagaacugaa

SEQ ID NO: 668302 - RNA, 22 nt, Human
caguccugggugcagcaggaaa

SEQ ID NO: 668303 - RNA, 22 nt, Human
auucucuggguuccaguaaaug

SEQ ID NO: 668304 - RNA, 22 nt, Human
ggcuccaggugcaugccaggcu

SEQ ID NO: 668305 - RNA, 22 nt, Human
agcugcuuauaagauuugggag

SEQ ID NO: 668306 - RNA, 23 nt, Human
ucaaacuguuauauugccagagu

SEQ ID NO: 668307 - RNA, 22 nt, Human
uugggcagaggcugugcagagg

SEQ ID NO: 668308 - RNA, 22 nt, Human
agaguagccucauagacacuca

SEQ ID NO: 668309 - RNA, 22 nt, Human
ggaggacucaggucuggccaug

SEQ ID NO: 668310 - RNA, 22 nt, Human
aagcccugaccugagaguccgu

SEQ ID NO: 668311 - RNA, 22 nt, Human
uagcuucccuagcuaaagaggu

SEQ ID NO: 668312 - RNA, 22 nt, Human
uacaggaagucucaguacagua

SEQ ID NO: 668313 - RNA, 22 nt, Human
agaaaucaugucuuauuucuau

SEQ ID NO: 668314 - RNA, 22 nt, Human
augacagaggauuguaaagagg

SEQ ID NO: 668315 - RNA, 22 nt, Human
gcuucugaugucagacuucugg

SEQ ID NO: 668316 - RNA, 22 nt, Human
aguccaggcggguauagaggcu

SEQ ID NO: 668317 - RNA, 22 nt, Human
ugcaggugucucugucuagcgu

SEQ ID NO: 668318 - RNA, 22 nt, Human
aagagguuucaugauuuucuua

SEQ ID NO: 668319 - RNA, 22 nt, Human
uauuuauucuuuguacugccuu

SEQ ID NO: 668320 - RNA, 22 nt, Human
uccuuguaaaggagcucuaaca

SEQ ID NO: 668321 - RNA, 22 nt, Human
auacaagugagaaaacugaaga

SEQ ID NO: 668322 - RNA, 22 nt, Human
aagcccugagcacugcagagaa

SEQ ID NO: 668323 - RNA, 21 nt, Human
cuaagcaaggagcagggguag

SEQ ID NO: 668324 - RNA, 22 nt, Human
aguccaagaucaaggugucagg

SEQ ID NO: 668325 - RNA, 22 nt, Human
uuugucauguccuuaacugucu

SEQ ID NO: 668326 - RNA, 22 nt, Human
acaaaugaaccugaaaucucag

SEQ ID NO: 668327 - RNA, 22 nt, Human
aaucacauuagugaaacacuga

SEQ ID NO: 668328 - RNA, 23 nt, Human
uaacucugugaagggugacuggg

SEQ ID NO: 668329 - RNA, 22 nt, Human
cugcuuggcuuauaaccucagg

SEQ ID NO: 668330 - RNA, 22 nt, Human
agcuauagcuggaucuuaagug

SEQ ID NO: 668331 - RNA, 22 nt, Human
cuacaagauuuuuaaaacugua

SEQ ID NO: 668332 - RNA, 22 nt, Human
aaugcuuugacuauaucuauaa

SEQ ID NO: 668333 - RNA, 22 nt, Human
ugugugugcaggagagcaggug

SEQ ID NO: 668334 - RNA, 22 nt, Human
aaaggaagauugagcuuuucca

SEQ ID NO: 668335 - RNA, 22 nt, Human
aguuccaaagccuguauucuua

SEQ ID NO: 668336 - RNA, 22 nt, Human
auuugccuugugauuuguaagu

SEQ ID NO: 668337 - RNA, 19 nt, Human
ccugaguugggugaagaga

SEQ ID NO: 668338 - RNA, 22 nt, Human
aaaccacuccugauucacuuca

SEQ ID NO: 668339 - RNA, 22 nt, Human
ucaagcaacugaauucuaaaag

SEQ ID NO: 668340 - RNA, 22 nt, Human
uuacaaagagugccagagugug

SEQ ID NO: 668341 - RNA, 22 nt, Human
gagaaaaucuugggucaagaau

SEQ ID NO: 668342 - RNA, 22 nt, Human
ggcagcaggagccaucugguag

SEQ ID NO: 668343 - RNA, 23 nt, Human
gagagcccauuggcagggguacc

SEQ ID NO: 668344 - RNA, 22 nt, Human
gaaaaaugcuccaaaucugugg

SEQ ID NO: 668345 - RNA, 22 nt, Human
acaggaacagcuugauggcauc

SEQ ID NO: 668346 - RNA, 22 nt, Human
cugggccuggggcuguugagag

SEQ ID NO: 668347 - RNA, 22 nt, Human
cugaggccuggccccaccacag

SEQ ID NO: 668348 - RNA, 22 nt, Human
agcacagugcucuggacagagu

SEQ ID NO: 668349 - RNA, 22 nt, Human
agacacagucugucuggaggag

SEQ ID NO: 668350 - RNA, 22 nt, Human
cuguuaaaauguggucuuaaaa

SEQ ID NO: 668351 - RNA, 22 nt, Human
ugucauuuaauagauaugaugg

SEQ ID NO: 668352 - RNA, 22 nt, Human
ucugagcaccuuauauucuuga

SEQ ID NO: 668353 - RNA, 22 nt, Human
gaaggggaaaguugagcaaaua

SEQ ID NO: 668354 - RNA, 22 nt, Human
cugggggucgcgccucugggca

SEQ ID NO: 668355 - RNA, 22 nt, Human
uagagaaauaagcuuugccuug

SEQ ID NO: 668356 - RNA, 22 nt, Human
aauccaauccuacucagaaagu

SEQ ID NO: 668357 - RNA, 18 nt, Human
ucacagaauauugagugg

SEQ ID NO: 668358 - RNA, 22 nt, Human
gaaccucuaguuuguucuuuga

SEQ ID NO: 668359 - RNA, 22 nt, Human
ucuggcucggauuugucuagca

SEQ ID NO: 668360 - RNA, 22 nt, Human
cuguaugaaauugucauuuuua

SEQ ID NO: 668361 - RNA, 22 nt, Human
uacaaagcuguauagccugguc

SEQ ID NO: 668362 - RNA, 22 nt, Human
aggagcuagccaggcauaugca

SEQ ID NO: 668363 - RNA, 22 nt, Human
auacaguaaccacauucuauag

SEQ ID NO: 668364 - RNA, 22 nt, Human
ucagauuugaugugguuuucua

SEQ ID NO: 668365 - RNA, 22 nt, Human
ugaaauacugagugaaagaauu

SEQ ID NO: 668366 - RNA, 22 nt, Human
gugugucuugaccaggaucgga

SEQ ID NO: 668367 - RNA, 22 nt, Human
cagaaggcuuuguggaguagac

SEQ ID NO: 668368 - RNA, 22 nt, Human
uuccucuggaggcucuaggaga

SEQ ID NO: 668369 - RNA, 22 nt, Human
ugcaaacaggagaguaaguaua

SEQ ID NO: 668370 - RNA, 22 nt, Human
cacugaggcugggggagaaggu

SEQ ID NO: 668371 - RNA, 22 nt, Human
ccuggggagagaaagcccagcc

SEQ ID NO: 668372 - RNA, 22 nt, Human
ggaggugcugaucccagucaac

SEQ ID NO: 668373 - RNA, 22 nt, Human
caugucugaguagagugugauu

SEQ ID NO: 668374 - RNA, 22 nt, Human
cuccagaggaaagcacauagug

SEQ ID NO: 668375 - RNA, 22 nt, Human
acugggcugccugguucuucua

SEQ ID NO: 668376 - RNA, 22 nt, Human
agggcagcagcggcccaggccu

SEQ ID NO: 668377 - RNA, 22 nt, Human
cugcugcaaucuggcuuccaug

SEQ ID NO: 668378 - RNA, 22 nt, Human
ccacuguaaguuugaaaauaac

SEQ ID NO: 668379 - RNA, 18 nt, Human
uucaggucagaaagaugg

SEQ ID NO: 668380 - RNA, 22 nt, Human
aagaggaacugggggcugaguc

SEQ ID NO: 668381 - RNA, 22 nt, Human
guacauauuacagacaaagcuu

SEQ ID NO: 668382 - RNA, 22 nt, Human
agguucucacacgucuacaccc

SEQ ID NO: 668383 - RNA, 20 nt, Human
cuccaggggaagagccuucc

SEQ ID NO: 668384 - RNA, 22 nt, Human
gcagcagcucugaaugggcccc

SEQ ID NO: 668385 - RNA, 20 nt, Human
ucccugccuuuuacugcugg

SEQ ID NO: 668386 - RNA, 22 nt, Human
cuggcucuuucagccgcuggag

SEQ ID NO: 668387 - RNA, 20 nt, Human
cucuggcuccgcgugaccgc

SEQ ID NO: 668388 - RNA, 22 nt, Human
aagucucugacucacacaaugu

SEQ ID NO: 668389 - RNA, 22 nt, Human
auauucuugaagggagauuaua

SEQ ID NO: 668390 - RNA, 22 nt, Human
gagcagggagacaacucuggug

SEQ ID NO: 668391 - RNA, 22 nt, Human
gaccacagauuccuaaguggca

SEQ ID NO: 668392 - RNA, 22 nt, Human
aagaauaaguagaugggagaag

SEQ ID NO: 668393 - RNA, 22 nt, Human
cgcccuccacacagccccuggc

SEQ ID NO: 668394 - RNA, 22 nt, Human
ucugggcuugccugguugugca

SEQ ID NO: 668395 - RNA, 22 nt, Human
uucuaaucccagcucuacuacu

SEQ ID NO: 668396 - RNA, 22 nt, Human
guuauuuucauuggcucagacu

SEQ ID NO: 668397 - RNA, 20 nt, Human
gagauccucaucuguaaagu

SEQ ID NO: 668398 - RNA, 22 nt, Human
ucuucaugaaugaaucuuugac

SEQ ID NO: 668399 - RNA, 22 nt, Human
acaguaacucuuuuacccuccu

SEQ ID NO: 668400 - RNA, 22 nt, Human
cuuuauguccuugaagaguugu

SEQ ID NO: 668401 - RNA, 22 nt, Human
augucuuugccauaguucauau

SEQ ID NO: 668402 - RNA, 22 nt, Human
ucgaacucauagucguagcugu

SEQ ID NO: 668403 - RNA, 22 nt, Human
cuggcacauuguaauauauaca

SEQ ID NO: 668404 - RNA, 22 nt, Human
ugcugaguauuuguuugaauaa

SEQ ID NO: 668405 - RNA, 22 nt, Human
gaugaggucuacauuguuaaaa

SEQ ID NO: 668406 - RNA, 22 nt, Human
gcugccucccccauggcuggaa

SEQ ID NO: 668407 - RNA, 22 nt, Human
ccaacacagauguguuaguguu

SEQ ID NO: 668408 - RNA, 22 nt, Human
cacaggaaucagcauuaauggc

SEQ ID NO: 668409 - RNA, 22 nt, Human
ucagcuuucuauguugcuaaac

SEQ ID NO: 668410 - RNA, 22 nt, Human
caggcagagcaacugguccaga

SEQ ID NO: 668411 - RNA, 22 nt, Human
aauuauggaauuuuuagagaag

SEQ ID NO: 668412 - RNA, 22 nt, Human
uagaaauguaggcuuccugaca

SEQ ID NO: 668413 - RNA, 22 nt, Human
ugacccaucaggccacaugagg

SEQ ID NO: 668414 - RNA, 22 nt, Human
ucagacccaggugccaagcugu

SEQ ID NO: 668415 - RNA, 22 nt, Human
cucauuagacagguauacuuua

SEQ ID NO: 668416 - RNA, 22 nt, Human
aaucacauagccaucucuuuga

SEQ ID NO: 668417 - RNA, 22 nt, Human
ucaggcuggggugcuaaggugu

SEQ ID NO: 668418 - RNA, 22 nt, Human
acagauguaccuuagugauggg

SEQ ID NO: 668419 - RNA, 22 nt, Human
gaauagcuuagauuccuuagug

SEQ ID NO: 668420 - RNA, 21 nt, Human
agugaaaugaaguguaugcuc

SEQ ID NO: 668421 - RNA, 22 nt, Human
ggagccagggaagcugcuuccu

SEQ ID NO: 668422 - RNA, 22 nt, Human
gcuagagaccagaggccuugaa

SEQ ID NO: 668423 - RNA, 22 nt, Human
caucaugccccgcuacagugca

SEQ ID NO: 668424 - RNA, 22 nt, Human
ucuacagucaaguuauauugcu

SEQ ID NO: 668425 - RNA, 22 nt, Human
cucugggcccacuuaaaucugg

SEQ ID NO: 668426 - RNA, 22 nt, Human
auucuuucauauaaaggcucag

SEQ ID NO: 668427 - RNA, 22 nt, Human
aaucuggcauguaagcuuagag

SEQ ID NO: 668428 - RNA, 22 nt, Human
ugagccaguucuucagauccau

SEQ ID NO: 668429 - RNA, 22 nt, Human
ugggcaggauaauaucucaugu

SEQ ID NO: 668430 - RNA, 22 nt, Human
ggugagggaguggaacgaggug

SEQ ID NO: 668431 - RNA, 22 nt, Human
uucagcacuggacagcgagucu

SEQ ID NO: 668432 - RNA, 22 nt, Human
auucaguaggugugaacuuauu

SEQ ID NO: 668433 - RNA, 22 nt, Human
cugcuugccuggacagcguuag

SEQ ID NO: 668434 - RNA, 22 nt, Human
uauuauugaaucaguucuuuga

SEQ ID NO: 668435 - RNA, 22 nt, Human
acaugccuccauugagcugugg

SEQ ID NO: 668436 - RNA, 22 nt, Human
ucacaaaucgaagccuuauaau

SEQ ID NO: 668437 - RNA, 22 nt, Human
ucggagaguuggaaguagcaga

SEQ ID NO: 668438 - RNA, 22 nt, Human
agaagcguuccauuugaugggu

SEQ ID NO: 668439 - RNA, 22 nt, Human
aaggagaagucuguugagauug

SEQ ID NO: 668440 - RNA, 22 nt, Human
cagguagguauggugcagucuu

SEQ ID NO: 668441 - RNA, 22 nt, Human
ucaggaaagaguaauguauaca

SEQ ID NO: 668442 - RNA, 22 nt, Human
ucauuuguacuugugugcuugu

SEQ ID NO: 668443 - RNA, 22 nt, Human
gcagaagcuguucgaaggccgc

SEQ ID NO: 668444 - RNA, 22 nt, Human
uggagacugauaaaggcuauug

SEQ ID NO: 668445 - RNA, 22 nt, Human
uuucagaguugucuucuugacc

SEQ ID NO: 668446 - RNA, 22 nt, Human
ugggcugccggcaggcucugcc

SEQ ID NO: 668447 - RNA, 22 nt, Human
ugcacauggcaaugcugcuccc

SEQ ID NO: 668448 - RNA, 22 nt, Human
caccuucagaaugcuccaggca

SEQ ID NO: 668449 - RNA, 22 nt, Human
agggaagagcuugcaagaaacc

SEQ ID NO: 668450 - RNA, 22 nt, Human
gccugcagcugcuuccacacac

SEQ ID NO: 668451 - RNA, 21 nt, Human
uucaguuucuuccucaucuau

SEQ ID NO: 668452 - RNA, 22 nt, Human
agcucuuccugcaccuguggcu

SEQ ID NO: 668453 - RNA, 22 nt, Human
uucauugaguauagggguauac

SEQ ID NO: 668454 - RNA, 22 nt, Human
cuaggaaaugaauacaguacac

SEQ ID NO: 668455 - RNA, 20 nt, Human
aagcugucagagguggacag

SEQ ID NO: 668456 - RNA, 22 nt, Human
uuauuccaguaaucucuguaau

SEQ ID NO: 668457 - RNA, 22 nt, Human
aaccuuccugaggaaagucuaa

SEQ ID NO: 668458 - RNA, 22 nt, Human
agcagcugaaaggcaaacuucu

SEQ ID NO: 668459 - RNA, 22 nt, Human
uggcugaaggaagauucuucua

SEQ ID NO: 668460 - RNA, 22 nt, Human
auauaucaugaguaaaacuuga

SEQ ID NO: 668461 - RNA, 23 nt, Human
gggaaguggggauuugaagucau

SEQ ID NO: 668462 - RNA, 23 nt, Human
aaacuacauuuauaguuuuucuc

SEQ ID NO: 668463 - RNA, 22 nt, Human
ugggugaguggagggcauucua

SEQ ID NO: 668464 - RNA, 22 nt, Human
ccagcuucucucugaugcagcu

SEQ ID NO: 668465 - RNA, 22 nt, Human
uccaugcaaacaguggcuagcu

SEQ ID NO: 668466 - RNA, 22 nt, Human
uuggcucuggaacuauuucuga

SEQ ID NO: 668467 - RNA, 22 nt, Human
ggagcccugcugacaugggugu

SEQ ID NO: 668468 - RNA, 22 nt, Human
cagaguguugaccauaagccca

SEQ ID NO: 668469 - RNA, 22 nt, Human
gcugcccucucuggccccacac

SEQ ID NO: 668470 - RNA, 22 nt, Human
cuccagggaggucugcaggacu

SEQ ID NO: 668471 - RNA, 22 nt, Human
cagcuggcccuuugguagccuu

SEQ ID NO: 668472 - RNA, 20 nt, Human
ugcaguguggaagacugaga

SEQ ID NO: 668473 - RNA, 22 nt, Human
aagaauguggguggauaugaug

SEQ ID NO: 668474 - RNA, 22 nt, Human
aacccaggaggcagaggcugca

SEQ ID NO: 668475 - RNA, 22 nt, Human
aguguuuuggagugggaaggca

SEQ ID NO: 668476 - RNA, 22 nt, Human
agccagagcugaugucauucuc

SEQ ID NO: 668477 - RNA, 22 nt, Human
gcucaggaaggcucaaccagga

SEQ ID NO: 668478 - RNA, 22 nt, Human
acaguggauauauuaaaugaga

SEQ ID NO: 668479 - RNA, 22 nt, Human
uauggguagagauggggguuag

SEQ ID NO: 668480 - RNA, 22 nt, Human
cagcucuguugccaaagugggc

SEQ ID NO: 668481 - RNA, 22 nt, Human
uuccaaaggaauggggagcuau

SEQ ID NO: 668482 - RNA, 22 nt, Human
caaauacuacgauucuugcagu

SEQ ID NO: 668483 - RNA, 22 nt, Human
ucccagaguauuagcaauugcu

SEQ ID NO: 668484 - RNA, 22 nt, Human
aucugggcagggcagcaaggcg

SEQ ID NO: 668485 - RNA, 22 nt, Human
ugugugaagcacauguucaagg

SEQ ID NO: 668486 - RNA, 22 nt, Human
guggaaauuuuaggaucaucuu

SEQ ID NO: 668487 - RNA, 22 nt, Human
ugugaaaucugaugaauugacc

SEQ ID NO: 668488 - RNA, 22 nt, Human
ucacaucaacauuauagcauga

SEQ ID NO: 668489 - RNA, 21 nt, Human
gagugucuaauccaggcuguc

SEQ ID NO: 668490 - RNA, 22 nt, Human
ggcucaggggccaggccugucc

SEQ ID NO: 668491 - RNA, 22 nt, Human
auacuuuaacguggcgaaccuu

SEQ ID NO: 668492 - RNA, 22 nt, Human
cuuuugauggaguucaagaagc

SEQ ID NO: 668493 - RNA, 22 nt, Human
aaggaucaaguggauuuucuua

SEQ ID NO: 668494 - RNA, 22 nt, Human
aauucugcauaagguggcucug

SEQ ID NO: 668495 - RNA, 22 nt, Human
ccugccugggcucacuugccag

SEQ ID NO: 668496 - RNA, 22 nt, Human
ucaugggguuuggcuggauguc

SEQ ID NO: 668497 - RNA, 22 nt, Human
cauaaucccaggcuugcauuca

SEQ ID NO: 668498 - RNA, 22 nt, Human
ucauuauuuuggacuggagugu

SEQ ID NO: 668499 - RNA, 22 nt, Human
uauuacagggcuaguuaugagu

SEQ ID NO: 668500 - RNA, 22 nt, Human
auuucaaguguugagcucauaa

SEQ ID NO: 668501 - RNA, 22 nt, Human
agugcauugcaucucugcuuca

SEQ ID NO: 668502 - RNA, 22 nt, Human
auguguauccaucugucuauuu

SEQ ID NO: 668503 - RNA, 22 nt, Human
cagagcacccaaggagcauuug

SEQ ID NO: 668504 - RNA, 22 nt, Human
aagcagcaaguuuauuucuauc

SEQ ID NO: 668505 - RNA, 22 nt, Human
ucuaaugaaagauguaggaacu

SEQ ID NO: 668506 - RNA, 22 nt, Human
ucccugggagaugaugaugagg

SEQ ID NO: 668507 - RNA, 22 nt, Human
uucugccuggcaggaggacugu

SEQ ID NO: 668508 - RNA, 22 nt, Human
aaacagaguuugguaaauagcc

SEQ ID NO: 668509 - RNA, 22 nt, Human
uucaggauggcggauguugggg

SEQ ID NO: 668510 - RNA, 22 nt, Human
aagauauaauaacuguugucau

SEQ ID NO: 668511 - RNA, 22 nt, Human
gagucacaaaagaugcccaggg

SEQ ID NO: 668512 - RNA, 22 nt, Human
uccaggcccugggaugggagca

SEQ ID NO: 668513 - RNA, 22 nt, Human
caugggcuugcucucugagcuc

SEQ ID NO: 668514 - RNA, 22 nt, Human
ggcucacaaaauguugcuuaau

SEQ ID NO: 668515 - RNA, 22 nt, Human
gaagcagaagguuuggacgugc

SEQ ID NO: 668516 - RNA, 22 nt, Human
uugaaugaauuugagcagagau

SEQ ID NO: 668517 - RNA, 22 nt, Human
gccugagaguugaaguucagug

SEQ ID NO: 668518 - RNA, 22 nt, Human
cccaaagggcuuccuguucuca

SEQ ID NO: 668519 - RNA, 22 nt, Human
gacagucccccagcagcaaacc

SEQ ID NO: 668520 - RNA, 22 nt, Human
aggauuuaaucaguuggcauuu

SEQ ID NO: 668521 - RNA, 22 nt, Human
augcccugcugcuggggcagug

SEQ ID NO: 668522 - RNA, 22 nt, Human
cacugcccuggggguugccauc

SEQ ID NO: 668523 - RNA, 22 nt, Human
guccucaggaaggcuuucugac

SEQ ID NO: 668524 - RNA, 22 nt, Human
aggucagaagugccagggaauu

SEQ ID NO: 668525 - RNA, 21 nt, Human
uuugcuucaauuccagaagcu

SEQ ID NO: 668526 - RNA, 22 nt, Human
aguaugaagcugaaugauuuua

SEQ ID NO: 668527 - RNA, 22 nt, Human
ucaaggaagauagcuauuauga

SEQ ID NO: 668528 - RNA, 22 nt, Human
cuaggcacucacguggcuuuag

SEQ ID NO: 668529 - RNA, 22 nt, Human
gcugccucaggcaccuccuggc

SEQ ID NO: 668530 - RNA, 22 nt, Human
aaauuggcaguucagggaauua

SEQ ID NO: 668531 - RNA, 22 nt, Human
auuuacacuaaaggaaggagga

SEQ ID NO: 668532 - RNA, 18 nt, Human
cagaugcuaggccuccag

SEQ ID NO: 668533 - RNA, 22 nt, Human
ugagaaagacagacauuccuaa

SEQ ID NO: 668534 - RNA, 22 nt, Human
acacuguugcuggcacagacag

SEQ ID NO: 668535 - RNA, 22 nt, Human
uuguggaagcccuaugagagac

SEQ ID NO: 668536 - RNA, 22 nt, Human
cuagccaacaccuuauuuucug

SEQ ID NO: 668537 - RNA, 22 nt, Human
gugauaaaauagaaacaguggu

SEQ ID NO: 668538 - RNA, 22 nt, Human
uugaaaugagacuaauugauug

SEQ ID NO: 668539 - RNA, 22 nt, Human
uuuagcaaauauuucuguugau

SEQ ID NO: 668540 - RNA, 22 nt, Human
acugagaacuuggggacagagg

SEQ ID NO: 668541 - RNA, 21 nt, Human
gagcugggcgaggcuccgggg

SEQ ID NO: 668542 - RNA, 22 nt, Human
aguguccucuauuaugacuuua

SEQ ID NO: 668543 - RNA, 22 nt, Human
auugucacuuaaaagugcaugu

SEQ ID NO: 668544 - RNA, 22 nt, Human
uagaucauuugaauugagguag

SEQ ID NO: 668545 - RNA, 22 nt, Human
uucuacacuuuucauuagcuag

SEQ ID NO: 668546 - RNA, 21 nt, Human
ccaaagaacugccauuuguca

SEQ ID NO: 668547 - RNA, 22 nt, Human
aauacuguaugagcuaugguag

SEQ ID NO: 668548 - RNA, 22 nt, Human
ggguguagaaagaacccucugg

SEQ ID NO: 668549 - RNA, 22 nt, Human
agugucugagcuaucauuaggg

SEQ ID NO: 668550 - RNA, 22 nt, Human
cagggccaagcugcagcaucug

SEQ ID NO: 668551 - RNA, 23 nt, Human
cccuggccuuggggcacaggcug

SEQ ID NO: 668552 - RNA, 22 nt, Human
auaugaauuuggcuggaaaggu

SEQ ID NO: 668553 - RNA, 22 nt, Human
auuuuaucugcuuacuuucagg

SEQ ID NO: 668554 - RNA, 22 nt, Human
ucuguccagcucuggggcucac

SEQ ID NO: 668555 - RNA, 23 nt, Human
augacacuccugugcgcacccug

SEQ ID NO: 668556 - RNA, 22 nt, Human
agugaugucuaacuugaucccu

SEQ ID NO: 668557 - RNA, 22 nt, Human
ugccugucucugacugccauua

SEQ ID NO: 668558 - RNA, 22 nt, Human
ggggcuucuuucugccaccgac

SEQ ID NO: 668559 - RNA, 22 nt, Human
ggugaaggucagagcaggaaaa

SEQ ID NO: 668560 - RNA, 20 nt, Human
augcuuaaguguucauuauu

SEQ ID NO: 668561 - RNA, 22 nt, Human
ugcauccuccuuuguccucuug

SEQ ID NO: 668562 - RNA, 22 nt, Human
gaaggccaagaggcuccaagau

SEQ ID NO: 668563 - RNA, 22 nt, Human
auugaagagaagcuaaauagag

SEQ ID NO: 668564 - RNA, 23 nt, Human
uguguucucacacagaugcagua

SEQ ID NO: 668565 - RNA, 18 nt, Human
gggguagaguguccuauu

SEQ ID NO: 668566 - RNA, 22 nt, Human
ugggcauggacuguggagccgc

SEQ ID NO: 668567 - RNA, 22 nt, Human
acaaaugauuuuccaagccagu

SEQ ID NO: 668568 - RNA, 22 nt, Human
aacaggcacuaagcaugugggg

SEQ ID NO: 668569 - RNA, 22 nt, Human
cugcaguagcaccuguggcuuu

SEQ ID NO: 668570 - RNA, 22 nt, Human
guuaaugccuacauauuaagca

SEQ ID NO: 668571 - RNA, 22 nt, Human
auucuagaugcuguaaguagca

SEQ ID NO: 668572 - RNA, 22 nt, Human
gagcuggaggaccaggacuggg

SEQ ID NO: 668573 - RNA, 22 nt, Human
uuggaugagagggugugguaca

SEQ ID NO: 668574 - RNA, 22 nt, Human
ugcccucuaggcuacaguucca

SEQ ID NO: 668575 - RNA, 22 nt, Human
uugggcugaggagggcguggcc

SEQ ID NO: 668576 - RNA, 22 nt, Human
acucagcuaaacucagucuaug

SEQ ID NO: 668577 - RNA, 22 nt, Human
aggagccagcguuccucaggau

SEQ ID NO: 668578 - RNA, 22 nt, Human
aagcugcccaagacugaagcau

SEQ ID NO: 668579 - RNA, 22 nt, Human
uaagaguuagggcuagcaauau

SEQ ID NO: 668580 - RNA, 22 nt, Human
ugucagcucccagucagagaga

SEQ ID NO: 668581 - RNA, 23 nt, Human
uucuaaccuuaaagcccuuugga

SEQ ID NO: 668582 - RNA, 22 nt, Human
uggcagcacaagguggcccaug

SEQ ID NO: 668583 - RNA, 21 nt, Human
ugaaugaggaggauggcauuu

SEQ ID NO: 668584 - RNA, 22 nt, Human
gcagggcauagaggcacggagg

SEQ ID NO: 668585 - RNA, 22 nt, Human
cagcaugaauguguucguaggg

SEQ ID NO: 668586 - RNA, 22 nt, Human
gcagggcaaacccagguguuca

SEQ ID NO: 668587 - RNA, 22 nt, Human
ggcugagacaaccugggaccca

SEQ ID NO: 668588 - RNA, 23 nt, Human
ucaguacucugcuggguauagag

SEQ ID NO: 668589 - RNA, 22 nt, Human
aaagcuauuuguuaugagagaa

SEQ ID NO: 668590 - RNA, 22 nt, Human
aggaagauguguuuagcagguu

SEQ ID NO: 668591 - RNA, 21 nt, Human
uagaaucacuaauaagaugua

SEQ ID NO: 668592 - RNA, 22 nt, Human
ugaggggcgcuggcagguuccu

SEQ ID NO: 668593 - RNA, 22 nt, Human
agaaaggagaccagcucugccc

SEQ ID NO: 668594 - RNA, 22 nt, Human
cuuuucucugcaccauguguga

SEQ ID NO: 668595 - RNA, 22 nt, Human
uggagccagcccaggccccucu

SEQ ID NO: 668596 - RNA, 22 nt, Human
cauaccuuucucaagcacaugu

SEQ ID NO: 668597 - RNA, 22 nt, Human
gucuggaggggagauuuggguu

SEQ ID NO: 668598 - RNA, 22 nt, Human
gaaaucuugcucauugugacaa

SEQ ID NO: 668599 - RNA, 22 nt, Human
cccaaggcauggcaugguggca

SEQ ID NO: 668600 - RNA, 22 nt, Human
acagggucaagggugcuacaag

SEQ ID NO: 668601 - RNA, 22 nt, Human
agacaaauugggacauuguguu

SEQ ID NO: 668602 - RNA, 22 nt, Human
uacagaaagaccucucgggaaa

SEQ ID NO: 668603 - RNA, 22 nt, Human
uaguccauuuucacacugcuga

SEQ ID NO: 668604 - RNA, 22 nt, Human
agucuccacuugacaucagcag

SEQ ID NO: 668605 - RNA, 22 nt, Human
gaggccacagugucugggggcc

SEQ ID NO: 668606 - RNA, 22 nt, Human
cagggucauggcaccugcacgg

SEQ ID NO: 668607 - RNA, 22 nt, Human
uucuucaaccaucuacauaaac

SEQ ID NO: 668608 - RNA, 22 nt, Human
uaagcaaugcuguaguucaguc

SEQ ID NO: 668609 - RNA, 22 nt, Human
accucugcaaugcaaugucaug

SEQ ID NO: 668610 - RNA, 22 nt, Human
ugccauccaacaguuccaucuu

SEQ ID NO: 668611 - RNA, 22 nt, Human
ucaccagggcuccagccagccu

SEQ ID NO: 668612 - RNA, 22 nt, Human
ucaagucuggagaucuggaacu

SEQ ID NO: 668613 - RNA, 22 nt, Human
accccuucuccuggcuguucca

SEQ ID NO: 668614 - RNA, 22 nt, Human
agggaaggaaaagcugucgcuu

SEQ ID NO: 668615 - RNA, 22 nt, Human
ugcugugacagagucucaugga

SEQ ID NO: 668616 - RNA, 22 nt, Human
caguagcaggcacucagcacgu

SEQ ID NO: 668617 - RNA, 22 nt, Human
agggagagaaguuauacaagau

SEQ ID NO: 668618 - RNA, 22 nt, Human
uaggcuguaagagagggcagag

SEQ ID NO: 668619 - RNA, 22 nt, Human
agugaaauaugcccauugcugu

SEQ ID NO: 668620 - RNA, 22 nt, Human
gcacagggagacagccguggcc

SEQ ID NO: 668621 - RNA, 22 nt, Human
ugauaaauccauguaaauggua

SEQ ID NO: 668622 - RNA, 22 nt, Human
cagucccagcugcucagaaggc

SEQ ID NO: 668623 - RNA, 22 nt, Human
ugacagagugacacucuugucu

SEQ ID NO: 668624 - RNA, 22 nt, Human
uuucuuggaugugaaacuaggg

SEQ ID NO: 668625 - RNA, 22 nt, Human
cuuuuccacugagccucacaaa

SEQ ID NO: 668626 - RNA, 22 nt, Human
aauaauacuucguaaaguuguu

SEQ ID NO: 668627 - RNA, 22 nt, Human
ucugagguuaauccugcugcau

SEQ ID NO: 668628 - RNA, 23 nt, Human
gccugggacugguagugugaccu

SEQ ID NO: 668629 - RNA, 22 nt, Human
cagcagcugguugaauccuucu

SEQ ID NO: 668630 - RNA, 22 nt, Human
gucucugccuggggggaucaga

SEQ ID NO: 668631 - RNA, 22 nt, Human
uuagccuuagaagcuuagcaaa

SEQ ID NO: 668632 - RNA, 22 nt, Human
ucauaacagcuaagucccuuuc

SEQ ID NO: 668633 - RNA, 22 nt, Human
auuuuacuuugugaauauugac

SEQ ID NO: 668634 - RNA, 21 nt, Human
ucccugugagcagcucuuccu

SEQ ID NO: 668635 - RNA, 22 nt, Human
uccuugggguaacuccagccug

SEQ ID NO: 668636 - RNA, 22 nt, Human
gcuguauuggaacacauccaug

SEQ ID NO: 668637 - RNA, 22 nt, Human
ugcaugcacguaucugcgugug

SEQ ID NO: 668638 - RNA, 22 nt, Human
agggcuuguggucguggcugug

SEQ ID NO: 668639 - RNA, 22 nt, Human
ccuccuggugggcgcuucuggc

SEQ ID NO: 668640 - RNA, 22 nt, Human
cucucuucccgugaguguugca

SEQ ID NO: 668641 - RNA, 22 nt, Human
auacacauauauacacguuuaa

SEQ ID NO: 668642 - RNA, 22 nt, Human
cccagcagauggcuaugugcua

SEQ ID NO: 668643 - RNA, 22 nt, Human
uuggccagcgacgaccuucuua

SEQ ID NO: 668644 - RNA, 22 nt, Human
ugugacagucguuaggagcuca

SEQ ID NO: 668645 - RNA, 22 nt, Human
uggagcugagaguuaauaagga

SEQ ID NO: 668646 - RNA, 22 nt, Human
cguauuucaucuccuuucugcu

SEQ ID NO: 668647 - RNA, 22 nt, Human
uggggcaguggcuuuucacccu

SEQ ID NO: 668648 - RNA, 22 nt, Human
cugggucuggugucaggcgacg

SEQ ID NO: 668649 - RNA, 22 nt, Human
ucacagcuccagacugcaacuc

SEQ ID NO: 668650 - RNA, 21 nt, Human
cacuggaauuuucugugacau

SEQ ID NO: 668651 - RNA, 21 nt, Human
cacaugugaauuacugaacug

SEQ ID NO: 668652 - RNA, 22 nt, Human
augaauccaaaguuuacuauua

SEQ ID NO: 668653 - RNA, 16 nt, Human
cuucacagaggagagu

SEQ ID NO: 668654 - RNA, 20 nt, Human
cucugcuuuccaccuuucag

SEQ ID NO: 668655 - RNA, 22 nt, Human
uugcuugucuucccuuuaccuc

SEQ ID NO: 668656 - RNA, 22 nt, Human
agauaaugauucugcauuucua

SEQ ID NO: 668657 - RNA, 22 nt, Human
gcucaggacccaggugugaccu

SEQ ID NO: 668658 - RNA, 22 nt, Human
uaacauuaaaagagauaauuga

SEQ ID NO: 668659 - RNA, 22 nt, Human
uauggaaacuaauucauuuuuc

SEQ ID NO: 668660 - RNA, 22 nt, Human
agggaguguaaauggugcucag

SEQ ID NO: 668661 - RNA, 22 nt, Human
agccuggagaagauguguauug

SEQ ID NO: 668662 - RNA, 22 nt, Human
aaaucucagcccuuauuuuaga

SEQ ID NO: 668663 - RNA, 18 nt, Human
uagaagugugcuauacaa

SEQ ID NO: 668664 - RNA, 20 nt, Human
ugccuuuccuguuucaucuu

SEQ ID NO: 668665 - RNA, 22 nt, Human
aagauacauauuuguucuagug

SEQ ID NO: 668666 - RNA, 22 nt, Human
auaagugauauuuagcuauaga

SEQ ID NO: 668667 - RNA, 20 nt, Human
ccaggcuggcaaaugggggc

SEQ ID NO: 668668 - RNA, 22 nt, Human
agggcugcuuugcuaaauaugg

SEQ ID NO: 668669 - RNA, 22 nt, Human
uugagaaaggggucaauaucuc

SEQ ID NO: 668670 - RNA, 22 nt, Human
auuagcagcuuucuggucucua

SEQ ID NO: 668671 - RNA, 22 nt, Human
aagcaagaguuggagugauguu

SEQ ID NO: 668672 - RNA, 22 nt, Human
ugaggugguuacuguggugcuc

SEQ ID NO: 668673 - RNA, 22 nt, Human
ccccuguguuguucaaggguca

SEQ ID NO: 668674 - RNA, 22 nt, Human
uuuaacagaugugaaauuuuca

SEQ ID NO: 668675 - RNA, 14 nt, Human
gcaggcggaucacu

SEQ ID NO: 668676 - RNA, 22 nt, Human
acaauguuuuuguucaaagagu

SEQ ID NO: 668677 - RNA, 19 nt, Human
uccagccccucugugugug

SEQ ID NO: 668678 - RNA, 22 nt, Human
aagagcaggacagaaucagaac

SEQ ID NO: 668679 - RNA, 22 nt, Human
uggaguugcagcuaccagacau

SEQ ID NO: 668680 - RNA, 19 nt, Human
uccuggggaggggcauggc

SEQ ID NO: 668681 - RNA, 22 nt, Human
uuuguguuguacuucugugcau

SEQ ID NO: 668682 - RNA, 22 nt, Human
ucagaugccuguggggucuagg

SEQ ID NO: 668683 - RNA, 22 nt, Human
aauguucaaaagcaucagugaa

SEQ ID NO: 668684 - RNA, 20 nt, Human
ccugugcuuaucacuugcug

SEQ ID NO: 668685 - RNA, 23 nt, Human
cagugugacgaggugaggcaggc

SEQ ID NO: 668686 - RNA, 22 nt, Human
cuggcaggcagacuucugcaag

SEQ ID NO: 668687 - RNA, 22 nt, Human
guagaacuaggacuucagguau

SEQ ID NO: 668688 - RNA, 22 nt, Human
uccacaucaagggcagagaggu

SEQ ID NO: 668689 - RNA, 22 nt, Human
uccugggguccugacugcuucc

SEQ ID NO: 668690 - RNA, 22 nt, Human
aggagccaggccccauggggcu

SEQ ID NO: 668691 - RNA, 22 nt, Human
agauggguaacuggagucugcu

SEQ ID NO: 668692 - RNA, 22 nt, Human
aagcagaggguauggccagguu

SEQ ID NO: 668693 - RNA, 22 nt, Human
aggcuucagccuagagcuggag

SEQ ID NO: 668694 - RNA, 22 nt, Human
aaauguacgggaguagaauuag

SEQ ID NO: 668695 - RNA, 22 nt, Human
caugcuaaaccagaacauagga

SEQ ID NO: 668696 - RNA, 20 nt, Human
uucagaggugaaguuguggu

SEQ ID NO: 668697 - RNA, 22 nt, Human
uccagacugcccugcacaugug

SEQ ID NO: 668698 - RNA, 22 nt, Human
gguggccucucaugcaagguag

SEQ ID NO: 668699 - RNA, 22 nt, Human
augugucugugggcacacacac

SEQ ID NO: 668700 - RNA, 22 nt, Human
gagcugggacuuggaauccaca

SEQ ID NO: 668701 - RNA, 22 nt, Human
uuggaagaaauaucaauagugu

SEQ ID NO: 668702 - RNA, 23 nt, Human
ggccuggcccagggcccugauga

SEQ ID NO: 668703 - RNA, 22 nt, Human
ccagcccugccucucagggccc

SEQ ID NO: 668704 - RNA, 22 nt, Human
accugaaaccaacuuguguacu

SEQ ID NO: 668705 - RNA, 23 nt, Human
ccagggcuacgggcaccguccug

SEQ ID NO: 668706 - RNA, 22 nt, Human
auagaauagcauagaaaauuga

SEQ ID NO: 668707 - RNA, 22 nt, Human
aacuuauugaacauucucgaau

SEQ ID NO: 668708 - RNA, 22 nt, Human
gauauucaaagauuacugauau

SEQ ID NO: 668709 - RNA, 22 nt, Human
ucuucagagugaaagucuguga

SEQ ID NO: 668710 - RNA, 18 nt, Human
ccagcugugcagcaucug

SEQ ID NO: 668711 - RNA, 22 nt, Human
cuggaagguaacaaggccauua

SEQ ID NO: 668712 - RNA, 18 nt, Human
ggcagaugacaggagaga

SEQ ID NO: 668713 - RNA, 22 nt, Human
uucuuaagcaguuuggcauguu

SEQ ID NO: 668714 - RNA, 22 nt, Human
auugcuguaaauuaucuuauua

SEQ ID NO: 668715 - RNA, 22 nt, Human
gaggaggcuggcgccgccugcc

SEQ ID NO: 668716 - RNA, 22 nt, Human
agcucugcaggcacagcugagg

SEQ ID NO: 668717 - RNA, 22 nt, Human
cuuugugaugaggccuaagaca

SEQ ID NO: 668718 - RNA, 22 nt, Human
aguacacacaguagaauagagu

SEQ ID NO: 668719 - RNA, 22 nt, Human
gccagcucagugccaggccccu

SEQ ID NO: 668720 - RNA, 22 nt, Human
cuggaagggucagagugaugag

SEQ ID NO: 668721 - RNA, 22 nt, Human
agccagagaguguuggagaugu

SEQ ID NO: 668722 - RNA, 22 nt, Human
gcauuuuucucuccuauaggag

SEQ ID NO: 668723 - RNA, 22 nt, Human
cugggucuucagcagcaggcgg

SEQ ID NO: 668724 - RNA, 22 nt, Human
cggcaggguugguuuucucuga

SEQ ID NO: 668725 - RNA, 22 nt, Human
ggcucaggacugcagcguagag

SEQ ID NO: 668726 - RNA, 22 nt, Human
aacaucuuguacugcacauuuu

SEQ ID NO: 668727 - RNA, 22 nt, Human
aagcagcuuuugaagagugagg

SEQ ID NO: 668728 - RNA, 22 nt, Human
cuaaacauggcuuagaacacuc

SEQ ID NO: 668729 - RNA, 22 nt, Human
ucccacucccaggcaggccucu

SEQ ID NO: 668730 - RNA, 22 nt, Human
uucugucacagugcugguauca

SEQ ID NO: 668731 - RNA, 22 nt, Human
agcaccuggucuccuggcgcug

SEQ ID NO: 668732 - RNA, 22 nt, Human
agagugucugguagcugcucug

SEQ ID NO: 668733 - RNA, 22 nt, Human
uuuguagcagcaugauuuauaa

SEQ ID NO: 668734 - RNA, 22 nt, Human
aguacacaguagacuuucucau

SEQ ID NO: 668735 - RNA, 22 nt, Human
acccgggaggcaggagucauag

SEQ ID NO: 668736 - RNA, 22 nt, Human
uauggaaagggaguuuaauuug

SEQ ID NO: 668737 - RNA, 22 nt, Human
ugaauaaaucaaagacugcccu

SEQ ID NO: 668738 - RNA, 22 nt, Human
aguggacaaccaugcugagauu

SEQ ID NO: 668739 - RNA, 22 nt, Human
cucugccucagugauuucuuua

SEQ ID NO: 668740 - RNA, 22 nt, Human
guuauugcuggauagauacauc

SEQ ID NO: 668741 - RNA, 22 nt, Human
auuuccaggcuguuuugugaau

SEQ ID NO: 668742 - RNA, 22 nt, Human
ucuaggagcuuaaaggaggcca

SEQ ID NO: 668743 - RNA, 22 nt, Human
cguguacagucuaucuuuuuuc

SEQ ID NO: 668744 - RNA, 22 nt, Human
caggcugauuaggccucgucca

SEQ ID NO: 668745 - RNA, 22 nt, Human
aagacacucauuaucacugguu

SEQ ID NO: 668746 - RNA, 22 nt, Human
uucugcauuuaaaauauuacua

SEQ ID NO: 668747 - RNA, 22 nt, Human
gcagaacauuucacaguaucuu

SEQ ID NO: 668748 - RNA, 22 nt, Human
gaagugaagagauuagaaauca

SEQ ID NO: 668749 - RNA, 22 nt, Human
caggaugcagugggacccaggg

SEQ ID NO: 668750 - RNA, 22 nt, Human
uugaaucuuagcucugccacuu

SEQ ID NO: 668751 - RNA, 22 nt, Human
ugggcucuccuggaggacaaca

SEQ ID NO: 668752 - RNA, 22 nt, Human
uggcuuuauaccuuugccuugg

SEQ ID NO: 668753 - RNA, 22 nt, Human
aggcugagguaggaggaucgcu

SEQ ID NO: 668754 - RNA, 22 nt, Human
ugucugggagggacagggcuac

SEQ ID NO: 668755 - RNA, 22 nt, Human
gagccaggucgggccgcggcga

SEQ ID NO: 668756 - RNA, 22 nt, Human
aaagucauccaaauuuuuaugu

SEQ ID NO: 668757 - RNA, 22 nt, Human
gcuccuggugcaaaguuucuuc

SEQ ID NO: 668758 - RNA, 22 nt, Human
gggcguggauggucagugcagg

SEQ ID NO: 668759 - RNA, 22 nt, Human
agacaaggaauguagcuuacuc

SEQ ID NO: 668760 - RNA, 22 nt, Human
gaggggcacaguaaaggguccc

SEQ ID NO: 668761 - RNA, 22 nt, Human
uauacagauggaaagauacaca

SEQ ID NO: 668762 - RNA, 23 nt, Human
guuaauaaugaacacuuucuccc

SEQ ID NO: 668763 - RNA, 22 nt, Human
cuuuggaaaaauaccuggcaua

SEQ ID NO: 668764 - RNA, 19 nt, Human
ugccagagauacucccaga

SEQ ID NO: 668765 - RNA, 22 nt, Human
ccuuuucuacaagcaaaugugc

SEQ ID NO: 668766 - RNA, 22 nt, Human
ccaaaugugccuguuucaacaa

SEQ ID NO: 668767 - RNA, 22 nt, Human
ccacagaaucgcuaguggagca

SEQ ID NO: 668768 - RNA, 22 nt, Human
ucacuguuagagcaaacguaug

SEQ ID NO: 668769 - RNA, 17 nt, Human
ggccagaggcggggcug

SEQ ID NO: 668770 - RNA, 22 nt, Human
uucuggaaagcauuugaggccc

SEQ ID NO: 668771 - RNA, 22 nt, Human
cauucucuacacuccugcccug

SEQ ID NO: 668772 - RNA, 19 nt, Human
cccaguccuuguccugggc

SEQ ID NO: 668773 - RNA, 22 nt, Human
gucagcaggguccccuugagug

SEQ ID NO: 668774 - RNA, 22 nt, Human
cagugccacaggaauggccaau

SEQ ID NO: 668775 - RNA, 22 nt, Human
gauuacacguuuuuaaucacau

SEQ ID NO: 668776 - RNA, 22 nt, Human
uacagggacauggaacaggcuc

SEQ ID NO: 668777 - RNA, 22 nt, Human
cagggacccgcacagguagcau

SEQ ID NO: 668778 - RNA, 22 nt, Human
cagagaacauucagagcuguag

SEQ ID NO: 668779 - RNA, 22 nt, Human
cagugcaggaagugagaugccu

SEQ ID NO: 668780 - RNA, 22 nt, Human
cugggccacuccagaugcccac

SEQ ID NO: 668781 - RNA, 22 nt, Human
aagugauaccuaggaaaucaag

SEQ ID NO: 668782 - RNA, 22 nt, Human
ucucaaguuuucucauaaucuc

SEQ ID NO: 668783 - RNA, 22 nt, Human
ugcuggguguuccgcacuugac

SEQ ID NO: 668784 - RNA, 22 nt, Human
ucuguuauacaacaaguaacag

SEQ ID NO: 668785 - RNA, 22 nt, Human
cagaggaagcuggguguggagu

SEQ ID NO: 668786 - RNA, 22 nt, Human
guuccuaaaucuggaggaccuc

SEQ ID NO: 668787 - RNA, 22 nt, Human
ggguaggcugcuccuggggccc

SEQ ID NO: 668788 - RNA, 22 nt, Human
uaugcacagaaguuugcugaau

SEQ ID NO: 668789 - RNA, 22 nt, Human
uacaacacugguucgacaugug

SEQ ID NO: 668790 - RNA, 22 nt, Human
ucugucacuuuuauuuacugaa

SEQ ID NO: 668791 - RNA, 22 nt, Human
cuggguguucaggagcugggcu

SEQ ID NO: 668792 - RNA, 22 nt, Human
agcagcuggguccggcggagca

SEQ ID NO: 668793 - RNA, 22 nt, Human
cucugaggucuaggaccauggc

SEQ ID NO: 668794 - RNA, 22 nt, Human
cacagcaggugcuuaaugauua

SEQ ID NO: 668795 - RNA, 22 nt, Human
agaacaucugaagauacaaagu

SEQ ID NO: 668796 - RNA, 18 nt, Human
cagcugugcccuguuugg

SEQ ID NO: 668797 - RNA, 22 nt, Human
augacauaaagcuaugcuaggu

SEQ ID NO: 668798 - RNA, 22 nt, Human
aacaguacuggacaaggaguca

SEQ ID NO: 668799 - RNA, 22 nt, Human
cugcagcugcaguucugagaga

SEQ ID NO: 668800 - RNA, 22 nt, Human
ugccugagggaguaagaguccu

SEQ ID NO: 668801 - RNA, 22 nt, Human
caacaggcuuuauguuuaaagu

SEQ ID NO: 668802 - RNA, 22 nt, Human
cuucugcuggcauacugcccca

SEQ ID NO: 668803 - RNA, 22 nt, Human
aaacucagaagguacagaaggg

SEQ ID NO: 668804 - RNA, 22 nt, Human
cuguggucaccaggcuggggcc

SEQ ID NO: 668805 - RNA, 22 nt, Human
ggccauggcgggagccggcguc

SEQ ID NO: 668806 - RNA, 22 nt, Human
guucuucaucauuuuagauagg

SEQ ID NO: 668807 - RNA, 22 nt, Human
aguucuuugucaucucuggagu

SEQ ID NO: 668808 - RNA, 22 nt, Human
cagggccucucaucccacgggc

SEQ ID NO: 668809 - RNA, 22 nt, Human
guccacugcugugugcuucacc

SEQ ID NO: 668810 - RNA, 22 nt, Human
ccuggcauguccuccuggcaug

SEQ ID NO: 668811 - RNA, 22 nt, Human
uugaacauaaaucacuggucag

SEQ ID NO: 668812 - RNA, 22 nt, Human
cuggcagcagcuucuggaucga

SEQ ID NO: 668813 - RNA, 22 nt, Human
aaauguaccuugauaguuuggu

SEQ ID NO: 668814 - RNA, 22 nt, Human
ucuuguuaaagugaagauacug

SEQ ID NO: 668815 - RNA, 22 nt, Human
acuuuagaccaucuuccacagu

SEQ ID NO: 668816 - RNA, 22 nt, Human
ucuauauuccagauacagauua

SEQ ID NO: 668817 - RNA, 21 nt, Human
ggacacugauaaucuuguugc

SEQ ID NO: 668818 - RNA, 22 nt, Human
gggggccuuauucaucugccag

SEQ ID NO: 668819 - RNA, 22 nt, Human
acugggaagauggaggcaagca

SEQ ID NO: 668820 - RNA, 22 nt, Human
uccuggagaaacucagagaucu

SEQ ID NO: 668821 - RNA, 22 nt, Human
caucuugagacaugaaaggugu

SEQ ID NO: 668822 - RNA, 22 nt, Human
aagugaagaaauacaugagaau

SEQ ID NO: 668823 - RNA, 22 nt, Human
ccuguuuagugaggugaggagu

SEQ ID NO: 668824 - RNA, 22 nt, Human
uagcaaagaggagaccuaggca

SEQ ID NO: 668825 - RNA, 22 nt, Human
uauuuaguuaucuuucauaaaa

SEQ ID NO: 668826 - RNA, 22 nt, Human
uuugggaauuguagcugucuug

SEQ ID NO: 668827 - RNA, 22 nt, Human
aagaagcaggucacagacaggg

SEQ ID NO: 668828 - RNA, 22 nt, Human
aguccagggcuuagucagcggg

SEQ ID NO: 668829 - RNA, 20 nt, Human
ggccuuggguuucgccuguu

SEQ ID NO: 668830 - RNA, 22 nt, Human
ccugggcaaauuauguuacuca

SEQ ID NO: 668831 - RNA, 22 nt, Human
acaugaguacagauggauguaa

SEQ ID NO: 668832 - RNA, 22 nt, Human
gccugagacagugugguccaau

SEQ ID NO: 668833 - RNA, 22 nt, Human
uggaggcccccaggcaacagca

SEQ ID NO: 668834 - RNA, 22 nt, Human
gucaauaauuuuauggagagaa

SEQ ID NO: 668835 - RNA, 22 nt, Human
cagacuugaaagagacucaguu

SEQ ID NO: 668836 - RNA, 22 nt, Human
cuguggcaggugucuggggcag

SEQ ID NO: 668837 - RNA, 22 nt, Human
gcacugccaucaaugcaugaca

SEQ ID NO: 668838 - RNA, 22 nt, Human
gccuggcccagggcuccgcagg

SEQ ID NO: 668839 - RNA, 22 nt, Human
cagagugggcugucagccacca

SEQ ID NO: 668840 - RNA, 22 nt, Human
caucacuuuuaaaggugaucga

SEQ ID NO: 668841 - RNA, 21 nt, Human
ccuggccaaucugauaggguu

SEQ ID NO: 668842 - RNA, 22 nt, Human
cuuccuuggcuucuggggugug

SEQ ID NO: 668843 - RNA, 22 nt, Human
ggagagcagggaggcugcucug

SEQ ID NO: 668844 - RNA, 22 nt, Human
aacacuaaaggucaguuagaag

SEQ ID NO: 668845 - RNA, 22 nt, Human
gccuucccacccugcgaggcug

SEQ ID NO: 668846 - RNA, 22 nt, Human
ucccaguuuuucuccacuaagg

SEQ ID NO: 668847 - RNA, 22 nt, Human
gaaagguuuggcuuuucaguag

SEQ ID NO: 668848 - RNA, 22 nt, Human
cuuucagaagaggaccuuucca

SEQ ID NO: 668849 - RNA, 22 nt, Human
cuggggcugcggacgggagccc

SEQ ID NO: 668850 - RNA, 22 nt, Human
uggaucugacuggcuuuucuuc

SEQ ID NO: 668851 - RNA, 22 nt, Human
gggugggagaaaugaguaucua

SEQ ID NO: 668852 - RNA, 22 nt, Human
cuuacaguguugagggaauuaa

SEQ ID NO: 668853 - RNA, 22 nt, Human
augggaggguggaaaggcucug

SEQ ID NO: 668854 - RNA, 22 nt, Human
ggaaagaccugagauaggaaua

SEQ ID NO: 668855 - RNA, 22 nt, Human
uuuugccugagauccgagucug

SEQ ID NO: 668856 - RNA, 22 nt, Human
uuucagaaauuauauuagaugc

SEQ ID NO: 668857 - RNA, 22 nt, Human
ucuggcucuguguccucaccca

SEQ ID NO: 668858 - RNA, 22 nt, Human
ggcacagaguuggcagagcugc

SEQ ID NO: 668859 - RNA, 22 nt, Human
acuguguccuauuuccuugaca

SEQ ID NO: 668860 - RNA, 22 nt, Human
cucugcugcccaggccugcuag

SEQ ID NO: 668861 - RNA, 22 nt, Human
gcaccugccugggacugaagau

SEQ ID NO: 668862 - RNA, 22 nt, Human
ugccgugucccauugugcucug

SEQ ID NO: 668863 - RNA, 22 nt, Human
aacauuugcaugcuuuauuaga

SEQ ID NO: 668864 - RNA, 22 nt, Human
ccagcucucagcgggagacuca

SEQ ID NO: 668865 - RNA, 22 nt, Human
uugacaguugcaauggugaucu

SEQ ID NO: 668866 - RNA, 22 nt, Human
cauuuguguccgucccaguucu

SEQ ID NO: 668867 - RNA, 22 nt, Human
aaauauacggucccuaacaguc

SEQ ID NO: 668868 - RNA, 22 nt, Human
gcugccaugguccaggcuccag

SEQ ID NO: 668869 - RNA, 17 nt, Human
gagccccuuuccaaguu

SEQ ID NO: 668870 - RNA, 22 nt, Human
gcuacaggagauaaaggccucu

SEQ ID NO: 668871 - RNA, 22 nt, Human
caucuaccuccacccuauauau

SEQ ID NO: 668872 - RNA, 22 nt, Human
guccuguggaaagcuagccgcu

SEQ ID NO: 668873 - RNA, 22 nt, Human
augggagugacagggccacugg

SEQ ID NO: 668874 - RNA, 22 nt, Human
gagagucuagugcaccuaguuu

SEQ ID NO: 668875 - RNA, 22 nt, Human
ccugucuggggacucccugggu

SEQ ID NO: 668876 - RNA, 22 nt, Human
uacaacaugugguccuuuauga

SEQ ID NO: 668877 - RNA, 22 nt, Human
uucauucauuacgugccaggca

SEQ ID NO: 668878 - RNA, 22 nt, Human
ccagaaucaucaucugaagccu

SEQ ID NO: 668879 - RNA, 19 nt, Human
cagcaucugagccgugucc

SEQ ID NO: 668880 - RNA, 22 nt, Human
cugcugccaagggugccacagg

SEQ ID NO: 668881 - RNA, 22 nt, Human
acagagcuguacaugugccaug

SEQ ID NO: 668882 - RNA, 20 nt, Human
ucugggagggacaagucucc

SEQ ID NO: 668883 - RNA, 22 nt, Human
agucaggaaccucagcaagucu

SEQ ID NO: 668884 - RNA, 20 nt, Human
gcuuuaagccaaaaugugaa

SEQ ID NO: 668885 - RNA, 22 nt, Human
uggcauguuuaaauggcaauaa

SEQ ID NO: 668886 - RNA, 20 nt, Human
cccagaagcuuaacagagca

SEQ ID NO: 668887 - RNA, 20 nt, Human
acagaaagagagaaugucag

SEQ ID NO: 668888 - RNA, 22 nt, Human
uugggcugaacccugcagcuga

SEQ ID NO: 668889 - RNA, 22 nt, Human
auccuguuuuagauaagcuuau

SEQ ID NO: 668890 - RNA, 22 nt, Human
cacugcccucacugugguucuc

SEQ ID NO: 668891 - RNA, 22 nt, Human
gccagcuguaggugguggguug

SEQ ID NO: 668892 - RNA, 22 nt, Human
gggaagcugcguggucuagggc

SEQ ID NO: 668893 - RNA, 22 nt, Human
aggaggcagaugcuuggcugua

SEQ ID NO: 668894 - RNA, 20 nt, Human
agucacaugcauacacaagu

SEQ ID NO: 668895 - RNA, 23 nt, Human
auagucugcgcaacugagagagg

SEQ ID NO: 668896 - RNA, 22 nt, Human
ugagaaaaguacauggagaagc

SEQ ID NO: 668897 - RNA, 22 nt, Human
gggcuugcuuaaggucacccgg

SEQ ID NO: 668898 - RNA, 22 nt, Human
cagagcuguuacuauucaugaa

SEQ ID NO: 668899 - RNA, 22 nt, Human
gguggggauuccugaucacugu

SEQ ID NO: 668900 - RNA, 20 nt, Human
auuuuguuuauguuccucuc

SEQ ID NO: 668901 - RNA, 22 nt, Human
caaaauugauuguggugauggu

SEQ ID NO: 668902 - RNA, 22 nt, Human
ucaggccccuugucagcucugu

SEQ ID NO: 668903 - RNA, 22 nt, Human
aacauucuauuuugcuaaaaca

SEQ ID NO: 668904 - RNA, 22 nt, Human
agcaaugcuaccgggugauucg

SEQ ID NO: 668905 - RNA, 22 nt, Human
cuggggaacgcagcgagcagcg

SEQ ID NO: 668906 - RNA, 22 nt, Human
acguuauaucugaaaaaaguga

SEQ ID NO: 668907 - RNA, 16 nt, Human
cuacccagugagaagg

SEQ ID NO: 668908 - RNA, 22 nt, Human
caggcaccacacuaggggcuga

SEQ ID NO: 668909 - RNA, 22 nt, Human
uuauaugauugaagugcauaag

SEQ ID NO: 668910 - RNA, 22 nt, Human
uccugcuucagguagagggggu

SEQ ID NO: 668911 - RNA, 22 nt, Human
guacacauauauuaaaaauugu

SEQ ID NO: 668912 - RNA, 22 nt, Human
ucacgagaggcacagaauagag

SEQ ID NO: 668913 - RNA, 22 nt, Human
ugccuugcacauaauauacauu

SEQ ID NO: 668914 - RNA, 22 nt, Human
cccuggggagcaggcgaaggag

SEQ ID NO: 668915 - RNA, 22 nt, Human
gucacaaaggugagggacauga

SEQ ID NO: 668916 - RNA, 22 nt, Human
ccaugcuccuuaccacucacuu

SEQ ID NO: 668917 - RNA, 22 nt, Human
gcccuuaggcaagcagaagccc

SEQ ID NO: 668918 - RNA, 21 nt, Human
augauacugaagcacaacuau

SEQ ID NO: 668919 - RNA, 17 nt, Human
cagcuuuaugcuacugu

SEQ ID NO: 668920 - RNA, 22 nt, Human
caguccuguuccuggaguaguu

SEQ ID NO: 668921 - RNA, 22 nt, Human
caguacauaaugcgcaaaaccg

SEQ ID NO: 668922 - RNA, 22 nt, Human
uucucauggugucuuuauacau

SEQ ID NO: 668923 - RNA, 22 nt, Human
ucacaucuuauuagaguaucuc

SEQ ID NO: 668924 - RNA, 22 nt, Human
uggagagguuuaaacaaaaguu

SEQ ID NO: 668925 - RNA, 22 nt, Human
aucuuucaucucuauuauuuga

SEQ ID NO: 668926 - RNA, 22 nt, Human
cuggcuuccaugcuguaguggc

SEQ ID NO: 668927 - RNA, 22 nt, Human
uacagcuuuauacccaucaaaa

SEQ ID NO: 668928 - RNA, 22 nt, Human
gggcagcacguuucaggaggau

SEQ ID NO: 668929 - RNA, 22 nt, Human
uuucuaaguaaacacagcauac

SEQ ID NO: 668930 - RNA, 19 nt, Human
agacacuggauggaaaaug

SEQ ID NO: 668931 - RNA, 22 nt, Human
uuauucugcacuuuuaaaauau

SEQ ID NO: 668932 - RNA, 22 nt, Human
gugccugcugcagcugagcagu

SEQ ID NO: 668933 - RNA, 22 nt, Human
ucaaagucuaucuguaauuacu

SEQ ID NO: 668934 - RNA, 22 nt, Human
gucugcccucacaugcacucuu

SEQ ID NO: 668935 - RNA, 22 nt, Human
uuccucuguaguugcugaugaa

SEQ ID NO: 668936 - RNA, 22 nt, Human
ggaggggcauaguucaccauca

SEQ ID NO: 668937 - RNA, 22 nt, Human
guaacauuuugagcaguaggcu

SEQ ID NO: 668938 - RNA, 22 nt, Human
uccuuaauucugugcaauaugu

SEQ ID NO: 668939 - RNA, 22 nt, Human
aagauggagcacgagcagaagc

SEQ ID NO: 668940 - RNA, 22 nt, Human
uggcugagaccuucccaaauuc

SEQ ID NO: 668941 - RNA, 22 nt, Human
gaggguggagcuccagaaucug

SEQ ID NO: 668942 - RNA, 17 nt, Human
ccuguuguugccuuugc

SEQ ID NO: 668943 - RNA, 22 nt, Human
aaggcucuuggagugaaugcag

SEQ ID NO: 668944 - RNA, 22 nt, Human
uccaaaggaagaggcugucagu

SEQ ID NO: 668945 - RNA, 22 nt, Human
ggcagcaguaggagcuaaucuu

SEQ ID NO: 668946 - RNA, 22 nt, Human
ucuguccuccacacuguaaguu

SEQ ID NO: 668947 - RNA, 22 nt, Human
agaguuuguugaauuuacuugg

SEQ ID NO: 668948 - RNA, 22 nt, Human
acuuagcagguggugacucgaa

SEQ ID NO: 668949 - RNA, 22 nt, Human
aacugaggccaagugaggaaag

SEQ ID NO: 668950 - RNA, 22 nt, Human
gcuggcuccaaaagcaggggcu

SEQ ID NO: 668951 - RNA, 22 nt, Human
ucaggaggaugucggcaaauuu

SEQ ID NO: 668952 - RNA, 22 nt, Human
auugucuuacauacuguggagg

SEQ ID NO: 668953 - RNA, 22 nt, Human
ccccuggggaucagcuggaauu

SEQ ID NO: 668954 - RNA, 22 nt, Human
aaggcagaaagggaugugagug

SEQ ID NO: 668955 - RNA, 19 nt, Human
uugaaagauuagcuuucua

SEQ ID NO: 668956 - RNA, 22 nt, Human
auguuucuacagcguccacuga

SEQ ID NO: 668957 - RNA, 22 nt, Human
auacauguuguaccauauguuu

SEQ ID NO: 668958 - RNA, 22 nt, Human
cuggagaaaauccauguguaug

SEQ ID NO: 668959 - RNA, 22 nt, Human
ccaggacacgauuuuuagucug

SEQ ID NO: 668960 - RNA, 22 nt, Human
uccuggugaggcuagaaguguc

SEQ ID NO: 668961 - RNA, 15 nt, Human
cuguggcuaaccuaa

SEQ ID NO: 668962 - RNA, 21 nt, Human
aguguguguggaaugagaaua

SEQ ID NO: 668963 - RNA, 22 nt, Human
uuuguauuuuucccagcuagcu

SEQ ID NO: 668964 - RNA, 22 nt, Human
uguguguauaugcauuuaucua

SEQ ID NO: 668965 - RNA, 22 nt, Human
ugaaaugagauaauuuaagugc

SEQ ID NO: 668966 - RNA, 22 nt, Human
gcugccaggcccuggggcuaug

SEQ ID NO: 668967 - RNA, 22 nt, Human
aaggcuccuuuguaguucuuuu

SEQ ID NO: 668968 - RNA, 22 nt, Human
aggcccagcuugaagugggaag

SEQ ID NO: 668969 - RNA, 22 nt, Human
uggcaccagggaacaagcauuu

SEQ ID NO: 668970 - RNA, 21 nt, Human
agcugggccucagccugcagu

SEQ ID NO: 668971 - RNA, 22 nt, Human
ugaaacauugcacuguaugaau

SEQ ID NO: 668972 - RNA, 22 nt, Human
uuaccauagaaacuuccuuuuu

SEQ ID NO: 668973 - RNA, 22 nt, Human
guuucauucggcagcucauaag

SEQ ID NO: 668974 - RNA, 22 nt, Human
aggggccuccucauuggagugu

SEQ ID NO: 668975 - RNA, 22 nt, Human
agaaucaggaccuguggcuguc

SEQ ID NO: 668976 - RNA, 22 nt, Human
ccucaggcaagucacuuaacau

SEQ ID NO: 668977 - RNA, 22 nt, Human
ucaaaaggacagaagaccuaaa

SEQ ID NO: 668978 - RNA, 22 nt, Human
agguauuauuagcaucucuauu

SEQ ID NO: 668979 - RNA, 22 nt, Human
cucccuucugagccuuuuguua

SEQ ID NO: 668980 - RNA, 22 nt, Human
uuuaaaaggcagcuucuuuugu

SEQ ID NO: 668981 - RNA, 22 nt, Human
ucagcugcagcaggcaccauuu

SEQ ID NO: 668982 - RNA, 22 nt, Human
aagcaaaugugggugcagaauu

SEQ ID NO: 668983 - RNA, 22 nt, Human
gcaggagcaauggccuaucaga

SEQ ID NO: 668984 - RNA, 22 nt, Human
auuagauuguaaauguuuucac

SEQ ID NO: 668985 - RNA, 22 nt, Human
ucuggucaagacauccuaacau

SEQ ID NO: 668986 - RNA, 22 nt, Human
ggcacugauaauguccucucuc

SEQ ID NO: 668987 - RNA, 22 nt, Human
uuccacucuccagucaauuuca

SEQ ID NO: 668988 - RNA, 22 nt, Human
cuggccacaacuagcccaggac

SEQ ID NO: 668989 - RNA, 22 nt, Human
gugguccucauaauucagugag

SEQ ID NO: 668990 - RNA, 22 nt, Human
cagggcccaggccacuggguug

SEQ ID NO: 668991 - RNA, 22 nt, Human
gaagaaucugaggacagucauu

SEQ ID NO: 668992 - RNA, 21 nt, Human
guacacagugguucugaggga

SEQ ID NO: 668993 - RNA, 22 nt, Human
gccugugaccccuccaucugcu

SEQ ID NO: 668994 - RNA, 22 nt, Human
uauuucugaauccaaaagguca

SEQ ID NO: 668995 - RNA, 22 nt, Human
uccucaucuguaccuuggggua

SEQ ID NO: 668996 - RNA, 22 nt, Human
aggcagaucacuugaggccagg

SEQ ID NO: 668997 - RNA, 22 nt, Human
cagcaacggaaaauacacauag

SEQ ID NO: 668998 - RNA, 22 nt, Human
cuuuagaaggguaacggaauua

SEQ ID NO: 668999 - RNA, 22 nt, Human
ugcaguggaacaauuucaacag

SEQ ID NO: 669000 - RNA, 22 nt, Human
gcugggagaggcccugaaguga

SEQ ID NO: 669001 - RNA, 22 nt, Human
ucagagaacugcagcccuuccu

SEQ ID NO: 669002 - RNA, 22 nt, Human
acagcaguucaggccgcagagg

SEQ ID NO: 669003 - RNA, 22 nt, Human
uagcaauguaagauguuaacac

SEQ ID NO: 669004 - RNA, 22 nt, Human
ccaggagcaccaggccugugcc

SEQ ID NO: 669005 - RNA, 22 nt, Human
acccugaagcaggcacucagcu

SEQ ID NO: 669006 - RNA, 22 nt, Human
agauaaguacuguuauuauugc

SEQ ID NO: 669007 - RNA, 22 nt, Human
guccacucacucuuagucacuc

SEQ ID NO: 669008 - RNA, 22 nt, Human
cagcucugccacuuccuagcua

SEQ ID NO: 669009 - RNA, 22 nt, Human
accaggaagaacaggcaaggca

SEQ ID NO: 669010 - RNA, 22 nt, Human
uuguuuuuagagaagcccugaa

SEQ ID NO: 669011 - RNA, 22 nt, Human
uacauauguaaacauguauaaa

SEQ ID NO: 669012 - RNA, 22 nt, Human
aggccagcaugcaguucuaagg

SEQ ID NO: 669013 - RNA, 22 nt, Human
augccuggacuguaucccagau

SEQ ID NO: 669014 - RNA, 21 nt, Human
ugcucaguaaaugcugaguga

SEQ ID NO: 669015 - RNA, 22 nt, Human
ucaaauaccagcaauuucaugu

SEQ ID NO: 669016 - RNA, 22 nt, Human
auugagaaucugagagccuagg

SEQ ID NO: 669017 - RNA, 22 nt, Human
ugcugucuuuuucccuuccuaa

SEQ ID NO: 669018 - RNA, 22 nt, Human
cagugcaauuagaacuuauuua

SEQ ID NO: 669019 - RNA, 19 nt, Human
gguggguuggugguucccu

SEQ ID NO: 669020 - RNA, 20 nt, Human
ucagauuaaauguucugucu

SEQ ID NO: 669021 - RNA, 22 nt, Human
ugcuucugcaggagcuccugau

SEQ ID NO: 669022 - RNA, 22 nt, Human
gccaggcauuauuccgaucccu

SEQ ID NO: 669023 - RNA, 22 nt, Human
cgcugccaggauccccugccgg

SEQ ID NO: 669024 - RNA, 22 nt, Human
caguggcugguuagggacagga

SEQ ID NO: 669025 - RNA, 22 nt, Human
uguguauaaacaagagucugug

SEQ ID NO: 669026 - RNA, 22 nt, Human
uaccagcaaugcuagucaacuc

SEQ ID NO: 669027 - RNA, 22 nt, Human
gaagugaugacgcuguguuuuu

SEQ ID NO: 669028 - RNA, 22 nt, Human
uugaaagucacaauggcauuaa

SEQ ID NO: 669029 - RNA, 18 nt, Human
agugugugcccuuucagg

SEQ ID NO: 669030 - RNA, 22 nt, Human
auggccuggggagcaugggaag

SEQ ID NO: 669031 - RNA, 22 nt, Human
ccaggcccguucccuucuccag

SEQ ID NO: 669032 - RNA, 22 nt, Human
agcugggagcugaaggcugauu

SEQ ID NO: 669033 - RNA, 22 nt, Human
uguuuaaguagucucagggccu

SEQ ID NO: 669034 - RNA, 22 nt, Human
uggaacacaagucauugagggg

SEQ ID NO: 669035 - RNA, 22 nt, Human
uuguucuagccuccuguuuuga

SEQ ID NO: 669036 - RNA, 22 nt, Human
gaagcugaugaggaccagauug

SEQ ID NO: 669037 - RNA, 22 nt, Human
acagaaugcguagugcauguug

SEQ ID NO: 669038 - RNA, 22 nt, Human
ugccugggcucaccgccucuuu

SEQ ID NO: 669039 - RNA, 22 nt, Human
uuccuccuacgcuuaucacuuu

SEQ ID NO: 669040 - RNA, 20 nt, Human
uggcagaguugucccaccca

SEQ ID NO: 669041 - RNA, 20 nt, Human
aggcaugggaugcccagauu

SEQ ID NO: 669042 - RNA, 19 nt, Human
aucuuuagcaacuuucaaa

SEQ ID NO: 669043 - RNA, 22 nt, Human
ucuuugaaguugaaguaguugg

SEQ ID NO: 669044 - RNA, 22 nt, Human
acagcagcuugucuguucuuua

SEQ ID NO: 669045 - RNA, 15 nt, Human
ggaacauuucuguuu

SEQ ID NO: 669046 - RNA, 22 nt, Human
cugucccuucccaagcccagcc

SEQ ID NO: 669047 - RNA, 22 nt, Human
ggcugccacgucgaggguccaa

SEQ ID NO: 669048 - RNA, 22 nt, Human
cccuguggaggaggagagcagu

SEQ ID NO: 669049 - RNA, 22 nt, Human
augacaguucuuuagagaugua

SEQ ID NO: 669050 - RNA, 22 nt, Human
aguuucacagaggguuagacgc

SEQ ID NO: 669051 - RNA, 22 nt, Human
agcagugaugcaugacagccua

SEQ ID NO: 669052 - RNA, 22 nt, Human
uucugcuuugguuccauggaug

SEQ ID NO: 669053 - RNA, 22 nt, Human
acaguuuacuggccuugccguu

SEQ ID NO: 669054 - RNA, 22 nt, Human
aaugagaaaacacagaggaggu

SEQ ID NO: 669055 - RNA, 22 nt, Human
ugugaacauuucugguuauuug

SEQ ID NO: 669056 - RNA, 19 nt, Human
ucuucccuggcugucaguc

SEQ ID NO: 669057 - RNA, 23 nt, Human
agacaguggccgagagguacuag

SEQ ID NO: 669058 - RNA, 22 nt, Human
gaguggcauaugugccugugaa

SEQ ID NO: 669059 - RNA, 20 nt, Human
cccucugcacauggcugugg

SEQ ID NO: 669060 - RNA, 22 nt, Human
cuggcucuaucuccaaggcugg

SEQ ID NO: 669061 - RNA, 23 nt, Human
acaugggaaaugcaaagagaagu

SEQ ID NO: 669062 - RNA, 22 nt, Human
auguggcuguggacaccuuuca

SEQ ID NO: 669063 - RNA, 22 nt, Human
auaaucugagcuauuucaugag

SEQ ID NO: 669064 - RNA, 22 nt, Human
cacauauaccagccgcgguacg

SEQ ID NO: 669065 - RNA, 22 nt, Human
aucuggcuuucuuaaugacuua

SEQ ID NO: 669066 - RNA, 22 nt, Human
ccugcccuguguuuggggacua

SEQ ID NO: 669067 - RNA, 19 nt, Human
aaaguucugacuguagagc

SEQ ID NO: 669068 - RNA, 22 nt, Human
gccugggagugcacagugaggu

SEQ ID NO: 669069 - RNA, 22 nt, Human
ugaggcuguucuaccagggcca

SEQ ID NO: 669070 - RNA, 22 nt, Human
gcacaugaggcugucuuugucu

SEQ ID NO: 669071 - RNA, 22 nt, Human
gcugccugcuucaugugggaga

SEQ ID NO: 669072 - RNA, 22 nt, Human
gacacuuugggacucagcccua

SEQ ID NO: 669073 - RNA, 22 nt, Human
ccugagcauuagacauccauca

SEQ ID NO: 669074 - RNA, 20 nt, Human
aggaaaaggguggugguaga

SEQ ID NO: 669075 - RNA, 21 nt, Human
uuagacuuggguuuuuccugg

SEQ ID NO: 669076 - RNA, 22 nt, Human
ucucaguggguuaaaagagaag

SEQ ID NO: 669077 - RNA, 22 nt, Human
caccuuuugugucugcguuugu

SEQ ID NO: 669078 - RNA, 23 nt, Human
ucuguucuuuuagcugaucauuu

SEQ ID NO: 669079 - RNA, 22 nt, Human
gcggugggggaaaggagcgguu

SEQ ID NO: 669080 - RNA, 22 nt, Human
ccuggaguugaaggaagguggg

SEQ ID NO: 669081 - RNA, 22 nt, Human
aaaauuguaggaacugaaucaa

SEQ ID NO: 669082 - RNA, 22 nt, Human
ucagaacuauaguaguuucaug

SEQ ID NO: 669083 - RNA, 19 nt, Human
aggcuuggauuguggccaa

SEQ ID NO: 669084 - RNA, 22 nt, Human
aagugugauuuguagaaugccu

SEQ ID NO: 669085 - RNA, 21 nt, Human
ugcauaaagaaauacaaauac

SEQ ID NO: 669086 - RNA, 22 nt, Human
augugagaauaacucaaaacaa

SEQ ID NO: 669087 - RNA, 22 nt, Human
caaaaacugcaauuacuuuuac

SEQ ID NO: 669088 - RNA, 22 nt, Human
aaagugcugagacagacuggga

SEQ ID NO: 669089 - RNA, 20 nt, Human
gccuggaguuaguuuuccuu

SEQ ID NO: 669090 - RNA, 22 nt, Human
gucuuuagagcuccuggcaucu

SEQ ID NO: 669091 - RNA, 22 nt, Human
gucugggcaucagacugcgggc

SEQ ID NO: 669092 - RNA, 22 nt, Human
ucaacugcaaguuugcuuaguu

SEQ ID NO: 669093 - RNA, 22 nt, Human
ggaaggucgagcugcaucuggc

SEQ ID NO: 669094 - RNA, 22 nt, Human
ucauucaagauuucaauagauu

SEQ ID NO: 669095 - RNA, 22 nt, Human
cagggacagagacugcaccuug

SEQ ID NO: 669096 - RNA, 22 nt, Human
uauggcuucuauaaggaagcuu

SEQ ID NO: 669097 - RNA, 22 nt, Human
cagaugaacugugacugaaaau

SEQ ID NO: 669098 - RNA, 22 nt, Human
uuggugacuccccaccaugaug

SEQ ID NO: 669099 - RNA, 22 nt, Human
cugggaugugaggagcgccucu

SEQ ID NO: 669100 - RNA, 22 nt, Human
ugguggggauucccucccuggc

SEQ ID NO: 669101 - RNA, 22 nt, Human
uaccagggaacagggauauuaa

SEQ ID NO: 669102 - RNA, 20 nt, Human
aaaugaugggaauaaucuau

SEQ ID NO: 669103 - RNA, 22 nt, Human
agcaggcugggcaauaugggca

SEQ ID NO: 669104 - RNA, 22 nt, Human
gcugccacucugagcuugcuuc

SEQ ID NO: 669105 - RNA, 22 nt, Human
acaaguguugcauuuugccauu

SEQ ID NO: 669106 - RNA, 22 nt, Human
uuggaacugauggccuucaucc

SEQ ID NO: 669107 - RNA, 22 nt, Human
uggcuuccaaaggaaugggccu

SEQ ID NO: 669108 - RNA, 22 nt, Human
aucaggaugcugucaguuacca

SEQ ID NO: 669109 - RNA, 23 nt, Human
cugcccugaucuugaucuauugu

SEQ ID NO: 669110 - RNA, 22 nt, Human
ggguaggccgugggucaccagg

SEQ ID NO: 669111 - RNA, 22 nt, Human
ugcuuuaccuucccagaaacca

SEQ ID NO: 669112 - RNA, 21 nt, Human
cauauuaaaucggugccuuua

SEQ ID NO: 669113 - RNA, 22 nt, Human
agggccagaugaagccacaagc

SEQ ID NO: 669114 - RNA, 22 nt, Human
aaagucacuuccuucugucagc

SEQ ID NO: 669115 - RNA, 22 nt, Human
gagaaaauagcauguguaguau

SEQ ID NO: 669116 - RNA, 22 nt, Human
uuccaugaaggagacugagaag

SEQ ID NO: 669117 - RNA, 22 nt, Human
ugggcucuuccuauaguuuaua

SEQ ID NO: 669118 - RNA, 22 nt, Human
uccugaaugaguugaucacaau

SEQ ID NO: 669119 - RNA, 20 nt, Human
auuuggcaugaaguauugau

SEQ ID NO: 669120 - RNA, 22 nt, Human
aaacccaggguuuugucuuccc

SEQ ID NO: 669121 - RNA, 22 nt, Human
agaccagggucccacagagucu

SEQ ID NO: 669122 - RNA, 21 nt, Human
ccacucaugacuccacucacc

SEQ ID NO: 669123 - RNA, 22 nt, Human
cugaggcuuggaggggucuggu

SEQ ID NO: 669124 - RNA, 22 nt, Human
cucuggguucagaacagcaagc

SEQ ID NO: 669125 - RNA, 22 nt, Human
ucaggcacugcuuucugauaug

SEQ ID NO: 669126 - RNA, 22 nt, Human
cuguucuuuaguuccacugcaa

SEQ ID NO: 669127 - RNA, 22 nt, Human
gugcaggggaucagguugcagc

SEQ ID NO: 669128 - RNA, 22 nt, Human
ucacuggauucucuuuuguucc

SEQ ID NO: 669129 - RNA, 22 nt, Human
gugcguccugggggcugggucg

SEQ ID NO: 669130 - RNA, 19 nt, Human
ccaaaagcaauuccaagua

SEQ ID NO: 669131 - RNA, 22 nt, Human
gccagccacuucagcuauggcu

SEQ ID NO: 669132 - RNA, 22 nt, Human
uggcccagggaguucauggugu

SEQ ID NO: 669133 - RNA, 22 nt, Human
ucaugagucugcaaauuaugga

SEQ ID NO: 669134 - RNA, 22 nt, Human
gcucaagggaugggagugggug

SEQ ID NO: 669135 - RNA, 22 nt, Human
gcugggacugagacagugaccu

SEQ ID NO: 669136 - RNA, 22 nt, Human
uuacagagccucauuuuagaga

SEQ ID NO: 669137 - RNA, 22 nt, Human
ccugggagagucuguggucucc

SEQ ID NO: 669138 - RNA, 23 nt, Human
aucaaaguggaaaucaauuaucu

SEQ ID NO: 669139 - RNA, 22 nt, Human
auucagaucauauuuauagcuu

SEQ ID NO: 669140 - RNA, 22 nt, Human
uagcaaugcuucauuauuuaaa

SEQ ID NO: 669141 - RNA, 22 nt, Human
ggcaaccugagcuuguggagaa

SEQ ID NO: 669142 - RNA, 22 nt, Human
uuccauuuauucuuguccagau

SEQ ID NO: 669143 - RNA, 22 nt, Human
cgcuccuugagcgugucggccu

SEQ ID NO: 669144 - RNA, 22 nt, Human
cuugcaguuuagguccucugug

SEQ ID NO: 669145 - RNA, 22 nt, Human
ccaggcugggcggggaaccugg

SEQ ID NO: 669146 - RNA, 22 nt, Human
ugcacauggccugagugccuga

SEQ ID NO: 669147 - RNA, 22 nt, Human
agcaacaggaauauuauggcaa

SEQ ID NO: 669148 - RNA, 23 nt, Human
cagaccuggcagucauccucaac

SEQ ID NO: 669149 - RNA, 22 nt, Human
ugucugggucaccccuccuggc

SEQ ID NO: 669150 - RNA, 22 nt, Human
aaagacauugaagaaggacuua

SEQ ID NO: 669151 - RNA, 22 nt, Human
ggagcacccugcucagccaagc

SEQ ID NO: 669152 - RNA, 22 nt, Human
cauuucugucacguucuuuuau

SEQ ID NO: 669153 - RNA, 22 nt, Human
aaaucagagucugauuuuaagg

SEQ ID NO: 669154 - RNA, 22 nt, Human
uacuuuguggagauuaaaaaua

SEQ ID NO: 669155 - RNA, 22 nt, Human
ggcagaagaaaggcuaagucuc

SEQ ID NO: 669156 - RNA, 22 nt, Human
aaauugcaaccaggucucuguc

SEQ ID NO: 669157 - RNA, 22 nt, Human
aacaggaggccuuccaguccag

SEQ ID NO: 669158 - RNA, 22 nt, Human
ugauuacaguauuugagaucca

SEQ ID NO: 669159 - RNA, 22 nt, Human
gcaaggaagcagaguugcuauc

SEQ ID NO: 669160 - RNA, 22 nt, Human
gugaggugggcugggcucuaug

SEQ ID NO: 669161 - RNA, 22 nt, Human
aagcacugggaggaggcugaga

SEQ ID NO: 669162 - RNA, 22 nt, Human
cccaccacgugcuuugcuggag

SEQ ID NO: 669163 - RNA, 22 nt, Human
gguucccggaucuccgaguccc

SEQ ID NO: 669164 - RNA, 22 nt, Human
uauuauauuuaguaauguggag

SEQ ID NO: 669165 - RNA, 22 nt, Human
gggcuguggagccgcgagggcu

SEQ ID NO: 669166 - RNA, 22 nt, Human
aaaauccugcugacucgagaug

SEQ ID NO: 669167 - RNA, 22 nt, Human
accuggagcuuccaacucaacu

SEQ ID NO: 669168 - RNA, 22 nt, Human
aaacaucuaucagcauuuuuua

SEQ ID NO: 669169 - RNA, 19 nt, Human
ccagagagcuagguacaga

SEQ ID NO: 669170 - RNA, 22 nt, Human
acauucuaaagcaugcucagga

SEQ ID NO: 669171 - RNA, 22 nt, Human
accuuggaacugaaguguuuuu

SEQ ID NO: 669172 - RNA, 22 nt, Human
aggaagagcauucacaugguag

SEQ ID NO: 669173 - RNA, 22 nt, Human
cuguguuggcuuuucucuugua

SEQ ID NO: 669174 - RNA, 22 nt, Human
aagcaacuaaggcaaggaaaug

SEQ ID NO: 669175 - RNA, 21 nt, Human
uuucuucccuuggcuucugag

SEQ ID NO: 669176 - RNA, 22 nt, Human
acagaacaacaagguggaccag

SEQ ID NO: 669177 - RNA, 22 nt, Human
aauguugaggauaucagaaaau

SEQ ID NO: 669178 - RNA, 22 nt, Human
ugacagugcaugugacaaagga

SEQ ID NO: 669179 - RNA, 22 nt, Human
ugggugcuucgucagcucugag

SEQ ID NO: 669180 - RNA, 18 nt, Human
cuugcugagggccucauu

SEQ ID NO: 669181 - RNA, 20 nt, Human
acugagcugcauggagagga

SEQ ID NO: 669182 - RNA, 22 nt, Human
aggacagcccuugagagcacau

SEQ ID NO: 669183 - RNA, 22 nt, Human
agaaauguauucuguauguuuu

SEQ ID NO: 669184 - RNA, 22 nt, Human
gggagcugagggaccucugugg

SEQ ID NO: 669185 - RNA, 22 nt, Human
ggacagcacagcucuugacaac

SEQ ID NO: 669186 - RNA, 22 nt, Human
aggaguggaauuacuggguucu

SEQ ID NO: 669187 - RNA, 22 nt, Human
uuucaucaucaaaauagugagg

SEQ ID NO: 669188 - RNA, 22 nt, Human
gcaggccauucaggagaugugc

SEQ ID NO: 669189 - RNA, 22 nt, Human
uauuuccugcauggugauguaa

SEQ ID NO: 669190 - RNA, 22 nt, Human
cuggcucccagcuuucagggag

SEQ ID NO: 669191 - RNA, 22 nt, Human
uaccuucaggcugcccuuugau

SEQ ID NO: 669192 - RNA, 22 nt, Human
cagcuuugaaacauggcucuag

SEQ ID NO: 669193 - RNA, 22 nt, Human
aagggcaggcacccacccucac

SEQ ID NO: 669194 - RNA, 22 nt, Human
ugaaucuggaucuaugaucaau

SEQ ID NO: 669195 - RNA, 22 nt, Human
caagggaagaggacagggaccu

SEQ ID NO: 669196 - RNA, 22 nt, Human
uuguucaugguuguaaguuuga

SEQ ID NO: 669197 - RNA, 22 nt, Human
aagccaggaccaaacucauccu

SEQ ID NO: 669198 - RNA, 22 nt, Human
ucccugugagaaaugaagcagg

SEQ ID NO: 669199 - RNA, 22 nt, Human
agcaaauaauugucuuugaggg

SEQ ID NO: 669200 - RNA, 22 nt, Human
ugcacagaaucauuuucagcug

SEQ ID NO: 669201 - RNA, 22 nt, Human
gacugucauucuagugcccaug

SEQ ID NO: 669202 - RNA, 22 nt, Human
aggcuccaggccucccugcaug

SEQ ID NO: 669203 - RNA, 22 nt, Human
ugcugggcuggggccucagacc

SEQ ID NO: 669204 - RNA, 22 nt, Human
cccaagagaucgcauguaguug

SEQ ID NO: 669205 - RNA, 23 nt, Human
uaucucagaggaauguaguuacu

SEQ ID NO: 669206 - RNA, 22 nt, Human
ugcugggcuucaacugccugag

SEQ ID NO: 669207 - RNA, 22 nt, Human
auucuuuucccaacugcuuuaa

SEQ ID NO: 669208 - RNA, 22 nt, Human
uauugacagugacuauugguag

SEQ ID NO: 669209 - RNA, 22 nt, Human
caucucugguucagucucugug

SEQ ID NO: 669210 - RNA, 22 nt, Human
aaaugucugucucaugaggaaa

SEQ ID NO: 669211 - RNA, 22 nt, Human
gggcucuggaaggugcaccaug

SEQ ID NO: 669212 - RNA, 22 nt, Human
cuguggcucauaucuguaaucu

SEQ ID NO: 669213 - RNA, 22 nt, Human
caguaauuccaagugcuuauac

SEQ ID NO: 669214 - RNA, 22 nt, Human
agcuggaggauaacucacuucu

SEQ ID NO: 669215 - RNA, 22 nt, Human
gcccagcagcuccacuuggcuu

SEQ ID NO: 669216 - RNA, 22 nt, Human
cggggcagaaaguugucuuuug

SEQ ID NO: 669217 - RNA, 22 nt, Human
uauugacauuuuuauagcuuga

SEQ ID NO: 669218 - RNA, 22 nt, Human
uuuuacaggugaaaaaugaaga

SEQ ID NO: 669219 - RNA, 22 nt, Human
ccauccugucuguggccucagg

SEQ ID NO: 669220 - RNA, 22 nt, Human
uuuauguaguuacggacuauca

SEQ ID NO: 669221 - RNA, 22 nt, Human
gagacacacccaagguuaugag

SEQ ID NO: 669222 - RNA, 22 nt, Human
uucuaaagagaaugcguuucug

SEQ ID NO: 669223 - RNA, 22 nt, Human
auugaagauuaaaugcuuccuu

SEQ ID NO: 669224 - RNA, 22 nt, Human
ucuaagaggcaucaagacaagc

SEQ ID NO: 669225 - RNA, 22 nt, Human
ggacaggagugaggcggguucc

SEQ ID NO: 669226 - RNA, 22 nt, Human
caguuuuuagauuaguuggugg

SEQ ID NO: 669227 - RNA, 22 nt, Human
caccagcccccucacgcuguca

SEQ ID NO: 669228 - RNA, 22 nt, Human
ucagaacauguuugaguaagac

SEQ ID NO: 669229 - RNA, 20 nt, Human
ccacaggaguccagucgacc

SEQ ID NO: 669230 - RNA, 22 nt, Human
cagaggagugggccguuauggu

SEQ ID NO: 669231 - RNA, 22 nt, Human
cuccuccagcuuccaguggcuc

SEQ ID NO: 669232 - RNA, 22 nt, Human
ggcuggagacaacguccugccc

SEQ ID NO: 669233 - RNA, 22 nt, Human
guaaccuggaaguuuagggaag

SEQ ID NO: 669234 - RNA, 22 nt, Human
uucuguacaaguuguggcugcu

SEQ ID NO: 669235 - RNA, 22 nt, Human
auggcuggauuugauccauggg

SEQ ID NO: 669236 - RNA, 22 nt, Human
ucauugaguucaaauccuucau

SEQ ID NO: 669237 - RNA, 23 nt, Human
ggggaaagaccaugcuugaggac

SEQ ID NO: 669238 - RNA, 22 nt, Human
acagagaaagugggcugaagau

SEQ ID NO: 669239 - RNA, 22 nt, Human
cuccucuggcuuccuggaggca

SEQ ID NO: 669240 - RNA, 22 nt, Human
ggaagccacccagcuuugauag

SEQ ID NO: 669241 - RNA, 20 nt, Human
aguacaauguaugauucaga

SEQ ID NO: 669242 - RNA, 22 nt, Human
cuacccaggcuuagagggcugg

SEQ ID NO: 669243 - RNA, 22 nt, Human
cugaaaagcuuugaaccguuaa

SEQ ID NO: 669244 - RNA, 22 nt, Human
caccagcuuacagucucacccc

SEQ ID NO: 669245 - RNA, 22 nt, Human
aggcuucagaggaagugcggcc

SEQ ID NO: 669246 - RNA, 22 nt, Human
acauaauaggugccugaauauu

SEQ ID NO: 669247 - RNA, 22 nt, Human
ucuacuuuucccuauacaguuu

SEQ ID NO: 669248 - RNA, 22 nt, Human
ucccugggguaacauuagaggg

SEQ ID NO: 669249 - RNA, 22 nt, Human
ugggacagauuauaagucugca

SEQ ID NO: 669250 - RNA, 22 nt, Human
cagucucuaaaucaaucugaau

SEQ ID NO: 669251 - RNA, 23 nt, Human
ugcugguucaaaaaggaaggagg

SEQ ID NO: 669252 - RNA, 22 nt, Human
gagucagaugaagauaaaaggg

SEQ ID NO: 669253 - RNA, 22 nt, Human
cagagggcacucggagugacau

SEQ ID NO: 669254 - RNA, 22 nt, Human
gcacagagagucccgggugccc

SEQ ID NO: 669255 - RNA, 22 nt, Human
uuaugaaaacaaucaguaggca

SEQ ID NO: 669256 - RNA, 22 nt, Human
acacagcugugcaguuuuuuca

SEQ ID NO: 669257 - RNA, 22 nt, Human
ugugugugcacgugcgcgcgag

SEQ ID NO: 669258 - RNA, 22 nt, Human
gcuggcaggauagaagucuaau

SEQ ID NO: 669259 - RNA, 21 nt, Human
cucugggccauuuucuuccac

SEQ ID NO: 669260 - RNA, 22 nt, Human
uuugacuccuguguuucuggaa

SEQ ID NO: 669261 - RNA, 22 nt, Human
aucacaguuacucaaauaauga

SEQ ID NO: 669262 - RNA, 22 nt, Human
cucuggacagcccuccaggaag

SEQ ID NO: 669263 - RNA, 22 nt, Human
aaugugucauuucccacaggug

SEQ ID NO: 669264 - RNA, 22 nt, Human
uggugaggaagaccugcuccug

SEQ ID NO: 669265 - RNA, 22 nt, Human
uuacaaugaugaauaaauggca

SEQ ID NO: 669266 - RNA, 22 nt, Human
uguaugaaaaggaauagauuga

SEQ ID NO: 669267 - RNA, 22 nt, Human
aagcaauaagccagauuuggau

SEQ ID NO: 669268 - RNA, 22 nt, Human
uggcucucuacaggucaagacc

SEQ ID NO: 669269 - RNA, 20 nt, Human
aggcacuggggauagguaag

SEQ ID NO: 669270 - RNA, 22 nt, Human
uaccuagacaugaacacagaug

SEQ ID NO: 669271 - RNA, 22 nt, Human
ugugucagagguagagauggca

SEQ ID NO: 669272 - RNA, 22 nt, Human
ucauugaauacauauuugggau

SEQ ID NO: 669273 - RNA, 22 nt, Human
ccaaaguccacaguuuacauua

SEQ ID NO: 669274 - RNA, 22 nt, Human
agagccagauggagccgugugu

SEQ ID NO: 669275 - RNA, 22 nt, Human
accuucaagauugugggucaau

SEQ ID NO: 669276 - RNA, 22 nt, Human
guccaggcugaccccuagagga

SEQ ID NO: 669277 - RNA, 22 nt, Human
gcuggagauagaauggccacug

SEQ ID NO: 669278 - RNA, 22 nt, Human
uagcaguggaaucuuuugucca

SEQ ID NO: 669279 - RNA, 22 nt, Human
cugggcuccuaaccauccaggu

SEQ ID NO: 669280 - RNA, 22 nt, Human
aggaggccaggcccucaagccu

SEQ ID NO: 669281 - RNA, 22 nt, Human
ggaggugggaguuuaguucuug

SEQ ID NO: 669282 - RNA, 22 nt, Human
acauuuaaauaccuauguuucu

SEQ ID NO: 669283 - RNA, 22 nt, Human
acugugggcagcuucugggaac

SEQ ID NO: 669284 - RNA, 22 nt, Human
aaccuuucaauuauccucaucu

SEQ ID NO: 669285 - RNA, 22 nt, Human
cuggccuggagccucugggugg

SEQ ID NO: 669286 - RNA, 22 nt, Human
ucugcaggccucgacaaggcca

SEQ ID NO: 669287 - RNA, 17 nt, Human
caguggucugagguaug

SEQ ID NO: 669288 - RNA, 22 nt, Human
gugagggcaaauuagaaucaaa

SEQ ID NO: 669289 - RNA, 22 nt, Human
aagaggcuagccggcucacuaa

SEQ ID NO: 669290 - RNA, 22 nt, Human
gccuggugguauccuggcaaga

SEQ ID NO: 669291 - RNA, 22 nt, Human
uccucagucagcuccguucuug

SEQ ID NO: 669292 - RNA, 22 nt, Human
accucccuggccuucugauucc

SEQ ID NO: 669293 - RNA, 22 nt, Human
uggacuccagugucuguguucu

SEQ ID NO: 669294 - RNA, 22 nt, Human
agcuacaacuuuuccaugagca

SEQ ID NO: 669295 - RNA, 22 nt, Human
ugcucuggagggugaagcuuuu

SEQ ID NO: 669296 - RNA, 22 nt, Human
ccuggcugaggggccaaggacc

SEQ ID NO: 669297 - RNA, 22 nt, Human
acauuguauaaugauuaucaca

SEQ ID NO: 669298 - RNA, 22 nt, Human
gggcuuuaugagauugagaucu

SEQ ID NO: 669299 - RNA, 22 nt, Human
uuggcaguccaggauuaauaua

SEQ ID NO: 669300 - RNA, 22 nt, Human
aagagagaagucucucugguuc

SEQ ID NO: 669301 - RNA, 22 nt, Human
ggguggagugugaaaucuggcu

SEQ ID NO: 669302 - RNA, 22 nt, Human
ggguggcauagggugauggcuu

SEQ ID NO: 669303 - RNA, 19 nt, Human
gcuaggcuggccuugaggg

SEQ ID NO: 669304 - RNA, 22 nt, Human
ugguuuuauuuauguugaguca

SEQ ID NO: 669305 - RNA, 22 nt, Human
guccccagcuaaucucuuugcc

SEQ ID NO: 669306 - RNA, 22 nt, Human
uccagcuguuccaucagcucuu

SEQ ID NO: 669307 - RNA, 22 nt, Human
cuccagugcgcaggacagcccc

SEQ ID NO: 669308 - RNA, 22 nt, Human
guagaaauuccauuuacuuuga

SEQ ID NO: 669309 - RNA, 22 nt, Human
gggcuugcuaagaagagcgcau

SEQ ID NO: 669310 - RNA, 22 nt, Human
uauggguagaaguggcccaagc

SEQ ID NO: 669311 - RNA, 22 nt, Human
gcugccugucuguuucuuuuau

SEQ ID NO: 669312 - RNA, 22 nt, Human
uuggaagauucugugucuggug

SEQ ID NO: 669313 - RNA, 18 nt, Human
cugucuuuuuucucucca

SEQ ID NO: 669314 - RNA, 22 nt, Human
gcccucucuucugcagccucca

SEQ ID NO: 669315 - RNA, 17 nt, Human
cuguggccaccuggaug

SEQ ID NO: 669316 - RNA, 22 nt, Human
uaaaccugcaacuauagccacc

SEQ ID NO: 669317 - RNA, 22 nt, Human
caguguggcuuagggaauaggc

SEQ ID NO: 669318 - RNA, 23 nt, Human
ugugucauaaaauuaaaacuuca

SEQ ID NO: 669319 - RNA, 22 nt, Human
auucugcucauuuuauuuccag

SEQ ID NO: 669320 - RNA, 22 nt, Human
guguaugaacgaaagaauggau

SEQ ID NO: 669321 - RNA, 22 nt, Human
ucucagcuugaguggaugagcu

SEQ ID NO: 669322 - RNA, 22 nt, Human
ugagcaggacugaccggccuua

SEQ ID NO: 669323 - RNA, 22 nt, Human
ucugcugcugcagcuacacuau

SEQ ID NO: 669324 - RNA, 22 nt, Human
caggaaacauaugugcuugagg

SEQ ID NO: 669325 - RNA, 21 nt, Human
uggaccaggaaggugguggug

SEQ ID NO: 669326 - RNA, 22 nt, Human
acccaugaguguaucuuuaaaa

SEQ ID NO: 669327 - RNA, 22 nt, Human
aaaccggguccagaucuucagg

SEQ ID NO: 669328 - RNA, 23 nt, Human
uggaaacauucugaauguccauc

SEQ ID NO: 669329 - RNA, 22 nt, Human
uccagcccugcuuccugccuca

SEQ ID NO: 669330 - RNA, 22 nt, Human
uguuuugucuaaucuaaauucu

SEQ ID NO: 669331 - RNA, 22 nt, Human
acauuuaccuaguuaagucaau

SEQ ID NO: 669332 - RNA, 22 nt, Human
aggcuccauuccaggagcuaga

SEQ ID NO: 669333 - RNA, 22 nt, Human
cucaugucaggggugucaaugu

SEQ ID NO: 669334 - RNA, 22 nt, Human
cacaugagacaauuaaagacuu

SEQ ID NO: 669335 - RNA, 22 nt, Human
gggcugcaucagcaggacccgg

SEQ ID NO: 669336 - RNA, 22 nt, Human
cuggccccuguggcuaaaauca

SEQ ID NO: 669337 - RNA, 22 nt, Human
gucuugcacuuaccuaagaacu

SEQ ID NO: 669338 - RNA, 22 nt, Human
auuccacuguuauaaaaugucc

SEQ ID NO: 669339 - RNA, 22 nt, Human
ucuccagguggcuugggcuucu

SEQ ID NO: 669340 - RNA, 22 nt, Human
uacauuccacaagcauugcuuu

SEQ ID NO: 669341 - RNA, 22 nt, Human
guauuagguuggugcaaaagua

SEQ ID NO: 669342 - RNA, 22 nt, Human
ccuggccaggcucucagcacug

SEQ ID NO: 669343 - RNA, 22 nt, Human
auuugaaaaccugagccucccg

SEQ ID NO: 669344 - RNA, 22 nt, Human
acaguggaggccauaugguccu

SEQ ID NO: 669345 - RNA, 22 nt, Human
uuaguguauuuucaaauguaga

SEQ ID NO: 669346 - RNA, 22 nt, Human
uugagaagaauguguugaguuu

SEQ ID NO: 669347 - RNA, 22 nt, Human
uaaaggcuuuauuuuccaguca

SEQ ID NO: 669348 - RNA, 22 nt, Human
aggauguguuuugagcugacua

SEQ ID NO: 669349 - RNA, 22 nt, Human
cuuuacagccuccagaaggaac

SEQ ID NO: 669350 - RNA, 22 nt, Human
gaaaagggcaagagagagggca

SEQ ID NO: 669351 - RNA, 22 nt, Human
uuuagaggggaaaguggcuggu

SEQ ID NO: 669352 - RNA, 22 nt, Human
cguaugaaauuuuugacauuug

SEQ ID NO: 669353 - RNA, 22 nt, Human
ugugugauuccacuuauauggg

SEQ ID NO: 669354 - RNA, 22 nt, Human
ucaaauaguugacauuaacuug

SEQ ID NO: 669355 - RNA, 22 nt, Human
ugguuugcccacucgagugauu

SEQ ID NO: 669356 - RNA, 22 nt, Human
cagagggcccccuggccacagu

SEQ ID NO: 669357 - RNA, 22 nt, Human
gcaggggcuacucugagcuucc

SEQ ID NO: 669358 - RNA, 22 nt, Human
aggucccaguguuagggugaca

SEQ ID NO: 669359 - RNA, 21 nt, Human
gcucaggcucuugacagagca

SEQ ID NO: 669360 - RNA, 22 nt, Human
uagcccagaagagggaagcaac

SEQ ID NO: 669361 - RNA, 22 nt, Human
gccucucugggcugccgaggcu

SEQ ID NO: 669362 - RNA, 22 nt, Human
uuugccugauucuaagagcuca

SEQ ID NO: 669363 - RNA, 22 nt, Human
uucuccuugguuuaugggacau

SEQ ID NO: 669364 - RNA, 22 nt, Human
uuggcccuggggccagcuucga

SEQ ID NO: 669365 - RNA, 22 nt, Human
ccccuucucugcaagccugcuc

SEQ ID NO: 669366 - RNA, 22 nt, Human
agaugcauggaaaucucauuac

SEQ ID NO: 669367 - RNA, 22 nt, Human
aacuuuaaggcuauaaauuaug

SEQ ID NO: 669368 - RNA, 22 nt, Human
augagaaaguuaaucaucauga

SEQ ID NO: 669369 - RNA, 22 nt, Human
caccugcagggggagucaagag

SEQ ID NO: 669370 - RNA, 22 nt, Human
gcauuauuaauagcugcaugag

SEQ ID NO: 669371 - RNA, 22 nt, Human
ucaguuuuaagguuugagaauu

SEQ ID NO: 669372 - RNA, 22 nt, Human
gcaggagacuggcugugguagu

SEQ ID NO: 669373 - RNA, 21 nt, Human
accucaagcaacaaccaaggu

SEQ ID NO: 669374 - RNA, 22 nt, Human
uagcacauuguugaccagaagg

SEQ ID NO: 669375 - RNA, 22 nt, Human
agcagcaauuuucacugucaau

SEQ ID NO: 669376 - RNA, 22 nt, Human
uucaggaauaauuaucauauga

SEQ ID NO: 669377 - RNA, 22 nt, Human
cuuuucuuguauuggaugcccc

SEQ ID NO: 669378 - RNA, 19 nt, Human
auaacuacauuggcucagu

SEQ ID NO: 669379 - RNA, 22 nt, Human
aggacacagcucuucaguaaga

SEQ ID NO: 669380 - RNA, 22 nt, Human
gcagcuguggguuccaagucua

SEQ ID NO: 669381 - RNA, 22 nt, Human
uauuugucacuagaaaggguaa

SEQ ID NO: 669382 - RNA, 22 nt, Human
uuuccuucucagggagcuucaa

SEQ ID NO: 669383 - RNA, 22 nt, Human
aacaggcaaacugugggauccc

SEQ ID NO: 669384 - RNA, 23 nt, Human
augguuuauguuguugugaagca

SEQ ID NO: 669385 - RNA, 22 nt, Human
cacacagguauauauauguaca

SEQ ID NO: 669386 - RNA, 22 nt, Human
agcugaguuaauucaucacuua

SEQ ID NO: 669387 - RNA, 22 nt, Human
ugcuggaauuugccuucuggaa

SEQ ID NO: 669388 - RNA, 22 nt, Human
gaucaauacuauuaagaucaua

SEQ ID NO: 669389 - RNA, 22 nt, Human
uggggacagggcucagcaauuu

SEQ ID NO: 669390 - RNA, 22 nt, Human
gcagggcuccccaggcccgagg

SEQ ID NO: 669391 - RNA, 22 nt, Human
ugagcccuaagggucaagcagg

SEQ ID NO: 669392 - RNA, 18 nt, Human
agucuucugauccauuuu

SEQ ID NO: 669393 - RNA, 22 nt, Human
cacuguucaucaaaacugcucu

SEQ ID NO: 669394 - RNA, 22 nt, Human
ugaauaagaauuauuauaauga

SEQ ID NO: 669395 - RNA, 22 nt, Human
acacaggaagucagcacugaug

SEQ ID NO: 669396 - RNA, 22 nt, Human
uggcaauguaggcaagaacauu

SEQ ID NO: 669397 - RNA, 22 nt, Human
gccuuuggaugguuuuucuauu

SEQ ID NO: 669398 - RNA, 22 nt, Human
cucugagaggauccugcccggg

SEQ ID NO: 669399 - RNA, 22 nt, Human
cagugcaguuucccagaugcug

SEQ ID NO: 669400 - RNA, 22 nt, Human
auugcuguacacuucuagaucu

SEQ ID NO: 669401 - RNA, 18 nt, Human
uggcuucuugagcuaaca

SEQ ID NO: 669402 - RNA, 22 nt, Human
gugcccuccugaagccaucaca

SEQ ID NO: 669403 - RNA, 22 nt, Human
agcacccuucagcccagccugg

SEQ ID NO: 669404 - RNA, 22 nt, Human
gcgggcggggguucccaggucu

SEQ ID NO: 669405 - RNA, 22 nt, Human
uugcuguaaguaucuuucuacc

SEQ ID NO: 669406 - RNA, 22 nt, Human
ccccugccagcuaucccugaac

SEQ ID NO: 669407 - RNA, 22 nt, Human
gggcuccaaaguaagcuuuagu

SEQ ID NO: 669408 - RNA, 22 nt, Human
uuugaaugagggaaccacaguu

SEQ ID NO: 669409 - RNA, 21 nt, Human
aucuuaaaaggucuuaacuuu

SEQ ID NO: 669410 - RNA, 22 nt, Human
gaccuggaggcuuuucccaaga

SEQ ID NO: 669411 - RNA, 22 nt, Human
uugcuuaauucugaaaauauag

SEQ ID NO: 669412 - RNA, 22 nt, Human
uuccuccagccuggagcacuuc

SEQ ID NO: 669413 - RNA, 22 nt, Human
aagucacuaagugaaccacugg

SEQ ID NO: 669414 - RNA, 22 nt, Human
ggcuucugaaaucucugugcgu

SEQ ID NO: 669415 - RNA, 21 nt, Human
uguggcagagacaaugcuagu

SEQ ID NO: 669416 - RNA, 22 nt, Human
ugucccagggaaggcccagcac

SEQ ID NO: 669417 - RNA, 22 nt, Human
uuuuggaauuuauacaguaaug

SEQ ID NO: 669418 - RNA, 22 nt, Human
gacauaaaauggaauucuguug

SEQ ID NO: 669419 - RNA, 22 nt, Human
uuacacaugcuuuguguguaug

SEQ ID NO: 669420 - RNA, 22 nt, Human
ccagcuccucuucccaguguca

SEQ ID NO: 669421 - RNA, 22 nt, Human
uucacauuccgcggcuauuuuc

SEQ ID NO: 669422 - RNA, 22 nt, Human
gcaggccaagcccucgcagaga

SEQ ID NO: 669423 - RNA, 22 nt, Human
accagccugucugagucguggg

SEQ ID NO: 669424 - RNA, 22 nt, Human
gccucugaguuuggagaagagc

SEQ ID NO: 669425 - RNA, 22 nt, Human
auuucucauuaagaucuuccaa

SEQ ID NO: 669426 - RNA, 19 nt, Human
gggcuucugggaucaagag

SEQ ID NO: 669427 - RNA, 22 nt, Human
uugcaagacacuuggaagcaca

SEQ ID NO: 669428 - RNA, 19 nt, Human
cacuuugcugaacucuucu

SEQ ID NO: 669429 - RNA, 17 nt, Human
uucugcugucguccucu

SEQ ID NO: 669430 - RNA, 22 nt, Human
acauugaagcugugaaaucaaa

SEQ ID NO: 669431 - RNA, 22 nt, Human
agagccagcauuugggcccugc

SEQ ID NO: 669432 - RNA, 22 nt, Human
uugaagaacauaauagcuacuu

SEQ ID NO: 669433 - RNA, 22 nt, Human
uuuuccucugcaauaaaagcag

SEQ ID NO: 669434 - RNA, 22 nt, Human
guuaaauucgaugauggauaaa

SEQ ID NO: 669435 - RNA, 22 nt, Human
acaacugucuucuucaugcucc

SEQ ID NO: 669436 - RNA, 22 nt, Human
cgcugccaggucaccaggggua

SEQ ID NO: 669437 - RNA, 22 nt, Human
cucaggaguaguucagcagcug

SEQ ID NO: 669438 - RNA, 22 nt, Human
ugaagcuggaaguuagguagac

SEQ ID NO: 669439 - RNA, 23 nt, Human
ugcaggcuaggaagagagccuuc

SEQ ID NO: 669440 - RNA, 22 nt, Human
caucaucuggcuuuuagaaaaa

SEQ ID NO: 669441 - RNA, 22 nt, Human
uacuugcuguuaguauuuuaca

SEQ ID NO: 669442 - RNA, 22 nt, Human
gaggcugcccacaccugcgccg

SEQ ID NO: 669443 - RNA, 22 nt, Human
ggacagagagugaauaugacau

SEQ ID NO: 669444 - RNA, 22 nt, Human
aguauaucugcuucuggguccc

SEQ ID NO: 669445 - RNA, 22 nt, Human
guuuuaguggguggccacugau

SEQ ID NO: 669446 - RNA, 22 nt, Human
ucuuccagccaauagcguccuu

SEQ ID NO: 669447 - RNA, 22 nt, Human
gcucuggcacuggcgcgggaug

SEQ ID NO: 669448 - RNA, 22 nt, Human
uugauuuauagaauguucaagc

SEQ ID NO: 669449 - RNA, 22 nt, Human
acagaaggcggggacaaggcgg

SEQ ID NO: 669450 - RNA, 22 nt, Human
agacaucauguuacagauuaag

SEQ ID NO: 669451 - RNA, 22 nt, Human
caaggccaagucucugugaaga

SEQ ID NO: 669452 - RNA, 22 nt, Human
acauccuugauuauguaaggau

SEQ ID NO: 669453 - RNA, 22 nt, Human
ugcuagugugugagauguucaa

SEQ ID NO: 669454 - RNA, 22 nt, Human
ucucaucuauucacauuaacug

SEQ ID NO: 669455 - RNA, 22 nt, Human
acuuucucaggaauucacagac

SEQ ID NO: 669456 - RNA, 22 nt, Human
ccuugaaauguucucacugggg

SEQ ID NO: 669457 - RNA, 22 nt, Human
ugccuguggaaaggcuggugcu

SEQ ID NO: 669458 - RNA, 22 nt, Human
uuagaaaugcacccaagaccua

SEQ ID NO: 669459 - RNA, 22 nt, Human
uuuccucuuuguaccuugacua

SEQ ID NO: 669460 - RNA, 22 nt, Human
agggccugggguagcuuacugc

SEQ ID NO: 669461 - RNA, 21 nt, Human
ucuguuggaggccucucuucc

SEQ ID NO: 669462 - RNA, 22 nt, Human
uuggaacagaaacagacaaaua

SEQ ID NO: 669463 - RNA, 22 nt, Human
augcugaagagugcacaggcua

SEQ ID NO: 669464 - RNA, 22 nt, Human
uaucuguuggcuccuaguugua

SEQ ID NO: 669465 - RNA, 22 nt, Human
aauggcuuuaggaauccagugc

SEQ ID NO: 669466 - RNA, 22 nt, Human
gacuggagcccccaaggacacc

SEQ ID NO: 669467 - RNA, 22 nt, Human
aacuuguuucuuccauucaaca

SEQ ID NO: 669468 - RNA, 22 nt, Human
cugcuuccugcugggauacuga

SEQ ID NO: 669469 - RNA, 22 nt, Human
cccagagcaugugcugccuuug

SEQ ID NO: 669470 - RNA, 18 nt, Human
ugcaggagugaccccggc

SEQ ID NO: 669471 - RNA, 22 nt, Human
agguggccggugccagccgggc

SEQ ID NO: 669472 - RNA, 22 nt, Human
aggcuccuuguucaucauccau

SEQ ID NO: 669473 - RNA, 22 nt, Human
ugucugaauuccacaucguucu

SEQ ID NO: 669474 - RNA, 22 nt, Human
aaacagcuaauggccaggaaua

SEQ ID NO: 669475 - RNA, 22 nt, Human
ugggcucauggcccagcacugg

SEQ ID NO: 669476 - RNA, 22 nt, Human
uauguagacaggcugcuuuucc

SEQ ID NO: 669477 - RNA, 20 nt, Human
aaauuguguuugugagcucc

SEQ ID NO: 669478 - RNA, 22 nt, Human
ugacccucuuccccaugcgcuc

SEQ ID NO: 669479 - RNA, 22 nt, Human
uaccugcacagccagccaugug

SEQ ID NO: 669480 - RNA, 22 nt, Human
ucacuuuugaucccuaugcagu

SEQ ID NO: 669481 - RNA, 20 nt, Human
uuuuccugugguuugauaug

SEQ ID NO: 669482 - RNA, 22 nt, Human
ccuggggccccgagccagaagc

SEQ ID NO: 669483 - RNA, 16 nt, Human
ucugccagggacaggc

SEQ ID NO: 669484 - RNA, 19 nt, Human
aaaaggagagaucagaguu

SEQ ID NO: 669485 - RNA, 22 nt, Human
auacacagcuacauugaacaau

SEQ ID NO: 669486 - RNA, 22 nt, Human
ucagcucucugggcucgaaccu

SEQ ID NO: 669487 - RNA, 22 nt, Human
cacugcuucuggaggaauuugg

SEQ ID NO: 669488 - RNA, 22 nt, Human
cucuggagucaggcagcccugg

SEQ ID NO: 669489 - RNA, 20 nt, Human
cuagaagcagaauugcugau

SEQ ID NO: 669490 - RNA, 22 nt, Human
gaccagcugauaaggcauauaa

SEQ ID NO: 669491 - RNA, 21 nt, Human
ugcagcagaguaagcagggga

SEQ ID NO: 669492 - RNA, 22 nt, Human
gucaggagauagggcaagcuuc

SEQ ID NO: 669493 - RNA, 21 nt, Human
uuucaauguguucuuuguagu

SEQ ID NO: 669494 - RNA, 22 nt, Human
acagacuggccugucucgcacc

SEQ ID NO: 669495 - RNA, 22 nt, Human
ugcuuuauguuaucagaagggu

SEQ ID NO: 669496 - RNA, 22 nt, Human
cagcuaggaaaccagagggcag

SEQ ID NO: 669497 - RNA, 22 nt, Human
ggucacauauccucgguuugga

SEQ ID NO: 669498 - RNA, 22 nt, Human
ucaguuucacagucugugcaga

SEQ ID NO: 669499 - RNA, 22 nt, Human
gcacuucaugacuuugucaaau

SEQ ID NO: 669500 - RNA, 22 nt, Human
gaaaggagggcucacaaaagug

SEQ ID NO: 669501 - RNA, 22 nt, Human
gaaguucuuagucucauuugca

SEQ ID NO: 669502 - RNA, 22 nt, Human
cucugcuguucuuauguguccu

SEQ ID NO: 669503 - RNA, 22 nt, Human
cugagaaaggaccucaaacagg

SEQ ID NO: 669504 - RNA, 17 nt, Human
cguggcugagccauaga

SEQ ID NO: 669505 - RNA, 22 nt, Human
uucagcagagaaauuacauaau

SEQ ID NO: 669506 - RNA, 22 nt, Human
guuuaauucccacaccugcccu

SEQ ID NO: 669507 - RNA, 22 nt, Human
augagcuucccagacaggaugg

SEQ ID NO: 669508 - RNA, 19 nt, Human
ccagcagguucauuucagg

SEQ ID NO: 669509 - RNA, 22 nt, Human
uuaauagauaugccucuagagu

SEQ ID NO: 669510 - RNA, 22 nt, Human
gugggcagaggagagaacauua

SEQ ID NO: 669511 - RNA, 22 nt, Human
cuccagagacacuucucaugau

SEQ ID NO: 669512 - RNA, 22 nt, Human
uuuaucuguauaucucaagugu

SEQ ID NO: 669513 - RNA, 22 nt, Human
augcaagauguauagaagacuu

SEQ ID NO: 669514 - RNA, 22 nt, Human
auggcuuucagauuucuauguu

SEQ ID NO: 669515 - RNA, 22 nt, Human
aaagcagucucagacuuaagca

SEQ ID NO: 669516 - RNA, 23 nt, Human
ucuggcuuccaguggguucaacc

SEQ ID NO: 669517 - RNA, 22 nt, Human
auguauaguggugaugauuaca

SEQ ID NO: 669518 - RNA, 18 nt, Human
ccucugccuuuguagagc

SEQ ID NO: 669519 - RNA, 22 nt, Human
ucauauauuuaguugugcaaca

SEQ ID NO: 669520 - RNA, 22 nt, Human
uuccuggcacauaguuagugcu

SEQ ID NO: 669521 - RNA, 22 nt, Human
uuuaggauauuaauguucagag

SEQ ID NO: 669522 - RNA, 22 nt, Human
gggccuguguguucaggagccu

SEQ ID NO: 669523 - RNA, 22 nt, Human
agugcauuauauguuucaaugg

SEQ ID NO: 669524 - RNA, 17 nt, Human
ugcagcaguucccaucu

SEQ ID NO: 669525 - RNA, 22 nt, Human
cuucaaggccuuccagguugaa

SEQ ID NO: 669526 - RNA, 22 nt, Human
agcaccagcaacuaugggcugc

SEQ ID NO: 669527 - RNA, 22 nt, Human
agugaaacagagcacagcaugc

SEQ ID NO: 669528 - RNA, 19 nt, Human
ugaccccacgcuccagagc

SEQ ID NO: 669529 - RNA, 22 nt, Human
aaugcagaguaaauauuuaauu

SEQ ID NO: 669530 - RNA, 22 nt, Human
ccugggucuccuccugcuggcu

SEQ ID NO: 669531 - RNA, 22 nt, Human
uuuccacaauuugagcagcaga

SEQ ID NO: 669532 - RNA, 19 nt, Human
ucagugugugggagguggu

SEQ ID NO: 669533 - RNA, 22 nt, Human
auccugcuuguuacuuauagag

SEQ ID NO: 669534 - RNA, 22 nt, Human
guauucagggcuagucagagga

SEQ ID NO: 669535 - RNA, 22 nt, Human
uacacagaggcugaugucuuag

SEQ ID NO: 669536 - RNA, 21 nt, Human
ucucuacaaauuauguuaggu

SEQ ID NO: 669537 - RNA, 22 nt, Human
cugugggcuccugcagcucagg

SEQ ID NO: 669538 - RNA, 22 nt, Human
caguuauuaugaggucauuagg

SEQ ID NO: 669539 - RNA, 22 nt, Human
uuuguacacaaccugugguagu

SEQ ID NO: 669540 - RNA, 22 nt, Human
ugcccucucaaguugagucaga

SEQ ID NO: 669541 - RNA, 20 nt, Human
uaggaaauauguuuuuaccc

SEQ ID NO: 669542 - RNA, 22 nt, Human
auaggcaaauuaauaagucaua

SEQ ID NO: 669543 - RNA, 22 nt, Human
aacagcaguggcaggagaaggc

SEQ ID NO: 669544 - RNA, 22 nt, Human
uaaguuacacuuaacuuacuag

SEQ ID NO: 669545 - RNA, 22 nt, Human
gggcaguguugcucucaaaguc

SEQ ID NO: 669546 - RNA, 22 nt, Human
uccggguuuuacacucacauca

SEQ ID NO: 669547 - RNA, 21 nt, Human
uccuggccagggcacuaggca

SEQ ID NO: 669548 - RNA, 22 nt, Human
aaccugcauguuucuaaaagca

SEQ ID NO: 669549 - RNA, 22 nt, Human
cacccaggcuagagugcagugg

SEQ ID NO: 669550 - RNA, 22 nt, Human
gcagagcaggggcugaaccugg

SEQ ID NO: 669551 - RNA, 22 nt, Human
guguacaggaugacuguacuua

SEQ ID NO: 669552 - RNA, 22 nt, Human
cacagagaauucccauauguga

SEQ ID NO: 669553 - RNA, 22 nt, Human
uuugaagucagacacugcuuug

SEQ ID NO: 669554 - RNA, 22 nt, Human
uucagucucaauuuaaguuuaa

SEQ ID NO: 669555 - RNA, 17 nt, Human
agaguuuuaagaaauuu

SEQ ID NO: 669556 - RNA, 22 nt, Human
aaagcuauuugugaguuauaga

SEQ ID NO: 669557 - RNA, 22 nt, Human
uggcacagacugggccaaggaa

SEQ ID NO: 669558 - RNA, 22 nt, Human
agcccuggggugcagaaccaug

SEQ ID NO: 669559 - RNA, 18 nt, Human
uggacaggguggagaaaa

SEQ ID NO: 669560 - RNA, 22 nt, Human
agugcuuucuugcuccaucagu

SEQ ID NO: 669561 - RNA, 20 nt, Human
uauugugauagguguuaauc

SEQ ID NO: 669562 - RNA, 22 nt, Human
agagaacaugacguaauagugg

SEQ ID NO: 669563 - RNA, 22 nt, Human
acuguuuuccuaaugagcaaga

SEQ ID NO: 669564 - RNA, 22 nt, Human
aggcuaauauuuaugaaaccaa

SEQ ID NO: 669565 - RNA, 21 nt, Human
ggcuggacaucccaggagacu

SEQ ID NO: 669566 - RNA, 22 nt, Human
guucccauacaguaucagugcu

SEQ ID NO: 669567 - RNA, 22 nt, Human
ccuguacagugaaugaauguga

SEQ ID NO: 669568 - RNA, 22 nt, Human
guuuuggagucaggcuuagaug

SEQ ID NO: 669569 - RNA, 22 nt, Human
uaaagccacuucauucuagucu

SEQ ID NO: 669570 - RNA, 22 nt, Human
gcagugugaccgagcuugcuuc

SEQ ID NO: 669571 - RNA, 22 nt, Human
cugucuucuccuuuguuucagg

SEQ ID NO: 669572 - RNA, 22 nt, Human
aguguuuauugugugccacaca

SEQ ID NO: 669573 - RNA, 22 nt, Human
acccagccuacaaagcucaccu

SEQ ID NO: 669574 - RNA, 22 nt, Human
uccagcucagaugcagggauca

SEQ ID NO: 669575 - RNA, 22 nt, Human
ugccagggacccugucggcccu

SEQ ID NO: 669576 - RNA, 22 nt, Human
guugcaggaagcacacacaugu

SEQ ID NO: 669577 - RNA, 22 nt, Human
agugcaaagaaaucagcuuugu

SEQ ID NO: 669578 - RNA, 22 nt, Human
cucugggauagagccucggucu

SEQ ID NO: 669579 - RNA, 22 nt, Human
acaucugaccauuacaagacau

SEQ ID NO: 669580 - RNA, 22 nt, Human
caggagcuggaucuccuugcgg

SEQ ID NO: 669581 - RNA, 22 nt, Human
gcauggcuucugccaggcaccu

SEQ ID NO: 669582 - RNA, 22 nt, Human
agccucucuccagcuuggcaga

SEQ ID NO: 669583 - RNA, 22 nt, Human
aacaguaaagacagaauuuauc

SEQ ID NO: 669584 - RNA, 22 nt, Human
ugauuuccacagucaggggugc

SEQ ID NO: 669585 - RNA, 22 nt, Human
ugcagcugguaucccauggauu

SEQ ID NO: 669586 - RNA, 19 nt, Human
cuuuucaucaacagccaau

SEQ ID NO: 669587 - RNA, 22 nt, Human
gggcuggcugauuuuccucucu

SEQ ID NO: 669588 - RNA, 22 nt, Human
ccaggggcucucagggugugug

SEQ ID NO: 669589 - RNA, 17 nt, Human
cugcagcuggagggcca

SEQ ID NO: 669590 - RNA, 22 nt, Human
cccuuuccugaagaauauuuuu

SEQ ID NO: 669591 - RNA, 22 nt, Human
cauuguuugagcaucugggauc

SEQ ID NO: 669592 - RNA, 19 nt, Human
ugagaaggcaguggggagc

SEQ ID NO: 669593 - RNA, 22 nt, Human
ccagcuuuggaguguuguugcu

SEQ ID NO: 669594 - RNA, 22 nt, Human
ucugcguccaucugccugcuug

SEQ ID NO: 669595 - RNA, 22 nt, Human
caucauuucacuuagaugaagu

SEQ ID NO: 669596 - RNA, 22 nt, Human
ugaagaauaaaugguugagacu

SEQ ID NO: 669597 - RNA, 22 nt, Human
aaaguuuccaaguuacaccauu

SEQ ID NO: 669598 - RNA, 22 nt, Human
ucucugaguuguaaaaaauagu

SEQ ID NO: 669599 - RNA, 22 nt, Human
agaaaccuccauuuauucacuc

SEQ ID NO: 669600 - RNA, 22 nt, Human
gcagacugcgagcgugcuggug

SEQ ID NO: 669601 - RNA, 21 nt, Human
gccucugcugucuuauuguga

SEQ ID NO: 669602 - RNA, 17 nt, Human
agguauaaaaugguagc

SEQ ID NO: 669603 - RNA, 22 nt, Human
cuggaagaguccuaaacagaua

SEQ ID NO: 669604 - RNA, 23 nt, Human
ugaagugaaauuucacaagggac

SEQ ID NO: 669605 - RNA, 22 nt, Human
acauuuguaugcguuuuuacug

SEQ ID NO: 669606 - RNA, 22 nt, Human
agaaguaguccaguggaaagua

SEQ ID NO: 669607 - RNA, 22 nt, Human
agggcucugagcuggaccaccu

SEQ ID NO: 669608 - RNA, 22 nt, Human
ugcacacauguuuacaagcauc

SEQ ID NO: 669609 - RNA, 22 nt, Human
aacuaaaguaaccaaggauauc

SEQ ID NO: 669610 - RNA, 22 nt, Human
gcucccucugcucaggcacuug

SEQ ID NO: 669611 - RNA, 22 nt, Human
uggcagcacuugaacuugagcc

SEQ ID NO: 669612 - RNA, 22 nt, Human
augggugugaaaauggucaucu

SEQ ID NO: 669613 - RNA, 22 nt, Human
ggcacuggccuggggccaagag

SEQ ID NO: 669614 - RNA, 22 nt, Human
ggacagagcagacgagcagcgg

SEQ ID NO: 669615 - RNA, 22 nt, Human
aguaaugugccugaaauacuug

SEQ ID NO: 669616 - RNA, 22 nt, Human
ccaaaguccauaguuuacauua

SEQ ID NO: 669617 - RNA, 22 nt, Human
ccuguccccucacaaugccacu

SEQ ID NO: 669618 - RNA, 19 nt, Human
uuucucucccucaucccga

SEQ ID NO: 669619 - RNA, 18 nt, Human
cuuccucuucuggagaaa

SEQ ID NO: 669620 - RNA, 22 nt, Human
cagugauggauauggagaaguc

SEQ ID NO: 669621 - RNA, 22 nt, Human
cagcucccagaacugaccaugu

SEQ ID NO: 669622 - RNA, 22 nt, Human
cugggccuccucugcccaagcu

SEQ ID NO: 669623 - RNA, 18 nt, Human
uuugaaggauggccugga

SEQ ID NO: 669624 - RNA, 22 nt, Human
guguaauugaaauugagaacca

SEQ ID NO: 669625 - RNA, 19 nt, Human
ggcucagggcgcugccgcc

SEQ ID NO: 669626 - RNA, 22 nt, Human
aaauugcuuauaaagaugaaug

SEQ ID NO: 669627 - RNA, 22 nt, Human
gaacagcagcuuccugggaauu

SEQ ID NO: 669628 - RNA, 22 nt, Human
ggucccugguucccucugagcu

SEQ ID NO: 669629 - RNA, 22 nt, Human
guacaugcagauuauagcuaau

SEQ ID NO: 669630 - RNA, 22 nt, Human
cagggcauccgugcuccaugcu

SEQ ID NO: 669631 - RNA, 22 nt, Human
aaguucaaggugauaguggcag

SEQ ID NO: 669632 - RNA, 22 nt, Human
cugaggcuuguccucucagcuu

SEQ ID NO: 669633 - RNA, 22 nt, Human
uugauuacuauguguugaaagc

SEQ ID NO: 669634 - RNA, 23 nt, Human
uggcucagcuaguuuuccauuuc

SEQ ID NO: 669635 - RNA, 22 nt, Human
acccaggagacagguugcagug

SEQ ID NO: 669636 - RNA, 22 nt, Human
aaccugagucuuuugauuugcu

SEQ ID NO: 669637 - RNA, 22 nt, Human
cagcagccagacaagauacauc

SEQ ID NO: 669638 - RNA, 22 nt, Human
uuccaagagccuuucuucuaga

SEQ ID NO: 669639 - RNA, 22 nt, Human
ugguccugguagcggugugcuu

SEQ ID NO: 669640 - RNA, 21 nt, Human
cugcccauuugugaugucccc

SEQ ID NO: 669641 - RNA, 22 nt, Human
ugcucaggaggaggcugugagg

SEQ ID NO: 669642 - RNA, 22 nt, Human
cugggaugauagugcuaguauu

SEQ ID NO: 669643 - RNA, 22 nt, Human
cagucucuuuauccaccaagcc

SEQ ID NO: 669644 - RNA, 22 nt, Human
aggggagccgaggggcaucugu

SEQ ID NO: 669645 - RNA, 22 nt, Human
gcugagguuuucugccugcuca

SEQ ID NO: 669646 - RNA, 22 nt, Human
agggaugcuuugcugacagauu

SEQ ID NO: 669647 - RNA, 19 nt, Human
agccagcaggccucugagc

SEQ ID NO: 669648 - RNA, 22 nt, Human
ucaaaguuacuugugguuuucu

SEQ ID NO: 669649 - RNA, 22 nt, Human
gggcaggugugcagagcuguug

SEQ ID NO: 669650 - RNA, 22 nt, Human
uggaacacuguggaugagaaga

SEQ ID NO: 669651 - RNA, 22 nt, Human
ggggcagggagguuaucgccga

SEQ ID NO: 669652 - RNA, 22 nt, Human
aaggaaccauuugugugcaugg

SEQ ID NO: 669653 - RNA, 22 nt, Human
aguguccuggcaaggguuucag

SEQ ID NO: 669654 - RNA, 22 nt, Human
agcaaguguaagaaugcagaau

SEQ ID NO: 669655 - RNA, 22 nt, Human
guccuuugaaggcaaaaggaga

SEQ ID NO: 669656 - RNA, 22 nt, Human
uuugugaacaaacaugaagaug

SEQ ID NO: 669657 - RNA, 22 nt, Human
cacaauuuguuugcucuuaguc

SEQ ID NO: 669658 - RNA, 22 nt, Human
uucuuucuucucaggcugggua

SEQ ID NO: 669659 - RNA, 22 nt, Human
gggguugguuuaaaugcuugag

SEQ ID NO: 669660 - RNA, 22 nt, Human
acccugggaccuggagguggau

SEQ ID NO: 669661 - RNA, 22 nt, Human
ugcauuggaaacucagcagcac

SEQ ID NO: 669662 - RNA, 22 nt, Human
uggcagggagccaccggucaug

SEQ ID NO: 669663 - RNA, 22 nt, Human
agcuuuaaaucaauccagugag

SEQ ID NO: 669664 - RNA, 22 nt, Human
uuucaaugacacaaaagagaaa

SEQ ID NO: 669665 - RNA, 22 nt, Human
acauucuuucaccuugugucca

SEQ ID NO: 669666 - RNA, 22 nt, Human
augaggucauccuggaguaagg

SEQ ID NO: 669667 - RNA, 21 nt, Human
uuuuacagaugaggggaaggg

SEQ ID NO: 669668 - RNA, 20 nt, Human
agcggcagcuuccugcuucg

SEQ ID NO: 669669 - RNA, 22 nt, Human
gacauaauaaucugaccuagau

SEQ ID NO: 669670 - RNA, 22 nt, Human
ucagcugccccaguggccccag

SEQ ID NO: 669671 - RNA, 20 nt, Human
ggaaacauuuuuauuuccau

SEQ ID NO: 669672 - RNA, 22 nt, Human
uuaagauuuucuucaguauuau

SEQ ID NO: 669673 - RNA, 22 nt, Human
caugaagcauguuuugucauga

SEQ ID NO: 669674 - RNA, 22 nt, Human
aucauucuaguccuuauggucu

SEQ ID NO: 669675 - RNA, 22 nt, Human
agcagcaacuuauuuuucuuau

SEQ ID NO: 669676 - RNA, 22 nt, Human
gcucuccaggucucaugcacug

SEQ ID NO: 669677 - RNA, 22 nt, Human
ucugaggguuguagagagggac

SEQ ID NO: 669678 - RNA, 22 nt, Human
gacuacucaaacuuucucuaua

SEQ ID NO: 669679 - RNA, 22 nt, Human
auuaaauuggaucugcauaguu

SEQ ID NO: 669680 - RNA, 22 nt, Human
cugguucugauuuugcugcauu

SEQ ID NO: 669681 - RNA, 19 nt, Human
ucugccucuggucaggcuc

SEQ ID NO: 669682 - RNA, 22 nt, Human
aaagacuggaaggugaggcugu

SEQ ID NO: 669683 - RNA, 22 nt, Human
auuucuguauccugcugucaga

SEQ ID NO: 669684 - RNA, 23 nt, Human
ccuggggcacuugaguccucauc

SEQ ID NO: 669685 - RNA, 22 nt, Human
ugcucuguucaguguaucuugu

SEQ ID NO: 669686 - RNA, 22 nt, Human
gucugcccuuggccugggacuu

SEQ ID NO: 669687 - RNA, 22 nt, Human
agagucugaaugcucagaguug

SEQ ID NO: 669688 - RNA, 20 nt, Human
acagaaagcugccuuguccc

SEQ ID NO: 669689 - RNA, 22 nt, Human
accauuuuggguauuuucagag

SEQ ID NO: 669690 - RNA, 22 nt, Human
guaaacaacacaaaucauuuga

SEQ ID NO: 669691 - RNA, 22 nt, Human
uuacacaaacacauuccagaua

SEQ ID NO: 669692 - RNA, 22 nt, Human
aacaggcagcagacugaaucug

SEQ ID NO: 669693 - RNA, 22 nt, Human
uccuggggaggucgaggcugag

SEQ ID NO: 669694 - RNA, 22 nt, Human
acucugcuauugcagugcaaaa

SEQ ID NO: 669695 - RNA, 21 nt, Human
guuugcaugaacaagucagcc

SEQ ID NO: 669696 - RNA, 22 nt, Human
ugcaauuucaaauaucagaaag

SEQ ID NO: 669697 - RNA, 23 nt, Human
ugggucagcugccuccaggacaa

SEQ ID NO: 669698 - RNA, 22 nt, Human
aggcccuuggacucaugcucga

SEQ ID NO: 669699 - RNA, 22 nt, Human
cuguuucagcuacuguuccaug

SEQ ID NO: 669700 - RNA, 22 nt, Human
accaguggaauuauucuguggu

SEQ ID NO: 669701 - RNA, 22 nt, Human
uacaaauguauuuuauuuuggu

SEQ ID NO: 669702 - RNA, 22 nt, Human
cuacugaugcuauacuucucag

SEQ ID NO: 669703 - RNA, 22 nt, Human
auaaugcugggagaaauuguua

SEQ ID NO: 669704 - RNA, 22 nt, Human
aaaggcaugugcaacuacaaau

SEQ ID NO: 669705 - RNA, 22 nt, Human
gcagcauacagggagaguacuc

SEQ ID NO: 669706 - RNA, 22 nt, Human
ucacaucugugugauugucauu

SEQ ID NO: 669707 - RNA, 22 nt, Human
aggcugcagaacagucaggugc

SEQ ID NO: 669708 - RNA, 22 nt, Human
gcucccagauuucagccuugug

SEQ ID NO: 669709 - RNA, 22 nt, Human
guccucaggcuugaguguuuau

SEQ ID NO: 669710 - RNA, 22 nt, Human
gcacugagcaccagccacagau

SEQ ID NO: 669711 - RNA, 22 nt, Human
ucacagcauuuuuagaaagauu

SEQ ID NO: 669712 - RNA, 22 nt, Human
aacuucaguugagaaaggcaug

SEQ ID NO: 669713 - RNA, 22 nt, Human
gcaguauauggauuuuaaacau

SEQ ID NO: 669714 - RNA, 22 nt, Human
gagcuccagcaucucugccaaa

SEQ ID NO: 669715 - RNA, 22 nt, Human
ucacaugcccuaccuaaucuua

SEQ ID NO: 669716 - RNA, 22 nt, Human
gguguccuugcagaaggcggcg

SEQ ID NO: 669717 - RNA, 22 nt, Human
ccucccagugccggggccggcu

SEQ ID NO: 669718 - RNA, 23 nt, Human
aaaugcacaguauugauuuuuaa

SEQ ID NO: 669719 - RNA, 22 nt, Human
ugucagccuugcuuuagcgguu

SEQ ID NO: 669720 - RNA, 15 nt, Human
agucaaaucuguuuu

SEQ ID NO: 669721 - RNA, 23 nt, Human
cucuccugaaggacaagcugccg

SEQ ID NO: 669722 - RNA, 22 nt, Human
ucucagagauuuuguuucccuu

SEQ ID NO: 669723 - RNA, 20 nt, Human
caguccugccccuuggggac

SEQ ID NO: 669724 - RNA, 22 nt, Human
acauguguggccgcuguagaca

SEQ ID NO: 669725 - RNA, 22 nt, Human
gcacaugucuuauucacuguua

SEQ ID NO: 669726 - RNA, 22 nt, Human
uccaggagguagugcuuaauuu

SEQ ID NO: 669727 - RNA, 22 nt, Human
uuaaaagggauguuaucuguaa

SEQ ID NO: 669728 - RNA, 22 nt, Human
ugguccugggcacaguauaugc

SEQ ID NO: 669729 - RNA, 22 nt, Human
ucucugaguuuuaaggaugaug

SEQ ID NO: 669730 - RNA, 22 nt, Human
agaaaauuuauucauguuaguu

SEQ ID NO: 669731 - RNA, 22 nt, Human
aggggaauggguagacuguuga

SEQ ID NO: 669732 - RNA, 22 nt, Human
aaugaguucugguucauuuuau

SEQ ID NO: 669733 - RNA, 22 nt, Human
uagucagcaugaaauaagcagc

SEQ ID NO: 669734 - RNA, 22 nt, Human
aagugugggaaguagguggcga

SEQ ID NO: 669735 - RNA, 22 nt, Human
ugauuguauagggguuauuaau

SEQ ID NO: 669736 - RNA, 22 nt, Human
ucaagacagugugauacuggcc

SEQ ID NO: 669737 - RNA, 22 nt, Human
gcagggacugugaucucacaga

SEQ ID NO: 669738 - RNA, 19 nt, Human
gcccugcaggagguggggc

SEQ ID NO: 669739 - RNA, 22 nt, Human
uuguaacaucaccaucaaaauc

SEQ ID NO: 669740 - RNA, 22 nt, Human
acaaacuaaaauucuuuauuga

SEQ ID NO: 669741 - RNA, 22 nt, Human
cuuguauuaagcuuagagaggc

SEQ ID NO: 669742 - RNA, 22 nt, Human
agucugugcuguuggugaggau

SEQ ID NO: 669743 - RNA, 22 nt, Human
agcaaagcuaccaauuauugag

SEQ ID NO: 669744 - RNA, 22 nt, Human
aggagcugggcugcugcuggga

SEQ ID NO: 669745 - RNA, 22 nt, Human
gcucagggucccuuggugcugg

SEQ ID NO: 669746 - RNA, 22 nt, Human
acagaccaaguuuccagcaggu

SEQ ID NO: 669747 - RNA, 22 nt, Human
auggccagggccaaaagagaug

SEQ ID NO: 669748 - RNA, 22 nt, Human
cccuggagggauuucucaauca

SEQ ID NO: 669749 - RNA, 22 nt, Human
aaaucaucucugcauccuuagc

SEQ ID NO: 669750 - RNA, 22 nt, Human
ugccaggcauuugacagacacu

SEQ ID NO: 669751 - RNA, 22 nt, Human
ccaucccuccuccaccagcuag

SEQ ID NO: 669752 - RNA, 22 nt, Human
ucacuugagauguaccacaaac

SEQ ID NO: 669753 - RNA, 22 nt, Human
agcucagggcaaagacucaaau

SEQ ID NO: 669754 - RNA, 20 nt, Human
ucugaacaaaauguaauguc

SEQ ID NO: 669755 - RNA, 22 nt, Human
ucugcuguuuacugugugauau

SEQ ID NO: 669756 - RNA, 22 nt, Human
ugacuugucaaagaaaugugug

SEQ ID NO: 669757 - RNA, 22 nt, Human
ugugccagucauccagaugugu

SEQ ID NO: 669758 - RNA, 22 nt, Human
uguauuuccugguuuagaucaa

SEQ ID NO: 669759 - RNA, 22 nt, Human
agugcuuuagcauccaacuguc

SEQ ID NO: 669760 - RNA, 22 nt, Human
agagccaggaucuguuuugggg

SEQ ID NO: 669761 - RNA, 22 nt, Human
cuucagugaauguugaguaagg

SEQ ID NO: 669762 - RNA, 22 nt, Human
ucugggucacugugggagggca

SEQ ID NO: 669763 - RNA, 22 nt, Human
aauagcugggaggcacauucau

SEQ ID NO: 669764 - RNA, 22 nt, Human
uacuauuuggaauuuuaaauug

SEQ ID NO: 669765 - RNA, 22 nt, Human
cuggagcugucuucacaggccu

SEQ ID NO: 669766 - RNA, 22 nt, Human
cagggcuguggaaaacuggugc

SEQ ID NO: 669767 - RNA, 23 nt, Human
agucaguguaaguuuggaaugca

SEQ ID NO: 669768 - RNA, 22 nt, Human
gcuggaaaucauauuuuguugu

SEQ ID NO: 669769 - RNA, 22 nt, Human
gaugcacuugccccuccucaga

SEQ ID NO: 669770 - RNA, 22 nt, Human
cugaggcucagcgugaggaaag

SEQ ID NO: 669771 - RNA, 22 nt, Human
agguucacacacacaaaaagau

SEQ ID NO: 669772 - RNA, 22 nt, Human
uuaggucauucccugagcagau

SEQ ID NO: 669773 - RNA, 22 nt, Human
uggaauguuuccccagccugca

SEQ ID NO: 669774 - RNA, 22 nt, Human
gagauucuguagucaggcaucu

SEQ ID NO: 669775 - RNA, 22 nt, Human
guauuucuagaaaaugcagauu

SEQ ID NO: 669776 - RNA, 22 nt, Human
guguaaggccccagguucuuua

SEQ ID NO: 669777 - RNA, 22 nt, Human
ugaacaaacugcauucuucacu

SEQ ID NO: 669778 - RNA, 22 nt, Human
cugcuguguuggcauuggauag

SEQ ID NO: 669779 - RNA, 22 nt, Human
gaacaucaaggucugugucuag

SEQ ID NO: 669780 - RNA, 22 nt, Human
ccugccuauguaagugguuucu

SEQ ID NO: 669781 - RNA, 22 nt, Human
aagauaauauucauuaacuaga

SEQ ID NO: 669782 - RNA, 22 nt, Human
acugcugauuuagcuuuguggg

SEQ ID NO: 669783 - RNA, 22 nt, Human
aaggggugggcauuagagcagu

SEQ ID NO: 669784 - RNA, 22 nt, Human
ggaaggaaauuggggcaguugu

SEQ ID NO: 669785 - RNA, 22 nt, Human
uaauacuugcuuuggauguaug

SEQ ID NO: 669786 - RNA, 22 nt, Human
auggguaaagcaggaagagagu

SEQ ID NO: 669787 - RNA, 22 nt, Human
agucacaugcauuuucuucaau

SEQ ID NO: 669788 - RNA, 22 nt, Human
uacuucaauuuguauaugugaa

SEQ ID NO: 669789 - RNA, 22 nt, Human
agauuucccucuuguauuugca

SEQ ID NO: 669790 - RNA, 22 nt, Human
ucagaauaugcuaaugacauuu

SEQ ID NO: 669791 - RNA, 22 nt, Human
gagcucccuggagguucagaua

SEQ ID NO: 669792 - RNA, 18 nt, Human
acugggccagcaggcagg

SEQ ID NO: 669793 - RNA, 20 nt, Human
gagcugaguguggucauggg

SEQ ID NO: 669794 - RNA, 22 nt, Human
agacauuuauucacacauuuau

SEQ ID NO: 669795 - RNA, 22 nt, Human
aaguaaucuggaauuugguuuu

SEQ ID NO: 669796 - RNA, 22 nt, Human
cugcuguguggugaaacucagu

SEQ ID NO: 669797 - RNA, 22 nt, Human
aaacuguauauuuauggcaugu

SEQ ID NO: 669798 - RNA, 22 nt, Human
uccucuggggcgugguccugga

SEQ ID NO: 669799 - RNA, 22 nt, Human
uuugaacaagagcuucacauua

SEQ ID NO: 669800 - RNA, 17 nt, Human
gguggaaguuucuaguu

SEQ ID NO: 669801 - RNA, 22 nt, Human
ggcucagaaggccaugcucugc

SEQ ID NO: 669802 - RNA, 20 nt, Human
gauuucaaagcagaguggcc

SEQ ID NO: 669803 - RNA, 22 nt, Human
aaagugcauucgaaaguccauc

SEQ ID NO: 669804 - RNA, 22 nt, Human
augcauauugauuauagauuca

SEQ ID NO: 669805 - RNA, 22 nt, Human
cccagcucaagcagagagcuaa

SEQ ID NO: 669806 - RNA, 22 nt, Human
uucaauucuaaacuaauauucu

SEQ ID NO: 669807 - RNA, 22 nt, Human
caugcugauucuuccugagcuu

SEQ ID NO: 669808 - RNA, 22 nt, Human
acagauauuuaagagcuuuugu

SEQ ID NO: 669809 - RNA, 22 nt, Human
aggcuaggggaacacuagaauc

SEQ ID NO: 669810 - RNA, 22 nt, Human
gugggcaguucaauucugggag

SEQ ID NO: 669811 - RNA, 22 nt, Human
gugucagauguccagggcagca

SEQ ID NO: 669812 - RNA, 22 nt, Human
aauagcaucuucccugguaacc

SEQ ID NO: 669813 - RNA, 22 nt, Human
agaggcucagaggccugguccu

SEQ ID NO: 669814 - RNA, 22 nt, Human
ucuggcucacuucaggcuucac

SEQ ID NO: 669815 - RNA, 22 nt, Human
gcuucugcgcacgcuucuuccc

SEQ ID NO: 669816 - RNA, 22 nt, Human
aagauguaaaggcaauauaaag

SEQ ID NO: 669817 - RNA, 22 nt, Human
cagcaugacagucugcagcaga

SEQ ID NO: 669818 - RNA, 22 nt, Human
agcccagccugauucuacaccc

SEQ ID NO: 669819 - RNA, 22 nt, Human
agauggugauagagcugggauu

SEQ ID NO: 669820 - RNA, 22 nt, Human
agagugauucuaguuagggaau

SEQ ID NO: 669821 - RNA, 22 nt, Human
ucuuuuaaaagcccugcugucu

SEQ ID NO: 669822 - RNA, 23 nt, Human
gcacauacuacacagaaaauggc

SEQ ID NO: 669823 - RNA, 22 nt, Human
caugagugucaucucagcagcu

SEQ ID NO: 669824 - RNA, 22 nt, Human
aagcugccuagaguugaauguc

SEQ ID NO: 669825 - RNA, 22 nt, Human
uuccacaagugauaucuagcug

SEQ ID NO: 669826 - RNA, 22 nt, Human
uggcucugugaacagacgacug

SEQ ID NO: 669827 - RNA, 22 nt, Human
agagugcaaccgaaacaagcag

SEQ ID NO: 669828 - RNA, 22 nt, Human
gagguccagccaagcggcaagg

SEQ ID NO: 669829 - RNA, 22 nt, Human
gccaauuuaucuuacucgugcu

SEQ ID NO: 669830 - RNA, 18 nt, Human
ucacagugcucuugccua

SEQ ID NO: 669831 - RNA, 17 nt, Human
gggcgcggguagagccc

SEQ ID NO: 669832 - RNA, 22 nt, Human
acaacaaaaucacuagucuucc

SEQ ID NO: 669833 - RNA, 22 nt, Human
gcagggucgcucuaggagauca

SEQ ID NO: 669834 - RNA, 22 nt, Human
gauguguuuccaggauuuguuu

SEQ ID NO: 669835 - RNA, 17 nt, Human
cuaaauacuugcguuuc

SEQ ID NO: 669836 - RNA, 22 nt, Human
agccaggggauucaucagggac

SEQ ID NO: 669837 - RNA, 22 nt, Human
gauuccacggcucagccucaac

SEQ ID NO: 669838 - RNA, 22 nt, Human
cugcagaucuuguguacuuguc

SEQ ID NO: 669839 - RNA, 22 nt, Human
gugcuguuuugagugcuacccc

SEQ ID NO: 669840 - RNA, 22 nt, Human
uuaaagauucugaggcugauua

SEQ ID NO: 669841 - RNA, 22 nt, Human
ugugaggagggucaaacugagu

SEQ ID NO: 669842 - RNA, 22 nt, Human
ucucuaguauaauauagcaaaa

SEQ ID NO: 669843 - RNA, 22 nt, Human
aaagcugcuuuaaacaucuaug

SEQ ID NO: 669844 - RNA, 22 nt, Human
gcagagaccccgcagugaggcc

SEQ ID NO: 669845 - RNA, 22 nt, Human
aguaaaauuguauuggaaaaca

SEQ ID NO: 669846 - RNA, 22 nt, Human
gcugucucgccugacacuggcu

SEQ ID NO: 669847 - RNA, 22 nt, Human
auauuccuguuuuuaacacuuu

SEQ ID NO: 669848 - RNA, 22 nt, Human
cucuuuucaaaauuucacugca

SEQ ID NO: 669849 - RNA, 22 nt, Human
gcuguggccuaguuuguuauau

SEQ ID NO: 669850 - RNA, 22 nt, Human
aagucaaucacaugcacacuga

SEQ ID NO: 669851 - RNA, 22 nt, Human
accuuugguaaguuuccaaaac

SEQ ID NO: 669852 - RNA, 22 nt, Human
agggcaauccagccagcugauc

SEQ ID NO: 669853 - RNA, 22 nt, Human
cuaaggguugaaacagcaagaa

SEQ ID NO: 669854 - RNA, 22 nt, Human
uuuuauugcaauaaagugugua

SEQ ID NO: 669855 - RNA, 22 nt, Human
ucucccaaggcacagaaagagu

SEQ ID NO: 669856 - RNA, 22 nt, Human
aaagcaaucuaguuccaauucu

SEQ ID NO: 669857 - RNA, 17 nt, Human
cucuguacaggaaagag

SEQ ID NO: 669858 - RNA, 22 nt, Human
cagaacugggcagggagcagag

SEQ ID NO: 669859 - RNA, 22 nt, Human
ucccaaaguauuagcauuucaa

SEQ ID NO: 669860 - RNA, 22 nt, Human
ugcaugcacuuggcuggcacgu

SEQ ID NO: 669861 - RNA, 22 nt, Human
ccagugcauaaucaauacagcc

SEQ ID NO: 669862 - RNA, 22 nt, Human
uccuguuucuccugcaaaaucc

SEQ ID NO: 669863 - RNA, 22 nt, Human
cccaggagguggagguugcagc

SEQ ID NO: 669864 - RNA, 22 nt, Human
ugacuuuaaagcucacucuuuu

SEQ ID NO: 669865 - RNA, 22 nt, Human
ugcggcagccaccgcguggccc

SEQ ID NO: 669866 - RNA, 22 nt, Human
cagguccuggcaucaggcaggu

SEQ ID NO: 669867 - RNA, 22 nt, Human
cuggcuugggucuaccugccuu

SEQ ID NO: 669868 - RNA, 22 nt, Human
gacagcagaauccauucccagu

SEQ ID NO: 669869 - RNA, 22 nt, Human
cugggggcaauggucagagugu

SEQ ID NO: 669870 - RNA, 22 nt, Human
gugacagucaaagacaugacuu

SEQ ID NO: 669871 - RNA, 22 nt, Human
gagagggcaaacuuguagcuaa

SEQ ID NO: 669872 - RNA, 22 nt, Human
aguuaacuaaacugugaguaaa

SEQ ID NO: 669873 - RNA, 22 nt, Human
uuguaugaccacaaucugacgu

SEQ ID NO: 669874 - RNA, 19 nt, Human
aacaucauggcucuuucca

SEQ ID NO: 669875 - RNA, 22 nt, Human
cacaguguggcaaauuucaacu

SEQ ID NO: 669876 - RNA, 22 nt, Human
agaaaccagggcuuaccagugc

SEQ ID NO: 669877 - RNA, 22 nt, Human
gugcauuugugcaugcacaugu

SEQ ID NO: 669878 - RNA, 16 nt, Human
ccucuggcaauuagau

SEQ ID NO: 669879 - RNA, 22 nt, Human
ugguccuucguggugcaguucu

SEQ ID NO: 669880 - RNA, 22 nt, Human
uaaagcacauaucuuacaauaa

SEQ ID NO: 669881 - RNA, 23 nt, Human
aauuaaauugcuagauccagggc

SEQ ID NO: 669882 - RNA, 22 nt, Human
agggcugccccaguccagccgg

SEQ ID NO: 669883 - RNA, 22 nt, Human
ggcacugcagguaagugcuguc

SEQ ID NO: 669884 - RNA, 22 nt, Human
ccagugugaccaucuguuagcu

SEQ ID NO: 669885 - RNA, 22 nt, Human
augaaacagugaauuagucaag

SEQ ID NO: 669886 - RNA, 22 nt, Human
uggcuggaccugggcuggaauu

SEQ ID NO: 669887 - RNA, 22 nt, Human
ggcugaggcucaugccaucuug

SEQ ID NO: 669888 - RNA, 22 nt, Human
acagagguggaccucagcaggc

SEQ ID NO: 669889 - RNA, 20 nt, Human
agaggccaguuaggagucua

SEQ ID NO: 669890 - RNA, 22 nt, Human
aaguggugguaugaaccgaggg

SEQ ID NO: 669891 - RNA, 22 nt, Human
auuguauuuaggagaaaagggu

SEQ ID NO: 669892 - RNA, 22 nt, Human
auuauuaggugcucucugacaa

SEQ ID NO: 669893 - RNA, 22 nt, Human
acaaggaacaagcauguaguuu

SEQ ID NO: 669894 - RNA, 22 nt, Human
uagcuguugggagagggcuaga

SEQ ID NO: 669895 - RNA, 22 nt, Human
cucuuaaaaacuugauauauuu

SEQ ID NO: 669896 - RNA, 18 nt, Human
aaacuguauuucuuucua

SEQ ID NO: 669897 - RNA, 22 nt, Human
ccccagcacuaccagaagccag

SEQ ID NO: 669898 - RNA, 22 nt, Human
aacugcauucagaaagcucacu

SEQ ID NO: 669899 - RNA, 22 nt, Human
ccaucccugccauuauagccca

SEQ ID NO: 669900 - RNA, 22 nt, Human
acguggagccacagauggagca

SEQ ID NO: 669901 - RNA, 22 nt, Human
accagcuguuaucuguaguauc

SEQ ID NO: 669902 - RNA, 17 nt, Human
auggaggcagacagguc

SEQ ID NO: 669903 - RNA, 22 nt, Human
agaggccagcccaggccaccga

SEQ ID NO: 669904 - RNA, 22 nt, Human
cccaaaguacaaguaaacaugu

SEQ ID NO: 669905 - RNA, 22 nt, Human
auguagagcuccuugauccucc

SEQ ID NO: 669906 - RNA, 22 nt, Human
gcuggggucugugaggagggcu

SEQ ID NO: 669907 - RNA, 22 nt, Human
ucuggggaccauggcaucuaaa

SEQ ID NO: 669908 - RNA, 22 nt, Human
cagcaaaagccagcauaagcuc

SEQ ID NO: 669909 - RNA, 22 nt, Human
ucauugaagacuuacuggcuuc

SEQ ID NO: 669910 - RNA, 22 nt, Human
augcuauuccagaauguaaauu

SEQ ID NO: 669911 - RNA, 22 nt, Human
ccuccagguguuacauaugacu

SEQ ID NO: 669912 - RNA, 22 nt, Human
cugauucuuugaagaugcaccc

SEQ ID NO: 669913 - RNA, 22 nt, Human
guccugggggcagcugugucca

SEQ ID NO: 669914 - RNA, 22 nt, Human
cuuggaacaaauuaaacaauac

SEQ ID NO: 669915 - RNA, 22 nt, Human
gcugucugagaacaugguggaa

SEQ ID NO: 669916 - RNA, 22 nt, Human
agcagacauggcuuggaugugg

SEQ ID NO: 669917 - RNA, 22 nt, Human
acuggggcaggaaaguaugcug

SEQ ID NO: 669918 - RNA, 22 nt, Human
uucaguucacauguaucauggc

SEQ ID NO: 669919 - RNA, 22 nt, Human
cacugcuuuaaggcugaguaac

SEQ ID NO: 669920 - RNA, 17 nt, Human
gugcagggaugaaggau

SEQ ID NO: 669921 - RNA, 22 nt, Human
gucuggaagagcaggaauaaac

SEQ ID NO: 669922 - RNA, 16 nt, Human
aggcagagauuuaccc

SEQ ID NO: 669923 - RNA, 22 nt, Human
cucagcuacuugggaagcuuag

SEQ ID NO: 669924 - RNA, 22 nt, Human
augugagggcucaggcugacug

SEQ ID NO: 669925 - RNA, 22 nt, Human
aagaagcagcugccaggccagu

SEQ ID NO: 669926 - RNA, 22 nt, Human
ucucuucuauuugagacuauuu

SEQ ID NO: 669927 - RNA, 20 nt, Human
gcuugcuuugucugaugggc

SEQ ID NO: 669928 - RNA, 22 nt, Human
agugcucacucuccacagugcc

SEQ ID NO: 669929 - RNA, 22 nt, Human
uucagcgauauuauucaugagc

SEQ ID NO: 669930 - RNA, 22 nt, Human
uuuccuucccuggaugagaagu

SEQ ID NO: 669931 - RNA, 23 nt, Human
agagaaaaauaucugggcacauu

SEQ ID NO: 669932 - RNA, 22 nt, Human
gaaaccugugcugauuuguuag

SEQ ID NO: 669933 - RNA, 22 nt, Human
gagcugagucugcagucgccau

SEQ ID NO: 669934 - RNA, 22 nt, Human
cuggcugggguaccaguugaac

SEQ ID NO: 669935 - RNA, 22 nt, Human
ugcuaaauaacuuacauagugg

SEQ ID NO: 669936 - RNA, 22 nt, Human
ugaggccagucucaucacaggc

SEQ ID NO: 669937 - RNA, 22 nt, Human
gggcuuggcacaugggcucagc

SEQ ID NO: 669938 - RNA, 22 nt, Human
gugucugcuuucagcuaguagg

SEQ ID NO: 669939 - RNA, 23 nt, Human
acucagagaccccgggaagugac

SEQ ID NO: 669940 - RNA, 20 nt, Human
ucugggcagggcacauggaa

SEQ ID NO: 669941 - RNA, 22 nt, Human
guuauucuauuaaugugauugu

SEQ ID NO: 669942 - RNA, 22 nt, Human
gcucaccuucguccagcagccg

SEQ ID NO: 669943 - RNA, 22 nt, Human
uaggaaacuaauacagucugga

SEQ ID NO: 669944 - RNA, 22 nt, Human
ccacagaaagccugggaagugg

SEQ ID NO: 669945 - RNA, 22 nt, Human
gggagcuggaguuguguugccu

SEQ ID NO: 669946 - RNA, 23 nt, Human
gagcucagguagggcucgcccgc

SEQ ID NO: 669947 - RNA, 22 nt, Human
ugugaucucuauaggauucaau

SEQ ID NO: 669948 - RNA, 22 nt, Human
gucuguccaucagcaaaggcuu

SEQ ID NO: 669949 - RNA, 22 nt, Human
acaggcugcugggcuccgugcu

SEQ ID NO: 669950 - RNA, 22 nt, Human
ccugaggacagugugaccaugg

SEQ ID NO: 669951 - RNA, 18 nt, Human
aagaggaggagcagguug

SEQ ID NO: 669952 - RNA, 22 nt, Human
gacaauguaaaucaggauagca

SEQ ID NO: 669953 - RNA, 22 nt, Human
caaauaagaaccacaggggagu

SEQ ID NO: 669954 - RNA, 19 nt, Human
aguauagaguauugaggag

SEQ ID NO: 669955 - RNA, 22 nt, Human
agaaauacugugagagcagccu

SEQ ID NO: 669956 - RNA, 22 nt, Human
aacugaacauaaugaaagccaa

SEQ ID NO: 669957 - RNA, 22 nt, Human
uuggagggacagauggcuaggc

SEQ ID NO: 669958 - RNA, 22 nt, Human
guuaaacaagcuggacacugaa

SEQ ID NO: 669959 - RNA, 22 nt, Human
augauuuaaagucauugugaac

SEQ ID NO: 669960 - RNA, 22 nt, Human
caggcagcucaaccuugggagc

SEQ ID NO: 669961 - RNA, 22 nt, Human
ccaaggaggccccaggucagcu

SEQ ID NO: 669962 - RNA, 22 nt, Human
acacucucagcuuuucaacuua

SEQ ID NO: 669963 - RNA, 22 nt, Human
uacagagagcuccggacauuca

SEQ ID NO: 669964 - RNA, 22 nt, Human
uuuguucauuuugagcucauca

SEQ ID NO: 669965 - RNA, 18 nt, Human
ugcauuuaguacaucuag

SEQ ID NO: 669966 - RNA, 22 nt, Human
auucagucaaaccacuggucau

SEQ ID NO: 669967 - RNA, 22 nt, Human
aaacacuugcaaaaugguuccu

SEQ ID NO: 669968 - RNA, 22 nt, Human
gucaauauauucugucucuuug

SEQ ID NO: 669969 - RNA, 22 nt, Human
gaggaaaaugggacaggcugua

SEQ ID NO: 669970 - RNA, 22 nt, Human
ucacccaggcuggugcgcagug

SEQ ID NO: 669971 - RNA, 22 nt, Human
gggcugagacgauggggucuuc

SEQ ID NO: 669972 - RNA, 22 nt, Human
uggcuccacuacuggguguguu

SEQ ID NO: 669973 - RNA, 22 nt, Human
gcugccagccagggugggaucc

SEQ ID NO: 669974 - RNA, 22 nt, Human
uucccuuuguuaaauuggaaga

SEQ ID NO: 669975 - RNA, 22 nt, Human
auguaguguagagauuagucuc

SEQ ID NO: 669976 - RNA, 22 nt, Human
caggcagccugagggaucuggg

SEQ ID NO: 669977 - RNA, 22 nt, Human
cacccagcacagagggaggcga

SEQ ID NO: 669978 - RNA, 22 nt, Human
cucacagguucugcagcucaca

SEQ ID NO: 669979 - RNA, 22 nt, Human
uugaugagaccauugccgcguc

SEQ ID NO: 669980 - RNA, 22 nt, Human
uagcaccauacccggcagcucg

SEQ ID NO: 669981 - RNA, 22 nt, Human
uccuugaauugugccacuuacc

SEQ ID NO: 669982 - RNA, 22 nt, Human
uccaggagacacaagguacaua

SEQ ID NO: 669983 - RNA, 22 nt, Human
uaucauuuagaguauuucuuca

SEQ ID NO: 669984 - RNA, 22 nt, Human
ccaguggaaauguggucaggau

SEQ ID NO: 669985 - RNA, 22 nt, Human
acaggcugagcguccaucuuca

SEQ ID NO: 669986 - RNA, 22 nt, Human
aacaaaugauaccaguucucaa

SEQ ID NO: 669987 - RNA, 17 nt, Human
cgugagcagcaggugcc

SEQ ID NO: 669988 - RNA, 23 nt, Human
ucucaaauaugaucugggucauc

SEQ ID NO: 669989 - RNA, 22 nt, Human
ucuuccuucuuugaugacaagg

SEQ ID NO: 669990 - RNA, 22 nt, Human
aaccuuuugcaagugccuugac

SEQ ID NO: 669991 - RNA, 22 nt, Human
uguggguccuccugugugcccg

SEQ ID NO: 669992 - RNA, 22 nt, Human
ucuucuccagugcuucugcaca

SEQ ID NO: 669993 - RNA, 22 nt, Human
acagccagugcuccgugaggac

SEQ ID NO: 669994 - RNA, 22 nt, Human
gccugucucuuggaacuuggua

SEQ ID NO: 669995 - RNA, 22 nt, Human
uuaaaaugcagauucugauuca

SEQ ID NO: 669996 - RNA, 22 nt, Human
caguuucuauggcugggcucug

SEQ ID NO: 669997 - RNA, 22 nt, Human
cggcagagcuuccugcucagcg

SEQ ID NO: 669998 - RNA, 22 nt, Human
uuucagaaaacuuaucaucagu

SEQ ID NO: 669999 - RNA, 22 nt, Human
acagccugcagccccaggucgc

SEQ ID NO: 670000 - RNA, 22 nt, Human
caggcacagcuaagacuggcca

SEQ ID NO: 670001 - RNA, 22 nt, Human
agagccaggugcugcuguuuga

SEQ ID NO: 670002 - RNA, 21 nt, Human
auacuuugaauuacagccuug

SEQ ID NO: 670003 - RNA, 22 nt, Human
agcugggccugagcuggaagcu

SEQ ID NO: 670004 - RNA, 22 nt, Human
acaaagugaauugcaucgaguu

SEQ ID NO: 670005 - RNA, 21 nt, Human
acuucccaggaccuacucaga

SEQ ID NO: 670006 - RNA, 22 nt, Human
ggacaacacuucauuccagcua

SEQ ID NO: 670007 - RNA, 20 nt, Human
ugugugaacacggacucugu

SEQ ID NO: 670008 - RNA, 22 nt, Human
cugggacugccauucacagcca

SEQ ID NO: 670009 - RNA, 22 nt, Human
ucucagagaggggccgggccuu

SEQ ID NO: 670010 - RNA, 22 nt, Human
uuucauaaacaguagaagacua

SEQ ID NO: 670011 - RNA, 22 nt, Human
caguucaaaguuaagcagcagu

SEQ ID NO: 670012 - RNA, 22 nt, Human
gugggagcauggucccagugcc

SEQ ID NO: 670013 - RNA, 21 nt, Human
uuuuuucuugcgugaggccug

SEQ ID NO: 670014 - RNA, 22 nt, Human
auauuauagacagagucuucug

SEQ ID NO: 670015 - RNA, 20 nt, Human
gggcucuuagguagcagggg

SEQ ID NO: 670016 - RNA, 23 nt, Human
cugugucuaugcagccauaucca

SEQ ID NO: 670017 - RNA, 22 nt, Human
augggcuggcagccugaacagc

SEQ ID NO: 670018 - RNA, 22 nt, Human
acuaauugagugcaugaucuuu

SEQ ID NO: 670019 - RNA, 22 nt, Human
cuuucuuauaccugucagggcc

SEQ ID NO: 670020 - RNA, 19 nt, Human
ucaaagcaagcauguucug

SEQ ID NO: 670021 - RNA, 22 nt, Human
aguggcagagcaggugcuggaa

SEQ ID NO: 670022 - RNA, 23 nt, Human
gcauugaacaaaagaggggagua

SEQ ID NO: 670023 - RNA, 22 nt, Human
ucacagggauggaauagaaaua

SEQ ID NO: 670024 - RNA, 22 nt, Human
aacagccucagugagauuagga

SEQ ID NO: 670025 - RNA, 22 nt, Human
ucccugaaacaucucuguggau

SEQ ID NO: 670026 - RNA, 22 nt, Human
cauuuguagcuauuuacuguau

SEQ ID NO: 670027 - RNA, 22 nt, Human
acugugaguuuauuuaucugau

SEQ ID NO: 670028 - RNA, 22 nt, Human
cugcucucuguuccccuggauc

SEQ ID NO: 670029 - RNA, 22 nt, Human
aauggcuuuugcacuuaaaucg

SEQ ID NO: 670030 - RNA, 22 nt, Human
guggggagggagaugcugaagu

SEQ ID NO: 670031 - RNA, 22 nt, Human
auuugugaucgugcgugaugaa

SEQ ID NO: 670032 - RNA, 22 nt, Human
ugacuuuggcuuaagcagcagu

SEQ ID NO: 670033 - RNA, 20 nt, Human
ucccaggcugggcuccagcu

SEQ ID NO: 670034 - RNA, 22 nt, Human
aagcacagaccagaucuccagg

SEQ ID NO: 670035 - RNA, 22 nt, Human
acucugcuaucuuagcaaaagg

SEQ ID NO: 670036 - RNA, 22 nt, Human
gggccacauugaagggugggua

SEQ ID NO: 670037 - RNA, 22 nt, Human
cagaagacugcagggaagggac

SEQ ID NO: 670038 - RNA, 22 nt, Human
cccuggcucuucaccaccugcc

SEQ ID NO: 670039 - RNA, 22 nt, Human
gaauucugguuuugaaaugaau

SEQ ID NO: 670040 - RNA, 22 nt, Human
aaggaaaugugccugacacugc

SEQ ID NO: 670041 - RNA, 22 nt, Human
uuucaguugauugcuuggguua

SEQ ID NO: 670042 - RNA, 22 nt, Human
agcagcccagauaaagcucagg

SEQ ID NO: 670043 - RNA, 22 nt, Human
acugaacacaccugcagcacgu

SEQ ID NO: 670044 - RNA, 22 nt, Human
cuuuacaaauagggagggagug

SEQ ID NO: 670045 - RNA, 22 nt, Human
caaagggcauggccugagcacu

SEQ ID NO: 670046 - RNA, 22 nt, Human
ucacugaaggaagacacuguca

SEQ ID NO: 670047 - RNA, 22 nt, Human
cuacauuuguucaaauaagcug

SEQ ID NO: 670048 - RNA, 22 nt, Human
agcuacucagaguuccacucua

SEQ ID NO: 670049 - RNA, 22 nt, Human
uuccacagcccaagcugguggc

SEQ ID NO: 670050 - RNA, 22 nt, Human
guuucuuagguaaauucuuuga

SEQ ID NO: 670051 - RNA, 22 nt, Human
agcucuaaauggaauuuugccu

SEQ ID NO: 670052 - RNA, 22 nt, Human
auuugcauuuagaaagaucacu

SEQ ID NO: 670053 - RNA, 22 nt, Human
uaaaaguaggaaugaaacgcau

SEQ ID NO: 670054 - RNA, 22 nt, Human
cuugggagacacaagaagacau

SEQ ID NO: 670055 - RNA, 20 nt, Human
ugucugcucauaauaaaccc

SEQ ID NO: 670056 - RNA, 22 nt, Human
uggcuucugagucuccugacau

SEQ ID NO: 670057 - RNA, 22 nt, Human
ucuucuuccuccacagggccca

SEQ ID NO: 670058 - RNA, 22 nt, Human
cauucaaaaugggcugaccugu

SEQ ID NO: 670059 - RNA, 22 nt, Human
uuucccuuguuccuuccucuga

SEQ ID NO: 670060 - RNA, 22 nt, Human
cuguuauuugcuggaagaguuu

SEQ ID NO: 670061 - RNA, 22 nt, Human
acacugugauuucuggguucca

SEQ ID NO: 670062 - RNA, 22 nt, Human
gcuguguggcugugccgucacg

SEQ ID NO: 670063 - RNA, 22 nt, Human
cagaggcucaccagccuuucac

SEQ ID NO: 670064 - RNA, 22 nt, Human
cugcagcaguacucagcagcca

SEQ ID NO: 670065 - RNA, 22 nt, Human
ggagggggaaacuuuggcugcc

SEQ ID NO: 670066 - RNA, 22 nt, Human
ucuggauggucagcucuuccug

SEQ ID NO: 670067 - RNA, 22 nt, Human
ugcuuaaacacauacauacaua

SEQ ID NO: 670068 - RNA, 22 nt, Human
cucuucucugcagccuuugaag

SEQ ID NO: 670069 - RNA, 22 nt, Human
auuccaaaaggauguuagaaug

SEQ ID NO: 670070 - RNA, 22 nt, Human
ucucugagacaguagccucugc

SEQ ID NO: 670071 - RNA, 19 nt, Human
gcuaggguugguggcgugc

SEQ ID NO: 670072 - RNA, 20 nt, Human
guccaggacccagcaggagg

SEQ ID NO: 670073 - RNA, 22 nt, Human
gacuucaugacauucaggucag

SEQ ID NO: 670074 - RNA, 19 nt, Human
agcuuugccaaaaacuuag

SEQ ID NO: 670075 - RNA, 22 nt, Human
gggagacacgcugcaggcauaa

SEQ ID NO: 670076 - RNA, 22 nt, Human
acugcagccuugaacucugggc

SEQ ID NO: 670077 - RNA, 22 nt, Human
uaaggaaaguacauguuuugac

SEQ ID NO: 670078 - RNA, 22 nt, Human
uaggaagccuaaauuaaguggu

SEQ ID NO: 670079 - RNA, 22 nt, Human
aagaugauaggacuugcuuaag

SEQ ID NO: 670080 - RNA, 22 nt, Human
cagcaucucauuugacuucugc

SEQ ID NO: 670081 - RNA, 22 nt, Human
ucaaugucucuuucuaaaaugu

SEQ ID NO: 670082 - RNA, 22 nt, Human
ucugacagucacaguggaggau

SEQ ID NO: 670083 - RNA, 22 nt, Human
ucauuucacuucucuagggaga

SEQ ID NO: 670084 - RNA, 22 nt, Human
ggggggcuguucuggacaggaa

SEQ ID NO: 670085 - RNA, 22 nt, Human
gacaaugugcaauugcagcuag

SEQ ID NO: 670086 - RNA, 22 nt, Human
uugcaauagccuuauuuccaaa

SEQ ID NO: 670087 - RNA, 22 nt, Human
ucagggaccccucugaguggag

SEQ ID NO: 670088 - RNA, 22 nt, Human
cauucccaugacuccugcucag

SEQ ID NO: 670089 - RNA, 22 nt, Human
gggugggguucaggaaucuuca

SEQ ID NO: 670090 - RNA, 22 nt, Human
cuuuguuguuaauuggcgcuua

SEQ ID NO: 670091 - RNA, 22 nt, Human
uggaggcauuuuagguugucac

SEQ ID NO: 670092 - RNA, 22 nt, Human
aagcagcauguggguuaucggg

SEQ ID NO: 670093 - RNA, 22 nt, Human
aucagaaauugcuaccagugga

SEQ ID NO: 670094 - RNA, 22 nt, Human
uccagacccaugacccugggga

SEQ ID NO: 670095 - RNA, 22 nt, Human
cuggugggaggcaagguggaag

SEQ ID NO: 670096 - RNA, 22 nt, Human
agugcaugccuuccuguggaug

SEQ ID NO: 670097 - RNA, 22 nt, Human
aauguucaaacagaucacuuag

SEQ ID NO: 670098 - RNA, 22 nt, Human
ggaguuaaggccuaagaaauag

SEQ ID NO: 670099 - RNA, 22 nt, Human
uacagaauuagauuauuagaga

SEQ ID NO: 670100 - RNA, 22 nt, Human
agagggugggcacgugauggau

SEQ ID NO: 670101 - RNA, 22 nt, Human
ggcuccucucuggccgcucccg

SEQ ID NO: 670102 - RNA, 22 nt, Human
agcagaacagucuucuaguucu

SEQ ID NO: 670103 - RNA, 22 nt, Human
uuuauugaauuguaacccuauu

SEQ ID NO: 670104 - RNA, 22 nt, Human
ucaggugucaagcagggagcug

SEQ ID NO: 670105 - RNA, 21 nt, Human
aggcuguccuuugccagcccu

SEQ ID NO: 670106 - RNA, 21 nt, Human
ugugagaagaguacugagguc

SEQ ID NO: 670107 - RNA, 18 nt, Human
cccagcuggugggucagu

SEQ ID NO: 670108 - RNA, 20 nt, Human
uauaaauucagagcuuuggu

SEQ ID NO: 670109 - RNA, 22 nt, Human
ugaguuacugccuaguaacuug

SEQ ID NO: 670110 - RNA, 22 nt, Human
ggggcacuuccaggcugaggcu

SEQ ID NO: 670111 - RNA, 19 nt, Human
ugcuuccucaccaucuccc

SEQ ID NO: 670112 - RNA, 22 nt, Human
ucugaaaguaucuggaucuuuu

SEQ ID NO: 670113 - RNA, 22 nt, Human
ucucuucccuuuaugguaugug

SEQ ID NO: 670114 - RNA, 22 nt, Human
augcagguccaaacgcuagugu

SEQ ID NO: 670115 - RNA, 22 nt, Human
agggaaauggagaguguaguuu

SEQ ID NO: 670116 - RNA, 22 nt, Human
caccugggucauugcugguguu

SEQ ID NO: 670117 - RNA, 22 nt, Human
caugaaauguguuaaucucuug

SEQ ID NO: 670118 - RNA, 22 nt, Human
cccucacagucuaggagcagcu

SEQ ID NO: 670119 - RNA, 22 nt, Human
ggaggagauuccccucucacuu

SEQ ID NO: 670120 - RNA, 22 nt, Human
aggccugagccccagguuuguu

SEQ ID NO: 670121 - RNA, 22 nt, Human
aaaaguuagcuauuaguaggug

SEQ ID NO: 670122 - RNA, 22 nt, Human
aagcaucuuaaaaaguaucaga

SEQ ID NO: 670123 - RNA, 22 nt, Human
agcuucuugacggauguucugg

SEQ ID NO: 670124 - RNA, 22 nt, Human
ggcuuccuggagaaggucugag

SEQ ID NO: 670125 - RNA, 22 nt, Human
uguaaacauaucagacuuucuu

SEQ ID NO: 670126 - RNA, 18 nt, Human
gccaggcaggguggggaa

SEQ ID NO: 670127 - RNA, 19 nt, Human
ugccugcuccuggcuucca

SEQ ID NO: 670128 - RNA, 22 nt, Human
uuuggaauauuaaaaugucuca

SEQ ID NO: 670129 - RNA, 22 nt, Human
agugagggacuagugcugggga

SEQ ID NO: 670130 - RNA, 22 nt, Human
uguguggcaagcuguaugcuag

SEQ ID NO: 670131 - RNA, 22 nt, Human
agaauugcuggaauuugcuuua

SEQ ID NO: 670132 - RNA, 22 nt, Human
aauugcuuaugccaggugagag

SEQ ID NO: 670133 - RNA, 22 nt, Human
uccuggguucauguccuggugc

SEQ ID NO: 670134 - RNA, 23 nt, Human
auaucacacccaguacagucucc

SEQ ID NO: 670135 - RNA, 22 nt, Human
auggcccugcugguuugaucgu

SEQ ID NO: 670136 - RNA, 22 nt, Human
ggaggccaaagugugggcggcu

SEQ ID NO: 670137 - RNA, 22 nt, Human
ggagcugcucagagccaguccc

SEQ ID NO: 670138 - RNA, 22 nt, Human
ugcuuuauucaggguuuacccc

SEQ ID NO: 670139 - RNA, 22 nt, Human
uccaggcugccacagugcaacg

SEQ ID NO: 670140 - RNA, 22 nt, Human
aggcaguggaaggagaaagcaa

SEQ ID NO: 670141 - RNA, 22 nt, Human
gcaccaggugcagccgggcccc

SEQ ID NO: 670142 - RNA, 22 nt, Human
ccccagcagacucagggcaggu

SEQ ID NO: 670143 - RNA, 22 nt, Human
uggccagaacucagacaugugg

SEQ ID NO: 670144 - RNA, 22 nt, Human
gaggccaaguuggagaccaggu

SEQ ID NO: 670145 - RNA, 22 nt, Human
ucuguuuucucuguauuuugac

SEQ ID NO: 670146 - RNA, 22 nt, Human
aaggcuuguagauuugggcuuu

SEQ ID NO: 670147 - RNA, 22 nt, Human
gcuaggaggaagaaugugaauu

SEQ ID NO: 670148 - RNA, 22 nt, Human
aguauguggcacagaauuucuu

SEQ ID NO: 670149 - RNA, 22 nt, Human
ucuaggguugaggccacaggga

SEQ ID NO: 670150 - RNA, 22 nt, Human
uuuggaauggaauagagauugc

SEQ ID NO: 670151 - RNA, 22 nt, Human
ggaagcugccaguccaccagcu

SEQ ID NO: 670152 - RNA, 22 nt, Human
aucaagaguuauauuucauagu

SEQ ID NO: 670153 - RNA, 22 nt, Human
aagugucuagcaccuggaugca

SEQ ID NO: 670154 - RNA, 22 nt, Human
cagggccagcgucucgggcuau

SEQ ID NO: 670155 - RNA, 21 nt, Human
ugacuaauugugauaaagugc

SEQ ID NO: 670156 - RNA, 22 nt, Human
agcaaagaguaauuuuguuuug

SEQ ID NO: 670157 - RNA, 22 nt, Human
cagcuuuuggcaggaugaccag

SEQ ID NO: 670158 - RNA, 22 nt, Human
auaaucagaauucaugaaagau

SEQ ID NO: 670159 - RNA, 22 nt, Human
ucugcugagaugcccaugguua

SEQ ID NO: 670160 - RNA, 22 nt, Human
acaggaugggcgcacagagcua

SEQ ID NO: 670161 - RNA, 22 nt, Human
gacccuggcagguagccucaca

SEQ ID NO: 670162 - RNA, 22 nt, Human
gcauuuccugugcuuggcauau

SEQ ID NO: 670163 - RNA, 22 nt, Human
ugcugagauaagcuaugaccag

SEQ ID NO: 670164 - RNA, 16 nt, Human
gcuggagggagggguu

SEQ ID NO: 670165 - RNA, 22 nt, Human
aauguuuugcauuaguuuucua

SEQ ID NO: 670166 - RNA, 22 nt, Human
uguaaaccagggucauccuuag

SEQ ID NO: 670167 - RNA, 22 nt, Human
aaucuguugaugcaaaccuccc

SEQ ID NO: 670168 - RNA, 22 nt, Human
agcuggagaaaccugggagggu

SEQ ID NO: 670169 - RNA, 22 nt, Human
uugaggcaaaaucaacgggaag

SEQ ID NO: 670170 - RNA, 22 nt, Human
agaaagcuggagucaagcagag

SEQ ID NO: 670171 - RNA, 23 nt, Human
agaugaggcuucuccauguuggu

SEQ ID NO: 670172 - RNA, 23 nt, Human
uccagcagagccuuccaggaggg

SEQ ID NO: 670173 - RNA, 22 nt, Human
gacugugggcuccuugagggca

SEQ ID NO: 670174 - RNA, 22 nt, Human
cauuuauucucagauccuuguc

SEQ ID NO: 670175 - RNA, 22 nt, Human
ugaggaaagaaaggcaugcaug

SEQ ID NO: 670176 - RNA, 22 nt, Human
gagcacagccaaaguaagaagg

SEQ ID NO: 670177 - RNA, 22 nt, Human
auccccagacuuuagauuucuc

SEQ ID NO: 670178 - RNA, 22 nt, Human
uaucacacuguuuuaauuacuu

SEQ ID NO: 670179 - RNA, 22 nt, Human
cuauuuuaacuugauuaccucu

SEQ ID NO: 670180 - RNA, 22 nt, Human
uuuaguguaagcauaaagaaca

SEQ ID NO: 670181 - RNA, 22 nt, Human
gccaggcugcuggcugcugucc

SEQ ID NO: 670182 - RNA, 22 nt, Human
uacuauacucuccauuuuauag

SEQ ID NO: 670183 - RNA, 18 nt, Human
uaggaagcuuaauguuuu

SEQ ID NO: 670184 - RNA, 22 nt, Human
cuguuucaauuugaggaucagc

SEQ ID NO: 670185 - RNA, 22 nt, Human
ggagggccccuccagugggcag

SEQ ID NO: 670186 - RNA, 22 nt, Human
aagacaacagagaugacagacu

SEQ ID NO: 670187 - RNA, 22 nt, Human
ggcagaugacagaccaguaugu

SEQ ID NO: 670188 - RNA, 20 nt, Human
aauuccagcaugauauuuau

SEQ ID NO: 670189 - RNA, 22 nt, Human
cuuccccaaguagagaggggag

SEQ ID NO: 670190 - RNA, 22 nt, Human
ucaucccucugccaggcccagg

SEQ ID NO: 670191 - RNA, 22 nt, Human
cagcaugaaaaguguugcuauc

SEQ ID NO: 670192 - RNA, 22 nt, Human
ccuaggcccuaggcuuccauca

SEQ ID NO: 670193 - RNA, 22 nt, Human
uugcuuugguagcagcuauaga

SEQ ID NO: 670194 - RNA, 22 nt, Human
auuuagacuucccagcacugug

SEQ ID NO: 670195 - RNA, 22 nt, Human
uuugcauuaguuuagauuucaa

SEQ ID NO: 670196 - RNA, 22 nt, Human
ccagcaggguugguuucuucug

SEQ ID NO: 670197 - RNA, 22 nt, Human
ucagaggcuggaagagccuccu

SEQ ID NO: 670198 - RNA, 19 nt, Human
aaggcuuggcugagcuggg

SEQ ID NO: 670199 - RNA, 22 nt, Human
agcuggugaaccugaggcacag

SEQ ID NO: 670200 - RNA, 17 nt, Human
acagagguuauacagac

SEQ ID NO: 670201 - RNA, 22 nt, Human
gaugucuuugcuguuauccacu

SEQ ID NO: 670202 - RNA, 22 nt, Human
uggggcucaugccugcuggaac

SEQ ID NO: 670203 - RNA, 21 nt, Human
uggcucuguucaauauaugga

SEQ ID NO: 670204 - RNA, 22 nt, Human
uggcuggaggguuagugagaua

SEQ ID NO: 670205 - RNA, 22 nt, Human
cuguauuuuuuaagaauaucuc

SEQ ID NO: 670206 - RNA, 22 nt, Human
ugguggcaauucaaagacagca

SEQ ID NO: 670207 - RNA, 22 nt, Human
cugauggagugauggagaaauu

SEQ ID NO: 670208 - RNA, 22 nt, Human
uuuguacuaugguuuuucacua

SEQ ID NO: 670209 - RNA, 22 nt, Human
cacagcagggcauggcuguugu

SEQ ID NO: 670210 - RNA, 22 nt, Human
gcugagagugggugcagugcuu

SEQ ID NO: 670211 - RNA, 22 nt, Human
uuuggacauguugagucugaua

SEQ ID NO: 670212 - RNA, 22 nt, Human
aggcccuguccauggugcugaa

SEQ ID NO: 670213 - RNA, 22 nt, Human
caaccugacaagguuaaugaau

SEQ ID NO: 670214 - RNA, 22 nt, Human
aaaugaacucuuccugcauccc

SEQ ID NO: 670215 - RNA, 22 nt, Human
ugcagauucaaaugaaaugcaa

SEQ ID NO: 670216 - RNA, 22 nt, Human
cacaguauucacugggcagauu

SEQ ID NO: 670217 - RNA, 22 nt, Human
uacaaacuccgaaguuuguacc

SEQ ID NO: 670218 - RNA, 22 nt, Human
gcucccaccuuugcuaucagua

SEQ ID NO: 670219 - RNA, 22 nt, Human
gcaggcagaucaccugucagga

SEQ ID NO: 670220 - RNA, 22 nt, Human
uccugggcugcagggaagagca

SEQ ID NO: 670221 - RNA, 22 nt, Human
cagcuuccacagacuuggcucg

SEQ ID NO: 670222 - RNA, 22 nt, Human
aauaugcacucugauuuagcag

SEQ ID NO: 670223 - RNA, 22 nt, Human
gcuuccaggucauucucacccu

SEQ ID NO: 670224 - RNA, 22 nt, Human
ggagucaggauccuggggaugg

SEQ ID NO: 670225 - RNA, 22 nt, Human
cugaagucagauggcacaaggu

SEQ ID NO: 670226 - RNA, 22 nt, Human
cacaaggacauguauauuuaug

SEQ ID NO: 670227 - RNA, 22 nt, Human
guggcagaaauauucuugcucu

SEQ ID NO: 670228 - RNA, 22 nt, Human
ucuggcuguguaagguagcacc

SEQ ID NO: 670229 - RNA, 19 nt, Human
ucuuuucacgcauuuugaa

SEQ ID NO: 670230 - RNA, 22 nt, Human
ugaguccacuuuaaaaugucag

SEQ ID NO: 670231 - RNA, 19 nt, Human
guguauguaaguugugagg

SEQ ID NO: 670232 - RNA, 22 nt, Human
guccagcccucugccuccaggu

SEQ ID NO: 670233 - RNA, 22 nt, Human
aacaagauguuuugauauaugu

SEQ ID NO: 670234 - RNA, 22 nt, Human
acugggcuguuuuuugagugga

SEQ ID NO: 670235 - RNA, 22 nt, Human
cccaugagguggagguugcagu

SEQ ID NO: 670236 - RNA, 22 nt, Human
cuggguccugcucucccuaaga

SEQ ID NO: 670237 - RNA, 22 nt, Human
auggaggaugugcagcaugggc

SEQ ID NO: 670238 - RNA, 22 nt, Human
ucugggcucuuaguguacccuc

SEQ ID NO: 670239 - RNA, 23 nt, Human
acaaaugcccauacaucuaguuc

SEQ ID NO: 670240 - RNA, 22 nt, Human
gaagauuuucuccuuuaaauga

SEQ ID NO: 670241 - RNA, 22 nt, Human
auggucuuaggguaggcagcug

SEQ ID NO: 670242 - RNA, 22 nt, Human
ucuguaucacccguucccagaa

SEQ ID NO: 670243 - RNA, 22 nt, Human
cucaguuuccucaacugcaaaa

SEQ ID NO: 670244 - RNA, 22 nt, Human
gcagcacacgguggugcccugg

SEQ ID NO: 670245 - RNA, 22 nt, Human
caggcucuuccauccugcugag

SEQ ID NO: 670246 - RNA, 22 nt, Human
uggagcagcuaagccucugaga

SEQ ID NO: 670247 - RNA, 22 nt, Human
aggcagguguuaacccucugag

SEQ ID NO: 670248 - RNA, 22 nt, Human
gccacagggcgagcggaggcca

SEQ ID NO: 670249 - RNA, 22 nt, Human
cagaggcucuuccucacugccc

SEQ ID NO: 670250 - RNA, 22 nt, Human
gcugcuggaacaaaucacccca

SEQ ID NO: 670251 - RNA, 22 nt, Human
augucacauuggagcugcugga

SEQ ID NO: 670252 - RNA, 22 nt, Human
ggcuuuauuuugcaugaaugcu

SEQ ID NO: 670253 - RNA, 22 nt, Human
aagcccagaugagaucccugga

SEQ ID NO: 670254 - RNA, 22 nt, Human
acaguauauaugguuaucugau

SEQ ID NO: 670255 - RNA, 22 nt, Human
gaaggcccugguauucuugagg

SEQ ID NO: 670256 - RNA, 22 nt, Human
gccaggcuggccagcaccuucu

SEQ ID NO: 670257 - RNA, 22 nt, Human
ucugacuuccuccacaucuguu

SEQ ID NO: 670258 - RNA, 22 nt, Human
uucuuccucuguaaaaggugac

SEQ ID NO: 670259 - RNA, 22 nt, Human
gcauggcauuaacaagauggaa

SEQ ID NO: 670260 - RNA, 22 nt, Human
ccauuacuuagaaaggaacuga

SEQ ID NO: 670261 - RNA, 22 nt, Human
ggaggggcaggucccaaguugu

SEQ ID NO: 670262 - RNA, 22 nt, Human
uuauauguaugcuuauaaacca

SEQ ID NO: 670263 - RNA, 22 nt, Human
acccaggaggugacacagggcu

SEQ ID NO: 670264 - RNA, 22 nt, Human
uucugucuggaaaaggacauag

SEQ ID NO: 670265 - RNA, 19 nt, Human
uucacaauuaugaaauuag

SEQ ID NO: 670266 - RNA, 22 nt, Human
cccaggguaaucaugugaagcc

SEQ ID NO: 670267 - RNA, 22 nt, Human
gcacacagacuaaccauauuuc

SEQ ID NO: 670268 - RNA, 22 nt, Human
aagagauugguuauaagagauu

SEQ ID NO: 670269 - RNA, 22 nt, Human
accucugcuucccggguucaag

SEQ ID NO: 670270 - RNA, 22 nt, Human
caagaugugccuaaucagaccu

SEQ ID NO: 670271 - RNA, 22 nt, Human
cagcaaaauuugaggauugccu

SEQ ID NO: 670272 - RNA, 22 nt, Human
cagcggccggugaggaagggga

SEQ ID NO: 670273 - RNA, 22 nt, Human
ccuggcagcuaagugcuuugag

SEQ ID NO: 670274 - RNA, 20 nt, Human
ucagcaugcuccucagacau

SEQ ID NO: 670275 - RNA, 22 nt, Human
cuuuacuaucaggaauaaacaa

SEQ ID NO: 670276 - RNA, 23 nt, Human
aauucaaauucagugugacuagg

SEQ ID NO: 670277 - RNA, 22 nt, Human
ggcgaggccgggacaggcugga

SEQ ID NO: 670278 - RNA, 22 nt, Human
acuuaaaaagaaucuuuucacg

SEQ ID NO: 670279 - RNA, 22 nt, Human
gucucuggguuaagcagugcau

SEQ ID NO: 670280 - RNA, 22 nt, Human
cccagccucugggcucacccaa

SEQ ID NO: 670281 - RNA, 22 nt, Human
gguggcaccuugaucuuggacu

SEQ ID NO: 670282 - RNA, 22 nt, Human
gcuuccugucccucagccauga

SEQ ID NO: 670283 - RNA, 22 nt, Human
uggacucuaagcagaggaucua

SEQ ID NO: 670284 - RNA, 22 nt, Human
auuguacagguuggaggaagug

SEQ ID NO: 670285 - RNA, 22 nt, Human
aggcugagggcuccugagggca

SEQ ID NO: 670286 - RNA, 22 nt, Human
ccugggcaggaugggcccggug

SEQ ID NO: 670287 - RNA, 22 nt, Human
aaaaagauagcauugugcuccu

SEQ ID NO: 670288 - RNA, 22 nt, Human
uaauaacaauuguaggacauga

SEQ ID NO: 670289 - RNA, 22 nt, Human
cagcagccuaggguuccaucau

SEQ ID NO: 670290 - RNA, 22 nt, Human
ugcagaguugcuuugauagucc

SEQ ID NO: 670291 - RNA, 22 nt, Human
ggugggaugccucuggagaagu

SEQ ID NO: 670292 - RNA, 22 nt, Human
gcuggcucuacauuugagguca

SEQ ID NO: 670293 - RNA, 22 nt, Human
gaaacuuuuaaaccucaugagu

SEQ ID NO: 670294 - RNA, 22 nt, Human
gcauugaucuguaugcauuaag

SEQ ID NO: 670295 - RNA, 21 nt, Human
aggaggcugucucuuucagcu

SEQ ID NO: 670296 - RNA, 22 nt, Human
ucugauguguuuaagaaagaag

SEQ ID NO: 670297 - RNA, 22 nt, Human
uagaucaggcugcuuagauaga

SEQ ID NO: 670298 - RNA, 23 nt, Human
cccagaccuugugcugcccuugg

SEQ ID NO: 670299 - RNA, 22 nt, Human
uuucagagaacugaguccuugc

SEQ ID NO: 670300 - RNA, 22 nt, Human
ugccuggguguaaagggccaac

SEQ ID NO: 670301 - RNA, 20 nt, Human
ccaguccaccugagacaugu

SEQ ID NO: 670302 - RNA, 16 nt, Human
cagccugcagugguca

SEQ ID NO: 670303 - RNA, 22 nt, Human
acaaugaagggagacacuugcu

SEQ ID NO: 670304 - RNA, 22 nt, Human
gauucuugggccuucugaaguu

SEQ ID NO: 670305 - RNA, 21 nt, Human
ugucuccuguuggcacauggc

SEQ ID NO: 670306 - RNA, 22 nt, Human
uuuuauauugagugagaguucc

SEQ ID NO: 670307 - RNA, 22 nt, Human
uuguaaaugaccuuuucuaauu

SEQ ID NO: 670308 - RNA, 22 nt, Human
acaucuuuauacuaguccuuga

SEQ ID NO: 670309 - RNA, 22 nt, Human
uuggaauagggaggcuggcaua

SEQ ID NO: 670310 - RNA, 22 nt, Human
uggaaagugcucuagacuuucu

SEQ ID NO: 670311 - RNA, 22 nt, Human
uucuggaggagaaagggugggc

SEQ ID NO: 670312 - RNA, 22 nt, Human
uuucaugaggcugcauaaggag

SEQ ID NO: 670313 - RNA, 22 nt, Human
ucuuuaagccaagauauauuua

SEQ ID NO: 670314 - RNA, 22 nt, Human
agucucacuucuugagcuaugc

SEQ ID NO: 670315 - RNA, 22 nt, Human
gcugggccagacuuucaauguc

SEQ ID NO: 670316 - RNA, 18 nt, Human
aaacccacucagcgcuga

SEQ ID NO: 670317 - RNA, 22 nt, Human
aaagcucagucagugguguaug

SEQ ID NO: 670318 - RNA, 16 nt, Human
ggaggaaggcauagug

SEQ ID NO: 670319 - RNA, 22 nt, Human
ucugaggcuaagagacagaggc

SEQ ID NO: 670320 - RNA, 23 nt, Human
caaaaguuagcccuucccaucuc

SEQ ID NO: 670321 - RNA, 22 nt, Human
uuauucacuucuuggucccuca

SEQ ID NO: 670322 - RNA, 22 nt, Human
cugggcagcuaccaccacugcu

SEQ ID NO: 670323 - RNA, 22 nt, Human
gcugauggcuugcuggcugaca

SEQ ID NO: 670324 - RNA, 22 nt, Human
agcaggguccugaggugaguca

SEQ ID NO: 670325 - RNA, 23 nt, Human
ugagcccaggaggucaaggcugc

SEQ ID NO: 670326 - RNA, 22 nt, Human
ugccuuuuccagcuuccaggag

SEQ ID NO: 670327 - RNA, 22 nt, Human
gcauaucaugacuucuaucuua

SEQ ID NO: 670328 - RNA, 22 nt, Human
ccagauguuccccuggaggccu

SEQ ID NO: 670329 - RNA, 22 nt, Human
aggagccaccuaggagcuguuu

SEQ ID NO: 670330 - RNA, 22 nt, Human
caaacuguucucugugggauuc

SEQ ID NO: 670331 - RNA, 22 nt, Human
caugcagucaauaaacaugugu

SEQ ID NO: 670332 - RNA, 22 nt, Human
ugaagcagcuucuuucugucaa

SEQ ID NO: 670333 - RNA, 22 nt, Human
uuuguuagagugugggaggcug

SEQ ID NO: 670334 - RNA, 19 nt, Human
gcgaggaagucacuguggc

SEQ ID NO: 670335 - RNA, 23 nt, Human
uuucagaagugguccuaggaagc

SEQ ID NO: 670336 - RNA, 22 nt, Human
uauuuaucgagugucuacuaug

SEQ ID NO: 670337 - RNA, 22 nt, Human
caggcacuuugcugggggcgca

SEQ ID NO: 670338 - RNA, 22 nt, Human
cuggcccagagagcagagcuua

SEQ ID NO: 670339 - RNA, 22 nt, Human
agaugcauguuuaugucuuucc

SEQ ID NO: 670340 - RNA, 22 nt, Human
ugucaugaguuauuucauagga

SEQ ID NO: 670341 - RNA, 22 nt, Human
aaagcagcaaauacuuuugcac

SEQ ID NO: 670342 - RNA, 23 nt, Human
gccugccugaccugugcaaaguc

SEQ ID NO: 670343 - RNA, 22 nt, Human
aaaauuuuacugguguuuccuu

SEQ ID NO: 670344 - RNA, 22 nt, Human
cacagaggcggaaaauucugaa

SEQ ID NO: 670345 - RNA, 19 nt, Human
ggagacucagcccaugccu

SEQ ID NO: 670346 - RNA, 22 nt, Human
cucuccaggcugggacaggacc

SEQ ID NO: 670347 - RNA, 21 nt, Human
uagugucuuaagagccuugca

SEQ ID NO: 670348 - RNA, 21 nt, Human
guucaaauccugacacuacac

SEQ ID NO: 670349 - RNA, 17 nt, Human
ugaggcucggugaggag

SEQ ID NO: 670350 - RNA, 22 nt, Human
ugucaggaggguccagagaaaa

SEQ ID NO: 670351 - RNA, 22 nt, Human
ugggucagaaucagagaguugc

SEQ ID NO: 670352 - RNA, 22 nt, Human
ccucaggggcuuuucguuguug

SEQ ID NO: 670353 - RNA, 22 nt, Human
aacugauaauggacacauaaaa

SEQ ID NO: 670354 - RNA, 23 nt, Human
uccugaggaauggcaucucacau

SEQ ID NO: 670355 - RNA, 22 nt, Human
uuggccagguccauuucuccau

SEQ ID NO: 670356 - RNA, 22 nt, Human
acagguggggaggcugagguuc

SEQ ID NO: 670357 - RNA, 22 nt, Human
auucaaguccagcuucucuaca

SEQ ID NO: 670358 - RNA, 22 nt, Human
aggacuaaggaacagcugauuc

SEQ ID NO: 670359 - RNA, 19 nt, Human
ccaggccuccugggagguc

SEQ ID NO: 670360 - RNA, 19 nt, Human
uugaauuguuuugaguagg

SEQ ID NO: 670361 - RNA, 21 nt, Human
auaaauucugagaggcucugc

SEQ ID NO: 670362 - RNA, 22 nt, Human
ucagggaaaggggagagucauu

SEQ ID NO: 670363 - RNA, 22 nt, Human
aagcacagcuggaacagcagga

SEQ ID NO: 670364 - RNA, 22 nt, Human
cauuucuaccaaaugugacugg

SEQ ID NO: 670365 - RNA, 20 nt, Human
ucucugcuguccacauuugc

SEQ ID NO: 670366 - RNA, 22 nt, Human
cacacacaguuuuguauucugu

SEQ ID NO: 670367 - RNA, 22 nt, Human
uuuaggcauacuuuugggagaa

SEQ ID NO: 670368 - RNA, 22 nt, Human
uguauauaagcauuuacuuguu

SEQ ID NO: 670369 - RNA, 22 nt, Human
gcagcccagagcgcaggacccc

SEQ ID NO: 670370 - RNA, 22 nt, Human
cuaagaaauguugugaaugcca

SEQ ID NO: 670371 - RNA, 22 nt, Human
gacacaggauuccuggcucugc

SEQ ID NO: 670372 - RNA, 19 nt, Human
agguggguaagcaguucuc

SEQ ID NO: 670373 - RNA, 22 nt, Human
gccugggaaagaguagggaaau

SEQ ID NO: 670374 - RNA, 22 nt, Human
aaugcaauaccuuuuuaugcug

SEQ ID NO: 670375 - RNA, 22 nt, Human
augcuaaggcccaggagaaaau

SEQ ID NO: 670376 - RNA, 22 nt, Human
acugucugugccagaugcuggg

SEQ ID NO: 670377 - RNA, 22 nt, Human
uauacugaguguguuaaugaug

SEQ ID NO: 670378 - RNA, 22 nt, Human
cucagggaauuauuucuguccu

SEQ ID NO: 670379 - RNA, 22 nt, Human
ucuggcagcgaagcguguacuu

SEQ ID NO: 670380 - RNA, 22 nt, Human
ccuuggauuuugugcccacgcc

SEQ ID NO: 670381 - RNA, 22 nt, Human
uguuuauugagugccuacuaua

SEQ ID NO: 670382 - RNA, 22 nt, Human
auuguuaaaaagguggaaaugc

SEQ ID NO: 670383 - RNA, 22 nt, Human
gaaggagagggucaaggauaau

SEQ ID NO: 670384 - RNA, 22 nt, Human
cacaaaugacugaaacgacugu

SEQ ID NO: 670385 - RNA, 22 nt, Human
cagguucccagguccagggcuu

SEQ ID NO: 670386 - RNA, 22 nt, Human
agcaguggcuggauggugugcu

SEQ ID NO: 670387 - RNA, 20 nt, Human
auguccugcuucuccucacc

SEQ ID NO: 670388 - RNA, 20 nt, Human
augaggccagcagggcucag

SEQ ID NO: 670389 - RNA, 22 nt, Human
agcacagguaauacagaguaac

SEQ ID NO: 670390 - RNA, 22 nt, Human
ucuguguuuaaaagauaugucc

SEQ ID NO: 670391 - RNA, 22 nt, Human
agccaagcaccacuggcacucg

SEQ ID NO: 670392 - RNA, 22 nt, Human
gggagcaguuaaaaugauuccu

SEQ ID NO: 670393 - RNA, 22 nt, Human
ucuugagucuaaucugaacuuu

SEQ ID NO: 670394 - RNA, 22 nt, Human
aaaaguaaucgcaguuuuugcc

SEQ ID NO: 670395 - RNA, 22 nt, Human
ggugacggggcccagguuuccu

SEQ ID NO: 670396 - RNA, 22 nt, Human
agagcagagggcucugggacaa

SEQ ID NO: 670397 - RNA, 22 nt, Human
ugaaacaauuagaauguaauga

SEQ ID NO: 670398 - RNA, 22 nt, Human
gggagacaaggagaaccaaaga

SEQ ID NO: 670399 - RNA, 22 nt, Human
gcacacagaaucagugggcaua

SEQ ID NO: 670400 - RNA, 22 nt, Human
cuccuucaugucauguguccgg

SEQ ID NO: 670401 - RNA, 21 nt, Human
ucaaaucauguacugaccaca

SEQ ID NO: 670402 - RNA, 22 nt, Human
aagcaccuggguuauaucuuag

SEQ ID NO: 670403 - RNA, 22 nt, Human
agggcagcuaaggugcugacug

SEQ ID NO: 670404 - RNA, 22 nt, Human
uguuucuuuguagauauucuuu

SEQ ID NO: 670405 - RNA, 22 nt, Human
auccugaguuccugccucuaaa

SEQ ID NO: 670406 - RNA, 22 nt, Human
cugaggccucuguucaccagaa

SEQ ID NO: 670407 - RNA, 22 nt, Human
aagcccuggcccaaccuugauu

SEQ ID NO: 670408 - RNA, 22 nt, Human
ggcaccaucagcugugcagggg

SEQ ID NO: 670409 - RNA, 21 nt, Human
ggacaauuguucauuuucuuu

SEQ ID NO: 670410 - RNA, 22 nt, Human
cucuuagcugcuguucuuugag

SEQ ID NO: 670411 - RNA, 22 nt, Human
ucaggcccuuugcugcugcccc

SEQ ID NO: 670412 - RNA, 22 nt, Human
ggcugcaggaugcccagccgug

SEQ ID NO: 670413 - RNA, 21 nt, Human
ggaggucccuucugguuucag

SEQ ID NO: 670414 - RNA, 22 nt, Human
cacucugaugguuucuguucaa

SEQ ID NO: 670415 - RNA, 22 nt, Human
uacaggagcauggggaagggau

SEQ ID NO: 670416 - RNA, 22 nt, Human
gaaagcacccaagauuuccuuc

SEQ ID NO: 670417 - RNA, 22 nt, Human
uuugacaaauauuuauuggcac

SEQ ID NO: 670418 - RNA, 22 nt, Human
uaggccauugauuuuuauaagu

SEQ ID NO: 670419 - RNA, 21 nt, Human
ggcaguaagauuuacuuuaag

SEQ ID NO: 670420 - RNA, 22 nt, Human
gaaauaauacagugcucuucuc

SEQ ID NO: 670421 - RNA, 22 nt, Human
guuugccugccgacgcucucau

SEQ ID NO: 670422 - RNA, 22 nt, Human
aacaccagucccaagagaggcu

SEQ ID NO: 670423 - RNA, 22 nt, Human
acaaaaagggagaugagguaga

SEQ ID NO: 670424 - RNA, 20 nt, Human
cagcccuuuauccuccuaug

SEQ ID NO: 670425 - RNA, 22 nt, Human
ggcuccagggaguggagagaag

SEQ ID NO: 670426 - RNA, 22 nt, Human
aaaaaugugaccacaggguguu

SEQ ID NO: 670427 - RNA, 22 nt, Human
caggcugggacugaccccugcu

SEQ ID NO: 670428 - RNA, 22 nt, Human
aagugacaaaaggguauccaaa

SEQ ID NO: 670429 - RNA, 22 nt, Human
uccaagaaucagucucuuuugg

SEQ ID NO: 670430 - RNA, 22 nt, Human
cauggcaggaaaaugaacaggc

SEQ ID NO: 670431 - RNA, 22 nt, Human
accccaggaaguggaggucaug

SEQ ID NO: 670432 - RNA, 22 nt, Human
gugugagccaugauguguccag

SEQ ID NO: 670433 - RNA, 22 nt, Human
uccaagaagagccuuucuccuc

SEQ ID NO: 670434 - RNA, 22 nt, Human
aaacuucagggaauaaaagagu

SEQ ID NO: 670435 - RNA, 22 nt, Human
auugugcagaauuggaauugca

SEQ ID NO: 670436 - RNA, 22 nt, Human
aucauuuggggaauuguggaca

SEQ ID NO: 670437 - RNA, 22 nt, Human
cagcugugcuagaagccacgaa

SEQ ID NO: 670438 - RNA, 22 nt, Human
cccaaggaagacgcuugugaua

SEQ ID NO: 670439 - RNA, 22 nt, Human
cugcugagcccuggcacaggug

SEQ ID NO: 670440 - RNA, 22 nt, Human
auucaaaccccauagacaacuu

SEQ ID NO: 670441 - RNA, 22 nt, Human
auugauaucaguuugcugauug

SEQ ID NO: 670442 - RNA, 23 nt, Human
gccuggauuaaggcagugacuuc

SEQ ID NO: 670443 - RNA, 22 nt, Human
ccaucuguaucugacaaauucu

SEQ ID NO: 670444 - RNA, 22 nt, Human
ucccuggcagcuaagggugguc

SEQ ID NO: 670445 - RNA, 22 nt, Human
agccccuugcacuuccccacgc

SEQ ID NO: 670446 - RNA, 22 nt, Human
augaaugauuugucagucacag

SEQ ID NO: 670447 - RNA, 22 nt, Human
augugcaaauccaaugugaaug

SEQ ID NO: 670448 - RNA, 18 nt, Human
ugcugggguagaauccac

SEQ ID NO: 670449 - RNA, 22 nt, Human
ugaccccacugugcucagaggu

SEQ ID NO: 670450 - RNA, 22 nt, Human
guaacaaaguuucuaggugcug

SEQ ID NO: 670451 - RNA, 21 nt, Human
auggcugguggcucagccucc

SEQ ID NO: 670452 - RNA, 22 nt, Human
guauuucccccagacucccugg

SEQ ID NO: 670453 - RNA, 22 nt, Human
cagcuucccuuggcugagcaga

SEQ ID NO: 670454 - RNA, 22 nt, Human
uguauaaauuuaaauuccugcu

SEQ ID NO: 670455 - RNA, 22 nt, Human
guggggcuuccuggggcaaguu

SEQ ID NO: 670456 - RNA, 22 nt, Human
gaaggggacuggcagcugcaga

SEQ ID NO: 670457 - RNA, 22 nt, Human
uuuguucaauccagacaauagc

SEQ ID NO: 670458 - RNA, 22 nt, Human
uggcuuuauaaauccacugguu

SEQ ID NO: 670459 - RNA, 22 nt, Human
uuagccauguugaagauuuaga

SEQ ID NO: 670460 - RNA, 22 nt, Human
caugcauauuacuagcacagca

SEQ ID NO: 670461 - RNA, 22 nt, Human
guaugcaucgacucaagucuga

SEQ ID NO: 670462 - RNA, 22 nt, Human
ccaggcucugacauagauggga

SEQ ID NO: 670463 - RNA, 23 nt, Human
aguguucagcauguaguaaauac

SEQ ID NO: 670464 - RNA, 22 nt, Human
ucaguuaauauggguaaagcau

SEQ ID NO: 670465 - RNA, 22 nt, Human
cacaggaagcaagccuggggcc

SEQ ID NO: 670466 - RNA, 22 nt, Human
uugugaaaucguguuuggaagc

SEQ ID NO: 670467 - RNA, 22 nt, Human
ggagugaguacuggaguagcug

SEQ ID NO: 670468 - RNA, 22 nt, Human
uucuggaagccaugggaacagg

SEQ ID NO: 670469 - RNA, 22 nt, Human
ugcuggcuguucuagggaggcc

SEQ ID NO: 670470 - RNA, 22 nt, Human
ccugccuguaagauggguacaa

SEQ ID NO: 670471 - RNA, 22 nt, Human
auagaucaauauuuagaaacuu

SEQ ID NO: 670472 - RNA, 22 nt, Human
uggaggagugugauugucugcc

SEQ ID NO: 670473 - RNA, 22 nt, Human
agagagcauggcacagaggggu

SEQ ID NO: 670474 - RNA, 22 nt, Human
auagauguguguaaguacauaa

SEQ ID NO: 670475 - RNA, 22 nt, Human
ccaccuggggccucugagucuc

SEQ ID NO: 670476 - RNA, 22 nt, Human
guucacagcugggacaagacug

SEQ ID NO: 670477 - RNA, 22 nt, Human
aaugaugacaggauaaagaaca

SEQ ID NO: 670478 - RNA, 22 nt, Human
cacaugguggugcuugauaagc

SEQ ID NO: 670479 - RNA, 22 nt, Human
uccagggcucauucccucugca

SEQ ID NO: 670480 - RNA, 22 nt, Human
uggguucuuucacuucucaguu

SEQ ID NO: 670481 - RNA, 18 nt, Human
aagccagagaccacugcc

SEQ ID NO: 670482 - RNA, 22 nt, Human
acaaugcauaccuagcagcuca

SEQ ID NO: 670483 - RNA, 22 nt, Human
agcugugaccuucaagagcuac

SEQ ID NO: 670484 - RNA, 22 nt, Human
augaaagugaagguuuacuaag

SEQ ID NO: 670485 - RNA, 22 nt, Human
uggggccugagguggagcugca

SEQ ID NO: 670486 - RNA, 22 nt, Human
ccagcugucacucagaaaggcc

SEQ ID NO: 670487 - RNA, 21 nt, Human
gcuggcucucugacgugcuuu

SEQ ID NO: 670488 - RNA, 22 nt, Human
gauugaaaggucuuuaaauugg

SEQ ID NO: 670489 - RNA, 22 nt, Human
ugacauuuaauuaacgaaugcu

SEQ ID NO: 670490 - RNA, 22 nt, Human
uucugcuuauucuguagccuuu

SEQ ID NO: 670491 - RNA, 22 nt, Human
cagggcuggguuaaaagcaggg

SEQ ID NO: 670492 - RNA, 22 nt, Human
auauucuauaagcaguuggaag

SEQ ID NO: 670493 - RNA, 22 nt, Human
ugucucugaggugagggucagc

SEQ ID NO: 670494 - RNA, 22 nt, Human
auuaaaugguggucauucauuu

SEQ ID NO: 670495 - RNA, 22 nt, Human
cuggcucccggggaucgagcac

SEQ ID NO: 670496 - RNA, 22 nt, Human
aagcuuaaucagucugguugca

SEQ ID NO: 670497 - RNA, 20 nt, Human
aacauugaaagucuagaaga

SEQ ID NO: 670498 - RNA, 22 nt, Human
uaccuuggaaaugcuagaguaa

SEQ ID NO: 670499 - RNA, 22 nt, Human
accuuuggagcaugcauuuucu

SEQ ID NO: 670500 - RNA, 21 nt, Human
auggagucaggggaaugggcc

SEQ ID NO: 670501 - RNA, 22 nt, Human
aagaaugucaagcagaaggucu

SEQ ID NO: 670502 - RNA, 22 nt, Human
ggccagaggugguacauagcuu

SEQ ID NO: 670503 - RNA, 22 nt, Human
gaaggcacagauggcaguccac

SEQ ID NO: 670504 - RNA, 22 nt, Human
auaugaaaguaagcaugugugu

SEQ ID NO: 670505 - RNA, 22 nt, Human
ugaggccaagaaaagcugggug

SEQ ID NO: 670506 - RNA, 22 nt, Human
aauuuacaguugcugaugguac

SEQ ID NO: 670507 - RNA, 22 nt, Human
ggguggccuucauagcucaggg

SEQ ID NO: 670508 - RNA, 22 nt, Human
cccucacuguccuugggcccuu

SEQ ID NO: 670509 - RNA, 22 nt, Human
ccugcagguccccggaugcgca

SEQ ID NO: 670510 - RNA, 22 nt, Human
aggcacuugaauugaugauguu

SEQ ID NO: 670511 - RNA, 22 nt, Human
uaugacagugaaaaaaaucaga

SEQ ID NO: 670512 - RNA, 18 nt, Human
guuaauuuugaaguucau

SEQ ID NO: 670513 - RNA, 22 nt, Human
uuuccuuucucaagagccggca

SEQ ID NO: 670514 - RNA, 22 nt, Human
cuuccucugccucccgugcuca

SEQ ID NO: 670515 - RNA, 22 nt, Human
aggcuuuaaguggccuacagcu

SEQ ID NO: 670516 - RNA, 22 nt, Human
gcucaagagagaugcaguucuu

SEQ ID NO: 670517 - RNA, 22 nt, Human
uuuugcuuaucugagugcagcc

SEQ ID NO: 670518 - RNA, 22 nt, Human
gggagcuggagcuggaagacuc

SEQ ID NO: 670519 - RNA, 22 nt, Human
ucccaggccauaaaacucagag

SEQ ID NO: 670520 - RNA, 22 nt, Human
gccaggcacugcucuaagcccu

SEQ ID NO: 670521 - RNA, 22 nt, Human
gacagccaggucugaugaccca

SEQ ID NO: 670522 - RNA, 22 nt, Human
uguggcagucucacuggagggc

SEQ ID NO: 670523 - RNA, 22 nt, Human
gcuggagauaguaggauccaua

SEQ ID NO: 670524 - RNA, 22 nt, Human
ggaagccuaaagcccaggucuc

SEQ ID NO: 670525 - RNA, 22 nt, Human
uucugaaauucgacuauccaau

SEQ ID NO: 670526 - RNA, 21 nt, Human
ggcagcccgcccucuccuggc

SEQ ID NO: 670527 - RNA, 22 nt, Human
uaaguucaaaucaucccaacuu

SEQ ID NO: 670528 - RNA, 22 nt, Human
uauuaucuaguaacugauagug

SEQ ID NO: 670529 - RNA, 22 nt, Human
ugaggcugccuugggaagaggg

SEQ ID NO: 670530 - RNA, 22 nt, Human
uggcuuuaggguuccuucuacc

SEQ ID NO: 670531 - RNA, 22 nt, Human
uguaugcagggcuuguaugcag

SEQ ID NO: 670532 - RNA, 22 nt, Human
auuacagugccaccucgugguc

SEQ ID NO: 670533 - RNA, 22 nt, Human
gcugcugcuugaaggcucggag

SEQ ID NO: 670534 - RNA, 20 nt, Human
uuucaagucagcaauucuca

SEQ ID NO: 670535 - RNA, 22 nt, Human
aucaguuauuuuuaagcuauaa

SEQ ID NO: 670536 - RNA, 19 nt, Human
ucuccaguugcuuucaggg

SEQ ID NO: 670537 - RNA, 22 nt, Human
cuccuucccuucaaguguuccu

SEQ ID NO: 670538 - RNA, 22 nt, Human
ucagagcacuuggcucauggca

SEQ ID NO: 670539 - RNA, 22 nt, Human
agaucagacuuugugacuagga

SEQ ID NO: 670540 - RNA, 22 nt, Human
uagcuucuugagaaagggugcc

SEQ ID NO: 670541 - RNA, 22 nt, Human
aucuaauuuucacucauuugcu

SEQ ID NO: 670542 - RNA, 22 nt, Human
uguucaauccccagguccugaa

SEQ ID NO: 670543 - RNA, 22 nt, Human
gcuuuuauugucuuuacgacga

SEQ ID NO: 670544 - RNA, 22 nt, Human
cccagggaagggcuaccugagg

SEQ ID NO: 670545 - RNA, 22 nt, Human
aggaguguggccagggcucugg

SEQ ID NO: 670546 - RNA, 16 nt, Human
ccugggcucuguugga

SEQ ID NO: 670547 - RNA, 22 nt, Human
cucuggggaagcagccagcugg

SEQ ID NO: 670548 - RNA, 22 nt, Human
gcagagcauuucgguugcuucc

SEQ ID NO: 670549 - RNA, 22 nt, Human
gcuggcuuuugaagucuagcua

SEQ ID NO: 670550 - RNA, 22 nt, Human
aaguugcuaaugauguguuugc

SEQ ID NO: 670551 - RNA, 22 nt, Human
cuccaggacugaggacagagcu

SEQ ID NO: 670552 - RNA, 22 nt, Human
cccuuccucaaggagcuguguu

SEQ ID NO: 670553 - RNA, 22 nt, Human
agcuccugcacccagccuugag

SEQ ID NO: 670554 - RNA, 22 nt, Human
cuucagaggggacucaaaguca

SEQ ID NO: 670555 - RNA, 22 nt, Human
gccugcuguuaacugcaggaau

SEQ ID NO: 670556 - RNA, 22 nt, Human
acuggggcagugggcagugguu

SEQ ID NO: 670557 - RNA, 22 nt, Human
uuugacaccaggagagaaaaca

SEQ ID NO: 670558 - RNA, 22 nt, Human
gacccuguuucuacaaauaauu

SEQ ID NO: 670559 - RNA, 22 nt, Human
aaauuccaguucuuuuaccugc

SEQ ID NO: 670560 - RNA, 22 nt, Human
uaaauuuuuguuaacagccucu

SEQ ID NO: 670561 - RNA, 22 nt, Human
cuggccaggagguaaccagaug

SEQ ID NO: 670562 - RNA, 22 nt, Human
cagugucugggacagaaaguca

SEQ ID NO: 670563 - RNA, 22 nt, Human
caagagcucagaaacccuugcu

SEQ ID NO: 670564 - RNA, 22 nt, Human
gucugagcgcuggagcuugugu

SEQ ID NO: 670565 - RNA, 17 nt, Human
ccuuagggcaguguggu

SEQ ID NO: 670566 - RNA, 22 nt, Human
uuucagagguaugcugcuuauc

SEQ ID NO: 670567 - RNA, 22 nt, Human
ugcuggaaaaagauuguguuuu

SEQ ID NO: 670568 - RNA, 19 nt, Human
aggaaacugucuuuuccag

SEQ ID NO: 670569 - RNA, 22 nt, Human
cuguguuuugagauauuauuaa

SEQ ID NO: 670570 - RNA, 22 nt, Human
gaggcccaaggacucugucccg

SEQ ID NO: 670571 - RNA, 22 nt, Human
ccagggcucgggugcuuaguca

SEQ ID NO: 670572 - RNA, 22 nt, Human
gcacagggcaacaggucuguua

SEQ ID NO: 670573 - RNA, 22 nt, Human
cacugaagaugcgacuagugcu

SEQ ID NO: 670574 - RNA, 22 nt, Human
gacagaauuuuccaucaugugg

SEQ ID NO: 670575 - RNA, 22 nt, Human
ggguuaaagcaggaagcaucuu

SEQ ID NO: 670576 - RNA, 21 nt, Human
aaagugguaaggauuauuuug

SEQ ID NO: 670577 - RNA, 22 nt, Human
gcugggcaaggcugaagcuacc

SEQ ID NO: 670578 - RNA, 22 nt, Human
ccagcugugcuguuggcuuguc

SEQ ID NO: 670579 - RNA, 17 nt, Human
ccuuucuucccagaggg

SEQ ID NO: 670580 - RNA, 22 nt, Human
ccagcugcuuuuugucacaugg

SEQ ID NO: 670581 - RNA, 22 nt, Human
auggagggaaaaguggagagcc

SEQ ID NO: 670582 - RNA, 22 nt, Human
ugaggaaggaauugagguuuua

SEQ ID NO: 670583 - RNA, 22 nt, Human
aguaaacacugucuuuauauau

SEQ ID NO: 670584 - RNA, 22 nt, Human
uggaagacauuuuggaccuugg

SEQ ID NO: 670585 - RNA, 22 nt, Human
gcauuuuaaugagguuuaugag

SEQ ID NO: 670586 - RNA, 22 nt, Human
ggaagagagggcugggccucaa

SEQ ID NO: 670587 - RNA, 22 nt, Human
ucucuggguccuggcaagcuca

SEQ ID NO: 670588 - RNA, 22 nt, Human
uuguacuuuggggaaauguuga

SEQ ID NO: 670589 - RNA, 18 nt, Human
gagcuucaggcuaaccug

SEQ ID NO: 670590 - RNA, 22 nt, Human
cugacaguaacuaauguggaga

SEQ ID NO: 670591 - RNA, 22 nt, Human
aggacagcaguuggugagguuc

SEQ ID NO: 670592 - RNA, 22 nt, Human
auucaagguuuauucaguuuag

SEQ ID NO: 670593 - RNA, 22 nt, Human
aguggaagagccauguuccaac

SEQ ID NO: 670594 - RNA, 22 nt, Human
aagaugccuguagcaggaagau

SEQ ID NO: 670595 - RNA, 22 nt, Human
agggcagaaaucgauuacaccu

SEQ ID NO: 670596 - RNA, 22 nt, Human
uuuauucauuguuucgucgcag

SEQ ID NO: 670597 - RNA, 22 nt, Human
acucugggaauccucaccuucc

SEQ ID NO: 670598 - RNA, 22 nt, Human
ucuccucucuuaccugguacaa

SEQ ID NO: 670599 - RNA, 22 nt, Human
ugacagugacagccaaaggcuu

SEQ ID NO: 670600 - RNA, 22 nt, Human
gguguccgcgcuguagaagguc

SEQ ID NO: 670601 - RNA, 22 nt, Human
uguggccucaaggcugcccuca

SEQ ID NO: 670602 - RNA, 21 nt, Human
caguguggugaccagggucuc

SEQ ID NO: 670603 - RNA, 22 nt, Human
uuucaguguaagguuuccagga

SEQ ID NO: 670604 - RNA, 22 nt, Human
gagcuuggggcauauggugcua

SEQ ID NO: 670605 - RNA, 22 nt, Human
aagggacuuugucagcuuucca

SEQ ID NO: 670606 - RNA, 22 nt, Human
cccuuucccuucuggcucaggg

SEQ ID NO: 670607 - RNA, 22 nt, Human
ugcaguaggcacguggcuguga

SEQ ID NO: 670608 - RNA, 22 nt, Human
uguccuugaugaauaugaaauu

SEQ ID NO: 670609 - RNA, 22 nt, Human
aauuaccaggauuuuucaguau

SEQ ID NO: 670610 - RNA, 22 nt, Human
guuaaugugguagugcauaucu

SEQ ID NO: 670611 - RNA, 22 nt, Human
gaggggcugggcagucccugga

SEQ ID NO: 670612 - RNA, 22 nt, Human
cauuugaucuccugaauaaaca

SEQ ID NO: 670613 - RNA, 19 nt, Human
cugcagggaugugcagagu

SEQ ID NO: 670614 - RNA, 22 nt, Human
gaagggcuuggcugggaggcca

SEQ ID NO: 670615 - RNA, 22 nt, Human
uugcuuuauuuggcaugccacu

SEQ ID NO: 670616 - RNA, 22 nt, Human
agcacagauaacauggagugga

SEQ ID NO: 670617 - RNA, 22 nt, Human
acauagaacuucgaugucuuuu

SEQ ID NO: 670618 - RNA, 22 nt, Human
uccagggaguuggcuggauagu

SEQ ID NO: 670619 - RNA, 23 nt, Human
ugagaaauuuugauucaguagga

SEQ ID NO: 670620 - RNA, 22 nt, Human
gcucaggcauguaugugguugc

SEQ ID NO: 670621 - RNA, 22 nt, Human
acagauccugguuacagccauu

SEQ ID NO: 670622 - RNA, 22 nt, Human
guggcccuggaguugugacacu

SEQ ID NO: 670623 - RNA, 22 nt, Human
uacagcuguugguguuuccucu

SEQ ID NO: 670624 - RNA, 22 nt, Human
aggagacauaacuaugaugaga

SEQ ID NO: 670625 - RNA, 22 nt, Human
uaaacaucuguagccuucaguc

SEQ ID NO: 670626 - RNA, 22 nt, Human
aauuguaacuacauugagaaca

SEQ ID NO: 670627 - RNA, 22 nt, Human
ccugggagggcaagugcugaug

SEQ ID NO: 670628 - RNA, 22 nt, Human
aaugucacucuguuuccucugc

SEQ ID NO: 670629 - RNA, 22 nt, Human
caguacuuggucaaggaagcag

SEQ ID NO: 670630 - RNA, 22 nt, Human
guguguuucagaagccaggugu

SEQ ID NO: 670631 - RNA, 22 nt, Human
cucugugccucaguuuucuucu

SEQ ID NO: 670632 - RNA, 22 nt, Human
ugucaaauuauguaaugggaag

SEQ ID NO: 670633 - RNA, 22 nt, Human
uagggcugugucuccaggacca

SEQ ID NO: 670634 - RNA, 22 nt, Human
ggaauacaaaucuuuguucucu

SEQ ID NO: 670635 - RNA, 21 nt, Human
agcacagcauauccaauguca

SEQ ID NO: 670636 - RNA, 22 nt, Human
guguggggucuucucuuggccu

SEQ ID NO: 670637 - RNA, 22 nt, Human
uugcugagcuuuggcaaggaag

SEQ ID NO: 670638 - RNA, 23 nt, Human
uuauaaauauuuucagguguguu

SEQ ID NO: 670639 - RNA, 22 nt, Human
aucuguccugugacagugggag

SEQ ID NO: 670640 - RNA, 22 nt, Human
ugggccaguccagccccaggga

SEQ ID NO: 670641 - RNA, 22 nt, Human
cuccaggagguugcugcuuccu

SEQ ID NO: 670642 - RNA, 22 nt, Human
gagggcugauaacaggaauaca

SEQ ID NO: 670643 - RNA, 22 nt, Human
gaaaucacuuuuuucauaguug

SEQ ID NO: 670644 - RNA, 22 nt, Human
ugauuuccuggcuuuggaguuc

SEQ ID NO: 670645 - RNA, 22 nt, Human
gaucauugcugccuuuuucuau

SEQ ID NO: 670646 - RNA, 22 nt, Human
aagauauauuuuggugauuuca

SEQ ID NO: 670647 - RNA, 22 nt, Human
ugcuuuauuuauaaaauagcaa

SEQ ID NO: 670648 - RNA, 22 nt, Human
gggccugcuccccaucgcugcu

SEQ ID NO: 670649 - RNA, 21 nt, Human
ugacugaggcuucuucacaca

SEQ ID NO: 670650 - RNA, 23 nt, Human
ggagccagccuguggggagcggg

SEQ ID NO: 670651 - RNA, 22 nt, Human
agaguggggacagggccugucc

SEQ ID NO: 670652 - RNA, 23 nt, Human
ugacacaggucaaaaauaagaug

SEQ ID NO: 670653 - RNA, 22 nt, Human
aucuaacugggcuauuuuauug

SEQ ID NO: 670654 - RNA, 22 nt, Human
uuuaaauuuguguuuagagggu

SEQ ID NO: 670655 - RNA, 22 nt, Human
ggcagugcaaggcuggcacagu

SEQ ID NO: 670656 - RNA, 17 nt, Human
ccucacagggaccagac

SEQ ID NO: 670657 - RNA, 22 nt, Human
gcugggcucagaccuagugaac

SEQ ID NO: 670658 - RNA, 22 nt, Human
agguauaugcuauuacuucugc

SEQ ID NO: 670659 - RNA, 22 nt, Human
aggcucugacccaugggaccca

SEQ ID NO: 670660 - RNA, 17 nt, Human
uauggcuguguuugugc

SEQ ID NO: 670661 - RNA, 22 nt, Human
gcuuagcagugugugcuuuuga

SEQ ID NO: 670662 - RNA, 22 nt, Human
ccaugcagugcuggagcugauu

SEQ ID NO: 670663 - RNA, 22 nt, Human
cagagagagcaggaaaccuccg

SEQ ID NO: 670664 - RNA, 22 nt, Human
uaagcauuguuucugaggaugg

SEQ ID NO: 670665 - RNA, 22 nt, Human
ucuucucuacaccagcagcccc

SEQ ID NO: 670666 - RNA, 22 nt, Human
gagcuggucaguuucaggagag

SEQ ID NO: 670667 - RNA, 22 nt, Human
uaaauggcaaccccuagagcug

SEQ ID NO: 670668 - RNA, 22 nt, Human
cagcacaauuuucaggagucca

SEQ ID NO: 670669 - RNA, 22 nt, Human
auccugaguucucagagucucc

SEQ ID NO: 670670 - RNA, 22 nt, Human
ccugagagugagggccuccuua

SEQ ID NO: 670671 - RNA, 22 nt, Human
guagaaaauuaggaugaggcuu

SEQ ID NO: 670672 - RNA, 22 nt, Human
aaguagcauuccaugguauaga

SEQ ID NO: 670673 - RNA, 22 nt, Human
augauuucuauauaaacuuaaa

SEQ ID NO: 670674 - RNA, 17 nt, Human
ccagugccuguggcaac

SEQ ID NO: 670675 - RNA, 22 nt, Human
aaugauaagacaugaguagagg

SEQ ID NO: 670676 - RNA, 22 nt, Human
auggccaagaauauuucucaac

SEQ ID NO: 670677 - RNA, 22 nt, Human
cucaaauaccucuccaugugac

SEQ ID NO: 670678 - RNA, 22 nt, Human
uagaaguuaugauaauaauagu

SEQ ID NO: 670679 - RNA, 22 nt, Human
uucagcaacucaaaccuauuag

SEQ ID NO: 670680 - RNA, 22 nt, Human
ccucacaguguucgugucagau

SEQ ID NO: 670681 - RNA, 22 nt, Human
ugggaauggaugcuaagugcua

SEQ ID NO: 670682 - RNA, 22 nt, Human
cccaguguuacgugacagccug

SEQ ID NO: 670683 - RNA, 22 nt, Human
uuuguucaccuagcaaacuuuu

SEQ ID NO: 670684 - RNA, 20 nt, Human
ugagucagcugcaugggugg

SEQ ID NO: 670685 - RNA, 22 nt, Human
ccagggugagugucauggguua

SEQ ID NO: 670686 - RNA, 23 nt, Human
ccaagcuugucccugccugcuuu

SEQ ID NO: 670687 - RNA, 22 nt, Human
gcuggccuugugucugaggaag

SEQ ID NO: 670688 - RNA, 22 nt, Human
aaugaacaucaaaugccuacca

SEQ ID NO: 670689 - RNA, 23 nt, Human
uuguaaaacagugugacgguucc

SEQ ID NO: 670690 - RNA, 22 nt, Human
agcuuagugguuguaugaguua

SEQ ID NO: 670691 - RNA, 22 nt, Human
ugcauuccuuugucuguuaaag

SEQ ID NO: 670692 - RNA, 22 nt, Human
uccuggagagugggcgagcaca

SEQ ID NO: 670693 - RNA, 22 nt, Human
uuguaacacuuuucuauuaaua

SEQ ID NO: 670694 - RNA, 22 nt, Human
ucagggcagaauccaaagaauu

SEQ ID NO: 670695 - RNA, 22 nt, Human
gcuuagcaaacaucuguagucc

SEQ ID NO: 670696 - RNA, 22 nt, Human
gaggagacugacagcagauucu

SEQ ID NO: 670697 - RNA, 22 nt, Human
caaaugcaaaauauaacccugu

SEQ ID NO: 670698 - RNA, 19 nt, Human
acacaugaggagggacccc

SEQ ID NO: 670699 - RNA, 22 nt, Human
aaugaggugaggaaggccucag

SEQ ID NO: 670700 - RNA, 22 nt, Human
ucuggaaauuucaguuuuagag

SEQ ID NO: 670701 - RNA, 18 nt, Human
ccuaggaaagggaggcaa

SEQ ID NO: 670702 - RNA, 22 nt, Human
cagcagaaacccagcaaagcca

SEQ ID NO: 670703 - RNA, 22 nt, Human
caguuucugggcguucacaggu

SEQ ID NO: 670704 - RNA, 22 nt, Human
uagaaacauauguuugagacau

SEQ ID NO: 670705 - RNA, 22 nt, Human
guggccaaaaggaagaagguua

SEQ ID NO: 670706 - RNA, 22 nt, Human
uaugcacaguuacaagaauauc

SEQ ID NO: 670707 - RNA, 22 nt, Human
agcugccuggagucauuuccug

SEQ ID NO: 670708 - RNA, 22 nt, Human
uucagaaugugaccuuauuugg

SEQ ID NO: 670709 - RNA, 22 nt, Human
cagguggggcgcccucaggcag

SEQ ID NO: 670710 - RNA, 22 nt, Human
accucgaguucuuucaauucac

SEQ ID NO: 670711 - RNA, 20 nt, Human
gccagcugcccuuccacccu

SEQ ID NO: 670712 - RNA, 22 nt, Human
cccuuuggcauuuccaggauau

SEQ ID NO: 670713 - RNA, 22 nt, Human
ugugaagaguagacauguggug

SEQ ID NO: 670714 - RNA, 22 nt, Human
uggcuaccugauuucuuuucag

SEQ ID NO: 670715 - RNA, 22 nt, Human
cagugugggugaaauacaaagu

SEQ ID NO: 670716 - RNA, 22 nt, Human
cuggauaaauguuugcuuuaga

SEQ ID NO: 670717 - RNA, 22 nt, Human
guggauggauugaggcaguggg

SEQ ID NO: 670718 - RNA, 22 nt, Human
gagcaaggaggguggggccuuu

SEQ ID NO: 670719 - RNA, 23 nt, Human
gccaggcacaugguggacacgca

SEQ ID NO: 670720 - RNA, 22 nt, Human
uccagggagucaaaugaacuac

SEQ ID NO: 670721 - RNA, 22 nt, Human
ccuugcagacaucaguaguggc

SEQ ID NO: 670722 - RNA, 22 nt, Human
uggccugguaccacauagauuu

SEQ ID NO: 670723 - RNA, 22 nt, Human
ugagguggugcuaaucucugcu

SEQ ID NO: 670724 - RNA, 22 nt, Human
cucuccccgguacgagcggccg

SEQ ID NO: 670725 - RNA, 22 nt, Human
auggcccuuuauuccuucuucc

SEQ ID NO: 670726 - RNA, 22 nt, Human
caggccucuccuuagucuggca

SEQ ID NO: 670727 - RNA, 22 nt, Human
ggcgccccauauaguucuuaau

SEQ ID NO: 670728 - RNA, 22 nt, Human
uaauuuauauggaauuguugcu

SEQ ID NO: 670729 - RNA, 22 nt, Human
agauacauuguucuaagcauug

SEQ ID NO: 670730 - RNA, 22 nt, Human
gcagcagaaguagaaguacagg

SEQ ID NO: 670731 - RNA, 22 nt, Human
ugucacuacaucauaaauauau

SEQ ID NO: 670732 - RNA, 22 nt, Human
acauuaaagaguaagguuaguu

SEQ ID NO: 670733 - RNA, 22 nt, Human
uauauuuaauuaguugcuggau

SEQ ID NO: 670734 - RNA, 22 nt, Human
ugagcagaguuguuucuccuga

SEQ ID NO: 670735 - RNA, 22 nt, Human
ugcuggcauuucaggacucacc

SEQ ID NO: 670736 - RNA, 22 nt, Human
gguggccauaggaccagccugg

SEQ ID NO: 670737 - RNA, 22 nt, Human
uuuagagguuagaggcugauag

SEQ ID NO: 670738 - RNA, 22 nt, Human
uuucuaaguaagauuaacuucu

SEQ ID NO: 670739 - RNA, 22 nt, Human
ggcccagcaucuugugaaguuu

SEQ ID NO: 670740 - RNA, 22 nt, Human
gcaugcaggauagguugagcuc

SEQ ID NO: 670741 - RNA, 22 nt, Human
ugauacaaucaugagagaggac

SEQ ID NO: 670742 - RNA, 22 nt, Human
auuguauacaagcuuaauuguu

SEQ ID NO: 670743 - RNA, 22 nt, Human
ucaggaaagaguuagaugauua

SEQ ID NO: 670744 - RNA, 22 nt, Human
ggacauuuaguuucauugggca

SEQ ID NO: 670745 - RNA, 21 nt, Human
caaguguggauguggaaggua

SEQ ID NO: 670746 - RNA, 22 nt, Human
ugugugaaggagccacuguuca

SEQ ID NO: 670747 - RNA, 22 nt, Human
uggaaucuguauguauguauaa

SEQ ID NO: 670748 - RNA, 22 nt, Human
accuggaggcagagguugcagu

SEQ ID NO: 670749 - RNA, 22 nt, Human
accucuggacacugcauccuuc

SEQ ID NO: 670750 - RNA, 22 nt, Human
ugguccugccccgugcacagag

SEQ ID NO: 670751 - RNA, 22 nt, Human
cauuaaauuccuuguucucaaa

SEQ ID NO: 670752 - RNA, 22 nt, Human
guagauuccaguggucuguguc

SEQ ID NO: 670753 - RNA, 22 nt, Human
aucugcauuuacauugcuugua

SEQ ID NO: 670754 - RNA, 22 nt, Human
cccguguggaugcgcuggugcu

SEQ ID NO: 670755 - RNA, 22 nt, Human
uacagcauguccuuagcaaggc

SEQ ID NO: 670756 - RNA, 22 nt, Human
ucaaacuggcagacuucuacuu

SEQ ID NO: 670757 - RNA, 23 nt, Human
agacagaggcugaggcuggccgc

SEQ ID NO: 670758 - RNA, 22 nt, Human
ugcuucaaaaaguuguuagagg

SEQ ID NO: 670759 - RNA, 22 nt, Human
aggcuucuuagauuggcuggag

SEQ ID NO: 670760 - RNA, 20 nt, Human
gagggugggacuuccuaggc

SEQ ID NO: 670761 - RNA, 22 nt, Human
gaggacaaggccuugcaauucu

SEQ ID NO: 670762 - RNA, 22 nt, Human
agcuaagacuuagugacuuagu

SEQ ID NO: 670763 - RNA, 22 nt, Human
gcacugggaaugugagcagcug

SEQ ID NO: 670764 - RNA, 22 nt, Human
uggagccaggagccugggaguc

SEQ ID NO: 670765 - RNA, 22 nt, Human
gccaguggcuugccaggcagga

SEQ ID NO: 670766 - RNA, 22 nt, Human
caguagucuuuuuccuccuaga

SEQ ID NO: 670767 - RNA, 22 nt, Human
ccucccagaugugcccaaugga

SEQ ID NO: 670768 - RNA, 22 nt, Human
cugugagggcagggaccagagg

SEQ ID NO: 670769 - RNA, 22 nt, Human
acuguacacacuucucugucuu

SEQ ID NO: 670770 - RNA, 19 nt, Human
caguccuuuccgcuuucuc

SEQ ID NO: 670771 - RNA, 22 nt, Human
uucccucucuagcuuuccccaa

SEQ ID NO: 670772 - RNA, 22 nt, Human
gaacccaggagguugcagugag

SEQ ID NO: 670773 - RNA, 22 nt, Human
ugugaaagucaaauuaauugaa

SEQ ID NO: 670774 - RNA, 22 nt, Human
cacuugauggaagagcagaaga

SEQ ID NO: 670775 - RNA, 22 nt, Human
agcuucuccugguacagaacug

SEQ ID NO: 670776 - RNA, 22 nt, Human
aggcugccuagguucaacaccu

SEQ ID NO: 670777 - RNA, 22 nt, Human
cagcuguucacauuuccaaaac

SEQ ID NO: 670778 - RNA, 22 nt, Human
guccacagcuggccagggccuc

SEQ ID NO: 670779 - RNA, 22 nt, Human
agcaagagcaugucggccuggu

SEQ ID NO: 670780 - RNA, 22 nt, Human
uuaguuuucccaucuuuauggu

SEQ ID NO: 670781 - RNA, 22 nt, Human
augcuacauuuugguuuauaaa

SEQ ID NO: 670782 - RNA, 22 nt, Human
agaugggcgcgcugcucugaug

SEQ ID NO: 670783 - RNA, 22 nt, Human
gagcaauggaagauagauaaca

SEQ ID NO: 670784 - RNA, 19 nt, Human
uggucuaaaugugugcccc

SEQ ID NO: 670785 - RNA, 22 nt, Human
uuuacagaugaggaaacugaga

SEQ ID NO: 670786 - RNA, 22 nt, Human
ggcaggcagauggcugcaccaa

SEQ ID NO: 670787 - RNA, 22 nt, Human
caugugcagacggugggcugga

SEQ ID NO: 670788 - RNA, 22 nt, Human
guccucuggugaaagcauuccc

SEQ ID NO: 670789 - RNA, 22 nt, Human
ucugagaauggagcuaaaaauc

SEQ ID NO: 670790 - RNA, 22 nt, Human
acuuucugccuuacaggagucc

SEQ ID NO: 670791 - RNA, 22 nt, Human
auugacacaaugggauguaagg

SEQ ID NO: 670792 - RNA, 22 nt, Human
cucuggcuuaguaugcuccaaa

SEQ ID NO: 670793 - RNA, 22 nt, Human
aaguugguaggagacagaaggu

SEQ ID NO: 670794 - RNA, 22 nt, Human
cacugaacuggucuuaggaggu

SEQ ID NO: 670795 - RNA, 22 nt, Human
ucaccuguuggauguauacugu

SEQ ID NO: 670796 - RNA, 22 nt, Human
auaacacuaaauguauguaaca

SEQ ID NO: 670797 - RNA, 22 nt, Human
ucuucagagacucugagccccu

SEQ ID NO: 670798 - RNA, 22 nt, Human
agguccaggccucaugauggcc

SEQ ID NO: 670799 - RNA, 22 nt, Human
augccugcuuacuccaggugcu

SEQ ID NO: 670800 - RNA, 22 nt, Human
ugaguggacgugaggcugagua

SEQ ID NO: 670801 - RNA, 22 nt, Human
guguggggccaggaucagggcu

SEQ ID NO: 670802 - RNA, 22 nt, Human
caggcagagacccucuccuaaa

SEQ ID NO: 670803 - RNA, 22 nt, Human
uaucaucacuguaauccguuga

SEQ ID NO: 670804 - RNA, 22 nt, Human
aaggagagagcuuugcuggaac

SEQ ID NO: 670805 - RNA, 22 nt, Human
gagggcuggggcuuaggcuuag

SEQ ID NO: 670806 - RNA, 22 nt, Human
gggcuccaaggaggccagccug

SEQ ID NO: 670807 - RNA, 22 nt, Human
ugcaaggguagaagugauggca

SEQ ID NO: 670808 - RNA, 22 nt, Human
uuaugacauaugaguacaagua

SEQ ID NO: 670809 - RNA, 22 nt, Human
uacacugugagguuuccaaggg

SEQ ID NO: 670810 - RNA, 22 nt, Human
aguuuguaucaauuugcuuuau

SEQ ID NO: 670811 - RNA, 22 nt, Human
ugaaggugaccugacaguggcu

SEQ ID NO: 670812 - RNA, 22 nt, Human
aaaagagguuaaccaggugugu

SEQ ID NO: 670813 - RNA, 22 nt, Human
guguuuccucacuucucugacu

SEQ ID NO: 670814 - RNA, 22 nt, Human
cacauucaauuacacagauagg

SEQ ID NO: 670815 - RNA, 22 nt, Human
uacagaaaaacuggcauugaag

SEQ ID NO: 670816 - RNA, 22 nt, Human
gcuccuggcucuggccaaggga

SEQ ID NO: 670817 - RNA, 22 nt, Human
cucaggagguuuccugucuagg

SEQ ID NO: 670818 - RNA, 22 nt, Human
ucuuucauguauaugcaaccua

SEQ ID NO: 670819 - RNA, 22 nt, Human
ugaugucugccaggguccuggg

SEQ ID NO: 670820 - RNA, 22 nt, Human
guccugagaugucacaagguuu

SEQ ID NO: 670821 - RNA, 22 nt, Human
ugagcuggcaggggcucaggga

SEQ ID NO: 670822 - RNA, 22 nt, Human
uaugcacauauaaccugcacug

SEQ ID NO: 670823 - RNA, 22 nt, Human
gugagguccucccugcugggag

SEQ ID NO: 670824 - RNA, 22 nt, Human
uaugcaaaugacugguauguuu

SEQ ID NO: 670825 - RNA, 22 nt, Human
gaguuuagccaauuuggucccc

SEQ ID NO: 670826 - RNA, 21 nt, Human
aagccagcccacagugguuug

SEQ ID NO: 670827 - RNA, 22 nt, Human
agccaacagccagcaucaacca

SEQ ID NO: 670828 - RNA, 22 nt, Human
cucuagcuuuugauaccagugu

SEQ ID NO: 670829 - RNA, 22 nt, Human
aauuuuaaucaguggugcugag

SEQ ID NO: 670830 - RNA, 23 nt, Human
ucucucuggcaaauuucacauau

SEQ ID NO: 670831 - RNA, 20 nt, Human
ugcuuguaauaccugcuuca

SEQ ID NO: 670832 - RNA, 23 nt, Human
gcugggcuuacucuuucagugag

SEQ ID NO: 670833 - RNA, 17 nt, Human
ucucuuguucacugcug

SEQ ID NO: 670834 - RNA, 22 nt, Human
uuagcauuucaguacacauguu

SEQ ID NO: 670835 - RNA, 22 nt, Human
ucaaaucaccaaacucacuggc

SEQ ID NO: 670836 - RNA, 22 nt, Human
uuccaagugggggaagcugagu

SEQ ID NO: 670837 - RNA, 22 nt, Human
cguguaugugccugcauucaca

SEQ ID NO: 670838 - RNA, 21 nt, Human
agcauucuuggccaguccacc

SEQ ID NO: 670839 - RNA, 22 nt, Human
gucuggagacuugggucaucaa

SEQ ID NO: 670840 - RNA, 22 nt, Human
auguucuuagcaaaguacuugc

SEQ ID NO: 670841 - RNA, 22 nt, Human
ucucccaagccuggcaggggca

SEQ ID NO: 670842 - RNA, 22 nt, Human
ugcucuaguggguagagcauug

SEQ ID NO: 670843 - RNA, 22 nt, Human
uaaugucuucuuuuaauuuggc

SEQ ID NO: 670844 - RNA, 22 nt, Human
cucaggaaccgcggcagcagcc

SEQ ID NO: 670845 - RNA, 22 nt, Human
accaagcacaaagaugaguaaa

SEQ ID NO: 670846 - RNA, 22 nt, Human
gcucacagcccaggccagcgug

SEQ ID NO: 670847 - RNA, 22 nt, Human
uauuuccauguuagaacuaagu

SEQ ID NO: 670848 - RNA, 22 nt, Human
aacaucugugaacuccgaaaau

SEQ ID NO: 670849 - RNA, 22 nt, Human
uuugaaagaauuuauguacuuu

SEQ ID NO: 670850 - RNA, 22 nt, Human
agugaaaugacugaaucagaua

SEQ ID NO: 670851 - RNA, 22 nt, Human
ugcuugucucucugugcccacu

SEQ ID NO: 670852 - RNA, 22 nt, Human
ccuuggguguuuaauagauaua

SEQ ID NO: 670853 - RNA, 18 nt, Human
ccugugcuccagcaucug

SEQ ID NO: 670854 - RNA, 23 nt, Human
gagauggcugguuguccucugaa

SEQ ID NO: 670855 - RNA, 22 nt, Human
cugggcucuaagggagcaccgu

SEQ ID NO: 670856 - RNA, 22 nt, Human
guuucuuuugugaucaccaacc

SEQ ID NO: 670857 - RNA, 21 nt, Human
ucaaacaugaucugggucauc

SEQ ID NO: 670858 - RNA, 22 nt, Human
acauuucucaucuaguagagua

SEQ ID NO: 670859 - RNA, 22 nt, Human
uuauucugagaguugaaguaau

SEQ ID NO: 670860 - RNA, 22 nt, Human
accucccagcucugagcuuggg

SEQ ID NO: 670861 - RNA, 22 nt, Human
auuuacagacguggauuagugc

SEQ ID NO: 670862 - RNA, 22 nt, Human
gggagugguugauggugaaaau

SEQ ID NO: 670863 - RNA, 22 nt, Human
ucuucauuuuauagcaucugug

SEQ ID NO: 670864 - RNA, 22 nt, Human
acagcagauuucccugggcucc

SEQ ID NO: 670865 - RNA, 22 nt, Human
uuggcgucuuuuccauggaaag

SEQ ID NO: 670866 - RNA, 22 nt, Human
ugcauucaaauccugauccugc

SEQ ID NO: 670867 - RNA, 22 nt, Human
acgauguggccugaaucaggca

SEQ ID NO: 670868 - RNA, 22 nt, Human
uaggcucagggcugggugacgg

SEQ ID NO: 670869 - RNA, 22 nt, Human
gcaggcucaaaagcugguagga

SEQ ID NO: 670870 - RNA, 22 nt, Human
cagugagguagacagcuuuuuc

SEQ ID NO: 670871 - RNA, 22 nt, Human
ugcuugacuuaguuucucauuu

SEQ ID NO: 670872 - RNA, 22 nt, Human
ccugggcuuucaaaaccagccu

SEQ ID NO: 670873 - RNA, 22 nt, Human
uagaaaccucagggaaaucuuu

SEQ ID NO: 670874 - RNA, 22 nt, Human
acaaagaaggaauuggucuuua

SEQ ID NO: 670875 - RNA, 22 nt, Human
guuaaacaguuacaugugcugg

SEQ ID NO: 670876 - RNA, 20 nt, Human
aguggggagucaggagugcc

SEQ ID NO: 670877 - RNA, 22 nt, Human
cuguuuauuacacuggauagca

SEQ ID NO: 670878 - RNA, 22 nt, Human
ucuuagaaguuuauggcacgga

SEQ ID NO: 670879 - RNA, 22 nt, Human
ugacagaacagguugggagcaa

SEQ ID NO: 670880 - RNA, 22 nt, Human
gagccagagcuacaagugucug

SEQ ID NO: 670881 - RNA, 22 nt, Human
ucuugcuagaaucauuuggaga

SEQ ID NO: 670882 - RNA, 22 nt, Human
cagcuggaggagcagcuuccag

SEQ ID NO: 670883 - RNA, 19 nt, Human
ucugaaguccagggcauac

SEQ ID NO: 670884 - RNA, 22 nt, Human
uuggcucauuaaagaugauaau

SEQ ID NO: 670885 - RNA, 22 nt, Human
aaacuugaacccagcucaggcu

SEQ ID NO: 670886 - RNA, 22 nt, Human
cucaagaaggaugagcuauugc

SEQ ID NO: 670887 - RNA, 22 nt, Human
ucagagcacuggugcuaccuug

SEQ ID NO: 670888 - RNA, 22 nt, Human
uccucagaaaccccugugaggu

SEQ ID NO: 670889 - RNA, 22 nt, Human
uuauucaccgcaggugcuuccc

SEQ ID NO: 670890 - RNA, 22 nt, Human
uaauaaaugaaagugcuggcau

SEQ ID NO: 670891 - RNA, 22 nt, Human
cagagcuggagcuugaauggag

SEQ ID NO: 670892 - RNA, 17 nt, Human
uauugaccuuuguaugu

SEQ ID NO: 670893 - RNA, 22 nt, Human
ucccaggguauccuguaguaaa

SEQ ID NO: 670894 - RNA, 17 nt, Human
uccuggcucugccacug

SEQ ID NO: 670895 - RNA, 22 nt, Human
uuagccauuaauguccugugca

SEQ ID NO: 670896 - RNA, 22 nt, Human
gaagagcugcucagaacaugau

SEQ ID NO: 670897 - RNA, 22 nt, Human
cuggccugcugggugagguccu

SEQ ID NO: 670898 - RNA, 22 nt, Human
agugugggccacgcagcugagc

SEQ ID NO: 670899 - RNA, 22 nt, Human
cacagacccagaagggaugaag

SEQ ID NO: 670900 - RNA, 22 nt, Human
acuguguccucauguggcagaa

SEQ ID NO: 670901 - RNA, 22 nt, Human
cagcugugaauugucuuaucua

SEQ ID NO: 670902 - RNA, 22 nt, Human
gcuugaguuuugggacaaagcc

SEQ ID NO: 670903 - RNA, 22 nt, Human
augaagauucuauuuaucacuu

SEQ ID NO: 670904 - RNA, 22 nt, Human
guagugggugaggaaggaagga

SEQ ID NO: 670905 - RNA, 22 nt, Human
uauggcuugaguuucagacuau

SEQ ID NO: 670906 - RNA, 22 nt, Human
gccuuuggacugagguagucag

SEQ ID NO: 670907 - RNA, 22 nt, Human
accagcuccaggccccugcuga

SEQ ID NO: 670908 - RNA, 22 nt, Human
uacaguuccaggaucauagggu

SEQ ID NO: 670909 - RNA, 22 nt, Human
uauguucugacucuacauggga

SEQ ID NO: 670910 - RNA, 22 nt, Human
gagggcugcaaugagacagaga

SEQ ID NO: 670911 - RNA, 22 nt, Human
gaagguggcgagcggauugcug

SEQ ID NO: 670912 - RNA, 22 nt, Human
auucuggguuugcuguacaaag

SEQ ID NO: 670913 - RNA, 22 nt, Human
cccucccaggaguggccagaga

SEQ ID NO: 670914 - RNA, 22 nt, Human
ucacaauauuuaucuuccaauu

SEQ ID NO: 670915 - RNA, 22 nt, Human
auggauuggauuuuuauggacc

SEQ ID NO: 670916 - RNA, 22 nt, Human
cccagcuugcaaauggguugcu

SEQ ID NO: 670917 - RNA, 22 nt, Human
cugaagagcucuccuguccccu

SEQ ID NO: 670918 - RNA, 22 nt, Human
cgaggccaccgugguuuccgag

SEQ ID NO: 670919 - RNA, 22 nt, Human
uaaaggaacagaggacucauuu

SEQ ID NO: 670920 - RNA, 22 nt, Human
ucaccaguuaaaauaacaguaa

SEQ ID NO: 670921 - RNA, 22 nt, Human
agcucugacugaagagaugcaa

SEQ ID NO: 670922 - RNA, 22 nt, Human
gcagggcgcguuugagcgggcu

SEQ ID NO: 670923 - RNA, 22 nt, Human
auggcagacacaggcaggcaga

SEQ ID NO: 670924 - RNA, 22 nt, Human
ucugcccaguuugugcucaggu

SEQ ID NO: 670925 - RNA, 22 nt, Human
uggcaggguggcaacuuuuggu

SEQ ID NO: 670926 - RNA, 22 nt, Human
aagcuuuggaagggcaggguug

SEQ ID NO: 670927 - RNA, 22 nt, Human
cccugcagaccaaugccauaga

SEQ ID NO: 670928 - RNA, 20 nt, Human
gucuuauuuaacacaugacu

SEQ ID NO: 670929 - RNA, 22 nt, Human
cuuucaguuacaguuacacaca

SEQ ID NO: 670930 - RNA, 22 nt, Human
cagagcugagaauguugaugcu

SEQ ID NO: 670931 - RNA, 22 nt, Human
auggggugcaugcagauuggga

SEQ ID NO: 670932 - RNA, 22 nt, Human
agauggauuucuuccagugaga

SEQ ID NO: 670933 - RNA, 22 nt, Human
uucuucuuuccuauaauuaauu

SEQ ID NO: 670934 - RNA, 22 nt, Human
gggcaugagcgagcugcuuuga

SEQ ID NO: 670935 - RNA, 22 nt, Human
aguaucuuuacuuaaauaguca

SEQ ID NO: 670936 - RNA, 22 nt, Human
cccuuuccauggcucuccuagg

SEQ ID NO: 670937 - RNA, 22 nt, Human
cagccaggauggagaacuguug

SEQ ID NO: 670938 - RNA, 22 nt, Human
acagguggcauaggcaguuuga

SEQ ID NO: 670939 - RNA, 22 nt, Human
cagcaggguagguuguaucagu

SEQ ID NO: 670940 - RNA, 22 nt, Human
cacagcugggaaaauuuguaca

SEQ ID NO: 670941 - RNA, 22 nt, Human
aaaucucuggucacagaacuua

SEQ ID NO: 670942 - RNA, 19 nt, Human
ugaaauggcaguugcuaaa

SEQ ID NO: 670943 - RNA, 22 nt, Human
ggcuccauccaaggccuucuag

SEQ ID NO: 670944 - RNA, 22 nt, Human
ggccuggcucuugcccagccug

SEQ ID NO: 670945 - RNA, 22 nt, Human
agaauucuccuucagggcagga

SEQ ID NO: 670946 - RNA, 22 nt, Human
cccuuuggaagaggcucacuga

SEQ ID NO: 670947 - RNA, 22 nt, Human
agggccacgugcaccgcggucu

SEQ ID NO: 670948 - RNA, 20 nt, Human
cuguagggugcagcaggcuc

SEQ ID NO: 670949 - RNA, 22 nt, Human
guggcagaguugcugacuagaa

SEQ ID NO: 670950 - RNA, 22 nt, Human
cccugaggaugucuccuuccug

SEQ ID NO: 670951 - RNA, 19 nt, Human
gcccaggggcccgaugcug

SEQ ID NO: 670952 - RNA, 22 nt, Human
ggucacaggggagaagagugau

SEQ ID NO: 670953 - RNA, 22 nt, Human
aggcugucugaccccagagccc

SEQ ID NO: 670954 - RNA, 22 nt, Human
cuugccugaggaacagagggua

SEQ ID NO: 670955 - RNA, 22 nt, Human
uuguuucuuugaaguuucuaga

SEQ ID NO: 670956 - RNA, 22 nt, Human
aaugcacaugucuuggccucac

SEQ ID NO: 670957 - RNA, 22 nt, Human
aguccucuggaguaugccuuau

SEQ ID NO: 670958 - RNA, 22 nt, Human
uagaaaugauuuugaugcuuca

SEQ ID NO: 670959 - RNA, 22 nt, Human
guguacaaaaugucuccaugga

SEQ ID NO: 670960 - RNA, 22 nt, Human
caagauggaguccgggaaugug

SEQ ID NO: 670961 - RNA, 22 nt, Human
augcuguggccagaguucaacu

SEQ ID NO: 670962 - RNA, 22 nt, Human
ugccaggcccugugcuggaugc

SEQ ID NO: 670963 - RNA, 22 nt, Human
aacuuaguuuaggguauugauu

SEQ ID NO: 670964 - RNA, 22 nt, Human
gcagcccaggaggcgggagccc

SEQ ID NO: 670965 - RNA, 22 nt, Human
cuuggcagauccaaaaaugaca

SEQ ID NO: 670966 - RNA, 22 nt, Human
agggcagcuagcuguagaaaga

SEQ ID NO: 670967 - RNA, 20 nt, Human
uggcaggagccacuggaagc

SEQ ID NO: 670968 - RNA, 22 nt, Human
cugcugguuagucuuaguggga

SEQ ID NO: 670969 - RNA, 22 nt, Human
caggugccauagacgggccugg

SEQ ID NO: 670970 - RNA, 22 nt, Human
acccaggggcgaagcuggccac

SEQ ID NO: 670971 - RNA, 22 nt, Human
gcguggggcagcccagggcuuc

SEQ ID NO: 670972 - RNA, 22 nt, Human
cacagaggcaaccuucuggggu

SEQ ID NO: 670973 - RNA, 22 nt, Human
uuagaacauuccaucacugggu

SEQ ID NO: 670974 - RNA, 22 nt, Human
cugugugcuguuagggagcugc

SEQ ID NO: 670975 - RNA, 22 nt, Human
ucagcuuucucagaggccuaac

SEQ ID NO: 670976 - RNA, 22 nt, Human
aagcccuggauagagagaacug

SEQ ID NO: 670977 - RNA, 22 nt, Human
acugagcauaaauaugugucca

SEQ ID NO: 670978 - RNA, 22 nt, Human
ucaccugggagggcugugguag

SEQ ID NO: 670979 - RNA, 22 nt, Human
uggggagaaaugucuuuguucc

SEQ ID NO: 670980 - RNA, 22 nt, Human
aagaugugcaguucauggcagg

SEQ ID NO: 670981 - RNA, 22 nt, Human
uggaggcccacacuggguagau

SEQ ID NO: 670982 - RNA, 22 nt, Human
caugcaugccuggcucacagag

SEQ ID NO: 670983 - RNA, 22 nt, Human
uggacccccucaaggcagagcu

SEQ ID NO: 670984 - RNA, 22 nt, Human
auauaacucuuguucuuauagu

SEQ ID NO: 670985 - RNA, 22 nt, Human
cugggagcggcugucacugguu

SEQ ID NO: 670986 - RNA, 22 nt, Human
ggaggcuccacugcucuuccug

SEQ ID NO: 670987 - RNA, 22 nt, Human
gaguucaguaguuauagucuag

SEQ ID NO: 670988 - RNA, 22 nt, Human
acuuagcaguuuagaauauguc

SEQ ID NO: 670989 - RNA, 22 nt, Human
gaccacagguaugggcuuggca

SEQ ID NO: 670990 - RNA, 22 nt, Human
ccugggcugcucauggggauga

SEQ ID NO: 670991 - RNA, 22 nt, Human
auuugaggauaguuggguacuc

SEQ ID NO: 670992 - RNA, 22 nt, Human
uagagcuuggacugcauuuucg

SEQ ID NO: 670993 - RNA, 22 nt, Human
cucuucagauauacaguacucu

SEQ ID NO: 670994 - RNA, 22 nt, Human
uggucucuccaugcccuccacc

SEQ ID NO: 670995 - RNA, 22 nt, Human
ucaucuccauacggucucgcag

SEQ ID NO: 670996 - RNA, 22 nt, Human
ggagccagcucccuccuuguga

SEQ ID NO: 670997 - RNA, 22 nt, Human
aucuuucaggccuaguguuuaa

SEQ ID NO: 670998 - RNA, 22 nt, Human
aagggcaggaaaagauggaugu

SEQ ID NO: 670999 - RNA, 22 nt, Human
ucucaggucucaugccaggccu

SEQ ID NO: 671000 - RNA, 22 nt, Human
cugggcacuuuggggagccuac

SEQ ID NO: 671001 - RNA, 22 nt, Human
augagaaauuuauuacaagcua

SEQ ID NO: 671002 - RNA, 20 nt, Human
uccagagaguggcaaagcuc

SEQ ID NO: 671003 - RNA, 22 nt, Human
gagcccagcuaaauuuauauaa

SEQ ID NO: 671004 - RNA, 22 nt, Human
ggcugcuggaagacugaacaag

SEQ ID NO: 671005 - RNA, 22 nt, Human
uccuguuucaacccuuacacug

SEQ ID NO: 671006 - RNA, 22 nt, Human
cucagagucccuucccucgugg

SEQ ID NO: 671007 - RNA, 22 nt, Human
uguuucauuaguacugacaaua

SEQ ID NO: 671008 - RNA, 22 nt, Human
ccuucaugauggaaaggguuca

SEQ ID NO: 671009 - RNA, 22 nt, Human
ccugagagcgaguggccucaug

SEQ ID NO: 671010 - RNA, 22 nt, Human
agaacagccaauaaaagagggg

SEQ ID NO: 671011 - RNA, 22 nt, Human
uguguacaucucuucucacauu

SEQ ID NO: 671012 - RNA, 22 nt, Human
aaaggugacacucugccagcug

SEQ ID NO: 671013 - RNA, 22 nt, Human
uuuauccaucaucugcugaagg

SEQ ID NO: 671014 - RNA, 22 nt, Human
aggcaggccuacacaaugggag

SEQ ID NO: 671015 - RNA, 22 nt, Human
gcaaagcacacuggagaugucg

SEQ ID NO: 671016 - RNA, 22 nt, Human
ucaaacuagccugacugguauu

SEQ ID NO: 671017 - RNA, 22 nt, Human
aaggcuggagaugguuggaaug

SEQ ID NO: 671018 - RNA, 22 nt, Human
guauggaaguauaaguuuugaa

SEQ ID NO: 671019 - RNA, 22 nt, Human
ucuggagucuaaagaaccaaaa

SEQ ID NO: 671020 - RNA, 22 nt, Human
cccagggacucgggauucuagg

SEQ ID NO: 671021 - RNA, 22 nt, Human
agcugggaagacuggaagacag

SEQ ID NO: 671022 - RNA, 22 nt, Human
caucuuugaacucuguauaaac

SEQ ID NO: 671023 - RNA, 20 nt, Human
cagcaucuagugagauuugc

SEQ ID NO: 671024 - RNA, 22 nt, Human
uuguuuaucgcuugcucacaua

SEQ ID NO: 671025 - RNA, 22 nt, Human
guuucaugguuguuugauggca

SEQ ID NO: 671026 - RNA, 22 nt, Human
agcuggaggaguuucuccuagc

SEQ ID NO: 671027 - RNA, 22 nt, Human
ucauacauaacuuguacaguga

SEQ ID NO: 671028 - RNA, 22 nt, Human
ggaagacaucugcuugcaccag

SEQ ID NO: 671029 - RNA, 19 nt, Human
cugggagguguucagagaa

SEQ ID NO: 671030 - RNA, 20 nt, Human
uccccagggcaucaggagca

SEQ ID NO: 671031 - RNA, 22 nt, Human
cuggaggaaaacaacugcagac

SEQ ID NO: 671032 - RNA, 23 nt, Human
acagaggcuuaaaugaguggcag

SEQ ID NO: 671033 - RNA, 18 nt, Human
gcuuuuuagugcaucuuc

SEQ ID NO: 671034 - RNA, 22 nt, Human
acagagaugggaacauucaggu

SEQ ID NO: 671035 - RNA, 23 nt, Human
cugacucaucccaccaccuccuc

SEQ ID NO: 671036 - RNA, 22 nt, Human
cuagaaaucucuguuuacauca

SEQ ID NO: 671037 - RNA, 22 nt, Human
uucuuguuuauuaagauauaaa

SEQ ID NO: 671038 - RNA, 22 nt, Human
uuccagaacaauguggacguau

SEQ ID NO: 671039 - RNA, 22 nt, Human
augacaaaauaaauggucucug

SEQ ID NO: 671040 - RNA, 22 nt, Human
aagacgggagucaggugagcuc

SEQ ID NO: 671041 - RNA, 23 nt, Human
agcugggaauuuucugaagcuuu

SEQ ID NO: 671042 - RNA, 22 nt, Human
aggcucagauucacauuugguu

SEQ ID NO: 671043 - RNA, 22 nt, Human
ccuuuugcucucccauccagaa

SEQ ID NO: 671044 - RNA, 22 nt, Human
cuggccacugauuccuccccug

SEQ ID NO: 671045 - RNA, 22 nt, Human
cugggacucagaccaguucugu

SEQ ID NO: 671046 - RNA, 22 nt, Human
ggccaagauggaaggagagaug

SEQ ID NO: 671047 - RNA, 22 nt, Human
guguguggaaaguuuuccaugg

SEQ ID NO: 671048 - RNA, 22 nt, Human
gcuggcugccuuacuuugugga

SEQ ID NO: 671049 - RNA, 22 nt, Human
cagcaucuuuauaaaaaguaaa

SEQ ID NO: 671050 - RNA, 22 nt, Human
ucaggcagaggauggggagcgu

SEQ ID NO: 671051 - RNA, 20 nt, Human
caggaaccaaagaggacucc

SEQ ID NO: 671052 - RNA, 22 nt, Human
cacauuguagagauuagaaaga

SEQ ID NO: 671053 - RNA, 22 nt, Human
cugggggccuuacggaacucca

SEQ ID NO: 671054 - RNA, 22 nt, Human
agaagcauuauuuaauuuuacu

SEQ ID NO: 671055 - RNA, 22 nt, Human
guggcagagccaaggcuggagc

SEQ ID NO: 671056 - RNA, 22 nt, Human
uuugagaaacagacgaaagaca

SEQ ID NO: 671057 - RNA, 22 nt, Human
caugcacacacgugcauguacg

SEQ ID NO: 671058 - RNA, 22 nt, Human
cagucuggaggucagcuggcuu

SEQ ID NO: 671059 - RNA, 19 nt, Human
gccacaggaugaaguuugg

SEQ ID NO: 671060 - RNA, 21 nt, Human
gggugggguuccagccuuuuc

SEQ ID NO: 671061 - RNA, 22 nt, Human
ucaggagcagcuguaggaaggg

SEQ ID NO: 671062 - RNA, 22 nt, Human
uauuuaacuggaaacacaauga

SEQ ID NO: 671063 - RNA, 22 nt, Human
cugagagaucaagccacaggau

SEQ ID NO: 671064 - RNA, 22 nt, Human
gaguggggaaagccaggacaga

SEQ ID NO: 671065 - RNA, 22 nt, Human
acaguagugcucaaucaguguu

SEQ ID NO: 671066 - RNA, 22 nt, Human
gaaguauagcagauguuauuua

SEQ ID NO: 671067 - RNA, 22 nt, Human
aagucagauaggugaguccaaa

SEQ ID NO: 671068 - RNA, 22 nt, Human
aggugcagcaugaguccaacgg

SEQ ID NO: 671069 - RNA, 19 nt, Human
gcacugaagaguuggucac

SEQ ID NO: 671070 - RNA, 22 nt, Human
auggccugggcccgcuucagau

SEQ ID NO: 671071 - RNA, 22 nt, Human
ugaauaugugacuuugauuuca

SEQ ID NO: 671072 - RNA, 22 nt, Human
uaauuauagccgcuauuuugcu

SEQ ID NO: 671073 - RNA, 22 nt, Human
ugucugaaagaggacgagcugg

SEQ ID NO: 671074 - RNA, 22 nt, Human
aaucacaaacgaauugauggaa

SEQ ID NO: 671075 - RNA, 22 nt, Human
aaggcaccaugagaugcugguu

SEQ ID NO: 671076 - RNA, 22 nt, Human
ccagggcagcagaauuggggca

SEQ ID NO: 671077 - RNA, 19 nt, Human
aggagcacugccagcacca

SEQ ID NO: 671078 - RNA, 22 nt, Human
caggagguggagcucaaguggu

SEQ ID NO: 671079 - RNA, 22 nt, Human
gaaugauagagcugccuucgga

SEQ ID NO: 671080 - RNA, 22 nt, Human
augaugguggguaauguguaaa

SEQ ID NO: 671081 - RNA, 22 nt, Human
uuacaaugcacucaccuuuaga

SEQ ID NO: 671082 - RNA, 19 nt, Human
ggccacuccuggugacugg

SEQ ID NO: 671083 - RNA, 22 nt, Human
uccaucauguucacagcuauau

SEQ ID NO: 671084 - RNA, 22 nt, Human
uuucuaggcacagugucuuccc

SEQ ID NO: 671085 - RNA, 22 nt, Human
aaagaccauguuuacagcuagg

SEQ ID NO: 671086 - RNA, 22 nt, Human
agcuccugggcaccucuuucac

SEQ ID NO: 671087 - RNA, 22 nt, Human
agcagcauauugugucuucaua

SEQ ID NO: 671088 - RNA, 22 nt, Human
accaggcuuaauccuuugcuau

SEQ ID NO: 671089 - RNA, 22 nt, Human
uggcuugcuacugaggugucag

SEQ ID NO: 671090 - RNA, 22 nt, Human
agaagccaccagcugaggaaga

SEQ ID NO: 671091 - RNA, 22 nt, Human
cagcagcaaaucuagaagagga

SEQ ID NO: 671092 - RNA, 22 nt, Human
uaugaaagaaucucagagcaca

SEQ ID NO: 671093 - RNA, 22 nt, Human
ccuguacacggucuaugccucc

SEQ ID NO: 671094 - RNA, 22 nt, Human
agcaauaugacauugcuacauc

SEQ ID NO: 671095 - RNA, 22 nt, Human
aagaagugguccuuuucuuucu

SEQ ID NO: 671096 - RNA, 22 nt, Human
caggaaauuggcuauuugggau

SEQ ID NO: 671097 - RNA, 22 nt, Human
ugcuucuggguaggccucagga

SEQ ID NO: 671098 - RNA, 22 nt, Human
acagcuuuucaauucugcugag

SEQ ID NO: 671099 - RNA, 22 nt, Human
ucugucuacagggagaaugaua

SEQ ID NO: 671100 - RNA, 22 nt, Human
agcugguucacuaagcauaaua

SEQ ID NO: 671101 - RNA, 22 nt, Human
uggggagaagcaauagacucua

SEQ ID NO: 671102 - RNA, 22 nt, Human
ccuguggaccaggaggcagccc

SEQ ID NO: 671103 - RNA, 22 nt, Human
uuaaagcaggcaucauuccuca

SEQ ID NO: 671104 - RNA, 22 nt, Human
ggcaccaggacaugacucccag

SEQ ID NO: 671105 - RNA, 22 nt, Human
ucagcauguacuucuccuccau

SEQ ID NO: 671106 - RNA, 22 nt, Human
uuugguuuagggucauuuaaca

SEQ ID NO: 671107 - RNA, 22 nt, Human
ucugugcucauucagucauuca

SEQ ID NO: 671108 - RNA, 22 nt, Human
acaguggaauuuguagaugugu

SEQ ID NO: 671109 - RNA, 22 nt, Human
cuguacucaagguaaaccagga

SEQ ID NO: 671110 - RNA, 22 nt, Human
uuguuacagcagcaauagaaaa

SEQ ID NO: 671111 - RNA, 22 nt, Human
augcaguaaauguuaagaaaaa

SEQ ID NO: 671112 - RNA, 22 nt, Human
gucucugggugugugaugccaa

SEQ ID NO: 671113 - RNA, 22 nt, Human
cugccagcuggagaccaaggaa

SEQ ID NO: 671114 - RNA, 22 nt, Human
gcauugaaggcauuuuaucuac

SEQ ID NO: 671115 - RNA, 23 nt, Human
aagucagagccaagucaaugaga

SEQ ID NO: 671116 - RNA, 22 nt, Human
gaaugcagcugacagucguuuu

SEQ ID NO: 671117 - RNA, 22 nt, Human
ucuccuggccuuuagguuaagg

SEQ ID NO: 671118 - RNA, 22 nt, Human
uggcacuuuacacccauuuggc

SEQ ID NO: 671119 - RNA, 22 nt, Human
gaaggaagacugguuuaaaugu

SEQ ID NO: 671120 - RNA, 22 nt, Human
agcaggacacgaugcggcagga

SEQ ID NO: 671121 - RNA, 22 nt, Human
ucucugcccaaguuucucaagu

SEQ ID NO: 671122 - RNA, 22 nt, Human
uucugugauugacauguggcuu

SEQ ID NO: 671123 - RNA, 22 nt, Human
cauauuagccuccacugggaca

SEQ ID NO: 671124 - RNA, 22 nt, Human
aaguccuuggagaauagaaagg

SEQ ID NO: 671125 - RNA, 22 nt, Human
auguagaggaguuucuggucug

SEQ ID NO: 671126 - RNA, 22 nt, Human
gccugggacuggauguguuugu

SEQ ID NO: 671127 - RNA, 22 nt, Human
uccucaguuauaaauaggaaac

SEQ ID NO: 671128 - RNA, 22 nt, Human
uagggaugagccaguggguagu

SEQ ID NO: 671129 - RNA, 20 nt, Human
uccugagaccugggaagguu

SEQ ID NO: 671130 - RNA, 22 nt, Human
ugcauuaagugucugcauaugg

SEQ ID NO: 671131 - RNA, 22 nt, Human
uggccugggcaugaagcaucgu

SEQ ID NO: 671132 - RNA, 19 nt, Human
gaaugggaaugggaaagcu

SEQ ID NO: 671133 - RNA, 22 nt, Human
gaacauuuggauuuguaaauuu

SEQ ID NO: 671134 - RNA, 19 nt, Human
ccuagagggaaggcaggac

SEQ ID NO: 671135 - RNA, 22 nt, Human
ucgucugugaaauugggauaag

SEQ ID NO: 671136 - RNA, 22 nt, Human
uccauucauucagguauuuagu

SEQ ID NO: 671137 - RNA, 22 nt, Human
ggcaggcuccguguuccauucc

SEQ ID NO: 671138 - RNA, 22 nt, Human
guaguuaguuaagaugaguuua

SEQ ID NO: 671139 - RNA, 22 nt, Human
augucacauggucaccucuagc

SEQ ID NO: 671140 - RNA, 22 nt, Human
gcagagccuugcgucaugugcc

SEQ ID NO: 671141 - RNA, 22 nt, Human
uggcugaguuacgaacagagca

SEQ ID NO: 671142 - RNA, 22 nt, Human
acugagcagaagagaucuguga

SEQ ID NO: 671143 - RNA, 21 nt, Human
aaacugaagagacaggaacuu

SEQ ID NO: 671144 - RNA, 22 nt, Human
aaggcuaaauucuguacugcau

SEQ ID NO: 671145 - RNA, 20 nt, Human
ugggccucuggugccucugg

SEQ ID NO: 671146 - RNA, 22 nt, Human
auggcccuggaaagagcuugag

SEQ ID NO: 671147 - RNA, 22 nt, Human
ggcagagacaccgaaugacucu

SEQ ID NO: 671148 - RNA, 21 nt, Human
uuagcuuucuagaaucuuugu

SEQ ID NO: 671149 - RNA, 22 nt, Human
ucaaaaguggccuguaaaaucu

SEQ ID NO: 671150 - RNA, 23 nt, Human
uggcucuguggaucccucaggag

SEQ ID NO: 671151 - RNA, 22 nt, Human
acucaaauagcaacggugagaa

SEQ ID NO: 671152 - RNA, 22 nt, Human
auaauguagguauguguauuua

SEQ ID NO: 671153 - RNA, 22 nt, Human
cagauucuucauucauucuaca

SEQ ID NO: 671154 - RNA, 22 nt, Human
gacagcugaaaaauguaaggua

SEQ ID NO: 671155 - RNA, 22 nt, Human
uggagagcuguugaaaugcaga

SEQ ID NO: 671156 - RNA, 22 nt, Human
aggggcugggacagagccaagc

SEQ ID NO: 671157 - RNA, 22 nt, Human
uuccaagagucagcugauccca

SEQ ID NO: 671158 - RNA, 22 nt, Human
uuucagaacagggauugggccu

SEQ ID NO: 671159 - RNA, 22 nt, Human
caggaagcugagcugcacugca

SEQ ID NO: 671160 - RNA, 22 nt, Human
uugauguacagaauuguucaca

SEQ ID NO: 671161 - RNA, 19 nt, Human
aucaggaacaaggcugauc

SEQ ID NO: 671162 - RNA, 18 nt, Human
ugagcccuuaucuuuggc

SEQ ID NO: 671163 - RNA, 22 nt, Human
uaaauucccaacucugcucuuc

SEQ ID NO: 671164 - RNA, 21 nt, Human
aaauugccacacauuucuucc

SEQ ID NO: 671165 - RNA, 22 nt, Human
uauggaaagcucuuuuugauug

SEQ ID NO: 671166 - RNA, 22 nt, Human
cccugcaggcucagacuggagu

SEQ ID NO: 671167 - RNA, 22 nt, Human
aguccuggacuuggagucaggg

SEQ ID NO: 671168 - RNA, 22 nt, Human
uagcuucucuuuucaacaucuu

SEQ ID NO: 671169 - RNA, 22 nt, Human
uccuccuuguuuugucucugcu

SEQ ID NO: 671170 - RNA, 22 nt, Human
ucccugcccugccuucaugguu

SEQ ID NO: 671171 - RNA, 22 nt, Human
ugugacaucgcugugucuguuu

SEQ ID NO: 671172 - RNA, 22 nt, Human
agaacugguggugaucaguuau

SEQ ID NO: 671173 - RNA, 22 nt, Human
auucuggaauucuaagauucug

SEQ ID NO: 671174 - RNA, 22 nt, Human
uggcagagucugggcuugggca

SEQ ID NO: 671175 - RNA, 22 nt, Human
ccaccagcuuuggcggugacag

SEQ ID NO: 671176 - RNA, 22 nt, Human
agaucacaguggcaacucccuu

SEQ ID NO: 671177 - RNA, 22 nt, Human
aaagggaauguguaggacaugu

SEQ ID NO: 671178 - RNA, 22 nt, Human
ugcuugcugggccaauggcaau

SEQ ID NO: 671179 - RNA, 22 nt, Human
ucuguccucuuugaagcugcuc

SEQ ID NO: 671180 - RNA, 22 nt, Human
ucuuugaauucaaacuguucaa

SEQ ID NO: 671181 - RNA, 22 nt, Human
cuaucucuuguuuuccugaagc

SEQ ID NO: 671182 - RNA, 22 nt, Human
aagcugaggcccauggcaaggu

SEQ ID NO: 671183 - RNA, 22 nt, Human
caccuaggguuucgccuuucuu

SEQ ID NO: 671184 - RNA, 22 nt, Human
uucacauugaaggugcuuucuu

SEQ ID NO: 671185 - RNA, 22 nt, Human
cuggugcuggagccuagucccu

SEQ ID NO: 671186 - RNA, 22 nt, Human
auauaugaagaagucuugauua

SEQ ID NO: 671187 - RNA, 22 nt, Human
gaaaccugagccagagugggga

SEQ ID NO: 671188 - RNA, 22 nt, Human
cagaaauucccauuucagauuc

SEQ ID NO: 671189 - RNA, 22 nt, Human
agcugcccugguaagauugaug

SEQ ID NO: 671190 - RNA, 22 nt, Human
ucuggcuccaggaccgggcaca

SEQ ID NO: 671191 - RNA, 22 nt, Human
cagagaggauggauuccauagc

SEQ ID NO: 671192 - RNA, 22 nt, Human
ugguuccaaucgcacuggcuca

SEQ ID NO: 671193 - RNA, 22 nt, Human
ucagcaacuauuuaucaaauuc

SEQ ID NO: 671194 - RNA, 22 nt, Human
guuauugagacauagaguuaug

SEQ ID NO: 671195 - RNA, 22 nt, Human
gggaggcacgaggcgcgcagug

SEQ ID NO: 671196 - RNA, 22 nt, Human
ucacugaauacuugucucaucc

SEQ ID NO: 671197 - RNA, 22 nt, Human
cuaagcuuuucaaaaacauguu

SEQ ID NO: 671198 - RNA, 22 nt, Human
auagcuuuuugucauagagucu

SEQ ID NO: 671199 - RNA, 22 nt, Human
gacaggcaccuugucugucuug

SEQ ID NO: 671200 - RNA, 22 nt, Human
gacuccagagugacuauuuguc

SEQ ID NO: 671201 - RNA, 22 nt, Human
agggcugagaaugacagggccg

SEQ ID NO: 671202 - RNA, 22 nt, Human
gcaaugucugcaaugggugugg

SEQ ID NO: 671203 - RNA, 20 nt, Human
cugccaugauugauagagug

SEQ ID NO: 671204 - RNA, 16 nt, Human
uccuggggauacugga

SEQ ID NO: 671205 - RNA, 22 nt, Human
acugggccuacccagauuggca

SEQ ID NO: 671206 - RNA, 22 nt, Human
cugcagggugacguugcccacc

SEQ ID NO: 671207 - RNA, 22 nt, Human
aaguuuacuggggagaucaccu

SEQ ID NO: 671208 - RNA, 22 nt, Human
aaaggcucacgcaguuagugau

SEQ ID NO: 671209 - RNA, 22 nt, Human
agggggugcccagaugaaggau

SEQ ID NO: 671210 - RNA, 22 nt, Human
aaauauugguaggaugcuuguu

SEQ ID NO: 671211 - RNA, 22 nt, Human
gaacagacuuugccaauuacag

SEQ ID NO: 671212 - RNA, 22 nt, Human
aggaugaggcuggacacuucuu

SEQ ID NO: 671213 - RNA, 22 nt, Human
acaguucugccuguuugagaag

SEQ ID NO: 671214 - RNA, 22 nt, Human
ccauaaaguaggaaacacuaca

SEQ ID NO: 671215 - RNA, 22 nt, Human
gggagcucgugcgcccaggugc

SEQ ID NO: 671216 - RNA, 22 nt, Human
agcgagggaggucugaggacag

SEQ ID NO: 671217 - RNA, 22 nt, Human
gucugagauuagggaagauuuu

SEQ ID NO: 671218 - RNA, 22 nt, Human
cacaugcauuggcaaaagugua

SEQ ID NO: 671219 - RNA, 22 nt, Human
uuccaagugcugaggacaguag

SEQ ID NO: 671220 - RNA, 22 nt, Human
agcaggcaagcgugaguucucu

SEQ ID NO: 671221 - RNA, 22 nt, Human
ugcauguuauagaauuuuaacu

SEQ ID NO: 671222 - RNA, 22 nt, Human
ucugaaauaggagccauguaga

SEQ ID NO: 671223 - RNA, 22 nt, Human
uucagaaaugucagccaucaga

SEQ ID NO: 671224 - RNA, 22 nt, Human
uccagcauguuugugcugcuga

SEQ ID NO: 671225 - RNA, 22 nt, Human
gcaagcuggcuguuagaggaug

SEQ ID NO: 671226 - RNA, 22 nt, Human
gcaguaggggcuggagggcugu

SEQ ID NO: 671227 - RNA, 22 nt, Human
auuagcugaccucuaaggagcc

SEQ ID NO: 671228 - RNA, 22 nt, Human
cugcugcuuagcauagcagagg

SEQ ID NO: 671229 - RNA, 22 nt, Human
uuacauguggagucugauugca

SEQ ID NO: 671230 - RNA, 22 nt, Human
acacagagccagggaauacagu

SEQ ID NO: 671231 - RNA, 22 nt, Human
ugaagaagccaauugguaggcu

SEQ ID NO: 671232 - RNA, 22 nt, Human
acacugaagagcacuuucaaag

SEQ ID NO: 671233 - RNA, 22 nt, Human
ugcucaguccuaccuuggcucc

SEQ ID NO: 671234 - RNA, 22 nt, Human
aggcuuuguaccuggggucuua

SEQ ID NO: 671235 - RNA, 19 nt, Human
uguguguuuauauauguau

SEQ ID NO: 671236 - RNA, 22 nt, Human
aagaacauguuaaaagauucac

SEQ ID NO: 671237 - RNA, 22 nt, Human
caggcucccgcuccacugggca

SEQ ID NO: 671238 - RNA, 22 nt, Human
cuuuguuagcagccaauuuguu

SEQ ID NO: 671239 - RNA, 22 nt, Human
auuucucaucaagugccaacuc

SEQ ID NO: 671240 - RNA, 22 nt, Human
ucagagugggagaaugugccaa

SEQ ID NO: 671241 - RNA, 20 nt, Human
aaaguguaaggcaaaguugu

SEQ ID NO: 671242 - RNA, 22 nt, Human
uacuuugguaucaaacuaaaac

SEQ ID NO: 671243 - RNA, 22 nt, Human
uccagcuugccuggucuuuugg

SEQ ID NO: 671244 - RNA, 22 nt, Human
aagauucucacugcucaacuuu

SEQ ID NO: 671245 - RNA, 22 nt, Human
ccagagagggcgccaccuggag

SEQ ID NO: 671246 - RNA, 22 nt, Human
agacaauacauuuauucccuuu

SEQ ID NO: 671247 - RNA, 22 nt, Human
acauucaaggccuucugacaca

SEQ ID NO: 671248 - RNA, 22 nt, Human
gauaaacuuguggaguuuuggu

SEQ ID NO: 671249 - RNA, 22 nt, Human
ucaggcugcuuucaugcuuaga

SEQ ID NO: 671250 - RNA, 22 nt, Human
uuguagcaucaaucaguacuuu

SEQ ID NO: 671251 - RNA, 20 nt, Human
aaacagcuaaaccagcucuc

SEQ ID NO: 671252 - RNA, 18 nt, Human
uacaggaaaaguguuaca

SEQ ID NO: 671253 - RNA, 22 nt, Human
ucuggagaucauguggggugga

SEQ ID NO: 671254 - RNA, 20 nt, Human
auaugggugaugaugucugu

SEQ ID NO: 671255 - RNA, 22 nt, Human
cugcucugaagccaggauucug

SEQ ID NO: 671256 - RNA, 22 nt, Human
gcaggcugaaacucggggucua

SEQ ID NO: 671257 - RNA, 22 nt, Human
aggcacugaaggaagcuugcgc

SEQ ID NO: 671258 - RNA, 22 nt, Human
ucucugaguucuccuccagccc

SEQ ID NO: 671259 - RNA, 21 nt, Human
cuggagucuggggguggcagu

SEQ ID NO: 671260 - RNA, 20 nt, Human
gcucuaaaccacaaagccca

SEQ ID NO: 671261 - RNA, 21 nt, Human
uuugaacuagagguaaauucc

SEQ ID NO: 671262 - RNA, 22 nt, Human
gcacuugggcagagacgcacag

SEQ ID NO: 671263 - RNA, 22 nt, Human
acacuugagguuuuuaggugcg

SEQ ID NO: 671264 - RNA, 22 nt, Human
agaguggcuucuuugacaugcu

SEQ ID NO: 671265 - RNA, 21 nt, Human
uguucaaacguacacauuucu

SEQ ID NO: 671266 - RNA, 22 nt, Human
ucagcucuuaacccucuggccu

SEQ ID NO: 671267 - RNA, 22 nt, Human
cgcaacagcguggcgcccagcu

SEQ ID NO: 671268 - RNA, 22 nt, Human
agcuccugcagacuccugcuca

SEQ ID NO: 671269 - RNA, 22 nt, Human
ucagugugacugauggcuuuau

SEQ ID NO: 671270 - RNA, 22 nt, Human
gcagagccugugucugagcaaa

SEQ ID NO: 671271 - RNA, 22 nt, Human
agauuucagguuggggcagaag

SEQ ID NO: 671272 - RNA, 22 nt, Human
uagcuuggaauaaaaugagaau

SEQ ID NO: 671273 - RNA, 22 nt, Human
uauuggaguauggggcuggagu

SEQ ID NO: 671274 - RNA, 19 nt, Human
gguguuucuucauuuucca

SEQ ID NO: 671275 - RNA, 22 nt, Human
caggcugugggagucaggaccc

SEQ ID NO: 671276 - RNA, 22 nt, Human
uucuccuuccugguuuucaggc

SEQ ID NO: 671277 - RNA, 22 nt, Human
gugagggguggcugagcaguuu

SEQ ID NO: 671278 - RNA, 22 nt, Human
uggcugagggggcaguucagga

SEQ ID NO: 671279 - RNA, 22 nt, Human
agccuggaagaaccugaagucu

SEQ ID NO: 671280 - RNA, 22 nt, Human
aaaucagacuugaauuuucauc

SEQ ID NO: 671281 - RNA, 23 nt, Human
ucacauaauccuucauccacagg

SEQ ID NO: 671282 - RNA, 22 nt, Human
gaggcuguguuucagugaggcc

SEQ ID NO: 671283 - RNA, 22 nt, Human
ggcuccugaaagacuaugggaa

SEQ ID NO: 671284 - RNA, 22 nt, Human
ccacaugaaucuuggaagcagg

SEQ ID NO: 671285 - RNA, 22 nt, Human
gggcugagccauuugaaccuug

SEQ ID NO: 671286 - RNA, 22 nt, Human
aaaagggaaagcagaaugacuu

SEQ ID NO: 671287 - RNA, 22 nt, Human
acagcuggacaggggagaguuu

SEQ ID NO: 671288 - RNA, 22 nt, Human
ccuuccagugacuaaggaggaa

SEQ ID NO: 671289 - RNA, 22 nt, Human
guggcuggaguaugaggaaagg

SEQ ID NO: 671290 - RNA, 22 nt, Human
aaagcccauguggaaguacagg

SEQ ID NO: 671291 - RNA, 22 nt, Human
auauguguguauuucuuacuag

SEQ ID NO: 671292 - RNA, 22 nt, Human
ccuuccagccccaucucaucgu

SEQ ID NO: 671293 - RNA, 22 nt, Human
ugggcagguuguuauuugacau

SEQ ID NO: 671294 - RNA, 22 nt, Human
aaguccagcagugcuuguugau

SEQ ID NO: 671295 - RNA, 22 nt, Human
auggagagagaaggcuugcugu

SEQ ID NO: 671296 - RNA, 22 nt, Human
gaggccuggcugucagucccca

SEQ ID NO: 671297 - RNA, 22 nt, Human
cccaggagaccugugaaaggac

SEQ ID NO: 671298 - RNA, 22 nt, Human
ccacugaggggucaugguggga

SEQ ID NO: 671299 - RNA, 19 nt, Human
cucucuccaguggcuggcu

SEQ ID NO: 671300 - RNA, 22 nt, Human
cagcuugugcaaagguccuggg

SEQ ID NO: 671301 - RNA, 22 nt, Human
uuuuguuggcuuaagaaauaca

SEQ ID NO: 671302 - RNA, 22 nt, Human
agugaaauugcuguaagaggaa

SEQ ID NO: 671303 - RNA, 20 nt, Human
ccuggcuuugcagcaugaga

SEQ ID NO: 671304 - RNA, 22 nt, Human
cugcugugccuuaaaaugcaag

SEQ ID NO: 671305 - RNA, 22 nt, Human
agggccugggaagaggaacccu

SEQ ID NO: 671306 - RNA, 22 nt, Human
acuucauguugcucuuggcuau

SEQ ID NO: 671307 - RNA, 22 nt, Human
ugcaacaggagaguucagggca

SEQ ID NO: 671308 - RNA, 23 nt, Human
ccacagagcugccaauuccugug

SEQ ID NO: 671309 - RNA, 22 nt, Human
ccagagagaguacugggcucug

SEQ ID NO: 671310 - RNA, 22 nt, Human
cucucucuucuuuguaggggcc

SEQ ID NO: 671311 - RNA, 22 nt, Human
cugcacugagcucucccagccc

SEQ ID NO: 671312 - RNA, 22 nt, Human
ugaacagauggcccagcagagg

SEQ ID NO: 671313 - RNA, 22 nt, Human
aguggaggcacuaauuggauuu

SEQ ID NO: 671314 - RNA, 22 nt, Human
ccuucacacuuucacuuggaua

SEQ ID NO: 671315 - RNA, 22 nt, Human
guuauguaucuugauugggugg

SEQ ID NO: 671316 - RNA, 22 nt, Human
ugagccuggcggaagcagcgug

SEQ ID NO: 671317 - RNA, 20 nt, Human
cuuggccuacuuagcuuugu

SEQ ID NO: 671318 - RNA, 20 nt, Human
auggcucuguuuggcaguga

SEQ ID NO: 671319 - RNA, 22 nt, Human
cuggagaguuggaagauggacu

SEQ ID NO: 671320 - RNA, 22 nt, Human
ggaguggcaggccacagugcug

SEQ ID NO: 671321 - RNA, 22 nt, Human
auggcagggacuguggcccuug

SEQ ID NO: 671322 - RNA, 22 nt, Human
ccuuucugacagugaugggggg

SEQ ID NO: 671323 - RNA, 22 nt, Human
gacccaggcucgugggacggcu

SEQ ID NO: 671324 - RNA, 22 nt, Human
gaaggaaguuuauuuuagaaga

SEQ ID NO: 671325 - RNA, 22 nt, Human
guuuccuauggcugcugcagga

SEQ ID NO: 671326 - RNA, 22 nt, Human
cagugcugguguaggcugacca

SEQ ID NO: 671327 - RNA, 22 nt, Human
gaggugagaagggggucagaug

SEQ ID NO: 671328 - RNA, 22 nt, Human
auguucuuucagccagugcauc

SEQ ID NO: 671329 - RNA, 22 nt, Human
ggugcagggagaggcaggcccc

SEQ ID NO: 671330 - RNA, 22 nt, Human
auuuuccucaagccucuggaag

SEQ ID NO: 671331 - RNA, 22 nt, Human
acacauuugcauaauaccucau

SEQ ID NO: 671332 - RNA, 22 nt, Human
uugauucugggcucauuucuuu

SEQ ID NO: 671333 - RNA, 22 nt, Human
gcaugcaucuagauaugcagac

SEQ ID NO: 671334 - RNA, 22 nt, Human
cuggaggggccauccacagucu

SEQ ID NO: 671335 - RNA, 22 nt, Human
agaaggcccuguguggucugag

SEQ ID NO: 671336 - RNA, 22 nt, Human
uugaauuggcaaaacugcagcu

SEQ ID NO: 671337 - RNA, 22 nt, Human
cacugggaguacaaagaauggg

SEQ ID NO: 671338 - RNA, 22 nt, Human
ucuguacauuuguguugugaau

SEQ ID NO: 671339 - RNA, 20 nt, Human
uccuccuugcagagcccaga

SEQ ID NO: 671340 - RNA, 22 nt, Human
uaaugaacucuuuacuuuggga

SEQ ID NO: 671341 - RNA, 22 nt, Human
agggcucauaauuccugacuuc

SEQ ID NO: 671342 - RNA, 22 nt, Human
agucucuggacugggagauggc

SEQ ID NO: 671343 - RNA, 22 nt, Human
acuuguucauugaguacauaug

SEQ ID NO: 671344 - RNA, 22 nt, Human
acaaaaccagaaaaucucuacc

SEQ ID NO: 671345 - RNA, 22 nt, Human
agcaggcugaugggcaugcuug

SEQ ID NO: 671346 - RNA, 22 nt, Human
agggcucccgcgguguccggga

SEQ ID NO: 671347 - RNA, 22 nt, Human
agggcagcauugccuuucucca

SEQ ID NO: 671348 - RNA, 22 nt, Human
agcugccuuugcaucacuuuaa

SEQ ID NO: 671349 - RNA, 22 nt, Human
aaaccugucugauuauggagac

SEQ ID NO: 671350 - RNA, 22 nt, Human
agaagggccagcuggacaccug

SEQ ID NO: 671351 - RNA, 22 nt, Human
ucucugaauuguuuaaguuauu

SEQ ID NO: 671352 - RNA, 22 nt, Human
uacaaugacucucaguuuggcu

SEQ ID NO: 671353 - RNA, 22 nt, Human
acugcuuuaucugagaaguccu

SEQ ID NO: 671354 - RNA, 22 nt, Human
uucauacuguguuuccaaguuu

SEQ ID NO: 671355 - RNA, 22 nt, Human
accugcagcugagaaaaugacu

SEQ ID NO: 671356 - RNA, 22 nt, Human
accaggaagugugggccaacgu

SEQ ID NO: 671357 - RNA, 22 nt, Human
cuugggcuuagaagguaaguga

SEQ ID NO: 671358 - RNA, 22 nt, Human
uuuggaauuaugcuuaaaguuu

SEQ ID NO: 671359 - RNA, 22 nt, Human
aggagucaggaccaaauggaaa

SEQ ID NO: 671360 - RNA, 22 nt, Human
gguggcaccuuacccugcgcag

SEQ ID NO: 671361 - RNA, 22 nt, Human
acugccuugucucuugccuguu

SEQ ID NO: 671362 - RNA, 22 nt, Human
cuggcagcuuagcacucugguu

SEQ ID NO: 671363 - RNA, 22 nt, Human
uaugagguauuacaggaaauau

SEQ ID NO: 671364 - RNA, 22 nt, Human
ucugugcacuaacauuccuggu

SEQ ID NO: 671365 - RNA, 22 nt, Human
gucuuuaguugaaacauguggu

SEQ ID NO: 671366 - RNA, 22 nt, Human
aucagaaaaacauaauguuauu

SEQ ID NO: 671367 - RNA, 22 nt, Human
auuggcagggccagcaucuccc

SEQ ID NO: 671368 - RNA, 21 nt, Human
ugucacagauucucagcuugc

SEQ ID NO: 671369 - RNA, 22 nt, Human
cugccaucugagccaaaagugc

SEQ ID NO: 671370 - RNA, 22 nt, Human
caaccuggcccuagcccuggga

SEQ ID NO: 671371 - RNA, 22 nt, Human
auacaucucauguaagagauaa

SEQ ID NO: 671372 - RNA, 22 nt, Human
ucccacauuacccugacugaca

SEQ ID NO: 671373 - RNA, 19 nt, Human
uggcugggcgugccuccgu

SEQ ID NO: 671374 - RNA, 18 nt, Human
agggcugaugaguuuggg

SEQ ID NO: 671375 - RNA, 22 nt, Human
agcuccaggccuugggccccgg

SEQ ID NO: 671376 - RNA, 22 nt, Human
cauuauggaagacaguguggug

SEQ ID NO: 671377 - RNA, 17 nt, Human
ucucuuucccuuucugc

SEQ ID NO: 671378 - RNA, 22 nt, Human
ugagucugauuuuucuagcauu

SEQ ID NO: 671379 - RNA, 22 nt, Human
cagcacaggaagugggccuuca

SEQ ID NO: 671380 - RNA, 22 nt, Human
cgcccagcugaaaucuccaggc

SEQ ID NO: 671381 - RNA, 22 nt, Human
auggcugucacgccacugugag

SEQ ID NO: 671382 - RNA, 21 nt, Human
uucaugagauaaccagcugua

SEQ ID NO: 671383 - RNA, 22 nt, Human
gucagauuaauagcaauaauaa

SEQ ID NO: 671384 - RNA, 22 nt, Human
ucagcugccucucccuggaaga

SEQ ID NO: 671385 - RNA, 22 nt, Human
acacaggcauagccauacaugu

SEQ ID NO: 671386 - RNA, 22 nt, Human
uuucacauuuuauacuuaagcc

SEQ ID NO: 671387 - RNA, 22 nt, Human
ugcuguggcaguuuauguauag

SEQ ID NO: 671388 - RNA, 22 nt, Human
ucugaaagggcuaaauaauuug

SEQ ID NO: 671389 - RNA, 22 nt, Human
cauuugaugacucaacucauaa

SEQ ID NO: 671390 - RNA, 18 nt, Human
uccugggaaaggcauaca

SEQ ID NO: 671391 - RNA, 22 nt, Human
cagaagaguagcugaacaaguu

SEQ ID NO: 671392 - RNA, 22 nt, Human
cgaugguucuggcugcuuguau

SEQ ID NO: 671393 - RNA, 22 nt, Human
aagcccuggaacuuuccuagcc

SEQ ID NO: 671394 - RNA, 22 nt, Human
uaggcaggcugaauguagauuu

SEQ ID NO: 671395 - RNA, 22 nt, Human
guguaucaguaacuguggacag

SEQ ID NO: 671396 - RNA, 22 nt, Human
ucugaacauggcuuccucuuca

SEQ ID NO: 671397 - RNA, 22 nt, Human
cagagcuuccugcugggcuucu

SEQ ID NO: 671398 - RNA, 21 nt, Human
ugcugacaucaggucugcuau

SEQ ID NO: 671399 - RNA, 22 nt, Human
auguggcuagggaauaaaauau

SEQ ID NO: 671400 - RNA, 22 nt, Human
uccuggaguugucuguacucau

SEQ ID NO: 671401 - RNA, 22 nt, Human
gaaggagggagcggcgcggauu

SEQ ID NO: 671402 - RNA, 22 nt, Human
uuggaugaagucuagcuuuagu

SEQ ID NO: 671403 - RNA, 22 nt, Human
aauaaguugccuguugaaucau

SEQ ID NO: 671404 - RNA, 19 nt, Human
ucagaaggcaggagaggcc

SEQ ID NO: 671405 - RNA, 22 nt, Human
gcaaugcauauguggguagcau

SEQ ID NO: 671406 - RNA, 22 nt, Human
aggagccauccccaugagaggu

SEQ ID NO: 671407 - RNA, 22 nt, Human
guuccuaagcuguggcccugga

SEQ ID NO: 671408 - RNA, 22 nt, Human
uuauccaacaugacuuaugucc

SEQ ID NO: 671409 - RNA, 22 nt, Human
auguuacacauaggcauaaaug

SEQ ID NO: 671410 - RNA, 22 nt, Human
guuccacaaaaggucuaguuua

SEQ ID NO: 671411 - RNA, 22 nt, Human
agugggggccaacgagggcagc

SEQ ID NO: 671412 - RNA, 22 nt, Human
uauagcaagcucuuuguaacca

SEQ ID NO: 671413 - RNA, 22 nt, Human
acacagaaccucauagccucuc

SEQ ID NO: 671414 - RNA, 22 nt, Human
uuggcucaccugucuacccaga

SEQ ID NO: 671415 - RNA, 22 nt, Human
aagacaagcaucaaaucaggca

SEQ ID NO: 671416 - RNA, 22 nt, Human
agagacugauggagcucacucu

SEQ ID NO: 671417 - RNA, 22 nt, Human
ggccacagucucuggaaggaug

SEQ ID NO: 671418 - RNA, 22 nt, Human
uguuugaauaacuuggauauau

SEQ ID NO: 671419 - RNA, 22 nt, Human
uacuuuuuaugauaagaacuga

SEQ ID NO: 671420 - RNA, 22 nt, Human
aaauuagauaugugugagacuc

SEQ ID NO: 671421 - RNA, 22 nt, Human
aggagccauugcaggauggcag

SEQ ID NO: 671422 - RNA, 22 nt, Human
uacugugggauguugugauuag

SEQ ID NO: 671423 - RNA, 22 nt, Human
cccucccucugcuggguguaga

SEQ ID NO: 671424 - RNA, 22 nt, Human
cagcccucugaagaggcgcuug

SEQ ID NO: 671425 - RNA, 22 nt, Human
uuauugucaaaaacaggacacu

SEQ ID NO: 671426 - RNA, 22 nt, Human
cucugucacuucuccagcugag

SEQ ID NO: 671427 - RNA, 22 nt, Human
ggcacagggggcugaggacuag

SEQ ID NO: 671428 - RNA, 22 nt, Human
ucugcaucucaggauucccuuc

SEQ ID NO: 671429 - RNA, 22 nt, Human
gcaggaacuggagcuggauguu

SEQ ID NO: 671430 - RNA, 22 nt, Human
ccagcucuguaagcugugaaau

SEQ ID NO: 671431 - RNA, 22 nt, Human
aguguuuuuggguagggugagu

SEQ ID NO: 671432 - RNA, 20 nt, Human
aucaggaagagagacugacc

SEQ ID NO: 671433 - RNA, 22 nt, Human
uugaccuauguuucuucaucug

SEQ ID NO: 671434 - RNA, 22 nt, Human
gugucccacucuggaggugaag

SEQ ID NO: 671435 - RNA, 22 nt, Human
caaauaguaugagcaaugauuc

SEQ ID NO: 671436 - RNA, 22 nt, Human
gagcucagaggcgucuuugucc

SEQ ID NO: 671437 - RNA, 22 nt, Human
ccagcuuuaucaagucugagcu

SEQ ID NO: 671438 - RNA, 17 nt, Human
ucucagugacugauagc

SEQ ID NO: 671439 - RNA, 22 nt, Human
cauuuaaugcacggauguagcc

SEQ ID NO: 671440 - RNA, 22 nt, Human
aagaagaaguguuauuuuuaga

SEQ ID NO: 671441 - RNA, 18 nt, Human
gccucuguugcuugccug

SEQ ID NO: 671442 - RNA, 22 nt, Human
gaaaguauucacaaaguucuug

SEQ ID NO: 671443 - RNA, 22 nt, Human
gcagcaguaggaaauaacacag

SEQ ID NO: 671444 - RNA, 22 nt, Human
uucauacaaugggauauuauga

SEQ ID NO: 671445 - RNA, 22 nt, Human
aaguuuagcuugagauggaaag

SEQ ID NO: 671446 - RNA, 22 nt, Human
cugucauuuaagacauucugga

SEQ ID NO: 671447 - RNA, 22 nt, Human
aggggacacggcuucuccaggg

SEQ ID NO: 671448 - RNA, 22 nt, Human
gaggggcugggguugacuccaa

SEQ ID NO: 671449 - RNA, 22 nt, Human
ucagaaggaaacgaugccagcu

SEQ ID NO: 671450 - RNA, 22 nt, Human
guuugucuuaauuaggcaucga

SEQ ID NO: 671451 - RNA, 20 nt, Human
uauuuagauucaaguaugga

SEQ ID NO: 671452 - RNA, 22 nt, Human
aagaucauaauauuuaucucau

SEQ ID NO: 671453 - RNA, 18 nt, Human
ucagagguacagaaaagu

SEQ ID NO: 671454 - RNA, 22 nt, Human
aagagggaggugcgggugcaga

SEQ ID NO: 671455 - RNA, 22 nt, Human
uccugggaacucggaaagcucu

SEQ ID NO: 671456 - RNA, 22 nt, Human
agaagccacaggaaagcagcuu

SEQ ID NO: 671457 - RNA, 22 nt, Human
ucaggagugcagcaguuuggag

SEQ ID NO: 671458 - RNA, 22 nt, Human
gucuggggugaggcccgggauu

SEQ ID NO: 671459 - RNA, 22 nt, Human
augcauuuauguguguacauug

SEQ ID NO: 671460 - RNA, 22 nt, Human
ugugaagauagcuguuacaucu

SEQ ID NO: 671461 - RNA, 22 nt, Human
agccccuuccaguucucagauc

SEQ ID NO: 671462 - RNA, 22 nt, Human
uucuguucuuuauuuaccauau

SEQ ID NO: 671463 - RNA, 22 nt, Human
ggcaucaggaucugucuugcuu

SEQ ID NO: 671464 - RNA, 22 nt, Human
cugugaaacuggacagcacuug

SEQ ID NO: 671465 - RNA, 22 nt, Human
guauuaggaggaacacaggccu

SEQ ID NO: 671466 - RNA, 18 nt, Human
cugggcucgagagauccu

SEQ ID NO: 671467 - RNA, 22 nt, Human
ccuucaggucauauaugucaga

SEQ ID NO: 671468 - RNA, 22 nt, Human
uuacaaagaguguucuuuucca

SEQ ID NO: 671469 - RNA, 22 nt, Human
ccagaaaaggagcugcaggaug

SEQ ID NO: 671470 - RNA, 22 nt, Human
ugcccagggauaagccuagaga

SEQ ID NO: 671471 - RNA, 22 nt, Human
ucuaacuuagggaauacuuuag

SEQ ID NO: 671472 - RNA, 22 nt, Human
gguuccagaccacggguguucu

SEQ ID NO: 671473 - RNA, 22 nt, Human
uuuauucaagaugagguucaug

SEQ ID NO: 671474 - RNA, 22 nt, Human
agggcccuccccgcucagggca

SEQ ID NO: 671475 - RNA, 22 nt, Human
augagguuuuacugccauuuuc

SEQ ID NO: 671476 - RNA, 22 nt, Human
gagcagugaugggaggacguca

SEQ ID NO: 671477 - RNA, 22 nt, Human
uauauguagauuguaccaaugu

SEQ ID NO: 671478 - RNA, 19 nt, Human
ucaaagucugagucacuuu

SEQ ID NO: 671479 - RNA, 22 nt, Human
ccugagagagaagcgaccuggu

SEQ ID NO: 671480 - RNA, 22 nt, Human
uggagaguaaauggcagaauca

SEQ ID NO: 671481 - RNA, 22 nt, Human
agggccagcacuccuggcagga

SEQ ID NO: 671482 - RNA, 22 nt, Human
guuucuggcgccggggcaggcc

SEQ ID NO: 671483 - RNA, 23 nt, Human
uggcuggcagaaacugaagcaug

SEQ ID NO: 671484 - RNA, 22 nt, Human
ucuggaguggcagucaucugaa

SEQ ID NO: 671485 - RNA, 22 nt, Human
ucauagaaauaucacgucuuuu

SEQ ID NO: 671486 - RNA, 22 nt, Human
ggcucagaaacuaaaggcgcug

SEQ ID NO: 671487 - RNA, 19 nt, Human
aguuauuucuaaauuuacc

SEQ ID NO: 671488 - RNA, 22 nt, Human
cucuuuggcguuggcagagcca

SEQ ID NO: 671489 - RNA, 22 nt, Human
uaaauguuguaaguacaucuaa

SEQ ID NO: 671490 - RNA, 22 nt, Human
aucacaaucuucaaaucgauuc

SEQ ID NO: 671491 - RNA, 22 nt, Human
gcaguggccacauggaggagga

SEQ ID NO: 671492 - RNA, 22 nt, Human
ugaaacauuugaugaucuuugg

SEQ ID NO: 671493 - RNA, 22 nt, Human
aagucuaguauccuucuugacu

SEQ ID NO: 671494 - RNA, 22 nt, Human
cguuuaaccagcacgcuuggcc

SEQ ID NO: 671495 - RNA, 22 nt, Human
agcugcuuugcugggcaggccc

SEQ ID NO: 671496 - RNA, 22 nt, Human
ucuuuguuauugugaauagggu

SEQ ID NO: 671497 - RNA, 22 nt, Human
cuucauaaacucagaaggcagc

SEQ ID NO: 671498 - RNA, 22 nt, Human
agcuggcccucgagagccaauu

SEQ ID NO: 671499 - RNA, 22 nt, Human
ccagacaggaacacacaucucc

SEQ ID NO: 671500 - RNA, 19 nt, Human
agcagagcagggccguggg

SEQ ID NO: 671501 - RNA, 22 nt, Human
uccagggcuggguuggcucagc

SEQ ID NO: 671502 - RNA, 22 nt, Human
cugggacagcugagacaggaga

SEQ ID NO: 671503 - RNA, 22 nt, Human
ugcuucugggcaaaugugugug

SEQ ID NO: 671504 - RNA, 19 nt, Human
ugcuauuuagaacgccugg

SEQ ID NO: 671505 - RNA, 20 nt, Human
agcuccagugcugacgcuuc

SEQ ID NO: 671506 - RNA, 22 nt, Human
aguccaaagcagaugagggcca

SEQ ID NO: 671507 - RNA, 22 nt, Human
cagcuucaugacaaacaguuuu

SEQ ID NO: 671508 - RNA, 22 nt, Human
aacaucuccaaccuacauccac

SEQ ID NO: 671509 - RNA, 22 nt, Human
augacauugacagaccugcugc

SEQ ID NO: 671510 - RNA, 22 nt, Human
ucacuggauuaguuugaacugu

SEQ ID NO: 671511 - RNA, 22 nt, Human
agcagcucaaagccugcaagga

SEQ ID NO: 671512 - RNA, 22 nt, Human
aggcagcaaaugucuggaacag

SEQ ID NO: 671513 - RNA, 22 nt, Human
gcgagugccgagagggcagggc

SEQ ID NO: 671514 - RNA, 22 nt, Human
aaagguuauuauuacuauuguc

SEQ ID NO: 671515 - RNA, 22 nt, Human
gaguaacauaccaaaauucaca

SEQ ID NO: 671516 - RNA, 22 nt, Human
gucccagcuucccacuagcagc

SEQ ID NO: 671517 - RNA, 22 nt, Human
ucaguggaguauggaugaaguc

SEQ ID NO: 671518 - RNA, 23 nt, Human
agagcuuucuaaaauguaaaucu

SEQ ID NO: 671519 - RNA, 17 nt, Human
guaaggcuugcagaugc

SEQ ID NO: 671520 - RNA, 22 nt, Human
cacugccugugagcugugugcc

SEQ ID NO: 671521 - RNA, 22 nt, Human
gugggagcuuuggcaucaggcu

SEQ ID NO: 671522 - RNA, 22 nt, Human
ucuccagggagguagcccagug

SEQ ID NO: 671523 - RNA, 22 nt, Human
uugaaugauuaaagucaucuga

SEQ ID NO: 671524 - RNA, 22 nt, Human
gaggcucagagagguccacaua

SEQ ID NO: 671525 - RNA, 22 nt, Human
ugggcuacucugggagccuaac

SEQ ID NO: 671526 - RNA, 22 nt, Human
cacagcuucccaaaguggaccu

SEQ ID NO: 671527 - RNA, 22 nt, Human
uugaggccaaaaaguccuauga

SEQ ID NO: 671528 - RNA, 22 nt, Human
uggggaaaggagagcauuauuu

SEQ ID NO: 671529 - RNA, 22 nt, Human
guccucagggaauguggcgggu

SEQ ID NO: 671530 - RNA, 23 nt, Human
aggcagugggggccacuuugcuu

SEQ ID NO: 671531 - RNA, 22 nt, Human
cagacagggguaaccuuccuca

SEQ ID NO: 671532 - RNA, 22 nt, Human
agugucaucgugaaaacauagc

SEQ ID NO: 671533 - RNA, 22 nt, Human
ucucugagcuuaagguguuuca

SEQ ID NO: 671534 - RNA, 22 nt, Human
guccagaaggaggucaaguugg

SEQ ID NO: 671535 - RNA, 22 nt, Human
agcaucugcuuaauggcuuaac

SEQ ID NO: 671536 - RNA, 22 nt, Human
ucccagagccaagcuauggaug

SEQ ID NO: 671537 - RNA, 17 nt, Human
cgggcccgcggccgcuc

SEQ ID NO: 671538 - RNA, 22 nt, Human
aaaagagaauccuguacagaga

SEQ ID NO: 671539 - RNA, 22 nt, Human
ggccagcuucucugcugccugu

SEQ ID NO: 671540 - RNA, 22 nt, Human
gacuuuaaaaugcuagaacagg

SEQ ID NO: 671541 - RNA, 22 nt, Human
cauuuauugaguggccacagug

SEQ ID NO: 671542 - RNA, 22 nt, Human
gugcaugugucuuuauaguaga

SEQ ID NO: 671543 - RNA, 22 nt, Human
acaauuuuaagccagagugggu

SEQ ID NO: 671544 - RNA, 22 nt, Human
caugcuaauucccaggccccaa

SEQ ID NO: 671545 - RNA, 22 nt, Human
aguacagaccugucucuuccug

SEQ ID NO: 671546 - RNA, 22 nt, Human
ccucucagcgauuccucuugga

SEQ ID NO: 671547 - RNA, 22 nt, Human
uugguuuacuaggauucaaauu

SEQ ID NO: 671548 - RNA, 22 nt, Human
ugagcagagacuucaagggcag

SEQ ID NO: 671549 - RNA, 22 nt, Human
ugguuucccauuaucugcagga

SEQ ID NO: 671550 - RNA, 22 nt, Human
uagagcauucuaucuccaacag

SEQ ID NO: 671551 - RNA, 22 nt, Human
guguuuggucagacguccgggg

SEQ ID NO: 671552 - RNA, 22 nt, Human
gugagaagauaaguauugcaaa

SEQ ID NO: 671553 - RNA, 19 nt, Human
gaagaagcuugagaaguag

SEQ ID NO: 671554 - RNA, 22 nt, Human
aguguccuuguuauuacugcuc

SEQ ID NO: 671555 - RNA, 22 nt, Human
ggcuugaacucccaaucauuua

SEQ ID NO: 671556 - RNA, 22 nt, Human
ggugugugaggagucacuuagu

SEQ ID NO: 671557 - RNA, 22 nt, Human
uugauauuagaguauuuguuug

SEQ ID NO: 671558 - RNA, 22 nt, Human
acuccagggguugcuauuuaca

SEQ ID NO: 671559 - RNA, 22 nt, Human
aacccagggugaggggagucua

SEQ ID NO: 671560 - RNA, 22 nt, Human
aggacaagacaaggaccagaga

SEQ ID NO: 671561 - RNA, 22 nt, Human
acccagagcugggcuuggcaaa

SEQ ID NO: 671562 - RNA, 22 nt, Human
cugccuggaaugccagcuucuc

SEQ ID NO: 671563 - RNA, 22 nt, Human
cucugagaugcuugaagaggau

SEQ ID NO: 671564 - RNA, 22 nt, Human
ccccuuucucccgcgucuggcc

SEQ ID NO: 671565 - RNA, 22 nt, Human
uuccacuggcuuucagugaucu

SEQ ID NO: 671566 - RNA, 22 nt, Human
cuggagaagccaaacuagucac

SEQ ID NO: 671567 - RNA, 22 nt, Human
auaaaacuuggguaugaucccu

SEQ ID NO: 671568 - RNA, 21 nt, Human
aaaauguagacuuuucccuga

SEQ ID NO: 671569 - RNA, 22 nt, Human
ggcuccaguuugugccuucagc

SEQ ID NO: 671570 - RNA, 22 nt, Human
aucuuugcccagagacucagcc

SEQ ID NO: 671571 - RNA, 22 nt, Human
gcuauacacauuucuugguagu

SEQ ID NO: 671572 - RNA, 22 nt, Human
augaaugugaugauucuguuac

SEQ ID NO: 671573 - RNA, 22 nt, Human
uucucuaauggugaugauuaga

SEQ ID NO: 671574 - RNA, 22 nt, Human
cugagcauccagcagguacugc

SEQ ID NO: 671575 - RNA, 20 nt, Human
ucccuggaggugguggcauc

SEQ ID NO: 671576 - RNA, 22 nt, Human
guggaaguagauuugagaaggu

SEQ ID NO: 671577 - RNA, 22 nt, Human
ccuuuucuggccaccaagcgcu

SEQ ID NO: 671578 - RNA, 22 nt, Human
ccugguguggcugucacagagg

SEQ ID NO: 671579 - RNA, 22 nt, Human
aaauggauguugaguuaaaugu

SEQ ID NO: 671580 - RNA, 17 nt, Human
aagaaucauuagagaag

SEQ ID NO: 671581 - RNA, 22 nt, Human
caggagccccaggcugacaaua

SEQ ID NO: 671582 - RNA, 19 nt, Human
ucccuuccugucgggcucc

SEQ ID NO: 671583 - RNA, 22 nt, Human
ugcugggcccccagugaccuuc

SEQ ID NO: 671584 - RNA, 22 nt, Human
aagaaggcuucagagcccagga

SEQ ID NO: 671585 - RNA, 19 nt, Human
uacaugcucuugguucagg

SEQ ID NO: 671586 - RNA, 22 nt, Human
uguuagcagagcagcugacaga

SEQ ID NO: 671587 - RNA, 22 nt, Human
uacucugccccagccaauaaug

SEQ ID NO: 671588 - RNA, 22 nt, Human
uuacuucuugucucaugccuau

SEQ ID NO: 671589 - RNA, 22 nt, Human
aagcaggcaucuuggaggucaa

SEQ ID NO: 671590 - RNA, 22 nt, Human
agagccacuccaggacucaggg

SEQ ID NO: 671591 - RNA, 22 nt, Human
gggcuggagacaagugagccgc

SEQ ID NO: 671592 - RNA, 20 nt, Human
uggcaggacuggcuccaccc

SEQ ID NO: 671593 - RNA, 22 nt, Human
gauguucuuauaccauuguggg

SEQ ID NO: 671594 - RNA, 22 nt, Human
agauuacagcaugggaauggga

SEQ ID NO: 671595 - RNA, 22 nt, Human
ucccaagcccuggaugccucag

SEQ ID NO: 671596 - RNA, 22 nt, Human
cuguggugagcaacugacugaa

SEQ ID NO: 671597 - RNA, 22 nt, Human
uauggguaaagggcuaggguuu

SEQ ID NO: 671598 - RNA, 22 nt, Human
ggcugagcguggcugccguggg

SEQ ID NO: 671599 - RNA, 22 nt, Human
ugaaauaauaucuggaucaauc

SEQ ID NO: 671600 - RNA, 22 nt, Human
aggcccagcuggacaaacugcu

SEQ ID NO: 671601 - RNA, 22 nt, Human
ggcuccugcaccugucccucug

SEQ ID NO: 671602 - RNA, 22 nt, Human
guuuuauaggcuguugcuauau

SEQ ID NO: 671603 - RNA, 22 nt, Human
uuauauacugugguaguacugu

SEQ ID NO: 671604 - RNA, 22 nt, Human
aaggccacuuuaccuuaaaucc

SEQ ID NO: 671605 - RNA, 23 nt, Human
acaaggcaacauagaucagggca

SEQ ID NO: 671606 - RNA, 22 nt, Human
gccaagcucaccuucugaugga

SEQ ID NO: 671607 - RNA, 22 nt, Human
cuuuguggcuccugcaggccau

SEQ ID NO: 671608 - RNA, 22 nt, Human
aaggcugugucagaagcucccu

SEQ ID NO: 671609 - RNA, 22 nt, Human
ccagcucuagccccauguggcu

SEQ ID NO: 671610 - RNA, 22 nt, Human
ggccuugggcuggcugcaguau

SEQ ID NO: 671611 - RNA, 22 nt, Human
ucugaggcauaaccuguucugc

SEQ ID NO: 671612 - RNA, 22 nt, Human
cagauccuuaggacaaccaucc

SEQ ID NO: 671613 - RNA, 22 nt, Human
cuccucucaggcuggauggcgc

SEQ ID NO: 671614 - RNA, 22 nt, Human
cuggcccuauuccaggccuucc

SEQ ID NO: 671615 - RNA, 22 nt, Human
aggugaggauagguggccaagg

SEQ ID NO: 671616 - RNA, 22 nt, Human
acaggcagagaacucagccaga

SEQ ID NO: 671617 - RNA, 22 nt, Human
aaggaagaggcagguuuugcug

SEQ ID NO: 671618 - RNA, 22 nt, Human
ugucuauuugaauuauccuaau

SEQ ID NO: 671619 - RNA, 22 nt, Human
aggcuguguuucuugcguuuuc

SEQ ID NO: 671620 - RNA, 22 nt, Human
ucucaggaguagugggauccau

SEQ ID NO: 671621 - RNA, 22 nt, Human
uucaugagguaccugugaucau

SEQ ID NO: 671622 - RNA, 22 nt, Human
aaggaagcagcaaugcaugauu

SEQ ID NO: 671623 - RNA, 22 nt, Human
agaaauguuacaguuguuauuu

SEQ ID NO: 671624 - RNA, 22 nt, Human
uagggacaaagagcugaggccu

SEQ ID NO: 671625 - RNA, 22 nt, Human
gagaggagacuuauccagauug

SEQ ID NO: 671626 - RNA, 22 nt, Human
agacauaagccagucacucacu

SEQ ID NO: 671627 - RNA, 22 nt, Human
gccaggcucagcagucaaccug

SEQ ID NO: 671628 - RNA, 23 nt, Human
ugucaucuccagacucccagugc

SEQ ID NO: 671629 - RNA, 22 nt, Human
gaaaauuauugaaaauggcucu

SEQ ID NO: 671630 - RNA, 22 nt, Human
uguuaacuaauggucuaacauu

SEQ ID NO: 671631 - RNA, 22 nt, Human
auuaagagccuacuaugugccg

SEQ ID NO: 671632 - RNA, 22 nt, Human
uguccuggacaacagccccuag

SEQ ID NO: 671633 - RNA, 22 nt, Human
cuuccuuugcuguucggagguu

SEQ ID NO: 671634 - RNA, 22 nt, Human
uccuggagggcucacaggcggc

SEQ ID NO: 671635 - RNA, 22 nt, Human
gcuguggccaacaaaccacuuu

SEQ ID NO: 671636 - RNA, 22 nt, Human
gcugcaggggggucuggacuug

SEQ ID NO: 671637 - RNA, 22 nt, Human
ugaggacuuuccauguuaaugu

SEQ ID NO: 671638 - RNA, 22 nt, Human
uacaagagguauauagaaacag

SEQ ID NO: 671639 - RNA, 22 nt, Human
acucugcucuguauuucacugu

SEQ ID NO: 671640 - RNA, 22 nt, Human
ugcauucugacuuaguuaauau

SEQ ID NO: 671641 - RNA, 22 nt, Human
cagacccucgggugaguuggcc

SEQ ID NO: 671642 - RNA, 22 nt, Human
ucuccaucugucauucuugucc

SEQ ID NO: 671643 - RNA, 22 nt, Human
uuuguucagcucucauugauua

SEQ ID NO: 671644 - RNA, 22 nt, Human
uuuggaucacuguuccucuggg

SEQ ID NO: 671645 - RNA, 22 nt, Human
ucugcccacaguccaauaguug

SEQ ID NO: 671646 - RNA, 22 nt, Human
ccaguguugcauaggaugggga

SEQ ID NO: 671647 - RNA, 22 nt, Human
cauuuguuaaugcugcuuuuaa

SEQ ID NO: 671648 - RNA, 22 nt, Human
cuaucuuuuguucauuuugagu

SEQ ID NO: 671649 - RNA, 22 nt, Human
ccagaaaacucuacaugcuugu

SEQ ID NO: 671650 - RNA, 22 nt, Human
agccaagaaucaugagcuaaua

SEQ ID NO: 671651 - RNA, 22 nt, Human
ccauugaauccucagcugcuag

SEQ ID NO: 671652 - RNA, 22 nt, Human
uccauaaaccagaaaaucaaga

SEQ ID NO: 671653 - RNA, 22 nt, Human
gauuaguauccuuauuaagaga

SEQ ID NO: 671654 - RNA, 19 nt, Human
ucaugcacuuugauguaac

SEQ ID NO: 671655 - RNA, 19 nt, Human
agcagagcaaaguggcuga

SEQ ID NO: 671656 - RNA, 16 nt, Human
guaacauucuguagcc

SEQ ID NO: 671657 - RNA, 22 nt, Human
agaagccaagaacagacagugc

SEQ ID NO: 671658 - RNA, 22 nt, Human
cacaugaggugacuuccaagcu

SEQ ID NO: 671659 - RNA, 22 nt, Human
uauguagauuucucuguuuuuc

SEQ ID NO: 671660 - RNA, 22 nt, Human
uucaucaggcaucaugcucaag

SEQ ID NO: 671661 - RNA, 23 nt, Human
ugaacaguaugugggacauugag

SEQ ID NO: 671662 - RNA, 22 nt, Human
cacuaagucaacagccucucuu

SEQ ID NO: 671663 - RNA, 22 nt, Human
ccuggcucugcgugcagcuccg

SEQ ID NO: 671664 - RNA, 22 nt, Human
guauuugcaaaucuaaaagaga

SEQ ID NO: 671665 - RNA, 22 nt, Human
auaaaagucugcuuauuugggc

SEQ ID NO: 671666 - RNA, 22 nt, Human
ccuuuuggccaggucagugcag

SEQ ID NO: 671667 - RNA, 22 nt, Human
gguuuucucccccucuucucag

SEQ ID NO: 671668 - RNA, 22 nt, Human
auaguuuuauagauauugugua

SEQ ID NO: 671669 - RNA, 22 nt, Human
ggccucucauucucccuggucc

SEQ ID NO: 671670 - RNA, 22 nt, Human
uaggaagcugagcagcauuccu

SEQ ID NO: 671671 - RNA, 22 nt, Human
uacuucaacaccauaugguccu

SEQ ID NO: 671672 - RNA, 22 nt, Human
agaucuuuagaagauagaauca

SEQ ID NO: 671673 - RNA, 21 nt, Human
ucugacaaucucauuucaaac

SEQ ID NO: 671674 - RNA, 22 nt, Human
aggcuagucaagucaagcagug

SEQ ID NO: 671675 - RNA, 19 nt, Human
ccagggcuccaagcugagu

SEQ ID NO: 671676 - RNA, 22 nt, Human
guccugugugagugcaccaccu

SEQ ID NO: 671677 - RNA, 22 nt, Human
uggaggaauaacagcaaccuua

SEQ ID NO: 671678 - RNA, 22 nt, Human
uaaagcuuguauugcaauauuu

SEQ ID NO: 671679 - RNA, 22 nt, Human
ugugugaaggaauauauacuca

SEQ ID NO: 671680 - RNA, 22 nt, Human
gugacauuucgugacgugagaa

SEQ ID NO: 671681 - RNA, 22 nt, Human
uguggccucuaagcucacgaag

SEQ ID NO: 671682 - RNA, 22 nt, Human
uccaugcagaguccaggccuca

SEQ ID NO: 671683 - RNA, 22 nt, Human
auguacacaugcaugcaugugc

SEQ ID NO: 671684 - RNA, 22 nt, Human
gugaggaugcagaugagggccu

SEQ ID NO: 671685 - RNA, 21 nt, Human
gggcuggauauuggaaagagg

SEQ ID NO: 671686 - RNA, 22 nt, Human
uccucacacccauaccacugac

SEQ ID NO: 671687 - RNA, 22 nt, Human
ggagacaggguugaaccacgca

SEQ ID NO: 671688 - RNA, 22 nt, Human
agcuggaagauccugguuuugu

SEQ ID NO: 671689 - RNA, 22 nt, Human
ggggcugacgggcauguggcuu

SEQ ID NO: 671690 - RNA, 23 nt, Human
uggcuuuauucacauaucugacc

SEQ ID NO: 671691 - RNA, 22 nt, Human
agaaagguggaugcucuggaau

SEQ ID NO: 671692 - RNA, 19 nt, Human
ccagaggcagcuucuguaa

SEQ ID NO: 671693 - RNA, 22 nt, Human
auaaauggcuuucauuccuagg

SEQ ID NO: 671694 - RNA, 22 nt, Human
caguccuuucaauggugaccuu

SEQ ID NO: 671695 - RNA, 22 nt, Human
gcuggccacacugcugauggag

SEQ ID NO: 671696 - RNA, 22 nt, Human
ucaaugauaguacaaucagccu

SEQ ID NO: 671697 - RNA, 22 nt, Human
uuacaucagaaggaaacagcgu

SEQ ID NO: 671698 - RNA, 18 nt, Human
ucauucaaagucuacuga

SEQ ID NO: 671699 - RNA, 22 nt, Human
aagugccugggcaacauagcaa

SEQ ID NO: 671700 - RNA, 23 nt, Human
cugcuuccuugcuucauugcugg

SEQ ID NO: 671701 - RNA, 22 nt, Human
uucucuuccagccgggcuugca

SEQ ID NO: 671702 - RNA, 22 nt, Human
auccuguuagcaccuucaaacu

SEQ ID NO: 671703 - RNA, 22 nt, Human
uaucacacgccuugcuucauuu

SEQ ID NO: 671704 - RNA, 22 nt, Human
ggugcccuguaaaagccaugca

SEQ ID NO: 671705 - RNA, 22 nt, Human
ggaggcugaggccccucacagg

SEQ ID NO: 671706 - RNA, 22 nt, Human
agucugaaggauggaagguacc

SEQ ID NO: 671707 - RNA, 22 nt, Human
aggcaacauaacacgaaagucu

SEQ ID NO: 671708 - RNA, 22 nt, Human
uccuacagauacuaaggagauc

SEQ ID NO: 671709 - RNA, 22 nt, Human
aggcucugugcauccuccccaa

SEQ ID NO: 671710 - RNA, 22 nt, Human
ugcauuggaaaacuauggcuca

SEQ ID NO: 671711 - RNA, 22 nt, Human
cuucugugcaauuguggaggag

SEQ ID NO: 671712 - RNA, 22 nt, Human
ugccuaggaaaccucaugcuuc

SEQ ID NO: 671713 - RNA, 22 nt, Human
cuucucuuggguguggugucuu

SEQ ID NO: 671714 - RNA, 20 nt, Human
cccucccagaugcuucccaa

SEQ ID NO: 671715 - RNA, 22 nt, Human
guuauacaguuuugggucugcu

SEQ ID NO: 671716 - RNA, 22 nt, Human
uacuguggggauauugauugua

SEQ ID NO: 671717 - RNA, 20 nt, Human
uggcuucauaaugguuucug

SEQ ID NO: 671718 - RNA, 21 nt, Human
ggcaugagggcagugagcaga

SEQ ID NO: 671719 - RNA, 22 nt, Human
cagcaagucauccaggaugaug

SEQ ID NO: 671720 - RNA, 22 nt, Human
augcccaggcccauaccuagau

SEQ ID NO: 671721 - RNA, 22 nt, Human
cuggguucuauuuuuggcuuca

SEQ ID NO: 671722 - RNA, 22 nt, Human
gcccaucuucuagcagcuguua

SEQ ID NO: 671723 - RNA, 22 nt, Human
cuggcagauaguaagugaucaa

SEQ ID NO: 671724 - RNA, 22 nt, Human
uuuuucaucugauugauaacuc

SEQ ID NO: 671725 - RNA, 22 nt, Human
cuccagagauacacggucuugc

SEQ ID NO: 671726 - RNA, 22 nt, Human
ggggccuuuucugaauguggaa

SEQ ID NO: 671727 - RNA, 22 nt, Human
gccucaggccgcccugcugcuc

SEQ ID NO: 671728 - RNA, 22 nt, Human
acagaugaguuaaagcagagug

SEQ ID NO: 671729 - RNA, 22 nt, Human
uuccacucuucucuggacuuau

SEQ ID NO: 671730 - RNA, 18 nt, Human
auguucauauuuuuaggg

SEQ ID NO: 671731 - RNA, 20 nt, Human
cugcuuccaggcucaccccc

SEQ ID NO: 671732 - RNA, 22 nt, Human
cagaggccaccuguggccacug

SEQ ID NO: 671733 - RNA, 20 nt, Human
agagagagguaaauugagca

SEQ ID NO: 671734 - RNA, 22 nt, Human
gaggaggcuuccgggaggcacg

SEQ ID NO: 671735 - RNA, 22 nt, Human
ugggccacucuucccugggucu

SEQ ID NO: 671736 - RNA, 22 nt, Human
cucucagggacccagccagccu

SEQ ID NO: 671737 - RNA, 22 nt, Human
uaauuuuuccacguacacuggg

SEQ ID NO: 671738 - RNA, 22 nt, Human
gaaauguauaagcuggucuuuu

SEQ ID NO: 671739 - RNA, 19 nt, Human
cagucccaaauucuuguca

SEQ ID NO: 671740 - RNA, 22 nt, Human
gcugccugugcgggucgcuagg

SEQ ID NO: 671741 - RNA, 22 nt, Human
ggcaggcugcuugggucauguc

SEQ ID NO: 671742 - RNA, 22 nt, Human
aauaagaugugcuugaguuugg

SEQ ID NO: 671743 - RNA, 19 nt, Human
acucuacaguguguacaac

SEQ ID NO: 671744 - RNA, 22 nt, Human
gggaugagagcugggacagaag

SEQ ID NO: 671745 - RNA, 22 nt, Human
uggggcuaacgagagagcagag

SEQ ID NO: 671746 - RNA, 22 nt, Human
uuuagacuaauuccuaaagggc

SEQ ID NO: 671747 - RNA, 22 nt, Human
ucuuauucagugggcucugcca

SEQ ID NO: 671748 - RNA, 22 nt, Human
uuacaggaggugcuagguguuu

SEQ ID NO: 671749 - RNA, 22 nt, Human
aacacuucaagcagaagguugg

SEQ ID NO: 671750 - RNA, 22 nt, Human
agcucugggauucucaggccac

SEQ ID NO: 671751 - RNA, 22 nt, Human
cuccagauucuggaugacuggg

SEQ ID NO: 671752 - RNA, 22 nt, Human
acagaccaaaaaaggauauugg

SEQ ID NO: 671753 - RNA, 22 nt, Human
gagacagccuacuccagucuca

SEQ ID NO: 671754 - RNA, 21 nt, Human
uuuuaacaaggauuucccuag

SEQ ID NO: 671755 - RNA, 23 nt, Human
uggcugagcccacuaucuuggcc

SEQ ID NO: 671756 - RNA, 22 nt, Human
uauggcuuguggagaguuguag

SEQ ID NO: 671757 - RNA, 22 nt, Human
ugcaggcucugguuuauagugc

SEQ ID NO: 671758 - RNA, 22 nt, Human
acagcagcagaccagcauaugu

SEQ ID NO: 671759 - RNA, 17 nt, Human
agcuccugcccauggcu

SEQ ID NO: 671760 - RNA, 22 nt, Human
ccuugcugcgugcuagcacaga

SEQ ID NO: 671761 - RNA, 22 nt, Human
ugugccugacuaggugaaucaa

SEQ ID NO: 671762 - RNA, 22 nt, Human
acagcacuuggguuuuccuguu

SEQ ID NO: 671763 - RNA, 22 nt, Human
cugugcccuguggcuggcaccu

SEQ ID NO: 671764 - RNA, 21 nt, Human
gacacaaaggguaguaauggu

SEQ ID NO: 671765 - RNA, 23 nt, Human
ggaggaguucccagcccuccugg

SEQ ID NO: 671766 - RNA, 22 nt, Human
gagacacacacaggagguggca

SEQ ID NO: 671767 - RNA, 22 nt, Human
ggccaccuuccuguggucucug

SEQ ID NO: 671768 - RNA, 22 nt, Human
acacugaauguuuaagaacuug

SEQ ID NO: 671769 - RNA, 17 nt, Human
uucuccucuguguccuu

SEQ ID NO: 671770 - RNA, 22 nt, Human
aucuguaauuuugaaugcaaau

SEQ ID NO: 671771 - RNA, 22 nt, Human
cagugcuuuuuuaccuuccaac

SEQ ID NO: 671772 - RNA, 22 nt, Human
accugauauguuugaucacccu

SEQ ID NO: 671773 - RNA, 22 nt, Human
cagcagcauugcucuggauucc

SEQ ID NO: 671774 - RNA, 22 nt, Human
cugccccugccaggcagcuguc

SEQ ID NO: 671775 - RNA, 22 nt, Human
cagcagaggugguucacauugu

SEQ ID NO: 671776 - RNA, 22 nt, Human
ugaagauuuuguagcuuucagc

SEQ ID NO: 671777 - RNA, 22 nt, Human
cagcagggcccccgggugcgcc

SEQ ID NO: 671778 - RNA, 22 nt, Human
acaggaguggcucuaccagacc

SEQ ID NO: 671779 - RNA, 22 nt, Human
uuucacagugcucuguaaguau

SEQ ID NO: 671780 - RNA, 22 nt, Human
caaagguuggaaauguuuacca

SEQ ID NO: 671781 - RNA, 20 nt, Human
gcccugugaugucuugaccu

SEQ ID NO: 671782 - RNA, 22 nt, Human
augaagaugguucaacuggccu

SEQ ID NO: 671783 - RNA, 22 nt, Human
ucacaaaugaccaugguuacua

SEQ ID NO: 671784 - RNA, 22 nt, Human
ggucuggauuucugcuucuuuc

SEQ ID NO: 671785 - RNA, 22 nt, Human
cagcagaacaggcagggaagcu

SEQ ID NO: 671786 - RNA, 22 nt, Human
aaguuaguggauaaacagcaaa

SEQ ID NO: 671787 - RNA, 22 nt, Human
uccagccccgaggccggcgacg

SEQ ID NO: 671788 - RNA, 22 nt, Human
ccuggcucucugcagauccugg

SEQ ID NO: 671789 - RNA, 22 nt, Human
ggacagcucugccaggagcuca

SEQ ID NO: 671790 - RNA, 23 nt, Human
gcuguccuccugggcccagcagc

SEQ ID NO: 671791 - RNA, 22 nt, Human
gcagaggcagggcccuccucca

SEQ ID NO: 671792 - RNA, 22 nt, Human
ccucuuccuucucacuguggaa

SEQ ID NO: 671793 - RNA, 22 nt, Human
cccccagaugcgagccauagcc

SEQ ID NO: 671794 - RNA, 22 nt, Human
cacucugggggcugccgcugcc

SEQ ID NO: 671795 - RNA, 22 nt, Human
uggcucuuaaggucccugugcu

SEQ ID NO: 671796 - RNA, 22 nt, Human
cuacauuuggagaguauaggaa

SEQ ID NO: 671797 - RNA, 22 nt, Human
ccuccagucaccuggaugagaa

SEQ ID NO: 671798 - RNA, 22 nt, Human
augguuuaagggagaauauuga

SEQ ID NO: 671799 - RNA, 22 nt, Human
caggaggaggguacaccaucag

SEQ ID NO: 671800 - RNA, 20 nt, Human
gugggcagaugugugcaugg

SEQ ID NO: 671801 - RNA, 22 nt, Human
gaaucagauacugauuucaguc

SEQ ID NO: 671802 - RNA, 22 nt, Human
auacaauccagccauugccaca

SEQ ID NO: 671803 - RNA, 22 nt, Human
guggcagggguauuccagcuga

SEQ ID NO: 671804 - RNA, 22 nt, Human
ugcagggcccucauuccugucc

SEQ ID NO: 671805 - RNA, 22 nt, Human
ucauggggcucuucaaguggag

SEQ ID NO: 671806 - RNA, 22 nt, Human
agaaagagaugaaugcuuuaag

SEQ ID NO: 671807 - RNA, 22 nt, Human
agaaaucacaggaggcagaagg

SEQ ID NO: 671808 - RNA, 22 nt, Human
uggacagggcagagaccgaguc

SEQ ID NO: 671809 - RNA, 22 nt, Human
uuccaaggccagacagggcagu

SEQ ID NO: 671810 - RNA, 22 nt, Human
ccugucuggccaccagggcgau

SEQ ID NO: 671811 - RNA, 22 nt, Human
uccaggagagguagaggguucc

SEQ ID NO: 671812 - RNA, 22 nt, Human
ugccuggcugaggugacagguu

SEQ ID NO: 671813 - RNA, 22 nt, Human
uuucauugucuacauaugacau

SEQ ID NO: 671814 - RNA, 22 nt, Human
gccaggcugaggcucuggaaga

SEQ ID NO: 671815 - RNA, 22 nt, Human
gagcaggcauucuaguggcuga

SEQ ID NO: 671816 - RNA, 22 nt, Human
cugcugugacagcugccguguu

SEQ ID NO: 671817 - RNA, 22 nt, Human
aauuauggucacuguuccuggg

SEQ ID NO: 671818 - RNA, 22 nt, Human
ucacugaaugcagauacgugac

SEQ ID NO: 671819 - RNA, 22 nt, Human
ugccugcuagauauccagguga

SEQ ID NO: 671820 - RNA, 22 nt, Human
uggaagacggaaaucuguagau

SEQ ID NO: 671821 - RNA, 22 nt, Human
gcaggauggugcccuuucugcc

SEQ ID NO: 671822 - RNA, 22 nt, Human
accacccucagcagagcugaaa

SEQ ID NO: 671823 - RNA, 22 nt, Human
acaauagauacugggcacauau

SEQ ID NO: 671824 - RNA, 22 nt, Human
ccaggaagcauaauguaguggg

SEQ ID NO: 671825 - RNA, 22 nt, Human
cauuucacgcacacucauuacu

SEQ ID NO: 671826 - RNA, 19 nt, Human
uggcagggagugauauuag

SEQ ID NO: 671827 - RNA, 21 nt, Human
uucugggccggagaaggggcg

SEQ ID NO: 671828 - RNA, 22 nt, Human
cccagggguucuagaccagcuu

SEQ ID NO: 671829 - RNA, 20 nt, Human
ggguggaguugcggucugug

SEQ ID NO: 671830 - RNA, 22 nt, Human
cgugcucuggacucguggcaca

SEQ ID NO: 671831 - RNA, 22 nt, Human
acuccuggggauccauuccuuu

SEQ ID NO: 671832 - RNA, 22 nt, Human
ggcauagaaugugcugugacaa

SEQ ID NO: 671833 - RNA, 22 nt, Human
uaaagguuuauucaacaaaaua

SEQ ID NO: 671834 - RNA, 22 nt, Human
cacauaauaaauguuccugaug

SEQ ID NO: 671835 - RNA, 22 nt, Human
auccaggcgaaugcagaaggcc

SEQ ID NO: 671836 - RNA, 20 nt, Human
uuucugcagauguuuacaug

SEQ ID NO: 671837 - RNA, 22 nt, Human
ccacugccaugggcuaggcaug

SEQ ID NO: 671838 - RNA, 22 nt, Human
ggccugcugcuaugacuuccug

SEQ ID NO: 671839 - RNA, 22 nt, Human
gauggaaugaauggcagauaca

SEQ ID NO: 671840 - RNA, 22 nt, Human
cuggacucugcagagaaaagua

SEQ ID NO: 671841 - RNA, 22 nt, Human
ugaaagcauaugcuaaagacca

SEQ ID NO: 671842 - RNA, 20 nt, Human
ucuguaaagacuccagaagc

SEQ ID NO: 671843 - RNA, 22 nt, Human
uguacaagcaaauagaccuuca

SEQ ID NO: 671844 - RNA, 22 nt, Human
augugcagcuuuucuagagaag

SEQ ID NO: 671845 - RNA, 22 nt, Human
ggaggaaaggcucccucccucu

SEQ ID NO: 671846 - RNA, 22 nt, Human
aauuucuucagcucuaaaaugg

SEQ ID NO: 671847 - RNA, 22 nt, Human
ucagacagggagucagaaaaua

SEQ ID NO: 671848 - RNA, 22 nt, Human
agucacaugggauuagaaccca

SEQ ID NO: 671849 - RNA, 21 nt, Human
caucuuaauugaaagcagaga

SEQ ID NO: 671850 - RNA, 22 nt, Human
uucagcucuaguaagcagacac

SEQ ID NO: 671851 - RNA, 19 nt, Human
auagaaaggguuaaagaca

SEQ ID NO: 671852 - RNA, 22 nt, Human
uuacaaagugcugcaccauuuu

SEQ ID NO: 671853 - RNA, 22 nt, Human
uacuuuucaagcagcugguuau

SEQ ID NO: 671854 - RNA, 22 nt, Human
acuuccaggguagaggggaaga

SEQ ID NO: 671855 - RNA, 22 nt, Human
acacauauauuugcauauacac

SEQ ID NO: 671856 - RNA, 22 nt, Human
cacauucuugaguuacagucua

SEQ ID NO: 671857 - RNA, 22 nt, Human
acucucccagcuauauguggug

SEQ ID NO: 671858 - RNA, 22 nt, Human
gcauucaucaaaaauguuccuc

SEQ ID NO: 671859 - RNA, 22 nt, Human
aaaagacaucuauuucaggcag

SEQ ID NO: 671860 - RNA, 22 nt, Human
uagucaaauggcagggauauuu

SEQ ID NO: 671861 - RNA, 22 nt, Human
ccuggcaccuguguuuucugga

SEQ ID NO: 671862 - RNA, 22 nt, Human
uggcaagggauuguggagaacu

SEQ ID NO: 671863 - RNA, 22 nt, Human
ucuguauaaggacaaacauuua

SEQ ID NO: 671864 - RNA, 20 nt, Human
aguuagugaguaauugagcu

SEQ ID NO: 671865 - RNA, 22 nt, Human
cacagcugcacagaggaggugc

SEQ ID NO: 671866 - RNA, 22 nt, Human
uugaggucaauucuguuuccug

SEQ ID NO: 671867 - RNA, 22 nt, Human
ggaccugcccuggcucagaugc

SEQ ID NO: 671868 - RNA, 20 nt, Human
gugcagaggcagccuguggg

SEQ ID NO: 671869 - RNA, 22 nt, Human
ccuguucaccauggucacgugc

SEQ ID NO: 671870 - RNA, 19 nt, Human
cagcccagggugcuaccaa

SEQ ID NO: 671871 - RNA, 22 nt, Human
ucagcuggaagauggugcagaa

SEQ ID NO: 671872 - RNA, 22 nt, Human
cucuuuuaauugucauaacaac

SEQ ID NO: 671873 - RNA, 22 nt, Human
accugucaaguccagcgcaaca

SEQ ID NO: 671874 - RNA, 22 nt, Human
cuucauuaaccaaaaugcaaua

SEQ ID NO: 671875 - RNA, 22 nt, Human
gccugggagaaugaccuccaac

SEQ ID NO: 671876 - RNA, 22 nt, Human
cuggagcaggcuugucccagcu

SEQ ID NO: 671877 - RNA, 22 nt, Human
uccagguguauuuacugaagua

SEQ ID NO: 671878 - RNA, 22 nt, Human
cuggaaagugcuuuucugagag

SEQ ID NO: 671879 - RNA, 22 nt, Human
acaguauauuuucuugauuguu

SEQ ID NO: 671880 - RNA, 22 nt, Human
guggcuuucauuucaggaugug

SEQ ID NO: 671881 - RNA, 22 nt, Human
uuucccaacagucucucucaaa

SEQ ID NO: 671882 - RNA, 22 nt, Human
acacuguaaauugagugcguga

SEQ ID NO: 671883 - RNA, 22 nt, Human
ggcagaguggagugcggccucc

SEQ ID NO: 671884 - RNA, 20 nt, Human
gcccaugaggacugcagcug

SEQ ID NO: 671885 - RNA, 22 nt, Human
cuguggcagaggugacaccucu

SEQ ID NO: 671886 - RNA, 22 nt, Human
ugcuuggcuagcuuggcagcuc

SEQ ID NO: 671887 - RNA, 22 nt, Human
agcaacagaagauagagugaau

SEQ ID NO: 671888 - RNA, 22 nt, Human
uucaaaaagguauguucaaguc

SEQ ID NO: 671889 - RNA, 22 nt, Human
ggaagaggaggagccaggcuuu

SEQ ID NO: 671890 - RNA, 22 nt, Human
gccaggaggucagccccucaac

SEQ ID NO: 671891 - RNA, 22 nt, Human
uuagggagcucaguccucagau

SEQ ID NO: 671892 - RNA, 22 nt, Human
agggucagcuggcugucagggg

SEQ ID NO: 671893 - RNA, 22 nt, Human
auggcuguaaauucagagaugg

SEQ ID NO: 671894 - RNA, 22 nt, Human
gaaguacaguuuuaucuagcca

SEQ ID NO: 671895 - RNA, 22 nt, Human
uguaacagagcuuuuuuauagc

SEQ ID NO: 671896 - RNA, 23 nt, Human
cugauuugagcagaauaaaauag

SEQ ID NO: 671897 - RNA, 22 nt, Human
agagcacaguaucugcacauca

SEQ ID NO: 671898 - RNA, 20 nt, Human
ucacaggggaccaggagcag

SEQ ID NO: 671899 - RNA, 22 nt, Human
uagugugucccuggggaguguu

SEQ ID NO: 671900 - RNA, 22 nt, Human
agcagcaaguguaacugaauau

SEQ ID NO: 671901 - RNA, 23 nt, Human
agcauucucuccaacauuuaaca

SEQ ID NO: 671902 - RNA, 22 nt, Human
aucauacagccuuuguuagugu

SEQ ID NO: 671903 - RNA, 22 nt, Human
agaaauguuuacucacccccuu

SEQ ID NO: 671904 - RNA, 22 nt, Human
agucucuuccuucaaggcuggu

SEQ ID NO: 671905 - RNA, 22 nt, Human
agagauaugaguaguugugaca

SEQ ID NO: 671906 - RNA, 22 nt, Human
agucccagcuucccccaugcag

SEQ ID NO: 671907 - RNA, 22 nt, Human
acuccaguuaccuuggcugagg

SEQ ID NO: 671908 - RNA, 23 nt, Human
uuacaaggaagugcacagauggg

SEQ ID NO: 671909 - RNA, 22 nt, Human
aaauuuucagagcacuagagaa

SEQ ID NO: 671910 - RNA, 22 nt, Human
cuguggugggcccugggcuuca

SEQ ID NO: 671911 - RNA, 22 nt, Human
gccuggcucugaguuucucucc

SEQ ID NO: 671912 - RNA, 22 nt, Human
cugcacagcuggccagggagag

SEQ ID NO: 671913 - RNA, 21 nt, Human
cauuucuaagccuggcuauag

SEQ ID NO: 671914 - RNA, 22 nt, Human
aagggcuccauccuuauaaaug

SEQ ID NO: 671915 - RNA, 20 nt, Human
gcccacucuaauccacuguc

SEQ ID NO: 671916 - RNA, 22 nt, Human
ucagcuuuggucacauugaguu

SEQ ID NO: 671917 - RNA, 22 nt, Human
gaggcugaaguguacaugggug

SEQ ID NO: 671918 - RNA, 22 nt, Human
cugucuucccgaggcccuggag

SEQ ID NO: 671919 - RNA, 22 nt, Human
cgcggagcuccgcccggugccc

SEQ ID NO: 671920 - RNA, 21 nt, Human
ccugggagaucagcugccuuc

SEQ ID NO: 671921 - RNA, 21 nt, Human
agccaggguggacacuguaug

SEQ ID NO: 671922 - RNA, 22 nt, Human
gcacagugcaccacuuugaaaa

SEQ ID NO: 671923 - RNA, 22 nt, Human
aaccagaaggaaucugagcuga

SEQ ID NO: 671924 - RNA, 22 nt, Human
agcaggaacugacaccaagcca

SEQ ID NO: 671925 - RNA, 21 nt, Human
agacagagugcagucuacaua

SEQ ID NO: 671926 - RNA, 22 nt, Human
ucauaauguaguucauggcugg

SEQ ID NO: 671927 - RNA, 22 nt, Human
aaugcuaucggcucuaagcaug

SEQ ID NO: 671928 - RNA, 20 nt, Human
ccacaguggagacuggagac

SEQ ID NO: 671929 - RNA, 22 nt, Human
uggcuacaucacagagaauucc

SEQ ID NO: 671930 - RNA, 22 nt, Human
aaagguuugccgaccucugcuu

SEQ ID NO: 671931 - RNA, 22 nt, Human
cucugggcaaguaugauagaaa

SEQ ID NO: 671932 - RNA, 22 nt, Human
ucacaggagggagagacaccca

SEQ ID NO: 671933 - RNA, 22 nt, Human
uggaggcaguuuaagucugaga

SEQ ID NO: 671934 - RNA, 22 nt, Human
ugaaauagacuugcacuauaug

SEQ ID NO: 671935 - RNA, 20 nt, Human
caucuugaaggucuuccaca

SEQ ID NO: 671936 - RNA, 22 nt, Human
uuuuaaugggcgacuauuaugg

SEQ ID NO: 671937 - RNA, 22 nt, Human
ggucucuguugccuccaucaag

SEQ ID NO: 671938 - RNA, 18 nt, Human
cggcagagugcuucuagc

SEQ ID NO: 671939 - RNA, 22 nt, Human
uauucacauuaauaagucuuca

SEQ ID NO: 671940 - RNA, 16 nt, Human
aggcgaagguucauuu

SEQ ID NO: 671941 - RNA, 22 nt, Human
caggcuguggaucaggagccuu

SEQ ID NO: 671942 - RNA, 22 nt, Human
uugaaacugucagcuuuuacgc

SEQ ID NO: 671943 - RNA, 22 nt, Human
gaggcaguuugccaugccagga

SEQ ID NO: 671944 - RNA, 22 nt, Human
cuggcucugacuccgcauauuu

SEQ ID NO: 671945 - RNA, 22 nt, Human
aggcacugacagauucuguguc

SEQ ID NO: 671946 - RNA, 22 nt, Human
cugugugugcuacaggcuucca

SEQ ID NO: 671947 - RNA, 20 nt, Human
uuccuguauacaaagaguuc

SEQ ID NO: 671948 - RNA, 22 nt, Human
ugcagcuucuccaaauauuaca

SEQ ID NO: 671949 - RNA, 22 nt, Human
ggcagggcccugauuccugggg

SEQ ID NO: 671950 - RNA, 22 nt, Human
uuauuuauggcccucaccugau

SEQ ID NO: 671951 - RNA, 22 nt, Human
ggccucuucugcucauacuuuc

SEQ ID NO: 671952 - RNA, 22 nt, Human
auacuuccugcuucccugaucu

SEQ ID NO: 671953 - RNA, 22 nt, Human
gccaggcuguuuuuauuacugu

SEQ ID NO: 671954 - RNA, 22 nt, Human
uuaaugaauaugacaggagagg

SEQ ID NO: 671955 - RNA, 18 nt, Human
ugucauugccagggaagc

SEQ ID NO: 671956 - RNA, 22 nt, Human
ccaucccuucaccacagcagua

SEQ ID NO: 671957 - RNA, 22 nt, Human
guguuaauggcuaugaacugau

SEQ ID NO: 671958 - RNA, 22 nt, Human
uccuggguccauggcagccgaa

SEQ ID NO: 671959 - RNA, 22 nt, Human
acagauuugaucugagaacaaa

SEQ ID NO: 671960 - RNA, 22 nt, Human
ucagagaagcugccaggcgagc

SEQ ID NO: 671961 - RNA, 22 nt, Human
acagcuggagugaggauggagu

SEQ ID NO: 671962 - RNA, 22 nt, Human
gucguggagcucacagugugcc

SEQ ID NO: 671963 - RNA, 22 nt, Human
ugguggagccuaggcuaagucu

SEQ ID NO: 671964 - RNA, 22 nt, Human
caaagugcuggaauuauagggg

SEQ ID NO: 671965 - RNA, 22 nt, Human
cucaguuuuugcugucugguuc

SEQ ID NO: 671966 - RNA, 22 nt, Human
ucccagccuuucuuucuccagc

SEQ ID NO: 671967 - RNA, 22 nt, Human
ugugcuaaguauuuucuuauuu

SEQ ID NO: 671968 - RNA, 22 nt, Human
cuugaagacaauggcagauucc

SEQ ID NO: 671969 - RNA, 22 nt, Human
ugcuacagagccaggaagagug

SEQ ID NO: 671970 - RNA, 22 nt, Human
cuggccugcagaucccaggguc

SEQ ID NO: 671971 - RNA, 22 nt, Human
ccuggccugugaaucugagagc

SEQ ID NO: 671972 - RNA, 18 nt, Human
ucucucagggaaacagaa

SEQ ID NO: 671973 - RNA, 22 nt, Human
ugauuuccuagcugacaugaaa

SEQ ID NO: 671974 - RNA, 22 nt, Human
cuuguauuaggaagaaugcuuu

SEQ ID NO: 671975 - RNA, 22 nt, Human
cagaagcagugagagaugugca

SEQ ID NO: 671976 - RNA, 22 nt, Human
uucaaacuaguuaaaagucaga

SEQ ID NO: 671977 - RNA, 22 nt, Human
cauaagaaauaaugaugaugac

SEQ ID NO: 671978 - RNA, 22 nt, Human
uacuaugugaaaauacuauagu

SEQ ID NO: 671979 - RNA, 22 nt, Human
acaugauuggacuccuuccccu

SEQ ID NO: 671980 - RNA, 22 nt, Human
caaugucaaggagaccaaaacg

SEQ ID NO: 671981 - RNA, 22 nt, Human
aacagcuuacucaauggugauu

SEQ ID NO: 671982 - RNA, 22 nt, Human
uuugaauagcauaggauuacau

SEQ ID NO: 671983 - RNA, 22 nt, Human
gcagacagaugagggugcuggg

SEQ ID NO: 671984 - RNA, 17 nt, Human
uaucucuucaaguuuca

SEQ ID NO: 671985 - RNA, 22 nt, Human
ggccuuggauuuuacccuaaag

SEQ ID NO: 671986 - RNA, 22 nt, Human
ugcuuaaauuucagcagcuuaa

SEQ ID NO: 671987 - RNA, 22 nt, Human
ucuggcuccguguccgcuccca

SEQ ID NO: 671988 - RNA, 22 nt, Human
ccucagcugcuucccuggagcc

SEQ ID NO: 671989 - RNA, 22 nt, Human
ucugcagaaggaaucagcugag

SEQ ID NO: 671990 - RNA, 22 nt, Human
ccagcuuuucuuaucauuauaa

SEQ ID NO: 671991 - RNA, 22 nt, Human
auagugugugguauagguagag

SEQ ID NO: 671992 - RNA, 22 nt, Human
uggggcucuccacagugucuca

SEQ ID NO: 671993 - RNA, 22 nt, Human
uugauuugggaauggucuggca

SEQ ID NO: 671994 - RNA, 22 nt, Human
cugcagggcccgccugagcccu

SEQ ID NO: 671995 - RNA, 22 nt, Human
uaauuacagguccaaaacaauc

SEQ ID NO: 671996 - RNA, 22 nt, Human
uuagcuuuucacuugcauuauc

SEQ ID NO: 671997 - RNA, 22 nt, Human
ugugaauauccauuuguuucag

SEQ ID NO: 671998 - RNA, 22 nt, Human
ggcaguggcuccucucuacucc

SEQ ID NO: 671999 - RNA, 21 nt, Human
cagagcagcguucugcugugg

SEQ ID NO: 672000 - RNA, 22 nt, Human
gcaggcaccggguugcuccccu

SEQ ID NO: 672001 - RNA, 22 nt, Human
gcagcagcucucaaaguggucu

SEQ ID NO: 672002 - RNA, 22 nt, Human
ucaggccuuguccugaccuccu

SEQ ID NO: 672003 - RNA, 22 nt, Human
acaggcaauauauaaauuauga

SEQ ID NO: 672004 - RNA, 22 nt, Human
cuuggagcccagcaggccugga

SEQ ID NO: 672005 - RNA, 22 nt, Human
gaguuuaguuuggcuuaaacug

SEQ ID NO: 672006 - RNA, 22 nt, Human
gcaauuguacuagaaaacaaua

SEQ ID NO: 672007 - RNA, 22 nt, Human
uggaaaggaggcuuguggaaua

SEQ ID NO: 672008 - RNA, 22 nt, Human
cugugcaagcccaagauaaaac

SEQ ID NO: 672009 - RNA, 22 nt, Human
agauccauuuuggugucaacuc

SEQ ID NO: 672010 - RNA, 22 nt, Human
gauuuacaaagcucucuagugu

SEQ ID NO: 672011 - RNA, 22 nt, Human
aaaaccacuuccuugcuauugg

SEQ ID NO: 672012 - RNA, 22 nt, Human
cagggauggccuggcgggccac

SEQ ID NO: 672013 - RNA, 22 nt, Human
uaugaagcugauaaucacugau

SEQ ID NO: 672014 - RNA, 22 nt, Human
gggcaaguccggugcccagagc

SEQ ID NO: 672015 - RNA, 22 nt, Human
uucuaagucugcugucuucauc

SEQ ID NO: 672016 - RNA, 22 nt, Human
ugugagacaggaccuguugacu

SEQ ID NO: 672017 - RNA, 22 nt, Human
gcagcaggaauuuaaauuuaua

SEQ ID NO: 672018 - RNA, 22 nt, Human
cugcugucuuuauuucacugcu

SEQ ID NO: 672019 - RNA, 22 nt, Human
cagucuucuaaccuagcagccu

SEQ ID NO: 672020 - RNA, 22 nt, Human
aaguacauccuagucucuuuca

SEQ ID NO: 672021 - RNA, 22 nt, Human
ucacaugcacauacuuccugug

SEQ ID NO: 672022 - RNA, 22 nt, Human
ugggcagcagcaaagccagacu

SEQ ID NO: 672023 - RNA, 19 nt, Human
ccagagacauuggcaucuu

SEQ ID NO: 672024 - RNA, 22 nt, Human
agguaggcccugagugcuguug

SEQ ID NO: 672025 - RNA, 23 nt, Human
auccaugcuuaaguaaucauuug

SEQ ID NO: 672026 - RNA, 22 nt, Human
cuguucacagaauccuccccug

SEQ ID NO: 672027 - RNA, 22 nt, Human
uucugagcugcaacacuaacau

SEQ ID NO: 672028 - RNA, 22 nt, Human
uccugagagccuuggcuucaga

SEQ ID NO: 672029 - RNA, 22 nt, Human
aaggcugucuuuuccucuuccc

SEQ ID NO: 672030 - RNA, 22 nt, Human
cucugugugguagauuccauua

SEQ ID NO: 672031 - RNA, 22 nt, Human
ggcaggugccaguuggcuuggg

SEQ ID NO: 672032 - RNA, 22 nt, Human
ccuccugggacaggcuggcaca

SEQ ID NO: 672033 - RNA, 22 nt, Human
gaccuggaggauccucuucuug

SEQ ID NO: 672034 - RNA, 22 nt, Human
ggaggccaaggcagguggaucg

SEQ ID NO: 672035 - RNA, 22 nt, Human
gaggccacgugcuuauguuucu

SEQ ID NO: 672036 - RNA, 22 nt, Human
cacugagcaagucaguacagca

SEQ ID NO: 672037 - RNA, 22 nt, Human
uuucacagcauauagguguacu

SEQ ID NO: 672038 - RNA, 22 nt, Human
uguuuuucaaauauugcucugu

SEQ ID NO: 672039 - RNA, 22 nt, Human
aaaaguaauugaugcaaucgua

SEQ ID NO: 672040 - RNA, 22 nt, Human
gugcuuccucugccaacacucu

SEQ ID NO: 672041 - RNA, 22 nt, Human
cauugaaauauggaaacugaug

SEQ ID NO: 672042 - RNA, 21 nt, Human
aagcagcuuaauaaaguaugu

SEQ ID NO: 672043 - RNA, 22 nt, Human
aacagaaugcaggggaugcugc

SEQ ID NO: 672044 - RNA, 22 nt, Human
cucuuuuacaccaaaaggccua

SEQ ID NO: 672045 - RNA, 22 nt, Human
ucugccuuguugcaggcgcuau

SEQ ID NO: 672046 - RNA, 22 nt, Human
aagaauaacacuuagguuuugc

SEQ ID NO: 672047 - RNA, 22 nt, Human
agagcccucuucacugccccuu

SEQ ID NO: 672048 - RNA, 22 nt, Human
uguguuuacuucuaugcaguuu

SEQ ID NO: 672049 - RNA, 21 nt, Human
gggaggaagcugcuucucucu

SEQ ID NO: 672050 - RNA, 22 nt, Human
cauauuuuaguugcugaacagc

SEQ ID NO: 672051 - RNA, 22 nt, Human
uucacuuaacauuuaccaagga

SEQ ID NO: 672052 - RNA, 22 nt, Human
ggaggccuagccagcuccaguu

SEQ ID NO: 672053 - RNA, 22 nt, Human
gcugcaugacagacaggccugg

SEQ ID NO: 672054 - RNA, 22 nt, Human
guaugcugccuacgaacaugca

SEQ ID NO: 672055 - RNA, 22 nt, Human
uggcccagcucagggugggcgg

SEQ ID NO: 672056 - RNA, 22 nt, Human
acaugcauaagccuagccauca

SEQ ID NO: 672057 - RNA, 22 nt, Human
aggagugagcuuuggggucaga

SEQ ID NO: 672058 - RNA, 22 nt, Human
acaaggcuuuggaggguucuua

SEQ ID NO: 672059 - RNA, 22 nt, Human
gaggccagcuaguccaggaagu

SEQ ID NO: 672060 - RNA, 22 nt, Human
uucuauugacauucacuguaac

SEQ ID NO: 672061 - RNA, 22 nt, Human
uaacauugucaguucaacugcu

SEQ ID NO: 672062 - RNA, 22 nt, Human
ucagggaacaucguuaaacuag

SEQ ID NO: 672063 - RNA, 22 nt, Human
gaugagaaauggacaggagugg

SEQ ID NO: 672064 - RNA, 22 nt, Human
cuucuucaguugcauguauugg

SEQ ID NO: 672065 - RNA, 22 nt, Human
gagaaaccuguaaggaaggaag

SEQ ID NO: 672066 - RNA, 22 nt, Human
cuggcuccaccccaggaggaug

SEQ ID NO: 672067 - RNA, 22 nt, Human
ugcagggaauccagucuagggu

SEQ ID NO: 672068 - RNA, 22 nt, Human
uguauuaucaaguaaauacaug

SEQ ID NO: 672069 - RNA, 22 nt, Human
accagccuccuagcugcuccug

SEQ ID NO: 672070 - RNA, 21 nt, Human
aaacugaggcuucaagcagug

SEQ ID NO: 672071 - RNA, 22 nt, Human
cugcuugaccuguuguucucac

SEQ ID NO: 672072 - RNA, 18 nt, Human
gcgggcggugcagugggc

SEQ ID NO: 672073 - RNA, 19 nt, Human
gcuuuuuguugucaaaggu

SEQ ID NO: 672074 - RNA, 22 nt, Human
uccagccuaggggaacagcugc

SEQ ID NO: 672075 - RNA, 18 nt, Human
aguaguggguuuagcuuc

SEQ ID NO: 672076 - RNA, 22 nt, Human
ucucccagaaguccucaguaca

SEQ ID NO: 672077 - RNA, 22 nt, Human
ucuaaaguaugcuaauauguga

SEQ ID NO: 672078 - RNA, 22 nt, Human
ucaaagcaugguuuugaaagac

SEQ ID NO: 672079 - RNA, 22 nt, Human
guauuugauagauuucaaagga

SEQ ID NO: 672080 - RNA, 22 nt, Human
acccaggcugcuucucaguggc

SEQ ID NO: 672081 - RNA, 22 nt, Human
uagagucagagaaucauuacag

SEQ ID NO: 672082 - RNA, 23 nt, Human
gggaucuguaaguugaagacaaa

SEQ ID NO: 672083 - RNA, 22 nt, Human
ucagagguggcaggggugucca

SEQ ID NO: 672084 - RNA, 22 nt, Human
uuugugugcgucuggccugggg

SEQ ID NO: 672085 - RNA, 21 nt, Human
cagaggccuaucacagacucc

SEQ ID NO: 672086 - RNA, 22 nt, Human
acucuuuuauaaagcaucuuga

SEQ ID NO: 672087 - RNA, 22 nt, Human
ccugggaagucagccaaggacg

SEQ ID NO: 672088 - RNA, 22 nt, Human
aguccuucaagaaaucuggaaa

SEQ ID NO: 672089 - RNA, 22 nt, Human
ccuggccagcagccccuuccuc

SEQ ID NO: 672090 - RNA, 23 nt, Human
uaucuuuuucaauguuggaaaua

SEQ ID NO: 672091 - RNA, 22 nt, Human
ucgcaccuguccucugauuaug

SEQ ID NO: 672092 - RNA, 19 nt, Human
uuacaauggugauuagguu

SEQ ID NO: 672093 - RNA, 22 nt, Human
uuccugggcuuuccccucuggu

SEQ ID NO: 672094 - RNA, 22 nt, Human
gccucugggcucugccccuggc

SEQ ID NO: 672095 - RNA, 23 nt, Human
ugccagaggcagucacaguggug

SEQ ID NO: 672096 - RNA, 22 nt, Human
gcuucaagcuguucagaacuau

SEQ ID NO: 672097 - RNA, 22 nt, Human
aacuagaacgucuaguugcugg

SEQ ID NO: 672098 - RNA, 17 nt, Human
cuccucucuggguuacu

SEQ ID NO: 672099 - RNA, 22 nt, Human
agcugccacugagggugcacag

SEQ ID NO: 672100 - RNA, 22 nt, Human
aggagcugcuuaaaugguuggu

SEQ ID NO: 672101 - RNA, 22 nt, Human
accugcaggggugcucucuggg

SEQ ID NO: 672102 - RNA, 22 nt, Human
uagcuguguaagcuugguaaga

SEQ ID NO: 672103 - RNA, 22 nt, Human
guuucauauaccaagcacuuga

SEQ ID NO: 672104 - RNA, 22 nt, Human
ucugaagugaucaucauuucuc

SEQ ID NO: 672105 - RNA, 22 nt, Human
ggugcugguucaggguggcugu

SEQ ID NO: 672106 - RNA, 22 nt, Human
uagcuucuaauacuuaccaauu

SEQ ID NO: 672107 - RNA, 22 nt, Human
aauaacuucaucuucaggauag

SEQ ID NO: 672108 - RNA, 22 nt, Human
cagauguacaugaagggcaaug

SEQ ID NO: 672109 - RNA, 22 nt, Human
agcugcuuugccaaugcguucc

SEQ ID NO: 672110 - RNA, 22 nt, Human
cucagggcaguauggcugagag

SEQ ID NO: 672111 - RNA, 22 nt, Human
auuagcaauugcccugugcaau

SEQ ID NO: 672112 - RNA, 22 nt, Human
agggaggcauuagcuacugcga

SEQ ID NO: 672113 - RNA, 22 nt, Human
acagaauugaaaguauaaucug

SEQ ID NO: 672114 - RNA, 22 nt, Human
augcuucaugauuuggccaugu

SEQ ID NO: 672115 - RNA, 22 nt, Human
aacuucuugguccugagcuguu

SEQ ID NO: 672116 - RNA, 22 nt, Human
gucuccugagccuugacugcaa

SEQ ID NO: 672117 - RNA, 22 nt, Human
ucuuucuacaucauuugcuucu

SEQ ID NO: 672118 - RNA, 22 nt, Human
gagcagugaagacagaaguaca

SEQ ID NO: 672119 - RNA, 22 nt, Human
caaaugcauaguuuauaagaag

SEQ ID NO: 672120 - RNA, 22 nt, Human
agcccaagcauaggagggaggc

SEQ ID NO: 672121 - RNA, 22 nt, Human
cucugucaggcugcagaugcuc

SEQ ID NO: 672122 - RNA, 19 nt, Human
gcuggcagauguggccgug

SEQ ID NO: 672123 - RNA, 22 nt, Human
ugugggcucccccucacucugu

SEQ ID NO: 672124 - RNA, 22 nt, Human
aauuuagaauucgcuagcuaau

SEQ ID NO: 672125 - RNA, 19 nt, Human
ccagagguuugcugggccu

SEQ ID NO: 672126 - RNA, 22 nt, Human
caauagcagcuucugaaugcaa

SEQ ID NO: 672127 - RNA, 22 nt, Human
uaugcauaugaccccaagcuug

SEQ ID NO: 672128 - RNA, 22 nt, Human
guccugucccccaaggcugugg

SEQ ID NO: 672129 - RNA, 22 nt, Human
ggagcugggaauuggaucaucu

SEQ ID NO: 672130 - RNA, 23 nt, Human
ucaugcccaggcuccagauguca

SEQ ID NO: 672131 - RNA, 17 nt, Human
augaggucauuaagaua

SEQ ID NO: 672132 - RNA, 20 nt, Human
ucagauuuugggucacugau

SEQ ID NO: 672133 - RNA, 22 nt, Human
uccuucuuucaccucauaguca

SEQ ID NO: 672134 - RNA, 22 nt, Human
ugggguucuuuguuuccugccu

SEQ ID NO: 672135 - RNA, 22 nt, Human
cagggcucccucuggcucccag

SEQ ID NO: 672136 - RNA, 18 nt, Human
cgggcgggcgccuggccc

SEQ ID NO: 672137 - RNA, 22 nt, Human
gugcaugucggggugcauguca

SEQ ID NO: 672138 - RNA, 21 nt, Human
aagagcugucaggaaggcugc

SEQ ID NO: 672139 - RNA, 21 nt, Human
agcagcugcaguuucuaucug

SEQ ID NO: 672140 - RNA, 22 nt, Human
ccagggagccuggugugucagc

SEQ ID NO: 672141 - RNA, 22 nt, Human
gagcagcacuugaggcauguca

SEQ ID NO: 672142 - RNA, 23 nt, Human
cuggacucaggggaugugaagga

SEQ ID NO: 672143 - RNA, 22 nt, Human
auagacauuauaacacagagcu

SEQ ID NO: 672144 - RNA, 22 nt, Human
gucaggagagaucaggacagca

SEQ ID NO: 672145 - RNA, 22 nt, Human
aagaggugagaagcuacacuua

SEQ ID NO: 672146 - RNA, 22 nt, Human
agauauuguuuguuucaccaau

SEQ ID NO: 672147 - RNA, 22 nt, Human
ugagcagcccuuccuccggcca

SEQ ID NO: 672148 - RNA, 22 nt, Human
agagacagaggcaauauagcuu

SEQ ID NO: 672149 - RNA, 22 nt, Human
uccuuggcaugccgucuucucc

SEQ ID NO: 672150 - RNA, 18 nt, Human
uccucagccucaccuagc

SEQ ID NO: 672151 - RNA, 22 nt, Human
aaagaucaugcuguuuugugau

SEQ ID NO: 672152 - RNA, 22 nt, Human
ccacagggaacaugacagccuu

SEQ ID NO: 672153 - RNA, 22 nt, Human
agaagcacgguuuugucuagca

SEQ ID NO: 672154 - RNA, 22 nt, Human
uaaagcuacacauuauuaaucc

SEQ ID NO: 672155 - RNA, 22 nt, Human
cauggcaggcuucuucagccuu

SEQ ID NO: 672156 - RNA, 22 nt, Human
gaggagguggagucaugcagag

SEQ ID NO: 672157 - RNA, 22 nt, Human
agcugucagugcugugccugua

SEQ ID NO: 672158 - RNA, 22 nt, Human
gauacauuccgggagggcuacc

SEQ ID NO: 672159 - RNA, 22 nt, Human
uaucuguugucuuuuacaugua

SEQ ID NO: 672160 - RNA, 22 nt, Human
cuaggcugagcugggcugagcu

SEQ ID NO: 672161 - RNA, 22 nt, Human
cucaggagagucuuauaucucc

SEQ ID NO: 672162 - RNA, 22 nt, Human
cucacagcagcucugcgagaua

SEQ ID NO: 672163 - RNA, 22 nt, Human
uuguauuuggguaguauagaga

SEQ ID NO: 672164 - RNA, 22 nt, Human
cuuaucuguaaaauggauacaa

SEQ ID NO: 672165 - RNA, 22 nt, Human
gggaugacaaagugucuguccc

SEQ ID NO: 672166 - RNA, 22 nt, Human
cucaaguccauagaaucaggaa

SEQ ID NO: 672167 - RNA, 22 nt, Human
uaaugaggcaagagucauggcu

SEQ ID NO: 672168 - RNA, 22 nt, Human
gaggauggaggcaguuagggcc

SEQ ID NO: 672169 - RNA, 22 nt, Human
gcagcuuucuacuuccuacagc

SEQ ID NO: 672170 - RNA, 22 nt, Human
cucaggcacuuuugucacagac

SEQ ID NO: 672171 - RNA, 22 nt, Human
cugcccaguuugggagccuuuc

SEQ ID NO: 672172 - RNA, 22 nt, Human
guaaaugugaaugucauuuagc

SEQ ID NO: 672173 - RNA, 22 nt, Human
aggacuggcggucgguggggau

SEQ ID NO: 672174 - RNA, 20 nt, Human
agcagauagcgggagaguuu

SEQ ID NO: 672175 - RNA, 22 nt, Human
cagggguguuuuuggccaggag

SEQ ID NO: 672176 - RNA, 22 nt, Human
guggucagaaaucucaguggca

SEQ ID NO: 672177 - RNA, 20 nt, Human
ugcucaggauggagaggugu

SEQ ID NO: 672178 - RNA, 22 nt, Human
uggcucacaaucucccaugaag

SEQ ID NO: 672179 - RNA, 22 nt, Human
agauauaauaauuuacaagugu

SEQ ID NO: 672180 - RNA, 17 nt, Human
cauaaaacaguucuauu

SEQ ID NO: 672181 - RNA, 22 nt, Human
guguuauuugagugggagcgug

SEQ ID NO: 672182 - RNA, 22 nt, Human
uguuugugguuauaauaaguau

SEQ ID NO: 672183 - RNA, 22 nt, Human
agaaauuccuaagguacacaag

SEQ ID NO: 672184 - RNA, 22 nt, Human
aggcauguauaugugcacaugu

SEQ ID NO: 672185 - RNA, 22 nt, Human
augcaguacagauaauucuaca

SEQ ID NO: 672186 - RNA, 22 nt, Human
uccacgugagcuucgugugcag

SEQ ID NO: 672187 - RNA, 22 nt, Human
uuuuaccugaaccacacaguau

SEQ ID NO: 672188 - RNA, 22 nt, Human
cuucacuuuaagccaaucauga

SEQ ID NO: 672189 - RNA, 22 nt, Human
cccagggaaggcagauggagga

SEQ ID NO: 672190 - RNA, 22 nt, Human
aggagcugguagucucauuggg

SEQ ID NO: 672191 - RNA, 22 nt, Human
cuaugaaaggauuuggaguugu

SEQ ID NO: 672192 - RNA, 22 nt, Human
aagucaucuugagucuaagauu

SEQ ID NO: 672193 - RNA, 20 nt, Human
acagaugaggaaaaugaagu

SEQ ID NO: 672194 - RNA, 22 nt, Human
auaaaggcagauuuuggaccuc

SEQ ID NO: 672195 - RNA, 22 nt, Human
augcaggggccgccuggccagg

SEQ ID NO: 672196 - RNA, 22 nt, Human
uacaguuuguuacauuguuagu

SEQ ID NO: 672197 - RNA, 22 nt, Human
gacaaggaaauuacuagcugga

SEQ ID NO: 672198 - RNA, 22 nt, Human
ucucaggcuguguguggaggac

SEQ ID NO: 672199 - RNA, 22 nt, Human
ccuggcucaaggcgaggacucc

SEQ ID NO: 672200 - RNA, 17 nt, Human
ucagcucagagcaccug

SEQ ID NO: 672201 - RNA, 22 nt, Human
ugcagccuugaccuccagugcu

SEQ ID NO: 672202 - RNA, 22 nt, Human
uugaacaguccuaagagacccu

SEQ ID NO: 672203 - RNA, 22 nt, Human
ugcuuaaaggauaguuuaaacu

SEQ ID NO: 672204 - RNA, 22 nt, Human
uccaggcccauagacacuucuc

SEQ ID NO: 672205 - RNA, 22 nt, Human
caccugccugguccuuagggcu

SEQ ID NO: 672206 - RNA, 22 nt, Human
uuacuuucaaaaacuacguggg

SEQ ID NO: 672207 - RNA, 22 nt, Human
agucaggaagcuggagcugggg

SEQ ID NO: 672208 - RNA, 22 nt, Human
auacacuucauguuuucaucug

SEQ ID NO: 672209 - RNA, 22 nt, Human
aggcgcaggguuuggacccagg

SEQ ID NO: 672210 - RNA, 22 nt, Human
ugccagaacagcucaucuggcc

SEQ ID NO: 672211 - RNA, 22 nt, Human
cagguccacggcgcccaggggu

SEQ ID NO: 672212 - RNA, 22 nt, Human
ccccagcccacaagcauauuaa

SEQ ID NO: 672213 - RNA, 23 nt, Human
aguacaauaaguauaauucuuuc

SEQ ID NO: 672214 - RNA, 22 nt, Human
aagagagggacuuauuaaaguc

SEQ ID NO: 672215 - RNA, 22 nt, Human
gaguuaaaggcaguugaggaaa

SEQ ID NO: 672216 - RNA, 22 nt, Human
uaaggcagugagaagaaacagg

SEQ ID NO: 672217 - RNA, 22 nt, Human
ugcacagugaccacugagcaag

SEQ ID NO: 672218 - RNA, 22 nt, Human
ugcaggcagcugaaaggugccu

SEQ ID NO: 672219 - RNA, 22 nt, Human
ucuuuaucaagucuguucuuug

SEQ ID NO: 672220 - RNA, 22 nt, Human
uguacaaugccgagacuaacuc

SEQ ID NO: 672221 - RNA, 22 nt, Human
aacuguuuggaacucuuccaca

SEQ ID NO: 672222 - RNA, 22 nt, Human
gcuccuggcucucugagggcug

SEQ ID NO: 672223 - RNA, 22 nt, Human
uucuggagucauuggggcugau

SEQ ID NO: 672224 - RNA, 22 nt, Human
uucaaguuaacucuccuuguac

SEQ ID NO: 672225 - RNA, 22 nt, Human
gagcaaggcggcaucucucuga

SEQ ID NO: 672226 - RNA, 18 nt, Human
cagauccaggcagcuauu

SEQ ID NO: 672227 - RNA, 22 nt, Human
ggcaggaagcucauguggacug

SEQ ID NO: 672228 - RNA, 22 nt, Human
uucacaauuaacuuuauacuua

SEQ ID NO: 672229 - RNA, 17 nt, Human
uggggaagcucagauuu

SEQ ID NO: 672230 - RNA, 22 nt, Human
cugccagaagguuccugcugca

SEQ ID NO: 672231 - RNA, 22 nt, Human
uccucacagaguggcaggcaau

SEQ ID NO: 672232 - RNA, 22 nt, Human
cuguggcucaauugccuacuga

SEQ ID NO: 672233 - RNA, 22 nt, Human
auaaaugaacauucacagagcu

SEQ ID NO: 672234 - RNA, 22 nt, Human
ucugucuuggccagccaucugg

SEQ ID NO: 672235 - RNA, 22 nt, Human
cccugggauggauuggcaggaa

SEQ ID NO: 672236 - RNA, 22 nt, Human
accacacuggcuagugaagaag

SEQ ID NO: 672237 - RNA, 22 nt, Human
uuucaagcugugguaacugaga

SEQ ID NO: 672238 - RNA, 22 nt, Human
gacaaaacacauuaguuuaaaa

SEQ ID NO: 672239 - RNA, 22 nt, Human
uuacauauugucuauuguucaa

SEQ ID NO: 672240 - RNA, 22 nt, Human
gagacacaauuuccccauccua

SEQ ID NO: 672241 - RNA, 22 nt, Human
cugcaauaugaugucugagaaa

SEQ ID NO: 672242 - RNA, 22 nt, Human
cuaggguggauuugugcagagu

SEQ ID NO: 672243 - RNA, 22 nt, Human
aaaaucuaaguagcgaguaagg

SEQ ID NO: 672244 - RNA, 22 nt, Human
gagaaaaugucagacuuggucg

SEQ ID NO: 672245 - RNA, 22 nt, Human
aagaguuuuagacaaacugauu

SEQ ID NO: 672246 - RNA, 22 nt, Human
ucuuuuauuaggcugaaauggg

SEQ ID NO: 672247 - RNA, 22 nt, Human
ugccugggaucugugcccuuug

SEQ ID NO: 672248 - RNA, 22 nt, Human
caggcaugaucauaggaguuua

SEQ ID NO: 672249 - RNA, 22 nt, Human
cucugugggaggaggaguaggc

SEQ ID NO: 672250 - RNA, 22 nt, Human
uucacaauaauguccauccucu

SEQ ID NO: 672251 - RNA, 22 nt, Human
gcuuuauguaaguccaaaggca

SEQ ID NO: 672252 - RNA, 22 nt, Human
auuuccuauggauacaggcaga

SEQ ID NO: 672253 - RNA, 22 nt, Human
cuuacagugacccugcagauuu

SEQ ID NO: 672254 - RNA, 22 nt, Human
aggugcagaaaaaaguccuuua

SEQ ID NO: 672255 - RNA, 22 nt, Human
uuucacagcaacacugucugca

SEQ ID NO: 672256 - RNA, 22 nt, Human
ucacaacuugaagcugauuuaa

SEQ ID NO: 672257 - RNA, 22 nt, Human
uggcagcugauuagauggugcc

SEQ ID NO: 672258 - RNA, 22 nt, Human
uguuugaaaaguggagauuuau

SEQ ID NO: 672259 - RNA, 22 nt, Human
aagcacccaauuuacagcaguu

SEQ ID NO: 672260 - RNA, 22 nt, Human
cugccugcuaccugaaaugcca

SEQ ID NO: 672261 - RNA, 22 nt, Human
acacauaucuaagauagaugac

SEQ ID NO: 672262 - RNA, 22 nt, Human
aauucucuccaggguaacauca

SEQ ID NO: 672263 - RNA, 22 nt, Human
gcaggcuggucugaccaucccu

SEQ ID NO: 672264 - RNA, 22 nt, Human
gguucacacuuucaugauuuca

SEQ ID NO: 672265 - RNA, 22 nt, Human
ugcccacauucugaagcucccu

SEQ ID NO: 672266 - RNA, 19 nt, Human
ugggagaggcaacagagua

SEQ ID NO: 672267 - RNA, 22 nt, Human
acgacagcacaacagcauccuc

SEQ ID NO: 672268 - RNA, 22 nt, Human
ugacagaguucggauugaguuu

SEQ ID NO: 672269 - RNA, 21 nt, Human
agagaauugccuuagauguuc

SEQ ID NO: 672270 - RNA, 22 nt, Human
ucagggcaucucuuaaguggug

SEQ ID NO: 672271 - RNA, 22 nt, Human
augucuuuauaaauguauaaug

SEQ ID NO: 672272 - RNA, 22 nt, Human
cugaggcagagaaugaguuugu

SEQ ID NO: 672273 - RNA, 22 nt, Human
agaaaaagucaaggaauuggac

SEQ ID NO: 672274 - RNA, 22 nt, Human
ccagugugaaccucaccacccu

SEQ ID NO: 672275 - RNA, 22 nt, Human
uagaugauagggccagaauuug

SEQ ID NO: 672276 - RNA, 22 nt, Human
augcuguguuugagaaccuagg

SEQ ID NO: 672277 - RNA, 22 nt, Human
uaacauguuaagaaauuagaua

SEQ ID NO: 672278 - RNA, 22 nt, Human
auacaucaccuauauauucaca

SEQ ID NO: 672279 - RNA, 22 nt, Human
guacaacaggauugauguacca

SEQ ID NO: 672280 - RNA, 22 nt, Human
ugucaugcccaggagcaaggua

SEQ ID NO: 672281 - RNA, 22 nt, Human
ugaggccucauaaugagauuuc

SEQ ID NO: 672282 - RNA, 22 nt, Human
acucucugguguagaaagaccu

SEQ ID NO: 672283 - RNA, 22 nt, Human
cauuuacacacagaggugugcu

SEQ ID NO: 672284 - RNA, 22 nt, Human
gugcaaaagcaguuggauuuuu

SEQ ID NO: 672285 - RNA, 22 nt, Human
uagcugccaaaagggugggcua

SEQ ID NO: 672286 - RNA, 22 nt, Human
aggaccugagaguuggaaaucc

SEQ ID NO: 672287 - RNA, 21 nt, Human
gcagcaugagaaagccccaaa

SEQ ID NO: 672288 - RNA, 22 nt, Human
guucacaguucagccuguaaca

SEQ ID NO: 672289 - RNA, 20 nt, Human
aagguccaaacucuguguuc

SEQ ID NO: 672290 - RNA, 22 nt, Human
uucccacagucacugggagaag

SEQ ID NO: 672291 - RNA, 22 nt, Human
cugccugaguggaggucgaggg

SEQ ID NO: 672292 - RNA, 22 nt, Human
aauggcuuuggucuggguccca

SEQ ID NO: 672293 - RNA, 22 nt, Human
uaaccucugagcuccagcuucu

SEQ ID NO: 672294 - RNA, 22 nt, Human
cugugagggucacagccaugcc

SEQ ID NO: 672295 - RNA, 22 nt, Human
acucagagccucgagggacugc

SEQ ID NO: 672296 - RNA, 22 nt, Human
ucaaaggaguuuaaguuacugg

SEQ ID NO: 672297 - RNA, 22 nt, Human
gauuucaaggauguuagaggug

SEQ ID NO: 672298 - RNA, 22 nt, Human
aaguuguauauaccgcuuuaag

SEQ ID NO: 672299 - RNA, 22 nt, Human
uaaauugagauuauuaggguaa

SEQ ID NO: 672300 - RNA, 22 nt, Human
agggcucagggcacgucaucca

SEQ ID NO: 672301 - RNA, 22 nt, Human
acagaguuaaaguggaguuuaa

SEQ ID NO: 672302 - RNA, 22 nt, Human
auaaucuggcuuguuugcuuaa

SEQ ID NO: 672303 - RNA, 22 nt, Human
aucacuguggcccaaaaccuca

SEQ ID NO: 672304 - RNA, 22 nt, Human
auguagcagaagauguuuuccu

SEQ ID NO: 672305 - RNA, 22 nt, Human
aaagugcauuguuuguguuccu

SEQ ID NO: 672306 - RNA, 22 nt, Human
cucagggaggcccugggacccu

SEQ ID NO: 672307 - RNA, 22 nt, Human
uuuguuaaggaguauugcuucu

SEQ ID NO: 672308 - RNA, 22 nt, Human
ugcuccuuucauccaauucuca

SEQ ID NO: 672309 - RNA, 22 nt, Human
ucugggaaguuggcagccagcu

SEQ ID NO: 672310 - RNA, 22 nt, Human
cuccaacgaggcugggguacaa

SEQ ID NO: 672311 - RNA, 22 nt, Human
uccaggagggggagccgugccg

SEQ ID NO: 672312 - RNA, 22 nt, Human
uccacuuuagcaaugauugaau

SEQ ID NO: 672313 - RNA, 23 nt, Human
cuguuauuccaggcugaugggug

SEQ ID NO: 672314 - RNA, 22 nt, Human
agccugguguggggcugcagag

SEQ ID NO: 672315 - RNA, 22 nt, Human
uuuuuuaucuaugguaguacca

SEQ ID NO: 672316 - RNA, 22 nt, Human
auuugcuugugcuaugaaaguu

SEQ ID NO: 672317 - RNA, 19 nt, Human
agcuccuguucagcagcuc

SEQ ID NO: 672318 - RNA, 22 nt, Human
cuggucaccuccuucccagcua

SEQ ID NO: 672319 - RNA, 22 nt, Human
acauagaaggaagaguaguagg

SEQ ID NO: 672320 - RNA, 22 nt, Human
guguguccaggcgggagucaag

SEQ ID NO: 672321 - RNA, 22 nt, Human
guggacuggcagugaccuuggu

SEQ ID NO: 672322 - RNA, 22 nt, Human
cacaaaguauaacuugauggaa

SEQ ID NO: 672323 - RNA, 22 nt, Human
uuuuaugaagauaauuuucuga

SEQ ID NO: 672324 - RNA, 22 nt, Human
uucaagaucgaguuuaaaguga

SEQ ID NO: 672325 - RNA, 22 nt, Human
gccuccaccccuggggagugga

SEQ ID NO: 672326 - RNA, 22 nt, Human
ccugcugugaagccaggccugu

SEQ ID NO: 672327 - RNA, 22 nt, Human
uugccucaagauuuuuuauuga

SEQ ID NO: 672328 - RNA, 22 nt, Human
aguaucugcaugauuuugagaa

SEQ ID NO: 672329 - RNA, 22 nt, Human
caggcacuucggcagcguggua

SEQ ID NO: 672330 - RNA, 22 nt, Human
cacuuaaaucuguugagaaaaa

SEQ ID NO: 672331 - RNA, 22 nt, Human
gcauggccuucagggacagcug

SEQ ID NO: 672332 - RNA, 22 nt, Human
cagugcauagauccugaggccu

SEQ ID NO: 672333 - RNA, 18 nt, Human
gggcccuggcguccgccc

SEQ ID NO: 672334 - RNA, 22 nt, Human
gaagaauugaggauguuuaccu

SEQ ID NO: 672335 - RNA, 22 nt, Human
ucugauaacaaccaugucuggc

SEQ ID NO: 672336 - RNA, 22 nt, Human
aaguucugccaggcuguggcag

SEQ ID NO: 672337 - RNA, 22 nt, Human
guauaaacauggagugcauucu

SEQ ID NO: 672338 - RNA, 21 nt, Human
ugcagaaaugguuuuucuaag

SEQ ID NO: 672339 - RNA, 22 nt, Human
gucaggauuauaauccccaugg

SEQ ID NO: 672340 - RNA, 19 nt, Human
aaugucucuaucuguucuc

SEQ ID NO: 672341 - RNA, 22 nt, Human
aucugggcguauaggugcaagu

SEQ ID NO: 672342 - RNA, 22 nt, Human
ccuagccccagauaucucacac

SEQ ID NO: 672343 - RNA, 22 nt, Human
agcgugaauuaguugguacaca

SEQ ID NO: 672344 - RNA, 22 nt, Human
caggcacaggggaaugucuuuu

SEQ ID NO: 672345 - RNA, 22 nt, Human
cggagcugcgccgggacacggg

SEQ ID NO: 672346 - RNA, 22 nt, Human
ccaggagcaaagaucacuggga

SEQ ID NO: 672347 - RNA, 21 nt, Human
gcccagugauuucuucacagu

SEQ ID NO: 672348 - RNA, 20 nt, Human
acauggaucaaaugucaguu

SEQ ID NO: 672349 - RNA, 22 nt, Human
uugcagcuuagugauguuaucu

SEQ ID NO: 672350 - RNA, 22 nt, Human
ggccagccuggggcucccagac

SEQ ID NO: 672351 - RNA, 22 nt, Human
agauguaaacucucaugucauu

SEQ ID NO: 672352 - RNA, 22 nt, Human
auacauaguaccacauuugaca

SEQ ID NO: 672353 - RNA, 22 nt, Human
caacagucagaaugaagcugag

SEQ ID NO: 672354 - RNA, 22 nt, Human
aauagguagccagauauauaaa

SEQ ID NO: 672355 - RNA, 22 nt, Human
gccucuggcuucugcaucagug

SEQ ID NO: 672356 - RNA, 17 nt, Human
uuucccuccuuccacuc

SEQ ID NO: 672357 - RNA, 22 nt, Human
aagaucagcucccgagucugag

SEQ ID NO: 672358 - RNA, 22 nt, Human
aaaauuuccaccaucuuugugu

SEQ ID NO: 672359 - RNA, 22 nt, Human
aggggcucugagugggccagga

SEQ ID NO: 672360 - RNA, 22 nt, Human
aggcugagcuggcccuugaaau

SEQ ID NO: 672361 - RNA, 21 nt, Human
ugcaagaaucaggaagcugcc

SEQ ID NO: 672362 - RNA, 22 nt, Human
cuaaaggcuaggucugaacuca

SEQ ID NO: 672363 - RNA, 22 nt, Human
ucuuuuagaaaaguugaaugua

SEQ ID NO: 672364 - RNA, 22 nt, Human
ccuguacaagagccaucuggau

SEQ ID NO: 672365 - RNA, 22 nt, Human
guuuauucuucagcaacaucug

SEQ ID NO: 672366 - RNA, 22 nt, Human
acuucagagacuuuauggucca

SEQ ID NO: 672367 - RNA, 22 nt, Human
aggaagcccuugucauuucugu

SEQ ID NO: 672368 - RNA, 22 nt, Human
ugcucgcgcuguuccagcagcu

SEQ ID NO: 672369 - RNA, 22 nt, Human
cagcagcuagaggaagggcaga

SEQ ID NO: 672370 - RNA, 22 nt, Human
aauuaacaaauguagcugugau

SEQ ID NO: 672371 - RNA, 22 nt, Human
aacacauggguguuuauuguac

SEQ ID NO: 672372 - RNA, 22 nt, Human
ugcguggcuggucccugugacc

SEQ ID NO: 672373 - RNA, 22 nt, Human
aguuggcgggacauguggaaag

SEQ ID NO: 672374 - RNA, 22 nt, Human
ccugccugauuccaggauggcu

SEQ ID NO: 672375 - RNA, 22 nt, Human
gccuggaucccagggagucagg

SEQ ID NO: 672376 - RNA, 17 nt, Human
gacuuuggaguuucaua

SEQ ID NO: 672377 - RNA, 22 nt, Human
ucaggagccugaaagaggucua

SEQ ID NO: 672378 - RNA, 22 nt, Human
auccaaaucaugucagaagaac

SEQ ID NO: 672379 - RNA, 22 nt, Human
agaucuuuugguuauuauaaga

SEQ ID NO: 672380 - RNA, 22 nt, Human
gggauaggagauugggaguguu

SEQ ID NO: 672381 - RNA, 22 nt, Human
cccuucaggguuaaguagaggg

SEQ ID NO: 672382 - RNA, 22 nt, Human
aaguaacaaugcuguugaauug

SEQ ID NO: 672383 - RNA, 22 nt, Human
agaaugcuuccuuugaaacuga

SEQ ID NO: 672384 - RNA, 22 nt, Human
ccaguguguuaguggauuuccc

SEQ ID NO: 672385 - RNA, 22 nt, Human
ucuggaaagaucauuaaaucca

SEQ ID NO: 672386 - RNA, 20 nt, Human
auguggcuuuuugaccugcu

SEQ ID NO: 672387 - RNA, 22 nt, Human
agaggucuuuuggucugcagaa

SEQ ID NO: 672388 - RNA, 22 nt, Human
augauacaucuucaugucagug

SEQ ID NO: 672389 - RNA, 22 nt, Human
uucacagugagcuaugucuugu

SEQ ID NO: 672390 - RNA, 22 nt, Human
uguaagaauaaugauuucuaag

SEQ ID NO: 672391 - RNA, 19 nt, Human
agugaacuccauaucaggu

SEQ ID NO: 672392 - RNA, 22 nt, Human
uuauuuccucucuaauagggua

SEQ ID NO: 672393 - RNA, 22 nt, Human
agagccagcauuugacacuggc

SEQ ID NO: 672394 - RNA, 19 nt, Human
gcuccuggaugaccugugg

SEQ ID NO: 672395 - RNA, 21 nt, Human
uaucuacaguguccauucagu

SEQ ID NO: 672396 - RNA, 22 nt, Human
cagggugccaaagaacaaauau

SEQ ID NO: 672397 - RNA, 22 nt, Human
agugugcuguuuccagaagggc

SEQ ID NO: 672398 - RNA, 22 nt, Human
cuuccuguuguauuugugagcc

SEQ ID NO: 672399 - RNA, 22 nt, Human
ugacaaaacugcaauuacuuuu

SEQ ID NO: 672400 - RNA, 22 nt, Human
agaucacugguuacuuaaugaa

SEQ ID NO: 672401 - RNA, 19 nt, Human
gguagaagggaaguguuuu

SEQ ID NO: 672402 - RNA, 22 nt, Human
uccccagccgugaaggagagga

SEQ ID NO: 672403 - RNA, 22 nt, Human
agcugcuaugacaacaccagcc

SEQ ID NO: 672404 - RNA, 22 nt, Human
gcaguauauacucuuugagggg

SEQ ID NO: 672405 - RNA, 22 nt, Human
aaauugcauucaggaugcagga

SEQ ID NO: 672406 - RNA, 22 nt, Human
aucugccuggcuccaggugagc

SEQ ID NO: 672407 - RNA, 22 nt, Human
ugaagcagaggggucuugagcu

SEQ ID NO: 672408 - RNA, 22 nt, Human
uuacuuuugcaccaaacuaaua

SEQ ID NO: 672409 - RNA, 22 nt, Human
aggcuucuuuuagaggggaugg

SEQ ID NO: 672410 - RNA, 22 nt, Human
acacacucaauugcauaagcac

SEQ ID NO: 672411 - RNA, 22 nt, Human
ugggcaagcucuggguggacac

SEQ ID NO: 672412 - RNA, 22 nt, Human
cuccuacaguguuugaguccag

SEQ ID NO: 672413 - RNA, 22 nt, Human
aaaugcaucagcucauaagaga

SEQ ID NO: 672414 - RNA, 22 nt, Human
acuuaaagguuagcuauucuac

SEQ ID NO: 672415 - RNA, 22 nt, Human
aggagaccuucaccacuuccac

SEQ ID NO: 672416 - RNA, 20 nt, Human
ggcacugcaccaguuaguag

SEQ ID NO: 672417 - RNA, 22 nt, Human
guguuguggagcuugucagggg

SEQ ID NO: 672418 - RNA, 22 nt, Human
aauguguguauuucuaggcgag

SEQ ID NO: 672419 - RNA, 22 nt, Human
gugggccaggcgucuaggcccu

SEQ ID NO: 672420 - RNA, 22 nt, Human
ccagagccucuuaugaagaucg

SEQ ID NO: 672421 - RNA, 21 nt, Human
agggagcuauuuauaguaagc

SEQ ID NO: 672422 - RNA, 22 nt, Human
augcuguggggagugaggguag

SEQ ID NO: 672423 - RNA, 22 nt, Human
agguuccagguucgaaucccau

SEQ ID NO: 672424 - RNA, 22 nt, Human
aagaggaggaugcuuuacagcu

SEQ ID NO: 672425 - RNA, 22 nt, Human
ugggcacaggggaauggaugaa

SEQ ID NO: 672426 - RNA, 22 nt, Human
ucagggcacguuucugcaaugc

SEQ ID NO: 672427 - RNA, 22 nt, Human
gacagugucccucuggggugga

SEQ ID NO: 672428 - RNA, 20 nt, Human
gcccaagcgccggccgcaga

SEQ ID NO: 672429 - RNA, 22 nt, Human
acugcacugauuuaucauccca

SEQ ID NO: 672430 - RNA, 22 nt, Human
gggaauguaaucauggaaugcu

SEQ ID NO: 672431 - RNA, 22 nt, Human
uuucagugcacguaguuuauuu

SEQ ID NO: 672432 - RNA, 22 nt, Human
ucugggugccacugucuguaca

SEQ ID NO: 672433 - RNA, 22 nt, Human
gcaaacuggcaaaccugucugu

SEQ ID NO: 672434 - RNA, 22 nt, Human
auacagugaauacuuacagugu

SEQ ID NO: 672435 - RNA, 22 nt, Human
ugguccugagcaccagccugac

SEQ ID NO: 672436 - RNA, 22 nt, Human
uuagaaaaaggcuguggucuua

SEQ ID NO: 672437 - RNA, 22 nt, Human
gcuugacuaggcucuggcgaca

SEQ ID NO: 672438 - RNA, 22 nt, Human
ccuguacaagcucuuggugaca

SEQ ID NO: 672439 - RNA, 22 nt, Human
aagggcucugugugccucccca

SEQ ID NO: 672440 - RNA, 22 nt, Human
gcaggagguugagccaggacug

SEQ ID NO: 672441 - RNA, 22 nt, Human
gacagugguguuuuccauugca

SEQ ID NO: 672442 - RNA, 22 nt, Human
ggaauucuguagcucuuccucu

SEQ ID NO: 672443 - RNA, 22 nt, Human
cuccaccccgugccggugcugg

SEQ ID NO: 672444 - RNA, 22 nt, Human
ggcacagugauuaagagccagu

SEQ ID NO: 672445 - RNA, 22 nt, Human
ccagggcuggaccagugcuugg

SEQ ID NO: 672446 - RNA, 22 nt, Human
uagcagggaagaugaucagaau

SEQ ID NO: 672447 - RNA, 22 nt, Human
uuaagauuuguagagaaaaagc

SEQ ID NO: 672448 - RNA, 22 nt, Human
agcucaggccggagcuacaggc

SEQ ID NO: 672449 - RNA, 22 nt, Human
uacauuuacagagccuucucug

SEQ ID NO: 672450 - RNA, 22 nt, Human
ccugccuggagcugagugugga

SEQ ID NO: 672451 - RNA, 22 nt, Human
uguguccauucaggcacugacc

SEQ ID NO: 672452 - RNA, 22 nt, Human
agcuuugaaugagugcauugca

SEQ ID NO: 672453 - RNA, 22 nt, Human
gaugggguuuugccaggcuggu

SEQ ID NO: 672454 - RNA, 22 nt, Human
gcccccagaccucagugggcug

SEQ ID NO: 672455 - RNA, 22 nt, Human
uguggacuuuaguaggugagag

SEQ ID NO: 672456 - RNA, 22 nt, Human
uacuucauuccuuuguaaaaug

SEQ ID NO: 672457 - RNA, 22 nt, Human
aauaacuucauguaacauuuaa

SEQ ID NO: 672458 - RNA, 22 nt, Human
uggggugaaucuuuguuguccg

SEQ ID NO: 672459 - RNA, 22 nt, Human
uugauuuuaaaauagugacacu

SEQ ID NO: 672460 - RNA, 22 nt, Human
ggugaguugggguucacagguc

SEQ ID NO: 672461 - RNA, 22 nt, Human
ucuccuggauggaccuucucuu

SEQ ID NO: 672462 - RNA, 22 nt, Human
gcccuggauguacaggcauguu

SEQ ID NO: 672463 - RNA, 22 nt, Human
uuuccucugagugagcugggag

SEQ ID NO: 672464 - RNA, 22 nt, Human
uacaagaaauuucugcauauau

SEQ ID NO: 672465 - RNA, 21 nt, Human
ugaggauaaguaaagcugaag

SEQ ID NO: 672466 - RNA, 22 nt, Human
cagugucaccaggcgagucucc

SEQ ID NO: 672467 - RNA, 22 nt, Human
uaacacauauuugcaguaagca

SEQ ID NO: 672468 - RNA, 22 nt, Human
uguuuuaaagccauugccuuuc

SEQ ID NO: 672469 - RNA, 22 nt, Human
auggcagaccugggcuggagaa

SEQ ID NO: 672470 - RNA, 22 nt, Human
ucuuuuggguucuuaugauuua

SEQ ID NO: 672471 - RNA, 22 nt, Human
gagugugugacuucacuuuagc

SEQ ID NO: 672472 - RNA, 22 nt, Human
cuggucugcaaggccauauaga

SEQ ID NO: 672473 - RNA, 22 nt, Human
gguguguguggauuagcaugcc

SEQ ID NO: 672474 - RNA, 22 nt, Human
gcugguuaggugagggugcgcc

SEQ ID NO: 672475 - RNA, 20 nt, Human
gaguccaggggccuguagca

SEQ ID NO: 672476 - RNA, 21 nt, Human
gauauuuaugacucauuccuu

SEQ ID NO: 672477 - RNA, 22 nt, Human
auaauugugggcagugugauau

SEQ ID NO: 672478 - RNA, 21 nt, Human
ugcuccuuagcugccccugcc

SEQ ID NO: 672479 - RNA, 19 nt, Human
uggaaggcuaagacacuug

SEQ ID NO: 672480 - RNA, 22 nt, Human
uccuggacaagcccuucacccu

SEQ ID NO: 672481 - RNA, 22 nt, Human
uucuggaaggguggaguagcuu

SEQ ID NO: 672482 - RNA, 22 nt, Human
cugagaaaauuucaggaagugu

SEQ ID NO: 672483 - RNA, 22 nt, Human
ugcagaugagggaugaaaauga

SEQ ID NO: 672484 - RNA, 22 nt, Human
auauuuaaacaggguaccaaua

SEQ ID NO: 672485 - RNA, 19 nt, Human
ggaugagggucaggcauag

SEQ ID NO: 672486 - RNA, 22 nt, Human
caaagucagggaagaguggcug

SEQ ID NO: 672487 - RNA, 22 nt, Human
ggaggcucagacuccauccuca

SEQ ID NO: 672488 - RNA, 22 nt, Human
ucacucaaugguaucaggaggu

SEQ ID NO: 672489 - RNA, 22 nt, Human
acuuggaaaauucaaaauggca

SEQ ID NO: 672490 - RNA, 20 nt, Human
gaugggaaucggagcuggua

SEQ ID NO: 672491 - RNA, 22 nt, Human
uagugcuucuacccuaggcagg

SEQ ID NO: 672492 - RNA, 21 nt, Human
uauuaauuuuucuucccacua

SEQ ID NO: 672493 - RNA, 22 nt, Human
uccuggaggcaaaugagcacau

SEQ ID NO: 672494 - RNA, 22 nt, Human
cugggggucuugaaagggagag

SEQ ID NO: 672495 - RNA, 18 nt, Human
ucacacuuccuuuggguc

SEQ ID NO: 672496 - RNA, 22 nt, Human
caauguuuguuagagcucuaga

SEQ ID NO: 672497 - RNA, 22 nt, Human
acauccugaagucagucauuug

SEQ ID NO: 672498 - RNA, 22 nt, Human
ugaugggacugccagcugcuga

SEQ ID NO: 672499 - RNA, 22 nt, Human
uggcucagauaauucaaggggc

SEQ ID NO: 672500 - RNA, 22 nt, Human
cucuuaguaaugccaugaagca

SEQ ID NO: 672501 - RNA, 22 nt, Human
cuggaggcugaguugggucucc

SEQ ID NO: 672502 - RNA, 22 nt, Human
ucagggcugcagaagaggcagg

SEQ ID NO: 672503 - RNA, 22 nt, Human
ccaggagcccugccacaauggu

SEQ ID NO: 672504 - RNA, 17 nt, Human
cugcuuggccucugggg

SEQ ID NO: 672505 - RNA, 22 nt, Human
gagaacugauuagcauuugcca

SEQ ID NO: 672506 - RNA, 22 nt, Human
cugagacuuucaugugcuuuua

SEQ ID NO: 672507 - RNA, 20 nt, Human
uaaaugcaugaauguaaggc

SEQ ID NO: 672508 - RNA, 22 nt, Human
gcccugcugucuucagaguaua

SEQ ID NO: 672509 - RNA, 22 nt, Human
auggaauaauuguuucacagaa

SEQ ID NO: 672510 - RNA, 18 nt, Human
gagacacaagggccugga

SEQ ID NO: 672511 - RNA, 22 nt, Human
gauaauuuuagucugaaaauug

SEQ ID NO: 672512 - RNA, 22 nt, Human
aacucucuugggaguaccugga

SEQ ID NO: 672513 - RNA, 22 nt, Human
ucccagcauuaaugccugucag

SEQ ID NO: 672514 - RNA, 22 nt, Human
cuucaaauucgaggaguagaug

SEQ ID NO: 672515 - RNA, 21 nt, Human
ugggggugaggccuaggaauc

SEQ ID NO: 672516 - RNA, 22 nt, Human
augaaguucuagugagaaaugc

SEQ ID NO: 672517 - RNA, 20 nt, Human
gccugcagguuggaugggau

SEQ ID NO: 672518 - RNA, 22 nt, Human
uacaacuuacuugaauggcuuu

SEQ ID NO: 672519 - RNA, 22 nt, Human
uaacaaugguuuugcugauaau

SEQ ID NO: 672520 - RNA, 22 nt, Human
uagucccauuuugagguauuug

SEQ ID NO: 672521 - RNA, 22 nt, Human
guuguacaggcagggaaacuga

SEQ ID NO: 672522 - RNA, 22 nt, Human
gggacuccauaagcacauggau

SEQ ID NO: 672523 - RNA, 22 nt, Human
aggccagcccugggcugagaga

SEQ ID NO: 672524 - RNA, 22 nt, Human
aagguguucagguuuucccauu

SEQ ID NO: 672525 - RNA, 22 nt, Human
ccaggugucuguggccagcccu

SEQ ID NO: 672526 - RNA, 22 nt, Human
ccagggcaggggcuggaguuca

SEQ ID NO: 672527 - RNA, 22 nt, Human
cugccucuguugggcauggucu

SEQ ID NO: 672528 - RNA, 22 nt, Human
ugcuggagaggaaggugggguc

SEQ ID NO: 672529 - RNA, 22 nt, Human
ccacaggacggaggucuggccg

SEQ ID NO: 672530 - RNA, 22 nt, Human
aagaaacucacuuugggaggca

SEQ ID NO: 672531 - RNA, 22 nt, Human
aggcaagaacagacaugggagu

SEQ ID NO: 672532 - RNA, 22 nt, Human
ugacaagagaccccuccgcagg

SEQ ID NO: 672533 - RNA, 22 nt, Human
aacaucagaaguagaagacuca

SEQ ID NO: 672534 - RNA, 22 nt, Human
agggcuuugauguccaugagga

SEQ ID NO: 672535 - RNA, 22 nt, Human
aggggagguggcagaaaugugc

SEQ ID NO: 672536 - RNA, 22 nt, Human
uuccacauuccuuacauucaua

SEQ ID NO: 672537 - RNA, 22 nt, Human
uccauggagauggaugacugua

SEQ ID NO: 672538 - RNA, 22 nt, Human
ggcccugggaugcucagcagug

SEQ ID NO: 672539 - RNA, 22 nt, Human
cugguuggaagugcagacucuc

SEQ ID NO: 672540 - RNA, 22 nt, Human
acaggccuggaaaggaaggagu

SEQ ID NO: 672541 - RNA, 22 nt, Human
ggcuucugguaaagaccacacc

SEQ ID NO: 672542 - RNA, 22 nt, Human
cccccucugccgggguccuuca

SEQ ID NO: 672543 - RNA, 22 nt, Human
uugccuuuaaguauaacugcug

SEQ ID NO: 672544 - RNA, 21 nt, Human
cccaagggaggcaggauaagg

SEQ ID NO: 672545 - RNA, 22 nt, Human
uuuagcaaguucucugagagaa

SEQ ID NO: 672546 - RNA, 22 nt, Human
auuguucagaguagggcucugu

SEQ ID NO: 672547 - RNA, 22 nt, Human
agcagccucccagggagcagcc

SEQ ID NO: 672548 - RNA, 22 nt, Human
uucccucuuuuccaacaguugu

SEQ ID NO: 672549 - RNA, 22 nt, Human
agcagcuccugccaugagugcu

SEQ ID NO: 672550 - RNA, 22 nt, Human
uugugucuaaauaaggagaccu

SEQ ID NO: 672551 - RNA, 20 nt, Human
ugcucuggaaauggucugag

SEQ ID NO: 672552 - RNA, 22 nt, Human
uugucuguccaggcaccccaag

SEQ ID NO: 672553 - RNA, 22 nt, Human
uuaagggccauuauggaugggu

SEQ ID NO: 672554 - RNA, 22 nt, Human
caccuguccacgcagucugccu

SEQ ID NO: 672555 - RNA, 22 nt, Human
uacagccuggcacuacccuggg

SEQ ID NO: 672556 - RNA, 22 nt, Human
cagagccagagaccugcugugc

SEQ ID NO: 672557 - RNA, 22 nt, Human
aagagacaugaauacucgaagg

SEQ ID NO: 672558 - RNA, 19 nt, Human
ccaggagugguggggugag

SEQ ID NO: 672559 - RNA, 22 nt, Human
gugcugagcaucaugaggcacu

SEQ ID NO: 672560 - RNA, 22 nt, Human
aacugcauaauauaucaugcag

SEQ ID NO: 672561 - RNA, 22 nt, Human
gacugaacaguaagaggcuuua

SEQ ID NO: 672562 - RNA, 22 nt, Human
uuccuggguucccucucauucu

SEQ ID NO: 672563 - RNA, 20 nt, Human
agauuaggggcuuucuucuu

SEQ ID NO: 672564 - RNA, 22 nt, Human
gaggggcuggcuguggucccau

SEQ ID NO: 672565 - RNA, 22 nt, Human
ccucugugugaugcgcaaagua

SEQ ID NO: 672566 - RNA, 22 nt, Human
cacuuuacuaucuauaaaauaa

SEQ ID NO: 672567 - RNA, 22 nt, Human
gggcagccucggugccugcugc

SEQ ID NO: 672568 - RNA, 22 nt, Human
aucaacaugaauuucucugaag

SEQ ID NO: 672569 - RNA, 22 nt, Human
cugcaaaaguaauugcagguuu

SEQ ID NO: 672570 - RNA, 22 nt, Human
ugcacagagcaggcaccagcgg

SEQ ID NO: 672571 - RNA, 20 nt, Human
accuucaggaacuuaucagc

SEQ ID NO: 672572 - RNA, 22 nt, Human
ugaaaucaugaacaagguaggu

SEQ ID NO: 672573 - RNA, 20 nt, Human
uaaugcuuaacacauccccu

SEQ ID NO: 672574 - RNA, 22 nt, Human
uaggaaauuuuacuggucuggg

SEQ ID NO: 672575 - RNA, 22 nt, Human
agucucuccacauuguuauaaa

SEQ ID NO: 672576 - RNA, 22 nt, Human
agugcaaacuuuauugugaccu

SEQ ID NO: 672577 - RNA, 22 nt, Human
ccagugcccagucucccugguc

SEQ ID NO: 672578 - RNA, 22 nt, Human
aaaguucuggagaaaauaauga

SEQ ID NO: 672579 - RNA, 19 nt, Human
ugacacagcuagguuugcu

SEQ ID NO: 672580 - RNA, 22 nt, Human
gcauucauauggaaggaaacua

SEQ ID NO: 672581 - RNA, 22 nt, Human
aauuagcuaauuaauuguagcc

SEQ ID NO: 672582 - RNA, 22 nt, Human
acacccaggcuggcgugcagug

SEQ ID NO: 672583 - RNA, 22 nt, Human
gcugagcagccuaagcaaauuu

SEQ ID NO: 672584 - RNA, 22 nt, Human
caugcauuccuccucugccuua

SEQ ID NO: 672585 - RNA, 22 nt, Human
aaugcaaacagcccagaaucca

SEQ ID NO: 672586 - RNA, 22 nt, Human
agggaaggagguuagaacccac

SEQ ID NO: 672587 - RNA, 17 nt, Human
ccugggaggaguuauga

SEQ ID NO: 672588 - RNA, 22 nt, Human
aaaauguaugauggaggugcua

SEQ ID NO: 672589 - RNA, 22 nt, Human
uuuauugggugcagugcccaca

SEQ ID NO: 672590 - RNA, 22 nt, Human
ucuuugaaaagggagauagaaa

SEQ ID NO: 672591 - RNA, 22 nt, Human
aucagcaagacuaggggaauac

SEQ ID NO: 672592 - RNA, 22 nt, Human
auuuagacucucaccuccaccu

SEQ ID NO: 672593 - RNA, 22 nt, Human
guucuauuccccuuaucuguga

SEQ ID NO: 672594 - RNA, 22 nt, Human
cugaagcaaaggaucgagcuaa

SEQ ID NO: 672595 - RNA, 22 nt, Human
uguggcugcagacacuggagcc

SEQ ID NO: 672596 - RNA, 22 nt, Human
cgagugucugcuaugggcugag

SEQ ID NO: 672597 - RNA, 22 nt, Human
ucuuuggcauuuaggagcagga

SEQ ID NO: 672598 - RNA, 22 nt, Human
ugguggcaucaauugacuucuc

SEQ ID NO: 672599 - RNA, 22 nt, Human
gacagcuucgaggaggugagcu

SEQ ID NO: 672600 - RNA, 22 nt, Human
caaaauuagggagugagcugga

SEQ ID NO: 672601 - RNA, 22 nt, Human
aaguuuuaacaaguacuuacua

SEQ ID NO: 672602 - RNA, 22 nt, Human
ugaaugauuugggugcauucag

SEQ ID NO: 672603 - RNA, 22 nt, Human
cugccugccuuggccuccagga

SEQ ID NO: 672604 - RNA, 22 nt, Human
uggcaauguuagcaaagcauuu

SEQ ID NO: 672605 - RNA, 23 nt, Human
agguuacaguuguuaaguugcaa

SEQ ID NO: 672606 - RNA, 22 nt, Human
gcuucuuuggcaacccugacau

SEQ ID NO: 672607 - RNA, 22 nt, Human
uuucagacaugggggcaaacag

SEQ ID NO: 672608 - RNA, 22 nt, Human
cuucuuuucauggcuugggaag

SEQ ID NO: 672609 - RNA, 22 nt, Human
uaaacagccuaaaacuuucuuu

SEQ ID NO: 672610 - RNA, 22 nt, Human
auacaaucuagucugucagcaa

SEQ ID NO: 672611 - RNA, 22 nt, Human
gugcuguaucagaaucugcucu

SEQ ID NO: 672612 - RNA, 22 nt, Human
gaccccaucuggcugccccagg

SEQ ID NO: 672613 - RNA, 22 nt, Human
agugugagccuacaggccaaag

SEQ ID NO: 672614 - RNA, 22 nt, Human
gccuggaguguugguauuucuc

SEQ ID NO: 672615 - RNA, 22 nt, Human
aggccugcugucuugaggccaa

SEQ ID NO: 672616 - RNA, 22 nt, Human
ccacugagaagggguugggguc

SEQ ID NO: 672617 - RNA, 22 nt, Human
gcagguggcagaggugggaucu

SEQ ID NO: 672618 - RNA, 19 nt, Human
gccaugggcuggcagcaga

SEQ ID NO: 672619 - RNA, 22 nt, Human
aagaguggagaauaaaauagga

SEQ ID NO: 672620 - RNA, 22 nt, Human
cuggcucuuggcuagggagagu

SEQ ID NO: 672621 - RNA, 22 nt, Human
acuccaggcaucugcuucugcu

SEQ ID NO: 672622 - RNA, 22 nt, Human
ugcauagaggauccaguguggu

SEQ ID NO: 672623 - RNA, 22 nt, Human
ucaaguccugcuguggaccaca

SEQ ID NO: 672624 - RNA, 22 nt, Human
guauuccuucagaagacguuua

SEQ ID NO: 672625 - RNA, 22 nt, Human
augcacaggcugugggcugguu

SEQ ID NO: 672626 - RNA, 22 nt, Human
gggucaaaugauaauugcuucu

SEQ ID NO: 672627 - RNA, 22 nt, Human
caaugucagaauuacaguugau

SEQ ID NO: 672628 - RNA, 22 nt, Human
ggcagcugguucuuuccauuaa

SEQ ID NO: 672629 - RNA, 22 nt, Human
ccaaacaaauccccauucuuag

SEQ ID NO: 672630 - RNA, 22 nt, Human
augucuucauagcuuauaucca

SEQ ID NO: 672631 - RNA, 22 nt, Human
uacagaggagaccaaggcucag

SEQ ID NO: 672632 - RNA, 22 nt, Human
aucagucuguguuagaaaagag

SEQ ID NO: 672633 - RNA, 22 nt, Human
uucagccuguucaugcuguugc

SEQ ID NO: 672634 - RNA, 22 nt, Human
aacacuguaacagcaucauuuu

SEQ ID NO: 672635 - RNA, 22 nt, Human
cccaggcacauccacucuguga

SEQ ID NO: 672636 - RNA, 18 nt, Human
gacccaggaaagaguccu

SEQ ID NO: 672637 - RNA, 22 nt, Human
aaaaugaggaacggaucauggc

SEQ ID NO: 672638 - RNA, 22 nt, Human
ugauauuugcugacugcauugu

SEQ ID NO: 672639 - RNA, 22 nt, Human
caagauuuagccugcugccugu

SEQ ID NO: 672640 - RNA, 22 nt, Human
gagcaggugccuguagcucucu

SEQ ID NO: 672641 - RNA, 22 nt, Human
aacaggagucauugucauuauu

SEQ ID NO: 672642 - RNA, 22 nt, Human
gcaaaggcuagagacacaggga

SEQ ID NO: 672643 - RNA, 22 nt, Human
ccuuuaaauggauguucaacug

SEQ ID NO: 672644 - RNA, 22 nt, Human
auggcuaaaccugaacuggucu

SEQ ID NO: 672645 - RNA, 22 nt, Human
ugucaaugcuggucuugaauga

SEQ ID NO: 672646 - RNA, 22 nt, Human
ugugccagccucuggcuguguc

SEQ ID NO: 672647 - RNA, 22 nt, Human
uggcugaaucugcagcaggaag

SEQ ID NO: 672648 - RNA, 22 nt, Human
aacaaagaugggugggaaagag

SEQ ID NO: 672649 - RNA, 22 nt, Human
augauugaaaaugacauugcca

SEQ ID NO: 672650 - RNA, 22 nt, Human
gaguuauaaccuaguuuaacug

SEQ ID NO: 672651 - RNA, 22 nt, Human
ccuucucccucugagaggaacc

SEQ ID NO: 672652 - RNA, 22 nt, Human
cagcauguaucuuucaggugug

SEQ ID NO: 672653 - RNA, 22 nt, Human
cacacaauuaugugugcacaau

SEQ ID NO: 672654 - RNA, 22 nt, Human
ggaagccagaaagugagaauau

SEQ ID NO: 672655 - RNA, 22 nt, Human
caggccucagagaguggcgggg

SEQ ID NO: 672656 - RNA, 22 nt, Human
ggugggaaggggccagugugcg

SEQ ID NO: 672657 - RNA, 22 nt, Human
gaggcucaguuauuuuagccug

SEQ ID NO: 672658 - RNA, 22 nt, Human
agugcagccgagaucaggugcu

SEQ ID NO: 672659 - RNA, 22 nt, Human
uguggucucguuauguugccca

SEQ ID NO: 672660 - RNA, 22 nt, Human
gagcuguccuaccaggaguccu

SEQ ID NO: 672661 - RNA, 21 nt, Human
ugccuggccuuugcuuuuccu

SEQ ID NO: 672662 - RNA, 22 nt, Human
uaauacuugucauaaaggcauu

SEQ ID NO: 672663 - RNA, 22 nt, Human
cugcuucuaagaaccugcagcu

SEQ ID NO: 672664 - RNA, 22 nt, Human
uaacuuuggggacacuucucuu

SEQ ID NO: 672665 - RNA, 22 nt, Human
uguccaggucagcagcagggac

SEQ ID NO: 672666 - RNA, 22 nt, Human
uggccucugcacugggcucccc

SEQ ID NO: 672667 - RNA, 22 nt, Human
uuggcacaaauuucugaaauaa

SEQ ID NO: 672668 - RNA, 22 nt, Human
gggugguguauuagagcugcag

SEQ ID NO: 672669 - RNA, 22 nt, Human
cagaguucaaagccugcuggga

SEQ ID NO: 672670 - RNA, 22 nt, Human
aggguugccucugagugcuccg

SEQ ID NO: 672671 - RNA, 22 nt, Human
cuccugggagucuuccuggaug

SEQ ID NO: 672672 - RNA, 22 nt, Human
gcaggugaaugauggacuagga

SEQ ID NO: 672673 - RNA, 22 nt, Human
aauaauuagugggacagagaac

SEQ ID NO: 672674 - RNA, 22 nt, Human
cagcauguaagccacugcccug

SEQ ID NO: 672675 - RNA, 23 nt, Human
uuugaagaagugaauaucauaua

SEQ ID NO: 672676 - RNA, 22 nt, Human
agcugcugaagugagagaauug

SEQ ID NO: 672677 - RNA, 22 nt, Human
ggcuaggggaauaaucuguggu

SEQ ID NO: 672678 - RNA, 22 nt, Human
agggcuuuacuucucaguucua

SEQ ID NO: 672679 - RNA, 19 nt, Human
acauucccaucagcaaugu

SEQ ID NO: 672680 - RNA, 22 nt, Human
cccagcugaacuugcauuccaa

SEQ ID NO: 672681 - RNA, 22 nt, Human
ucucugcucaggcaccagcccu

SEQ ID NO: 672682 - RNA, 22 nt, Human
aaagcuaucaucaaugcaacuu

SEQ ID NO: 672683 - RNA, 22 nt, Human
uguuauuuauuucaccuccaga

SEQ ID NO: 672684 - RNA, 22 nt, Human
ucaggcaggaagggaggacuug

SEQ ID NO: 672685 - RNA, 22 nt, Human
gauagcugcugggauauuuuua

SEQ ID NO: 672686 - RNA, 22 nt, Human
ucaccucucuggccgucuaccu

SEQ ID NO: 672687 - RNA, 22 nt, Human
gccacccuuaucccaugcuucu

SEQ ID NO: 672688 - RNA, 22 nt, Human
aucuggcuccuacacuugaaga

SEQ ID NO: 672689 - RNA, 22 nt, Human
guggccaggcguccgcgcggcu

SEQ ID NO: 672690 - RNA, 22 nt, Human
gccuggagcagacgugucccgg

SEQ ID NO: 672691 - RNA, 22 nt, Human
auguacaaccugcaugacaguc

SEQ ID NO: 672692 - RNA, 22 nt, Human
augacagaugcuguggggaggu

SEQ ID NO: 672693 - RNA, 22 nt, Human
ugcucgagguccccaccggcuc

SEQ ID NO: 672694 - RNA, 22 nt, Human
caugucaacaggcccagaaaau

SEQ ID NO: 672695 - RNA, 22 nt, Human
ccauuauccauuuugagucuua

SEQ ID NO: 672696 - RNA, 22 nt, Human
uugaucuuacaguguucuucca

SEQ ID NO: 672697 - RNA, 22 nt, Human
cauuucuagagucccaagaggu

SEQ ID NO: 672698 - RNA, 22 nt, Human
cuggcuggcaaguagaacacaa

SEQ ID NO: 672699 - RNA, 22 nt, Human
gccaccucuuugucucugccgc

SEQ ID NO: 672700 - RNA, 23 nt, Human
cauggggagcagugcuccugacc

SEQ ID NO: 672701 - RNA, 22 nt, Human
aagaagagaaaugugcugcugg

SEQ ID NO: 672702 - RNA, 22 nt, Human
auguauuuuaagauuugccuca

SEQ ID NO: 672703 - RNA, 23 nt, Human
cagugcagggcaacucagacucc

SEQ ID NO: 672704 - RNA, 22 nt, Human
uguucagagacagaaauucuaa

SEQ ID NO: 672705 - RNA, 22 nt, Human
gcccucucggcauagcaggggc

SEQ ID NO: 672706 - RNA, 22 nt, Human
ucagaagggaaacacaagugac

SEQ ID NO: 672707 - RNA, 22 nt, Human
ccugggcaacauagugagaccc

SEQ ID NO: 672708 - RNA, 22 nt, Human
auguacaagcuguuuuacugca

SEQ ID NO: 672709 - RNA, 22 nt, Human
agauggcugauggcaggagcca

SEQ ID NO: 672710 - RNA, 22 nt, Human
accccagguccagguuacagag

SEQ ID NO: 672711 - RNA, 22 nt, Human
uggcuggaauauguggagacca

SEQ ID NO: 672712 - RNA, 22 nt, Human
gggugccugaguuagggcagaa

SEQ ID NO: 672713 - RNA, 22 nt, Human
gagacagaguuucacucuuguu

SEQ ID NO: 672714 - RNA, 22 nt, Human
cagugucucaaaacaaguugcu

SEQ ID NO: 672715 - RNA, 22 nt, Human
guacauauuaaaggucuauaaa

SEQ ID NO: 672716 - RNA, 22 nt, Human
aaagagcuaacauugccgagau

SEQ ID NO: 672717 - RNA, 20 nt, Human
uccagaggccacauccagug

SEQ ID NO: 672718 - RNA, 21 nt, Human
cacucaggguaugugccaggc

SEQ ID NO: 672719 - RNA, 22 nt, Human
ccuuuagagcaaacgccaccua

SEQ ID NO: 672720 - RNA, 22 nt, Human
ucaggaucaggggccuuuccuu

SEQ ID NO: 672721 - RNA, 22 nt, Human
uggaagagacacuuacauucag

SEQ ID NO: 672722 - RNA, 19 nt, Human
guuuugcaggcagagggga

SEQ ID NO: 672723 - RNA, 22 nt, Human
augcuucccucacauauccugg

SEQ ID NO: 672724 - RNA, 22 nt, Human
ucugguggcacgugucuugcau

SEQ ID NO: 672725 - RNA, 22 nt, Human
gccugcuuuaagucuguugccu

SEQ ID NO: 672726 - RNA, 22 nt, Human
ccuggcuuuagcugccuucccu

SEQ ID NO: 672727 - RNA, 22 nt, Human
agggaucacgguggacuuggau

SEQ ID NO: 672728 - RNA, 22 nt, Human
uuuaguauauaaaaagagaagu

SEQ ID NO: 672729 - RNA, 22 nt, Human
acagaaaaugccagaagggugg

SEQ ID NO: 672730 - RNA, 22 nt, Human
agauaacucauuuuguauaucc

SEQ ID NO: 672731 - RNA, 22 nt, Human
uccuguccugaggcuccaggcc

SEQ ID NO: 672732 - RNA, 22 nt, Human
uccacauuagaauguuuucuca

SEQ ID NO: 672733 - RNA, 22 nt, Human
cacaaaaucuuucucgauuauu

SEQ ID NO: 672734 - RNA, 22 nt, Human
uuuguuuucuguaggccuuucc

SEQ ID NO: 672735 - RNA, 22 nt, Human
augucuaaaagauaaaguuuaa

SEQ ID NO: 672736 - RNA, 22 nt, Human
cugugcguaaguagccaaaaua

SEQ ID NO: 672737 - RNA, 22 nt, Human
agucaggugguucugcuccacu

SEQ ID NO: 672738 - RNA, 22 nt, Human
ucagaggaggcauuuaaacaga

SEQ ID NO: 672739 - RNA, 22 nt, Human
cuggcucccguuguccuugaag

SEQ ID NO: 672740 - RNA, 22 nt, Human
cccuucaagcucucuggguuuu

SEQ ID NO: 672741 - RNA, 22 nt, Human
uucuccugcgcaggcccaggga

SEQ ID NO: 672742 - RNA, 22 nt, Human
acuuucuucuacuacuuggaga

SEQ ID NO: 672743 - RNA, 22 nt, Human
caguauuuucaggauuuggaag

SEQ ID NO: 672744 - RNA, 22 nt, Human
aagcauaaaacguuacaacaug

SEQ ID NO: 672745 - RNA, 22 nt, Human
uaagccacuagucuguuaugaa

SEQ ID NO: 672746 - RNA, 22 nt, Human
cauguguuucgagacuguugag

SEQ ID NO: 672747 - RNA, 22 nt, Human
cagaagacagcuguuucacucg

SEQ ID NO: 672748 - RNA, 22 nt, Human
ggccacagugggaaauccuggg

SEQ ID NO: 672749 - RNA, 22 nt, Human
agcucugggggaaagucugcuc

SEQ ID NO: 672750 - RNA, 22 nt, Human
auguucaaacuuuuuacacacc

SEQ ID NO: 672751 - RNA, 22 nt, Human
gcugaugggagcuggcucaccc

SEQ ID NO: 672752 - RNA, 22 nt, Human
uucucaaagugugcucccugga

SEQ ID NO: 672753 - RNA, 22 nt, Human
aagacccuauacucagugaccc

SEQ ID NO: 672754 - RNA, 22 nt, Human
ugcagggauuagaggccgggga

SEQ ID NO: 672755 - RNA, 19 nt, Human
ugucccagacuccgugucu

SEQ ID NO: 672756 - RNA, 22 nt, Human
ucuagaaagccaaauuaggaau

SEQ ID NO: 672757 - RNA, 22 nt, Human
ucuggcaggaccaugaagcgua

SEQ ID NO: 672758 - RNA, 22 nt, Human
ucauuuaugcaggaauggcaua

SEQ ID NO: 672759 - RNA, 22 nt, Human
ucaucugaaauuguauauguag

SEQ ID NO: 672760 - RNA, 18 nt, Human
uaacaucggcuaugcauc

SEQ ID NO: 672761 - RNA, 22 nt, Human
uuaaucucuuagcaaauuaaug

SEQ ID NO: 672762 - RNA, 22 nt, Human
ugaggggaacugaugcccauug

SEQ ID NO: 672763 - RNA, 22 nt, Human
caguagcauguaauaaagacag

SEQ ID NO: 672764 - RNA, 22 nt, Human
ccaguguuauuuuagaguguga

SEQ ID NO: 672765 - RNA, 22 nt, Human
uagucacaggaaguuucaaugu

SEQ ID NO: 672766 - RNA, 22 nt, Human
cuucaaauccuguguagggcua

SEQ ID NO: 672767 - RNA, 22 nt, Human
cucagugguggucacuuggugg

SEQ ID NO: 672768 - RNA, 22 nt, Human
gggaccugcgccacucacuguc

SEQ ID NO: 672769 - RNA, 22 nt, Human
cccuggagguggagguugcagg

SEQ ID NO: 672770 - RNA, 21 nt, Human
aagccucaagcagaagacaga

SEQ ID NO: 672771 - RNA, 18 nt, Human
uauauuucacacauauuc

SEQ ID NO: 672772 - RNA, 22 nt, Human
ugacauuuuuguacaaagucag

SEQ ID NO: 672773 - RNA, 22 nt, Human
agcuuccucaccucagaggucu

SEQ ID NO: 672774 - RNA, 22 nt, Human
ugucucuugagcugccugaugc

SEQ ID NO: 672775 - RNA, 22 nt, Human
gacccaggagagaggguugcau

SEQ ID NO: 672776 - RNA, 22 nt, Human
uauugucuaggaauuguuuaaa

SEQ ID NO: 672777 - RNA, 22 nt, Human
guguuuccucuagaagccaugg

SEQ ID NO: 672778 - RNA, 22 nt, Human
aagggcacagggaaagagugca

SEQ ID NO: 672779 - RNA, 22 nt, Human
aacccaggaguuggaggcugug

SEQ ID NO: 672780 - RNA, 22 nt, Human
aacauucuaugugcauucagaa

SEQ ID NO: 672781 - RNA, 22 nt, Human
auauauuacaaaagaggaagga

SEQ ID NO: 672782 - RNA, 22 nt, Human
acagguguugacucacaggccc

SEQ ID NO: 672783 - RNA, 22 nt, Human
ucagcacuuuuacucucuuugc

SEQ ID NO: 672784 - RNA, 22 nt, Human
aaugaggccaguagaaggaagu

SEQ ID NO: 672785 - RNA, 22 nt, Human
aagaugaaaauuuacugugaug

SEQ ID NO: 672786 - RNA, 22 nt, Human
gcugccuuagagggagugguuc

SEQ ID NO: 672787 - RNA, 22 nt, Human
guucuuuaaguggagaaggaaa

SEQ ID NO: 672788 - RNA, 22 nt, Human
ggucucaggagacuggagagca

SEQ ID NO: 672789 - RNA, 22 nt, Human
uuucacaacacaaucucguuaa

SEQ ID NO: 672790 - RNA, 22 nt, Human
uuggcucaaaacuuagauucca

SEQ ID NO: 672791 - RNA, 22 nt, Human
aaccugcaguuuuuauucugag

SEQ ID NO: 672792 - RNA, 22 nt, Human
uggcauguacccaggaauggac

SEQ ID NO: 672793 - RNA, 22 nt, Human
uuccugagaacauggcagcuua

SEQ ID NO: 672794 - RNA, 22 nt, Human
agugcugaggccauacuccaua

SEQ ID NO: 672795 - RNA, 22 nt, Human
agcagccuggacuuggaugugg

SEQ ID NO: 672796 - RNA, 22 nt, Human
cugucccagccccguacucuaa

SEQ ID NO: 672797 - RNA, 22 nt, Human
aucaaaguggaaguuuacuagg

SEQ ID NO: 672798 - RNA, 21 nt, Human
uucuccaggcaaccauuucag

SEQ ID NO: 672799 - RNA, 22 nt, Human
uucucagauccaucagaagucc

SEQ ID NO: 672800 - RNA, 22 nt, Human
aaccugaauuacuuuugcacca

SEQ ID NO: 672801 - RNA, 22 nt, Human
gugaaugccgcagucuguugcu

SEQ ID NO: 672802 - RNA, 22 nt, Human
gcagaggagcaagcuggacacc

SEQ ID NO: 672803 - RNA, 22 nt, Human
gugagcuguuuuggacccaucu

SEQ ID NO: 672804 - RNA, 22 nt, Human
gcagcagugucucccaucuugc

SEQ ID NO: 672805 - RNA, 22 nt, Human
caggaaauuuaagaguguacaa

SEQ ID NO: 672806 - RNA, 22 nt, Human
ccuucacacagguagaagcaga

SEQ ID NO: 672807 - RNA, 22 nt, Human
cagggccacuguagaugaggag

SEQ ID NO: 672808 - RNA, 22 nt, Human
cuggggagaagcgacucggcug

SEQ ID NO: 672809 - RNA, 22 nt, Human
cugagcgcgggaccugaggcug

SEQ ID NO: 672810 - RNA, 21 nt, Human
uccaggggccagcacccaagc

SEQ ID NO: 672811 - RNA, 22 nt, Human
ggcuccugauuugagggggcug

SEQ ID NO: 672812 - RNA, 23 nt, Human
agccccucauaucugcuuucucu

SEQ ID NO: 672813 - RNA, 22 nt, Human
agugaaauaaagcugccuaugg

SEQ ID NO: 672814 - RNA, 21 nt, Human
ugauggaaaggauuuuggguc

SEQ ID NO: 672815 - RNA, 22 nt, Human
cucagacacagccccacgaagu

SEQ ID NO: 672816 - RNA, 22 nt, Human
aaucuggcauuugagaguagga

SEQ ID NO: 672817 - RNA, 21 nt, Human
uagagaaaagaagcuguuccu

SEQ ID NO: 672818 - RNA, 22 nt, Human
agcagcugccagagagaguucc

SEQ ID NO: 672819 - RNA, 22 nt, Human
aaucuguugucaggaauccaca

SEQ ID NO: 672820 - RNA, 22 nt, Human
ucagccauggugagagugagag

SEQ ID NO: 672821 - RNA, 22 nt, Human
uuaagaggagaucauacuggag

SEQ ID NO: 672822 - RNA, 22 nt, Human
cuaugagaagaaaacaagauua

SEQ ID NO: 672823 - RNA, 23 nt, Human
gcacucaucugaagcuauggugc

SEQ ID NO: 672824 - RNA, 22 nt, Human
cugggcuuaggaccuggugcgg

SEQ ID NO: 672825 - RNA, 22 nt, Human
auucaaacaggccaauugaccu

SEQ ID NO: 672826 - RNA, 22 nt, Human
guuucuaagggagagcugccag

SEQ ID NO: 672827 - RNA, 22 nt, Human
gagcccugugauucuguugugu

SEQ ID NO: 672828 - RNA, 22 nt, Human
uggagucaugauggcugcugau

SEQ ID NO: 672829 - RNA, 22 nt, Human
gagggugggcuccuaucugggu

SEQ ID NO: 672830 - RNA, 22 nt, Human
guggccagccccauggacaguu

SEQ ID NO: 672831 - RNA, 22 nt, Human
uugaguguaaggaauguggggc

SEQ ID NO: 672832 - RNA, 22 nt, Human
gagaauaaaucuaaaguuucuu

SEQ ID NO: 672833 - RNA, 22 nt, Human
aaaggcagagugcucagcuggc

SEQ ID NO: 672834 - RNA, 22 nt, Human
aaaguagcuuuguagguacagu

SEQ ID NO: 672835 - RNA, 22 nt, Human
uuuguuugaaagucucuacagc

SEQ ID NO: 672836 - RNA, 22 nt, Human
uaaagucauaagaguggauccg

SEQ ID NO: 672837 - RNA, 22 nt, Human
ucuggguccgggacuguggaug

SEQ ID NO: 672838 - RNA, 22 nt, Human
aaacaucugacuugcuuuuuca

SEQ ID NO: 672839 - RNA, 22 nt, Human
cugcaguguucuggaaugcauu

SEQ ID NO: 672840 - RNA, 22 nt, Human
ucacuccucauugcugcccauu

SEQ ID NO: 672841 - RNA, 19 nt, Human
aaugaguuccaugaaaaga

SEQ ID NO: 672842 - RNA, 18 nt, Human
ucuuuuguccccugcugc

SEQ ID NO: 672843 - RNA, 22 nt, Human
auuauuggacacuucuucugca

SEQ ID NO: 672844 - RNA, 22 nt, Human
cauggaaugugaguuguuuagu

SEQ ID NO: 672845 - RNA, 22 nt, Human
uagaaacagcauauauuagccc

SEQ ID NO: 672846 - RNA, 22 nt, Human
auuccuaaggaaggcuggcaag

SEQ ID NO: 672847 - RNA, 22 nt, Human
gugccaccucugccccagaggg

SEQ ID NO: 672848 - RNA, 22 nt, Human
gagggguccaggaggcacuuac

SEQ ID NO: 672849 - RNA, 22 nt, Human
cagagccauccaggugccuguu

SEQ ID NO: 672850 - RNA, 22 nt, Human
ugucuucuguauucaagucuau

SEQ ID NO: 672851 - RNA, 22 nt, Human
cagaagccugccucagaugcac

SEQ ID NO: 672852 - RNA, 22 nt, Human
cuggaguuuguggcuugcucaa

SEQ ID NO: 672853 - RNA, 22 nt, Human
uagugucugacauuuaagagca

SEQ ID NO: 672854 - RNA, 22 nt, Human
aucaggaauuaggugagaugga

SEQ ID NO: 672855 - RNA, 22 nt, Human
acagugauuucauccuucuggg

SEQ ID NO: 672856 - RNA, 19 nt, Human
ucuugaugagguuucucca

SEQ ID NO: 672857 - RNA, 22 nt, Human
ccuggcacaagagcagcauugg

SEQ ID NO: 672858 - RNA, 22 nt, Human
uauauguaagcuauguaagagu

SEQ ID NO: 672859 - RNA, 22 nt, Human
guagaauuaccucucuaugucc

SEQ ID NO: 672860 - RNA, 22 nt, Human
gccaagcuggaugaagagguug

SEQ ID NO: 672861 - RNA, 22 nt, Human
uggagcaggugccaggugugug

SEQ ID NO: 672862 - RNA, 22 nt, Human
aguucaugugguuuaacuuaau

SEQ ID NO: 672863 - RNA, 22 nt, Human
ccucacagccucaugcccagcc

SEQ ID NO: 672864 - RNA, 23 nt, Human
acagaucaucucgaaacaacuau

SEQ ID NO: 672865 - RNA, 22 nt, Human
caggccggggcggcgccaucuu

SEQ ID NO: 672866 - RNA, 22 nt, Human
gggagcugaaggagccggcggg

SEQ ID NO: 672867 - RNA, 22 nt, Human
agaagauguugcaguugaugcg

SEQ ID NO: 672868 - RNA, 22 nt, Human
acaaauuggguaugagcuaaga

SEQ ID NO: 672869 - RNA, 22 nt, Human
accuccccauuaggucacccac

SEQ ID NO: 672870 - RNA, 22 nt, Human
aaacaucaccauuuuaccuaau

SEQ ID NO: 672871 - RNA, 22 nt, Human
gcauccauggagagcacucuga

SEQ ID NO: 672872 - RNA, 21 nt, Human
ugcuggccucaagggugacuu

SEQ ID NO: 672873 - RNA, 22 nt, Human
cugggacuugggcuaugcucug

SEQ ID NO: 672874 - RNA, 22 nt, Human
uguuaaaaaugcagauuccuau

SEQ ID NO: 672875 - RNA, 22 nt, Human
ucuucuuuaugucauaugccag

SEQ ID NO: 672876 - RNA, 22 nt, Human
uggcuggcugucaguaggcugu

SEQ ID NO: 672877 - RNA, 22 nt, Human
aaagguaguacuucuagaaggg

SEQ ID NO: 672878 - RNA, 22 nt, Human
uugccuugauucuucucaugug

SEQ ID NO: 672879 - RNA, 22 nt, Human
uaagaacauaaauucauacggg

SEQ ID NO: 672880 - RNA, 22 nt, Human
uggagagccuggagucccugau

SEQ ID NO: 672881 - RNA, 22 nt, Human
uagauucucccaucaugagaug

SEQ ID NO: 672882 - RNA, 22 nt, Human
cuggaagaggggaaaugccaug

SEQ ID NO: 672883 - RNA, 23 nt, Human
ucagaggaucaucaaacguuuuc

SEQ ID NO: 672884 - RNA, 22 nt, Human
gcgcaggagccgcggagggccg

SEQ ID NO: 672885 - RNA, 22 nt, Human
acugugugccaggcgcuggucu

SEQ ID NO: 672886 - RNA, 22 nt, Human
uguggaaaaaccacaaguuugg

SEQ ID NO: 672887 - RNA, 23 nt, Human
agcaggcugcuucuccacagcug

SEQ ID NO: 672888 - RNA, 22 nt, Human
auggggcuagacaaccagugcc

SEQ ID NO: 672889 - RNA, 22 nt, Human
augccuuugccacagauuagga

SEQ ID NO: 672890 - RNA, 22 nt, Human
aggagaaagacuggacagccaa

SEQ ID NO: 672891 - RNA, 22 nt, Human
auucugacuuucaucugccuuu

SEQ ID NO: 672892 - RNA, 22 nt, Human
cagacccaggauccaaauguug

SEQ ID NO: 672893 - RNA, 22 nt, Human
aaacauucacucucaauuuuag

SEQ ID NO: 672894 - RNA, 22 nt, Human
gccccaccuugagagcagaaac

SEQ ID NO: 672895 - RNA, 22 nt, Human
gaugcauucgggauguuuacuu

SEQ ID NO: 672896 - RNA, 22 nt, Human
agcccagugggccgaggcgggg

SEQ ID NO: 672897 - RNA, 22 nt, Human
caggggccggcuguccgugccc

SEQ ID NO: 672898 - RNA, 22 nt, Human
ucugugacuugcgggaggagaa

SEQ ID NO: 672899 - RNA, 22 nt, Human
augcaaagcaccacacuaagau

SEQ ID NO: 672900 - RNA, 22 nt, Human
gaaagaaugagcaucaugacuu

SEQ ID NO: 672901 - RNA, 22 nt, Human
aucucuggccccugggguccga

SEQ ID NO: 672902 - RNA, 22 nt, Human
gaccccaggcagaucagggggu

SEQ ID NO: 672903 - RNA, 17 nt, Human
auuugugauguaacguc

SEQ ID NO: 672904 - RNA, 22 nt, Human
acaaucacacaugcaauuauac

SEQ ID NO: 672905 - RNA, 20 nt, Human
acugugaaugcugaauuagc

SEQ ID NO: 672906 - RNA, 22 nt, Human
ccugccaggccagugagcuucc

SEQ ID NO: 672907 - RNA, 22 nt, Human
uagcuuuagaaauauucucaga

SEQ ID NO: 672908 - RNA, 17 nt, Human
ccaaggcuauuuguagu

SEQ ID NO: 672909 - RNA, 20 nt, Human
aggggccuggaacaggccuu

SEQ ID NO: 672910 - RNA, 22 nt, Human
ugcauuaaaaugugccucucuu

SEQ ID NO: 672911 - RNA, 22 nt, Human
aagaguuagcucaauaacuuga

SEQ ID NO: 672912 - RNA, 22 nt, Human
uccugagcaccuaugccauggc

SEQ ID NO: 672913 - RNA, 22 nt, Human
ucugccacaugagggcacagca

SEQ ID NO: 672914 - RNA, 22 nt, Human
agugcauucucuaauuacaggu

SEQ ID NO: 672915 - RNA, 22 nt, Human
gcaggaguuagagguuuaaucu

SEQ ID NO: 672916 - RNA, 22 nt, Human
cccaggcacucuuggucauuuu

SEQ ID NO: 672917 - RNA, 22 nt, Human
uuccucagaaaauacuguccaa

SEQ ID NO: 672918 - RNA, 19 nt, Human
acaggggcuagcggaagca

SEQ ID NO: 672919 - RNA, 22 nt, Human
auuucucuaagcauccguuugc

SEQ ID NO: 672920 - RNA, 22 nt, Human
ccagcccucacugaggccucuc

SEQ ID NO: 672921 - RNA, 20 nt, Human
agccaggcucaagcuccccc

SEQ ID NO: 672922 - RNA, 22 nt, Human
aucuggcuuacgaagcacuggu

SEQ ID NO: 672923 - RNA, 23 nt, Human
uggucucacuugguaagaugaag

SEQ ID NO: 672924 - RNA, 20 nt, Human
cagcccugugaccuggcccu

SEQ ID NO: 672925 - RNA, 22 nt, Human
cauccugagaggucucucuacc

SEQ ID NO: 672926 - RNA, 22 nt, Human
gccaggagaaugcuagcagagg

SEQ ID NO: 672927 - RNA, 22 nt, Human
uggccaggccucuuggugccca

SEQ ID NO: 672928 - RNA, 22 nt, Human
agacaauuaaaaaauuaugcuu

SEQ ID NO: 672929 - RNA, 22 nt, Human
aggcuggcuucccaagcguccu

SEQ ID NO: 672930 - RNA, 22 nt, Human
uugcugugucugauggcugaga

SEQ ID NO: 672931 - RNA, 22 nt, Human
ccaaggcauauggcugaaacca

SEQ ID NO: 672932 - RNA, 22 nt, Human
agugugagugcucauguccauc

SEQ ID NO: 672933 - RNA, 22 nt, Human
acuaaauaguuuugacagaaca

SEQ ID NO: 672934 - RNA, 22 nt, Human
ggaaguguuuccuugggcagca

SEQ ID NO: 672935 - RNA, 22 nt, Human
aaggggaagagaccgcagaguc

SEQ ID NO: 672936 - RNA, 22 nt, Human
uuacacagugcacaagcagagu

SEQ ID NO: 672937 - RNA, 23 nt, Human
agaugagccaacaccuccaugcc

SEQ ID NO: 672938 - RNA, 22 nt, Human
cucccuggcacagcgagagguu

SEQ ID NO: 672939 - RNA, 23 nt, Human
agcugugugcgcguccggguucu

SEQ ID NO: 672940 - RNA, 22 nt, Human
uucaaacauucaaauaaaccgg

SEQ ID NO: 672941 - RNA, 22 nt, Human
gcugagggggaaggaaagcuga

SEQ ID NO: 672942 - RNA, 22 nt, Human
gcucuccaggggcucccaggau

SEQ ID NO: 672943 - RNA, 22 nt, Human
cccugaaauccugugcucugug

SEQ ID NO: 672944 - RNA, 22 nt, Human
cgcaggcuccggggugcccugg

SEQ ID NO: 672945 - RNA, 22 nt, Human
auugaguaauaauugaucuugg

SEQ ID NO: 672946 - RNA, 22 nt, Human
uucucuccaguccuggauucug

SEQ ID NO: 672947 - RNA, 22 nt, Human
ugcuagaaaucugaaacuagca

SEQ ID NO: 672948 - RNA, 20 nt, Human
uuugauuucacaaggccagu

SEQ ID NO: 672949 - RNA, 22 nt, Human
ggcuuccugggcauguguucua

SEQ ID NO: 672950 - RNA, 20 nt, Human
ccucaguguccuggacuggg

SEQ ID NO: 672951 - RNA, 22 nt, Human
gcucauccagcaagccagggcc

SEQ ID NO: 672952 - RNA, 20 nt, Human
uguuucuuuuaaugagcggc

SEQ ID NO: 672953 - RNA, 22 nt, Human
aaaagcaguuaucugggaggaa

SEQ ID NO: 672954 - RNA, 22 nt, Human
cugagguggcauccuagcucua

SEQ ID NO: 672955 - RNA, 22 nt, Human
ggaucuucagccagcaggugcc

SEQ ID NO: 672956 - RNA, 22 nt, Human
auuaauauccugcuggcuaaau

SEQ ID NO: 672957 - RNA, 22 nt, Human
gcccugugugaucacaugaaca

SEQ ID NO: 672958 - RNA, 22 nt, Human
cagcccagcagacuguuaccac

SEQ ID NO: 672959 - RNA, 22 nt, Human
acugaggcuuacaaagguaaag

SEQ ID NO: 672960 - RNA, 22 nt, Human
ccagagccuggcaucugcauaa

SEQ ID NO: 672961 - RNA, 22 nt, Human
gauucaaagacagacucauuuc

SEQ ID NO: 672962 - RNA, 22 nt, Human
uuuuauguaauaaacuguacac

SEQ ID NO: 672963 - RNA, 17 nt, Human
cugagccccgggcagcu

SEQ ID NO: 672964 - RNA, 22 nt, Human
gggaucugacuugcuggugggu

SEQ ID NO: 672965 - RNA, 22 nt, Human
accagcugccaagggcuacacu

SEQ ID NO: 672966 - RNA, 18 nt, Human
cucagagaugcccuuauu

SEQ ID NO: 672967 - RNA, 22 nt, Human
aauaugaauuauuguuacaagu

SEQ ID NO: 672968 - RNA, 22 nt, Human
auagcacuuauuguaugcugag

SEQ ID NO: 672969 - RNA, 22 nt, Human
gggaagguauuuagcugcugaa

SEQ ID NO: 672970 - RNA, 22 nt, Human
ccacugucagaggggcugugcc

SEQ ID NO: 672971 - RNA, 22 nt, Human
ccauuuuuaaagagcuuaagua

SEQ ID NO: 672972 - RNA, 22 nt, Human
ugcccccuuuucuuguuacacu

SEQ ID NO: 672973 - RNA, 22 nt, Human
gcagggaggaagagaugcuucc

SEQ ID NO: 672974 - RNA, 23 nt, Human
agccacuucuaucuugcuccugg

SEQ ID NO: 672975 - RNA, 22 nt, Human
uauguauaugguagaaguaugu

SEQ ID NO: 672976 - RNA, 22 nt, Human
uuuccuacccuuccaggcagag

SEQ ID NO: 672977 - RNA, 22 nt, Human
aggagacagaauuuaaauuugg

SEQ ID NO: 672978 - RNA, 17 nt, Human
gucaauauuguugacag

SEQ ID NO: 672979 - RNA, 22 nt, Human
aguuaaacuuugccagauggga

SEQ ID NO: 672980 - RNA, 22 nt, Human
cuauuagguaugugguugcuau

SEQ ID NO: 672981 - RNA, 22 nt, Human
uugagaaacaucuaaucuuugu

SEQ ID NO: 672982 - RNA, 22 nt, Human
acacauuauagagaguauaaua

SEQ ID NO: 672983 - RNA, 21 nt, Human
gcuuucuguggacucugcacc

SEQ ID NO: 672984 - RNA, 19 nt, Human
ucaugucucucaucuguga

SEQ ID NO: 672985 - RNA, 22 nt, Human
cugcagcaagagaagugcugac

SEQ ID NO: 672986 - RNA, 17 nt, Human
augugucuagugcaacc

SEQ ID NO: 672987 - RNA, 22 nt, Human
uggaggaaguugcuggaaguca

SEQ ID NO: 672988 - RNA, 22 nt, Human
acuagaaaguuuccagaguuau

SEQ ID NO: 672989 - RNA, 22 nt, Human
caggggaaggagccuugaaacu

SEQ ID NO: 672990 - RNA, 22 nt, Human
cucuggcacacuccuuccaggu

SEQ ID NO: 672991 - RNA, 22 nt, Human
gacaucauggagaggauaaaua

SEQ ID NO: 672992 - RNA, 22 nt, Human
ccacaucauggauacaguuaug

SEQ ID NO: 672993 - RNA, 22 nt, Human
gauucaaaaguuugagcuccaa

SEQ ID NO: 672994 - RNA, 22 nt, Human
guuugauucaagaacaaagagu

SEQ ID NO: 672995 - RNA, 23 nt, Human
ccaagacuguuaggaguggggag

SEQ ID NO: 672996 - RNA, 22 nt, Human
gugguccaaggaguuuccagca

SEQ ID NO: 672997 - RNA, 22 nt, Human
caagcuggagguuggagcuacu

SEQ ID NO: 672998 - RNA, 22 nt, Human
gcagcagugcuuuggaauccug

SEQ ID NO: 672999 - RNA, 22 nt, Human
gaguagaacuagaauucuucaa

SEQ ID NO: 673000 - RNA, 22 nt, Human
ucagcccaucacucacguauua

SEQ ID NO: 673001 - RNA, 22 nt, Human
agcugccucccugugcuugucc

SEQ ID NO: 673002 - RNA, 22 nt, Human
gcacauuucucaaagaauuguc

SEQ ID NO: 673003 - RNA, 23 nt, Human
agccucagccgguggcagaagug

SEQ ID NO: 673004 - RNA, 21 nt, Human
uaaauaauaaguugcugagau

SEQ ID NO: 673005 - RNA, 22 nt, Human
gccaagggggcagugcaugggu

SEQ ID NO: 673006 - RNA, 22 nt, Human
gagcucugacugcugggugaca

SEQ ID NO: 673007 - RNA, 20 nt, Human
uacaaagagccccucucuuc

SEQ ID NO: 673008 - RNA, 22 nt, Human
uggaggcagucaccugaaguca

SEQ ID NO: 673009 - RNA, 22 nt, Human
gucugaaaaugcccuacgauug

SEQ ID NO: 673010 - RNA, 22 nt, Human
gcccuggggaaggugucuccaa

SEQ ID NO: 673011 - RNA, 22 nt, Human
ggagauguagugucacuggacu

SEQ ID NO: 673012 - RNA, 22 nt, Human
agccaaaucuaaagugaauauu

SEQ ID NO: 673013 - RNA, 22 nt, Human
cccagcaguaaccaguggaaau

SEQ ID NO: 673014 - RNA, 22 nt, Human
ucaaagaacaucaucugaaaug

SEQ ID NO: 673015 - RNA, 22 nt, Human
gcugaauaggggucccaaagau

SEQ ID NO: 673016 - RNA, 22 nt, Human
gugcacagaaacauacaaugug

SEQ ID NO: 673017 - RNA, 22 nt, Human
gcaugucaugucauguaggaau

SEQ ID NO: 673018 - RNA, 22 nt, Human
agcacuagagccaaaauuuggg

SEQ ID NO: 673019 - RNA, 22 nt, Human
ugccagugaaacguggucucau

SEQ ID NO: 673020 - RNA, 22 nt, Human
acucugcuuauugcugcaggca

SEQ ID NO: 673021 - RNA, 20 nt, Human
ggaaggcuguuuuuccacca

SEQ ID NO: 673022 - RNA, 22 nt, Human
ggcaugggccgaggugccuccu

SEQ ID NO: 673023 - RNA, 22 nt, Human
ucaaauaugugauagaagcuaa

SEQ ID NO: 673024 - RNA, 22 nt, Human
ugcagaagcagagccgguggcc

SEQ ID NO: 673025 - RNA, 22 nt, Human
cucuggaagaauacacuuagaa

SEQ ID NO: 673026 - RNA, 22 nt, Human
gggucgggcaggcgcccucguc

SEQ ID NO: 673027 - RNA, 22 nt, Human
aaaauuauagaucuagugccug

SEQ ID NO: 673028 - RNA, 22 nt, Human
ucugcaggucacgcuccagccu

SEQ ID NO: 673029 - RNA, 22 nt, Human
caguggaaaucagagugagagu

SEQ ID NO: 673030 - RNA, 22 nt, Human
ccuggaaagcugcccugugaca

SEQ ID NO: 673031 - RNA, 22 nt, Human
ugaguucaaauuuuggcucugc

SEQ ID NO: 673032 - RNA, 21 nt, Human
gcaugccugcaucuuaguguu

SEQ ID NO: 673033 - RNA, 22 nt, Human
accucccagaaaguuuugcagg

SEQ ID NO: 673034 - RNA, 22 nt, Human
acagauaauuuaauuaaugcau

SEQ ID NO: 673035 - RNA, 22 nt, Human
uaguuucauaugcaaaauagua

SEQ ID NO: 673036 - RNA, 22 nt, Human
aaguaugcuaauuaacuagcac

SEQ ID NO: 673037 - RNA, 22 nt, Human
ucucuagagcaugugcugggca

SEQ ID NO: 673038 - RNA, 22 nt, Human
caaauagacuucaaucucuuga

SEQ ID NO: 673039 - RNA, 22 nt, Human
uuuccauauucugcgucugcca

SEQ ID NO: 673040 - RNA, 22 nt, Human
gcucucaaguccuuuugcucag

SEQ ID NO: 673041 - RNA, 22 nt, Human
cugucccauccuuacucuaccc

SEQ ID NO: 673042 - RNA, 22 nt, Human
cuguggcugcguaggucuggca

SEQ ID NO: 673043 - RNA, 22 nt, Human
auaugcauaugucaaaacuuau

SEQ ID NO: 673044 - RNA, 22 nt, Human
aaagaguucuaugaucuuucca

SEQ ID NO: 673045 - RNA, 22 nt, Human
uuucuguuuagcauaaaguggc

SEQ ID NO: 673046 - RNA, 22 nt, Human
aacaguuucaguuacugaugag

SEQ ID NO: 673047 - RNA, 22 nt, Human
cccagggcugcagauggaggcu

SEQ ID NO: 673048 - RNA, 22 nt, Human
auuuacuaaugucauaucgcgu

SEQ ID NO: 673049 - RNA, 22 nt, Human
auucugcaacuguuguuggugg

SEQ ID NO: 673050 - RNA, 22 nt, Human
ugcauuaagggccuggagauac

SEQ ID NO: 673051 - RNA, 22 nt, Human
gagguuuuaaguugaaggggga

SEQ ID NO: 673052 - RNA, 22 nt, Human
ucacagcuguuuuguccauuaa

SEQ ID NO: 673053 - RNA, 22 nt, Human
cagaaaggacuuugguuggcuu

SEQ ID NO: 673054 - RNA, 22 nt, Human
agucuggggucugguagaacga

SEQ ID NO: 673055 - RNA, 22 nt, Human
uaaggcacuucaauguuuagaa

SEQ ID NO: 673056 - RNA, 22 nt, Human
ucuuccagucuguaggacuagg

SEQ ID NO: 673057 - RNA, 22 nt, Human
cugagaaaaguaugagcucugg

SEQ ID NO: 673058 - RNA, 22 nt, Human
aguggcuggaauugcaggugcg

SEQ ID NO: 673059 - RNA, 22 nt, Human
auuucucacaaaguugcuuauc

SEQ ID NO: 673060 - RNA, 22 nt, Human
gcagagcuucuguccuucagga

SEQ ID NO: 673061 - RNA, 22 nt, Human
uauggcuugucccuggucaguc

SEQ ID NO: 673062 - RNA, 22 nt, Human
ggaagccaguugcuuggugugg

SEQ ID NO: 673063 - RNA, 22 nt, Human
ugagaaagugggugccuagcaa

SEQ ID NO: 673064 - RNA, 17 nt, Human
gcaucacagauaacacg

SEQ ID NO: 673065 - RNA, 22 nt, Human
agugugagaugauugaggagca

SEQ ID NO: 673066 - RNA, 22 nt, Human
uuauuccacagcucagaauuuu

SEQ ID NO: 673067 - RNA, 22 nt, Human
ugaagguggcauaggagagaug

SEQ ID NO: 673068 - RNA, 22 nt, Human
uggggccacagccuccuagcuu

SEQ ID NO: 673069 - RNA, 22 nt, Human
cuuauuuaaugaggguuagaau

SEQ ID NO: 673070 - RNA, 22 nt, Human
uguggaauguccucagcauccu

SEQ ID NO: 673071 - RNA, 22 nt, Human
cagucuccgccagcuccucaca

SEQ ID NO: 673072 - RNA, 22 nt, Human
gcacuugaucauuguuacagau

SEQ ID NO: 673073 - RNA, 22 nt, Human
auagaaauggcagcuggugcua

SEQ ID NO: 673074 - RNA, 22 nt, Human
cuggcauucuuguuucuggaaa

SEQ ID NO: 673075 - RNA, 22 nt, Human
uugcuugcccugcagcauacuu

SEQ ID NO: 673076 - RNA, 22 nt, Human
aacugaaacuuaggaaguaauc

SEQ ID NO: 673077 - RNA, 22 nt, Human
uccagauagaguccuguuagua

SEQ ID NO: 673078 - RNA, 22 nt, Human
caggugcuucuguaagaaagac

SEQ ID NO: 673079 - RNA, 22 nt, Human
gagcaagguagcucucuggggc

SEQ ID NO: 673080 - RNA, 22 nt, Human
gaggagcugaggcugaggccuc

SEQ ID NO: 673081 - RNA, 22 nt, Human
agcugauacauuucuuguagcc

SEQ ID NO: 673082 - RNA, 22 nt, Human
ugggccugauuuaucaucuuca

SEQ ID NO: 673083 - RNA, 18 nt, Human
agcagcugucagaaugcc

SEQ ID NO: 673084 - RNA, 22 nt, Human
ucuucaaguuccaaagugcagg

SEQ ID NO: 673085 - RNA, 22 nt, Human
gccagcccauuaaccccugucc

SEQ ID NO: 673086 - RNA, 22 nt, Human
gaaaaugccucuggcauuaaac

SEQ ID NO: 673087 - RNA, 22 nt, Human
ggcagacuuuuucucugaaggg

SEQ ID NO: 673088 - RNA, 22 nt, Human
aaccccaggcuggaggagucuc

SEQ ID NO: 673089 - RNA, 22 nt, Human
guuuccugacccuggcccagca

SEQ ID NO: 673090 - RNA, 22 nt, Human
gguaacacaggugcaguuuuaa

SEQ ID NO: 673091 - RNA, 22 nt, Human
ugugugcacuuaaugcaaucau

SEQ ID NO: 673092 - RNA, 22 nt, Human
ucagcuucuccaagugacaugg

SEQ ID NO: 673093 - RNA, 22 nt, Human
acauuucucagguaagucauuu

SEQ ID NO: 673094 - RNA, 22 nt, Human
acccaaagcaauauucaucagu

SEQ ID NO: 673095 - RNA, 22 nt, Human
agcagguggacagaggaagaaa

SEQ ID NO: 673096 - RNA, 22 nt, Human
gaguccugcccuuguguagucc

SEQ ID NO: 673097 - RNA, 22 nt, Human
uuucagaagucaacuagguaaa

SEQ ID NO: 673098 - RNA, 22 nt, Human
aguggcaggcagaagcuucuca

SEQ ID NO: 673099 - RNA, 22 nt, Human
cuggaaaaugaagaagcagagg

SEQ ID NO: 673100 - RNA, 17 nt, Human
ccuuccucaucuccuuc

SEQ ID NO: 673101 - RNA, 22 nt, Human
ugcauuuuacuuaccuguuagu

SEQ ID NO: 673102 - RNA, 22 nt, Human
agucacauggcagagagaaguu

SEQ ID NO: 673103 - RNA, 21 nt, Human
ugaggcucuguugugccugca

SEQ ID NO: 673104 - RNA, 22 nt, Human
gugcuugggggaaguaacagac

SEQ ID NO: 673105 - RNA, 20 nt, Human
uaugauaauuacaaaauagu

SEQ ID NO: 673106 - RNA, 21 nt, Human
cucugcugagcuccauuuuca

SEQ ID NO: 673107 - RNA, 22 nt, Human
gagcccaggaugguguauggcu

SEQ ID NO: 673108 - RNA, 22 nt, Human
gccagcuguucagacauucuuu

SEQ ID NO: 673109 - RNA, 22 nt, Human
gaggguccccaugcagagcuca

SEQ ID NO: 673110 - RNA, 22 nt, Human
cacaauuuuucuuagguccugg

SEQ ID NO: 673111 - RNA, 22 nt, Human
ggaugggagcagaggacgacca

SEQ ID NO: 673112 - RNA, 22 nt, Human
ugugaccucaucuuaacuggaa

SEQ ID NO: 673113 - RNA, 22 nt, Human
cacagucucuguugcugggacc

SEQ ID NO: 673114 - RNA, 22 nt, Human
uuugguuaaacgagagaacaua

SEQ ID NO: 673115 - RNA, 21 nt, Human
ugcuuugcucguucccagagu

SEQ ID NO: 673116 - RNA, 22 nt, Human
accugaaaauuauuauuuccgc

SEQ ID NO: 673117 - RNA, 20 nt, Human
ucucuauucccacgaggaaa

SEQ ID NO: 673118 - RNA, 22 nt, Human
aauggcaagagccacagaggcg

SEQ ID NO: 673119 - RNA, 22 nt, Human
aagcagaaaaacugagcuccaa

SEQ ID NO: 673120 - RNA, 22 nt, Human
ugugcagggaagggcaugcuau

SEQ ID NO: 673121 - RNA, 20 nt, Human
agguuccagccacaaccagc

SEQ ID NO: 673122 - RNA, 22 nt, Human
agaggcuccucggugccucgug

SEQ ID NO: 673123 - RNA, 22 nt, Human
cagcuuuagagaaaacauauuu

SEQ ID NO: 673124 - RNA, 22 nt, Human
auuguuuuaauuccauugugaa

SEQ ID NO: 673125 - RNA, 22 nt, Human
cuggccaggcauccccugaucc

SEQ ID NO: 673126 - RNA, 22 nt, Human
acccucaacaaauucacucuau

SEQ ID NO: 673127 - RNA, 22 nt, Human
guuauucuuuguaugguacauc

SEQ ID NO: 673128 - RNA, 22 nt, Human
gaugcacugcaguauauacugu

SEQ ID NO: 673129 - RNA, 22 nt, Human
gggcaggugaccucuuguccug

SEQ ID NO: 673130 - RNA, 22 nt, Human
gaaguuuagguucuuauguuua

SEQ ID NO: 673131 - RNA, 22 nt, Human
gggucaaggcuacauggagacc

SEQ ID NO: 673132 - RNA, 22 nt, Human
aacaaaccuggguggagaaagg

SEQ ID NO: 673133 - RNA, 22 nt, Human
gagauuggccuggcuugccaac

SEQ ID NO: 673134 - RNA, 22 nt, Human
aagccuuccugagugcaaggcc

SEQ ID NO: 673135 - RNA, 22 nt, Human
gacccaggggcagggagaaagu

SEQ ID NO: 673136 - RNA, 22 nt, Human
ugugccuucucaguccugcuca

SEQ ID NO: 673137 - RNA, 22 nt, Human
guccugugccgaggugggaagc

SEQ ID NO: 673138 - RNA, 22 nt, Human
uuccaaguuaggcgagcuggug

SEQ ID NO: 673139 - RNA, 22 nt, Human
ugugggccucagcaggacucca

SEQ ID NO: 673140 - RNA, 22 nt, Human
gaucuucuauguaaugaagugu

SEQ ID NO: 673141 - RNA, 22 nt, Human
agucuuaauagagaaaaacugu

SEQ ID NO: 673142 - RNA, 22 nt, Human
cagugcuguuguaagcucauug

SEQ ID NO: 673143 - RNA, 22 nt, Human
uugaaauagaugcgucagagau

SEQ ID NO: 673144 - RNA, 22 nt, Human
agagcuguauccccuuaccagu

SEQ ID NO: 673145 - RNA, 22 nt, Human
gcuugucucucagccccaguca

SEQ ID NO: 673146 - RNA, 22 nt, Human
aagauuucugcuccugagagaa

SEQ ID NO: 673147 - RNA, 22 nt, Human
cuuguaauggcagagaccuguc

SEQ ID NO: 673148 - RNA, 22 nt, Human
ucccaaagguccgagcgggaau

SEQ ID NO: 673149 - RNA, 22 nt, Human
auagcuuacaggugauaucagc

SEQ ID NO: 673150 - RNA, 21 nt, Human
ucucugugucuuuaagcugga

SEQ ID NO: 673151 - RNA, 22 nt, Human
agagucugugcuggggccagcu

SEQ ID NO: 673152 - RNA, 22 nt, Human
cagcuccccaugguuccugaag

SEQ ID NO: 673153 - RNA, 22 nt, Human
cccugcagcuuuugcauaguca

SEQ ID NO: 673154 - RNA, 22 nt, Human
ugaguccaccuuaguauauggg

SEQ ID NO: 673155 - RNA, 22 nt, Human
uguuuacacaauagucucucuc

SEQ ID NO: 673156 - RNA, 22 nt, Human
caguucuuaauaccaugugguu

SEQ ID NO: 673157 - RNA, 22 nt, Human
aaaaguuugugcaaacacucag

SEQ ID NO: 673158 - RNA, 22 nt, Human
caaugcacgcucagauuugacc

SEQ ID NO: 673159 - RNA, 22 nt, Human
ggcucagguuaccagucccucc

SEQ ID NO: 673160 - RNA, 22 nt, Human
gucugcuguggguccccaggag

SEQ ID NO: 673161 - RNA, 22 nt, Human
auggcucucuugaccuaggcac

SEQ ID NO: 673162 - RNA, 22 nt, Human
ucucaggcaugguuuguucauc

SEQ ID NO: 673163 - RNA, 22 nt, Human
acuccagguuuucucucaaguu

SEQ ID NO: 673164 - RNA, 22 nt, Human
gaagauuuggauuccaugucac

SEQ ID NO: 673165 - RNA, 23 nt, Human
aagcaugguucacaguuaguacu

SEQ ID NO: 673166 - RNA, 22 nt, Human
ucaguuuaagaugacuaacaau

SEQ ID NO: 673167 - RNA, 22 nt, Human
gacaagcaggcuccugaagaaa

SEQ ID NO: 673168 - RNA, 23 nt, Human
uuuagcaugaagcagcuggagaa

SEQ ID NO: 673169 - RNA, 22 nt, Human
aagccagauuucacucuuaauu

SEQ ID NO: 673170 - RNA, 22 nt, Human
agugucauaugccacugcaucc

SEQ ID NO: 673171 - RNA, 22 nt, Human
acuaacuucugagaaccaauug

SEQ ID NO: 673172 - RNA, 22 nt, Human
agaaagcagcauuuaugaucuc

SEQ ID NO: 673173 - RNA, 22 nt, Human
caugucuuauauccugucuuca

SEQ ID NO: 673174 - RNA, 22 nt, Human
aucaccuggccauuggguuaac

SEQ ID NO: 673175 - RNA, 22 nt, Human
ccugagcugcggggcagugcuc

SEQ ID NO: 673176 - RNA, 22 nt, Human
agacacaguauaagcacaacaa

SEQ ID NO: 673177 - RNA, 22 nt, Human
agcaucucuaaauccaguaagu

SEQ ID NO: 673178 - RNA, 22 nt, Human
aacuagaaagaacauauuucca

SEQ ID NO: 673179 - RNA, 22 nt, Human
guccucugcuucaugcccugau

SEQ ID NO: 673180 - RNA, 21 nt, Human
ggccuaggggcagauggugcu

SEQ ID NO: 673181 - RNA, 22 nt, Human
aucugcuguucuucacagcuug

SEQ ID NO: 673182 - RNA, 22 nt, Human
auuaguguguaggcuggaaaaa

SEQ ID NO: 673183 - RNA, 22 nt, Human
gcuggcucccagaggccccagc

SEQ ID NO: 673184 - RNA, 22 nt, Human
aggcuucaccagacucuuaauc

SEQ ID NO: 673185 - RNA, 22 nt, Human
gccagaaagaggaggaccuggg

SEQ ID NO: 673186 - RNA, 22 nt, Human
ccuuuggguucaaucucggucu

SEQ ID NO: 673187 - RNA, 21 nt, Human
gcucagaguauugcacuguuu

SEQ ID NO: 673188 - RNA, 21 nt, Human
aguuuucugaguuauaaaaua

SEQ ID NO: 673189 - RNA, 22 nt, Human
cuccagugcugucaucccuucc

SEQ ID NO: 673190 - RNA, 22 nt, Human
ugagggcuaaauuguggcaggu

SEQ ID NO: 673191 - RNA, 22 nt, Human
gcccuguguguuugcacugauu

SEQ ID NO: 673192 - RNA, 22 nt, Human
cuaauacucauuucuguaacuc

SEQ ID NO: 673193 - RNA, 22 nt, Human
cacauacauacguauguauaca

SEQ ID NO: 673194 - RNA, 18 nt, Human
uggaggaaaaaucucaug

SEQ ID NO: 673195 - RNA, 22 nt, Human
cagcaggaggcauggcuucccu

SEQ ID NO: 673196 - RNA, 22 nt, Human
agguggggcugggaaagauucc

SEQ ID NO: 673197 - RNA, 22 nt, Human
uuucagucuguaaaggugagga

SEQ ID NO: 673198 - RNA, 22 nt, Human
ugcagaugaaugcugagacacu

SEQ ID NO: 673199 - RNA, 22 nt, Human
cugcaaggcuggggugagcugg

SEQ ID NO: 673200 - RNA, 22 nt, Human
agaggccccaggugagcaugcc

SEQ ID NO: 673201 - RNA, 22 nt, Human
ucugggaacagccuggcugugu

SEQ ID NO: 673202 - RNA, 20 nt, Human
acuggacacugaggugagcu

SEQ ID NO: 673203 - RNA, 19 nt, Human
uuuggcacucugaaguguu

SEQ ID NO: 673204 - RNA, 22 nt, Human
aggggugaaggcccgauaggag

SEQ ID NO: 673205 - RNA, 22 nt, Human
agaugaaaagauaagcagcaau

SEQ ID NO: 673206 - RNA, 22 nt, Human
uauggcuuugaaagggcuuuuc

SEQ ID NO: 673207 - RNA, 22 nt, Human
ucagugacuggguauuaaauca

SEQ ID NO: 673208 - RNA, 22 nt, Human
uuuauaucuuaugucauuucaa

SEQ ID NO: 673209 - RNA, 22 nt, Human
ugggcucucaaagugcggcuug

SEQ ID NO: 673210 - RNA, 22 nt, Human
uguucaaaucuuuugcuuauuu

SEQ ID NO: 673211 - RNA, 22 nt, Human
gguuaaaaauaauuuacuuggc

SEQ ID NO: 673212 - RNA, 22 nt, Human
ugucugcucgggguucccaccu

SEQ ID NO: 673213 - RNA, 22 nt, Human
agccagcaggugcagaauucca

SEQ ID NO: 673214 - RNA, 22 nt, Human
cccaugagauucugaauuuggc

SEQ ID NO: 673215 - RNA, 22 nt, Human
agcagagguuuguuggaaaccu

SEQ ID NO: 673216 - RNA, 22 nt, Human
ugagccaggucucacucaccuu

SEQ ID NO: 673217 - RNA, 22 nt, Human
uagugcuuaauaaauuucagaa

SEQ ID NO: 673218 - RNA, 22 nt, Human
caucacaguuugucagaaauca

SEQ ID NO: 673219 - RNA, 22 nt, Human
ugucuuucugcaccaccucaca

SEQ ID NO: 673220 - RNA, 22 nt, Human
ccacagagacaggguccuugcu

SEQ ID NO: 673221 - RNA, 17 nt, Human
ugaaggaaggaugaugu

SEQ ID NO: 673222 - RNA, 22 nt, Human
guggcccuaacaccguuucuca

SEQ ID NO: 673223 - RNA, 22 nt, Human
gccuggagcucaugugggcauu

SEQ ID NO: 673224 - RNA, 22 nt, Human
caucuuuaguuauugaauauag

SEQ ID NO: 673225 - RNA, 22 nt, Human
uccagccaacugccuagggagc

SEQ ID NO: 673226 - RNA, 22 nt, Human
cucagcauggagggagaacaag

SEQ ID NO: 673227 - RNA, 22 nt, Human
cuacagacccaccuuggaagaa

SEQ ID NO: 673228 - RNA, 22 nt, Human
uagugcuugagucucuccguac

SEQ ID NO: 673229 - RNA, 22 nt, Human
cuucuuucccaggcauguuuua

SEQ ID NO: 673230 - RNA, 22 nt, Human
uagcuacacugaggcugcuuaa

SEQ ID NO: 673231 - RNA, 22 nt, Human
agagauccuucaaucuaguuuu

SEQ ID NO: 673232 - RNA, 22 nt, Human
caaccugaauucugcuuuggca

SEQ ID NO: 673233 - RNA, 22 nt, Human
cuuauguaaacuacagauaaua

SEQ ID NO: 673234 - RNA, 22 nt, Human
agcugcugggauacaguaguga

SEQ ID NO: 673235 - RNA, 22 nt, Human
ugcagugccucggcagugcagc

SEQ ID NO: 673236 - RNA, 22 nt, Human
gucacuuugaagcuguuuuuag

SEQ ID NO: 673237 - RNA, 22 nt, Human
uuuucuaauuuaguuacccucc

SEQ ID NO: 673238 - RNA, 22 nt, Human
ucuucaaagaagccuuggauua

SEQ ID NO: 673239 - RNA, 22 nt, Human
agcuggaauuacaggcacgcac

SEQ ID NO: 673240 - RNA, 22 nt, Human
gugaccagagcgggagauuggg

SEQ ID NO: 673241 - RNA, 22 nt, Human
acucacauuucaucaggccaag

SEQ ID NO: 673242 - RNA, 22 nt, Human
gcauuaauguaagacccacucc

SEQ ID NO: 673243 - RNA, 22 nt, Human
ccucuggggguccucagagucu

SEQ ID NO: 673244 - RNA, 22 nt, Human
gaguuagaagacagaauguaaa

SEQ ID NO: 673245 - RNA, 18 nt, Human
ucagagagaauaguaauu

SEQ ID NO: 673246 - RNA, 22 nt, Human
gcauucuuuccacgaggaggua

SEQ ID NO: 673247 - RNA, 22 nt, Human
uuaguaaauaaagucuacuuuc

SEQ ID NO: 673248 - RNA, 22 nt, Human
uggcauguuucauggcugcaaa

SEQ ID NO: 673249 - RNA, 22 nt, Human
cugcuuccaagaaagagauagg

SEQ ID NO: 673250 - RNA, 22 nt, Human
acugaggcagaaggguaagugg

SEQ ID NO: 673251 - RNA, 22 nt, Human
ccaggcguggcuucagcagccc

SEQ ID NO: 673252 - RNA, 22 nt, Human
aagcagcuuaaauuagagccug

SEQ ID NO: 673253 - RNA, 20 nt, Human
aggccccaggaaacucucag

SEQ ID NO: 673254 - RNA, 22 nt, Human
caaaugauaccuauuacuaggc

SEQ ID NO: 673255 - RNA, 22 nt, Human
uucugcagugugcagggccugu

SEQ ID NO: 673256 - RNA, 22 nt, Human
auccuggacaguuuccccuauu

SEQ ID NO: 673257 - RNA, 22 nt, Human
uugagaaauaagcaugucuaga

SEQ ID NO: 673258 - RNA, 22 nt, Human
uugcuugcagacuuagcaaauu

SEQ ID NO: 673259 - RNA, 22 nt, Human
auccaaauauauuuuauucacu

SEQ ID NO: 673260 - RNA, 22 nt, Human
uagggaugauggagccuaugua

SEQ ID NO: 673261 - RNA, 20 nt, Human
ucaggcuccgcauuaacuua

SEQ ID NO: 673262 - RNA, 22 nt, Human
uuccuggcucacagcagugggg

SEQ ID NO: 673263 - RNA, 22 nt, Human
uuccuucaaacgccuccugcac

SEQ ID NO: 673264 - RNA, 22 nt, Human
gguuaaaacugauauuaugggu

SEQ ID NO: 673265 - RNA, 22 nt, Human
aguagaaagaaggcacugggcc

SEQ ID NO: 673266 - RNA, 22 nt, Human
acagagcaaugcguguucucua

SEQ ID NO: 673267 - RNA, 22 nt, Human
cugggcgcguccccugaggcgg

SEQ ID NO: 673268 - RNA, 22 nt, Human
cccagcuugcccaggacugagg

SEQ ID NO: 673269 - RNA, 22 nt, Human
uuuucuucuaccugcuguccaa

SEQ ID NO: 673270 - RNA, 19 nt, Human
uucuuugaguucuucugag

SEQ ID NO: 673271 - RNA, 22 nt, Human
ggaaauguaaucacagaggguu

SEQ ID NO: 673272 - RNA, 22 nt, Human
ggaucuguuuugccucugaggg

SEQ ID NO: 673273 - RNA, 20 nt, Human
gcuggugggggcuugacaug

SEQ ID NO: 673274 - RNA, 22 nt, Human
cauuuguaauacugacuugcag

SEQ ID NO: 673275 - RNA, 22 nt, Human
uaggcacaaaaugaaaauggca

SEQ ID NO: 673276 - RNA, 22 nt, Human
agagcccuggagggcagucccg

SEQ ID NO: 673277 - RNA, 22 nt, Human
gcugcaccagcuccaccagggc

SEQ ID NO: 673278 - RNA, 22 nt, Human
augucugguggucgaugcuaca

SEQ ID NO: 673279 - RNA, 22 nt, Human
ccuggcagcaggugggcccgug

SEQ ID NO: 673280 - RNA, 22 nt, Human
uugaguucuguguauccuuugu

SEQ ID NO: 673281 - RNA, 22 nt, Human
ucagguggcuuggagggggacg

SEQ ID NO: 673282 - RNA, 22 nt, Human
agcaaugaccagugaucuugua

SEQ ID NO: 673283 - RNA, 22 nt, Human
gcaccuggcugcccagguggag

SEQ ID NO: 673284 - RNA, 22 nt, Human
aagugugucuggcggcccagug

SEQ ID NO: 673285 - RNA, 22 nt, Human
ucaguguucuuauuuaauuagg

SEQ ID NO: 673286 - RNA, 23 nt, Human
agccagggcacugguggagauug

SEQ ID NO: 673287 - RNA, 22 nt, Human
ccagccuccauguagauagcug

SEQ ID NO: 673288 - RNA, 22 nt, Human
cuuccccaaccccgacugugug

SEQ ID NO: 673289 - RNA, 22 nt, Human
ucacauugccgucugugcacuu

SEQ ID NO: 673290 - RNA, 22 nt, Human
uggcucagaaggcugccuucac

SEQ ID NO: 673291 - RNA, 22 nt, Human
gaggcuguuaggagggacucug

SEQ ID NO: 673292 - RNA, 22 nt, Human
aggcugugaguaguucuuguug

SEQ ID NO: 673293 - RNA, 22 nt, Human
ccuggccagcgccggcugcucg

SEQ ID NO: 673294 - RNA, 22 nt, Human
uugggcaaaguguuucuggagc

SEQ ID NO: 673295 - RNA, 17 nt, Human
ugccagccugucccagg

SEQ ID NO: 673296 - RNA, 22 nt, Human
ggcacagucccuggcacagagu

SEQ ID NO: 673297 - RNA, 22 nt, Human
aaaauuuugcccuauccuucau

SEQ ID NO: 673298 - RNA, 22 nt, Human
uguucugccagcacuucucagc

SEQ ID NO: 673299 - RNA, 23 nt, Human
cuugcaggaagcagauggcacac

SEQ ID NO: 673300 - RNA, 22 nt, Human
acacagugucagggcaggggcc

SEQ ID NO: 673301 - RNA, 21 nt, Human
ugaggcucaucuuauguggcu

SEQ ID NO: 673302 - RNA, 22 nt, Human
auucugggccccaucccagacc

SEQ ID NO: 673303 - RNA, 22 nt, Human
gcaagcugcuuaagcucauugu

SEQ ID NO: 673304 - RNA, 22 nt, Human
uguuuacuaugauguaaccuau

SEQ ID NO: 673305 - RNA, 22 nt, Human
caguuuaguaggugauaucaau

SEQ ID NO: 673306 - RNA, 22 nt, Human
cugggucugugcccagggaccu

SEQ ID NO: 673307 - RNA, 22 nt, Human
ccucucagccggacugucaggc

SEQ ID NO: 673308 - RNA, 19 nt, Human
agggaauccggcugaggga

SEQ ID NO: 673309 - RNA, 22 nt, Human
ugcuccagcgcugccaccaguu

SEQ ID NO: 673310 - RNA, 22 nt, Human
cuccaggaaagccugaggcccg

SEQ ID NO: 673311 - RNA, 22 nt, Human
gugggagaagauuuggucaucu

SEQ ID NO: 673312 - RNA, 21 nt, Human
gaaugucugccuucacaauga

SEQ ID NO: 673313 - RNA, 22 nt, Human
caggaaagagcugccaggcagg

SEQ ID NO: 673314 - RNA, 22 nt, Human
uacacuauuuuacugauacaaa

SEQ ID NO: 673315 - RNA, 22 nt, Human
ugaacauauucaccucuaaaua

SEQ ID NO: 673316 - RNA, 22 nt, Human
ggcuucaagucguauauuuggg

SEQ ID NO: 673317 - RNA, 22 nt, Human
aggcugccucuuuugagagggu

SEQ ID NO: 673318 - RNA, 22 nt, Human
aauucuauaggcaagcuauuuu

SEQ ID NO: 673319 - RNA, 22 nt, Human
gggagcugccaccaccccuggg

SEQ ID NO: 673320 - RNA, 22 nt, Human
uuuuccucuguuauuaguguga

SEQ ID NO: 673321 - RNA, 22 nt, Human
aguuacacaacuuaucacaucu

SEQ ID NO: 673322 - RNA, 22 nt, Human
ugaaagaaggguggaaaaugua

SEQ ID NO: 673323 - RNA, 22 nt, Human
agagaggcugggcguagggcuu

SEQ ID NO: 673324 - RNA, 22 nt, Human
uacuuguuaucaucuuuuccuu

SEQ ID NO: 673325 - RNA, 22 nt, Human
uggaaugaauuuggcuuccucc

SEQ ID NO: 673326 - RNA, 20 nt, Human
acacugugcuaaggauuuuc

SEQ ID NO: 673327 - RNA, 22 nt, Human
aagagcuggaguuugcagcccu

SEQ ID NO: 673328 - RNA, 22 nt, Human
gguauuuauaguggugcuuagu

SEQ ID NO: 673329 - RNA, 22 nt, Human
gugagaguaccaccucaacauc

SEQ ID NO: 673330 - RNA, 15 nt, Human
aggcacugugggacc

SEQ ID NO: 673331 - RNA, 22 nt, Human
aggcuugacugcugauuuugcc

SEQ ID NO: 673332 - RNA, 22 nt, Human
ugcugcucuguaaagugaugag

SEQ ID NO: 673333 - RNA, 22 nt, Human
aguucaaacucuauaagaacuu

SEQ ID NO: 673334 - RNA, 22 nt, Human
uuccagaguauugguagcuaua

SEQ ID NO: 673335 - RNA, 22 nt, Human
ucacagaaaaguggagagccua

SEQ ID NO: 673336 - RNA, 22 nt, Human
uaggaagaucaaguuuaucuca

SEQ ID NO: 673337 - RNA, 17 nt, Human
uuacaacaauucaugag

SEQ ID NO: 673338 - RNA, 20 nt, Human
agcaguuuccuaacucagcu

SEQ ID NO: 673339 - RNA, 22 nt, Human
ccucucccgggugccgcugggc

SEQ ID NO: 673340 - RNA, 22 nt, Human
ugauggaaauauugacaccaca

SEQ ID NO: 673341 - RNA, 22 nt, Human
ggcucugaacauggggaggagu

SEQ ID NO: 673342 - RNA, 22 nt, Human
uuggagccaugcccagcucucu

SEQ ID NO: 673343 - RNA, 20 nt, Human
gcuguguagcagugugcagu

SEQ ID NO: 673344 - RNA, 22 nt, Human
gucccucacuggaccauaugaa

SEQ ID NO: 673345 - RNA, 22 nt, Human
uggggaaaagcguuaggaguuc

SEQ ID NO: 673346 - RNA, 22 nt, Human
aguguauguccugaggggagaa

SEQ ID NO: 673347 - RNA, 22 nt, Human
ggucaugagggagcagugcagg

SEQ ID NO: 673348 - RNA, 20 nt, Human
uuucacuggcuugauaaggu

SEQ ID NO: 673349 - RNA, 22 nt, Human
agaaacaucauuggaacacaag

SEQ ID NO: 673350 - RNA, 22 nt, Human
ucauugaauauggggccauaca

SEQ ID NO: 673351 - RNA, 22 nt, Human
cagcucaguuucaauaccaggu

SEQ ID NO: 673352 - RNA, 22 nt, Human
cugcagagcaaguucucuguug

SEQ ID NO: 673353 - RNA, 22 nt, Human
cagaaacuuucuuuacugagca

SEQ ID NO: 673354 - RNA, 22 nt, Human
gucuuucuaugcauagagcaga

SEQ ID NO: 673355 - RNA, 22 nt, Human
gccacugcacuccagcccaggc

SEQ ID NO: 673356 - RNA, 22 nt, Human
ccaguguggccaggugcuggua

SEQ ID NO: 673357 - RNA, 22 nt, Human
cuccuggcacucaguguggaag

SEQ ID NO: 673358 - RNA, 22 nt, Human
cugccucuggccucaggcccag

SEQ ID NO: 673359 - RNA, 22 nt, Human
uguaacugcuuagaagguuuua

SEQ ID NO: 673360 - RNA, 22 nt, Human
gcacacagccagcugagggcua

SEQ ID NO: 673361 - RNA, 22 nt, Human
caggcugcaagaaaggcauuca

SEQ ID NO: 673362 - RNA, 22 nt, Human
uucuggaagauaccucuccuaa

SEQ ID NO: 673363 - RNA, 22 nt, Human
ccacuguagagauuugaaugcc

SEQ ID NO: 673364 - RNA, 22 nt, Human
aagucaaaccuugcucacagga

SEQ ID NO: 673365 - RNA, 22 nt, Human
cuggacuuuggcccaucugcca

SEQ ID NO: 673366 - RNA, 22 nt, Human
gaugauuuucuguguuagaaga

SEQ ID NO: 673367 - RNA, 21 nt, Human
acagcuggugcagggcgggga

SEQ ID NO: 673368 - RNA, 22 nt, Human
ccacugugcccagccucauggg

SEQ ID NO: 673369 - RNA, 22 nt, Human
aacacaggggcguggcucuuac

SEQ ID NO: 673370 - RNA, 22 nt, Human
cagcuugcuaauuuugacuuca

SEQ ID NO: 673371 - RNA, 22 nt, Human
uucauaggaaauaguguucuuu

SEQ ID NO: 673372 - RNA, 22 nt, Human
uccugcagcugcagaccugggg

SEQ ID NO: 673373 - RNA, 21 nt, Human
uuucuggguggcugcauagug

SEQ ID NO: 673374 - RNA, 22 nt, Human
ucuccugguuuguuaaauaauu

SEQ ID NO: 673375 - RNA, 22 nt, Human
gcuccaggauaauaaaguuguu

SEQ ID NO: 673376 - RNA, 22 nt, Human
aggcuuaaaugcucauaucagu

SEQ ID NO: 673377 - RNA, 22 nt, Human
gugaaugcaaacuguuucugau

SEQ ID NO: 673378 - RNA, 22 nt, Human
augauggagguguccuggauuu

SEQ ID NO: 673379 - RNA, 21 nt, Human
gucagggauucaagugcucac

SEQ ID NO: 673380 - RNA, 22 nt, Human
cuucaugacccauaaaaauuua

SEQ ID NO: 673381 - RNA, 22 nt, Human
cauuucaauuauuugcucuucu

SEQ ID NO: 673382 - RNA, 22 nt, Human
ugcuaggagaggcagcacagcg

SEQ ID NO: 673383 - RNA, 22 nt, Human
cugccaccaaauagcugcauga

SEQ ID NO: 673384 - RNA, 22 nt, Human
aggaggccuacgcacaugucua

SEQ ID NO: 673385 - RNA, 22 nt, Human
gucaguaggaaccuagggucaa

SEQ ID NO: 673386 - RNA, 22 nt, Human
aaugcaccuuggcagggauuca

SEQ ID NO: 673387 - RNA, 22 nt, Human
acauuucuuccuaauuaucccu

SEQ ID NO: 673388 - RNA, 22 nt, Human
gguggcagagacauaggacaua

SEQ ID NO: 673389 - RNA, 22 nt, Human
cauguaaaaagaagaaucugga

SEQ ID NO: 673390 - RNA, 22 nt, Human
ucaggagauguaaccuuagcug

SEQ ID NO: 673391 - RNA, 22 nt, Human
cuggccuggggggacacauccc

SEQ ID NO: 673392 - RNA, 22 nt, Human
cuuccaaacccaggguaugggc

SEQ ID NO: 673393 - RNA, 22 nt, Human
ucucauuuggcuuuguuuuaaa

SEQ ID NO: 673394 - RNA, 22 nt, Human
uagugcuuuaggccugaguguc

SEQ ID NO: 673395 - RNA, 23 nt, Human
ggccucagcgcacagaaacugcu

SEQ ID NO: 673396 - RNA, 22 nt, Human
aauaugcaaagcguguuaucug

SEQ ID NO: 673397 - RNA, 22 nt, Human
aaggaagguacucagugauucu

SEQ ID NO: 673398 - RNA, 22 nt, Human
ugagaaucagcugcacagaggu

SEQ ID NO: 673399 - RNA, 22 nt, Human
ucacugggcccugaggugggac

SEQ ID NO: 673400 - RNA, 22 nt, Human
agcaaagaaauggaggcucaga

SEQ ID NO: 673401 - RNA, 22 nt, Human
gaggcuggagauauuccaaucu

SEQ ID NO: 673402 - RNA, 22 nt, Human
aucuuuacuuucagugcugagc

SEQ ID NO: 673403 - RNA, 19 nt, Human
uccaggagcaaagccaguu

SEQ ID NO: 673404 - RNA, 22 nt, Human
uaacuucaaaauugccacaugu

SEQ ID NO: 673405 - RNA, 22 nt, Human
aaagaacagauguguggugcau

SEQ ID NO: 673406 - RNA, 22 nt, Human
cucugggcuccuucagcccuuu

SEQ ID NO: 673407 - RNA, 22 nt, Human
agcaagcugucaagagagcuga

SEQ ID NO: 673408 - RNA, 22 nt, Human
acauugaagggaaugcaaagau

SEQ ID NO: 673409 - RNA, 22 nt, Human
ccagggaaacagcccaguguga

SEQ ID NO: 673410 - RNA, 22 nt, Human
ucacaaauauagugagaaccag

SEQ ID NO: 673411 - RNA, 22 nt, Human
uccugggauuugcccuuuucuc

SEQ ID NO: 673412 - RNA, 20 nt, Human
aacagggcagaagcggagac

SEQ ID NO: 673413 - RNA, 22 nt, Human
ucagggcaagauugguuaauaa

SEQ ID NO: 673414 - RNA, 22 nt, Human
ugccugugugaccacgggcaag

SEQ ID NO: 673415 - RNA, 22 nt, Human
cagugggcugugauggauucac

SEQ ID NO: 673416 - RNA, 22 nt, Human
acuaggggcucaggcccaggga

SEQ ID NO: 673417 - RNA, 22 nt, Human
uuucagugcuucuguuuaccgg

SEQ ID NO: 673418 - RNA, 22 nt, Human
ggguggggccaggcaauuugca

SEQ ID NO: 673419 - RNA, 22 nt, Human
ggaguugguggcccggaaucuc

SEQ ID NO: 673420 - RNA, 22 nt, Human
ccagucugcugugguaggaaga

SEQ ID NO: 673421 - RNA, 22 nt, Human
uauucaagauugaacuggcaga

SEQ ID NO: 673422 - RNA, 22 nt, Human
uggcugagagucauccugugug

SEQ ID NO: 673423 - RNA, 22 nt, Human
uucucucauucaaauuaaagug

SEQ ID NO: 673424 - RNA, 22 nt, Human
ccagauagcaggucagaagugc

SEQ ID NO: 673425 - RNA, 22 nt, Human
ugcagagcuucauugcauaggc

SEQ ID NO: 673426 - RNA, 22 nt, Human
gaaaggggcauguagggaucac

SEQ ID NO: 673427 - RNA, 22 nt, Human
gggugggacucuuuggccugag

SEQ ID NO: 673428 - RNA, 20 nt, Human
uuucugugauagagaggugu

SEQ ID NO: 673429 - RNA, 22 nt, Human
ccuguugcucugcaugaguuua

SEQ ID NO: 673430 - RNA, 22 nt, Human
auauuaggcaaggagauuauuu

SEQ ID NO: 673431 - RNA, 22 nt, Human
aagaacaugaaccucuucuaac

SEQ ID NO: 673432 - RNA, 23 nt, Human
aucauucuccaaucuggagcagg

SEQ ID NO: 673433 - RNA, 22 nt, Human
ucacagaaugucuagcauaauu

SEQ ID NO: 673434 - RNA, 18 nt, Human
gagagggaucccucagga

SEQ ID NO: 673435 - RNA, 22 nt, Human
gggcuucaggguacuuccuccu

SEQ ID NO: 673436 - RNA, 22 nt, Human
gggucugagcugaggggaaauc

SEQ ID NO: 673437 - RNA, 23 nt, Human
gaacagacauuagugagccaggc

SEQ ID NO: 673438 - RNA, 22 nt, Human
ggccugcuucucagugagcuug

SEQ ID NO: 673439 - RNA, 22 nt, Human
ugggagaagcauggggugcaga

SEQ ID NO: 673440 - RNA, 21 nt, Human
auucagaguaauucaucuuua

SEQ ID NO: 673441 - RNA, 22 nt, Human
agccacagucaaccuguccaua

SEQ ID NO: 673442 - RNA, 22 nt, Human
cugguggggaguccuggucucc

SEQ ID NO: 673443 - RNA, 22 nt, Human
cagacuggccacaucugcacug

SEQ ID NO: 673444 - RNA, 21 nt, Human
acagccuugugauggagacag

SEQ ID NO: 673445 - RNA, 16 nt, Human
cucagcuaaggagagg

SEQ ID NO: 673446 - RNA, 22 nt, Human
uucagaaaaagaccauugcaau

SEQ ID NO: 673447 - RNA, 22 nt, Human
auucaaguggcugcuauguuaa

SEQ ID NO: 673448 - RNA, 22 nt, Human
uuguuuucacagcuuugcccgg

SEQ ID NO: 673449 - RNA, 22 nt, Human
agguggccaagacuguuugaca

SEQ ID NO: 673450 - RNA, 22 nt, Human
ucauggggugaauuaguaugcu

SEQ ID NO: 673451 - RNA, 22 nt, Human
caucaucuugaaugacugugau

SEQ ID NO: 673452 - RNA, 22 nt, Human
agcagaaauagaagucaaugau

SEQ ID NO: 673453 - RNA, 23 nt, Human
gguggcaggaguggaugcugagc

SEQ ID NO: 673454 - RNA, 22 nt, Human
ucagaggucagcagcuugccca

SEQ ID NO: 673455 - RNA, 22 nt, Human
uggcucaggugugagcugaaga

SEQ ID NO: 673456 - RNA, 22 nt, Human
ucauggaaacagcaaugcuaau

SEQ ID NO: 673457 - RNA, 22 nt, Human
ggugaauaagcugaacacuugg

SEQ ID NO: 673458 - RNA, 22 nt, Human
aauguuugaacuuugcauauuu

SEQ ID NO: 673459 - RNA, 22 nt, Human
aucuguguguucaggaaguccu

SEQ ID NO: 673460 - RNA, 22 nt, Human
agugucuguguuuucuauugcu

SEQ ID NO: 673461 - RNA, 22 nt, Human
aaggcugacucaacagggggcc

SEQ ID NO: 673462 - RNA, 22 nt, Human
uaguaaguagcuaauauuuacu

SEQ ID NO: 673463 - RNA, 22 nt, Human
cucuggagggaggcugagcugg

SEQ ID NO: 673464 - RNA, 22 nt, Human
auagaauuuguacuuguagaac

SEQ ID NO: 673465 - RNA, 22 nt, Human
auugacaacccugguaugagca

SEQ ID NO: 673466 - RNA, 22 nt, Human
agugcuccugaagcuugaggca

SEQ ID NO: 673467 - RNA, 22 nt, Human
ugugccugauggucacguggcc

SEQ ID NO: 673468 - RNA, 22 nt, Human
uguauagaguuggaagaugacu

SEQ ID NO: 673469 - RNA, 22 nt, Human
uguuuaugugugugcauauaua

SEQ ID NO: 673470 - RNA, 22 nt, Human
aagaacauaacagaagcugugu

SEQ ID NO: 673471 - RNA, 22 nt, Human
cuucucagucaccugugagucu

SEQ ID NO: 673472 - RNA, 22 nt, Human
agcccaugcaacaggccuagcg

SEQ ID NO: 673473 - RNA, 22 nt, Human
gagagguacacccuuuaaacuu

SEQ ID NO: 673474 - RNA, 22 nt, Human
gggggacaggaugaauaucugu

SEQ ID NO: 673475 - RNA, 20 nt, Human
cagcucugggaaagaggcca

SEQ ID NO: 673476 - RNA, 19 nt, Human
uuuuccuucuccucuuaau

SEQ ID NO: 673477 - RNA, 22 nt, Human
ucugggcugcugugcagugacc

SEQ ID NO: 673478 - RNA, 20 nt, Human
acuuucucgguuucucaccu

SEQ ID NO: 673479 - RNA, 22 nt, Human
gccaaccauuggcuucuuguca

SEQ ID NO: 673480 - RNA, 22 nt, Human
uucugggcuugaaaguuuaaua

SEQ ID NO: 673481 - RNA, 22 nt, Human
uaggucucucuucuugauggga

SEQ ID NO: 673482 - RNA, 19 nt, Human
ugagauuucuuaggugauu

SEQ ID NO: 673483 - RNA, 22 nt, Human
cugcagagaccuaggucagguu

SEQ ID NO: 673484 - RNA, 22 nt, Human
uagcccagcucaaaugaccggu

SEQ ID NO: 673485 - RNA, 22 nt, Human
ugcccugguuacacuggagucc

SEQ ID NO: 673486 - RNA, 22 nt, Human
aaaguucagugccuucuauaca

SEQ ID NO: 673487 - RNA, 22 nt, Human
cuuauuuaugucugucucuaau

SEQ ID NO: 673488 - RNA, 23 nt, Human
aggccagcgcagacaccgagcac

SEQ ID NO: 673489 - RNA, 22 nt, Human
uaagaucaguucaaacaugugu

SEQ ID NO: 673490 - RNA, 22 nt, Human
uacugugucuuaggauguggaa

SEQ ID NO: 673491 - RNA, 22 nt, Human
uuauuccagguacuugguuucu

SEQ ID NO: 673492 - RNA, 22 nt, Human
ggauccuucuuugaccucacag

SEQ ID NO: 673493 - RNA, 19 nt, Human
aaggggugagggaagcaga

SEQ ID NO: 673494 - RNA, 22 nt, Human
ucuaaagagaaccuuuucucau

SEQ ID NO: 673495 - RNA, 22 nt, Human
aaacugugagcuaguaaauagg

SEQ ID NO: 673496 - RNA, 22 nt, Human
cagcugcaggagcugagcacuu

SEQ ID NO: 673497 - RNA, 22 nt, Human
aagagcagauuccuaguggagc

SEQ ID NO: 673498 - RNA, 22 nt, Human
agcuggguguguaucagauaaa

SEQ ID NO: 673499 - RNA, 22 nt, Human
uaguauauuuuguugcaauuca

SEQ ID NO: 673500 - RNA, 22 nt, Human
aguggaaggucaggggacagug

SEQ ID NO: 673501 - RNA, 22 nt, Human
auggcuggugauacuggaguga

SEQ ID NO: 673502 - RNA, 22 nt, Human
ugaucaaauucaggagucugga

SEQ ID NO: 673503 - RNA, 22 nt, Human
cagcaguacuucucagagguau

SEQ ID NO: 673504 - RNA, 22 nt, Human
accaggccuggcugggcagcca

SEQ ID NO: 673505 - RNA, 22 nt, Human
gcuccucuucucccacugaaug

SEQ ID NO: 673506 - RNA, 22 nt, Human
uugcauuucacuuucaguaggc

SEQ ID NO: 673507 - RNA, 22 nt, Human
acagggccaggugagaggugcu

SEQ ID NO: 673508 - RNA, 22 nt, Human
aucaguuucuaccauguggaau

SEQ ID NO: 673509 - RNA, 22 nt, Human
agcgugaaggcgggcagucggc

SEQ ID NO: 673510 - RNA, 22 nt, Human
uuuaagacuuaggaaagaggau

SEQ ID NO: 673511 - RNA, 22 nt, Human
ucugcaggagagugcccuagag

SEQ ID NO: 673512 - RNA, 22 nt, Human
cucagggaggagcuucugggcc

SEQ ID NO: 673513 - RNA, 22 nt, Human
cagagcuugaauguccaugguu

SEQ ID NO: 673514 - RNA, 22 nt, Human
cagguuggggacuuaggaugac

SEQ ID NO: 673515 - RNA, 22 nt, Human
cuccaggacacuaacccaggcu

SEQ ID NO: 673516 - RNA, 22 nt, Human
cagugaaauaguggacaucaaa

SEQ ID NO: 673517 - RNA, 21 nt, Human
ggcugagauggcagaaucacc

SEQ ID NO: 673518 - RNA, 22 nt, Human
aaccaggacaauuugaauagaa

SEQ ID NO: 673519 - RNA, 22 nt, Human
ccagcccugucaccaacuggag

SEQ ID NO: 673520 - RNA, 21 nt, Human
acaggcuuuagaaaaugacuc

SEQ ID NO: 673521 - RNA, 23 nt, Human
uucuccugaggaagcagggacug

SEQ ID NO: 673522 - RNA, 22 nt, Human
agaccuggauuccaauccuacc

SEQ ID NO: 673523 - RNA, 22 nt, Human
auucucuguagauggcuugaga

SEQ ID NO: 673524 - RNA, 22 nt, Human
agacauagauaggcacugauug

SEQ ID NO: 673525 - RNA, 22 nt, Human
uggcaguggauaggggagcggu

SEQ ID NO: 673526 - RNA, 22 nt, Human
uguuuccauggugacagcagcu

SEQ ID NO: 673527 - RNA, 22 nt, Human
caccagagugaguggacugucg

SEQ ID NO: 673528 - RNA, 22 nt, Human
ccaggggaaacagggagcacuc

SEQ ID NO: 673529 - RNA, 22 nt, Human
uauggguaucaaugacaaacau

SEQ ID NO: 673530 - RNA, 22 nt, Human
uccacagcuguccuguaacagg

SEQ ID NO: 673531 - RNA, 22 nt, Human
acagccugcugccugcuucuug

SEQ ID NO: 673532 - RNA, 22 nt, Human
cuccugggaaaugaaggggcag

SEQ ID NO: 673533 - RNA, 22 nt, Human
cacaugaguccugccagguaug

SEQ ID NO: 673534 - RNA, 22 nt, Human
caggaucccuggccuccgccca

SEQ ID NO: 673535 - RNA, 22 nt, Human
gggcccaguacccucugccaag

SEQ ID NO: 673536 - RNA, 22 nt, Human
aggcagcuuaagcccuggccca

SEQ ID NO: 673537 - RNA, 22 nt, Human
uuccaaaguuaguuauuagaaa

SEQ ID NO: 673538 - RNA, 22 nt, Human
ucuggagaccuagcccuguugu

SEQ ID NO: 673539 - RNA, 22 nt, Human
acugucuguacuucuugcaagg

SEQ ID NO: 673540 - RNA, 22 nt, Human
aggcugugggugauuuacugug

SEQ ID NO: 673541 - RNA, 22 nt, Human
guuuacuuuucauggagcauau

SEQ ID NO: 673542 - RNA, 22 nt, Human
cugagauggaguuucgcucuuc

SEQ ID NO: 673543 - RNA, 22 nt, Human
uagcagaguuugguaccugggg

SEQ ID NO: 673544 - RNA, 22 nt, Human
ucaggcugcagcugucagcagc

SEQ ID NO: 673545 - RNA, 22 nt, Human
acacacuucagauguaauuugu

SEQ ID NO: 673546 - RNA, 23 nt, Human
agugccagggagaucaggacgga

SEQ ID NO: 673547 - RNA, 18 nt, Human
ugaggcugaggguagagg

SEQ ID NO: 673548 - RNA, 22 nt, Human
aagugcauaaguaugauuauuu

SEQ ID NO: 673549 - RNA, 22 nt, Human
acagaaauucugggacagaaaa

SEQ ID NO: 673550 - RNA, 22 nt, Human
cuguggcugcgccaucgaaaac

SEQ ID NO: 673551 - RNA, 22 nt, Human
ggcagcagaccccuaagucuac

SEQ ID NO: 673552 - RNA, 22 nt, Human
agaacauuaaugcgagguauua

SEQ ID NO: 673553 - RNA, 22 nt, Human
gaaguucucagcuaggugaugu

SEQ ID NO: 673554 - RNA, 22 nt, Human
gggcugcuuauacugaugauaa

SEQ ID NO: 673555 - RNA, 22 nt, Human
auaaguguuagguaaacaucuu

SEQ ID NO: 673556 - RNA, 22 nt, Human
ucuagaaaaccaauauuacaug

SEQ ID NO: 673557 - RNA, 22 nt, Human
auuuuccuagucaugugcuucu

SEQ ID NO: 673558 - RNA, 22 nt, Human
gaagccagauuuggggcauauc

SEQ ID NO: 673559 - RNA, 22 nt, Human
aaugaauaccguuucacucagu

SEQ ID NO: 673560 - RNA, 22 nt, Human
uucuucaauaaauucccauaag

SEQ ID NO: 673561 - RNA, 22 nt, Human
cacaaauggccguguucaaaga

SEQ ID NO: 673562 - RNA, 22 nt, Human
uacagcaaugccugaaauagua

SEQ ID NO: 673563 - RNA, 22 nt, Human
uuacaaugggagcccuuggacu

SEQ ID NO: 673564 - RNA, 22 nt, Human
cagggugccuguccucagcaaa

SEQ ID NO: 673565 - RNA, 22 nt, Human
uggcaguccagacccuggacuc

SEQ ID NO: 673566 - RNA, 22 nt, Human
gacagcuuaggaaguuucuauu

SEQ ID NO: 673567 - RNA, 22 nt, Human
ugauucugcuuugauccuugug

SEQ ID NO: 673568 - RNA, 22 nt, Human
augcacagcagugaguucagug

SEQ ID NO: 673569 - RNA, 22 nt, Human
augcauuguaacgaugugcaca

SEQ ID NO: 673570 - RNA, 22 nt, Human
uggcugagccacuuguucagau

SEQ ID NO: 673571 - RNA, 22 nt, Human
uuuguaagagcauauguaaagg

SEQ ID NO: 673572 - RNA, 22 nt, Human
agggagcuucuacuucaaggca

SEQ ID NO: 673573 - RNA, 22 nt, Human
uaccuggagcaggaggcagaau

SEQ ID NO: 673574 - RNA, 22 nt, Human
ggcuggguuauuuauggccaag

SEQ ID NO: 673575 - RNA, 22 nt, Human
uugcagggcaucgcguacuucu

SEQ ID NO: 673576 - RNA, 23 nt, Human
agcacuuguaucuuacuaaaaug

SEQ ID NO: 673577 - RNA, 22 nt, Human
ugcugaaagaccguauuuaucu

SEQ ID NO: 673578 - RNA, 22 nt, Human
uugaucugccucauucuuguuc

SEQ ID NO: 673579 - RNA, 22 nt, Human
gaggcccagagagguugcauga

SEQ ID NO: 673580 - RNA, 22 nt, Human
aggcaccaguaagaguagaacu

SEQ ID NO: 673581 - RNA, 22 nt, Human
uagacuauuucuuuugcauagg

SEQ ID NO: 673582 - RNA, 22 nt, Human
caggguugggcuccaaggaugg

SEQ ID NO: 673583 - RNA, 17 nt, Human
ugccuccagcaggguga

SEQ ID NO: 673584 - RNA, 22 nt, Human
ggcugcugggucaugaugcaga

SEQ ID NO: 673585 - RNA, 22 nt, Human
agcugccccgaggcggcgggaa

SEQ ID NO: 673586 - RNA, 22 nt, Human
agacugggguucuggcaaggag

SEQ ID NO: 673587 - RNA, 22 nt, Human
guuuccuauguccauugaggga

SEQ ID NO: 673588 - RNA, 22 nt, Human
gaacacauguccuccuuggauu

SEQ ID NO: 673589 - RNA, 22 nt, Human
gaaggccauugcguccugggau

SEQ ID NO: 673590 - RNA, 22 nt, Human
ucacagagaaauguggcacaaa

SEQ ID NO: 673591 - RNA, 22 nt, Human
guuuacaguacucacuugcauu

SEQ ID NO: 673592 - RNA, 22 nt, Human
gaugcugugguaagccccaccg

SEQ ID NO: 673593 - RNA, 22 nt, Human
cuuuaguuugcuguccccuggg

SEQ ID NO: 673594 - RNA, 22 nt, Human
uacauacacaaauauacuguuu

SEQ ID NO: 673595 - RNA, 22 nt, Human
acccagggcagccagcggggag

SEQ ID NO: 673596 - RNA, 22 nt, Human
uggaagcacuuggguuuuguug

SEQ ID NO: 673597 - RNA, 22 nt, Human
ugguccugagaauccuguccuc

SEQ ID NO: 673598 - RNA, 22 nt, Human
cacacaggaaaauuggaauuaa

SEQ ID NO: 673599 - RNA, 22 nt, Human
caggucuggugagagaacaguu

SEQ ID NO: 673600 - RNA, 22 nt, Human
cggcuucagcucaggccccucg

SEQ ID NO: 673601 - RNA, 22 nt, Human
ccugaaaauauccucuccuuug

SEQ ID NO: 673602 - RNA, 21 nt, Human
uuuguucauagcucacucuuu

SEQ ID NO: 673603 - RNA, 22 nt, Human
ugauggaauauaccuucgggag

SEQ ID NO: 673604 - RNA, 22 nt, Human
gugacagaaacagggcuagaau

SEQ ID NO: 673605 - RNA, 19 nt, Human
ccugcagggaugagagguu

SEQ ID NO: 673606 - RNA, 22 nt, Human
ugcacacagaugguacaugcau

SEQ ID NO: 673607 - RNA, 22 nt, Human
acucuucacacuugucuccagg

SEQ ID NO: 673608 - RNA, 20 nt, Human
agcaguguuucuugacucua

SEQ ID NO: 673609 - RNA, 22 nt, Human
agccacagcuccuugguggaga

SEQ ID NO: 673610 - RNA, 22 nt, Human
auucuucauuuacuguuacuug

SEQ ID NO: 673611 - RNA, 22 nt, Human
ucauccaucuuugauuucauag

SEQ ID NO: 673612 - RNA, 22 nt, Human
uaaagaacacagggaauagcac

SEQ ID NO: 673613 - RNA, 22 nt, Human
gccacucaugggaggugugcaa

SEQ ID NO: 673614 - RNA, 22 nt, Human
uggcuccuaggauggugccugg

SEQ ID NO: 673615 - RNA, 22 nt, Human
agcugaggcucugagagggaag

SEQ ID NO: 673616 - RNA, 22 nt, Human
ucagagugugagacauauugga

SEQ ID NO: 673617 - RNA, 22 nt, Human
uuuauguuauggguaggaucaa

SEQ ID NO: 673618 - RNA, 22 nt, Human
auucaguauucugcugcauaau

SEQ ID NO: 673619 - RNA, 22 nt, Human
ccucuccaguuuuaacgugacc

SEQ ID NO: 673620 - RNA, 22 nt, Human
uuucugucugacaucccugccu

SEQ ID NO: 673621 - RNA, 22 nt, Human
aggagagagcugagcuuugcug

SEQ ID NO: 673622 - RNA, 22 nt, Human
agaggcccuggcuagagcagcu

SEQ ID NO: 673623 - RNA, 22 nt, Human
ccacaucucgguccccucuuug

SEQ ID NO: 673624 - RNA, 22 nt, Human
auuuaguuuaggaaaaguaggu

SEQ ID NO: 673625 - RNA, 22 nt, Human
cugccugccacguucagcugua

SEQ ID NO: 673626 - RNA, 22 nt, Human
ccaucagugaaggagacagauu

SEQ ID NO: 673627 - RNA, 22 nt, Human
guuuuggcucuggcauguggaa

SEQ ID NO: 673628 - RNA, 22 nt, Human
ugcuggagagccuuggccaagg

SEQ ID NO: 673629 - RNA, 22 nt, Human
agcuggcuuuaugguuggcuaa

SEQ ID NO: 673630 - RNA, 22 nt, Human
ugucugaaacuugguccuaugc

SEQ ID NO: 673631 - RNA, 23 nt, Human
acuauaaaguuguucugauuuac

SEQ ID NO: 673632 - RNA, 22 nt, Human
uccagccaugacucggacagug

SEQ ID NO: 673633 - RNA, 22 nt, Human
gcaggaaucuaacccaaggaga

SEQ ID NO: 673634 - RNA, 22 nt, Human
cagcucugagacugaggcuaug

SEQ ID NO: 673635 - RNA, 22 nt, Human
gcuuccuacaugugucugcgag

SEQ ID NO: 673636 - RNA, 22 nt, Human
gaaauguagaauugcuuaacug

SEQ ID NO: 673637 - RNA, 22 nt, Human
gucugccccacaggcucaguug

SEQ ID NO: 673638 - RNA, 22 nt, Human
caugacagaugcaaaggauugg

SEQ ID NO: 673639 - RNA, 22 nt, Human
uuauucagggauaacauccagg

SEQ ID NO: 673640 - RNA, 22 nt, Human
agaugcugggaggcugagugca

SEQ ID NO: 673641 - RNA, 22 nt, Human
gagggagagugauggaccauug

SEQ ID NO: 673642 - RNA, 22 nt, Human
ucacacagcugacagagccuuu

SEQ ID NO: 673643 - RNA, 22 nt, Human
uggcuucugggguggccugcau

SEQ ID NO: 673644 - RNA, 22 nt, Human
agguuauaugucauacugaagu

SEQ ID NO: 673645 - RNA, 22 nt, Human
cucaggaggccauucucaaggu

SEQ ID NO: 673646 - RNA, 22 nt, Human
cacauguguauaugugaggggg

SEQ ID NO: 673647 - RNA, 22 nt, Human
aaguauugugggaaagcagaaa

SEQ ID NO: 673648 - RNA, 22 nt, Human
uuggaauccugagaugagaauu

SEQ ID NO: 673649 - RNA, 22 nt, Human
uuacugauacacauaagaauuu

SEQ ID NO: 673650 - RNA, 22 nt, Human
aguggcagagcugugucuugaa

SEQ ID NO: 673651 - RNA, 22 nt, Human
augcaacacauuugaugagcga

SEQ ID NO: 673652 - RNA, 22 nt, Human
acacugaauauacaaugaauau

SEQ ID NO: 673653 - RNA, 22 nt, Human
uggaauguugauaaacauaggc

SEQ ID NO: 673654 - RNA, 22 nt, Human
ggaacuggagaaugcccucuuu

SEQ ID NO: 673655 - RNA, 22 nt, Human
ugcucccagcuguaggaauguu

SEQ ID NO: 673656 - RNA, 22 nt, Human
ugaggcaggagaaucaccggaa

SEQ ID NO: 673657 - RNA, 22 nt, Human
ggcugcagaggcccccaguggg

SEQ ID NO: 673658 - RNA, 22 nt, Human
cuggagugaagucuggcagcuu

SEQ ID NO: 673659 - RNA, 22 nt, Human
uugcaaauuccaauccaauauu

SEQ ID NO: 673660 - RNA, 22 nt, Human
aaccuggagugcugguuucacu

SEQ ID NO: 673661 - RNA, 22 nt, Human
guucugcuuccuugcuugcgca

SEQ ID NO: 673662 - RNA, 21 nt, Human
uucuucaguuuaauauaaaau

SEQ ID NO: 673663 - RNA, 22 nt, Human
acuuauaagagugcuaugggga

SEQ ID NO: 673664 - RNA, 22 nt, Human
uuauauuucugguagccuucag

SEQ ID NO: 673665 - RNA, 22 nt, Human
gaugucaucaggcuaagacacu

SEQ ID NO: 673666 - RNA, 23 nt, Human
ggcucagaaaaaguccuggccuc

SEQ ID NO: 673667 - RNA, 22 nt, Human
ccagacaugugcccuugaggaa

SEQ ID NO: 673668 - RNA, 22 nt, Human
gcugcucuugaggggcucacug

SEQ ID NO: 673669 - RNA, 20 nt, Human
cuccaaggcuugcaggaggc

SEQ ID NO: 673670 - RNA, 22 nt, Human
cugaggagagaucacguggugu

SEQ ID NO: 673671 - RNA, 22 nt, Human
ucucagguggcccccaugagug

SEQ ID NO: 673672 - RNA, 22 nt, Human
ugguuuuagaguauauucaggg

SEQ ID NO: 673673 - RNA, 22 nt, Human
uggucaaaccaguuaucuguaa

SEQ ID NO: 673674 - RNA, 22 nt, Human
ggccagaggccauccuccugcu

SEQ ID NO: 673675 - RNA, 22 nt, Human
uuuguacacugucuacuaugaa

SEQ ID NO: 673676 - RNA, 22 nt, Human
aaaauaugaaguugucaguaug

SEQ ID NO: 673677 - RNA, 22 nt, Human
agacucugauucccucauguca

SEQ ID NO: 673678 - RNA, 21 nt, Human
aggugccaaggagaagcaggc

SEQ ID NO: 673679 - RNA, 22 nt, Human
gugugaaaguaauugcgguuuu

SEQ ID NO: 673680 - RNA, 20 nt, Human
uccagccacuuccgcugguc

SEQ ID NO: 673681 - RNA, 22 nt, Human
ucuuuaauuguggaagagcagc

SEQ ID NO: 673682 - RNA, 22 nt, Human
cccaggagaucuggaucucguc

SEQ ID NO: 673683 - RNA, 20 nt, Human
agccaggguucuggaugcac

SEQ ID NO: 673684 - RNA, 22 nt, Human
uggcaugauaggaggugcagaa

SEQ ID NO: 673685 - RNA, 22 nt, Human
ggucggggauggccaggcuccc

SEQ ID NO: 673686 - RNA, 22 nt, Human
uuauaauucuggcauaggcugu

SEQ ID NO: 673687 - RNA, 22 nt, Human
agguggggaguauauguaauug

SEQ ID NO: 673688 - RNA, 22 nt, Human
guguggcuuucuggguuuaauu

SEQ ID NO: 673689 - RNA, 22 nt, Human
acuagacugggccagucaaauu

SEQ ID NO: 673690 - RNA, 22 nt, Human
aaguuacuuuaccucuuuagcu

SEQ ID NO: 673691 - RNA, 22 nt, Human
auaaggcagucacuggaauguu

SEQ ID NO: 673692 - RNA, 22 nt, Human
caccagcucuccaccagguuuc

SEQ ID NO: 673693 - RNA, 22 nt, Human
uuagcagcaauggcaucaacua

SEQ ID NO: 673694 - RNA, 22 nt, Human
gcagagccccucaagccagccu

SEQ ID NO: 673695 - RNA, 17 nt, Human
agcuuggagcagcauga

SEQ ID NO: 673696 - RNA, 22 nt, Human
aauaggcaguuggauaugcaag

SEQ ID NO: 673697 - RNA, 22 nt, Human
gaaggagggugcggaucugagc

SEQ ID NO: 673698 - RNA, 22 nt, Human
cagagucauaucagagaauaug

SEQ ID NO: 673699 - RNA, 22 nt, Human
ugcaagugccaugugcacagug

SEQ ID NO: 673700 - RNA, 22 nt, Human
aaauauguaaccaaggugaagu

SEQ ID NO: 673701 - RNA, 22 nt, Human
cuagcacaguaugguaucagau

SEQ ID NO: 673702 - RNA, 20 nt, Human
gaguuccccauuucuccugg

SEQ ID NO: 673703 - RNA, 22 nt, Human
uucaagucuggagaucuggaac

SEQ ID NO: 673704 - RNA, 22 nt, Human
auuuccugguugcauuggcuuu

SEQ ID NO: 673705 - RNA, 22 nt, Human
agagaugcaggguacauggaau

SEQ ID NO: 673706 - RNA, 22 nt, Human
agacauaagugcuaugacauug

SEQ ID NO: 673707 - RNA, 22 nt, Human
aggcacagccucccuucacaug

SEQ ID NO: 673708 - RNA, 22 nt, Human
aaguucaaggcagguccugagg

SEQ ID NO: 673709 - RNA, 22 nt, Human
gcagcuuuuuggaugucaguua

SEQ ID NO: 673710 - RNA, 22 nt, Human
cccagccaaggugcugguguug

SEQ ID NO: 673711 - RNA, 22 nt, Human
acucuugucucaacuuuuguau

SEQ ID NO: 673712 - RNA, 22 nt, Human
aguuuuuccugauuuuacagaa

SEQ ID NO: 673713 - RNA, 20 nt, Human
uuuuuccuucucuacaggca

SEQ ID NO: 673714 - RNA, 22 nt, Human
cuugaaaauaagaaagacuuuc

SEQ ID NO: 673715 - RNA, 22 nt, Human
ggacacugaagaaucucagaug

SEQ ID NO: 673716 - RNA, 18 nt, Human
agcuucccucugagaggg

SEQ ID NO: 673717 - RNA, 22 nt, Human
uacugcaugggugcaugcugcu

SEQ ID NO: 673718 - RNA, 22 nt, Human
agggcagcacagcugugcuccu

SEQ ID NO: 673719 - RNA, 22 nt, Human
gcacugggcuccaggaaggagg

SEQ ID NO: 673720 - RNA, 19 nt, Human
ugccagcucacaggagcuc

SEQ ID NO: 673721 - RNA, 22 nt, Human
gcccuccagcuguugcgcgucg

SEQ ID NO: 673722 - RNA, 22 nt, Human
cugcacagcccucaagagccug

SEQ ID NO: 673723 - RNA, 22 nt, Human
uuucuaaggugauccuuucuua

SEQ ID NO: 673724 - RNA, 21 nt, Human
gcucugucccugcuguguguc

SEQ ID NO: 673725 - RNA, 22 nt, Human
caugcagaugucaugaggcaug

SEQ ID NO: 673726 - RNA, 22 nt, Human
uucaguguacagugaagggauu

SEQ ID NO: 673727 - RNA, 22 nt, Human
aaagauguuaauagcaccauuu

SEQ ID NO: 673728 - RNA, 22 nt, Human
agcagaaucuguccuuggaaga

SEQ ID NO: 673729 - RNA, 22 nt, Human
gcaguccuggaggaagguguga

SEQ ID NO: 673730 - RNA, 23 nt, Human
guaaaauacgcagugcaguguga

SEQ ID NO: 673731 - RNA, 19 nt, Human
aggcuaaagagucuugcgu

SEQ ID NO: 673732 - RNA, 22 nt, Human
auucugcugcacaccuuccccc

SEQ ID NO: 673733 - RNA, 22 nt, Human
gcuggagaggaucccaaagcca

SEQ ID NO: 673734 - RNA, 22 nt, Human
cagggcucgcucuugcccuucg

SEQ ID NO: 673735 - RNA, 22 nt, Human
acagggcagugucuugaaaaau

SEQ ID NO: 673736 - RNA, 22 nt, Human
cccagcucuggaagguggggga

SEQ ID NO: 673737 - RNA, 22 nt, Human
uugagcuguaaggugggaugug

SEQ ID NO: 673738 - RNA, 22 nt, Human
gagccacagcaaccucaaagga

SEQ ID NO: 673739 - RNA, 22 nt, Human
cugcuguggugucaagcaucuc

SEQ ID NO: 673740 - RNA, 22 nt, Human
aauaucagcacuuuugugguau

SEQ ID NO: 673741 - RNA, 22 nt, Human
agaugaguagguagcauuagua

SEQ ID NO: 673742 - RNA, 22 nt, Human
ugaggagcaggguggcuuacuc

SEQ ID NO: 673743 - RNA, 22 nt, Human
uucugcagcccaacaguaguuu

SEQ ID NO: 673744 - RNA, 22 nt, Human
ucacagaacaauguuuaguucu

SEQ ID NO: 673745 - RNA, 22 nt, Human
ugccugcauuuuguggcuggcu

SEQ ID NO: 673746 - RNA, 22 nt, Human
cucugugucugaagcccuauuu

SEQ ID NO: 673747 - RNA, 22 nt, Human
aacacuuucuuccuugcucagg

SEQ ID NO: 673748 - RNA, 22 nt, Human
ucacauaaauuuaccagaugau

SEQ ID NO: 673749 - RNA, 22 nt, Human
uaacauuguuaugaaucagguc

SEQ ID NO: 673750 - RNA, 22 nt, Human
aggaaaaucaaugucuuuuuaa

SEQ ID NO: 673751 - RNA, 22 nt, Human
cuucaaguugucugaggguggg

SEQ ID NO: 673752 - RNA, 22 nt, Human
ugccgcagugcggggagggccc

SEQ ID NO: 673753 - RNA, 22 nt, Human
auguguuuuuauucuggcaugu

SEQ ID NO: 673754 - RNA, 22 nt, Human
guaugaaggcgagagcccacua

SEQ ID NO: 673755 - RNA, 22 nt, Human
auggaaaucgaugucuaaguua

SEQ ID NO: 673756 - RNA, 22 nt, Human
gccaauuuccugagguaaagcu

SEQ ID NO: 673757 - RNA, 22 nt, Human
cugcuggccuagcccauccucu

SEQ ID NO: 673758 - RNA, 22 nt, Human
agagggagcccagucauagcug

SEQ ID NO: 673759 - RNA, 22 nt, Human
acuccacauuugaacacaguuc

SEQ ID NO: 673760 - RNA, 22 nt, Human
gcaugguggccuuaggguagcc

SEQ ID NO: 673761 - RNA, 22 nt, Human
guuugcauuccaauuuagggga

SEQ ID NO: 673762 - RNA, 17 nt, Human
gagguaggaagugaguc

SEQ ID NO: 673763 - RNA, 22 nt, Human
uuuauucuagcucagaauaguu

SEQ ID NO: 673764 - RNA, 22 nt, Human
ggcggcuuauucacucugggga

SEQ ID NO: 673765 - RNA, 22 nt, Human
cuuguaauuauaauguacuguu

SEQ ID NO: 673766 - RNA, 22 nt, Human
ccaguggaauuaaaaauaagug

SEQ ID NO: 673767 - RNA, 22 nt, Human
uuuucucuauauugucugugaa

SEQ ID NO: 673768 - RNA, 18 nt, Human
ugacucacccugucagug

SEQ ID NO: 673769 - RNA, 22 nt, Human
acagcuauagacgauguauaga

SEQ ID NO: 673770 - RNA, 22 nt, Human
ccugugggccaaggaccugcca

SEQ ID NO: 673771 - RNA, 22 nt, Human
ugcuggcauaccaccuaguuca

SEQ ID NO: 673772 - RNA, 22 nt, Human
gcagcaaggaugaagcacuugg

SEQ ID NO: 673773 - RNA, 22 nt, Human
auaccaccaucuaugaaaggua

SEQ ID NO: 673774 - RNA, 22 nt, Human
aaagugcacuagaauccagauu

SEQ ID NO: 673775 - RNA, 22 nt, Human
aucauuuaugccccaauuagau

SEQ ID NO: 673776 - RNA, 22 nt, Human
ugggcucagccaugaccuccac

SEQ ID NO: 673777 - RNA, 22 nt, Human
ugccuucaccaggccuucagcc

SEQ ID NO: 673778 - RNA, 22 nt, Human
ccaaggcaggggaucaaaguuu

SEQ ID NO: 673779 - RNA, 22 nt, Human
ucuccaggcacuaccuggguaa

SEQ ID NO: 673780 - RNA, 22 nt, Human
aaggccaugaccacuugcugug

SEQ ID NO: 673781 - RNA, 22 nt, Human
uauuuuaucugccagaguggag

SEQ ID NO: 673782 - RNA, 22 nt, Human
gccuuggagaucacugcucaug

SEQ ID NO: 673783 - RNA, 22 nt, Human
auuaguguacaucucacacgca

SEQ ID NO: 673784 - RNA, 22 nt, Human
aauccuggccuagcugggcuca

SEQ ID NO: 673785 - RNA, 22 nt, Human
auccaagucagggauaguuuga

SEQ ID NO: 673786 - RNA, 22 nt, Human
ugaugagggcaguucuuguugc

SEQ ID NO: 673787 - RNA, 22 nt, Human
agagggaaugugauugcaccau

SEQ ID NO: 673788 - RNA, 22 nt, Human
gaaggucaccuccccucucugg

SEQ ID NO: 673789 - RNA, 22 nt, Human
cuguggcuccauagaaguugca

SEQ ID NO: 673790 - RNA, 22 nt, Human
ccugggcuuuggaacaguacuu

SEQ ID NO: 673791 - RNA, 23 nt, Human
augauaaugccauuaacuuugau

SEQ ID NO: 673792 - RNA, 22 nt, Human
aucuagauuagguauaagagcu

SEQ ID NO: 673793 - RNA, 22 nt, Human
cugaagcuuaguuuacgcucca

SEQ ID NO: 673794 - RNA, 22 nt, Human
aaaagcaguuuauagucaguug

SEQ ID NO: 673795 - RNA, 22 nt, Human
ucugaaauggcagcgggaauga

SEQ ID NO: 673796 - RNA, 22 nt, Human
uuuagggacaagggucuggggu

SEQ ID NO: 673797 - RNA, 22 nt, Human
uguggcucucagauccuccaau

SEQ ID NO: 673798 - RNA, 22 nt, Human
gagagggcucuguguggguacu

SEQ ID NO: 673799 - RNA, 22 nt, Human
gggcaguguugugguucucuau

SEQ ID NO: 673800 - RNA, 22 nt, Human
gugccaucauucaauaaauuca

SEQ ID NO: 673801 - RNA, 22 nt, Human
caaugucagucaagcagcaaau

SEQ ID NO: 673802 - RNA, 20 nt, Human
acguggccaccaguggcuua

SEQ ID NO: 673803 - RNA, 22 nt, Human
gcagugcaugucggaacucauu

SEQ ID NO: 673804 - RNA, 22 nt, Human
uccugaggcccuguuagggucu

SEQ ID NO: 673805 - RNA, 20 nt, Human
uucugagauuagguuacaaa

SEQ ID NO: 673806 - RNA, 22 nt, Human
ucagggaaccucuccuguuucu

SEQ ID NO: 673807 - RNA, 22 nt, Human
aggggugacacauaucagugca

SEQ ID NO: 673808 - RNA, 22 nt, Human
ucccacagggcuucucuguaca

SEQ ID NO: 673809 - RNA, 22 nt, Human
ccacaggaaguuaugaguacua

SEQ ID NO: 673810 - RNA, 22 nt, Human
aucucagaucuacagaucuaca

SEQ ID NO: 673811 - RNA, 22 nt, Human
aaagcuuagcauuuucaaaaug

SEQ ID NO: 673812 - RNA, 19 nt, Human
ugagacagggauucaggug

SEQ ID NO: 673813 - RNA, 20 nt, Human
auacacaugcagacagaugc

SEQ ID NO: 673814 - RNA, 22 nt, Human
cagguucagcaggaggcauccc

SEQ ID NO: 673815 - RNA, 22 nt, Human
ucacagaagcaucauacccgga

SEQ ID NO: 673816 - RNA, 22 nt, Human
uguccucagauaugucuacucu

SEQ ID NO: 673817 - RNA, 20 nt, Human
aaguuacauuguauuguacc

SEQ ID NO: 673818 - RNA, 22 nt, Human
aucuuugucacucuacugucua

SEQ ID NO: 673819 - RNA, 22 nt, Human
aaauuguugaucuacaguaagg

SEQ ID NO: 673820 - RNA, 22 nt, Human
ucuucugagacuucucuuuggu

SEQ ID NO: 673821 - RNA, 22 nt, Human
agagcaauggcauccagcugau

SEQ ID NO: 673822 - RNA, 22 nt, Human
uacguuuagcuuuaugagacau

SEQ ID NO: 673823 - RNA, 22 nt, Human
ccugcccuagagaugacacaau

SEQ ID NO: 673824 - RNA, 22 nt, Human
acacuucaggacucuggggcaa

SEQ ID NO: 673825 - RNA, 22 nt, Human
ucugagugucuuaauaggcucu

SEQ ID NO: 673826 - RNA, 22 nt, Human
gcugucugucucugugacuuaa

SEQ ID NO: 673827 - RNA, 22 nt, Human
aucuguuguuuguuugcuaaag

SEQ ID NO: 673828 - RNA, 22 nt, Human
ccucccugcuccucaacuggca

SEQ ID NO: 673829 - RNA, 22 nt, Human
ggcaaaaaccauaauuacuuuu

SEQ ID NO: 673830 - RNA, 23 nt, Human
uacuauaacgcugugucagcucc

SEQ ID NO: 673831 - RNA, 22 nt, Human
ucaccucuuuuuuaacaggcuu

SEQ ID NO: 673832 - RNA, 22 nt, Human
cucuggagaacgcuauggaucu

SEQ ID NO: 673833 - RNA, 19 nt, Human
ucccgcccacugagcgugc

SEQ ID NO: 673834 - RNA, 22 nt, Human
uguguauagaugcaugcauaua

SEQ ID NO: 673835 - RNA, 22 nt, Human
uuguccugugucuguuuggauu

SEQ ID NO: 673836 - RNA, 22 nt, Human
ugugugggcaugcuuuuaauuu

SEQ ID NO: 673837 - RNA, 20 nt, Human
uccuggaggcuucauccaua

SEQ ID NO: 673838 - RNA, 22 nt, Human
ugguuuugcuaaaauagaaaga

SEQ ID NO: 673839 - RNA, 22 nt, Human
ugaaaacuugacaagugaggua

SEQ ID NO: 673840 - RNA, 22 nt, Human
uucaaagauuuucccaaagcuc

SEQ ID NO: 673841 - RNA, 22 nt, Human
ucaggaugaagucagagggguc

SEQ ID NO: 673842 - RNA, 20 nt, Human
ugagugcuccauucugccca

SEQ ID NO: 673843 - RNA, 22 nt, Human
aggaccauccuaagguaggcaa

SEQ ID NO: 673844 - RNA, 22 nt, Human
cucaggauccaucuccugcccu

SEQ ID NO: 673845 - RNA, 22 nt, Human
uuuauugucuaugaacugcuug

SEQ ID NO: 673846 - RNA, 22 nt, Human
augacaagaguguucagggaga

SEQ ID NO: 673847 - RNA, 22 nt, Human
gagagcugauagaugagcuacu

SEQ ID NO: 673848 - RNA, 22 nt, Human
ugagaggaacaggcaguagguu

SEQ ID NO: 673849 - RNA, 22 nt, Human
guuagugugacugaggaaugca

SEQ ID NO: 673850 - RNA, 15 nt, Human
uugcuuuaagacaug

SEQ ID NO: 673851 - RNA, 22 nt, Human
cugagagaguaaaguagaauua

SEQ ID NO: 673852 - RNA, 22 nt, Human
augcuugcccauguuucugaag

SEQ ID NO: 673853 - RNA, 22 nt, Human
cuucuauuuucaugccuggguc

SEQ ID NO: 673854 - RNA, 22 nt, Human
guuacucuuccccggggucugg

SEQ ID NO: 673855 - RNA, 22 nt, Human
acaggagcucuagggacagcac

SEQ ID NO: 673856 - RNA, 22 nt, Human
uucuggagaucugccuauggga

SEQ ID NO: 673857 - RNA, 22 nt, Human
ggcucagaccucccagcuccag

SEQ ID NO: 673858 - RNA, 22 nt, Human
ucagggcauacucuucaagguc

SEQ ID NO: 673859 - RNA, 22 nt, Human
ggcuguaguuaccugaugaaau

SEQ ID NO: 673860 - RNA, 22 nt, Human
gacuugggugucggggcagucu

SEQ ID NO: 673861 - RNA, 20 nt, Human
gggcugugccuccucguggu

SEQ ID NO: 673862 - RNA, 22 nt, Human
agaauaaauguuggacuuagga

SEQ ID NO: 673863 - RNA, 20 nt, Human
cuggggacagcaauggcugu

SEQ ID NO: 673864 - RNA, 22 nt, Human
cagauguuguuccugccuguag

SEQ ID NO: 673865 - RNA, 22 nt, Human
aaaaguaauugcgguuuuugcu

SEQ ID NO: 673866 - RNA, 22 nt, Human
acagcuuuugaaaaauuacugg

SEQ ID NO: 673867 - RNA, 22 nt, Human
auuacaucaguugacaugugag

SEQ ID NO: 673868 - RNA, 22 nt, Human
uccuggccuuauccccaaacug

SEQ ID NO: 673869 - RNA, 22 nt, Human
ggcuggcacucuguccaguguc

SEQ ID NO: 673870 - RNA, 22 nt, Human
aucucaaaugauuacaccaagc

SEQ ID NO: 673871 - RNA, 22 nt, Human
aaauugcaaaaguacuuuuagg

SEQ ID NO: 673872 - RNA, 19 nt, Human
gcacacauacacccuuugg

SEQ ID NO: 673873 - RNA, 22 nt, Human
gugcccaguaaaugaaagcuuu

SEQ ID NO: 673874 - RNA, 22 nt, Human
ucuuaaaccacaaaauucagag

SEQ ID NO: 673875 - RNA, 22 nt, Human
ucuuccagauacuuccugacuu

SEQ ID NO: 673876 - RNA, 22 nt, Human
aauauccacacugugucccugc

SEQ ID NO: 673877 - RNA, 22 nt, Human
cuggccucagagggucauggug

SEQ ID NO: 673878 - RNA, 21 nt, Human
aauaaccacuaauauaguggc

SEQ ID NO: 673879 - RNA, 22 nt, Human
cugccuugaggagguuguggga

SEQ ID NO: 673880 - RNA, 22 nt, Human
gagagagaaccccgugcccuuc

SEQ ID NO: 673881 - RNA, 22 nt, Human
aggagcuguuuuguucagcaaa

SEQ ID NO: 673882 - RNA, 22 nt, Human
gcugugugcugggcauggcacu

SEQ ID NO: 673883 - RNA, 22 nt, Human
auagaacagggcacugucauga

SEQ ID NO: 673884 - RNA, 22 nt, Human
uguauucagggacauauaugua

SEQ ID NO: 673885 - RNA, 22 nt, Human
uucuaccagaccccagacuugu

SEQ ID NO: 673886 - RNA, 22 nt, Human
agugguggagccaggaaaugug

SEQ ID NO: 673887 - RNA, 22 nt, Human
ccaggaggcuucguccguggag

SEQ ID NO: 673888 - RNA, 22 nt, Human
acaggcugaaaguuaaguucug

SEQ ID NO: 673889 - RNA, 22 nt, Human
aaguuguagucagaugucaguu

SEQ ID NO: 673890 - RNA, 22 nt, Human
ugcacgugggcucucugcucuu

SEQ ID NO: 673891 - RNA, 22 nt, Human
aaggccaggccuagcacggagg

SEQ ID NO: 673892 - RNA, 22 nt, Human
agaacauggauugucaaaggua

SEQ ID NO: 673893 - RNA, 22 nt, Human
augcauaauguauguauugacu

SEQ ID NO: 673894 - RNA, 22 nt, Human
agagcagauggagcuggaagag

SEQ ID NO: 673895 - RNA, 22 nt, Human
acugcauuugucugucucaauu

SEQ ID NO: 673896 - RNA, 22 nt, Human
acagaggcugcgcuugggaacg

SEQ ID NO: 673897 - RNA, 22 nt, Human
uucaggaggugagcaagaaggg

SEQ ID NO: 673898 - RNA, 22 nt, Human
cagcaucuucuccaaagcugcc

SEQ ID NO: 673899 - RNA, 22 nt, Human
uagaggugagauauuuuauuuu

SEQ ID NO: 673900 - RNA, 20 nt, Human
aggcaagguagaugucugcu

SEQ ID NO: 673901 - RNA, 22 nt, Human
acuuucugcaguguuggaaaug

SEQ ID NO: 673902 - RNA, 22 nt, Human
aagccucuggggccucaucugu

SEQ ID NO: 673903 - RNA, 22 nt, Human
acuccagaggcagcugugcuga

SEQ ID NO: 673904 - RNA, 15 nt, Human
cagucccagggaccc

SEQ ID NO: 673905 - RNA, 23 nt, Human
cuaguaaauccugaauagcaggc

SEQ ID NO: 673906 - RNA, 22 nt, Human
uuuacaccaaaaugacacagag

SEQ ID NO: 673907 - RNA, 22 nt, Human
guuucauaggcaugugaccuau

SEQ ID NO: 673908 - RNA, 22 nt, Human
cauucucaauaguagaugagua

SEQ ID NO: 673909 - RNA, 20 nt, Human
uaauuugauaucuauaaguu

SEQ ID NO: 673910 - RNA, 22 nt, Human
uagauggaggcuagaugcaggg

SEQ ID NO: 673911 - RNA, 22 nt, Human
cugcccaggaaccagaggggca

SEQ ID NO: 673912 - RNA, 20 nt, Human
gagucacagaagaagcugaa

SEQ ID NO: 673913 - RNA, 22 nt, Human
cucauuuacucaucugcaaaac

SEQ ID NO: 673914 - RNA, 22 nt, Human
uacauugauucaggauauaggc

SEQ ID NO: 673915 - RNA, 22 nt, Human
ccuggccucgugcucacggcuc

SEQ ID NO: 673916 - RNA, 22 nt, Human
cugcucuguauaugagcaggaa

SEQ ID NO: 673917 - RNA, 22 nt, Human
cuucugcaagagcaucaguugu

SEQ ID NO: 673918 - RNA, 22 nt, Human
caaauguauaaauguacuuucu

SEQ ID NO: 673919 - RNA, 20 nt, Human
uuucaaacugcaccuuugcu

SEQ ID NO: 673920 - RNA, 22 nt, Human
ucagcaggcugucagcaggggc

SEQ ID NO: 673921 - RNA, 19 nt, Human
guuaucaaggggcuacuuu

SEQ ID NO: 673922 - RNA, 22 nt, Human
ggagcugaaggggugggcucag

SEQ ID NO: 673923 - RNA, 22 nt, Human
acaggcagguccugucccagcu

SEQ ID NO: 673924 - RNA, 22 nt, Human
guguaaggugaaaucaacaaau

SEQ ID NO: 673925 - RNA, 22 nt, Human
caaaguauaguguaggauggca

SEQ ID NO: 673926 - RNA, 22 nt, Human
caaauuuuguguguucucuagu

SEQ ID NO: 673927 - RNA, 22 nt, Human
cuggagucuucagcuugcugcc

SEQ ID NO: 673928 - RNA, 22 nt, Human
ucucuaaagauauuuauggcaa

SEQ ID NO: 673929 - RNA, 22 nt, Human
cugcuccagacaccugcagggg

SEQ ID NO: 673930 - RNA, 18 nt, Human
uggagcugagugcugugc

SEQ ID NO: 673931 - RNA, 22 nt, Human
auacuuuggggguuaguguaga

SEQ ID NO: 673932 - RNA, 22 nt, Human
gaaacauauuaauccagugaaa

SEQ ID NO: 673933 - RNA, 22 nt, Human
ucacagcuauucucauguauuu

SEQ ID NO: 673934 - RNA, 22 nt, Human
aacugcuguggccuaguacuua

SEQ ID NO: 673935 - RNA, 22 nt, Human
aucacacuguuauuuuaguuaa

SEQ ID NO: 673936 - RNA, 22 nt, Human
uuaagaucaagauaagcaauaa

SEQ ID NO: 673937 - RNA, 22 nt, Human
agggucugacaaugugacuuag

SEQ ID NO: 673938 - RNA, 22 nt, Human
ugcugaggacuaaaggagauga

SEQ ID NO: 673939 - RNA, 22 nt, Human
uacauuccauguguguguauuc

SEQ ID NO: 673940 - RNA, 22 nt, Human
ucaguuuucauuucaugagcag

SEQ ID NO: 673941 - RNA, 22 nt, Human
ggacagcccauacacaugucug

SEQ ID NO: 673942 - RNA, 22 nt, Human
cagcaaagguagaagcacagga

SEQ ID NO: 673943 - RNA, 22 nt, Human
uugaauugaaacauacccuggu

SEQ ID NO: 673944 - RNA, 22 nt, Human
agcuggccuuagugagcaccug

SEQ ID NO: 673945 - RNA, 22 nt, Human
gagaggugaaggcugcccuggg

SEQ ID NO: 673946 - RNA, 16 nt, Human
ucacacauuuguuggu

SEQ ID NO: 673947 - RNA, 22 nt, Human
ggaaacaaaccacucauggugg

SEQ ID NO: 673948 - RNA, 22 nt, Human
uccagcagacucaucagcaagg

SEQ ID NO: 673949 - RNA, 22 nt, Human
gagagugcugaacggcaagggu

SEQ ID NO: 673950 - RNA, 22 nt, Human
acugccuggcagagguuugcaa

SEQ ID NO: 673951 - RNA, 22 nt, Human
uggccagaaccugcaguaggcc

SEQ ID NO: 673952 - RNA, 22 nt, Human
uaacaaugggaaggacugauga

SEQ ID NO: 673953 - RNA, 22 nt, Human
agccaggcgcaguggcuuaugc

SEQ ID NO: 673954 - RNA, 22 nt, Human
aauuacuuaacucucugggccu

SEQ ID NO: 673955 - RNA, 22 nt, Human
uauucccacccuaaguaguagg

SEQ ID NO: 673956 - RNA, 22 nt, Human
gggaugucacugugccuggcac

SEQ ID NO: 673957 - RNA, 22 nt, Human
uacacaaugacuuaagauguca

SEQ ID NO: 673958 - RNA, 22 nt, Human
ugauacuuuucuuuuagacuaa

SEQ ID NO: 673959 - RNA, 22 nt, Human
uccagagagguuucuccaugcu

SEQ ID NO: 673960 - RNA, 22 nt, Human
uggcagugaaagacaauugggc

SEQ ID NO: 673961 - RNA, 22 nt, Human
uccuggcugucacucggguuga

SEQ ID NO: 673962 - RNA, 22 nt, Human
aggcagccagauggcagccugc

SEQ ID NO: 673963 - RNA, 22 nt, Human
uggaagccaggcccgcuccuaa

SEQ ID NO: 673964 - RNA, 22 nt, Human
agcagcauagaagcugggagga

SEQ ID NO: 673965 - RNA, 22 nt, Human
uuuggacugcaugaugaucugg

SEQ ID NO: 673966 - RNA, 22 nt, Human
gugcugggugcugcagacaggu

SEQ ID NO: 673967 - RNA, 22 nt, Human
ucucugaagagucagacauaac

SEQ ID NO: 673968 - RNA, 22 nt, Human
agcagagcuuuuuggacucaga

SEQ ID NO: 673969 - RNA, 22 nt, Human
gccaacagcugggugcaugucc

SEQ ID NO: 673970 - RNA, 22 nt, Human
agaccuggguucgaguccuaac

SEQ ID NO: 673971 - RNA, 22 nt, Human
ucacaacugggugucuucauca

SEQ ID NO: 673972 - RNA, 22 nt, Human
augggguggaguccgggcagcg

SEQ ID NO: 673973 - RNA, 22 nt, Human
ccucaggguggcaucagaucuu

SEQ ID NO: 673974 - RNA, 22 nt, Human
cugcugugauugggagaaaccg

SEQ ID NO: 673975 - RNA, 22 nt, Human
gagcugggcacacgccacuuga

SEQ ID NO: 673976 - RNA, 22 nt, Human
gugaagucaagaaugcaauuug

SEQ ID NO: 673977 - RNA, 23 nt, Human
gcuuccauucuaguuugcugugc

SEQ ID NO: 673978 - RNA, 22 nt, Human
uacugugaauacaaaauaaauu

SEQ ID NO: 673979 - RNA, 22 nt, Human
uguuuacucacuguauccacaa

SEQ ID NO: 673980 - RNA, 22 nt, Human
gcugcagacugggaggcaggug

SEQ ID NO: 673981 - RNA, 18 nt, Human
gagaggcccggcugugcc

SEQ ID NO: 673982 - RNA, 22 nt, Human
ucuggcuccuggcuccacugcc

SEQ ID NO: 673983 - RNA, 22 nt, Human
agaugcagaguuugcuguggac

SEQ ID NO: 673984 - RNA, 22 nt, Human
gaacaaugagucauucagguga

SEQ ID NO: 673985 - RNA, 22 nt, Human
auaaugcauuuagaauaauuca

SEQ ID NO: 673986 - RNA, 22 nt, Human
gguggaugcugacuguucugcu

SEQ ID NO: 673987 - RNA, 22 nt, Human
ugcauuccuccaccuccugcac

SEQ ID NO: 673988 - RNA, 22 nt, Human
ugccugaacaugaauaguuuau

SEQ ID NO: 673989 - RNA, 19 nt, Human
uggcaggcccaggauggac

SEQ ID NO: 673990 - RNA, 22 nt, Human
cugugccacugcccugccacgc

SEQ ID NO: 673991 - RNA, 22 nt, Human
cagcaagccaaauguggcccga

SEQ ID NO: 673992 - RNA, 22 nt, Human
accaguggaugaaugcuggacc

SEQ ID NO: 673993 - RNA, 18 nt, Human
acccuggcaugcucuucc

SEQ ID NO: 673994 - RNA, 22 nt, Human
aauugcuuugaagaagggagcg

SEQ ID NO: 673995 - RNA, 22 nt, Human
uauggcuucauugugcuccgca

SEQ ID NO: 673996 - RNA, 22 nt, Human
acugcaggccuuggugccagca

SEQ ID NO: 673997 - RNA, 22 nt, Human
ugagcacaaguuugcaugugug

SEQ ID NO: 673998 - RNA, 22 nt, Human
aacagauuugugaagcuacuca

SEQ ID NO: 673999 - RNA, 22 nt, Human
aaugauaccaaacauguagaua

SEQ ID NO: 674000 - RNA, 22 nt, Human
uugaggccugcuggaagguguu

SEQ ID NO: 674001 - RNA, 22 nt, Human
cucagauaaucuuugagucuuc

SEQ ID NO: 674002 - RNA, 22 nt, Human
agaguccugaguggaaaaaugg

SEQ ID NO: 674003 - RNA, 22 nt, Human
uccugcagccuugggcuggagc

SEQ ID NO: 674004 - RNA, 22 nt, Human
uagugcuuaaaaguggaagaga

SEQ ID NO: 674005 - RNA, 22 nt, Human
ccuucagaaugaaauucuaaug

SEQ ID NO: 674006 - RNA, 22 nt, Human
aauauccagguagaugucuucu

SEQ ID NO: 674007 - RNA, 22 nt, Human
ggagcuaguaguuucaugaguu

SEQ ID NO: 674008 - RNA, 22 nt, Human
uggccuggaaccuggcagggac

SEQ ID NO: 674009 - RNA, 22 nt, Human
agagaagauucuuauaugucuu

SEQ ID NO: 674010 - RNA, 22 nt, Human
uggcucugucgccguuuggaau

SEQ ID NO: 674011 - RNA, 22 nt, Human
gagccagccuccgccucucucc

SEQ ID NO: 674012 - RNA, 22 nt, Human
aagugaugcuacgacuuugaca

SEQ ID NO: 674013 - RNA, 20 nt, Human
ucagagucaucaaagauggu

SEQ ID NO: 674014 - RNA, 22 nt, Human
cuggaaggagaaggaggcugug

SEQ ID NO: 674015 - RNA, 20 nt, Human
uauuaugaccuguguucugg

SEQ ID NO: 674016 - RNA, 22 nt, Human
cacagcuuugcuuuccuuaaua

SEQ ID NO: 674017 - RNA, 18 nt, Human
ggcuuugcugggguuucu

SEQ ID NO: 674018 - RNA, 22 nt, Human
augaugaagaguaacaggcuga

SEQ ID NO: 674019 - RNA, 22 nt, Human
aagagcauuuccacuggcacug

SEQ ID NO: 674020 - RNA, 21 nt, Human
ccaggcuggccaugguauuga

SEQ ID NO: 674021 - RNA, 22 nt, Human
gccccuucguggaagugcauuc

SEQ ID NO: 674022 - RNA, 22 nt, Human
uacacaggggagcaugguugac

SEQ ID NO: 674023 - RNA, 22 nt, Human
agcauuaagagagacugaacug

SEQ ID NO: 674024 - RNA, 18 nt, Human
gcucaguguguuaacacu

SEQ ID NO: 674025 - RNA, 22 nt, Human
agcccaggagccuuuggagggu

SEQ ID NO: 674026 - RNA, 22 nt, Human
gggaccuggcaccuuugcucug

SEQ ID NO: 674027 - RNA, 22 nt, Human
aggacagagcccuaguuucaua

SEQ ID NO: 674028 - RNA, 22 nt, Human
gugugagagaagcugccaugga

SEQ ID NO: 674029 - RNA, 22 nt, Human
gaaaauugaaucaguagcugau

SEQ ID NO: 674030 - RNA, 21 nt, Human
gcccacagugaggaggauccc

SEQ ID NO: 674031 - RNA, 22 nt, Human
gggcuccaacuacaucagccuu

SEQ ID NO: 674032 - RNA, 22 nt, Human
caauuucuaacauuccauggau

SEQ ID NO: 674033 - RNA, 22 nt, Human
aagcacagaugcaagggggacc

SEQ ID NO: 674034 - RNA, 22 nt, Human
agcagcaggaggccauugucuu

SEQ ID NO: 674035 - RNA, 22 nt, Human
agaaggccaauagggugcacug

SEQ ID NO: 674036 - RNA, 22 nt, Human
gcucacuuaauuucaugcuaca

SEQ ID NO: 674037 - RNA, 22 nt, Human
aagagccagcuagugaagaggc

SEQ ID NO: 674038 - RNA, 22 nt, Human
uccagggaagagcagaggcuac

SEQ ID NO: 674039 - RNA, 18 nt, Human
gaguuuagguuguagaau

SEQ ID NO: 674040 - RNA, 22 nt, Human
gagcuuccacucuagaaggagu

SEQ ID NO: 674041 - RNA, 22 nt, Human
acuguaaaagaaggucuuugca

SEQ ID NO: 674042 - RNA, 16 nt, Human
gcacacacaucaauga

SEQ ID NO: 674043 - RNA, 22 nt, Human
uuugucuuauccaaucucucag

SEQ ID NO: 674044 - RNA, 22 nt, Human
uugaucaucuaagaguaauagu

SEQ ID NO: 674045 - RNA, 22 nt, Human
ugaaaacuccaaguuucaucag

SEQ ID NO: 674046 - RNA, 22 nt, Human
uucacaaacaccagaauggcua

SEQ ID NO: 674047 - RNA, 22 nt, Human
auauguguacgugcaguauaua

SEQ ID NO: 674048 - RNA, 22 nt, Human
gcagcugguuaaugggagaauu

SEQ ID NO: 674049 - RNA, 22 nt, Human
ggugggagggcugcguuccucu

SEQ ID NO: 674050 - RNA, 22 nt, Human
aaaggcagaguuguuggaggca

SEQ ID NO: 674051 - RNA, 19 nt, Human
ccaggccugcgggcguugg

SEQ ID NO: 674052 - RNA, 23 nt, Human
gcagagguuuuucaguaugguuu

SEQ ID NO: 674053 - RNA, 22 nt, Human
agauacaccggaaccugaggcu

SEQ ID NO: 674054 - RNA, 23 nt, Human
aaucuauacuuaggcugguaaua

SEQ ID NO: 674055 - RNA, 22 nt, Human
uugggcagguguggcucuccuu

SEQ ID NO: 674056 - RNA, 22 nt, Human
gaagucugagugggggccaggc

SEQ ID NO: 674057 - RNA, 22 nt, Human
agugacaaggccugaagcuccu

SEQ ID NO: 674058 - RNA, 22 nt, Human
ugagcugugugacauugagcca

SEQ ID NO: 674059 - RNA, 22 nt, Human
uuacacacucugcccugcuguu

SEQ ID NO: 674060 - RNA, 22 nt, Human
uucauucuuauuugugaucugg

SEQ ID NO: 674061 - RNA, 22 nt, Human
gcugccagcacaguucagcugu

SEQ ID NO: 674062 - RNA, 18 nt, Human
gcagagcagaagcucaag

SEQ ID NO: 674063 - RNA, 20 nt, Human
uagaggggacaaucauugcc

SEQ ID NO: 674064 - RNA, 20 nt, Human
gcugaggggucuauggcaua

SEQ ID NO: 674065 - RNA, 22 nt, Human
gaaauguagaguaucugaggau

SEQ ID NO: 674066 - RNA, 22 nt, Human
uagaacagaguuccagugauca

SEQ ID NO: 674067 - RNA, 17 nt, Human
aggccucccuccaggcc

SEQ ID NO: 674068 - RNA, 18 nt, Human
gcagugaagaaagagcuu

SEQ ID NO: 674069 - RNA, 22 nt, Human
ggugggaggcaggcugcuccca

SEQ ID NO: 674070 - RNA, 22 nt, Human
acuugggaaagaaguuucaccg

SEQ ID NO: 674071 - RNA, 22 nt, Human
uugcccuggggcuggccuggca

SEQ ID NO: 674072 - RNA, 22 nt, Human
ucacccagacugucugacucuu

SEQ ID NO: 674073 - RNA, 22 nt, Human
uuauauccaaaggcaaggagga

SEQ ID NO: 674074 - RNA, 22 nt, Human
aacaucauuauguccauuaaug

SEQ ID NO: 674075 - RNA, 22 nt, Human
auguuucucacuguuucucuau

SEQ ID NO: 674076 - RNA, 22 nt, Human
ugagggugugcggcccagacag

SEQ ID NO: 674077 - RNA, 22 nt, Human
aaaugcuagaacauuuuaaagg

SEQ ID NO: 674078 - RNA, 22 nt, Human
cagaggcugacaaaauauugcu

SEQ ID NO: 674079 - RNA, 22 nt, Human
gggcggggggagcuggaaugaa

SEQ ID NO: 674080 - RNA, 22 nt, Human
augaaggauggcuggcugcccu

SEQ ID NO: 674081 - RNA, 19 nt, Human
ccauggcaaugaucugaug

SEQ ID NO: 674082 - RNA, 22 nt, Human
gcugucucggggcuuucuccug

SEQ ID NO: 674083 - RNA, 22 nt, Human
gaaugaagcaggucacacaguu

SEQ ID NO: 674084 - RNA, 22 nt, Human
aaaugccucuggguuauucuag

SEQ ID NO: 674085 - RNA, 22 nt, Human
uuggccuuguacaucauauuaa

SEQ ID NO: 674086 - RNA, 21 nt, Human
gccugccugcgugacccucuu

SEQ ID NO: 674087 - RNA, 22 nt, Human
ccagccccgggaaccuggccgu

SEQ ID NO: 674088 - RNA, 22 nt, Human
gagaagguggaccugaaggagc

SEQ ID NO: 674089 - RNA, 22 nt, Human
gugcucugaucugucugacauc

SEQ ID NO: 674090 - RNA, 22 nt, Human
gaaacacuaugccaagacaggg

SEQ ID NO: 674091 - RNA, 22 nt, Human
uccugagaggugugaggugcag

SEQ ID NO: 674092 - RNA, 22 nt, Human
uuucacacaacgugaauauacu

SEQ ID NO: 674093 - RNA, 22 nt, Human
ggccaccaaaguccuguggcuu

SEQ ID NO: 674094 - RNA, 22 nt, Human
aaacaaagccagggaaguuaug

SEQ ID NO: 674095 - RNA, 22 nt, Human
agagcuuauaucuuggccaucc

SEQ ID NO: 674096 - RNA, 22 nt, Human
ucuccagguggggucaccuuuu

SEQ ID NO: 674097 - RNA, 22 nt, Human
agaaauuaggaaaguaacacuu

SEQ ID NO: 674098 - RNA, 17 nt, Human
agaggcagauacuugga

SEQ ID NO: 674099 - RNA, 22 nt, Human
gucugggguacuuucaucugau

SEQ ID NO: 674100 - RNA, 22 nt, Human
aagaggcuuucagugaacuugu

SEQ ID NO: 674101 - RNA, 22 nt, Human
ugaggaugacgauggcaauggc

SEQ ID NO: 674102 - RNA, 22 nt, Human
caaguuuuagcaaguggaaagg

SEQ ID NO: 674103 - RNA, 22 nt, Human
uacuagaaaaacacaugcucug

SEQ ID NO: 674104 - RNA, 22 nt, Human
ugcugccaucucaacugcccuu

SEQ ID NO: 674105 - RNA, 22 nt, Human
auugucuguacuuuaaaaaugu

SEQ ID NO: 674106 - RNA, 22 nt, Human
aagcagacagagaauggguuug

SEQ ID NO: 674107 - RNA, 22 nt, Human
ccacugggggcugcaggcacuc

SEQ ID NO: 674108 - RNA, 22 nt, Human
aagauauacuauuaaguaccau

SEQ ID NO: 674109 - RNA, 22 nt, Human
acaggccagagguggggcagcc

SEQ ID NO: 674110 - RNA, 22 nt, Human
gaguauauauagacaugucaca

SEQ ID NO: 674111 - RNA, 21 nt, Human
caguagugagguauuugccaa

SEQ ID NO: 674112 - RNA, 22 nt, Human
uuggcagaggggccaccugccc

SEQ ID NO: 674113 - RNA, 22 nt, Human
caccagccagagugacagcucc

SEQ ID NO: 674114 - RNA, 22 nt, Human
gagcagcacugaguuagcagcu

SEQ ID NO: 674115 - RNA, 22 nt, Human
uccagacucuuuaaguucauuu

SEQ ID NO: 674116 - RNA, 22 nt, Human
ccuggacuuucauuuccccuug

SEQ ID NO: 674117 - RNA, 22 nt, Human
uagaaacuagauugauagcgga

SEQ ID NO: 674118 - RNA, 22 nt, Human
ggcauccaguucugaucaacaa

SEQ ID NO: 674119 - RNA, 22 nt, Human
auauaauaguuucauaaaggcu

SEQ ID NO: 674120 - RNA, 22 nt, Human
cagagagagucugucccugaag

SEQ ID NO: 674121 - RNA, 20 nt, Human
ucugugugccaucaccuaac

SEQ ID NO: 674122 - RNA, 22 nt, Human
cugagcagcuguuacagagugu

SEQ ID NO: 674123 - RNA, 22 nt, Human
gggcuucuagaccagcagugag

SEQ ID NO: 674124 - RNA, 20 nt, Human
acaaaugcauucugugacau

SEQ ID NO: 674125 - RNA, 22 nt, Human
gagguuggcgcccugccuggcc

SEQ ID NO: 674126 - RNA, 22 nt, Human
cuggacagaaagggcugcugug

SEQ ID NO: 674127 - RNA, 22 nt, Human
cucuuuccucagccacagucua

SEQ ID NO: 674128 - RNA, 22 nt, Human
gucuccagaauucuugggaggg

SEQ ID NO: 674129 - RNA, 20 nt, Human
uuguuuauuauguucugauc

SEQ ID NO: 674130 - RNA, 21 nt, Human
aggaaguggccagauugggaa

SEQ ID NO: 674131 - RNA, 22 nt, Human
aguggcuguaucagucaacccu

SEQ ID NO: 674132 - RNA, 22 nt, Human
uagcagagaggggacaguggca

SEQ ID NO: 674133 - RNA, 22 nt, Human
uccuggccucacaguccugggu

SEQ ID NO: 674134 - RNA, 22 nt, Human
cugugggccuagucuggccuag

SEQ ID NO: 674135 - RNA, 22 nt, Human
caucugagggaaaacauguagu

SEQ ID NO: 674136 - RNA, 22 nt, Human
ucccagcagaugagcugaccua

SEQ ID NO: 674137 - RNA, 22 nt, Human
uggcuggcuagaauggaaaugu

SEQ ID NO: 674138 - RNA, 22 nt, Human
auucacacuuuacuucuuucca

SEQ ID NO: 674139 - RNA, 22 nt, Human
uuggcagcagaguguggugcuc

SEQ ID NO: 674140 - RNA, 22 nt, Human
aauuguacauauuuaugagcga

SEQ ID NO: 674141 - RNA, 22 nt, Human
caugaacagauucuucauuucu

SEQ ID NO: 674142 - RNA, 22 nt, Human
gcaaggcugaccucucuagacu

SEQ ID NO: 674143 - RNA, 22 nt, Human
cuguaugaguugggaauagaau

SEQ ID NO: 674144 - RNA, 22 nt, Human
gcuucugcgccuagccucaggu

SEQ ID NO: 674145 - RNA, 22 nt, Human
auguaagguucagaguauguga

SEQ ID NO: 674146 - RNA, 21 nt, Human
acccuuuguuuaugaaucagc

SEQ ID NO: 674147 - RNA, 22 nt, Human
cuggauuaaguaaaauagagga

SEQ ID NO: 674148 - RNA, 22 nt, Human
uugucugaggguuugagagaau

SEQ ID NO: 674149 - RNA, 22 nt, Human
cagcaaaugaguggcagggcag

SEQ ID NO: 674150 - RNA, 22 nt, Human
gcagaacaacguaggaguggag

SEQ ID NO: 674151 - RNA, 22 nt, Human
gcacacagcuagauuaccauuc

SEQ ID NO: 674152 - RNA, 22 nt, Human
gagcaacagggcgaggagaacu

SEQ ID NO: 674153 - RNA, 22 nt, Human
ggagaagccacacauugggugu

SEQ ID NO: 674154 - RNA, 22 nt, Human
aggcagauuacuugaggccagg

SEQ ID NO: 674155 - RNA, 22 nt, Human
cacaggcugggaagccuaggcc

SEQ ID NO: 674156 - RNA, 22 nt, Human
ugguguugaaccucagcagggg

SEQ ID NO: 674157 - RNA, 22 nt, Human
guauauaagguaaagcgauugu

SEQ ID NO: 674158 - RNA, 21 nt, Human
gccugccccauguuucuguug

SEQ ID NO: 674159 - RNA, 22 nt, Human
cucuggcuggcaccugaucuga

SEQ ID NO: 674160 - RNA, 22 nt, Human
agagcugguuuacucaggaauu

SEQ ID NO: 674161 - RNA, 22 nt, Human
caugcugugugguuagaacugu

SEQ ID NO: 674162 - RNA, 22 nt, Human
cagcuggcagcccuggcccugc

SEQ ID NO: 674163 - RNA, 22 nt, Human
ucaggagacaaagggugcggag

SEQ ID NO: 674164 - RNA, 18 nt, Human
auacaagcagcagagauu

SEQ ID NO: 674165 - RNA, 22 nt, Human
cugaacaaagaaauagucaugg

SEQ ID NO: 674166 - RNA, 20 nt, Human
accugggaaaaccuuuuccu

SEQ ID NO: 674167 - RNA, 22 nt, Human
aaaggcacacacuccuuguuau

SEQ ID NO: 674168 - RNA, 22 nt, Human
gccuccccugcaauuguccuug

SEQ ID NO: 674169 - RNA, 23 nt, Human
auguuaccaauggaggaaauugg

SEQ ID NO: 674170 - RNA, 22 nt, Human
agcuggcuauacuugaaaaguc

SEQ ID NO: 674171 - RNA, 22 nt, Human
uagcaacagaaaauaggagugc

SEQ ID NO: 674172 - RNA, 22 nt, Human
uguuaacauguguauuguauga

SEQ ID NO: 674173 - RNA, 21 nt, Human
uaggacagccccccugcccuc

SEQ ID NO: 674174 - RNA, 22 nt, Human
cagaaauggaauuuuccaucac

SEQ ID NO: 674175 - RNA, 22 nt, Human
ugaguagcggcuauguguaacu

SEQ ID NO: 674176 - RNA, 22 nt, Human
ugauucugucuccuucacuccg

SEQ ID NO: 674177 - RNA, 22 nt, Human
uucagggucuagaguaucuacc

SEQ ID NO: 674178 - RNA, 21 nt, Human
aaggagccuaggaggcucagg

SEQ ID NO: 674179 - RNA, 22 nt, Human
aaaguacugaugccaucagcac

SEQ ID NO: 674180 - RNA, 22 nt, Human
guuuuggcagccguguucacau

SEQ ID NO: 674181 - RNA, 22 nt, Human
cauccugguuaccccauaguca

SEQ ID NO: 674182 - RNA, 22 nt, Human
auucuguuacuuggugaucuuc

SEQ ID NO: 674183 - RNA, 22 nt, Human
auggcccaggccaggauccagc

SEQ ID NO: 674184 - RNA, 22 nt, Human
acaggcuuacuguuucauaggg

SEQ ID NO: 674185 - RNA, 22 nt, Human
uccucagacacccugcuggcuu

SEQ ID NO: 674186 - RNA, 22 nt, Human
aggccacagccugggaggugac

SEQ ID NO: 674187 - RNA, 22 nt, Human
aucacuguguauguauaugcag

SEQ ID NO: 674188 - RNA, 22 nt, Human
ugagaaccucgaagauuuugcc

SEQ ID NO: 674189 - RNA, 22 nt, Human
aggaggccccuccuggguugcu

SEQ ID NO: 674190 - RNA, 22 nt, Human
cuauuagacacaauuagugauu

SEQ ID NO: 674191 - RNA, 22 nt, Human
cagggcaugaggugugcuucuc

SEQ ID NO: 674192 - RNA, 22 nt, Human
agacaauggagagcagaguacu

SEQ ID NO: 674193 - RNA, 22 nt, Human
ugcaagacgugaaauugagaca

SEQ ID NO: 674194 - RNA, 20 nt, Human
gcuaccagaacaaggccauu

SEQ ID NO: 674195 - RNA, 22 nt, Human
uugcucugacuggagugcagug

SEQ ID NO: 674196 - RNA, 22 nt, Human
cuuccugaaaguaguagguuga

SEQ ID NO: 674197 - RNA, 17 nt, Human
gcugagugcagggaguc

SEQ ID NO: 674198 - RNA, 23 nt, Human
acccugggcaagucaccuaaccu

SEQ ID NO: 674199 - RNA, 22 nt, Human
ggacauagaggcccugcauggc

SEQ ID NO: 674200 - RNA, 22 nt, Human
uguggaaaagaauaagggagau

SEQ ID NO: 674201 - RNA, 22 nt, Human
gagcugggcgagccggggaagu

SEQ ID NO: 674202 - RNA, 22 nt, Human
cugggcucuucucacccuguuu

SEQ ID NO: 674203 - RNA, 22 nt, Human
cuggggccagugaggaggcuuu

SEQ ID NO: 674204 - RNA, 22 nt, Human
uaugagaaauuauaccuagguu

SEQ ID NO: 674205 - RNA, 20 nt, Human
gugugaagcccucaggagga

SEQ ID NO: 674206 - RNA, 22 nt, Human
agagccacaguggauaggagcc

SEQ ID NO: 674207 - RNA, 22 nt, Human
gcucagcacuuucuccaaccac

SEQ ID NO: 674208 - RNA, 18 nt, Human
ugcuggguaacuguaugg

SEQ ID NO: 674209 - RNA, 22 nt, Human
ucucugcuugguguaugugagu

SEQ ID NO: 674210 - RNA, 22 nt, Human
cgaggcagggaagcugcaaaag

SEQ ID NO: 674211 - RNA, 22 nt, Human
cagguucucagaaggcagucac

SEQ ID NO: 674212 - RNA, 22 nt, Human
gucauuuugcugcauauuuaga

SEQ ID NO: 674213 - RNA, 22 nt, Human
ucacaguaucagguggagugga

SEQ ID NO: 674214 - RNA, 22 nt, Human
acacacagguaaaggagccugg

SEQ ID NO: 674215 - RNA, 22 nt, Human
uuuuaauacugcuauuguagga

SEQ ID NO: 674216 - RNA, 22 nt, Human
uuucaucucucuaaaagacagu

SEQ ID NO: 674217 - RNA, 22 nt, Human
caaaugaagggagcugaagucu

SEQ ID NO: 674218 - RNA, 22 nt, Human
cuguggcuucagcauucagagc

SEQ ID NO: 674219 - RNA, 22 nt, Human
uuuaauuugaaaugaguaaccc

SEQ ID NO: 674220 - RNA, 16 nt, Human
ucucugcuucauaggu

SEQ ID NO: 674221 - RNA, 22 nt, Human
uuauaguaugugcauaugugug

SEQ ID NO: 674222 - RNA, 22 nt, Human
aucaggaucaugcuggguggga

SEQ ID NO: 674223 - RNA, 22 nt, Human
aagggcuggagaggaaagguug

SEQ ID NO: 674224 - RNA, 20 nt, Human
acugccuugguucaguaggu

SEQ ID NO: 674225 - RNA, 22 nt, Human
uuaaaagagacuuccuuuguuu

SEQ ID NO: 674226 - RNA, 22 nt, Human
gcccugcuguuuagagagcuac

SEQ ID NO: 674227 - RNA, 22 nt, Human
ucugaggccccugggcaggaug

SEQ ID NO: 674228 - RNA, 22 nt, Human
caauucaaguugaguacagcuu

SEQ ID NO: 674229 - RNA, 22 nt, Human
ucucauucauacccuacaugcu

SEQ ID NO: 674230 - RNA, 22 nt, Human
ccagagcugauuccugggacuu

SEQ ID NO: 674231 - RNA, 22 nt, Human
aaucuaaggacuuagcauugcu

SEQ ID NO: 674232 - RNA, 22 nt, Human
ucucuggguuuuuguccuguac

SEQ ID NO: 674233 - RNA, 22 nt, Human
ugucugaggaagucagcccuuu

SEQ ID NO: 674234 - RNA, 22 nt, Human
uggcaggcauccggcaccuucu

SEQ ID NO: 674235 - RNA, 22 nt, Human
uggguccuggaaggcgacaggu

SEQ ID NO: 674236 - RNA, 22 nt, Human
cauauuucagucuaagaugugu

SEQ ID NO: 674237 - RNA, 22 nt, Human
ucacugcucucuaagcaucgcc

SEQ ID NO: 674238 - RNA, 22 nt, Human
uuucuuuguuguuaucacauca

SEQ ID NO: 674239 - RNA, 22 nt, Human
agauggaguuaguaccagaguc

SEQ ID NO: 674240 - RNA, 22 nt, Human
aucacuguuaucuagaagcaca

SEQ ID NO: 674241 - RNA, 22 nt, Human
ggucucagugaaggagugugcu

SEQ ID NO: 674242 - RNA, 21 nt, Human
gagugcaggucugaugccauc

SEQ ID NO: 674243 - RNA, 22 nt, Human
agaaaugcucuuccugaccaga

SEQ ID NO: 674244 - RNA, 22 nt, Human
ugcagaagugagucaugaggaa

SEQ ID NO: 674245 - RNA, 22 nt, Human
caucaggaggagaugaagaaaa

SEQ ID NO: 674246 - RNA, 22 nt, Human
uggucugagcaacugcccuauc

SEQ ID NO: 674247 - RNA, 22 nt, Human
uguucagcccucuauuaaucag

SEQ ID NO: 674248 - RNA, 22 nt, Human
ugaguuuuuucaacauaugaag

SEQ ID NO: 674249 - RNA, 22 nt, Human
aguacuuugcacuuugcucaga

SEQ ID NO: 674250 - RNA, 20 nt, Human
gccaguaccauucugccacu

SEQ ID NO: 674251 - RNA, 22 nt, Human
gcagagugauggaaugugggug

SEQ ID NO: 674252 - RNA, 22 nt, Human
ugggccuggacaaggccacuag

SEQ ID NO: 674253 - RNA, 22 nt, Human
aguugcuucccuauucuuagca

SEQ ID NO: 674254 - RNA, 22 nt, Human
uccuggcugcaccagugacccu

SEQ ID NO: 674255 - RNA, 22 nt, Human
accagggcugacaaucugaugg

SEQ ID NO: 674256 - RNA, 22 nt, Human
agagcugcucagaugucacugc

SEQ ID NO: 674257 - RNA, 22 nt, Human
agcagcaggaggcuguccacca

SEQ ID NO: 674258 - RNA, 22 nt, Human
ggaacaggaaaggagggaugcu

SEQ ID NO: 674259 - RNA, 22 nt, Human
cagucaaacuuauaggcacauu

SEQ ID NO: 674260 - RNA, 22 nt, Human
aggguggagggagucccugagc

SEQ ID NO: 674261 - RNA, 20 nt, Human
ugaagcagccuugauucugu

SEQ ID NO: 674262 - RNA, 22 nt, Human
ugucagcaugucagccaaagau

SEQ ID NO: 674263 - RNA, 22 nt, Human
ucuccgaucacagguuuucaau

SEQ ID NO: 674264 - RNA, 22 nt, Human
caugagaaccaggucuguguuu

SEQ ID NO: 674265 - RNA, 22 nt, Human
caguaacuaggacaaggaggaa

SEQ ID NO: 674266 - RNA, 22 nt, Human
uuacuguugguguauccauagc

SEQ ID NO: 674267 - RNA, 23 nt, Human
cccugcucaggggucugauucuc

SEQ ID NO: 674268 - RNA, 22 nt, Human
cugcuuugacuguuaagaacca

SEQ ID NO: 674269 - RNA, 22 nt, Human
gacugccagaaugugaggccug

SEQ ID NO: 674270 - RNA, 22 nt, Human
ggcuucuaaggaguauccuuug

SEQ ID NO: 674271 - RNA, 22 nt, Human
uuuuccucuguauuugaaaugc

SEQ ID NO: 674272 - RNA, 22 nt, Human
cucaugugcaaaaguccaaauu

SEQ ID NO: 674273 - RNA, 22 nt, Human
agggcugucagacugaggaggc

SEQ ID NO: 674274 - RNA, 22 nt, Human
ccaggaggaaagaccagcccau

SEQ ID NO: 674275 - RNA, 22 nt, Human
ggucaggauccaagucugugcu

SEQ ID NO: 674276 - RNA, 22 nt, Human
ucugggcaguaccccucuccua

SEQ ID NO: 674277 - RNA, 22 nt, Human
ugggcugcacuccauuuucugc

SEQ ID NO: 674278 - RNA, 22 nt, Human
cugaggccucuuuccuuggcuu

SEQ ID NO: 674279 - RNA, 20 nt, Human
acgcacacgcgggggcgugc

SEQ ID NO: 674280 - RNA, 22 nt, Human
gcucugacacauuuguucuacc

SEQ ID NO: 674281 - RNA, 22 nt, Human
aacugaacagaacucagagauu

SEQ ID NO: 674282 - RNA, 22 nt, Human
caugaacuccaagcuuccuucc

SEQ ID NO: 674283 - RNA, 22 nt, Human
gcugccuccugagauuugggca

SEQ ID NO: 674284 - RNA, 22 nt, Human
uuagaaccaggguuacgauucu

SEQ ID NO: 674285 - RNA, 22 nt, Human
ugagcagauggaggcuucugca

SEQ ID NO: 674286 - RNA, 22 nt, Human
ugucucugauaaguaguucagu

SEQ ID NO: 674287 - RNA, 22 nt, Human
cagcacauaguagguauucacu

SEQ ID NO: 674288 - RNA, 22 nt, Human
uaguaucuauuaguaacaagag

SEQ ID NO: 674289 - RNA, 22 nt, Human
gcccaggaggucaaguagcuau

SEQ ID NO: 674290 - RNA, 22 nt, Human
ugaagcaagauagaaagcugcu

SEQ ID NO: 674291 - RNA, 22 nt, Human
uuggagaauguuuuccugcagu

SEQ ID NO: 674292 - RNA, 22 nt, Human
cuggggcucucuggaaugcuug

SEQ ID NO: 674293 - RNA, 22 nt, Human
gacuggagugccuccaggaaag

SEQ ID NO: 674294 - RNA, 22 nt, Human
ccacccuuggguucggaggccg

SEQ ID NO: 674295 - RNA, 20 nt, Human
uauggcuuggcaaagcuuca

SEQ ID NO: 674296 - RNA, 22 nt, Human
aagaugguggccagaguggaaa

SEQ ID NO: 674297 - RNA, 22 nt, Human
augcagaagaaaccauggcuuc

SEQ ID NO: 674298 - RNA, 22 nt, Human
ucacugcuuuguuuacaacuau

SEQ ID NO: 674299 - RNA, 22 nt, Human
ccagcagacacacaggcguggg

SEQ ID NO: 674300 - RNA, 22 nt, Human
gaacaggguugggugagagagg

SEQ ID NO: 674301 - RNA, 22 nt, Human
aaaagacauaugugggcauucu

SEQ ID NO: 674302 - RNA, 22 nt, Human
guucaaauugagaugguauaaa

SEQ ID NO: 674303 - RNA, 23 nt, Human
gaauacagagauaaauagaacac

SEQ ID NO: 674304 - RNA, 22 nt, Human
gagagccagcucacuccagggc

SEQ ID NO: 674305 - RNA, 21 nt, Human
ugggccagaucugaguuucua

SEQ ID NO: 674306 - RNA, 22 nt, Human
ucuguuuaggcaaaauagcuac

SEQ ID NO: 674307 - RNA, 22 nt, Human
uuugugaaaugaagucacaacu

SEQ ID NO: 674308 - RNA, 22 nt, Human
guuuacaugcagaaaaucaaug

SEQ ID NO: 674309 - RNA, 22 nt, Human
ucccagugcugcuaaagaggua

SEQ ID NO: 674310 - RNA, 22 nt, Human
ccucacagaggggcagccaucu

SEQ ID NO: 674311 - RNA, 22 nt, Human
cugugggagaaguugcuggagu

SEQ ID NO: 674312 - RNA, 22 nt, Human
gauaauauuagaagauacaaau

SEQ ID NO: 674313 - RNA, 22 nt, Human
agcuucauaauuccuugacuca

SEQ ID NO: 674314 - RNA, 22 nt, Human
ggggcugaaccuggaggugguc

SEQ ID NO: 674315 - RNA, 22 nt, Human
uuguaacaaucugucauaaaug

SEQ ID NO: 674316 - RNA, 22 nt, Human
ugugacaggaacuauguggaug

SEQ ID NO: 674317 - RNA, 22 nt, Human
cccugagagugagugccaccuu

SEQ ID NO: 674318 - RNA, 22 nt, Human
uggcuggcguuggggccaguga

SEQ ID NO: 674319 - RNA, 22 nt, Human
gacuuuaaguccuaucugugcg

SEQ ID NO: 674320 - RNA, 22 nt, Human
cugcccugugguuguggguucu

SEQ ID NO: 674321 - RNA, 18 nt, Human
agcuggggccucuggucc

SEQ ID NO: 674322 - RNA, 22 nt, Human
guaauagucucaaacuccugga

SEQ ID NO: 674323 - RNA, 22 nt, Human
cugagcgcaugguugcugggga

SEQ ID NO: 674324 - RNA, 22 nt, Human
cugggaagccacaggguguggg

SEQ ID NO: 674325 - RNA, 22 nt, Human
agacagcugcucgcagagcuau

SEQ ID NO: 674326 - RNA, 17 nt, Human
uguauuuguaccacagc

SEQ ID NO: 674327 - RNA, 22 nt, Human
uacaguauguucuugaauuugg

SEQ ID NO: 674328 - RNA, 22 nt, Human
cugggaggcccacguugggaag

SEQ ID NO: 674329 - RNA, 23 nt, Human
cccauuuucauguuaacuccugg

SEQ ID NO: 674330 - RNA, 22 nt, Human
cagacugaaaaucccugguagu

SEQ ID NO: 674331 - RNA, 22 nt, Human
uucagagaacuucauggaagag

SEQ ID NO: 674332 - RNA, 22 nt, Human
acugaucaaggguuuaauuuua

SEQ ID NO: 674333 - RNA, 18 nt, Human
ccagcugcgcugaaccga

SEQ ID NO: 674334 - RNA, 22 nt, Human
uucuccagagggcucugcagga

SEQ ID NO: 674335 - RNA, 22 nt, Human
cuggcuggucaucagcaguacg

SEQ ID NO: 674336 - RNA, 22 nt, Human
gagaucauggcuucugcugaua

SEQ ID NO: 674337 - RNA, 21 nt, Human
ucucuacacuuucacuaggcu

SEQ ID NO: 674338 - RNA, 22 nt, Human
acaagacugugcucuaagagug

SEQ ID NO: 674339 - RNA, 22 nt, Human
ggcucuggucagugaggggccu

SEQ ID NO: 674340 - RNA, 22 nt, Human
aaaacauguccauacagaaacu

SEQ ID NO: 674341 - RNA, 22 nt, Human
ucuuuccacauucucuguuuag

SEQ ID NO: 674342 - RNA, 19 nt, Human
uuucugcagcccagcagca

SEQ ID NO: 674343 - RNA, 22 nt, Human
cuucugaccccuggucuacagc

SEQ ID NO: 674344 - RNA, 22 nt, Human
gaagagcuguagccugcucuuu

SEQ ID NO: 674345 - RNA, 22 nt, Human
gacagacauuuccugauccaau

SEQ ID NO: 674346 - RNA, 22 nt, Human
uaaauugcugauuuuagaugcu

SEQ ID NO: 674347 - RNA, 22 nt, Human
ugggcagaauugugguaguuaa

SEQ ID NO: 674348 - RNA, 20 nt, Human
cagagacccaggcuucagcu

SEQ ID NO: 674349 - RNA, 23 nt, Human
ugcaguaggauggggcugggccu

SEQ ID NO: 674350 - RNA, 22 nt, Human
ugcauuaaggccauugaaauuu

SEQ ID NO: 674351 - RNA, 22 nt, Human
uacacauaaaaugcucauggua

SEQ ID NO: 674352 - RNA, 22 nt, Human
gcaaacaagcugccugaagauu

SEQ ID NO: 674353 - RNA, 21 nt, Human
ucacacacguuuccaagggca

SEQ ID NO: 674354 - RNA, 22 nt, Human
gagguuuuaggcugccauuauu

SEQ ID NO: 674355 - RNA, 22 nt, Human
acuaaaacaguggcuaguagac

SEQ ID NO: 674356 - RNA, 22 nt, Human
ccacagaagauggggagagugg

SEQ ID NO: 674357 - RNA, 22 nt, Human
guggggcaugcacgcugcuccu

SEQ ID NO: 674358 - RNA, 22 nt, Human
gaaucugcauuuuaacaagauc

SEQ ID NO: 674359 - RNA, 22 nt, Human
uuucugcagguauugcauaagu

SEQ ID NO: 674360 - RNA, 22 nt, Human
cauuugaaauaguucauucuug

SEQ ID NO: 674361 - RNA, 22 nt, Human
ccuggcugaacaaagucccucc

SEQ ID NO: 674362 - RNA, 22 nt, Human
uaaagugaaguucagaauggcu

SEQ ID NO: 674363 - RNA, 22 nt, Human
ugcuugacuuugucacagcaug

SEQ ID NO: 674364 - RNA, 22 nt, Human
ugagaccuguaaugagaaauug

SEQ ID NO: 674365 - RNA, 22 nt, Human
aauuuguuaaaagugagugaca

SEQ ID NO: 674366 - RNA, 22 nt, Human
cagagcauaauugacaugaggu

SEQ ID NO: 674367 - RNA, 22 nt, Human
ccugggcaucucaugcaccugc

SEQ ID NO: 674368 - RNA, 22 nt, Human
cugcuguguaucauuuuagaug

SEQ ID NO: 674369 - RNA, 22 nt, Human
auauaggcagaaaggaaggcaa

SEQ ID NO: 674370 - RNA, 22 nt, Human
ggcucugcccagaugaagagga

SEQ ID NO: 674371 - RNA, 22 nt, Human
ccugcuuccuucaaguuuaucu

SEQ ID NO: 674372 - RNA, 22 nt, Human
gcugcuuccuagaaggcccagu

SEQ ID NO: 674373 - RNA, 22 nt, Human
caugucagggaagagagucagu

SEQ ID NO: 674374 - RNA, 22 nt, Human
augcacauguggcuuuauguau

SEQ ID NO: 674375 - RNA, 22 nt, Human
gagggcucacugagaaagcagu

SEQ ID NO: 674376 - RNA, 21 nt, Human
auagaacaccaggcauauaua

SEQ ID NO: 674377 - RNA, 22 nt, Human
auuucuugugggaaaugcagca

SEQ ID NO: 674378 - RNA, 22 nt, Human
gagggacagcuaaagagaaauu

SEQ ID NO: 674379 - RNA, 19 nt, Human
ggcuaaugucuuugaaaua

SEQ ID NO: 674380 - RNA, 22 nt, Human
auucuuauuauaguaaaacagu

SEQ ID NO: 674381 - RNA, 22 nt, Human
caucuucaccagagacaagcaa

SEQ ID NO: 674382 - RNA, 22 nt, Human
uaaauccuuaucuucuuugaau

SEQ ID NO: 674383 - RNA, 22 nt, Human
aagagcugcccaaggugaacag

SEQ ID NO: 674384 - RNA, 22 nt, Human
cagucaggcugcgcuucucuga

SEQ ID NO: 674385 - RNA, 22 nt, Human
caguggggggacugaggccuga

SEQ ID NO: 674386 - RNA, 22 nt, Human
ucccuggcugggggcugccuug

SEQ ID NO: 674387 - RNA, 22 nt, Human
acaggcaagucacacaacuugu

SEQ ID NO: 674388 - RNA, 22 nt, Human
accugagacuugggaugggaau

SEQ ID NO: 674389 - RNA, 22 nt, Human
ccagcauccucagcucacuucu

SEQ ID NO: 674390 - RNA, 22 nt, Human
caugcaaaggucaagaucagga

SEQ ID NO: 674391 - RNA, 22 nt, Human
caugcagugccucuggauucuu

SEQ ID NO: 674392 - RNA, 22 nt, Human
cugguuuuauguuauagaugga

SEQ ID NO: 674393 - RNA, 22 nt, Human
ugugugccagauacaagcacug

SEQ ID NO: 674394 - RNA, 22 nt, Human
uguuugugagaugugagguacg

SEQ ID NO: 674395 - RNA, 22 nt, Human
acugggaaggaaaggaauguaa

SEQ ID NO: 674396 - RNA, 22 nt, Human
cacaauuuguuuuaucaguauu

SEQ ID NO: 674397 - RNA, 22 nt, Human
gcucccagucugauggaggaga

SEQ ID NO: 674398 - RNA, 22 nt, Human
aguuucucuuaaucuaguaucu

SEQ ID NO: 674399 - RNA, 22 nt, Human
caguaauaagcuggagggugug

SEQ ID NO: 674400 - RNA, 22 nt, Human
ggcucugccugcccagcagcac

SEQ ID NO: 674401 - RNA, 22 nt, Human
gaccacugaaugcacuucuaau

SEQ ID NO: 674402 - RNA, 22 nt, Human
uaauccuuuagguuaaaagagg

SEQ ID NO: 674403 - RNA, 22 nt, Human
ucuaacuugugaguauagauga

SEQ ID NO: 674404 - RNA, 22 nt, Human
ucccucagucccuggacaggca

SEQ ID NO: 674405 - RNA, 22 nt, Human
cugccccaggaccucuucugga

SEQ ID NO: 674406 - RNA, 22 nt, Human
aaaauagcuauggaaugucacu

SEQ ID NO: 674407 - RNA, 22 nt, Human
ggcugcucggagccuccuguga

SEQ ID NO: 674408 - RNA, 21 nt, Human
gagugggcugagauggggcug

SEQ ID NO: 674409 - RNA, 22 nt, Human
aauagcaaacagacaugcacaa

SEQ ID NO: 674410 - RNA, 22 nt, Human
aaugguuuugucucaucaaugu

SEQ ID NO: 674411 - RNA, 22 nt, Human
gcacagcagcugggggcccugg

SEQ ID NO: 674412 - RNA, 22 nt, Human
uauguguguaugacagacagag

SEQ ID NO: 674413 - RNA, 22 nt, Human
ugucaguuuaguugaagaaaga

SEQ ID NO: 674414 - RNA, 20 nt, Human
ggccaccugcuucagacccc

SEQ ID NO: 674415 - RNA, 22 nt, Human
ugccauauugcaaagugucugc

SEQ ID NO: 674416 - RNA, 22 nt, Human
cuuaaacaggaaagagccaggu

SEQ ID NO: 674417 - RNA, 22 nt, Human
ccaggcagggagcuguuuggcc

SEQ ID NO: 674418 - RNA, 22 nt, Human
ggcaaggaagaagccaugaugu

SEQ ID NO: 674419 - RNA, 22 nt, Human
ugaguagaccucacgugucaga

SEQ ID NO: 674420 - RNA, 22 nt, Human
uguaaaauaauucuccauguuu

SEQ ID NO: 674421 - RNA, 22 nt, Human
acccagccacagcauugaggga

SEQ ID NO: 674422 - RNA, 22 nt, Human
gccucuggguuggugacaggcu

SEQ ID NO: 674423 - RNA, 22 nt, Human
gagaaagacguaggcugggagg

SEQ ID NO: 674424 - RNA, 22 nt, Human
acauaaugagcucuuuauaaau

SEQ ID NO: 674425 - RNA, 22 nt, Human
ggaggaggggugacugaaugcu

SEQ ID NO: 674426 - RNA, 22 nt, Human
cuagggcucgcaagggcuggag

SEQ ID NO: 674427 - RNA, 21 nt, Human
ugccagggauuuacagagccu

SEQ ID NO: 674428 - RNA, 22 nt, Human
caggaggcccaaagggcgcaga

SEQ ID NO: 674429 - RNA, 22 nt, Human
aggcuucauguguccuggguga

SEQ ID NO: 674430 - RNA, 22 nt, Human
gaggaacagagggcaaggccag

SEQ ID NO: 674431 - RNA, 17 nt, Human
caggcacaugaagccag

SEQ ID NO: 674432 - RNA, 23 nt, Human
gccaaguagggggaaagcccgug

SEQ ID NO: 674433 - RNA, 22 nt, Human
gggagcugaggagccccgucgg

SEQ ID NO: 674434 - RNA, 22 nt, Human
uccaggcaaagccuuguagacg

SEQ ID NO: 674435 - RNA, 22 nt, Human
ccgggggaggcaagagacaugc

SEQ ID NO: 674436 - RNA, 22 nt, Human
uuacagauacauuucuuuuguu

SEQ ID NO: 674437 - RNA, 23 nt, Human
ugauucagcaaguccacuucugg

SEQ ID NO: 674438 - RNA, 22 nt, Human
gcacagccacugagugagaacc

SEQ ID NO: 674439 - RNA, 22 nt, Human
uaggugugggcucaggaaugug

SEQ ID NO: 674440 - RNA, 22 nt, Human
agcacagggcccagccuaggcc

SEQ ID NO: 674441 - RNA, 22 nt, Human
uccucaguaaggcauggcuuug

SEQ ID NO: 674442 - RNA, 22 nt, Human
caggcacaaaaggaccccagca

SEQ ID NO: 674443 - RNA, 22 nt, Human
aggcccuggcacugccugggag

SEQ ID NO: 674444 - RNA, 22 nt, Human
uccuggguagccuguccaagau

SEQ ID NO: 674445 - RNA, 22 nt, Human
aaacauugaugggaaguuuaau

SEQ ID NO: 674446 - RNA, 22 nt, Human
cauagaaugcagcaggaaaguu

SEQ ID NO: 674447 - RNA, 22 nt, Human
ugggaagggucaacagcuggaa

SEQ ID NO: 674448 - RNA, 22 nt, Human
cuucugugagucaguguuucug

SEQ ID NO: 674449 - RNA, 22 nt, Human
uccagagccuuucugcuugaca

SEQ ID NO: 674450 - RNA, 22 nt, Human
caugcaggccuauggagcagug

SEQ ID NO: 674451 - RNA, 21 nt, Human
acauguaagagaguuucaaga

SEQ ID NO: 674452 - RNA, 22 nt, Human
cuuucaguuaguaccuaguggc

SEQ ID NO: 674453 - RNA, 22 nt, Human
caccugcaaggagcuuucauuu

SEQ ID NO: 674454 - RNA, 22 nt, Human
gggucagggcuggcugucguca

SEQ ID NO: 674455 - RNA, 22 nt, Human
gcuucauuaauagaauuaguau

SEQ ID NO: 674456 - RNA, 22 nt, Human
agcaggcauagaguagcacuca

SEQ ID NO: 674457 - RNA, 22 nt, Human
uuuuacacuucgguugugugca

SEQ ID NO: 674458 - RNA, 22 nt, Human
gcugccaggggcagcugucuca

SEQ ID NO: 674459 - RNA, 22 nt, Human
acagaggucauggagaguucuc

SEQ ID NO: 674460 - RNA, 22 nt, Human
uccaucuggugagugaggagcc

SEQ ID NO: 674461 - RNA, 22 nt, Human
gauccugggacugaaugggugc

SEQ ID NO: 674462 - RNA, 23 nt, Human
agaguccacaagauuuuccagug

SEQ ID NO: 674463 - RNA, 22 nt, Human
ugcugggccucuucccuggaua

SEQ ID NO: 674464 - RNA, 22 nt, Human
uaacaucaaacauguuuuaaag

SEQ ID NO: 674465 - RNA, 22 nt, Human
gaguuggcuacucucugaggcu

SEQ ID NO: 674466 - RNA, 22 nt, Human
ucugggaagcugguccuguucu

SEQ ID NO: 674467 - RNA, 19 nt, Human
ugcaggaggacugagcaga

SEQ ID NO: 674468 - RNA, 22 nt, Human
uauugaggaucuccugcuaauu

SEQ ID NO: 674469 - RNA, 22 nt, Human
ugagaacggauacuaagggcug

SEQ ID NO: 674470 - RNA, 22 nt, Human
ggcaggugguaaggauuucaua

SEQ ID NO: 674471 - RNA, 20 nt, Human
uucagaaauaaggaaugagg

SEQ ID NO: 674472 - RNA, 22 nt, Human
aggcugucucaccucaggaggg

SEQ ID NO: 674473 - RNA, 22 nt, Human
auagaagauagcuuuuguuucu

SEQ ID NO: 674474 - RNA, 19 nt, Human
ugaagagcugucaaaagug

SEQ ID NO: 674475 - RNA, 22 nt, Human
gaggcagagugcaccccaggag

SEQ ID NO: 674476 - RNA, 22 nt, Human
augucacaucugggauggcccu

SEQ ID NO: 674477 - RNA, 22 nt, Human
gaucugggagccucauggagac

SEQ ID NO: 674478 - RNA, 22 nt, Human
cacaauuguaucagaaaauagu

SEQ ID NO: 674479 - RNA, 21 nt, Human
uggagacucugguucuuugug

SEQ ID NO: 674480 - RNA, 22 nt, Human
gauucccaugucugaggaggug

SEQ ID NO: 674481 - RNA, 22 nt, Human
uuucucaaguacugcacaugaa

SEQ ID NO: 674482 - RNA, 22 nt, Human
auuugaauggcuuaacacaacg

SEQ ID NO: 674483 - RNA, 22 nt, Human
aggacuucuccgauaagucaga

SEQ ID NO: 674484 - RNA, 22 nt, Human
cuccagugcacccagaggauuu

SEQ ID NO: 674485 - RNA, 21 nt, Human
uagggcucucugugucaggug

SEQ ID NO: 674486 - RNA, 22 nt, Human
ucuguuuuguaccagauacagc

SEQ ID NO: 674487 - RNA, 22 nt, Human
ugugccuacugauagagccaag

SEQ ID NO: 674488 - RNA, 22 nt, Human
cagugccucuuaagugucaccc

SEQ ID NO: 674489 - RNA, 22 nt, Human
gggaagagauuuccacaucauu

SEQ ID NO: 674490 - RNA, 22 nt, Human
caggcuggagugaguguagugg

SEQ ID NO: 674491 - RNA, 20 nt, Human
cccuccagcaaccaggacuu

SEQ ID NO: 674492 - RNA, 22 nt, Human
auucuuaaauuuaggucuguga

SEQ ID NO: 674493 - RNA, 22 nt, Human
gaguggagcaaaagagguagau

SEQ ID NO: 674494 - RNA, 18 nt, Human
caaauacuguugucuuau

SEQ ID NO: 674495 - RNA, 17 nt, Human
cuggccaguguacuugg

SEQ ID NO: 674496 - RNA, 22 nt, Human
cuguggaagguuuagauaggua

SEQ ID NO: 674497 - RNA, 21 nt, Human
uucauugaacuauuuguggag

SEQ ID NO: 674498 - RNA, 19 nt, Human
ucuggguauuuggaagaug

SEQ ID NO: 674499 - RNA, 22 nt, Human
ugacaaguacauaauuucaugu

SEQ ID NO: 674500 - RNA, 21 nt, Human
uuguuacauucuuauggcaua

SEQ ID NO: 674501 - RNA, 22 nt, Human
cucugaacucuugggcagcaug

SEQ ID NO: 674502 - RNA, 22 nt, Human
ccuuuaaagacugcauaacuuc

SEQ ID NO: 674503 - RNA, 22 nt, Human
auaaagcaaauaggacuauugc

SEQ ID NO: 674504 - RNA, 21 nt, Human
ccuugggaugcaagugagacu

SEQ ID NO: 674505 - RNA, 22 nt, Human
ggggccacuggcaggaccuugg

SEQ ID NO: 674506 - RNA, 22 nt, Human
caguucaaaauuuugaagaagg

SEQ ID NO: 674507 - RNA, 22 nt, Human
cuguggcugcagaccuuaaaca

SEQ ID NO: 674508 - RNA, 22 nt, Human
uggaacacagugauugauagcg

SEQ ID NO: 674509 - RNA, 22 nt, Human
augcaugagucacucagugcag

SEQ ID NO: 674510 - RNA, 22 nt, Human
gagucagaccgacugggcucau

SEQ ID NO: 674511 - RNA, 22 nt, Human
gccaugggucugcuggcucagc

SEQ ID NO: 674512 - RNA, 22 nt, Human
ucucuggcagaggcccuauccc

SEQ ID NO: 674513 - RNA, 22 nt, Human
aaguuucaugauguaauuauug

SEQ ID NO: 674514 - RNA, 22 nt, Human
cuucuuaaaguugucacagcug

SEQ ID NO: 674515 - RNA, 22 nt, Human
uuccuguggccuuacaucugug

SEQ ID NO: 674516 - RNA, 22 nt, Human
caugaugguucuuacaaaggug

SEQ ID NO: 674517 - RNA, 22 nt, Human
agcaaccuggaucauggugaaa

SEQ ID NO: 674518 - RNA, 22 nt, Human
ucugccuggaugauggcagggc

SEQ ID NO: 674519 - RNA, 22 nt, Human
ucaggccaaagaaacagcauga

SEQ ID NO: 674520 - RNA, 22 nt, Human
uuauugggucccaacaaguugc

SEQ ID NO: 674521 - RNA, 22 nt, Human
gcagggcaugggcccugucugc

SEQ ID NO: 674522 - RNA, 23 nt, Human
uguaggcuguaguuuguaggucc

SEQ ID NO: 674523 - RNA, 22 nt, Human
uucucagaauugacugggagca

SEQ ID NO: 674524 - RNA, 22 nt, Human
gcuguggcugaagaugcaggga

SEQ ID NO: 674525 - RNA, 22 nt, Human
ucacugcagacaaccucaguca

SEQ ID NO: 674526 - RNA, 21 nt, Human
ugcuucccugggccacacuga

SEQ ID NO: 674527 - RNA, 22 nt, Human
acugaaaugaaaucuaucaucu

SEQ ID NO: 674528 - RNA, 22 nt, Human
aauggcuuacccuggauugugu

SEQ ID NO: 674529 - RNA, 22 nt, Human
gcaggccugucuugcucgcccu

SEQ ID NO: 674530 - RNA, 19 nt, Human
ucugagguggaacuggggg

SEQ ID NO: 674531 - RNA, 22 nt, Human
acuuuguuguuccuugucuaaa

SEQ ID NO: 674532 - RNA, 22 nt, Human
caggaugagguagaggcagaua

SEQ ID NO: 674533 - RNA, 22 nt, Human
gcucuguggcauucaugggcag

SEQ ID NO: 674534 - RNA, 22 nt, Human
ggcagagacuggguuggcagag

SEQ ID NO: 674535 - RNA, 22 nt, Human
agaggcugggaaggguccccgg

SEQ ID NO: 674536 - RNA, 17 nt, Human
cccugccaccaggaagc

SEQ ID NO: 674537 - RNA, 19 nt, Human
ggcauccacagcuggagag

SEQ ID NO: 674538 - RNA, 22 nt, Human
ugggccagaggcauggagcuau

SEQ ID NO: 674539 - RNA, 22 nt, Human
cugaggcugcccagggccaggu

SEQ ID NO: 674540 - RNA, 22 nt, Human
cucugagcccgcugcagcccca

SEQ ID NO: 674541 - RNA, 22 nt, Human
caaaagggaguucucuggaagg

SEQ ID NO: 674542 - RNA, 20 nt, Human
agaagccaagugacauguuu

SEQ ID NO: 674543 - RNA, 22 nt, Human
augcuuucuucuuuccuguaag

SEQ ID NO: 674544 - RNA, 22 nt, Human
agagcccucugcaaugccucag

SEQ ID NO: 674545 - RNA, 19 nt, Human
aggcugcaagguggugggc

SEQ ID NO: 674546 - RNA, 22 nt, Human
acacaugcugauaagaauauaa

SEQ ID NO: 674547 - RNA, 17 nt, Human
cauccgugagcucggca

SEQ ID NO: 674548 - RNA, 22 nt, Human
caagucaagcaugcccuuauuu

SEQ ID NO: 674549 - RNA, 22 nt, Human
aaagcugcccuugugaaacaag

SEQ ID NO: 674550 - RNA, 22 nt, Human
augggcaggccucucauuucug

SEQ ID NO: 674551 - RNA, 22 nt, Human
ugucacagggauaccauggggc

SEQ ID NO: 674552 - RNA, 22 nt, Human
gucccagaaacauauugcuggu

SEQ ID NO: 674553 - RNA, 22 nt, Human
gccucugggguggagcccagca

SEQ ID NO: 674554 - RNA, 22 nt, Human
ucagcagggcugggagcuguga

SEQ ID NO: 674555 - RNA, 22 nt, Human
uuguguguacugguuaugggca

SEQ ID NO: 674556 - RNA, 22 nt, Human
gggaagcaucugaggguccacu

SEQ ID NO: 674557 - RNA, 22 nt, Human
aaaauucugucauuaaauugug

SEQ ID NO: 674558 - RNA, 19 nt, Human
acuucuuuucaacacagga

SEQ ID NO: 674559 - RNA, 22 nt, Human
ugucaguagauuauuacaauaa

SEQ ID NO: 674560 - RNA, 22 nt, Human
uaaagacaugguguaggugaac

SEQ ID NO: 674561 - RNA, 22 nt, Human
ugccugcaucuuggaggcccca

SEQ ID NO: 674562 - RNA, 23 nt, Human
gguuccaggaacacagccugaug

SEQ ID NO: 674563 - RNA, 21 nt, Human
uuacuuuagaaauugccuuuu

SEQ ID NO: 674564 - RNA, 22 nt, Human
uuuccuccuagccuccagccgc

SEQ ID NO: 674565 - RNA, 22 nt, Human
ccaguguuuuccaguuugccca

SEQ ID NO: 674566 - RNA, 22 nt, Human
gguuucaacuuuugugaggaau

SEQ ID NO: 674567 - RNA, 22 nt, Human
aagcaauaaauaauuuuuagua

SEQ ID NO: 674568 - RNA, 22 nt, Human
uggcauggguggagagagcaca

SEQ ID NO: 674569 - RNA, 22 nt, Human
uuaaggaaugugcaguuuauau

SEQ ID NO: 674570 - RNA, 22 nt, Human
uuuuccucaggaaugcuaagcu

SEQ ID NO: 674571 - RNA, 22 nt, Human
cccagcuaccucugcuaggaga

SEQ ID NO: 674572 - RNA, 21 nt, Human
cucuugucuuugcucaguagc

SEQ ID NO: 674573 - RNA, 22 nt, Human
caugcaggugaccagguguggg

SEQ ID NO: 674574 - RNA, 22 nt, Human
uaaaugcuuucuaugaaagagg

SEQ ID NO: 674575 - RNA, 20 nt, Human
gagccugggaagucuaaggu

SEQ ID NO: 674576 - RNA, 22 nt, Human
uauggcuuaaaauuucagcaug

SEQ ID NO: 674577 - RNA, 22 nt, Human
aggaguccucaugucugugcga

SEQ ID NO: 674578 - RNA, 22 nt, Human
ggccauggggacagagggugaa

SEQ ID NO: 674579 - RNA, 22 nt, Human
gacaggcacgaaauugggcugg

SEQ ID NO: 674580 - RNA, 22 nt, Human
ccugugugcacacgaggccaug

SEQ ID NO: 674581 - RNA, 22 nt, Human
cuggcccuguggccuaaggacu

SEQ ID NO: 674582 - RNA, 22 nt, Human
agcagcaauggaaagcaacaca

SEQ ID NO: 674583 - RNA, 22 nt, Human
gugaggagcugacacuggggug

SEQ ID NO: 674584 - RNA, 22 nt, Human
ccaugggaccuaccuccugugc

SEQ ID NO: 674585 - RNA, 22 nt, Human
gccagcuggagugagagugggc

SEQ ID NO: 674586 - RNA, 19 nt, Human
gcaggccaggaggcggagg

SEQ ID NO: 674587 - RNA, 21 nt, Human
cuggaggcagguggugccagg

SEQ ID NO: 674588 - RNA, 22 nt, Human
ugagaaaaguguggaggucaau

SEQ ID NO: 674589 - RNA, 22 nt, Human
gccucugcucggacuuugccuc

SEQ ID NO: 674590 - RNA, 22 nt, Human
aaguucaucaaagaguaaauau

SEQ ID NO: 674591 - RNA, 22 nt, Human
ucugggccugucucagagcugg

SEQ ID NO: 674592 - RNA, 22 nt, Human
aggcuguguggaugagucuuac

SEQ ID NO: 674593 - RNA, 22 nt, Human
ggggaaggauaugauuagacua

SEQ ID NO: 674594 - RNA, 21 nt, Human
uggcuggauagaugggaacug

SEQ ID NO: 674595 - RNA, 21 nt, Human
ccuuuagauuucuaugcaguu

SEQ ID NO: 674596 - RNA, 22 nt, Human
acugugagugauuuccuucugg

SEQ ID NO: 674597 - RNA, 23 nt, Human
cuugcagggcuggaggcuuagaa

SEQ ID NO: 674598 - RNA, 22 nt, Human
agagcauccaucggccaggacc

SEQ ID NO: 674599 - RNA, 22 nt, Human
uguaacacucaaucuguuuaac

SEQ ID NO: 674600 - RNA, 22 nt, Human
uuuuccucugagcuuugaauaa

SEQ ID NO: 674601 - RNA, 22 nt, Human
agacagcuguuccuucauguuu

SEQ ID NO: 674602 - RNA, 22 nt, Human
uuaaauuaggacucuaguucug

SEQ ID NO: 674603 - RNA, 22 nt, Human
ggucauugucagagccuguacu

SEQ ID NO: 674604 - RNA, 22 nt, Human
gcuuuaugcuacgauuucuagu

SEQ ID NO: 674605 - RNA, 18 nt, Human
ugaacagaugaguugaag

SEQ ID NO: 674606 - RNA, 17 nt, Human
ccagggaggggccgcgc

SEQ ID NO: 674607 - RNA, 19 nt, Human
ccagugcaagguaagauag

SEQ ID NO: 674608 - RNA, 22 nt, Human
gcaggaguuaggguaaaaauga

SEQ ID NO: 674609 - RNA, 22 nt, Human
aaacaguuucuaaucauggaga

SEQ ID NO: 674610 - RNA, 22 nt, Human
ucacagaagaaguagauugcau

SEQ ID NO: 674611 - RNA, 22 nt, Human
aggaauuguguuguaguggaga

SEQ ID NO: 674612 - RNA, 22 nt, Human
ccuggccuccuggccuucucau

SEQ ID NO: 674613 - RNA, 22 nt, Human
aaugacauggagcaucuuuuca

SEQ ID NO: 674614 - RNA, 23 nt, Human
aaaguuugaagcaacaguaguug

SEQ ID NO: 674615 - RNA, 22 nt, Human
uuaaagggccgauuuccaggcc

SEQ ID NO: 674616 - RNA, 21 nt, Human
uagaucaugguauucuuuggc

SEQ ID NO: 674617 - RNA, 22 nt, Human
aauauuaauagaagggguucua

SEQ ID NO: 674618 - RNA, 18 nt, Human
gccacccuccucgucucc

SEQ ID NO: 674619 - RNA, 22 nt, Human
aaguuugagaagcuuauagaua

SEQ ID NO: 674620 - RNA, 19 nt, Human
uccuuucuguuccugagau

SEQ ID NO: 674621 - RNA, 19 nt, Human
agcagcuggagguggagug

SEQ ID NO: 674622 - RNA, 22 nt, Human
ucacagccuggucacucugccc

SEQ ID NO: 674623 - RNA, 22 nt, Human
cucagcagcagggaagagguca

SEQ ID NO: 674624 - RNA, 22 nt, Human
cuagagaggcagauguccugug

SEQ ID NO: 674625 - RNA, 22 nt, Human
uggaguucauccaugacagcuu

SEQ ID NO: 674626 - RNA, 22 nt, Human
acuggcagaacgugaugcgggu

SEQ ID NO: 674627 - RNA, 22 nt, Human
cuuuggcuuuuagauauccauu

SEQ ID NO: 674628 - RNA, 22 nt, Human
augaaagcacgugggaagauaa

SEQ ID NO: 674629 - RNA, 17 nt, Human
cuggagccaagagggcc

SEQ ID NO: 674630 - RNA, 18 nt, Human
gcuccuggaccaggucac

SEQ ID NO: 674631 - RNA, 21 nt, Human
uaagugcaaagagacagauac

SEQ ID NO: 674632 - RNA, 21 nt, Human
ugcaauauauauuugccugaa

SEQ ID NO: 674633 - RNA, 22 nt, Human
acucuucauucaaguaugcaaa

SEQ ID NO: 674634 - RNA, 22 nt, Human
gugagagaaauuggagggaaug

SEQ ID NO: 674635 - RNA, 22 nt, Human
auguuuuugagauacaaacaga

SEQ ID NO: 674636 - RNA, 19 nt, Human
agacauaaagaguuugcaa

SEQ ID NO: 674637 - RNA, 22 nt, Human
uaguccaguaaaacagcuaacg

SEQ ID NO: 674638 - RNA, 21 nt, Human
caugaagccgguucccuguuu

SEQ ID NO: 674639 - RNA, 22 nt, Human
uguuaaaccuaguacagguccu

SEQ ID NO: 674640 - RNA, 22 nt, Human
guugaaagcuuuucauuuaguu

SEQ ID NO: 674641 - RNA, 22 nt, Human
ugagcugugaggguacagauau

SEQ ID NO: 674642 - RNA, 20 nt, Human
cucaucucugagccuccugg

SEQ ID NO: 674643 - RNA, 22 nt, Human
acucuaccaugccacuccauag

SEQ ID NO: 674644 - RNA, 22 nt, Human
uucucuaagccuuaguuucuuc

SEQ ID NO: 674645 - RNA, 22 nt, Human
acacauaugcagaucccccaca

SEQ ID NO: 674646 - RNA, 22 nt, Human
aucugucugggugcagcagucc

SEQ ID NO: 674647 - RNA, 22 nt, Human
uacuuuagaaggaaauaaguuc

SEQ ID NO: 674648 - RNA, 22 nt, Human
aagagcauuuggugagauuuga

SEQ ID NO: 674649 - RNA, 22 nt, Human
ucuggccagugaaaugcagaau

SEQ ID NO: 674650 - RNA, 22 nt, Human
uccuuuuugguccaaggugacc

SEQ ID NO: 674651 - RNA, 22 nt, Human
uuggaaggagucaaccagcuga

SEQ ID NO: 674652 - RNA, 22 nt, Human
agcauuccagugcacaguagaa

SEQ ID NO: 674653 - RNA, 22 nt, Human
acuguauuggaaauauagcaaa

SEQ ID NO: 674654 - RNA, 22 nt, Human
gauucugcgaugaggacgagcu

SEQ ID NO: 674655 - RNA, 22 nt, Human
agcaggcacuaugccaggaucu

SEQ ID NO: 674656 - RNA, 22 nt, Human
uuagggaaauauuuauauacuu

SEQ ID NO: 674657 - RNA, 22 nt, Human
ucccaggaagaucccagggacc

SEQ ID NO: 674658 - RNA, 22 nt, Human
uuaauaaaguaugaauuggaaa

SEQ ID NO: 674659 - RNA, 22 nt, Human
ggucugagcucuaaaacuaacu

SEQ ID NO: 674660 - RNA, 22 nt, Human
ugauucugccccuuggcucugg

SEQ ID NO: 674661 - RNA, 23 nt, Human
cuguggagcccuuuguugggaga

SEQ ID NO: 674662 - RNA, 22 nt, Human
agacaagacuaggcaguuguug

SEQ ID NO: 674663 - RNA, 22 nt, Human
cauggaggaguuaggugugagu

SEQ ID NO: 674664 - RNA, 22 nt, Human
cucccaggccaugcucuagcca

SEQ ID NO: 674665 - RNA, 22 nt, Human
cuuggucuacuagagaaaaaga

SEQ ID NO: 674666 - RNA, 22 nt, Human
aaugaaaucugcuggguaaaga

SEQ ID NO: 674667 - RNA, 22 nt, Human
ggugggcaggcgaggcccaggu

SEQ ID NO: 674668 - RNA, 20 nt, Human
uguggcaggaugagggcgga

SEQ ID NO: 674669 - RNA, 22 nt, Human
uuucagagaauuagaagcugau

SEQ ID NO: 674670 - RNA, 22 nt, Human
aaagauuugaguucugcuuaua

SEQ ID NO: 674671 - RNA, 22 nt, Human
gaaucaggauucaagaucagcu

SEQ ID NO: 674672 - RNA, 20 nt, Human
ugaggcucagagagguugag

SEQ ID NO: 674673 - RNA, 22 nt, Human
gcauucaucuucaugaaagcac

SEQ ID NO: 674674 - RNA, 22 nt, Human
ucacauuuuaguaccaugauuu

SEQ ID NO: 674675 - RNA, 22 nt, Human
cugggcacacagugacucugca

SEQ ID NO: 674676 - RNA, 22 nt, Human
uuuacaauucuggugccagcua

SEQ ID NO: 674677 - RNA, 22 nt, Human
uguuuacuggcuccugugguuc

SEQ ID NO: 674678 - RNA, 22 nt, Human
uuucuuuauccuccuuugcaca

SEQ ID NO: 674679 - RNA, 22 nt, Human
gcuggccagugucccagggauc

SEQ ID NO: 674680 - RNA, 22 nt, Human
auggcaguggaaugggaugagu

SEQ ID NO: 674681 - RNA, 22 nt, Human
gggacacucaaugagaccugca

SEQ ID NO: 674682 - RNA, 22 nt, Human
gggagacccccaaugccagguc

SEQ ID NO: 674683 - RNA, 22 nt, Human
uaugcauauguguucauuggag

SEQ ID NO: 674684 - RNA, 22 nt, Human
ccuggcuuccuggagcucacaa

SEQ ID NO: 674685 - RNA, 22 nt, Human
agguaacauugccuccaucuga

SEQ ID NO: 674686 - RNA, 22 nt, Human
caggcagugugacgcuaggguu

SEQ ID NO: 674687 - RNA, 22 nt, Human
auuguggcuagacagucacaau

SEQ ID NO: 674688 - RNA, 22 nt, Human
uacaagaaacuacaugaaugca

SEQ ID NO: 674689 - RNA, 22 nt, Human
ccuggagacccacuucugccaa

SEQ ID NO: 674690 - RNA, 22 nt, Human
agcaggugacagggcuguggug

SEQ ID NO: 674691 - RNA, 22 nt, Human
aauguuuuagauuacugcuggg

SEQ ID NO: 674692 - RNA, 22 nt, Human
uccugacuuaacuacucucugg

SEQ ID NO: 674693 - RNA, 22 nt, Human
cccagcucaucaggagccgccc

SEQ ID NO: 674694 - RNA, 22 nt, Human
gauugcgucugugucaccuuca

SEQ ID NO: 674695 - RNA, 22 nt, Human
uugaggucaucugaaguacuag

SEQ ID NO: 674696 - RNA, 22 nt, Human
aaaagaugaaauggugucuugg

SEQ ID NO: 674697 - RNA, 22 nt, Human
aaugguuuucuagaacaugaaa

SEQ ID NO: 674698 - RNA, 22 nt, Human
agaggauccuaagaagauauga

SEQ ID NO: 674699 - RNA, 22 nt, Human
gagggcuccauuccccgugccc

SEQ ID NO: 674700 - RNA, 22 nt, Human
augcuuccuuaccagaagauga

SEQ ID NO: 674701 - RNA, 22 nt, Human
uuuaaauaggacuccugggggu

SEQ ID NO: 674702 - RNA, 22 nt, Human
ucucuuaaaggucuucagcuga

SEQ ID NO: 674703 - RNA, 22 nt, Human
agcuccuggcuuuccucucacc

SEQ ID NO: 674704 - RNA, 22 nt, Human
gugaaaucugaggcccaugaug

SEQ ID NO: 674705 - RNA, 22 nt, Human
cagcagaaguccgacuccaguc

SEQ ID NO: 674706 - RNA, 20 nt, Human
ugguccucacagguccuccc

SEQ ID NO: 674707 - RNA, 22 nt, Human
cauucauuuaugaaauaucuau

SEQ ID NO: 674708 - RNA, 22 nt, Human
ugcucccaggcauucucuguug

SEQ ID NO: 674709 - RNA, 22 nt, Human
ugggggaagagcuuguuaaagu

SEQ ID NO: 674710 - RNA, 22 nt, Human
cuuugaagaucacauguugcuc

SEQ ID NO: 674711 - RNA, 22 nt, Human
aaugggaaagagacuagaugcu

SEQ ID NO: 674712 - RNA, 22 nt, Human
ucucagcucauggcagccuuga

SEQ ID NO: 674713 - RNA, 21 nt, Human
cugugcuuuuuaagugugaug

SEQ ID NO: 674714 - RNA, 22 nt, Human
agcuggguucagaggcacaugg

SEQ ID NO: 674715 - RNA, 20 nt, Human
gaggcugaaguguuuuugcu

SEQ ID NO: 674716 - RNA, 22 nt, Human
uuuguucacugagcaaugauua

SEQ ID NO: 674717 - RNA, 22 nt, Human
aaagagcuugcuugcuuuauau

SEQ ID NO: 674718 - RNA, 22 nt, Human
cugaagagguuguugaggaaua

SEQ ID NO: 674719 - RNA, 22 nt, Human
gguuucaacuaaaucaagaagg

SEQ ID NO: 674720 - RNA, 22 nt, Human
ccauuuguauuacugccccagg

SEQ ID NO: 674721 - RNA, 22 nt, Human
aaaucuguuucagguauauuug

SEQ ID NO: 674722 - RNA, 22 nt, Human
aagcagcuucccuggcuccugg

SEQ ID NO: 674723 - RNA, 22 nt, Human
ccccagguggauggcucgcaua

SEQ ID NO: 674724 - RNA, 22 nt, Human
agguaaagacagugaaagaggg

SEQ ID NO: 674725 - RNA, 22 nt, Human
gcucacagagggugcuuaauac

SEQ ID NO: 674726 - RNA, 23 nt, Human
auucaguugugagagaagacaca

SEQ ID NO: 674727 - RNA, 22 nt, Human
ggaggucacgacugggaugccu

SEQ ID NO: 674728 - RNA, 22 nt, Human
aucgcaauguuuagaauuuugu

SEQ ID NO: 674729 - RNA, 22 nt, Human
gucacuguuuccuauuauauuu

SEQ ID NO: 674730 - RNA, 22 nt, Human
ucaggucuauagaagaggaggg

SEQ ID NO: 674731 - RNA, 22 nt, Human
uugauacacaauggaacaaugu

SEQ ID NO: 674732 - RNA, 22 nt, Human
gaugugaggugguaaacaggga

SEQ ID NO: 674733 - RNA, 22 nt, Human
uuaaaaucuaaagcaguugucu

SEQ ID NO: 674734 - RNA, 20 nt, Human
ugcacagcugugaauaggau

SEQ ID NO: 674735 - RNA, 21 nt, Human
ucucuguguucaaggugccag

SEQ ID NO: 674736 - RNA, 22 nt, Human
cuauggaaacucaacauuuguu

SEQ ID NO: 674737 - RNA, 22 nt, Human
gacaugaauguuauacuuuauu

SEQ ID NO: 674738 - RNA, 22 nt, Human
guuuaaauaauuaggggccugu

SEQ ID NO: 674739 - RNA, 22 nt, Human
cuagagaaucuuuuaagaagug

SEQ ID NO: 674740 - RNA, 22 nt, Human
uaggaggguuagagggaaauau

SEQ ID NO: 674741 - RNA, 22 nt, Human
cacaugcaucacgacuuccuuu

SEQ ID NO: 674742 - RNA, 20 nt, Human
agugugguuuucaggaauau

SEQ ID NO: 674743 - RNA, 22 nt, Human
gucaggaugagggaugaggagu

SEQ ID NO: 674744 - RNA, 22 nt, Human
uccugaaauucugguugucacu

SEQ ID NO: 674745 - RNA, 22 nt, Human
ucaguucuuuauuucacaguga

SEQ ID NO: 674746 - RNA, 22 nt, Human
cacacauuagagccaaugucag

SEQ ID NO: 674747 - RNA, 22 nt, Human
uuugauucaauguuuauauaaa

SEQ ID NO: 674748 - RNA, 22 nt, Human
ggcugccugaggcagugagaga

SEQ ID NO: 674749 - RNA, 22 nt, Human
gcuucugcagccaaagaagccg

SEQ ID NO: 674750 - RNA, 22 nt, Human
uugaaugaauaguugcuagaag

SEQ ID NO: 674751 - RNA, 22 nt, Human
uagacaaucucagcaaacacac

SEQ ID NO: 674752 - RNA, 22 nt, Human
uucuggaaaugcacaacuaauu

SEQ ID NO: 674753 - RNA, 22 nt, Human
agggccugagcucuccuccagu

SEQ ID NO: 674754 - RNA, 22 nt, Human
gggcacuggaaggcucucaggc

SEQ ID NO: 674755 - RNA, 22 nt, Human
cacuggcaucuaguggguugag

SEQ ID NO: 674756 - RNA, 21 nt, Human
cucagagaaaugucugggagc

SEQ ID NO: 674757 - RNA, 22 nt, Human
acaucagagggcucacaugauc

SEQ ID NO: 674758 - RNA, 22 nt, Human
aggucugccucacucacuucug

SEQ ID NO: 674759 - RNA, 22 nt, Human
agaggccagcaaccacaguaaa

SEQ ID NO: 674760 - RNA, 21 nt, Human
uccugggaagcacuggggugg

SEQ ID NO: 674761 - RNA, 22 nt, Human
uucauagugacaugcauucugg

SEQ ID NO: 674762 - RNA, 22 nt, Human
aacuacagaaaagguaagcucu

SEQ ID NO: 674763 - RNA, 22 nt, Human
cagcagagguuggaacaguucu

SEQ ID NO: 674764 - RNA, 22 nt, Human
aaagacuacacgggaaagagcu

SEQ ID NO: 674765 - RNA, 22 nt, Human
gcacugugcuagaagccagggg

SEQ ID NO: 674766 - RNA, 22 nt, Human
acagggcuggcguugggacaga

SEQ ID NO: 674767 - RNA, 22 nt, Human
cugugucuucaauguacuggga

SEQ ID NO: 674768 - RNA, 16 nt, Human
ccagaggccuggccuc

SEQ ID NO: 674769 - RNA, 22 nt, Human
cacaggaagagguauacaauuc

SEQ ID NO: 674770 - RNA, 22 nt, Human
uaugaaaagguggccaauguag

SEQ ID NO: 674771 - RNA, 22 nt, Human
uuuaauuuuccucuuccuggag

SEQ ID NO: 674772 - RNA, 22 nt, Human
agugaauucugcacuacugaag

SEQ ID NO: 674773 - RNA, 22 nt, Human
ucagugaucuaaggguauggcc

SEQ ID NO: 674774 - RNA, 22 nt, Human
aggcugugacuacgcagggaag

SEQ ID NO: 674775 - RNA, 22 nt, Human
uugagcaaugcugcaaagagau

SEQ ID NO: 674776 - RNA, 22 nt, Human
auuugaagaaaguuuucuagau

SEQ ID NO: 674777 - RNA, 22 nt, Human
agcaucuggauggaaagcaagg

SEQ ID NO: 674778 - RNA, 22 nt, Human
acaacacagcaaaaccccaucu

SEQ ID NO: 674779 - RNA, 22 nt, Human
ccaggcaguggaagcuaaaauu

SEQ ID NO: 674780 - RNA, 22 nt, Human
ugguggagcuguggccacgacc

SEQ ID NO: 674781 - RNA, 22 nt, Human
cugggccaggaccaggguugaa

SEQ ID NO: 674782 - RNA, 22 nt, Human
ggagaugcuuuccaguggggau

SEQ ID NO: 674783 - RNA, 23 nt, Human
gggcauggaguguagguggaagg

SEQ ID NO: 674784 - RNA, 22 nt, Human
gaaggaagccguuucucuccag

SEQ ID NO: 674785 - RNA, 18 nt, Human
cgaggcaggcggaucacg

SEQ ID NO: 674786 - RNA, 22 nt, Human
ggcagugacuggggacccccaa

SEQ ID NO: 674787 - RNA, 22 nt, Human
acagauaauacauugugcuaca

SEQ ID NO: 674788 - RNA, 22 nt, Human
uagauucucccaccugccaggc

SEQ ID NO: 674789 - RNA, 22 nt, Human
ggcagcucacugauuagcaauu

SEQ ID NO: 674790 - RNA, 22 nt, Human
ugggccacagagugagaaaugu

SEQ ID NO: 674791 - RNA, 22 nt, Human
agaguuuguauuuuucagugaa

SEQ ID NO: 674792 - RNA, 22 nt, Human
augauucagggaguuuucagga

SEQ ID NO: 674793 - RNA, 22 nt, Human
aaaagguagauucuccuucuau

SEQ ID NO: 674794 - RNA, 22 nt, Human
uuuaaucucccacucucagccu

SEQ ID NO: 674795 - RNA, 18 nt, Human
agagacagcagcaaaaga

SEQ ID NO: 674796 - RNA, 23 nt, Human
ugugcacaucugacgggugaagg

SEQ ID NO: 674797 - RNA, 22 nt, Human
cccaggagguguagcugcgugg

SEQ ID NO: 674798 - RNA, 22 nt, Human
cagagcuggagaaguggauuua

SEQ ID NO: 674799 - RNA, 22 nt, Human
ggcucugggugugaccuugggu

SEQ ID NO: 674800 - RNA, 22 nt, Human
uuuggucuuuuauuuaaagcag

SEQ ID NO: 674801 - RNA, 20 nt, Human
ggcaggcuuuauauggaggg

SEQ ID NO: 674802 - RNA, 22 nt, Human
ucaggaacauuuaaccacaggg

SEQ ID NO: 674803 - RNA, 18 nt, Human
uuauggcugugaaagagu

SEQ ID NO: 674804 - RNA, 22 nt, Human
guuucuguaagacugaauugac

SEQ ID NO: 674805 - RNA, 22 nt, Human
caauuuuauugguccaaauaca

SEQ ID NO: 674806 - RNA, 22 nt, Human
uucugaaauuucuguagaucuu

SEQ ID NO: 674807 - RNA, 22 nt, Human
aauguguguucggggcccagag

SEQ ID NO: 674808 - RNA, 22 nt, Human
agguggagaagagaugggcagu

SEQ ID NO: 674809 - RNA, 22 nt, Human
cauucagucaugcugguuuuga

SEQ ID NO: 674810 - RNA, 22 nt, Human
uucaaaucagaccgaaggcaac

SEQ ID NO: 674811 - RNA, 22 nt, Human
guggaugagauaacuguagaag

SEQ ID NO: 674812 - RNA, 22 nt, Human
ugcuauaaguagacauucaaca

SEQ ID NO: 674813 - RNA, 22 nt, Human
uuuuucugccauucaaagagga

SEQ ID NO: 674814 - RNA, 22 nt, Human
ugcuauuuuuaucuugaucaaa

SEQ ID NO: 674815 - RNA, 22 nt, Human
augauuuuuucuaacacagucg

SEQ ID NO: 674816 - RNA, 22 nt, Human
aaauuucuaagcagccacuucc

SEQ ID NO: 674817 - RNA, 23 nt, Human
agggccucaggagggcugcaugg

SEQ ID NO: 674818 - RNA, 22 nt, Human
gacuucuauuaauaccucuacu

SEQ ID NO: 674819 - RNA, 22 nt, Human
aauggcagagacuguugaaaua

SEQ ID NO: 674820 - RNA, 22 nt, Human
agcuuucaggauaaugaaaaag

SEQ ID NO: 674821 - RNA, 22 nt, Human
uccugcagccaagggucaucga

SEQ ID NO: 674822 - RNA, 22 nt, Human
uggccucugugggagcugagca

SEQ ID NO: 674823 - RNA, 22 nt, Human
uuaucuguuuaacaaaguaucu

SEQ ID NO: 674824 - RNA, 22 nt, Human
uaccaaagauuaaauagcaaca

SEQ ID NO: 674825 - RNA, 22 nt, Human
guggcauggagaaggaggcagu

SEQ ID NO: 674826 - RNA, 22 nt, Human
ccucuggccacaugggacauag

SEQ ID NO: 674827 - RNA, 22 nt, Human
ugagcccugaccuagccuggcc

SEQ ID NO: 674828 - RNA, 22 nt, Human
aaugcuuuuacgacauguaccu

SEQ ID NO: 674829 - RNA, 19 nt, Human
gcugcucugggucucaucu

SEQ ID NO: 674830 - RNA, 22 nt, Human
cagucucuugcuucauuaguug

SEQ ID NO: 674831 - RNA, 22 nt, Human
acagugugaugggccugccuga

SEQ ID NO: 674832 - RNA, 22 nt, Human
aagaacaugaguuaugaugauu

SEQ ID NO: 674833 - RNA, 21 nt, Human
uuugauucuuccucuccccag

SEQ ID NO: 674834 - RNA, 22 nt, Human
agggcagcggugcuuguguuau

SEQ ID NO: 674835 - RNA, 19 nt, Human
uaggcccuagcucugcagu

SEQ ID NO: 674836 - RNA, 22 nt, Human
aauaacagaaacuugagcauca

SEQ ID NO: 674837 - RNA, 21 nt, Human
uucuuuccccagaggacuaaa

SEQ ID NO: 674838 - RNA, 22 nt, Human
uugauucuuugagaccgugaua

SEQ ID NO: 674839 - RNA, 22 nt, Human
aauguaaaauaucuuguacuug

SEQ ID NO: 674840 - RNA, 16 nt, Human
aaagaaacaggugucc

SEQ ID NO: 674841 - RNA, 22 nt, Human
ugaggccacuuccccacagccc

SEQ ID NO: 674842 - RNA, 22 nt, Human
aaugaacacagcccucuacuuu

SEQ ID NO: 674843 - RNA, 22 nt, Human
ugcccuggcauuggguuggaua

SEQ ID NO: 674844 - RNA, 22 nt, Human
cagcuucuguuucuagccccug

SEQ ID NO: 674845 - RNA, 22 nt, Human
agguucauucccaaauuuggag

SEQ ID NO: 674846 - RNA, 19 nt, Human
acacaaugacacauauaua

SEQ ID NO: 674847 - RNA, 22 nt, Human
ugucgcagcugaaaaucucaau

SEQ ID NO: 674848 - RNA, 22 nt, Human
cucuuuuucagccuuaccaaag

SEQ ID NO: 674849 - RNA, 22 nt, Human
uugcauguguauaaaaguugga

SEQ ID NO: 674850 - RNA, 22 nt, Human
aaagucauuuguauauacccuu

SEQ ID NO: 674851 - RNA, 22 nt, Human
gauuuuauuagcccaaacuuug

SEQ ID NO: 674852 - RNA, 21 nt, Human
ccccugggagcccugucagua

SEQ ID NO: 674853 - RNA, 22 nt, Human
ugccuacuaguacuauuuugug

SEQ ID NO: 674854 - RNA, 22 nt, Human
uuucugcagcagacucagugug

SEQ ID NO: 674855 - RNA, 22 nt, Human
uuuuggucaacaguacaugcgg

SEQ ID NO: 674856 - RNA, 21 nt, Human
gucagagaugcccaacugccu

SEQ ID NO: 674857 - RNA, 22 nt, Human
aggcagagaaaaaccagauaug

SEQ ID NO: 674858 - RNA, 22 nt, Human
acacaucucaggggacacucuc

SEQ ID NO: 674859 - RNA, 20 nt, Human
cugcccagccacugagggau

SEQ ID NO: 674860 - RNA, 22 nt, Human
uucagacugcuggugcuucccu

SEQ ID NO: 674861 - RNA, 22 nt, Human
gauuucuuugcaagcuguguuc

SEQ ID NO: 674862 - RNA, 22 nt, Human
uuggaauuugagaccaagaaaa

SEQ ID NO: 674863 - RNA, 22 nt, Human
cuggcacagagacagaaggauu

SEQ ID NO: 674864 - RNA, 22 nt, Human
gaaagauaaucaauuacuccuu

SEQ ID NO: 674865 - RNA, 22 nt, Human
aagccaguggugagaagauagc

SEQ ID NO: 674866 - RNA, 22 nt, Human
gagaagcaaucagcagccaccc

SEQ ID NO: 674867 - RNA, 22 nt, Human
cagucaacagagagcccgucag

SEQ ID NO: 674868 - RNA, 22 nt, Human
aaaaacugguaacuauucccca

SEQ ID NO: 674869 - RNA, 22 nt, Human
gugccuggcacacagaaggcaa

SEQ ID NO: 674870 - RNA, 22 nt, Human
uuucugagaaauuaaacacuuu

SEQ ID NO: 674871 - RNA, 22 nt, Human
uuucagacucagaacuuagcaa

SEQ ID NO: 674872 - RNA, 22 nt, Human
gagcugaaauaugaagccaauu

SEQ ID NO: 674873 - RNA, 22 nt, Human
acaaacuucccagacaagcucc

SEQ ID NO: 674874 - RNA, 22 nt, Human
gcaguccaaaguggcucucacc

SEQ ID NO: 674875 - RNA, 22 nt, Human
auggcaaaaauuaacagaucaa

SEQ ID NO: 674876 - RNA, 22 nt, Human
uuaaaauguacaggggaaagug

SEQ ID NO: 674877 - RNA, 22 nt, Human
guuuucaaggggauuuaacuga

SEQ ID NO: 674878 - RNA, 22 nt, Human
acugagaacuugccaaggacug

SEQ ID NO: 674879 - RNA, 22 nt, Human
gucagugugagauaaucuugga

SEQ ID NO: 674880 - RNA, 22 nt, Human
gcugcugggguggagaaacgcu

SEQ ID NO: 674881 - RNA, 22 nt, Human
uguucuaaauugcuagcuggaa

SEQ ID NO: 674882 - RNA, 22 nt, Human
aagcagcauucagugaaaugug

SEQ ID NO: 674883 - RNA, 22 nt, Human
auaaauuuucuugcuguacuua

SEQ ID NO: 674884 - RNA, 22 nt, Human
aaagaauuuguacacccuacua

SEQ ID NO: 674885 - RNA, 22 nt, Human
uggcaaagaccgcaauuacuuu

SEQ ID NO: 674886 - RNA, 22 nt, Human
gaaggccauuagagccugugcc

SEQ ID NO: 674887 - RNA, 22 nt, Human
cugccccaggccuccuuuucuu

SEQ ID NO: 674888 - RNA, 22 nt, Human
cuugggugcuggaggcugccgc

SEQ ID NO: 674889 - RNA, 22 nt, Human
agagcuggcugguagcccugau

SEQ ID NO: 674890 - RNA, 22 nt, Human
aaggucauuuuuuccucuguug

SEQ ID NO: 674891 - RNA, 22 nt, Human
uuggaaaacuuacacagagcug

SEQ ID NO: 674892 - RNA, 22 nt, Human
aggcucaguuugguuuccauug

SEQ ID NO: 674893 - RNA, 22 nt, Human
ggccagagaauaugccuuacgu

SEQ ID NO: 674894 - RNA, 22 nt, Human
cagccagagaggaaggaaugca

SEQ ID NO: 674895 - RNA, 22 nt, Human
guuaaaugcacuauugaaagcu

SEQ ID NO: 674896 - RNA, 22 nt, Human
uuucuuuaauucucacagcaau

SEQ ID NO: 674897 - RNA, 22 nt, Human
gcagcugggacacugaggccag

SEQ ID NO: 674898 - RNA, 22 nt, Human
ugucccagucaaggcugucauc

SEQ ID NO: 674899 - RNA, 22 nt, Human
acuuuacaggcacuucaaguau

SEQ ID NO: 674900 - RNA, 22 nt, Human
cagagcagugggguuggucaga

SEQ ID NO: 674901 - RNA, 21 nt, Human
auaugaacuguggacuuugga

SEQ ID NO: 674902 - RNA, 22 nt, Human
caucaucaaaagugacagagaa

SEQ ID NO: 674903 - RNA, 22 nt, Human
cagggacauugguggccagguu

SEQ ID NO: 674904 - RNA, 22 nt, Human
gguggcagaauaauugaagguc

SEQ ID NO: 674905 - RNA, 22 nt, Human
gucuccaguuacagcagccagg

SEQ ID NO: 674906 - RNA, 22 nt, Human
aagcucagagucucggagggaa

SEQ ID NO: 674907 - RNA, 22 nt, Human
cuugggcucagacuugaggaca

SEQ ID NO: 674908 - RNA, 22 nt, Human
aacuccaggcagggaggccacu

SEQ ID NO: 674909 - RNA, 22 nt, Human
aaaggcucuaacaaggagagag

SEQ ID NO: 674910 - RNA, 22 nt, Human
agugaaaagaugcauuucucug

SEQ ID NO: 674911 - RNA, 22 nt, Human
ugccaggcugucaauucaccca

SEQ ID NO: 674912 - RNA, 18 nt, Human
acauacauucugucugca

SEQ ID NO: 674913 - RNA, 22 nt, Human
acugagaaagaccacauggaga

SEQ ID NO: 674914 - RNA, 22 nt, Human
cugucuuugguccugucuguua

SEQ ID NO: 674915 - RNA, 22 nt, Human
agacauagaaaaucauuaggaa

SEQ ID NO: 674916 - RNA, 22 nt, Human
accuggacaccugcugucaucu

SEQ ID NO: 674917 - RNA, 22 nt, Human
auucagugggugcucagcacaa

SEQ ID NO: 674918 - RNA, 22 nt, Human
acacaggcaagagugcaggucu

SEQ ID NO: 674919 - RNA, 22 nt, Human
ggccucaucacagugcauuagu

SEQ ID NO: 674920 - RNA, 22 nt, Human
caacuccuccccagcaugccaa

SEQ ID NO: 674921 - RNA, 22 nt, Human
gcaaggagacuguagggccaag

SEQ ID NO: 674922 - RNA, 22 nt, Human
auucugcuuuugcugaccuacc

SEQ ID NO: 674923 - RNA, 22 nt, Human
uccagcaaagugauaggauuuc

SEQ ID NO: 674924 - RNA, 22 nt, Human
cucagagagacaaugugggaca

SEQ ID NO: 674925 - RNA, 18 nt, Human
agcugaggggacugaaga

SEQ ID NO: 674926 - RNA, 22 nt, Human
aaggcuuguguguucagugagg

SEQ ID NO: 674927 - RNA, 22 nt, Human
ggcccuuccucuugugcuggca

SEQ ID NO: 674928 - RNA, 22 nt, Human
gaggcaugucuggccuguccca

SEQ ID NO: 674929 - RNA, 22 nt, Human
ggcacauggagacuuggcauca

SEQ ID NO: 674930 - RNA, 22 nt, Human
auauucacuggguacuaaaaag

SEQ ID NO: 674931 - RNA, 22 nt, Human
ccugagggaaggaugcuaccca

SEQ ID NO: 674932 - RNA, 22 nt, Human
uuacaacauaugauaggagucu

SEQ ID NO: 674933 - RNA, 22 nt, Human
cagcaggcuggacuucaguccc

SEQ ID NO: 674934 - RNA, 19 nt, Human
uugugugucagucagaguu

SEQ ID NO: 674935 - RNA, 22 nt, Human
ucuacagacagagcagguggga

SEQ ID NO: 674936 - RNA, 22 nt, Human
cugcugcaacucuuuagagggu

SEQ ID NO: 674937 - RNA, 22 nt, Human
ugaaaucugucccacuuuagcu

SEQ ID NO: 674938 - RNA, 22 nt, Human
cacaaaggagaaugucagcaua

SEQ ID NO: 674939 - RNA, 22 nt, Human
ucaaagcaauuucaccagugcc

SEQ ID NO: 674940 - RNA, 22 nt, Human
agugcaugaaagcauacaaggc

SEQ ID NO: 674941 - RNA, 22 nt, Human
gagcaggaacagaucccuugga

SEQ ID NO: 674942 - RNA, 22 nt, Human
uucucuccuccuagaggcuuuu

SEQ ID NO: 674943 - RNA, 22 nt, Human
gaauaauugugaugcuugaagu

SEQ ID NO: 674944 - RNA, 22 nt, Human
aggagguggccugagcgugccc

SEQ ID NO: 674945 - RNA, 22 nt, Human
gcagcugaaagggaucucuaca

SEQ ID NO: 674946 - RNA, 22 nt, Human
ucugccuagguuuccaaugugc

SEQ ID NO: 674947 - RNA, 22 nt, Human
uuuccacaauguuuuugcagga

SEQ ID NO: 674948 - RNA, 22 nt, Human
gugagaaaugacaaaugugucg

SEQ ID NO: 674949 - RNA, 22 nt, Human
aggcugugaucucaugauuugu

SEQ ID NO: 674950 - RNA, 22 nt, Human
augauggugggagaugacccag

SEQ ID NO: 674951 - RNA, 22 nt, Human
uggcugccagcuccucgccuug

SEQ ID NO: 674952 - RNA, 22 nt, Human
agaggccggccgagcccauggg

SEQ ID NO: 674953 - RNA, 22 nt, Human
uccagaguacggaagagucauc

SEQ ID NO: 674954 - RNA, 22 nt, Human
ggcuggcaggcacaguaugcaa

SEQ ID NO: 674955 - RNA, 22 nt, Human
cugaggcuucucuaguucagcu

SEQ ID NO: 674956 - RNA, 22 nt, Human
aucuuuacaagaaauucuuuua

SEQ ID NO: 674957 - RNA, 22 nt, Human
guugcuuguuaguggugagguu

SEQ ID NO: 674958 - RNA, 22 nt, Human
acaguuuagagcaugaugacca

SEQ ID NO: 674959 - RNA, 21 nt, Human
uagaggcaggagggacugcag

SEQ ID NO: 674960 - RNA, 22 nt, Human
gauuuccuaauguggaucucug

SEQ ID NO: 674961 - RNA, 22 nt, Human
cuucugagggccuuugcuucca

SEQ ID NO: 674962 - RNA, 22 nt, Human
gguggccuuuuaugagcagggu

SEQ ID NO: 674963 - RNA, 22 nt, Human
uguuuuaugagccauauaaccu

SEQ ID NO: 674964 - RNA, 22 nt, Human
cagggcugucuccaaaggcccc

SEQ ID NO: 674965 - RNA, 22 nt, Human
uuacauuuugcacagauguccc

SEQ ID NO: 674966 - RNA, 22 nt, Human
cucuuugucacucauacaguca

SEQ ID NO: 674967 - RNA, 22 nt, Human
gacauucagguguucaaugcca

SEQ ID NO: 674968 - RNA, 21 nt, Human
guauugcagaguuaugugcuc

SEQ ID NO: 674969 - RNA, 22 nt, Human
cucugggcaccaaagagcagcu

SEQ ID NO: 674970 - RNA, 22 nt, Human
auaacagauacucucugugagg

SEQ ID NO: 674971 - RNA, 22 nt, Human
uuauuuuguagcucugaucuuu

SEQ ID NO: 674972 - RNA, 20 nt, Human
agggaggugcugggccugag

SEQ ID NO: 674973 - RNA, 22 nt, Human
agcugccuccuggugccccauc

SEQ ID NO: 674974 - RNA, 22 nt, Human
cuaguucugccauucaguguca

SEQ ID NO: 674975 - RNA, 22 nt, Human
uaacuguacaacugguuaguca

SEQ ID NO: 674976 - RNA, 20 nt, Human
ugcuuuuauaccuauaauga

SEQ ID NO: 674977 - RNA, 22 nt, Human
caaauuaaugugucucaaaaua

SEQ ID NO: 674978 - RNA, 21 nt, Human
uacauagaggugauaucuguu

SEQ ID NO: 674979 - RNA, 22 nt, Human
cggcuggguucggcugcaggcc

SEQ ID NO: 674980 - RNA, 22 nt, Human
agggccugcucuaucacucuca

SEQ ID NO: 674981 - RNA, 22 nt, Human
gcugcccaggguggagccggcu

SEQ ID NO: 674982 - RNA, 22 nt, Human
auucuguauuucuaauaagauc

SEQ ID NO: 674983 - RNA, 22 nt, Human
ccugggagugugccaucucugu

SEQ ID NO: 674984 - RNA, 22 nt, Human
cuacugccauugucucugccau

SEQ ID NO: 674985 - RNA, 22 nt, Human
caucugaagugaauugcuuuuu

SEQ ID NO: 674986 - RNA, 22 nt, Human
aagaguuugaccugugccaucc

SEQ ID NO: 674987 - RNA, 22 nt, Human
agcuccuggaggugcgcacucg

SEQ ID NO: 674988 - RNA, 22 nt, Human
ccacugagguuuugugguuaug

SEQ ID NO: 674989 - RNA, 22 nt, Human
uagcucucuuuaucuuucuaua

SEQ ID NO: 674990 - RNA, 21 nt, Human
ggauaaauggucugguuucuc

SEQ ID NO: 674991 - RNA, 21 nt, Human
agguccaguucugucuuggac

SEQ ID NO: 674992 - RNA, 22 nt, Human
gaaaaaggauaaauacaguguu

SEQ ID NO: 674993 - RNA, 22 nt, Human
aagaagcauucuuucauugguu

SEQ ID NO: 674994 - RNA, 22 nt, Human
cacaugugcaguuacaugaauu

SEQ ID NO: 674995 - RNA, 22 nt, Human
uucaguguucuuuucuguuagc

SEQ ID NO: 674996 - RNA, 22 nt, Human
agcagcuugaggcuggauucca

SEQ ID NO: 674997 - RNA, 22 nt, Human
gggcucugguacuuccuggcuc

SEQ ID NO: 674998 - RNA, 22 nt, Human
cagcugcaugucuguggugguc

SEQ ID NO: 674999 - RNA, 22 nt, Human
cucugcugagccagagucccca

SEQ ID NO: 675000 - RNA, 22 nt, Human
gccagcuguuucagagcccagu

SEQ ID NO: 675001 - RNA, 22 nt, Human
gggcaguggcucacgccuguaa

SEQ ID NO: 675002 - RNA, 22 nt, Human
cuguuauucaagacaaaggcag

SEQ ID NO: 675003 - RNA, 22 nt, Human
ggcucugccgugugcucacaug

SEQ ID NO: 675004 - RNA, 22 nt, Human
aaguugcuagugcuuuucugag

SEQ ID NO: 675005 - RNA, 22 nt, Human
aacuugcagacaccugucucaa

SEQ ID NO: 675006 - RNA, 22 nt, Human
accugcagccacuucucuccuu

SEQ ID NO: 675007 - RNA, 22 nt, Human
gcagugaagcaguccuuguuga

SEQ ID NO: 675008 - RNA, 22 nt, Human
aaacacuguacaaucugcaggg

SEQ ID NO: 675009 - RNA, 22 nt, Human
gaucaaaagcuggguucuaaaa

SEQ ID NO: 675010 - RNA, 22 nt, Human
cuuagacauggcagcuccaagu

SEQ ID NO: 675011 - RNA, 22 nt, Human
ugaagcaggaaccagcagcauu

SEQ ID NO: 675012 - RNA, 22 nt, Human
ugcagggcaguggagguugagu

SEQ ID NO: 675013 - RNA, 22 nt, Human
uuuuaucugcuucauuaguuga

SEQ ID NO: 675014 - RNA, 22 nt, Human
gucucuucuuugccgguccugc

SEQ ID NO: 675015 - RNA, 22 nt, Human
agguggcaguuguggaaccauc

SEQ ID NO: 675016 - RNA, 22 nt, Human
cuuggagauacagaggacauuu

SEQ ID NO: 675017 - RNA, 22 nt, Human
uugccuuauagugcucugcauu

SEQ ID NO: 675018 - RNA, 20 nt, Human
ugccaggcugcacgccugcc

SEQ ID NO: 675019 - RNA, 23 nt, Human
gcagauggccccagagugcugcc

SEQ ID NO: 675020 - RNA, 22 nt, Human
cucaguuucugacauuaaaauc

SEQ ID NO: 675021 - RNA, 17 nt, Human
caguggccuauggcuuu

SEQ ID NO: 675022 - RNA, 22 nt, Human
cucccaguguuguuuucugaug

SEQ ID NO: 675023 - RNA, 22 nt, Human
ugucaauaacuggagucauuau

SEQ ID NO: 675024 - RNA, 22 nt, Human
uuguuuuaucuuucuacagacu

SEQ ID NO: 675025 - RNA, 22 nt, Human
aagggagcaaauggacagacgg

SEQ ID NO: 675026 - RNA, 22 nt, Human
agaggcuuggccucaguucugu

SEQ ID NO: 675027 - RNA, 22 nt, Human
gaagacacaauuggugggucca

SEQ ID NO: 675028 - RNA, 22 nt, Human
uggcucagcuuacuuuugaggg

SEQ ID NO: 675029 - RNA, 21 nt, Human
aaguugucucuuuugguuccu

SEQ ID NO: 675030 - RNA, 22 nt, Human
aaacaugagcaucucuucaagc

SEQ ID NO: 675031 - RNA, 22 nt, Human
gcaugugucccucagucugugc

SEQ ID NO: 675032 - RNA, 22 nt, Human
aacagcuaguaccaauccacua

SEQ ID NO: 675033 - RNA, 22 nt, Human
aggcaccaggaucaguuagaga

SEQ ID NO: 675034 - RNA, 22 nt, Human
accccagaaucuaugcuuuaca

SEQ ID NO: 675035 - RNA, 22 nt, Human
ggagagaggagcccacugcugu

SEQ ID NO: 675036 - RNA, 22 nt, Human
agacagcagaaacuagagcacu

SEQ ID NO: 675037 - RNA, 22 nt, Human
agacccugcaccucucgugggc

SEQ ID NO: 675038 - RNA, 22 nt, Human
acagcucugcauuuuggguuaa

SEQ ID NO: 675039 - RNA, 22 nt, Human
acaguaauuaaacauucugauu

SEQ ID NO: 675040 - RNA, 22 nt, Human
uagcaaugcucuaugaugaaaa

SEQ ID NO: 675041 - RNA, 22 nt, Human
uccaggcuggccucgcgugaca

SEQ ID NO: 675042 - RNA, 22 nt, Human
uaaauguguuagucaugguuuu

SEQ ID NO: 675043 - RNA, 22 nt, Human
cugggcaguuuauucaguucug

SEQ ID NO: 675044 - RNA, 21 nt, Human
guguggauaugugacaggugg

SEQ ID NO: 675045 - RNA, 22 nt, Human
guagaugagcucacaugaccuu

SEQ ID NO: 675046 - RNA, 22 nt, Human
uuuaucuguagagcuucaccua

SEQ ID NO: 675047 - RNA, 22 nt, Human
gcuccagaugaaaggccagagg

SEQ ID NO: 675048 - RNA, 22 nt, Human
aaguggacuaauacaaggacua

SEQ ID NO: 675049 - RNA, 22 nt, Human
auucucaaaacauaacuucacu

SEQ ID NO: 675050 - RNA, 22 nt, Human
gcacuggaggguguaguugcug

SEQ ID NO: 675051 - RNA, 22 nt, Human
augcagggaccuuugcuuuggu

SEQ ID NO: 675052 - RNA, 22 nt, Human
uaauugcuauuggaaugcuuug

SEQ ID NO: 675053 - RNA, 16 nt, Human
cuuccucuucacuggc

SEQ ID NO: 675054 - RNA, 22 nt, Human
ugcuccuguuucaucagcuaua

SEQ ID NO: 675055 - RNA, 22 nt, Human
ucacaaauguuugcaugugucu

SEQ ID NO: 675056 - RNA, 22 nt, Human
cagcuauuuaucuuucaugaua

SEQ ID NO: 675057 - RNA, 22 nt, Human
uuggaaagcaagcuggacauac

SEQ ID NO: 675058 - RNA, 19 nt, Human
cugugcuuuaaacuccuau

SEQ ID NO: 675059 - RNA, 22 nt, Human
gaccucagcuguggggaugcug

SEQ ID NO: 675060 - RNA, 22 nt, Human
uuucuucacaggguauugggug

SEQ ID NO: 675061 - RNA, 22 nt, Human
ggcuggaagagacugaggacac

SEQ ID NO: 675062 - RNA, 22 nt, Human
guauuucugguaacugcugcua

SEQ ID NO: 675063 - RNA, 22 nt, Human
ccagagccuaagaucugauccu

SEQ ID NO: 675064 - RNA, 22 nt, Human
uacagguagcaaaaccuuuccu

SEQ ID NO: 675065 - RNA, 22 nt, Human
ggaaggaggggcaaagcaguuc

SEQ ID NO: 675066 - RNA, 22 nt, Human
ugcugccucaacugucaggaac

SEQ ID NO: 675067 - RNA, 22 nt, Human
auaacuuucuucacccuugcug

SEQ ID NO: 675068 - RNA, 22 nt, Human
cuuauuucagcccugggcaccc

SEQ ID NO: 675069 - RNA, 22 nt, Human
cugagagaaucaugcugcaggu

SEQ ID NO: 675070 - RNA, 22 nt, Human
uggugacacgaaguuugcuauc

SEQ ID NO: 675071 - RNA, 22 nt, Human
ugcuucucaaaaggagguaggu

SEQ ID NO: 675072 - RNA, 22 nt, Human
gagaaaugcaugcaugucauca

SEQ ID NO: 675073 - RNA, 20 nt, Human
gugggcagagcaccaccugg

SEQ ID NO: 675074 - RNA, 20 nt, Human
ugaguggccacugggucgca

SEQ ID NO: 675075 - RNA, 22 nt, Human
ggccuccuguuggcuaguguga

SEQ ID NO: 675076 - RNA, 20 nt, Human
acugggcauaccuguccugu

SEQ ID NO: 675077 - RNA, 22 nt, Human
uuaaggaaccacagcauguuag

SEQ ID NO: 675078 - RNA, 22 nt, Human
uucuuuuaauuucugucugcag

SEQ ID NO: 675079 - RNA, 17 nt, Human
agcaggcacgucagcac

SEQ ID NO: 675080 - RNA, 22 nt, Human
ggagggugcagacccuuugcaa

SEQ ID NO: 675081 - RNA, 22 nt, Human
agacuucucaguuuuauuagua

SEQ ID NO: 675082 - RNA, 22 nt, Human
acugcacagaaccuuagaauau

SEQ ID NO: 675083 - RNA, 19 nt, Human
agggccacggggagguauu

SEQ ID NO: 675084 - RNA, 22 nt, Human
gacaggugcuaagggaccuggc

SEQ ID NO: 675085 - RNA, 22 nt, Human
cacacuaauuuuucaagaguuu

SEQ ID NO: 675086 - RNA, 23 nt, Human
aauuggacuugcugucaaacuuc

SEQ ID NO: 675087 - RNA, 22 nt, Human
cugcccucuagggaugcacugg

SEQ ID NO: 675088 - RNA, 22 nt, Human
cugugcauugucuugucuguag

SEQ ID NO: 675089 - RNA, 19 nt, Human
auguucuauccuccaaguu

SEQ ID NO: 675090 - RNA, 22 nt, Human
uucaaauccuagcccuguggcc

SEQ ID NO: 675091 - RNA, 22 nt, Human
guauuucccugaguucugugag

SEQ ID NO: 675092 - RNA, 22 nt, Human
aaaauuuucagcuugacuugau

SEQ ID NO: 675093 - RNA, 22 nt, Human
ugggcuguggagcaccuuugca

SEQ ID NO: 675094 - RNA, 22 nt, Human
aucuuuagcauuacuuuauuca

SEQ ID NO: 675095 - RNA, 22 nt, Human
aagucagacagcugagcugccu

SEQ ID NO: 675096 - RNA, 22 nt, Human
uuguucuuuauccuggaagccu

SEQ ID NO: 675097 - RNA, 22 nt, Human
agcuugccucuuaaucaccuca

SEQ ID NO: 675098 - RNA, 22 nt, Human
ugagaggagugauuguaaaauu

SEQ ID NO: 675099 - RNA, 22 nt, Human
ggcaggcuuugagaaagagcau

SEQ ID NO: 675100 - RNA, 22 nt, Human
aauagcaaacacugguaaaguu

SEQ ID NO: 675101 - RNA, 22 nt, Human
agagucugauauuuguaccaga

SEQ ID NO: 675102 - RNA, 22 nt, Human
agccagagggaucuuucuaaga

SEQ ID NO: 675103 - RNA, 22 nt, Human
gaugcacaaagcagagggaauc

SEQ ID NO: 675104 - RNA, 22 nt, Human
agagagcuguccugggacaccc

SEQ ID NO: 675105 - RNA, 22 nt, Human
ugugugcuaauguaugcucuaa

SEQ ID NO: 675106 - RNA, 22 nt, Human
ggugcagaggagccagcugggg

SEQ ID NO: 675107 - RNA, 22 nt, Human
ucugcacauguaguaaauauua

SEQ ID NO: 675108 - RNA, 22 nt, Human
uacagaaagggaugauugaucu

SEQ ID NO: 675109 - RNA, 22 nt, Human
ggaaccaguggaaugauaugcu

SEQ ID NO: 675110 - RNA, 22 nt, Human
ugugcacauucuaggacuagua

SEQ ID NO: 675111 - RNA, 22 nt, Human
cuggugaccuugccccagguca

SEQ ID NO: 675112 - RNA, 22 nt, Human
ucaagaaagggcuucaccagga

SEQ ID NO: 675113 - RNA, 22 nt, Human
aggucaaaaucaggcagggaag

SEQ ID NO: 675114 - RNA, 22 nt, Human
augcacgccccacacuggugug

SEQ ID NO: 675115 - RNA, 22 nt, Human
ugccuggcauguuauagacaca

SEQ ID NO: 675116 - RNA, 22 nt, Human
uuugcauuuuagauuuaggccu

SEQ ID NO: 675117 - RNA, 22 nt, Human
uaagugaauccuugagaagaaa

SEQ ID NO: 675118 - RNA, 22 nt, Human
auguuuaagaaagucuuccaua

SEQ ID NO: 675119 - RNA, 21 nt, Human
uuccucugcaacugaugcuca

SEQ ID NO: 675120 - RNA, 22 nt, Human
ggaagcugaacuuagcaaggaa

SEQ ID NO: 675121 - RNA, 20 nt, Human
ugaggcccagcagagucggg

SEQ ID NO: 675122 - RNA, 22 nt, Human
uucugcaugguuggggagaagc

SEQ ID NO: 675123 - RNA, 19 nt, Human
ugcccugcacgcuguccug

SEQ ID NO: 675124 - RNA, 22 nt, Human
ugcuuuaaaccauggaugugag

SEQ ID NO: 675125 - RNA, 22 nt, Human
ugguaauuaauuugauagguuc

SEQ ID NO: 675126 - RNA, 22 nt, Human
uuuacagauguggaaagugagc

SEQ ID NO: 675127 - RNA, 22 nt, Human
cuucuaggcuucucagggggca

SEQ ID NO: 675128 - RNA, 22 nt, Human
augcagagacagauguggcaug

SEQ ID NO: 675129 - RNA, 22 nt, Human
cacagugacagcuauacagaga

SEQ ID NO: 675130 - RNA, 22 nt, Human
guuaagaacuuguugaaggucu

SEQ ID NO: 675131 - RNA, 22 nt, Human
ugugcacauaaaacaguacuag

SEQ ID NO: 675132 - RNA, 22 nt, Human
agggccagaaucccucagucua

SEQ ID NO: 675133 - RNA, 22 nt, Human
ccagcccaaagucaccccggga

SEQ ID NO: 675134 - RNA, 22 nt, Human
agaggucagaacaggaaagugu

SEQ ID NO: 675135 - RNA, 22 nt, Human
gcagacagacugcagugauuuu

SEQ ID NO: 675136 - RNA, 22 nt, Human
ucuuuacauaguguggacuacu

SEQ ID NO: 675137 - RNA, 22 nt, Human
acuuggcaaguaucuauaaagu

SEQ ID NO: 675138 - RNA, 22 nt, Human
ggucuccaaagcuuaggacuac

SEQ ID NO: 675139 - RNA, 22 nt, Human
gaucccauguaggagaauguua

SEQ ID NO: 675140 - RNA, 22 nt, Human
cugcucuggggaagccagaugu

SEQ ID NO: 675141 - RNA, 22 nt, Human
aagacauuuugaaauuggaagc

SEQ ID NO: 675142 - RNA, 22 nt, Human
aaagucuccacugggaaccaaa

SEQ ID NO: 675143 - RNA, 22 nt, Human
ucugcugcugagcacacuccua

SEQ ID NO: 675144 - RNA, 22 nt, Human
cuguguggacugguugaggccc

SEQ ID NO: 675145 - RNA, 22 nt, Human
ucucuggaguauaaccagggau

SEQ ID NO: 675146 - RNA, 22 nt, Human
acagagcccuuccuugcaccau

SEQ ID NO: 675147 - RNA, 22 nt, Human
gucuugucaguguuggcagcuu

SEQ ID NO: 675148 - RNA, 22 nt, Human
gaaaccuuugccgauggggucc

SEQ ID NO: 675149 - RNA, 22 nt, Human
augacauaagugaaaaacauca

SEQ ID NO: 675150 - RNA, 22 nt, Human
gaugguuugguaaaaguauguu

SEQ ID NO: 675151 - RNA, 22 nt, Human
aaggcaggaugggaaaagauuu

SEQ ID NO: 675152 - RNA, 22 nt, Human
caguaacaugaagagacaugga

SEQ ID NO: 675153 - RNA, 23 nt, Human
uugcaaauuucaguuaguucaug

SEQ ID NO: 675154 - RNA, 22 nt, Human
ccacagcaccgcugccaguccc

SEQ ID NO: 675155 - RNA, 20 nt, Human
auauguguacguguauacau

SEQ ID NO: 675156 - RNA, 22 nt, Human
uuuguacauauauaaaaucugu

SEQ ID NO: 675157 - RNA, 22 nt, Human
uggcuucaccucagcaugaagg

SEQ ID NO: 675158 - RNA, 22 nt, Human
ccagggcagcgccccuccacgc

SEQ ID NO: 675159 - RNA, 22 nt, Human
gaaaaggaaauuuauagagauc

SEQ ID NO: 675160 - RNA, 18 nt, Human
ggcaccucucuugccuua

SEQ ID NO: 675161 - RNA, 22 nt, Human
gaggccaggguaccaucaacau

SEQ ID NO: 675162 - RNA, 22 nt, Human
agagaacacgugcaucugcaau

SEQ ID NO: 675163 - RNA, 22 nt, Human
gcucugagucucagcuaccaca

SEQ ID NO: 675164 - RNA, 22 nt, Human
auggcaguacguugaaaauuuu

SEQ ID NO: 675165 - RNA, 22 nt, Human
ggugcugacuucacagucuuac

SEQ ID NO: 675166 - RNA, 22 nt, Human
cccaccccuggacaggugagug

SEQ ID NO: 675167 - RNA, 22 nt, Human
auugcucagcacaagcagcaga

SEQ ID NO: 675168 - RNA, 22 nt, Human
auaauuuacuaagcucuaccuu

SEQ ID NO: 675169 - RNA, 22 nt, Human
uacauugaggcaguagcuggag

SEQ ID NO: 675170 - RNA, 22 nt, Human
guagugcgcauggccuguuugu

SEQ ID NO: 675171 - RNA, 22 nt, Human
acugccaaugguaguuugaugg

SEQ ID NO: 675172 - RNA, 20 nt, Human
acugugugaucuggaaagcu

SEQ ID NO: 675173 - RNA, 19 nt, Human
cuucacaucugugagggga

SEQ ID NO: 675174 - RNA, 20 nt, Human
cccagggaccugagcuccau

SEQ ID NO: 675175 - RNA, 22 nt, Human
ucagaacagcacagggugauuu

SEQ ID NO: 675176 - RNA, 22 nt, Human
cauuuguaucugggcugcugug

SEQ ID NO: 675177 - RNA, 22 nt, Human
cucccagagagcaggugggccg

SEQ ID NO: 675178 - RNA, 22 nt, Human
gagucauuugggggcuucuuga

SEQ ID NO: 675179 - RNA, 22 nt, Human
aggagggaauaagaaagaguca

SEQ ID NO: 675180 - RNA, 22 nt, Human
ugucaugccauuuaaaauguuu

SEQ ID NO: 675181 - RNA, 22 nt, Human
cccaggagaauauaauguucuu

SEQ ID NO: 675182 - RNA, 22 nt, Human
ugguaggagauauggucuccga

SEQ ID NO: 675183 - RNA, 22 nt, Human
ugcugcuccugccuggcuccca

SEQ ID NO: 675184 - RNA, 22 nt, Human
gggcagcagagcccugccgagu

SEQ ID NO: 675185 - RNA, 22 nt, Human
agcauuuaguuaguaaauguuu

SEQ ID NO: 675186 - RNA, 22 nt, Human
acagcuguggggacucuugccc

SEQ ID NO: 675187 - RNA, 22 nt, Human
gagguaacaacugaaaugagaa

SEQ ID NO: 675188 - RNA, 22 nt, Human
acuuugaaacuaaaauucauua

SEQ ID NO: 675189 - RNA, 22 nt, Human
auugaacuuaacaguaaguggc

SEQ ID NO: 675190 - RNA, 22 nt, Human
gugacaggccacugcggcucug

SEQ ID NO: 675191 - RNA, 22 nt, Human
gugcucuccuggcugcccugac

SEQ ID NO: 675192 - RNA, 22 nt, Human
aauagcauguucaugauaaaau

SEQ ID NO: 675193 - RNA, 22 nt, Human
ucucaaauuuauacagaguuca

SEQ ID NO: 675194 - RNA, 22 nt, Human
aagauguucuauuuucacuuuu

SEQ ID NO: 675195 - RNA, 22 nt, Human
aagugacauaccuuacauaugu

SEQ ID NO: 675196 - RNA, 22 nt, Human
uguucuuagguauuugacaguc

SEQ ID NO: 675197 - RNA, 21 nt, Human
agagcuggccugccaggcccu

SEQ ID NO: 675198 - RNA, 18 nt, Human
gagaagcugauugaaugc

SEQ ID NO: 675199 - RNA, 22 nt, Human
cuggaagguggauggcgaggcc

SEQ ID NO: 675200 - RNA, 17 nt, Human
acacagggagagggagc

SEQ ID NO: 675201 - RNA, 22 nt, Human
acacacuuuugcuaaaaauugu

SEQ ID NO: 675202 - RNA, 22 nt, Human
guaaaguaaacccacuuuguag

SEQ ID NO: 675203 - RNA, 22 nt, Human
cuccaugaauuugagcuuugug

SEQ ID NO: 675204 - RNA, 22 nt, Human
guugaguggguuaggaugcuga

SEQ ID NO: 675205 - RNA, 22 nt, Human
gguggcugggauuaguagccca

SEQ ID NO: 675206 - RNA, 22 nt, Human
caaggaggcagugggacuugaa

SEQ ID NO: 675207 - RNA, 22 nt, Human
caugcaugccgggcugacagag

SEQ ID NO: 675208 - RNA, 22 nt, Human
cacaccuguaauaccagcuacu

SEQ ID NO: 675209 - RNA, 22 nt, Human
uguccucacaggaaugaacuuu

SEQ ID NO: 675210 - RNA, 22 nt, Human
ucaaaugcggucauggcuuuua

SEQ ID NO: 675211 - RNA, 22 nt, Human
caggggcugagaaggaacgucc

SEQ ID NO: 675212 - RNA, 22 nt, Human
uacaugcuggugacuguagaca

SEQ ID NO: 675213 - RNA, 22 nt, Human
uuugcugugaauccauuacugu

SEQ ID NO: 675214 - RNA, 22 nt, Human
auaguacacauccuacaauguu

SEQ ID NO: 675215 - RNA, 22 nt, Human
ccuggccaggcauggagucaca

SEQ ID NO: 675216 - RNA, 22 nt, Human
acaagucaguggaauuaauauu

SEQ ID NO: 675217 - RNA, 22 nt, Human
gggcuccacagcagugagugga

SEQ ID NO: 675218 - RNA, 22 nt, Human
gagggggagaugugcacacacu

SEQ ID NO: 675219 - RNA, 22 nt, Human
ugggaaaguaauugucauccuu

SEQ ID NO: 675220 - RNA, 22 nt, Human
uguguaugcauacacacauaga

SEQ ID NO: 675221 - RNA, 22 nt, Human
aauuuccagaccccauccacag

SEQ ID NO: 675222 - RNA, 22 nt, Human
ucccagaggaaauggcagcuga

SEQ ID NO: 675223 - RNA, 21 nt, Human
auuguuaucauugugcugugu

SEQ ID NO: 675224 - RNA, 22 nt, Human
uuauuauguggaugaaagaugu

SEQ ID NO: 675225 - RNA, 22 nt, Human
uccagagagauaguggcuaaua

SEQ ID NO: 675226 - RNA, 22 nt, Human
uuucacaaacugaggagacaau

SEQ ID NO: 675227 - RNA, 22 nt, Human
caucacaucuacuauaagugau

SEQ ID NO: 675228 - RNA, 22 nt, Human
ggcauuugacucagugacuggg

SEQ ID NO: 675229 - RNA, 22 nt, Human
cucugggguuagaucugaugcu

SEQ ID NO: 675230 - RNA, 22 nt, Human
cugggaagggagucaagauacu

SEQ ID NO: 675231 - RNA, 22 nt, Human
aagggcagcuauuaucgucauc

SEQ ID NO: 675232 - RNA, 22 nt, Human
uugaagagucuagauugguuau

SEQ ID NO: 675233 - RNA, 22 nt, Human
uuaaagaggcaugggaauguau

SEQ ID NO: 675234 - RNA, 19 nt, Human
uccagacuguccaggcuau

SEQ ID NO: 675235 - RNA, 22 nt, Human
uugcaaaugugaguuuagacug

SEQ ID NO: 675236 - RNA, 22 nt, Human
guuucuuuuaaaauauguagac

SEQ ID NO: 675237 - RNA, 23 nt, Human
agacaaacuuccuucacugcacc

SEQ ID NO: 675238 - RNA, 22 nt, Human
uuggcucaggaccccugugacu

SEQ ID NO: 675239 - RNA, 22 nt, Human
uagcccaggcuggagggcagug

SEQ ID NO: 675240 - RNA, 20 nt, Human
agugaauagagacauugccc

SEQ ID NO: 675241 - RNA, 22 nt, Human
aauucaaagacuagaauuuugc

SEQ ID NO: 675242 - RNA, 22 nt, Human
cauguguggucuguggcuaucu

SEQ ID NO: 675243 - RNA, 22 nt, Human
aacacugaaaugucuuaagauu

SEQ ID NO: 675244 - RNA, 23 nt, Human
agcuuuuagguggaaauggcacu

SEQ ID NO: 675245 - RNA, 22 nt, Human
uuauaaagugagaagugcuaug

SEQ ID NO: 675246 - RNA, 22 nt, Human
agucuucuggguguuuccagag

SEQ ID NO: 675247 - RNA, 22 nt, Human
gcccagugcugagggugcugcu

SEQ ID NO: 675248 - RNA, 20 nt, Human
ugccaugguaacagagugug

SEQ ID NO: 675249 - RNA, 22 nt, Human
cugcccagaagcuuagagcuua

SEQ ID NO: 675250 - RNA, 22 nt, Human
cucaggggaccuggcuccgagu

SEQ ID NO: 675251 - RNA, 22 nt, Human
guggcaguuuugacaucacaaa

SEQ ID NO: 675252 - RNA, 22 nt, Human
ggaauagggagagaaucguuug

SEQ ID NO: 675253 - RNA, 22 nt, Human
cccagagcugauuguuggagcc

SEQ ID NO: 675254 - RNA, 22 nt, Human
ucugccugcuucuucauagucu

SEQ ID NO: 675255 - RNA, 22 nt, Human
ugcagcaccacaccuggcuaau

SEQ ID NO: 675256 - RNA, 22 nt, Human
ccagggcagaaaaagagggaau

SEQ ID NO: 675257 - RNA, 22 nt, Human
agguggccaauaaauguuggag

SEQ ID NO: 675258 - RNA, 22 nt, Human
uguguauguguauacacuauau

SEQ ID NO: 675259 - RNA, 22 nt, Human
ucaguuuuuaagaguuaugcga

SEQ ID NO: 675260 - RNA, 22 nt, Human
gguuuguugggguccaggccca

SEQ ID NO: 675261 - RNA, 21 nt, Human
ugugaaauagcuaugcuacau

SEQ ID NO: 675262 - RNA, 22 nt, Human
aauggcuuaaugauaccuuauc

SEQ ID NO: 675263 - RNA, 17 nt, Human
uucugcaugugaagaug

SEQ ID NO: 675264 - RNA, 22 nt, Human
gggcugaugugacagaacucuc

SEQ ID NO: 675265 - RNA, 22 nt, Human
ccucucuccaauuuucaccuca

SEQ ID NO: 675266 - RNA, 22 nt, Human
uugugguuaaccgcacauuuuu

SEQ ID NO: 675267 - RNA, 22 nt, Human
uccuggggccaggcaccucugg

SEQ ID NO: 675268 - RNA, 19 nt, Human
gaggucagcaagaaguauu

SEQ ID NO: 675269 - RNA, 22 nt, Human
acagaacauauugcuucucuca

SEQ ID NO: 675270 - RNA, 22 nt, Human
gauauucauaggcagguauuua

SEQ ID NO: 675271 - RNA, 22 nt, Human
cuacacaguucugccuaauggc

SEQ ID NO: 675272 - RNA, 22 nt, Human
uuucuagugguuaagauuuaca

SEQ ID NO: 675273 - RNA, 22 nt, Human
guuaugaaauaaauauagauca

SEQ ID NO: 675274 - RNA, 22 nt, Human
uuucagaaacgauuaugaacac

SEQ ID NO: 675275 - RNA, 22 nt, Human
caguaaauaguggagauguggg

SEQ ID NO: 675276 - RNA, 22 nt, Human
augucccagacacuuuaucuua

SEQ ID NO: 675277 - RNA, 22 nt, Human
aaaauccuuagccgagugaggu

SEQ ID NO: 675278 - RNA, 22 nt, Human
uggucucugcugcagcuucuca

SEQ ID NO: 675279 - RNA, 22 nt, Human
ucugagcugggggccuggcaug

SEQ ID NO: 675280 - RNA, 22 nt, Human
ucuuccuuuuguaccuucugaa

SEQ ID NO: 675281 - RNA, 22 nt, Human
uggcagaugagccgcgcuccaa

SEQ ID NO: 675282 - RNA, 22 nt, Human
ucugccuugagguccucagcuc

SEQ ID NO: 675283 - RNA, 22 nt, Human
uuuccugcacccgcugaugcca

SEQ ID NO: 675284 - RNA, 22 nt, Human
cuccucuguauugauugggacu

SEQ ID NO: 675285 - RNA, 22 nt, Human
aggucauuggggacuaucuccg

SEQ ID NO: 675286 - RNA, 22 nt, Human
gagauguuauucuucagugugu

SEQ ID NO: 675287 - RNA, 22 nt, Human
auauuugagggcaauagggugg

SEQ ID NO: 675288 - RNA, 22 nt, Human
uaacacuuuggauuaaaauucu

SEQ ID NO: 675289 - RNA, 22 nt, Human
gcacugugcuuaguucacuauu

SEQ ID NO: 675290 - RNA, 22 nt, Human
ggggugggagugccauccuuga

SEQ ID NO: 675291 - RNA, 22 nt, Human
aauuuuacaagaaggccucgua

SEQ ID NO: 675292 - RNA, 22 nt, Human
ucaugcaaucucuuguucagga

SEQ ID NO: 675293 - RNA, 22 nt, Human
ucaauagagccuucuuucaggu

SEQ ID NO: 675294 - RNA, 22 nt, Human
ucucagagaagugaugagcaau

SEQ ID NO: 675295 - RNA, 22 nt, Human
guggucauuugucugagcucca

SEQ ID NO: 675296 - RNA, 22 nt, Human
uccugcccagagcucuccacuc

SEQ ID NO: 675297 - RNA, 22 nt, Human
auggcuccauccuguugcuagu

SEQ ID NO: 675298 - RNA, 22 nt, Human
ucugggcugggcuuaggaaccc

SEQ ID NO: 675299 - RNA, 22 nt, Human
auccuuggcacaguggaauuca

SEQ ID NO: 675300 - RNA, 22 nt, Human
gcauccuggcucuaggugucau

SEQ ID NO: 675301 - RNA, 22 nt, Human
uaacuugaccuguauaaaacac

SEQ ID NO: 675302 - RNA, 22 nt, Human
acauuuugcccuuauuugcuga

SEQ ID NO: 675303 - RNA, 22 nt, Human
cuuauuaauggaauccuaauga

SEQ ID NO: 675304 - RNA, 22 nt, Human
gaaagcugaaccaggaaccaug

SEQ ID NO: 675305 - RNA, 17 nt, Human
agcaacuucucccacag

SEQ ID NO: 675306 - RNA, 22 nt, Human
uacacaugugcacgcguguccu

SEQ ID NO: 675307 - RNA, 22 nt, Human
gcuauguuagacauucucauuu

SEQ ID NO: 675308 - RNA, 22 nt, Human
ggcuuccuaauacucccuacac

SEQ ID NO: 675309 - RNA, 22 nt, Human
uucauuccuucccuaagcaacu

SEQ ID NO: 675310 - RNA, 22 nt, Human
auccugagguacugcagggccg

SEQ ID NO: 675311 - RNA, 23 nt, Human
ugaguucucaucuuggcuucuau

SEQ ID NO: 675312 - RNA, 22 nt, Human
gggcagcagaauuggacagaaa

SEQ ID NO: 675313 - RNA, 22 nt, Human
ucugcacaauugaucauggcaa

SEQ ID NO: 675314 - RNA, 22 nt, Human
uugguuccuucugaaaguauug

SEQ ID NO: 675315 - RNA, 22 nt, Human
caaauaucuuuggcaaagagaa

SEQ ID NO: 675316 - RNA, 22 nt, Human
ucacagaaauaagauaguuauu

SEQ ID NO: 675317 - RNA, 22 nt, Human
aggcgcacaggguguugaugug

SEQ ID NO: 675318 - RNA, 23 nt, Human
agauugaaguauugaccagagcu

SEQ ID NO: 675319 - RNA, 22 nt, Human
uggacagguugaguaggaggag

SEQ ID NO: 675320 - RNA, 22 nt, Human
uacagacagacuucccacccuc

SEQ ID NO: 675321 - RNA, 19 nt, Human
auccuaaauccaguuucua

SEQ ID NO: 675322 - RNA, 22 nt, Human
gugugcaugugcuugcacagau

SEQ ID NO: 675323 - RNA, 22 nt, Human
aaggaagaagggaaguuacuua

SEQ ID NO: 675324 - RNA, 22 nt, Human
cggcuuccagcaggugcugcgc

SEQ ID NO: 675325 - RNA, 22 nt, Human
ccuggcucccuggaccucauua

SEQ ID NO: 675326 - RNA, 22 nt, Human
acuucuguauguccugcauuca

SEQ ID NO: 675327 - RNA, 22 nt, Human
uucucuggaaggcucuacggga

SEQ ID NO: 675328 - RNA, 22 nt, Human
ccagagucccuguucucggccu

SEQ ID NO: 675329 - RNA, 22 nt, Human
aggugggcacuccgcucgaggu

SEQ ID NO: 675330 - RNA, 22 nt, Human
ggcacaggaaucugugaagugc

SEQ ID NO: 675331 - RNA, 17 nt, Human
ccugaaggcacuuccag

SEQ ID NO: 675332 - RNA, 22 nt, Human
gcccucugcuggccucaccucg

SEQ ID NO: 675333 - RNA, 22 nt, Human
cagcccuguugcgcuuccggcg

SEQ ID NO: 675334 - RNA, 22 nt, Human
aauggcaugacuugcccaaggc

SEQ ID NO: 675335 - RNA, 22 nt, Human
ccagggcagggaccacgugucu

SEQ ID NO: 675336 - RNA, 21 nt, Human
ggaacauuguuaauagucucu

SEQ ID NO: 675337 - RNA, 22 nt, Human
ugcagccuugccuccucccagc

SEQ ID NO: 675338 - RNA, 22 nt, Human
agcagcugcuccacuugcuuaa

SEQ ID NO: 675339 - RNA, 22 nt, Human
ggccuaggaaggggauguaacu

SEQ ID NO: 675340 - RNA, 22 nt, Human
agccauugaguuuuaugugcua

SEQ ID NO: 675341 - RNA, 22 nt, Human
ccaagaguaaauucaugaugcc

SEQ ID NO: 675342 - RNA, 15 nt, Human
ccaaugucagaugcu

SEQ ID NO: 675343 - RNA, 22 nt, Human
uuggauuacaugaaaugcagaa

SEQ ID NO: 675344 - RNA, 22 nt, Human
uccagaauacucugaaaucauu

SEQ ID NO: 675345 - RNA, 22 nt, Human
cagccagggagggcaaaugaga

SEQ ID NO: 675346 - RNA, 22 nt, Human
guuuuuauauccuguggagugu

SEQ ID NO: 675347 - RNA, 22 nt, Human
ugucuguaagguguuuauguua

SEQ ID NO: 675348 - RNA, 22 nt, Human
agcuccugggccaucacaacca

SEQ ID NO: 675349 - RNA, 22 nt, Human
agcaauaagggauccucuauaa

SEQ ID NO: 675350 - RNA, 22 nt, Human
uggaaugcagugggagcuuacc

SEQ ID NO: 675351 - RNA, 22 nt, Human
aaccaagaggguuuuccuugaa

SEQ ID NO: 675352 - RNA, 22 nt, Human
cuggagcaaaagugacuccucu

SEQ ID NO: 675353 - RNA, 22 nt, Human
uucuucucggcugucagauagu

SEQ ID NO: 675354 - RNA, 22 nt, Human
aguguaugucaaguauauacac

SEQ ID NO: 675355 - RNA, 22 nt, Human
gacagcaaagcagagccaaggc

SEQ ID NO: 675356 - RNA, 22 nt, Human
aggccaggauagcauggaucag

SEQ ID NO: 675357 - RNA, 22 nt, Human
agacugugagaagauggcugcg

SEQ ID NO: 675358 - RNA, 22 nt, Human
ggcuucuuccugugaacauguu

SEQ ID NO: 675359 - RNA, 19 nt, Human
uccaauuuguauguuuuca

SEQ ID NO: 675360 - RNA, 20 nt, Human
cagaacaugagcaucgagcc

SEQ ID NO: 675361 - RNA, 22 nt, Human
uuucuauuuuaaaggcauaugg

SEQ ID NO: 675362 - RNA, 22 nt, Human
caucuguugcuuccuaacaagu

SEQ ID NO: 675363 - RNA, 22 nt, Human
uacuucauuauucuaguuuuga

SEQ ID NO: 675364 - RNA, 22 nt, Human
cccuaaggcagcccagucugug

SEQ ID NO: 675365 - RNA, 22 nt, Human
aaaagucagucucuccuagcuc

SEQ ID NO: 675366 - RNA, 22 nt, Human
cugggagauugaggccauggug

SEQ ID NO: 675367 - RNA, 22 nt, Human
caugcuauuuuccaauaaugua

SEQ ID NO: 675368 - RNA, 22 nt, Human
cugcccugagggccuguguguu

SEQ ID NO: 675369 - RNA, 22 nt, Human
ucuguuuauauuucaaaccuuc

SEQ ID NO: 675370 - RNA, 22 nt, Human
gugcaggaggaugacaacugca

SEQ ID NO: 675371 - RNA, 22 nt, Human
uagacauuggccauuccugugg

SEQ ID NO: 675372 - RNA, 22 nt, Human
cauguccacaguucugagaggc

SEQ ID NO: 675373 - RNA, 22 nt, Human
acuuaguauuuuucagcuuuga

SEQ ID NO: 675374 - RNA, 22 nt, Human
aggaggccuggcuggggagauc

SEQ ID NO: 675375 - RNA, 22 nt, Human
aagagagagcauucuucuguua

SEQ ID NO: 675376 - RNA, 22 nt, Human
agguaaaauagauaguauuucu

SEQ ID NO: 675377 - RNA, 22 nt, Human
cugagcuguggaauaaacacug

SEQ ID NO: 675378 - RNA, 22 nt, Human
acaggaucgcccuguugcccag

SEQ ID NO: 675379 - RNA, 22 nt, Human
caucaguaaggcaacauagcuu

SEQ ID NO: 675380 - RNA, 22 nt, Human
aaaugaucauguaauuucagaa

SEQ ID NO: 675381 - RNA, 22 nt, Human
auuguacacuaguggcagcagu

SEQ ID NO: 675382 - RNA, 22 nt, Human
gaaaccacaguacccaggaaaa

SEQ ID NO: 675383 - RNA, 22 nt, Human
ccuucgagauuuaaacacugau

SEQ ID NO: 675384 - RNA, 22 nt, Human
aguaaaaaguucagaaugguug

SEQ ID NO: 675385 - RNA, 22 nt, Human
acuguguggaaauuugugaggg

SEQ ID NO: 675386 - RNA, 22 nt, Human
cuggccucaccucagacuuacu

SEQ ID NO: 675387 - RNA, 22 nt, Human
ucugccacugugaugcaugaua

SEQ ID NO: 675388 - RNA, 22 nt, Human
agcagcaggguguaauugggca

SEQ ID NO: 675389 - RNA, 22 nt, Human
aaaccucugaauacuguuggca

SEQ ID NO: 675390 - RNA, 22 nt, Human
ugacagugaacagguuaccacu

SEQ ID NO: 675391 - RNA, 22 nt, Human
agggaagaggaccagagucucu

SEQ ID NO: 675392 - RNA, 22 nt, Human
cagcagagacgguaagcagaac

SEQ ID NO: 675393 - RNA, 22 nt, Human
auguguguauauauagucauuu

SEQ ID NO: 675394 - RNA, 22 nt, Human
aaagauuuaagaauaauuugug

SEQ ID NO: 675395 - RNA, 22 nt, Human
gugcuuuagcugaguuggucaa

SEQ ID NO: 675396 - RNA, 22 nt, Human
guagacagaaagcggaaucaua

SEQ ID NO: 675397 - RNA, 22 nt, Human
auaaaccuaugcuaagcugugg

SEQ ID NO: 675398 - RNA, 22 nt, Human
uccagcccaggcuggaguguag

SEQ ID NO: 675399 - RNA, 22 nt, Human
cugcagcuguagaggacagugg

SEQ ID NO: 675400 - RNA, 18 nt, Human
uugccccugggugaggau

SEQ ID NO: 675401 - RNA, 22 nt, Human
aguggcuucauuucugccagaa

SEQ ID NO: 675402 - RNA, 22 nt, Human
ucuggaguccagauccauuugg

SEQ ID NO: 675403 - RNA, 22 nt, Human
ucugggaaggcucugcagauau

SEQ ID NO: 675404 - RNA, 22 nt, Human
ucucugggccucaguuuucuca

SEQ ID NO: 675405 - RNA, 22 nt, Human
caugugugaaucuugugaucau

SEQ ID NO: 675406 - RNA, 22 nt, Human
ccuuagcaaauuggcaucuucu

SEQ ID NO: 675407 - RNA, 22 nt, Human
gggcugugcugaguaggaggug

SEQ ID NO: 675408 - RNA, 16 nt, Human
ucccaggaggcggaac

SEQ ID NO: 675409 - RNA, 22 nt, Human
cacugaaaucgaaaaauguagg

SEQ ID NO: 675410 - RNA, 19 nt, Human
cuuuuucaccuucuagaag

SEQ ID NO: 675411 - RNA, 22 nt, Human
uucuuaggacuaguauagcaug

SEQ ID NO: 675412 - RNA, 22 nt, Human
aggccuggcuuugguuugcuga

SEQ ID NO: 675413 - RNA, 22 nt, Human
gagcuagagggagaagggcacu

SEQ ID NO: 675414 - RNA, 22 nt, Human
uggcuuaguucuagaaauuugg

SEQ ID NO: 675415 - RNA, 22 nt, Human
acagagauguggaugagggauu

SEQ ID NO: 675416 - RNA, 23 nt, Human
guggagccacaucacaggcuccu

SEQ ID NO: 675417 - RNA, 22 nt, Human
ccauccauauggugacaaggug

SEQ ID NO: 675418 - RNA, 22 nt, Human
uaaucuguugacuaacuuggga

SEQ ID NO: 675419 - RNA, 22 nt, Human
ccaacagguugagagucugaau

SEQ ID NO: 675420 - RNA, 20 nt, Human
ccagcauguacacaugugga

SEQ ID NO: 675421 - RNA, 22 nt, Human
aauaacuuuuaaaagacccugg

SEQ ID NO: 675422 - RNA, 22 nt, Human
uaugccagggacuguuucacca

SEQ ID NO: 675423 - RNA, 22 nt, Human
uauaaaucuuuguuccuagaau

SEQ ID NO: 675424 - RNA, 21 nt, Human
agggaaaaggcugagugaggg

SEQ ID NO: 675425 - RNA, 22 nt, Human
ccagcagagcauggggaggaag

SEQ ID NO: 675426 - RNA, 22 nt, Human
cucugcugaucucagcugggcu

SEQ ID NO: 675427 - RNA, 22 nt, Human
ucuuagcauuucauaacaacug

SEQ ID NO: 675428 - RNA, 22 nt, Human
ucucagaauuguguccacuggg

SEQ ID NO: 675429 - RNA, 23 nt, Human
uauuagcaauucccacagagcag

SEQ ID NO: 675430 - RNA, 22 nt, Human
uucucagcuuuccuugcaguua

SEQ ID NO: 675431 - RNA, 22 nt, Human
auggcaguugcccagccaaucc

SEQ ID NO: 675432 - RNA, 22 nt, Human
uuggccaagggcucuuuaggcu

SEQ ID NO: 675433 - RNA, 22 nt, Human
uaggcacuggggaggcagcaug

SEQ ID NO: 675434 - RNA, 22 nt, Human
cagugguuucugaacagugugc

SEQ ID NO: 675435 - RNA, 22 nt, Human
auucacaguuuccucauauucu

SEQ ID NO: 675436 - RNA, 20 nt, Human
agacaaaaugacuucaugca

SEQ ID NO: 675437 - RNA, 16 nt, Human
aauugcuucuugcugc

SEQ ID NO: 675438 - RNA, 22 nt, Human
acuuuggacgccaugcuguuug

SEQ ID NO: 675439 - RNA, 22 nt, Human
acaguucaagucuuagacaaca

SEQ ID NO: 675440 - RNA, 22 nt, Human
agcaaacauucagcagauuggc

SEQ ID NO: 675441 - RNA, 21 nt, Human
guggccugauuaugaaugggu

SEQ ID NO: 675442 - RNA, 22 nt, Human
aacagcuaccuucucacugugc

SEQ ID NO: 675443 - RNA, 22 nt, Human
augucagucuuucugucucaga

SEQ ID NO: 675444 - RNA, 22 nt, Human
uggagcucaaaggccuguggga

SEQ ID NO: 675445 - RNA, 22 nt, Human
ugcuuccagcucucuguaaggu

SEQ ID NO: 675446 - RNA, 21 nt, Human
ccugagguuucuggccucugu

SEQ ID NO: 675447 - RNA, 22 nt, Human
acugucuucauaucugugucuc

SEQ ID NO: 675448 - RNA, 22 nt, Human
uuaacagguuauauuguacagg

SEQ ID NO: 675449 - RNA, 22 nt, Human
acaaauuugaauccugacuucu

SEQ ID NO: 675450 - RNA, 22 nt, Human
ucccagcccagguaugaugaua

SEQ ID NO: 675451 - RNA, 22 nt, Human
ugaggcagugcugggaagccug

SEQ ID NO: 675452 - RNA, 22 nt, Human
cugaggcucaagggcagguggg

SEQ ID NO: 675453 - RNA, 22 nt, Human
gaacaacuuugaaacaugaaga

SEQ ID NO: 675454 - RNA, 22 nt, Human
uaaggcagcauaauuaggccac

SEQ ID NO: 675455 - RNA, 22 nt, Human
uggugcagguguugaugcagga

SEQ ID NO: 675456 - RNA, 22 nt, Human
ccagacuuuuaguagugaguua

SEQ ID NO: 675457 - RNA, 18 nt, Human
auuuugaacugggaauau

SEQ ID NO: 675458 - RNA, 19 nt, Human
aucccaaggagcugggacu

SEQ ID NO: 675459 - RNA, 22 nt, Human
gaaccuuaugguaaaucuagag

SEQ ID NO: 675460 - RNA, 22 nt, Human
ucuaaucuacaaaaggaaauuc

SEQ ID NO: 675461 - RNA, 22 nt, Human
ugcuucauuuugacuuagccag

SEQ ID NO: 675462 - RNA, 22 nt, Human
acucuuuagagguacaucucuu

SEQ ID NO: 675463 - RNA, 22 nt, Human
uuguucauuagcgcuugggcac

SEQ ID NO: 675464 - RNA, 22 nt, Human
cagcucuuaacacagcuuguau

SEQ ID NO: 675465 - RNA, 22 nt, Human
uuucuaaguguauugagcuugg

SEQ ID NO: 675466 - RNA, 22 nt, Human
ucucaaauggacaauauugugg

SEQ ID NO: 675467 - RNA, 22 nt, Human
acugaagaacgcaucagugguu

SEQ ID NO: 675468 - RNA, 22 nt, Human
uugagggauuuacagagguggg

SEQ ID NO: 675469 - RNA, 22 nt, Human
caccuuguggcccagucagguu

SEQ ID NO: 675470 - RNA, 22 nt, Human
auacagaagaacuauagccacu

SEQ ID NO: 675471 - RNA, 22 nt, Human
uaaggaauagugcuaugaaaaa

SEQ ID NO: 675472 - RNA, 23 nt, Human
uagacacuccuuugucuguccuu

SEQ ID NO: 675473 - RNA, 22 nt, Human
cuccuccagcucucccuggggg

SEQ ID NO: 675474 - RNA, 22 nt, Human
cacaagggagcuuagaaaacau

SEQ ID NO: 675475 - RNA, 22 nt, Human
uggcucugccacuaacuuggua

SEQ ID NO: 675476 - RNA, 19 nt, Human
auacagauguauccaugau

SEQ ID NO: 675477 - RNA, 22 nt, Human
ucaguguuggcauucagaaaug

SEQ ID NO: 675478 - RNA, 22 nt, Human
acuuucaaauaucaugauucua

SEQ ID NO: 675479 - RNA, 22 nt, Human
aagucauagucgggaaagacau

SEQ ID NO: 675480 - RNA, 22 nt, Human
ucucagagugguggucccucug

SEQ ID NO: 675481 - RNA, 22 nt, Human
gagcacauguggagagucuggg

SEQ ID NO: 675482 - RNA, 22 nt, Human
guuaucuuaggguacaaaggac

SEQ ID NO: 675483 - RNA, 22 nt, Human
gcagaauacugagagcugauug

SEQ ID NO: 675484 - RNA, 22 nt, Human
ucugaaauaggcuucuuuuggu

SEQ ID NO: 675485 - RNA, 22 nt, Human
ggcaggugagagcucuuugaaa

SEQ ID NO: 675486 - RNA, 22 nt, Human
cgagcagagcagagacgucugg

SEQ ID NO: 675487 - RNA, 22 nt, Human
uacauacauuaccucauuuagu

SEQ ID NO: 675488 - RNA, 22 nt, Human
guuggccugaauggucaagagg

SEQ ID NO: 675489 - RNA, 22 nt, Human
ucugaagagcuuuggaaguaug

SEQ ID NO: 675490 - RNA, 22 nt, Human
cccugagccgcugcuccaaccu

SEQ ID NO: 675491 - RNA, 22 nt, Human
aggcugugagagguggcuccca

SEQ ID NO: 675492 - RNA, 22 nt, Human
agucagagaauguuuucaugga

SEQ ID NO: 675493 - RNA, 23 nt, Human
aaaaaaccauguaggcacucagu

SEQ ID NO: 675494 - RNA, 22 nt, Human
agcccaguugcuccacgcugca

SEQ ID NO: 675495 - RNA, 22 nt, Human
augaggagucaaggagucggag

SEQ ID NO: 675496 - RNA, 22 nt, Human
cucugggcuuccuuuguggguu

SEQ ID NO: 675497 - RNA, 22 nt, Human
uggcagcugcaggccuccugag

SEQ ID NO: 675498 - RNA, 22 nt, Human
aggaauguaguuugaguagaaa

SEQ ID NO: 675499 - RNA, 22 nt, Human
ggguggaguagaaagaugaauu

SEQ ID NO: 675500 - RNA, 22 nt, Human
gucuagaaaugccauacgugcc

SEQ ID NO: 675501 - RNA, 22 nt, Human
agcuccuggcaaggucauggug

SEQ ID NO: 675502 - RNA, 22 nt, Human
cucaaggacuuauucaugccug

SEQ ID NO: 675503 - RNA, 22 nt, Human
guggcagugaggcaggagcagu

SEQ ID NO: 675504 - RNA, 22 nt, Human
ucagggcugacugcuacucucc

SEQ ID NO: 675505 - RNA, 22 nt, Human
ucaucaguguccuuaucacuua

SEQ ID NO: 675506 - RNA, 22 nt, Human
ucucuugaagauugaagacaaa

SEQ ID NO: 675507 - RNA, 22 nt, Human
aaugaggcuugcauugugaacu

SEQ ID NO: 675508 - RNA, 22 nt, Human
cuggcccuuaggaaaacaaagu

SEQ ID NO: 675509 - RNA, 22 nt, Human
gcaagcuguccuuuugcauggc

SEQ ID NO: 675510 - RNA, 22 nt, Human
agaagccaaucagcucucugcu

SEQ ID NO: 675511 - RNA, 22 nt, Human
uauggguacuuugauuuagaaa

SEQ ID NO: 675512 - RNA, 22 nt, Human
uuuguagaacuauacuuacauu

SEQ ID NO: 675513 - RNA, 22 nt, Human
uguguuggaaauagggucuuug

SEQ ID NO: 675514 - RNA, 22 nt, Human
acuucuguaaagggaagacagu

SEQ ID NO: 675515 - RNA, 18 nt, Human
ucugaauauuaugcagug

SEQ ID NO: 675516 - RNA, 20 nt, Human
cacccucccagcaccuaugc

SEQ ID NO: 675517 - RNA, 22 nt, Human
gagaggucggggacacugcaaa

SEQ ID NO: 675518 - RNA, 22 nt, Human
ucacaucacaugacaguaggcc

SEQ ID NO: 675519 - RNA, 22 nt, Human
aauacauaauaaguuuugucug

SEQ ID NO: 675520 - RNA, 22 nt, Human
uuuugcaucuggugaagaccag

SEQ ID NO: 675521 - RNA, 22 nt, Human
cugauugagaaggaaggggauc

SEQ ID NO: 675522 - RNA, 22 nt, Human
uggcacaguuaaaguuguagaa

SEQ ID NO: 675523 - RNA, 22 nt, Human
cauuuagaaacuguuuuuaaca

SEQ ID NO: 675524 - RNA, 22 nt, Human
auagucuuagaucagauaaagu

SEQ ID NO: 675525 - RNA, 22 nt, Human
aaaugaacaucaagaauagccu

SEQ ID NO: 675526 - RNA, 22 nt, Human
ucagaacauauauuuugugaug

SEQ ID NO: 675527 - RNA, 17 nt, Human
ucuucucuuccagucuu

SEQ ID NO: 675528 - RNA, 22 nt, Human
ucccaucuccaacauuuuucuu

SEQ ID NO: 675529 - RNA, 22 nt, Human
acaugcacagcaagggugagag

SEQ ID NO: 675530 - RNA, 22 nt, Human
uuuuauugucuguauugccuau

SEQ ID NO: 675531 - RNA, 22 nt, Human
gaucuauuuacucuuuuccuag

SEQ ID NO: 675532 - RNA, 22 nt, Human
ugacauuucuuguugauauaaa

SEQ ID NO: 675533 - RNA, 17 nt, Human
ccaggugggaggugggg

SEQ ID NO: 675534 - RNA, 22 nt, Human
uaaaggcaaacucuccaaggau

SEQ ID NO: 675535 - RNA, 22 nt, Human
cauugucugguaggaagugggc

SEQ ID NO: 675536 - RNA, 22 nt, Human
uguccugggucccugcuagaag

SEQ ID NO: 675537 - RNA, 22 nt, Human
ucuacaugauguaccaucuaag

SEQ ID NO: 675538 - RNA, 22 nt, Human
uucugaaaauugggucauacuu

SEQ ID NO: 675539 - RNA, 22 nt, Human
agagcacagugcaggauccccg

SEQ ID NO: 675540 - RNA, 22 nt, Human
gggaaaauauuaagcaggacuu

SEQ ID NO: 675541 - RNA, 22 nt, Human
ggacaggcccucuggucagcuu

SEQ ID NO: 675542 - RNA, 22 nt, Human
ugucugaaucgcuuccuagagg

SEQ ID NO: 675543 - RNA, 22 nt, Human
aucaaguucugucacauuuguc

SEQ ID NO: 675544 - RNA, 22 nt, Human
ucuguucuaagcauucuaugug

SEQ ID NO: 675545 - RNA, 22 nt, Human
aauacauauggaauuccauguu

SEQ ID NO: 675546 - RNA, 22 nt, Human
caguugcuacaguucaagugug

SEQ ID NO: 675547 - RNA, 22 nt, Human
aagguggcccugagcaugacaa

SEQ ID NO: 675548 - RNA, 22 nt, Human
ucuugccucuuccccuuuccau

SEQ ID NO: 675549 - RNA, 22 nt, Human
guguucuuuugcuucacagaaa

SEQ ID NO: 675550 - RNA, 22 nt, Human
cucagcucacucuuuugugcuu

SEQ ID NO: 675551 - RNA, 22 nt, Human
auuugcagagcucugaauuuug

SEQ ID NO: 675552 - RNA, 22 nt, Human
ggugaugaaaagugccuuuauc

SEQ ID NO: 675553 - RNA, 22 nt, Human
ggcuggaaguccaagaucaaga

SEQ ID NO: 675554 - RNA, 22 nt, Human
aagguuucuccgaggcuauuuu

SEQ ID NO: 675555 - RNA, 22 nt, Human
caaagugccuguaccacuuugc

SEQ ID NO: 675556 - RNA, 22 nt, Human
cagaagugauguugagcuaguc

SEQ ID NO: 675557 - RNA, 22 nt, Human
cugcugggcuccucaugugacu

SEQ ID NO: 675558 - RNA, 18 nt, Human
acuugggacuuuugcauu

SEQ ID NO: 675559 - RNA, 22 nt, Human
ucucuaaagcacuuuaaccaca

SEQ ID NO: 675560 - RNA, 22 nt, Human
aucucccagccacagcauucuu

SEQ ID NO: 675561 - RNA, 22 nt, Human
ucuucuccaguucauccuacca

SEQ ID NO: 675562 - RNA, 22 nt, Human
uugaggcagggcaugguggccc

SEQ ID NO: 675563 - RNA, 22 nt, Human
auucugcucccaggugaugcug

SEQ ID NO: 675564 - RNA, 22 nt, Human
uacaagaugacaggugcaugau

SEQ ID NO: 675565 - RNA, 22 nt, Human
uguaugaaucucauuuguuuaa

SEQ ID NO: 675566 - RNA, 22 nt, Human
uaacagaagaugaaacuucuuu

SEQ ID NO: 675567 - RNA, 22 nt, Human
uacagccucuucccuggagugg

SEQ ID NO: 675568 - RNA, 22 nt, Human
auuacaguagcaaaagaccgga

SEQ ID NO: 675569 - RNA, 22 nt, Human
cagcaccuaggacaguagucag

SEQ ID NO: 675570 - RNA, 22 nt, Human
uguuagaaauuauuaguaauau

SEQ ID NO: 675571 - RNA, 22 nt, Human
ucaccccuggcccagucuugga

SEQ ID NO: 675572 - RNA, 22 nt, Human
agcucugcuacucuguggggug

SEQ ID NO: 675573 - RNA, 22 nt, Human
ccagguucaaauagcuguguga

SEQ ID NO: 675574 - RNA, 23 nt, Human
uggcucagggucucuuaugaagu

SEQ ID NO: 675575 - RNA, 22 nt, Human
uccuugaggaggugacacugga

SEQ ID NO: 675576 - RNA, 22 nt, Human
uccucaggagagcuccuaugcc

SEQ ID NO: 675577 - RNA, 22 nt, Human
ucuuaaaugacugauaagagga

SEQ ID NO: 675578 - RNA, 22 nt, Human
ucuucuccuuugccauguguuu

SEQ ID NO: 675579 - RNA, 22 nt, Human
gggcaagcagugaggacagcac

SEQ ID NO: 675580 - RNA, 22 nt, Human
aggcuggcugagcugcagccug

SEQ ID NO: 675581 - RNA, 22 nt, Human
gacagacaugggacuucauacu

SEQ ID NO: 675582 - RNA, 22 nt, Human
acaggcuucucacagaaaaggg

SEQ ID NO: 675583 - RNA, 21 nt, Human
ugccagcugcugcaucugucu

SEQ ID NO: 675584 - RNA, 22 nt, Human
aaauuguagagaucgcuuugug

SEQ ID NO: 675585 - RNA, 22 nt, Human
auaaacugugcuggaugaugag

SEQ ID NO: 675586 - RNA, 22 nt, Human
agaaaauaaauugaugguggaa

SEQ ID NO: 675587 - RNA, 22 nt, Human
cucaggccauuccuaccaaggg

SEQ ID NO: 675588 - RNA, 22 nt, Human
cagggacagggaucauuugcuu

SEQ ID NO: 675589 - RNA, 22 nt, Human
gaaacugugaucguguucuggg

SEQ ID NO: 675590 - RNA, 22 nt, Human
aggccaaauugaucaucuuuag

SEQ ID NO: 675591 - RNA, 22 nt, Human
uugaucagguugcuguggugua

SEQ ID NO: 675592 - RNA, 19 nt, Human
uccaguuuggcaggaagac

SEQ ID NO: 675593 - RNA, 22 nt, Human
uagaaagcccuguguucacugc

SEQ ID NO: 675594 - RNA, 22 nt, Human
aggcugugcucagccaauggga

SEQ ID NO: 675595 - RNA, 22 nt, Human
gagcccugcccacuugucugag

SEQ ID NO: 675596 - RNA, 22 nt, Human
cugggagcccgcguccuggugg

SEQ ID NO: 675597 - RNA, 22 nt, Human
aaaugucuuugaguauuucugc

SEQ ID NO: 675598 - RNA, 21 nt, Human
uguuccuguucucuaggaucc

SEQ ID NO: 675599 - RNA, 21 nt, Human
acagggcuucagggaggguua

SEQ ID NO: 675600 - RNA, 22 nt, Human
ucccuagaggucuucacaagau

SEQ ID NO: 675601 - RNA, 22 nt, Human
ucaggacagacuagacuagcgu

SEQ ID NO: 675602 - RNA, 22 nt, Human
uucucaggucaccagggugcca

SEQ ID NO: 675603 - RNA, 22 nt, Human
cacagugacuggcacauaguaa

SEQ ID NO: 675604 - RNA, 22 nt, Human
aauuaagagagaguugaagcaa

SEQ ID NO: 675605 - RNA, 20 nt, Human
cuaaccuuaaccaucaccag

SEQ ID NO: 675606 - RNA, 22 nt, Human
ggguguugauuuuacacuaaaa

SEQ ID NO: 675607 - RNA, 17 nt, Human
agcugagcuggccaggg

SEQ ID NO: 675608 - RNA, 19 nt, Human
cucugccucuggcuguggc

SEQ ID NO: 675609 - RNA, 22 nt, Human
aacauuuauucuaauucuggga

SEQ ID NO: 675610 - RNA, 22 nt, Human
ugcuggaggccgagaagcagca

SEQ ID NO: 675611 - RNA, 22 nt, Human
caaguccaacaguuuuucagac

SEQ ID NO: 675612 - RNA, 19 nt, Human
agcugcuggcccagggacc

SEQ ID NO: 675613 - RNA, 22 nt, Human
cucuggucauuuggaagagcau

SEQ ID NO: 675614 - RNA, 22 nt, Human
uggcucugccccauaccccugc

SEQ ID NO: 675615 - RNA, 22 nt, Human
ggaucagaaucucugagaguuu

SEQ ID NO: 675616 - RNA, 22 nt, Human
gagaaggaaguugagccagcau

SEQ ID NO: 675617 - RNA, 22 nt, Human
ccaggugugauuuggcaguguc

SEQ ID NO: 675618 - RNA, 22 nt, Human
uguauuuucugaggagcauuag

SEQ ID NO: 675619 - RNA, 22 nt, Human
cuuauacagaucaagggaaaag

SEQ ID NO: 675620 - RNA, 22 nt, Human
gaucacauaauuuggaaacagc

SEQ ID NO: 675621 - RNA, 22 nt, Human
caauuucagguggauagguuuu

SEQ ID NO: 675622 - RNA, 22 nt, Human
ucuuugauggagagauagauau

SEQ ID NO: 675623 - RNA, 22 nt, Human
gaaaucuacgauuagugaaaau

SEQ ID NO: 675624 - RNA, 22 nt, Human
ccugagaaaccuggugcaauua

SEQ ID NO: 675625 - RNA, 22 nt, Human
uuauaucuuuuuacaucucucc

SEQ ID NO: 675626 - RNA, 22 nt, Human
cagggacaugacuggucucugu

SEQ ID NO: 675627 - RNA, 22 nt, Human
uucucucuguuauggauuuuac

SEQ ID NO: 675628 - RNA, 22 nt, Human
ugccagugggugugcagagacu

SEQ ID NO: 675629 - RNA, 22 nt, Human
auuaguguggacccuaauuuaa

SEQ ID NO: 675630 - RNA, 22 nt, Human
aggcugggaaauguauuccagc

SEQ ID NO: 675631 - RNA, 22 nt, Human
acuuugaaggggaacauuuuaa

SEQ ID NO: 675632 - RNA, 22 nt, Human
uggcaggagccugcggggaggu

SEQ ID NO: 675633 - RNA, 22 nt, Human
agcaauuucccaucucuucugc

SEQ ID NO: 675634 - RNA, 22 nt, Human
cagagguagccgagugcaaucg

SEQ ID NO: 675635 - RNA, 22 nt, Human
uucuaugucagugugcucugug

SEQ ID NO: 675636 - RNA, 22 nt, Human
agagauucugugucaaaacgaa

SEQ ID NO: 675637 - RNA, 22 nt, Human
caaauuacccucaacaucuaga

SEQ ID NO: 675638 - RNA, 22 nt, Human
augcauauugucauuuaguccu

SEQ ID NO: 675639 - RNA, 23 nt, Human
aucagucuugguagcugugccca

SEQ ID NO: 675640 - RNA, 22 nt, Human
auguuuuccugggagagcacuc

SEQ ID NO: 675641 - RNA, 20 nt, Human
uagagcaugaaguccuaucc

SEQ ID NO: 675642 - RNA, 22 nt, Human
uagaaauguugguauuaacauu

SEQ ID NO: 675643 - RNA, 19 nt, Human
cagcucaggacucagcccc

SEQ ID NO: 675644 - RNA, 22 nt, Human
agggcuggccacaugauuuggu

SEQ ID NO: 675645 - RNA, 22 nt, Human
ugggccugauucuugaauccug

SEQ ID NO: 675646 - RNA, 22 nt, Human
ugggggcacuucgaggucgccu

SEQ ID NO: 675647 - RNA, 22 nt, Human
cuccuccaguccuccaaggaca

SEQ ID NO: 675648 - RNA, 22 nt, Human
ugaaucaaagcugaaguuuuca

SEQ ID NO: 675649 - RNA, 22 nt, Human
ucucacaguaugaauuguucac

SEQ ID NO: 675650 - RNA, 22 nt, Human
agaaauacaaaguacuaagaua

SEQ ID NO: 675651 - RNA, 22 nt, Human
acagaggccgccucucucacgg

SEQ ID NO: 675652 - RNA, 22 nt, Human
uggccugguuguugcugccguu

SEQ ID NO: 675653 - RNA, 22 nt, Human
ugcaggucuccauuggcagacu

SEQ ID NO: 675654 - RNA, 22 nt, Human
ucucaaauauuuggagagagga

SEQ ID NO: 675655 - RNA, 19 nt, Human
ccucccacggauuccuucc

SEQ ID NO: 675656 - RNA, 21 nt, Human
aucugaaagguuaguguugag

SEQ ID NO: 675657 - RNA, 22 nt, Human
ccugaaaugaguucugcucacu

SEQ ID NO: 675658 - RNA, 22 nt, Human
acauucacgcucucaaagcuga

SEQ ID NO: 675659 - RNA, 22 nt, Human
uugcuguuuuacaucugguggg

SEQ ID NO: 675660 - RNA, 22 nt, Human
aacaguguucuaggguguggcu

SEQ ID NO: 675661 - RNA, 22 nt, Human
cuuauaguaugauguugagaau

SEQ ID NO: 675662 - RNA, 22 nt, Human
acaguggaugacauccuuuugc

SEQ ID NO: 675663 - RNA, 22 nt, Human
gcaugcaggagagaaagacggc

SEQ ID NO: 675664 - RNA, 22 nt, Human
ugugcuucucacaucacuguug

SEQ ID NO: 675665 - RNA, 22 nt, Human
aauaauuuccagccaacuggaa

SEQ ID NO: 675666 - RNA, 22 nt, Human
uugauucuucugaauuugcaga

SEQ ID NO: 675667 - RNA, 22 nt, Human
uggcacuguggauuucacaagu

SEQ ID NO: 675668 - RNA, 22 nt, Human
aaucuauaugcuuuucacauac

SEQ ID NO: 675669 - RNA, 22 nt, Human
aucagaaaggugggcaagcaga

SEQ ID NO: 675670 - RNA, 22 nt, Human
aggggcaaaugugagccuggaa

SEQ ID NO: 675671 - RNA, 22 nt, Human
cugaggaccccacaggaggccc

SEQ ID NO: 675672 - RNA, 22 nt, Human
augucuuucucauacaagccca

SEQ ID NO: 675673 - RNA, 22 nt, Human
ggaacuuuaggauccuggcuca

SEQ ID NO: 675674 - RNA, 20 nt, Human
aggaacuuuguagaauacaa

SEQ ID NO: 675675 - RNA, 22 nt, Human
gauuucuaguaagucaugaagg

SEQ ID NO: 675676 - RNA, 23 nt, Human
agcaacagugggugaguguugcu

SEQ ID NO: 675677 - RNA, 19 nt, Human
cccaggguuuccucucucc

SEQ ID NO: 675678 - RNA, 22 nt, Human
cagaguggcgacccccucagcu

SEQ ID NO: 675679 - RNA, 22 nt, Human
ucaggcugauuucuuuugaggg

SEQ ID NO: 675680 - RNA, 22 nt, Human
acagauguaaucuauucacauu

SEQ ID NO: 675681 - RNA, 22 nt, Human
uuucuauaucuuaccuauugua

SEQ ID NO: 675682 - RNA, 22 nt, Human
uuaaaugacuuuuauuauucuc

SEQ ID NO: 675683 - RNA, 22 nt, Human
ugccugcuaggcccugcugggu

SEQ ID NO: 675684 - RNA, 23 nt, Human
agucaagaugcaucugugaggaa

SEQ ID NO: 675685 - RNA, 22 nt, Human
ugaggcagggagaguggauaug

SEQ ID NO: 675686 - RNA, 18 nt, Human
uggcucugccacucaccg

SEQ ID NO: 675687 - RNA, 22 nt, Human
gagcuuccugcaggucacugug

SEQ ID NO: 675688 - RNA, 22 nt, Human
cuuuacaaagcaauuuugucuc

SEQ ID NO: 675689 - RNA, 22 nt, Human
uguaaagaaagacgcagaguua

SEQ ID NO: 675690 - RNA, 22 nt, Human
guguccugggcauuaggcuuag

SEQ ID NO: 675691 - RNA, 22 nt, Human
gucugcccaucuccgggcgggg

SEQ ID NO: 675692 - RNA, 22 nt, Human
gaggggcacagcagcuguugca

SEQ ID NO: 675693 - RNA, 22 nt, Human
auucuuuuguccuagcuugaua

SEQ ID NO: 675694 - RNA, 23 nt, Human
uccugcugaaagcuccagcuggc

SEQ ID NO: 675695 - RNA, 22 nt, Human
ucccagaggcaguugguaacuu

SEQ ID NO: 675696 - RNA, 22 nt, Human
auacuguuucucuucuacauga

SEQ ID NO: 675697 - RNA, 22 nt, Human
ugaaggccuaacuuccagugcu

SEQ ID NO: 675698 - RNA, 22 nt, Human
ccagagguggucauagaaagca

SEQ ID NO: 675699 - RNA, 22 nt, Human
cuucugugcuucacaguugcca

SEQ ID NO: 675700 - RNA, 22 nt, Human
agcaucagccucuguccuggag

SEQ ID NO: 675701 - RNA, 22 nt, Human
uucuacaugguugcucagaggg

SEQ ID NO: 675702 - RNA, 22 nt, Human
uauugcagacaaaaugagcuac

SEQ ID NO: 675703 - RNA, 23 nt, Human
agaauuguaaauagaauauaccu

SEQ ID NO: 675704 - RNA, 22 nt, Human
gucuuucuuaauucaagugcuu

SEQ ID NO: 675705 - RNA, 17 nt, Human
gccuuccagcauguggg

SEQ ID NO: 675706 - RNA, 21 nt, Human
ggacagaggagaaggcacccu

SEQ ID NO: 675707 - RNA, 22 nt, Human
aggggccugguuggccucuguu

SEQ ID NO: 675708 - RNA, 22 nt, Human
ccaaaauguuugaaugcaugug

SEQ ID NO: 675709 - RNA, 22 nt, Human
cugggcuccacuacuugcuaac

SEQ ID NO: 675710 - RNA, 22 nt, Human
auuccucaaagguagcccauua

SEQ ID NO: 675711 - RNA, 22 nt, Human
ucuggagcuuguuucagauggu

SEQ ID NO: 675712 - RNA, 21 nt, Human
uaaaacuguaacuuuguccug

SEQ ID NO: 675713 - RNA, 22 nt, Human
aaagguaucauguccauacagu

SEQ ID NO: 675714 - RNA, 22 nt, Human
agaggcaguauacaauccgagc

SEQ ID NO: 675715 - RNA, 22 nt, Human
acauuuauuuucagcugggaaa

SEQ ID NO: 675716 - RNA, 22 nt, Human
aaaccucuggguuccgugguuu

SEQ ID NO: 675717 - RNA, 22 nt, Human
uucagcauuucuguuguuggcu

SEQ ID NO: 675718 - RNA, 18 nt, Human
uggcucagauggcuuuaa

SEQ ID NO: 675719 - RNA, 22 nt, Human
cauuuauuggcauguaguaggu

SEQ ID NO: 675720 - RNA, 22 nt, Human
ucccuggggaagggcaagcaag

SEQ ID NO: 675721 - RNA, 22 nt, Human
ucaagcucauuccucuaaccuc

SEQ ID NO: 675722 - RNA, 20 nt, Human
uggcugugggcaucuguuuc

SEQ ID NO: 675723 - RNA, 22 nt, Human
gagcugagcagggagccucacu

SEQ ID NO: 675724 - RNA, 22 nt, Human
cacccaggcauggguugagaug

SEQ ID NO: 675725 - RNA, 22 nt, Human
ggcagagguagcuggaaccagg

SEQ ID NO: 675726 - RNA, 17 nt, Human
aguguuuccuuaucauu

SEQ ID NO: 675727 - RNA, 22 nt, Human
agccccuguuuuuccagucaga

SEQ ID NO: 675728 - RNA, 22 nt, Human
uccagggcaugcucagacucag

SEQ ID NO: 675729 - RNA, 22 nt, Human
auaucuuuuagagcaagcuugu

SEQ ID NO: 675730 - RNA, 23 nt, Human
uggcuccaggagaagccagaagc

SEQ ID NO: 675731 - RNA, 22 nt, Human
ucagugguuaaguucuguccac

SEQ ID NO: 675732 - RNA, 22 nt, Human
uuagaaguaaggucagauuucu

SEQ ID NO: 675733 - RNA, 22 nt, Human
aguuuguaugccaacagcaaag

SEQ ID NO: 675734 - RNA, 22 nt, Human
gggagcugggcugguuuugcug

SEQ ID NO: 675735 - RNA, 22 nt, Human
cugggcugagccugggcugugu

SEQ ID NO: 675736 - RNA, 19 nt, Human
uggcccagaugguccuggg

SEQ ID NO: 675737 - RNA, 22 nt, Human
ggugucugcuucccuccagcug

SEQ ID NO: 675738 - RNA, 20 nt, Human
gcucuaaagccacagauuga

SEQ ID NO: 675739 - RNA, 22 nt, Human
ggcuucagaagacuggacaggu

SEQ ID NO: 675740 - RNA, 20 nt, Human
ucucccaggcucagggaaga

SEQ ID NO: 675741 - RNA, 22 nt, Human
aauaaacuuccacuguguuuuu

SEQ ID NO: 675742 - RNA, 22 nt, Human
gagggcuuguaaguggguggag

SEQ ID NO: 675743 - RNA, 22 nt, Human
cuuuggcugggcaaagggaggu

SEQ ID NO: 675744 - RNA, 22 nt, Human
aaggcagagggcuggaucagag

SEQ ID NO: 675745 - RNA, 22 nt, Human
uagaucauauacuugccaugac

SEQ ID NO: 675746 - RNA, 22 nt, Human
agccaggaaccagcuacagucu

SEQ ID NO: 675747 - RNA, 22 nt, Human
ucagccaggcccuaagagauug

SEQ ID NO: 675748 - RNA, 22 nt, Human
guguguguauauauacacacac

SEQ ID NO: 675749 - RNA, 22 nt, Human
cacauagauaggcagaagaaca

SEQ ID NO: 675750 - RNA, 22 nt, Human
auguuggagucguaaggcaugg

SEQ ID NO: 675751 - RNA, 22 nt, Human
uacauucuggaaaggcacagac

SEQ ID NO: 675752 - RNA, 22 nt, Human
gggaaggagccugcuugcuaga

SEQ ID NO: 675753 - RNA, 22 nt, Human
agggcucacugggaggcuauaa

SEQ ID NO: 675754 - RNA, 22 nt, Human
uggccuccucgggcugacccug

SEQ ID NO: 675755 - RNA, 22 nt, Human
auguaucacagcaauguaguca

SEQ ID NO: 675756 - RNA, 22 nt, Human
agcugcugcaaguggugcuaac

SEQ ID NO: 675757 - RNA, 22 nt, Human
aauauuuguuaguguuuuaaug

SEQ ID NO: 675758 - RNA, 20 nt, Human
cuguaucagguuacaaagua

SEQ ID NO: 675759 - RNA, 22 nt, Human
guggcagugccagcuccgacaa

SEQ ID NO: 675760 - RNA, 22 nt, Human
ggaacacagugccuuacaaacu

SEQ ID NO: 675761 - RNA, 22 nt, Human
aaagucugaaagaugcuaacau

SEQ ID NO: 675762 - RNA, 22 nt, Human
ugacaucuaguagguagagacc

SEQ ID NO: 675763 - RNA, 22 nt, Human
auaagcauuucacagguguguu

SEQ ID NO: 675764 - RNA, 22 nt, Human
uuacaguuuaguccaagccaga

SEQ ID NO: 675765 - RNA, 22 nt, Human
ugcacuccaggcugggugacag

SEQ ID NO: 675766 - RNA, 22 nt, Human
gcugccuggagcucagccugcc

SEQ ID NO: 675767 - RNA, 22 nt, Human
caucagcacuaugauuaaagua

SEQ ID NO: 675768 - RNA, 22 nt, Human
uagcuguucauguggcuuuaug

SEQ ID NO: 675769 - RNA, 22 nt, Human
ucucaaaucaaacuuugagcuu

SEQ ID NO: 675770 - RNA, 22 nt, Human
cuggaguaaguuaagauguucc

SEQ ID NO: 675771 - RNA, 22 nt, Human
auggcugcagagaccugaagaa

SEQ ID NO: 675772 - RNA, 22 nt, Human
uguaugcuuuccuucuuucugg

SEQ ID NO: 675773 - RNA, 22 nt, Human
ggcaggcaguguggugugaaac

SEQ ID NO: 675774 - RNA, 22 nt, Human
gcgguggggaaaggaggugcug

SEQ ID NO: 675775 - RNA, 22 nt, Human
gacuccagcauauacuuuuagu

SEQ ID NO: 675776 - RNA, 22 nt, Human
ucccagaguucaaugggaaggu

SEQ ID NO: 675777 - RNA, 22 nt, Human
uauguuuccugagcuuacacca

SEQ ID NO: 675778 - RNA, 22 nt, Human
uaguuuaggucguacaagcaaa

SEQ ID NO: 675779 - RNA, 22 nt, Human
gggagggguugcauguuugagu

SEQ ID NO: 675780 - RNA, 22 nt, Human
gcuguccagagcaugggagcaa

SEQ ID NO: 675781 - RNA, 22 nt, Human
aaagcauggcaugaagaacaug

SEQ ID NO: 675782 - RNA, 22 nt, Human
ugggcugcagggguugagagcu

SEQ ID NO: 675783 - RNA, 22 nt, Human
cagauacagguuuuuguuagau

SEQ ID NO: 675784 - RNA, 22 nt, Human
uauuacaaauuauaaugggaga

SEQ ID NO: 675785 - RNA, 22 nt, Human
guuaauuuaguagaguccagau

SEQ ID NO: 675786 - RNA, 22 nt, Human
uugacaauguccuuugaauuuc

SEQ ID NO: 675787 - RNA, 22 nt, Human
uggcauguugagaggcaagauu

SEQ ID NO: 675788 - RNA, 22 nt, Human
auuaaauuaaguggcuaauuua

SEQ ID NO: 675789 - RNA, 22 nt, Human
uguuaaaaccacaggugaggac

SEQ ID NO: 675790 - RNA, 22 nt, Human
cuggucuguccgcaggucaccu

SEQ ID NO: 675791 - RNA, 22 nt, Human
gggcucagcuccuuccuuccua

SEQ ID NO: 675792 - RNA, 22 nt, Human
agggagugguuaagaaggugca

SEQ ID NO: 675793 - RNA, 22 nt, Human
uuuaaagugcugcuccuauccu

SEQ ID NO: 675794 - RNA, 22 nt, Human
uugcauuguugcaaugaaguau

SEQ ID NO: 675795 - RNA, 21 nt, Human
uccagaccucccucuccuagc

SEQ ID NO: 675796 - RNA, 22 nt, Human
ucucuuggugacuuaaaauguu

SEQ ID NO: 675797 - RNA, 22 nt, Human
cacaugcuucuuuugauuauga

SEQ ID NO: 675798 - RNA, 22 nt, Human
ggggaggaguguacagguuuau

SEQ ID NO: 675799 - RNA, 22 nt, Human
ugaaaaugcacgcuggaaagca

SEQ ID NO: 675800 - RNA, 22 nt, Human
cuuagaugaagucacagaaccc

SEQ ID NO: 675801 - RNA, 22 nt, Human
aagagucccaaaaugauucuua

SEQ ID NO: 675802 - RNA, 22 nt, Human
aagcuguucucuaaguuucaug

SEQ ID NO: 675803 - RNA, 22 nt, Human
caguuuugguccuuucuaggua

SEQ ID NO: 675804 - RNA, 22 nt, Human
gaaaguauuagccuagaaguca

SEQ ID NO: 675805 - RNA, 22 nt, Human
agggcacccucucugcaguacc

SEQ ID NO: 675806 - RNA, 20 nt, Human
uccagggcccuggcuccucu

SEQ ID NO: 675807 - RNA, 19 nt, Human
agaggcugucaccuguagc

SEQ ID NO: 675808 - RNA, 22 nt, Human
uucuacagugacugcagccaua

SEQ ID NO: 675809 - RNA, 22 nt, Human
aauuuaacugagaguacuuuua

SEQ ID NO: 675810 - RNA, 22 nt, Human
uguguuugaggcauguugcaga

SEQ ID NO: 675811 - RNA, 22 nt, Human
uguggaggauucugaugccagc

SEQ ID NO: 675812 - RNA, 22 nt, Human
cagaaauguacugacaugcagu

SEQ ID NO: 675813 - RNA, 22 nt, Human
uuagugugcauggaucugugga

SEQ ID NO: 675814 - RNA, 22 nt, Human
ugggguggaacccuucugcugg

SEQ ID NO: 675815 - RNA, 23 nt, Human
aggagacagggaagugccuggcu

SEQ ID NO: 675816 - RNA, 22 nt, Human
uggcagaguucgcuccuauuca

SEQ ID NO: 675817 - RNA, 22 nt, Human
uaaugucuuaguaccuuaauuu

SEQ ID NO: 675818 - RNA, 22 nt, Human
aagacuguaugagacaauauaa

SEQ ID NO: 675819 - RNA, 22 nt, Human
uucagggagagcgggacgggug

SEQ ID NO: 675820 - RNA, 22 nt, Human
ucaggcuguggcuuugaccgca

SEQ ID NO: 675821 - RNA, 22 nt, Human
gggucucucaugcaguugcugu

SEQ ID NO: 675822 - RNA, 22 nt, Human
ccuuuucuauccuucuagguuc

SEQ ID NO: 675823 - RNA, 22 nt, Human
aagaugcuugcaaauuucugaa

SEQ ID NO: 675824 - RNA, 22 nt, Human
gcucugucaacagcuagcugug

SEQ ID NO: 675825 - RNA, 22 nt, Human
acaguguggugauggcacuugc

SEQ ID NO: 675826 - RNA, 22 nt, Human
aauucauuaagaaagagcuaaa

SEQ ID NO: 675827 - RNA, 22 nt, Human
uuuuucuugugcuggaucuaau

SEQ ID NO: 675828 - RNA, 22 nt, Human
agcaaauacuuuucacugagcc

SEQ ID NO: 675829 - RNA, 22 nt, Human
uaguaugggaagaacuuuguag

SEQ ID NO: 675830 - RNA, 22 nt, Human
gcaagcagcccagaacagcucu

SEQ ID NO: 675831 - RNA, 19 nt, Human
agaauuguuuugagacccc

SEQ ID NO: 675832 - RNA, 22 nt, Human
cuuuguuuauauuucuccucga

SEQ ID NO: 675833 - RNA, 22 nt, Human
aacacauuuugccuaggcaaua

SEQ ID NO: 675834 - RNA, 22 nt, Human
cuuggcagcuuuuggaggagcc

SEQ ID NO: 675835 - RNA, 22 nt, Human
gggaguggguuuggccuaggcc

SEQ ID NO: 675836 - RNA, 22 nt, Human
gcagcagcccagggcucucaga

SEQ ID NO: 675837 - RNA, 21 nt, Human
ugcagccucugcccagcagug

SEQ ID NO: 675838 - RNA, 22 nt, Human
gaagaacugugacagaagcagu

SEQ ID NO: 675839 - RNA, 22 nt, Human
auucuuuaguuggcuucuugcc

SEQ ID NO: 675840 - RNA, 22 nt, Human
aauaaccuuacuuauuacaugg

SEQ ID NO: 675841 - RNA, 22 nt, Human
uucaaauuaccacauuugcuua

SEQ ID NO: 675842 - RNA, 22 nt, Human
acaccuuugugaagugaugaug

SEQ ID NO: 675843 - RNA, 22 nt, Human
uuugucuuaaaucuuguuacug

SEQ ID NO: 675844 - RNA, 22 nt, Human
ugcuugaaagggguuucccagu

SEQ ID NO: 675845 - RNA, 22 nt, Human
agcccugcacaguucgggagga

SEQ ID NO: 675846 - RNA, 22 nt, Human
caugagaucugcagggaugggc

SEQ ID NO: 675847 - RNA, 22 nt, Human
ggccuuggccuagcccuccagg

SEQ ID NO: 675848 - RNA, 23 nt, Human
cacaggcagaaaucaagacggua

SEQ ID NO: 675849 - RNA, 19 nt, Human
ugaguuuaaugcaaaacug

SEQ ID NO: 675850 - RNA, 22 nt, Human
ucaggaaagccuagaagagaac

SEQ ID NO: 675851 - RNA, 22 nt, Human
acccaggacaaaauaaccaggu

SEQ ID NO: 675852 - RNA, 22 nt, Human
uuccacucaugcaaagguccca

SEQ ID NO: 675853 - RNA, 22 nt, Human
gccagccuucuguggccugcaa

SEQ ID NO: 675854 - RNA, 22 nt, Human
gauuucuaaggaggcugaacuu

SEQ ID NO: 675855 - RNA, 22 nt, Human
uccaguacaggucucucauuuc

SEQ ID NO: 675856 - RNA, 22 nt, Human
ccugcuguaaugugucuuuauu

SEQ ID NO: 675857 - RNA, 22 nt, Human
ccucugcaccauagccuucagc

SEQ ID NO: 675858 - RNA, 22 nt, Human
gacaggccaggggcugaggugg

SEQ ID NO: 675859 - RNA, 22 nt, Human
ugguggcaauguccuggagaag

SEQ ID NO: 675860 - RNA, 20 nt, Human
gucaagucccuggggcagcu

SEQ ID NO: 675861 - RNA, 22 nt, Human
agcugaaguucaguccagagaa

SEQ ID NO: 675862 - RNA, 18 nt, Human
uguagcuggaggccaggc

SEQ ID NO: 675863 - RNA, 22 nt, Human
agcuccugcgcacggugcacac

SEQ ID NO: 675864 - RNA, 23 nt, Human
cacauggaggaccguucuuauaa

SEQ ID NO: 675865 - RNA, 22 nt, Human
uauuacaguucgaguuucuagg

SEQ ID NO: 675866 - RNA, 19 nt, Human
ugccuguggcgagcaucuu

SEQ ID NO: 675867 - RNA, 22 nt, Human
guggcaggagacuggaagaugg

SEQ ID NO: 675868 - RNA, 22 nt, Human
acagcagaguugaguaguugca

SEQ ID NO: 675869 - RNA, 22 nt, Human
ugccgugcccauauugugggug

SEQ ID NO: 675870 - RNA, 22 nt, Human
gcaaguuauuuccauuuaaagc

SEQ ID NO: 675871 - RNA, 22 nt, Human
caaguuuaaggcacugauaagu

SEQ ID NO: 675872 - RNA, 22 nt, Human
acagggccucagcugauucugg

SEQ ID NO: 675873 - RNA, 22 nt, Human
agcugcucucacuggacgccug

SEQ ID NO: 675874 - RNA, 20 nt, Human
ccagaagguuugccacuuuc

SEQ ID NO: 675875 - RNA, 22 nt, Human
acagcaugagaguagcaaaagg

SEQ ID NO: 675876 - RNA, 22 nt, Human
cagggcugagaauuuagagaca

SEQ ID NO: 675877 - RNA, 22 nt, Human
agagcagcugcauucagcaccu

SEQ ID NO: 675878 - RNA, 22 nt, Human
acugaacacuuuugaaagauua

SEQ ID NO: 675879 - RNA, 18 nt, Human
gcagcugcaguuguagcu

SEQ ID NO: 675880 - RNA, 22 nt, Human
uuuucauuguuccucgagcauu

SEQ ID NO: 675881 - RNA, 22 nt, Human
gagauuuauugacuuaacagua

SEQ ID NO: 675882 - RNA, 22 nt, Human
agaggggaguccuaaucugauu

SEQ ID NO: 675883 - RNA, 19 nt, Human
cgcucuggguuucguguca

SEQ ID NO: 675884 - RNA, 22 nt, Human
aggaggaauacaauccagcagc

SEQ ID NO: 675885 - RNA, 19 nt, Human
caguuuaugcuuuggggac

SEQ ID NO: 675886 - RNA, 22 nt, Human
aaagugcaguaacuugcccaag

SEQ ID NO: 675887 - RNA, 22 nt, Human
ugacacugcauauauugaaguu

SEQ ID NO: 675888 - RNA, 18 nt, Human
ggcucaggcuauccuaac

SEQ ID NO: 675889 - RNA, 22 nt, Human
aagagauguugaaguuuauuag

SEQ ID NO: 675890 - RNA, 22 nt, Human
ucucugggccuguuuucucauc

SEQ ID NO: 675891 - RNA, 22 nt, Human
uggauugauaagagacaaguga

SEQ ID NO: 675892 - RNA, 22 nt, Human
auagcacugguuuuucuugguu

SEQ ID NO: 675893 - RNA, 22 nt, Human
cccugcccuggagacacuuaaa

SEQ ID NO: 675894 - RNA, 22 nt, Human
ugucucuuggagggucuaguga

SEQ ID NO: 675895 - RNA, 22 nt, Human
agagcuauaacagcacuguaca

SEQ ID NO: 675896 - RNA, 22 nt, Human
agaaugugugauugaagcucuu

SEQ ID NO: 675897 - RNA, 22 nt, Human
gacagacaggaggcauucaggg

SEQ ID NO: 675898 - RNA, 22 nt, Human
ggagucccagcaaagccuuccc

SEQ ID NO: 675899 - RNA, 22 nt, Human
aacuucaagcuucgucccuucg

SEQ ID NO: 675900 - RNA, 22 nt, Human
auacagaugagaucaggcauaa

SEQ ID NO: 675901 - RNA, 20 nt, Human
gggaugagaguccuagcucu

SEQ ID NO: 675902 - RNA, 17 nt, Human
gagcagggaugcgguuc

SEQ ID NO: 675903 - RNA, 22 nt, Human
aaaugucuacuccuguguuuau

SEQ ID NO: 675904 - RNA, 22 nt, Human
caaagagcuguucagugucgcu

SEQ ID NO: 675905 - RNA, 22 nt, Human
uugggguacgcaggucugggag

SEQ ID NO: 675906 - RNA, 23 nt, Human
agugaauucaguuuaaaacagag

SEQ ID NO: 675907 - RNA, 22 nt, Human
cagaagcacuaggaggaaacgu

SEQ ID NO: 675908 - RNA, 22 nt, Human
ggcuucucccuucuucugauug

SEQ ID NO: 675909 - RNA, 22 nt, Human
gcugcuggggucacaugguaag

SEQ ID NO: 675910 - RNA, 23 nt, Human
aaguacauauauuuagauaguga

SEQ ID NO: 675911 - RNA, 20 nt, Human
uccaccaggaaggguaggga

SEQ ID NO: 675912 - RNA, 22 nt, Human
cagcuucugucugauuagcaag

SEQ ID NO: 675913 - RNA, 22 nt, Human
uaggaaagaaaugaguagugau

SEQ ID NO: 675914 - RNA, 22 nt, Human
uggaacaagaagcaggucgcuu

SEQ ID NO: 675915 - RNA, 22 nt, Human
agccaggaagagaggccucacc

SEQ ID NO: 675916 - RNA, 22 nt, Human
agcugugguucugggcagcgac

SEQ ID NO: 675917 - RNA, 22 nt, Human
uuauguguguacaugcauaugu

SEQ ID NO: 675918 - RNA, 19 nt, Human
cucuccaccuaacagguau

SEQ ID NO: 675919 - RNA, 22 nt, Human
caggcaccccaggugagcacug

SEQ ID NO: 675920 - RNA, 22 nt, Human
gagcugcagaguaaccuuugca

SEQ ID NO: 675921 - RNA, 22 nt, Human
caccauaaccaacaugucaguu

SEQ ID NO: 675922 - RNA, 22 nt, Human
uuucacagaaagaagcuaguuu

SEQ ID NO: 675923 - RNA, 22 nt, Human
agaucuuuaaaaguuauuauua

SEQ ID NO: 675924 - RNA, 21 nt, Human
cagugaggcccuccuguuccc

SEQ ID NO: 675925 - RNA, 22 nt, Human
gcucagaagauauuugaugcug

SEQ ID NO: 675926 - RNA, 22 nt, Human
cucugugguuagacuauggcug

SEQ ID NO: 675927 - RNA, 22 nt, Human
gccaggcugcuccagggaggcc

SEQ ID NO: 675928 - RNA, 22 nt, Human
uaggacagagcugguuacaaug

SEQ ID NO: 675929 - RNA, 22 nt, Human
augggcagcagcugccauucau

SEQ ID NO: 675930 - RNA, 22 nt, Human
ucccuuggaaaguagccucaca

SEQ ID NO: 675931 - RNA, 21 nt, Human
agaggaagaagaguguauuau

SEQ ID NO: 675932 - RNA, 22 nt, Human
uauagcaauucagaauacaugu

SEQ ID NO: 675933 - RNA, 22 nt, Human
aaauggcuacaagaugugcucu

SEQ ID NO: 675934 - RNA, 18 nt, Human
ucuagaaacccagacucu

SEQ ID NO: 675935 - RNA, 22 nt, Human
ucugugugcccaccugacaccu

SEQ ID NO: 675936 - RNA, 22 nt, Human
acaagagauuaucuacagauga

SEQ ID NO: 675937 - RNA, 21 nt, Human
aguggcugucaagggggccuu

SEQ ID NO: 675938 - RNA, 22 nt, Human
agaacagaugugggcagaccug

SEQ ID NO: 675939 - RNA, 23 nt, Human
agcaggaaaccgagggugauguu

SEQ ID NO: 675940 - RNA, 22 nt, Human
gucccucugggccaucaggucc

SEQ ID NO: 675941 - RNA, 22 nt, Human
cuggccagaguuggagggugug

SEQ ID NO: 675942 - RNA, 22 nt, Human
aucucuccuuaugaagcauuau

SEQ ID NO: 675943 - RNA, 22 nt, Human
uuaaauugucauuugagcaaug

SEQ ID NO: 675944 - RNA, 22 nt, Human
aaaaacacugggcugggaguca

SEQ ID NO: 675945 - RNA, 19 nt, Human
gaauuuuaggacuucagca

SEQ ID NO: 675946 - RNA, 22 nt, Human
gucuucugaucugguuagccau

SEQ ID NO: 675947 - RNA, 22 nt, Human
auaaaaucuuuaugugcucugc

SEQ ID NO: 675948 - RNA, 22 nt, Human
aggcuucaagguucuuggcagg

SEQ ID NO: 675949 - RNA, 22 nt, Human
caaugaaaauuuaaguugcagc

SEQ ID NO: 675950 - RNA, 22 nt, Human
gcacagagucacuagcuaagca

SEQ ID NO: 675951 - RNA, 22 nt, Human
ugcuuaauagugcacugguuuc

SEQ ID NO: 675952 - RNA, 22 nt, Human
cacagagauggccagggcacau

SEQ ID NO: 675953 - RNA, 22 nt, Human
cuucuugggcugccaguuucag

SEQ ID NO: 675954 - RNA, 22 nt, Human
cuauucaguugugggcaacaau

SEQ ID NO: 675955 - RNA, 22 nt, Human
auacauguucguguacauguuc

SEQ ID NO: 675956 - RNA, 22 nt, Human
ucaacaauaggauauagcaggu

SEQ ID NO: 675957 - RNA, 22 nt, Human
ucuguguauuugugaccuguau

SEQ ID NO: 675958 - RNA, 22 nt, Human
gggagggcuuggacccagaugu

SEQ ID NO: 675959 - RNA, 22 nt, Human
ucagcuuucucucgccaucagg

SEQ ID NO: 675960 - RNA, 22 nt, Human
ggcccaguguugccagaccuga

SEQ ID NO: 675961 - RNA, 22 nt, Human
ucccagcccagauuugugugac

SEQ ID NO: 675962 - RNA, 22 nt, Human
aucccucucugcaugacugugu

SEQ ID NO: 675963 - RNA, 22 nt, Human
uguucuaagcugccaaaaugcu

SEQ ID NO: 675964 - RNA, 22 nt, Human
ccaugggcacuggguggaggua

SEQ ID NO: 675965 - RNA, 22 nt, Human
agcagggaauagcggaaagaau

SEQ ID NO: 675966 - RNA, 22 nt, Human
aggugucugugaugggagcgau

SEQ ID NO: 675967 - RNA, 22 nt, Human
agagaaaguaaagauucuaccu

SEQ ID NO: 675968 - RNA, 22 nt, Human
uugcuuuagaaucugcuucugg

SEQ ID NO: 675969 - RNA, 22 nt, Human
cuaauacacccuauugcuuguu

SEQ ID NO: 675970 - RNA, 23 nt, Human
auccagccuggggguuuaaccac

SEQ ID NO: 675971 - RNA, 17 nt, Human
ucuacuccugaaggaag

SEQ ID NO: 675972 - RNA, 21 nt, Human
gcuucagcaaggcuugcuggu

SEQ ID NO: 675973 - RNA, 22 nt, Human
ugguaaagaaggcuagaucuga

SEQ ID NO: 675974 - RNA, 22 nt, Human
uucaugugaauauauuugucuu

SEQ ID NO: 675975 - RNA, 22 nt, Human
ucagagguuacccaugggacag

SEQ ID NO: 675976 - RNA, 22 nt, Human
ucaaagaagauuacccucccau

SEQ ID NO: 675977 - RNA, 22 nt, Human
auggcagaaagaauagaggcua

SEQ ID NO: 675978 - RNA, 21 nt, Human
aggucccagguuugggcagca

SEQ ID NO: 675979 - RNA, 22 nt, Human
ucugguggugggccacaagcau

SEQ ID NO: 675980 - RNA, 22 nt, Human
gcuucagcuuugucuccuuggg

SEQ ID NO: 675981 - RNA, 22 nt, Human
uggcuggggccacaguuuuccu

SEQ ID NO: 675982 - RNA, 22 nt, Human
ugcacacagccagugaguggca

SEQ ID NO: 675983 - RNA, 20 nt, Human
agagagcacaggcaggaaag

SEQ ID NO: 675984 - RNA, 20 nt, Human
cauuugggaucaugagguuu

SEQ ID NO: 675985 - RNA, 22 nt, Human
uucuaacuuaacacuccuguga

SEQ ID NO: 675986 - RNA, 22 nt, Human
ugcauguggaucauauguccua

SEQ ID NO: 675987 - RNA, 18 nt, Human
auacagagaccucaagga

SEQ ID NO: 675988 - RNA, 18 nt, Human
ucucagaggccauccuag

SEQ ID NO: 675989 - RNA, 23 nt, Human
uucaugagauuaucugcaugugu

SEQ ID NO: 675990 - RNA, 22 nt, Human
ucugaagaggcucuugauaaga

SEQ ID NO: 675991 - RNA, 22 nt, Human
uagagguguuguugauauagaa

SEQ ID NO: 675992 - RNA, 22 nt, Human
uuacuggcugggccugagggcu

SEQ ID NO: 675993 - RNA, 22 nt, Human
uggggcagaguaggauuuuggc

SEQ ID NO: 675994 - RNA, 22 nt, Human
uaaagcauguacugugugcuag

SEQ ID NO: 675995 - RNA, 22 nt, Human
cacaguuuugcccagggcuucu

SEQ ID NO: 675996 - RNA, 22 nt, Human
ggacuggacucucaggcucaca

SEQ ID NO: 675997 - RNA, 22 nt, Human
augugcguguguacauauauau

SEQ ID NO: 675998 - RNA, 22 nt, Human
aguaaaaauaugcuuguggcua

SEQ ID NO: 675999 - RNA, 22 nt, Human
uccauccacccugcauuauauu

SEQ ID NO: 676000 - RNA, 22 nt, Human
uggccaggccggggacagaacu

SEQ ID NO: 676001 - RNA, 22 nt, Human
gcuuuagaagacacucuguuuu

SEQ ID NO: 676002 - RNA, 22 nt, Human
agcaagcacacuucaugugaac

SEQ ID NO: 676003 - RNA, 22 nt, Human
cugcuuugaaaauaaacuuguc

SEQ ID NO: 676004 - RNA, 22 nt, Human
gaaacuuuggcuaaaagccaga

SEQ ID NO: 676005 - RNA, 22 nt, Human
ucagccaguugccccaguuagu

SEQ ID NO: 676006 - RNA, 23 nt, Human
gaagccacacaaaggucgccaag

SEQ ID NO: 676007 - RNA, 22 nt, Human
cuaugaccccagcaugaauaag

SEQ ID NO: 676008 - RNA, 22 nt, Human
auucuuuggacaauaaguggug

SEQ ID NO: 676009 - RNA, 22 nt, Human
cagggucccaggagcugcuuuc

SEQ ID NO: 676010 - RNA, 22 nt, Human
gcaggagcccuggcauguucuu

SEQ ID NO: 676011 - RNA, 22 nt, Human
agucuucucauuucacaugcuu

SEQ ID NO: 676012 - RNA, 22 nt, Human
uccagugguacauggagacacu

SEQ ID NO: 676013 - RNA, 22 nt, Human
acugggaaagugcugccugcag

SEQ ID NO: 676014 - RNA, 22 nt, Human
caguacuuugaagauauuuuag

SEQ ID NO: 676015 - RNA, 22 nt, Human
guucucaguucaggaaggacau

SEQ ID NO: 676016 - RNA, 22 nt, Human
uauuugucacugcacuugaaau

SEQ ID NO: 676017 - RNA, 22 nt, Human
cuagggagcacuagcugccuug

SEQ ID NO: 676018 - RNA, 22 nt, Human
guggccagcugucagcacccuu

SEQ ID NO: 676019 - RNA, 22 nt, Human
ucuugaauaaguuucaugagcu

SEQ ID NO: 676020 - RNA, 22 nt, Human
auugagaaaauaaguauggaua

SEQ ID NO: 676021 - RNA, 22 nt, Human
ggacacuggccacauuucaaaa

SEQ ID NO: 676022 - RNA, 22 nt, Human
cacacuuuguugaaguuuucau

SEQ ID NO: 676023 - RNA, 22 nt, Human
gcugaggaagucagguggccca

SEQ ID NO: 676024 - RNA, 22 nt, Human
agacagugauggacaggcagac

SEQ ID NO: 676025 - RNA, 20 nt, Human
agcuguuuacauggauuucu

SEQ ID NO: 676026 - RNA, 20 nt, Human
accagaggaaagagcaguga

SEQ ID NO: 676027 - RNA, 22 nt, Human
cacagagagcuacgugcagcgu

SEQ ID NO: 676028 - RNA, 22 nt, Human
aggcacugugcagucccaagca

SEQ ID NO: 676029 - RNA, 22 nt, Human
agcaacauauaucaaugccuga

SEQ ID NO: 676030 - RNA, 22 nt, Human
uauauuuaaauccagguugaaa

SEQ ID NO: 676031 - RNA, 22 nt, Human
uaauuagaguuugguaaacaau

SEQ ID NO: 676032 - RNA, 20 nt, Human
agaagcaucauucugauguc

SEQ ID NO: 676033 - RNA, 20 nt, Human
ucuuccagguacagucugca

SEQ ID NO: 676034 - RNA, 22 nt, Human
ggaaaugacuuggugcuucguu

SEQ ID NO: 676035 - RNA, 22 nt, Human
ggucagaaggauucugggaaau

SEQ ID NO: 676036 - RNA, 22 nt, Human
ccuucagaccuagacaggaauc

SEQ ID NO: 676037 - RNA, 22 nt, Human
acugccuguuuggcauggcccc

SEQ ID NO: 676038 - RNA, 22 nt, Human
uucuggaguauuccuggcaccu

SEQ ID NO: 676039 - RNA, 22 nt, Human
accauugccuagaaaaauuccu

SEQ ID NO: 676040 - RNA, 22 nt, Human
uucagcuugcugacugcggcag

SEQ ID NO: 676041 - RNA, 22 nt, Human
ugcauguggaccccuggugccu

SEQ ID NO: 676042 - RNA, 22 nt, Human
acagaauacucauaagaagggg

SEQ ID NO: 676043 - RNA, 22 nt, Human
agguauggcauaaaucacaggg

SEQ ID NO: 676044 - RNA, 20 nt, Human
augauuuugcacuaacuuca

SEQ ID NO: 676045 - RNA, 22 nt, Human
caggagcaaggagcagugggau

SEQ ID NO: 676046 - RNA, 22 nt, Human
cuacagaggacacaaagaucuu

SEQ ID NO: 676047 - RNA, 22 nt, Human
uggagcaggacugcugcccuca

SEQ ID NO: 676048 - RNA, 22 nt, Human
uacaacaauuuccacauuagaa

SEQ ID NO: 676049 - RNA, 19 nt, Human
caucacauggucugaugaa

SEQ ID NO: 676050 - RNA, 22 nt, Human
ucagggagagccugucugacgu

SEQ ID NO: 676051 - RNA, 22 nt, Human
ggcucuggugggaagguuagau

SEQ ID NO: 676052 - RNA, 22 nt, Human
aaagcaguaguuuucaaauagu

SEQ ID NO: 676053 - RNA, 22 nt, Human
cugggccuugccaggggugucu

SEQ ID NO: 676054 - RNA, 22 nt, Human
gucagugucuuaacagagauua

SEQ ID NO: 676055 - RNA, 22 nt, Human
gccugggauucccagaggggca

SEQ ID NO: 676056 - RNA, 18 nt, Human
acauuucucucugcguga

SEQ ID NO: 676057 - RNA, 22 nt, Human
ucuacauuuucacaaggucucc

SEQ ID NO: 676058 - RNA, 22 nt, Human
uucagcaugaaaggauuugagu

SEQ ID NO: 676059 - RNA, 22 nt, Human
gcauggcuuccaaaagugcuaa

SEQ ID NO: 676060 - RNA, 21 nt, Human
ccagacuggccuaugugguag

SEQ ID NO: 676061 - RNA, 22 nt, Human
uuugcuucacaaguaugguucu

SEQ ID NO: 676062 - RNA, 22 nt, Human
uuucagauuaucucaacuuugg

SEQ ID NO: 676063 - RNA, 22 nt, Human
gagaaagcuucagaaauggccu

SEQ ID NO: 676064 - RNA, 22 nt, Human
uuuaaauguguucuuaguagcu

SEQ ID NO: 676065 - RNA, 22 nt, Human
aucuuacacgauaacuguuagu

SEQ ID NO: 676066 - RNA, 20 nt, Human
aggcugagggugauuguguc

SEQ ID NO: 676067 - RNA, 16 nt, Human
uaugugugugggagug

SEQ ID NO: 676068 - RNA, 22 nt, Human
uuuagaguaaaaacugugaccu

SEQ ID NO: 676069 - RNA, 22 nt, Human
augcugaggacaaagagaucaa

SEQ ID NO: 676070 - RNA, 22 nt, Human
uacugugugauuccauuuacgu

SEQ ID NO: 676071 - RNA, 22 nt, Human
ggcugccugggagcccuccucu

SEQ ID NO: 676072 - RNA, 22 nt, Human
uuaaacugcagacucaguguuc

SEQ ID NO: 676073 - RNA, 22 nt, Human
aggaaagacuggggccccagaa

SEQ ID NO: 676074 - RNA, 22 nt, Human
ucugccugagaaguggggugcc

SEQ ID NO: 676075 - RNA, 22 nt, Human
caucucuccacggcagcucucg

SEQ ID NO: 676076 - RNA, 22 nt, Human
caugcaguugaagcacagagag

SEQ ID NO: 676077 - RNA, 22 nt, Human
acccucugccuugagcagugcc

SEQ ID NO: 676078 - RNA, 22 nt, Human
ugugaaaugcuauugugacaaa

SEQ ID NO: 676079 - RNA, 22 nt, Human
aaagguuaguucuuagaagugc

SEQ ID NO: 676080 - RNA, 20 nt, Human
agagcugggaagcucccuau

SEQ ID NO: 676081 - RNA, 22 nt, Human
ccuugcguuuuacagcuucuag

SEQ ID NO: 676082 - RNA, 22 nt, Human
agaaauagucacauuggaggaa

SEQ ID NO: 676083 - RNA, 22 nt, Human
ccugggcuugguuguugagaac

SEQ ID NO: 676084 - RNA, 22 nt, Human
gugggcagcaccagggaagugu

SEQ ID NO: 676085 - RNA, 22 nt, Human
ugucacuucaggaaugcaggga

SEQ ID NO: 676086 - RNA, 22 nt, Human
uauuaugagccaggugcugucu

SEQ ID NO: 676087 - RNA, 22 nt, Human
ucucuuaaauacuucacaucuc

SEQ ID NO: 676088 - RNA, 22 nt, Human
uaacuuuuacauuuggcucacu

SEQ ID NO: 676089 - RNA, 22 nt, Human
uuagggaaagcagcauucccuu

SEQ ID NO: 676090 - RNA, 22 nt, Human
cacauuucuaggaaauuaaaug

SEQ ID NO: 676091 - RNA, 22 nt, Human
cagaaaauaaaguuucuacgca

SEQ ID NO: 676092 - RNA, 22 nt, Human
aucagugcuucauagcccuggu

SEQ ID NO: 676093 - RNA, 22 nt, Human
ucccuuaaaacucauguguugu

SEQ ID NO: 676094 - RNA, 22 nt, Human
gaagaugugggaacugcugaaa

SEQ ID NO: 676095 - RNA, 17 nt, Human
uguuugguugauuggug

SEQ ID NO: 676096 - RNA, 22 nt, Human
auacuguacgucccagauagga

SEQ ID NO: 676097 - RNA, 22 nt, Human
aggucugauauuuguuguauga

SEQ ID NO: 676098 - RNA, 22 nt, Human
agcauauugucuuuggugucuc

SEQ ID NO: 676099 - RNA, 22 nt, Human
acugaaauacugcucuuggauu

SEQ ID NO: 676100 - RNA, 22 nt, Human
caguccaggccuggaggagcca

SEQ ID NO: 676101 - RNA, 22 nt, Human
guuucuuaauagcaggggccaa

SEQ ID NO: 676102 - RNA, 22 nt, Human
ugagcagaggccagcaccuggg

SEQ ID NO: 676103 - RNA, 22 nt, Human
gcugccuggcugaugaaaauuc

SEQ ID NO: 676104 - RNA, 22 nt, Human
aacacuuucuauuauuaugguu

SEQ ID NO: 676105 - RNA, 22 nt, Human
aauggcuucugaagcacacuuu

SEQ ID NO: 676106 - RNA, 22 nt, Human
aagggggcggcagccaguggaa

SEQ ID NO: 676107 - RNA, 22 nt, Human
ucagacagucaucagagcuugu

SEQ ID NO: 676108 - RNA, 19 nt, Human
cugggaguucacugcugcc

SEQ ID NO: 676109 - RNA, 23 nt, Human
ugacagagcaagacuuggucuca

SEQ ID NO: 676110 - RNA, 19 nt, Human
agcuggggcgguguguguu

SEQ ID NO: 676111 - RNA, 22 nt, Human
ugucuucagcagucaucugggg

SEQ ID NO: 676112 - RNA, 19 nt, Human
cagcccucuuaccacugug

SEQ ID NO: 676113 - RNA, 22 nt, Human
uggcagcacuagguacugagcu

SEQ ID NO: 676114 - RNA, 22 nt, Human
ucugaauuuuaacuacacaaag

SEQ ID NO: 676115 - RNA, 22 nt, Human
uauagcaacuccaaagagacuu

SEQ ID NO: 676116 - RNA, 22 nt, Human
gcaggcugauagaggauuccau

SEQ ID NO: 676117 - RNA, 22 nt, Human
cuucuuaaagauuacacaauga

SEQ ID NO: 676118 - RNA, 22 nt, Human
caggagacaauggcuguggggc

SEQ ID NO: 676119 - RNA, 22 nt, Human
aagcauuugugaaauucagaug

SEQ ID NO: 676120 - RNA, 22 nt, Human
uguuacagucauuguuuucuga

SEQ ID NO: 676121 - RNA, 22 nt, Human
uuacagagcuggguggagagag

SEQ ID NO: 676122 - RNA, 22 nt, Human
ugcagguucugaccagccaacu

SEQ ID NO: 676123 - RNA, 22 nt, Human
uuucagacauagccugauucug

SEQ ID NO: 676124 - RNA, 22 nt, Human
gcacugaacuuuaaucauuucu

SEQ ID NO: 676125 - RNA, 22 nt, Human
ccucccuuuuggugucugcaua

SEQ ID NO: 676126 - RNA, 23 nt, Human
ugcugcccacucuuccagcccuc

SEQ ID NO: 676127 - RNA, 22 nt, Human
ugcaccccauuuuacauuuaca

SEQ ID NO: 676128 - RNA, 22 nt, Human
cagaagcaaguagugauucuuu

SEQ ID NO: 676129 - RNA, 22 nt, Human
cugagagguaaucacacaaaau

SEQ ID NO: 676130 - RNA, 21 nt, Human
uucuucaaagaagaaggcaca

SEQ ID NO: 676131 - RNA, 19 nt, Human
acccucucuguagaaagau

SEQ ID NO: 676132 - RNA, 22 nt, Human
uuccuuaaugaaucaggccauu

SEQ ID NO: 676133 - RNA, 22 nt, Human
aaaggagaaaacauacaggacu

SEQ ID NO: 676134 - RNA, 22 nt, Human
cacacauugaauucauucuugu

SEQ ID NO: 676135 - RNA, 22 nt, Human
caaagaauagugagaagaugua

SEQ ID NO: 676136 - RNA, 17 nt, Human
ugauaguucauuuuaag

SEQ ID NO: 676137 - RNA, 22 nt, Human
ucauggauggccgggaggugau

SEQ ID NO: 676138 - RNA, 22 nt, Human
ggacacuguucauggggagggg

SEQ ID NO: 676139 - RNA, 22 nt, Human
aaagagccgcugaugucagccc

SEQ ID NO: 676140 - RNA, 22 nt, Human
uggaaauacuugccauaaaacu

SEQ ID NO: 676141 - RNA, 22 nt, Human
ggaaauauuuugucuaauuugu

SEQ ID NO: 676142 - RNA, 22 nt, Human
gggcagugucggggcccaggga

SEQ ID NO: 676143 - RNA, 22 nt, Human
ugacagucugcaguuuuaaaaa

SEQ ID NO: 676144 - RNA, 22 nt, Human
uccugggaagagaccugagcau

SEQ ID NO: 676145 - RNA, 22 nt, Human
uucuccaggggaggguucucca

SEQ ID NO: 676146 - RNA, 22 nt, Human
uugcauuuugguuguaaauaug

SEQ ID NO: 676147 - RNA, 22 nt, Human
aaggcagauauaaagacuagag

SEQ ID NO: 676148 - RNA, 22 nt, Human
aaauuugauaagccauuguuac

SEQ ID NO: 676149 - RNA, 22 nt, Human
uagggagaaacaccaauuuauu

SEQ ID NO: 676150 - RNA, 22 nt, Human
gccccugggagcagagccacca

SEQ ID NO: 676151 - RNA, 22 nt, Human
cagagcugacccaaggauugaa

SEQ ID NO: 676152 - RNA, 22 nt, Human
cagagggaucaucuuccugaag

SEQ ID NO: 676153 - RNA, 22 nt, Human
gagauuuucagcuugacuggga

SEQ ID NO: 676154 - RNA, 22 nt, Human
cccuggugguacggcacuggca

SEQ ID NO: 676155 - RNA, 22 nt, Human
cugaaguuaguuaugccuaaaa

SEQ ID NO: 676156 - RNA, 22 nt, Human
gggaagcaggugcagcucgccu

SEQ ID NO: 676157 - RNA, 22 nt, Human
aaagcuauucaacacgaacaug

SEQ ID NO: 676158 - RNA, 21 nt, Human
uugaaggaucacuucuguacc

SEQ ID NO: 676159 - RNA, 22 nt, Human
acaacugaugggucauguggga

SEQ ID NO: 676160 - RNA, 22 nt, Human
auccagcacuuguucaugugaa

SEQ ID NO: 676161 - RNA, 22 nt, Human
aggauucgggcauaaagccauu

SEQ ID NO: 676162 - RNA, 22 nt, Human
uuggacugagaguuccaccauu

SEQ ID NO: 676163 - RNA, 22 nt, Human
ugugucuguguauacacggcau

SEQ ID NO: 676164 - RNA, 22 nt, Human
cggggccuagucuaccucggca

SEQ ID NO: 676165 - RNA, 22 nt, Human
acagccauagaugcuuauguaa

SEQ ID NO: 676166 - RNA, 20 nt, Human
aguucacaggccaaauuucu

SEQ ID NO: 676167 - RNA, 22 nt, Human
uaagaaugacaaccauaccauu

SEQ ID NO: 676168 - RNA, 22 nt, Human
cacagaggacuguagcggggag

SEQ ID NO: 676169 - RNA, 22 nt, Human
gcuuucugugcagugaacacua

SEQ ID NO: 676170 - RNA, 22 nt, Human
ggaggccaaggcgggcggauca

SEQ ID NO: 676171 - RNA, 22 nt, Human
auugaauagaugcauuauacua

SEQ ID NO: 676172 - RNA, 22 nt, Human
cuguggaguccuggggaaugga

SEQ ID NO: 676173 - RNA, 22 nt, Human
auacagcugccuucuaacuaug

SEQ ID NO: 676174 - RNA, 22 nt, Human
auguagagcaguguuguccaau

SEQ ID NO: 676175 - RNA, 22 nt, Human
ggccggggccuccccgcgucgc

SEQ ID NO: 676176 - RNA, 22 nt, Human
guccacagggauggccacacau

SEQ ID NO: 676177 - RNA, 18 nt, Human
ggcuccgacgggccgugc

SEQ ID NO: 676178 - RNA, 22 nt, Human
aaguauuucguucugaaaaagu

SEQ ID NO: 676179 - RNA, 22 nt, Human
gagagacugauguggcuaugua

SEQ ID NO: 676180 - RNA, 23 nt, Human
agguggccuuugccucuuucucu

SEQ ID NO: 676181 - RNA, 22 nt, Human
uacagacaguuuuucagauauu

SEQ ID NO: 676182 - RNA, 22 nt, Human
ucuucuggaugagagcggaggc

SEQ ID NO: 676183 - RNA, 22 nt, Human
ucugugcuagaggaguuggcca

SEQ ID NO: 676184 - RNA, 22 nt, Human
uuauacaggagauuccuuacuu

SEQ ID NO: 676185 - RNA, 22 nt, Human
agaggggagagcuaagcaauuc

SEQ ID NO: 676186 - RNA, 22 nt, Human
cauguauagcaaauauuuguuc

SEQ ID NO: 676187 - RNA, 20 nt, Human
aacacacugguggcaucagg

SEQ ID NO: 676188 - RNA, 23 nt, Human
uuacaacuauuugccauguuguu

SEQ ID NO: 676189 - RNA, 22 nt, Human
ccaggcccugccugugguuccu

SEQ ID NO: 676190 - RNA, 22 nt, Human
cuguguacccacgugggcaccc

SEQ ID NO: 676191 - RNA, 22 nt, Human
agcugagcauuugauccaccuc

SEQ ID NO: 676192 - RNA, 18 nt, Human
ugucaguaaagugacaga

SEQ ID NO: 676193 - RNA, 22 nt, Human
agacaagagcugaggacauauu

SEQ ID NO: 676194 - RNA, 22 nt, Human
aagcagaguccccuucccaugg

SEQ ID NO: 676195 - RNA, 22 nt, Human
ugggcucaggaccccagaggcc

SEQ ID NO: 676196 - RNA, 22 nt, Human
cuguuaucuguuauugccaguu

SEQ ID NO: 676197 - RNA, 22 nt, Human
ggcaggcacuguguuuuguguu

SEQ ID NO: 676198 - RNA, 23 nt, Human
cuggcucuguagguggcauccuu

SEQ ID NO: 676199 - RNA, 20 nt, Human
uaggacaggcagccgagggg

SEQ ID NO: 676200 - RNA, 22 nt, Human
aaagaagacagacauuucuuuc

SEQ ID NO: 676201 - RNA, 22 nt, Human
agugaaagguugagaauauucu

SEQ ID NO: 676202 - RNA, 22 nt, Human
gagguccaacacaauggguguu

SEQ ID NO: 676203 - RNA, 22 nt, Human
aaagacuuggcuuaugauuugc

SEQ ID NO: 676204 - RNA, 22 nt, Human
uggcaagaauauuggaccagaa

SEQ ID NO: 676205 - RNA, 22 nt, Human
aaagaguugaggcaguuaucca

SEQ ID NO: 676206 - RNA, 19 nt, Human
gauagcugaugaccaucau

SEQ ID NO: 676207 - RNA, 22 nt, Human
cagugguggaaugaggaauugu

SEQ ID NO: 676208 - RNA, 22 nt, Human
uggcagugcugcagugcccuua

SEQ ID NO: 676209 - RNA, 22 nt, Human
ucuuugaucagccuuucacuga

SEQ ID NO: 676210 - RNA, 22 nt, Human
ggcuucagaggggagguagugc

SEQ ID NO: 676211 - RNA, 18 nt, Human
ucccuggggcugccaccc

SEQ ID NO: 676212 - RNA, 22 nt, Human
ucagaacagcgagaauauucac

SEQ ID NO: 676213 - RNA, 22 nt, Human
ucagaggugcaagaaguucuga

SEQ ID NO: 676214 - RNA, 22 nt, Human
ccugguggccuucagcccacaa

SEQ ID NO: 676215 - RNA, 22 nt, Human
gacaugcaaugcagugguaagu

SEQ ID NO: 676216 - RNA, 18 nt, Human
aucugcuggcaggucugg

SEQ ID NO: 676217 - RNA, 23 nt, Human
uaauugcuugaguuaguaauaca

SEQ ID NO: 676218 - RNA, 22 nt, Human
agauguggcugcacccaccgcu

SEQ ID NO: 676219 - RNA, 22 nt, Human
auggaaugugaacaugauggca

SEQ ID NO: 676220 - RNA, 19 nt, Human
uggagggguuugaaugugg

SEQ ID NO: 676221 - RNA, 22 nt, Human
acaguguuguauuuaguuugau

SEQ ID NO: 676222 - RNA, 22 nt, Human
uugaaaacuuucuagaccaaga

SEQ ID NO: 676223 - RNA, 22 nt, Human
gagauguuuugcugagaauggg

SEQ ID NO: 676224 - RNA, 22 nt, Human
augucucugccccagagagcuu

SEQ ID NO: 676225 - RNA, 22 nt, Human
accacuggauaucagagaugua

SEQ ID NO: 676226 - RNA, 22 nt, Human
cuggcugugcuggaguugagga

SEQ ID NO: 676227 - RNA, 22 nt, Human
ucagcaaaauguggcuagugcu

SEQ ID NO: 676228 - RNA, 22 nt, Human
auucaguuuuuauuggaccagc

SEQ ID NO: 676229 - RNA, 22 nt, Human
cagcuguugcagcacugagaga

SEQ ID NO: 676230 - RNA, 22 nt, Human
aggggagcuaacaccagagccc

SEQ ID NO: 676231 - RNA, 22 nt, Human
aggaugagagauacauggagca

SEQ ID NO: 676232 - RNA, 22 nt, Human
cccagcaggugccaucacucug

SEQ ID NO: 676233 - RNA, 22 nt, Human
cuucucccuggcuucugcacac

SEQ ID NO: 676234 - RNA, 22 nt, Human
uaaggcaccuguccaggcuggg

SEQ ID NO: 676235 - RNA, 19 nt, Human
gcaggucauuaggcuaggu

SEQ ID NO: 676236 - RNA, 22 nt, Human
gguuuucaaagaggcauuucau

SEQ ID NO: 676237 - RNA, 22 nt, Human
aucuggcuauugacauguuaua

SEQ ID NO: 676238 - RNA, 22 nt, Human
augcauguuaagcucuuaaaau

SEQ ID NO: 676239 - RNA, 22 nt, Human
cuuugcaaacgauuaccacaug

SEQ ID NO: 676240 - RNA, 22 nt, Human
caugcucacaaaagauggcaaa

SEQ ID NO: 676241 - RNA, 22 nt, Human
aggcacaguggcucacaccugu

SEQ ID NO: 676242 - RNA, 22 nt, Human
ccaggcuucccugagaggcugc

SEQ ID NO: 676243 - RNA, 22 nt, Human
acacaugcauaagccuucccuu

SEQ ID NO: 676244 - RNA, 22 nt, Human
gaaaucugucuuuguuugaaua

SEQ ID NO: 676245 - RNA, 16 nt, Human
agccaggcugccucgg

SEQ ID NO: 676246 - RNA, 22 nt, Human
uuagagaaauucugguaaugua

SEQ ID NO: 676247 - RNA, 22 nt, Human
cugagcugguggaagcaugcag

SEQ ID NO: 676248 - RNA, 22 nt, Human
aaaaccacaguuacuuuugcac

SEQ ID NO: 676249 - RNA, 22 nt, Human
aaaggccaagcaugagguggac

SEQ ID NO: 676250 - RNA, 22 nt, Human
ccugaccuccaaguggcucugg

SEQ ID NO: 676251 - RNA, 22 nt, Human
aguguaagugaucauugauagu

SEQ ID NO: 676252 - RNA, 22 nt, Human
aguaccauuacucacuuauuuu

SEQ ID NO: 676253 - RNA, 22 nt, Human
ugagcugucuaugguccugucu

SEQ ID NO: 676254 - RNA, 22 nt, Human
cauuucaaugccuucaacauag

SEQ ID NO: 676255 - RNA, 22 nt, Human
uggucaguugugacuagaacac

SEQ ID NO: 676256 - RNA, 22 nt, Human
uacaguuucucauuaugcucuc

SEQ ID NO: 676257 - RNA, 22 nt, Human
uauaaaugccaggacuuuagau

SEQ ID NO: 676258 - RNA, 22 nt, Human
aggcagcagcuugcugguugcc

SEQ ID NO: 676259 - RNA, 22 nt, Human
gccauguuuugguaaauaccau

SEQ ID NO: 676260 - RNA, 22 nt, Human
uaaugccaauuuaaugauccau

SEQ ID NO: 676261 - RNA, 22 nt, Human
uggaggucugcaaggcgcugga

SEQ ID NO: 676262 - RNA, 22 nt, Human
uugaaauggaagugaaaauucu

SEQ ID NO: 676263 - RNA, 22 nt, Human
cauggcuuaccccaggagcagc

SEQ ID NO: 676264 - RNA, 22 nt, Human
cacaccagcauggucucagugu

SEQ ID NO: 676265 - RNA, 22 nt, Human
aggauucagaauguaugcagug

SEQ ID NO: 676266 - RNA, 22 nt, Human
ccuuugggguccugccugggcu

SEQ ID NO: 676267 - RNA, 15 nt, Human
ugcagagguaccugg

SEQ ID NO: 676268 - RNA, 22 nt, Human
cagcaagauuuuuaaagcaagg

SEQ ID NO: 676269 - RNA, 18 nt, Human
aagugacuggcaggccaa

SEQ ID NO: 676270 - RNA, 22 nt, Human
augaggcauagcagggaucgga

SEQ ID NO: 676271 - RNA, 22 nt, Human
aaggccagauucacuuuacaau

SEQ ID NO: 676272 - RNA, 22 nt, Human
uauguacaucuugagcaaugaa

SEQ ID NO: 676273 - RNA, 22 nt, Human
gguggcugaagcagucuucggg

SEQ ID NO: 676274 - RNA, 22 nt, Human
uaggaaauugccaauauaugac

SEQ ID NO: 676275 - RNA, 22 nt, Human
caggcacaagaucggcuagaua

SEQ ID NO: 676276 - RNA, 22 nt, Human
gccacugauuccaagucaauuu

SEQ ID NO: 676277 - RNA, 22 nt, Human
gagccuggagcuggaacgaagc

SEQ ID NO: 676278 - RNA, 22 nt, Human
aaagagcuuuagaaaucucaga

SEQ ID NO: 676279 - RNA, 22 nt, Human
ggugugggggcagcucugauau

SEQ ID NO: 676280 - RNA, 20 nt, Human
acgugugugugcacgcgcgc

SEQ ID NO: 676281 - RNA, 22 nt, Human
aucuggagagaucuucacaaaa

SEQ ID NO: 676282 - RNA, 22 nt, Human
gaugggcguggcgcguuuggug

SEQ ID NO: 676283 - RNA, 20 nt, Human
ugcugcugugagcgucccug

SEQ ID NO: 676284 - RNA, 22 nt, Human
aauggagacccuaaggaagagg

SEQ ID NO: 676285 - RNA, 22 nt, Human
gcugggcaacggaagagagaaa

SEQ ID NO: 676286 - RNA, 22 nt, Human
gagcauggaucaugugcugggu

SEQ ID NO: 676287 - RNA, 22 nt, Human
augaauaaaacauuuuaaucag

SEQ ID NO: 676288 - RNA, 22 nt, Human
ugcuucugaguugcaggacuug

SEQ ID NO: 676289 - RNA, 21 nt, Human
ugccaggccugagcugggguc

SEQ ID NO: 676290 - RNA, 22 nt, Human
uaaguucaaugaacucaguucu

SEQ ID NO: 676291 - RNA, 22 nt, Human
ccagaagaccccguccaccucc

SEQ ID NO: 676292 - RNA, 22 nt, Human
auguagcaugaggcacugugcc

SEQ ID NO: 676293 - RNA, 22 nt, Human
aaaugugucaguuucauucucu

SEQ ID NO: 676294 - RNA, 22 nt, Human
cagaaagugauuugcuauucca

SEQ ID NO: 676295 - RNA, 18 nt, Human
ucccugggauauaauuac

SEQ ID NO: 676296 - RNA, 22 nt, Human
ucacauuuuaucugagauugac

SEQ ID NO: 676297 - RNA, 22 nt, Human
gcagccucaaacuccccagcuc

SEQ ID NO: 676298 - RNA, 22 nt, Human
ucaauucauagaguugacacag

SEQ ID NO: 676299 - RNA, 22 nt, Human
ccacugcccccugaagaccagg

SEQ ID NO: 676300 - RNA, 22 nt, Human
ugcccugccaagaccaaguggu

SEQ ID NO: 676301 - RNA, 19 nt, Human
acagcagguguggggauaa

SEQ ID NO: 676302 - RNA, 22 nt, Human
aagccaguuagcacaucauugc

SEQ ID NO: 676303 - RNA, 22 nt, Human
ugugcagagaagccacuggggg

SEQ ID NO: 676304 - RNA, 22 nt, Human
uaguauuuuagaaaaccaugaa

SEQ ID NO: 676305 - RNA, 22 nt, Human
uagcuuuaggcacguuugaauu

SEQ ID NO: 676306 - RNA, 22 nt, Human
gucuuuuugucuggcagagguc

SEQ ID NO: 676307 - RNA, 22 nt, Human
aaaaguauccacagcucaggag

SEQ ID NO: 676308 - RNA, 22 nt, Human
aguauaauuuacauuugguauu

SEQ ID NO: 676309 - RNA, 22 nt, Human
cuauggcucaauucuagugguu

SEQ ID NO: 676310 - RNA, 22 nt, Human
ccagaggagcauggccuugaga

SEQ ID NO: 676311 - RNA, 22 nt, Human
aacaauguccugugagaugaua

SEQ ID NO: 676312 - RNA, 22 nt, Human
acccuugguuuugcagagcugu

SEQ ID NO: 676313 - RNA, 22 nt, Human
ccaggugugccagcagggacug

SEQ ID NO: 676314 - RNA, 20 nt, Human
ucaggugacacacguggcac

SEQ ID NO: 676315 - RNA, 22 nt, Human
ucuguucuuguccccacuucag

SEQ ID NO: 676316 - RNA, 22 nt, Human
auccucaguguuucugacaucu

SEQ ID NO: 676317 - RNA, 22 nt, Human
uccuggauucugcccugaaggc

SEQ ID NO: 676318 - RNA, 22 nt, Human
uagagguguugacgccaaggua

SEQ ID NO: 676319 - RNA, 22 nt, Human
cucaguuuugcuagcuggaguu

SEQ ID NO: 676320 - RNA, 22 nt, Human
auaagguuaggauuauaguguu

SEQ ID NO: 676321 - RNA, 22 nt, Human
guugaguguugugcaugcacca

SEQ ID NO: 676322 - RNA, 22 nt, Human
ugaguguauaucaggagagagc

SEQ ID NO: 676323 - RNA, 23 nt, Human
uagaaucuguauuucugcaguuc

SEQ ID NO: 676324 - RNA, 22 nt, Human
cagaacuuggcaaagccgacug

SEQ ID NO: 676325 - RNA, 22 nt, Human
uuuucaguuacuguuuauguga

SEQ ID NO: 676326 - RNA, 22 nt, Human
gaggcagcggcucacagagaaa

SEQ ID NO: 676327 - RNA, 22 nt, Human
aacagcauauuucauauauuga

SEQ ID NO: 676328 - RNA, 22 nt, Human
ucugcuguugagcacaagugaa

SEQ ID NO: 676329 - RNA, 22 nt, Human
cugugucuaaucuuauacauca

SEQ ID NO: 676330 - RNA, 22 nt, Human
cugucugucccgucaccgcccc

SEQ ID NO: 676331 - RNA, 22 nt, Human
ccuggcugugcauugccggccc

SEQ ID NO: 676332 - RNA, 22 nt, Human
gaggcccagcauucagggcagg

SEQ ID NO: 676333 - RNA, 22 nt, Human
acagcccagaaagccuaagggg

SEQ ID NO: 676334 - RNA, 22 nt, Human
cauucauuuacuuucaacagcu

SEQ ID NO: 676335 - RNA, 19 nt, Human
cagagagaccaaggcgcca

SEQ ID NO: 676336 - RNA, 22 nt, Human
uuuaauauccaguggauacaaa

SEQ ID NO: 676337 - RNA, 22 nt, Human
ggucuggcaggugaggacucag

SEQ ID NO: 676338 - RNA, 22 nt, Human
aauuccauaucugugauuauua

SEQ ID NO: 676339 - RNA, 22 nt, Human
cuucuggcaaaacaggcagaaa

SEQ ID NO: 676340 - RNA, 22 nt, Human
uugaagacacagacauauagag

SEQ ID NO: 676341 - RNA, 22 nt, Human
uuccagccacuuuauacugcua

SEQ ID NO: 676342 - RNA, 23 nt, Human
aggugcagcccuggaccugcccc

SEQ ID NO: 676343 - RNA, 22 nt, Human
acaugucuuguggcuuugaucu

SEQ ID NO: 676344 - RNA, 22 nt, Human
gugcccuggcucacagugucuc

SEQ ID NO: 676345 - RNA, 19 nt, Human
agguggucuaggcuggaga

SEQ ID NO: 676346 - RNA, 22 nt, Human
guuucuaugguuuauauuacug

SEQ ID NO: 676347 - RNA, 16 nt, Human
uagggcugggaaggag

SEQ ID NO: 676348 - RNA, 22 nt, Human
guucuucaguucaggcuguuca

SEQ ID NO: 676349 - RNA, 22 nt, Human
uuacaaacaacagacauuuauu

SEQ ID NO: 676350 - RNA, 22 nt, Human
gccuucagcggccgcucgcugc

SEQ ID NO: 676351 - RNA, 19 nt, Human
cuggggcuuugguacugcc

SEQ ID NO: 676352 - RNA, 19 nt, Human
agucucacccaagcagucu

SEQ ID NO: 676353 - RNA, 22 nt, Human
uacauugauggaguaccuagcu

SEQ ID NO: 676354 - RNA, 18 nt, Human
uggggucucucagguaag

SEQ ID NO: 676355 - RNA, 23 nt, Human
acaccugugcuguagucacuaca

SEQ ID NO: 676356 - RNA, 22 nt, Human
cagcucuucagugccugagaua

SEQ ID NO: 676357 - RNA, 22 nt, Human
aacuccaugguucucagauucu

SEQ ID NO: 676358 - RNA, 22 nt, Human
ccacagggcacaagggagguug

SEQ ID NO: 676359 - RNA, 23 nt, Human
aaauuauugcucuucaauugccu

SEQ ID NO: 676360 - RNA, 22 nt, Human
agggucagagaucggccaugug

SEQ ID NO: 676361 - RNA, 22 nt, Human
uuuaauauuucuuuccugaagc

SEQ ID NO: 676362 - RNA, 22 nt, Human
agaaagaggaugcagaucucau

SEQ ID NO: 676363 - RNA, 22 nt, Human
cuggcacauagucagcacucaa

SEQ ID NO: 676364 - RNA, 22 nt, Human
uagcugucagcaaucaaguggu

SEQ ID NO: 676365 - RNA, 22 nt, Human
ggccaggagauggacaccacau

SEQ ID NO: 676366 - RNA, 22 nt, Human
uuucacagcugauaccucuucc

SEQ ID NO: 676367 - RNA, 18 nt, Human
ucugccugcagggcaucu

SEQ ID NO: 676368 - RNA, 22 nt, Human
gucugccugucuggaugacaga

SEQ ID NO: 676369 - RNA, 22 nt, Human
aagugagugguaaggagcaugg

SEQ ID NO: 676370 - RNA, 22 nt, Human
uuaggaaguguguccagaagcg

SEQ ID NO: 676371 - RNA, 22 nt, Human
ugccaggcauauggccucuuug

SEQ ID NO: 676372 - RNA, 22 nt, Human
ucacaugcuacugagccagacc

SEQ ID NO: 676373 - RNA, 22 nt, Human
caggagaagguuuggagugcag

SEQ ID NO: 676374 - RNA, 22 nt, Human
auuuucagcccccacucguggc

SEQ ID NO: 676375 - RNA, 22 nt, Human
cagugguuccuguucuucuggg

SEQ ID NO: 676376 - RNA, 22 nt, Human
gaaagcaauuuguguaaucugu

SEQ ID NO: 676377 - RNA, 21 nt, Human
agaugcugugcuccaggagca

SEQ ID NO: 676378 - RNA, 22 nt, Human
gggcugggauugcuugcuguga

SEQ ID NO: 676379 - RNA, 22 nt, Human
uugagggucuggaucugcugcu

SEQ ID NO: 676380 - RNA, 22 nt, Human
cugcagagcaaguaacauccuc

SEQ ID NO: 676381 - RNA, 22 nt, Human
ucugcagaagaauuaaggacag

SEQ ID NO: 676382 - RNA, 22 nt, Human
gccuggcugcuagccagaggca

SEQ ID NO: 676383 - RNA, 22 nt, Human
uuaacacagggggagacaaagu

SEQ ID NO: 676384 - RNA, 22 nt, Human
auugcugguagucagugucccu

SEQ ID NO: 676385 - RNA, 22 nt, Human
uuacagaaggaacacuacucag

SEQ ID NO: 676386 - RNA, 22 nt, Human
uugacaggauauaaagacauaa

SEQ ID NO: 676387 - RNA, 22 nt, Human
aaacaaugaaauauuuuuaugg

SEQ ID NO: 676388 - RNA, 22 nt, Human
uggcagcauuaauuauucaggu

SEQ ID NO: 676389 - RNA, 22 nt, Human
uuuccucuucgauuaaguuugg

SEQ ID NO: 676390 - RNA, 22 nt, Human
aggccaggccuuucuccauucc

SEQ ID NO: 676391 - RNA, 22 nt, Human
ggcugccuugacccuggcuccg

SEQ ID NO: 676392 - RNA, 22 nt, Human
caggugaccuuuguccuaaguu

SEQ ID NO: 676393 - RNA, 22 nt, Human
uacaucauaauaauacuuagaa

SEQ ID NO: 676394 - RNA, 22 nt, Human
agaguucugaaauuaucuuuac

SEQ ID NO: 676395 - RNA, 22 nt, Human
gagcuggaggcagugcugaggu

SEQ ID NO: 676396 - RNA, 22 nt, Human
cucagagaagauggaugaggua

SEQ ID NO: 676397 - RNA, 22 nt, Human
uucagauaaacuacaaauaauu

SEQ ID NO: 676398 - RNA, 22 nt, Human
cauguguggagggcaugcaugg

SEQ ID NO: 676399 - RNA, 22 nt, Human
gcaauaaaauguaaugauuggg

SEQ ID NO: 676400 - RNA, 22 nt, Human
uccuugaagcaacgugcagaca

SEQ ID NO: 676401 - RNA, 16 nt, Human
aagccaguucagcauu

SEQ ID NO: 676402 - RNA, 22 nt, Human
uacaagugugcaccaccauguc

SEQ ID NO: 676403 - RNA, 22 nt, Human
cacagacagugucccuuuguug

SEQ ID NO: 676404 - RNA, 22 nt, Human
acacauuuacauguuuacguau

SEQ ID NO: 676405 - RNA, 22 nt, Human
ugcuugauggcucuucuuucua

SEQ ID NO: 676406 - RNA, 22 nt, Human
ggguggguggcagcaccgaggc

SEQ ID NO: 676407 - RNA, 22 nt, Human
gcuccaggaagggaaaucucca

SEQ ID NO: 676408 - RNA, 22 nt, Human
agagcuggagaugcagguuucg

SEQ ID NO: 676409 - RNA, 22 nt, Human
uuacagaucaucaagguauaau

SEQ ID NO: 676410 - RNA, 22 nt, Human
uucagcauagcagcuucaggac

SEQ ID NO: 676411 - RNA, 22 nt, Human
cauuccagaugaggccaggccc

SEQ ID NO: 676412 - RNA, 22 nt, Human
uucucuguaguugccuggugga

SEQ ID NO: 676413 - RNA, 22 nt, Human
guucacagucuacauaguaaag

SEQ ID NO: 676414 - RNA, 22 nt, Human
cccaggcucuuaugugacuugc

SEQ ID NO: 676415 - RNA, 22 nt, Human
ggagccuggccuggcucugugu

SEQ ID NO: 676416 - RNA, 22 nt, Human
cagucacacaaguggacuuggg

SEQ ID NO: 676417 - RNA, 22 nt, Human
uggugggagugagggcaugcca

SEQ ID NO: 676418 - RNA, 22 nt, Human
ucuggcucaggucagacaggga

SEQ ID NO: 676419 - RNA, 22 nt, Human
aggaagcuggugugaggaugaa

SEQ ID NO: 676420 - RNA, 23 nt, Human
ucucucuuagcuaugcuuauggc

SEQ ID NO: 676421 - RNA, 22 nt, Human
gaauguuuuuauaaguguuaca

SEQ ID NO: 676422 - RNA, 22 nt, Human
ccagucaaaaggaagucaaugu

SEQ ID NO: 676423 - RNA, 22 nt, Human
gcaggggcuaaggacacagaga

SEQ ID NO: 676424 - RNA, 22 nt, Human
gucauauuauaaauguucuguu

SEQ ID NO: 676425 - RNA, 22 nt, Human
uguagaaacuacacaugcaaca

SEQ ID NO: 676426 - RNA, 22 nt, Human
ggggucugcugcggagcagaga

SEQ ID NO: 676427 - RNA, 22 nt, Human
augcauaugcauggacacucag

SEQ ID NO: 676428 - RNA, 22 nt, Human
ucacauuuucauauucucugag

SEQ ID NO: 676429 - RNA, 22 nt, Human
augcuuuaaaacguauguguaa

SEQ ID NO: 676430 - RNA, 22 nt, Human
uuccuaacaagggguauucauc

SEQ ID NO: 676431 - RNA, 20 nt, Human
auguucuucauuuaauguuc

SEQ ID NO: 676432 - RNA, 22 nt, Human
uuuagcauuaagcuuuucaaau

SEQ ID NO: 676433 - RNA, 22 nt, Human
uucacauuucauaccacagcuu

SEQ ID NO: 676434 - RNA, 22 nt, Human
uggaaagcaguucuuagaaucg

SEQ ID NO: 676435 - RNA, 22 nt, Human
aacauuaauuacagucaaacau

SEQ ID NO: 676436 - RNA, 22 nt, Human
gccugcaguucugugcuaggca

SEQ ID NO: 676437 - RNA, 22 nt, Human
acaguguggaaagucaacuuga

SEQ ID NO: 676438 - RNA, 22 nt, Human
ccuucagcguccccuuuacccg

SEQ ID NO: 676439 - RNA, 22 nt, Human
uugcauugauguuccuucuugc

SEQ ID NO: 676440 - RNA, 22 nt, Human
aaagugcagaacuguucucacu

SEQ ID NO: 676441 - RNA, 22 nt, Human
gcuuuacacagcugguucuugu

SEQ ID NO: 676442 - RNA, 22 nt, Human
cugugauguuagcucuguguua

SEQ ID NO: 676443 - RNA, 22 nt, Human
uucacaagucauuagcugcaua

SEQ ID NO: 676444 - RNA, 22 nt, Human
cagaauguuaccaguuagucug

SEQ ID NO: 676445 - RNA, 22 nt, Human
ggggccccucggacacgugcgg

SEQ ID NO: 676446 - RNA, 22 nt, Human
aggcugccgcagccaaugguug

SEQ ID NO: 676447 - RNA, 20 nt, Human
ucauauugauguagagcagc

SEQ ID NO: 676448 - RNA, 22 nt, Human
caugggcaguuggcagggcuca

SEQ ID NO: 676449 - RNA, 22 nt, Human
aggcuccaccccgccagaccuu

SEQ ID NO: 676450 - RNA, 22 nt, Human
cccuggaggagcuuagagcuug

SEQ ID NO: 676451 - RNA, 22 nt, Human
ucaggggacagccagcuggagg

SEQ ID NO: 676452 - RNA, 22 nt, Human
ggcuggacauagacauagccau

SEQ ID NO: 676453 - RNA, 22 nt, Human
acugggacuguaugugcuggac

SEQ ID NO: 676454 - RNA, 22 nt, Human
uggaccugggguggccuccucu

SEQ ID NO: 676455 - RNA, 22 nt, Human
auacuugagguuguauaaauau

SEQ ID NO: 676456 - RNA, 17 nt, Human
gugagggcagaggaugg

SEQ ID NO: 676457 - RNA, 22 nt, Human
ucagagucucccccaguuuggg

SEQ ID NO: 676458 - RNA, 22 nt, Human
cgcugggcauggugccuuauuu

SEQ ID NO: 676459 - RNA, 22 nt, Human
uaggaacauaugcagugcuuuu

SEQ ID NO: 676460 - RNA, 22 nt, Human
gccuucucugugagcuccuagg

SEQ ID NO: 676461 - RNA, 22 nt, Human
uucccaggcugugcuaccagag

SEQ ID NO: 676462 - RNA, 22 nt, Human
cuucuggauuuauucauuccuu

SEQ ID NO: 676463 - RNA, 22 nt, Human
ugaaccacaugcaaagugaaua

SEQ ID NO: 676464 - RNA, 22 nt, Human
uuccagcuuagagcaucauguu

SEQ ID NO: 676465 - RNA, 22 nt, Human
agcagggccaacaguaaacacc

SEQ ID NO: 676466 - RNA, 22 nt, Human
ugccucugcugcuguggcauca

SEQ ID NO: 676467 - RNA, 22 nt, Human
aguuuuauugucccagagguga

SEQ ID NO: 676468 - RNA, 20 nt, Human
aaaaugaugggcagggcagg

SEQ ID NO: 676469 - RNA, 22 nt, Human
uaaacagagaagacuuugagca

SEQ ID NO: 676470 - RNA, 22 nt, Human
cccacaggcaggugcaugggcu

SEQ ID NO: 676471 - RNA, 22 nt, Human
ucccagggacccagccugauac

SEQ ID NO: 676472 - RNA, 22 nt, Human
uuccuugaccacugcauaauga

SEQ ID NO: 676473 - RNA, 22 nt, Human
agggcagccugagugcuggccc

SEQ ID NO: 676474 - RNA, 22 nt, Human
aaggguugcaaggucagaggaa

SEQ ID NO: 676475 - RNA, 22 nt, Human
gccuaggaguacagaaugguuu

SEQ ID NO: 676476 - RNA, 22 nt, Human
gcuguccugggaacaggcacua

SEQ ID NO: 676477 - RNA, 19 nt, Human
cuggaaggagggacuguuc

SEQ ID NO: 676478 - RNA, 22 nt, Human
gagagaggccuccauguacuga

SEQ ID NO: 676479 - RNA, 22 nt, Human
aggcagcugaccacaguaugau

SEQ ID NO: 676480 - RNA, 20 nt, Human
ugcuuugauggaaauacagc

SEQ ID NO: 676481 - RNA, 22 nt, Human
augagguaucucauuuccugaa

SEQ ID NO: 676482 - RNA, 22 nt, Human
accaggcuccccuuggauccug

SEQ ID NO: 676483 - RNA, 22 nt, Human
agcugggccugauuugcagggg

SEQ ID NO: 676484 - RNA, 22 nt, Human
uccaggcuucacgucugcccuc

SEQ ID NO: 676485 - RNA, 22 nt, Human
ggcccagaagccagaagccucc

SEQ ID NO: 676486 - RNA, 22 nt, Human
aguucugcugcugccuagggug

SEQ ID NO: 676487 - RNA, 21 nt, Human
cuguuuauuucaccugggugc

SEQ ID NO: 676488 - RNA, 20 nt, Human
cugcuccacccggcucucag

SEQ ID NO: 676489 - RNA, 22 nt, Human
ucagcaggcacggacaggcugc

SEQ ID NO: 676490 - RNA, 22 nt, Human
ugagagagggaugcacccuccu

SEQ ID NO: 676491 - RNA, 22 nt, Human
uugcauugaucccagcuugggc

SEQ ID NO: 676492 - RNA, 22 nt, Human
gagcaaagcuuuuagggccuuu

SEQ ID NO: 676493 - RNA, 22 nt, Human
uuugaaaagaaccaucgccuua

SEQ ID NO: 676494 - RNA, 22 nt, Human
augaccaagaguccaggucaag

SEQ ID NO: 676495 - RNA, 22 nt, Human
ucacagacucuugauugucuaa
